United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 83

SEQ ID NO: 3506825 - DNA, 17 bp, Homo sapiens
gctgtcaccaaggaaac

SEQ ID NO: 3506826 - DNA, 22 bp, Homo sapiens
gctgtcacctctcccacgggac

SEQ ID NO: 3506827 - DNA, 15 bp, Homo sapiens
gctgtcacttcttca

SEQ ID NO: 3506828 - DNA, 15 bp, Homo sapiens
gctgtcatctgtgca

SEQ ID NO: 3506829 - DNA, 16 bp, Homo sapiens
gctgtcatctgtgcac

SEQ ID NO: 3506830 - DNA, 22 bp, Homo sapiens
gctgtcatctgtgcactgccca

SEQ ID NO: 3506831 - DNA, 17 bp, Homo sapiens
gctgtccagtgcctaca

SEQ ID NO: 3506832 - DNA, 18 bp, Homo sapiens
gctgtcccatagtccctg

SEQ ID NO: 3506833 - DNA, 18 bp, Homo sapiens
gctgtcctcaggtggcca

SEQ ID NO: 3506834 - DNA, 20 bp, Homo sapiens
gctgtcctcaggtggccatg

SEQ ID NO: 3506835 - DNA, 17 bp, Homo sapiens
gctgtccttacccatct

SEQ ID NO: 3506836 - DNA, 18 bp, Homo sapiens
gctgtcggcgctgcccca

SEQ ID NO: 3506837 - DNA, 12 bp, Homo sapiens
gctgtctgcagc

SEQ ID NO: 3506838 - DNA, 17 bp, Homo sapiens
gctgtctggccaggcct

SEQ ID NO: 3506839 - DNA, 13 bp, Homo sapiens
gctgtgctctgga

SEQ ID NO: 3506840 - DNA, 15 bp, Homo sapiens
gctgtgtctaaactg

SEQ ID NO: 3506841 - DNA, 16 bp, Homo sapiens
gctgtgtctaaactgc

SEQ ID NO: 3506842 - DNA, 21 bp, Homo sapiens
gctgttattatatttgacatg

SEQ ID NO: 3506843 - DNA, 13 bp, Homo sapiens
gctgttcagctgg

SEQ ID NO: 3506844 - DNA, 22 bp, Homo sapiens
gctgttcccatgtagccccctg

SEQ ID NO: 3506845 - DNA, 21 bp, Homo sapiens
gctgttcctgttcagtaataa

SEQ ID NO: 3506846 - DNA, 16 bp, Homo sapiens
gctgttctcattcctg

SEQ ID NO: 3506847 - DNA, 14 bp, Homo sapiens
gctgttgctgaata

SEQ ID NO: 3506848 - DNA, 19 bp, Homo sapiens
gctgttgctgaataggcga

SEQ ID NO: 3506849 - DNA, 15 bp, Homo sapiens
gctgttggctggggg

SEQ ID NO: 3506850 - DNA, 16 bp, Homo sapiens
gctgttttcctccctt

SEQ ID NO: 3506851 - DNA, 22 bp, Homo sapiens
gctgttttcctcccttctgcta

SEQ ID NO: 3506852 - DNA, 14 bp, Homo sapiens
gcttaaaaatgtag

SEQ ID NO: 3506853 - DNA, 15 bp, Homo sapiens
gcttaatcattttca

SEQ ID NO: 3506854 - DNA, 14 bp, Homo sapiens
gcttacatctggaa

SEQ ID NO: 3506855 - DNA, 18 bp, Homo sapiens
gcttacatctggaatctg

SEQ ID NO: 3506856 - DNA, 23 bp, Homo sapiens
gcttacatctggaatctgaggca

SEQ ID NO: 3506857 - DNA, 17 bp, Homo sapiens
gcttagctttgctctgc

SEQ ID NO: 3506858 - DNA, 14 bp, Homo sapiens
gcttagtttgtgtg

SEQ ID NO: 3506859 - DNA, 15 bp, Homo sapiens
gcttataggtggcct

SEQ ID NO: 3506860 - DNA, 16 bp, Homo sapiens
gcttatggtaccagat

SEQ ID NO: 3506861 - DNA, 23 bp, Homo sapiens
gcttatgtgtaggtgaacagtca

SEQ ID NO: 3506862 - DNA, 15 bp, Homo sapiens
gcttcacggaagagc

SEQ ID NO: 3506863 - DNA, 10 bp, Homo sapiens
gcttcagggc

SEQ ID NO: 3506864 - DNA, 15 bp, Homo sapiens
gcttcaggtccaggc

SEQ ID NO: 3506865 - DNA, 14 bp, Homo sapiens
gcttcagtggcagc

SEQ ID NO: 3506866 - DNA, 15 bp, Homo sapiens
gcttcagtggcagct

SEQ ID NO: 3506867 - DNA, 16 bp, Homo sapiens
gcttcagtggcagctg

SEQ ID NO: 3506868 - DNA, 12 bp, Homo sapiens
ggcactgcctga

SEQ ID NO: 3506869 - DNA, 17 bp, Homo sapiens
ggcactggaccccagca

SEQ ID NO: 3506870 - DNA, 17 bp, Homo sapiens
ggcagaaatacagtctt

SEQ ID NO: 3506871 - DNA, 19 bp, Homo sapiens
ggcagactctttatgcttg

SEQ ID NO: 3506872 - DNA, 22 bp, Homo sapiens
ggcagactctttatgcttgcaa

SEQ ID NO: 3506873 - DNA, 16 bp, Homo sapiens
ggcagagcccaaggga

SEQ ID NO: 3506874 - DNA, 13 bp, Homo sapiens
ggcagagggctgg

SEQ ID NO: 3506875 - DNA, 16 bp, Homo sapiens
ggcagagttgtaaata

SEQ ID NO: 3506876 - DNA, 16 bp, Homo sapiens
ggcagatccaggacta

SEQ ID NO: 3506877 - DNA, 16 bp, Homo sapiens
ggcagatgacaagatg

SEQ ID NO: 3506878 - DNA, 14 bp, Homo sapiens
ggcagatgcacatg

SEQ ID NO: 3506879 - DNA, 16 bp, Homo sapiens
ggcagatgtggggctg

SEQ ID NO: 3506880 - DNA, 15 bp, Homo sapiens
ggcagattcccactg

SEQ ID NO: 3506881 - DNA, 21 bp, Homo sapiens
ggcagcacctgtctcctttca

SEQ ID NO: 3506882 - DNA, 18 bp, Homo sapiens
ggcagcagaagggggtgg

SEQ ID NO: 3506883 - DNA, 22 bp, Homo sapiens
ggcagcagtgtgaggccagggc

SEQ ID NO: 3506884 - DNA, 17 bp, Homo sapiens
ggcagcatccccttgaa

SEQ ID NO: 3506885 - DNA, 15 bp, Homo sapiens
ggcagccccagcctg

SEQ ID NO: 3506886 - DNA, 16 bp, Homo sapiens
ggcagccccagcctgc

SEQ ID NO: 3506887 - DNA, 17 bp, Homo sapiens
ggcagccccagcctgct

SEQ ID NO: 3506888 - DNA, 13 bp, Homo sapiens
ggcagcgacccca

SEQ ID NO: 3506889 - DNA, 15 bp, Homo sapiens
ggcagcgaccccagg

SEQ ID NO: 3506890 - DNA, 19 bp, Homo sapiens
ggcagcgaccccaggacct

SEQ ID NO: 3506891 - DNA, 15 bp, Homo sapiens
ggcagctctggacag

SEQ ID NO: 3506892 - DNA, 20 bp, Homo sapiens
ggcagctctggacagcccca

SEQ ID NO: 3506893 - DNA, 12 bp, Homo sapiens
ggcagctgccac

SEQ ID NO: 3506894 - DNA, 19 bp, Homo sapiens
ggcagctgcggtccaccca

SEQ ID NO: 3506895 - DNA, 21 bp, Homo sapiens
ggcagctgcggtccacccagg

SEQ ID NO: 3506896 - DNA, 21 bp, Homo sapiens
ggcaggacaacgaggaagccc

SEQ ID NO: 3506897 - DNA, 23 bp, Homo sapiens
ggcaggacatgctgaagccaaag

SEQ ID NO: 3506898 - DNA, 21 bp, Homo sapiens
ggcaggaccttcgggctgtgc

SEQ ID NO: 3506899 - DNA, 23 bp, Homo sapiens
ggcaggactcagctccccagagt

SEQ ID NO: 3506900 - DNA, 21 bp, Homo sapiens
ggcaggctaaggcgtggagct

SEQ ID NO: 3506901 - DNA, 12 bp, Homo sapiens
ggcaggctggcc

SEQ ID NO: 3506902 - DNA, 13 bp, Homo sapiens
ggcaggctggcca

SEQ ID NO: 3506903 - DNA, 11 bp, Homo sapiens
ggcagggctgt

SEQ ID NO: 3506904 - DNA, 16 bp, Homo sapiens
ggcaggggcctggaga

SEQ ID NO: 3506905 - DNA, 13 bp, Homo sapiens
ggcaggtccaggg

SEQ ID NO: 3506906 - DNA, 18 bp, Homo sapiens
ggcaggtcctcccctctc

SEQ ID NO: 3506907 - DNA, 17 bp, Homo sapiens
ggcaggttggtgggggc

SEQ ID NO: 3506908 - DNA, 14 bp, Homo sapiens
ggcagtccagccag

SEQ ID NO: 3506909 - DNA, 17 bp, Homo sapiens
ggcagtccagccagctc

SEQ ID NO: 3506910 - DNA, 19 bp, Homo sapiens
ggcagtccagccagctcct

SEQ ID NO: 3506911 - DNA, 20 bp, Homo sapiens
ggcagtccagccagctcctg

SEQ ID NO: 3506912 - DNA, 11 bp, Homo sapiens
ggcagtccctt

SEQ ID NO: 3506913 - DNA, 16 bp, Homo sapiens
ggcagtttcagagatg

SEQ ID NO: 3506914 - DNA, 22 bp, Homo sapiens
ggcatacgagagcagaggtctc

SEQ ID NO: 3506915 - DNA, 18 bp, Homo sapiens
ggcatcaccttaggcagg

SEQ ID NO: 3506916 - DNA, 23 bp, Homo sapiens
ggcatcaccttaggcagggaagt

SEQ ID NO: 3506917 - DNA, 18 bp, Homo sapiens
ggcatccagcagtctctg

SEQ ID NO: 3506918 - DNA, 12 bp, Homo sapiens
ggcatcctctga

SEQ ID NO: 3506919 - DNA, 19 bp, Homo sapiens
ggcatcctctgactccact

SEQ ID NO: 3506920 - DNA, 17 bp, Homo sapiens
ggcatcctctttttcca

SEQ ID NO: 3506921 - DNA, 15 bp, Homo sapiens
ggcatcttgctggct

SEQ ID NO: 3506922 - DNA, 17 bp, Homo sapiens
ggcatgacacacctggg

SEQ ID NO: 3506923 - DNA, 15 bp, Homo sapiens
ggcatgatccaagca

SEQ ID NO: 3506924 - DNA, 18 bp, Homo sapiens
ggcatgatccaagcaaga

SEQ ID NO: 3506925 - DNA, 21 bp, Homo sapiens
ggcatgggtcgggagagggga

SEQ ID NO: 3506926 - DNA, 20 bp, Homo sapiens
ggcatgttctctgaggacac

SEQ ID NO: 3506927 - DNA, 16 bp, Homo sapiens
ggcatgtttccagcag

SEQ ID NO: 3506928 - DNA, 21 bp, Homo sapiens
ggcatttttaccatcactgag

SEQ ID NO: 3506929 - DNA, 16 bp, Homo sapiens
ggccaaacctctgttc

SEQ ID NO: 3506930 - DNA, 16 bp, Homo sapiens
ggccaaaggctggtgg

SEQ ID NO: 3506931 - DNA, 14 bp, Homo sapiens
ggccaacaaagaac

SEQ ID NO: 3506932 - DNA, 16 bp, Homo sapiens
ggccaacccttctcct

SEQ ID NO: 3506933 - DNA, 20 bp, Homo sapiens
ggccaacccttctcctcttg

SEQ ID NO: 3506934 - DNA, 13 bp, Homo sapiens
ggccaagccagct

SEQ ID NO: 3506935 - DNA, 14 bp, Homo sapiens
ggccaaggagctgc

SEQ ID NO: 3506936 - DNA, 18 bp, Homo sapiens
ggccaagggccagacaga

SEQ ID NO: 3506937 - DNA, 16 bp, Homo sapiens
ggccacatcaaagagg

SEQ ID NO: 3506938 - DNA, 19 bp, Homo sapiens
ggccacatcaaagaggctg

SEQ ID NO: 3506939 - DNA, 18 bp, Homo sapiens
ggccaccaggtgcctttc

SEQ ID NO: 3506940 - DNA, 14 bp, Homo sapiens
ggccacgctccagc

SEQ ID NO: 3506941 - DNA, 18 bp, Homo sapiens
ggccacgctccagctgcc

SEQ ID NO: 3506942 - DNA, 23 bp, Homo sapiens
ggccacgtgggcaaacaggcagt

SEQ ID NO: 3506943 - DNA, 20 bp, Homo sapiens
ggccactaagcagaggaggg

SEQ ID NO: 3506944 - DNA, 21 bp, Homo sapiens
ggccactaagcagaggagggg

SEQ ID NO: 3506945 - DNA, 20 bp, Homo sapiens
ggccactgtgaagagaacca

SEQ ID NO: 3506946 - DNA, 14 bp, Homo sapiens
ggccacttctgtcc

SEQ ID NO: 3506947 - DNA, 17 bp, Homo sapiens
ggccagacagaccttca

SEQ ID NO: 3506948 - DNA, 12 bp, Homo sapiens
ggccagagccga

SEQ ID NO: 3506949 - DNA, 19 bp, Homo sapiens
ggccagaggcccccagccc

SEQ ID NO: 3506950 - DNA, 21 bp, Homo sapiens
ggccagaggcccccagcccag

SEQ ID NO: 3506951 - DNA, 11 bp, Homo sapiens
ggccagaggct

SEQ ID NO: 3506952 - DNA, 17 bp, Homo sapiens
ggccagagggagtgaca

SEQ ID NO: 3506953 - DNA, 19 bp, Homo sapiens
ggccagagggagtgacaga

SEQ ID NO: 3506954 - DNA, 23 bp, Homo sapiens
ggccagagggagtgacagaggca

SEQ ID NO: 3506955 - DNA, 19 bp, Homo sapiens
ggccagagtattggtctcc

SEQ ID NO: 3506956 - DNA, 16 bp, Homo sapiens
ggccagatccagcctg

SEQ ID NO: 3506957 - DNA, 17 bp, Homo sapiens
ggccagatccagcctgg

SEQ ID NO: 3506958 - DNA, 16 bp, Homo sapiens
ggccagcacccaaagg

SEQ ID NO: 3506959 - DNA, 20 bp, Homo sapiens
ggccagcacccaaagggtta

SEQ ID NO: 3506960 - DNA, 15 bp, Homo sapiens
ggccagccatgtctg

SEQ ID NO: 3506961 - DNA, 18 bp, Homo sapiens
ggccagctatctgcctga

SEQ ID NO: 3506962 - DNA, 20 bp, Homo sapiens
ggccagctgccccagccaga

SEQ ID NO: 3506963 - DNA, 16 bp, Homo sapiens
ggccagctggcagcag

SEQ ID NO: 3506964 - DNA, 20 bp, Homo sapiens
ggccaggccactgggccctg

SEQ ID NO: 3506965 - DNA, 14 bp, Homo sapiens
ggccaggccagagg

SEQ ID NO: 3506966 - DNA, 11 bp, Homo sapiens
ggccaggctgg

SEQ ID NO: 3506967 - DNA, 12 bp, Homo sapiens
ggccaggctggt

SEQ ID NO: 3506968 - DNA, 18 bp, Homo sapiens
ggccaggctggtctcaaa

SEQ ID NO: 3506969 - DNA, 15 bp, Homo sapiens
ggccagggagaagct

SEQ ID NO: 3506970 - DNA, 16 bp, Homo sapiens
ggccagggagaagctc

SEQ ID NO: 3506971 - DNA, 13 bp, Homo sapiens
ggccagggcagag

SEQ ID NO: 3506972 - DNA, 20 bp, Homo sapiens
ggccagggccacgctccagc

SEQ ID NO: 3506973 - DNA, 11 bp, Homo sapiens
ggccagggctg

SEQ ID NO: 3506974 - DNA, 15 bp, Homo sapiens
ggccagtccaggctg

SEQ ID NO: 3506975 - DNA, 21 bp, Homo sapiens
ggccagtccaggctgccgtgg

SEQ ID NO: 3506976 - DNA, 13 bp, Homo sapiens
ggccagtctgtgg

SEQ ID NO: 3506977 - DNA, 16 bp, Homo sapiens
ggccagtgtgacaagg

SEQ ID NO: 3506978 - DNA, 20 bp, Homo sapiens
ggccatccttccctgtctgc

SEQ ID NO: 3506979 - DNA, 19 bp, Homo sapiens
ggccatctctggatgcctg

SEQ ID NO: 3506980 - DNA, 21 bp, Homo sapiens
ggccatctggttaggatggca

SEQ ID NO: 3506981 - DNA, 14 bp, Homo sapiens
ggccatgcctcagc

SEQ ID NO: 3506982 - DNA, 13 bp, Homo sapiens
ggccatgctgagg

SEQ ID NO: 3506983 - DNA, 21 bp, Homo sapiens
ggccatggagagctggagcct

SEQ ID NO: 3506984 - DNA, 22 bp, Homo sapiens
ggccatggagagctggagcctg

SEQ ID NO: 3506985 - DNA, 17 bp, Homo sapiens
ggcccacgtggttgggg

SEQ ID NO: 3506986 - DNA, 11 bp, Homo sapiens
ggcccagagag

SEQ ID NO: 3506987 - DNA, 12 bp, Homo sapiens
ggcccagagagg

SEQ ID NO: 3506988 - DNA, 12 bp, Homo sapiens
ggcccagagccc

SEQ ID NO: 3506989 - DNA, 16 bp, Homo sapiens
ggcccagagcccagct

SEQ ID NO: 3506990 - DNA, 17 bp, Homo sapiens
ggcccagagcccagctc

SEQ ID NO: 3506991 - DNA, 19 bp, Homo sapiens
ggcccagagcccagctcca

SEQ ID NO: 3506992 - DNA, 20 bp, Homo sapiens
ggcccagggcaagctccgca

SEQ ID NO: 3506993 - DNA, 24 bp, Homo sapiens
ggcccatatctgtgaaatgctggc

SEQ ID NO: 3506994 - DNA, 17 bp, Homo sapiens
ggccccaccctgggccc

SEQ ID NO: 3506995 - DNA, 21 bp, Homo sapiens
ggccccaccctgggccctggg

SEQ ID NO: 3506996 - DNA, 15 bp, Homo sapiens
ggccccagcacagct

SEQ ID NO: 3506997 - DNA, 21 bp, Homo sapiens
ggcccccacaggccccccgca

SEQ ID NO: 3506998 - DNA, 15 bp, Homo sapiens
ggcccccacttgcct

SEQ ID NO: 3506999 - DNA, 17 bp, Homo sapiens
ggcccccagcccagggc

SEQ ID NO: 3507000 - DNA, 20 bp, Homo sapiens
ggcccccagcccagggctcc

SEQ ID NO: 3507001 - DNA, 17 bp, Homo sapiens
ggtcctacccatccccg

SEQ ID NO: 3507002 - DNA, 22 bp, Homo sapiens
ggtcctagaggccctttgctgt

SEQ ID NO: 3507003 - DNA, 12 bp, Homo sapiens
ggtcctctctct

SEQ ID NO: 3507004 - DNA, 22 bp, Homo sapiens
ggtcctctctctgtggggctga

SEQ ID NO: 3507005 - DNA, 21 bp, Homo sapiens
ggtcctctgtcagtcacagcc

SEQ ID NO: 3507006 - DNA, 22 bp, Homo sapiens
ggtcctcttctgggcctgacca

SEQ ID NO: 3507007 - DNA, 14 bp, Homo sapiens
ggtcctggccatcc

SEQ ID NO: 3507008 - DNA, 16 bp, Homo sapiens
ggtcctggccatccca

SEQ ID NO: 3507009 - DNA, 13 bp, Homo sapiens
ggtcctggcctcc

SEQ ID NO: 3507010 - DNA, 22 bp, Homo sapiens
ggtcctgttaacgtcatctcag

SEQ ID NO: 3507011 - DNA, 11 bp, Homo sapiens
ggtccttcctg

SEQ ID NO: 3507012 - DNA, 14 bp, Homo sapiens
ggtcgctcctgccc

SEQ ID NO: 3507013 - DNA, 22 bp, Homo sapiens
ggtctatgtcgagagctggcca

SEQ ID NO: 3507014 - DNA, 21 bp, Homo sapiens
ggtctcaaactcctgggctca

SEQ ID NO: 3507015 - DNA, 18 bp, Homo sapiens
ggtctcacagtgttgccc

SEQ ID NO: 3507016 - DNA, 19 bp, Homo sapiens
ggtctcacagtgttgccca

SEQ ID NO: 3507017 - DNA, 23 bp, Homo sapiens
ggtctcactctgtcgcccagtct

SEQ ID NO: 3507018 - DNA, 16 bp, Homo sapiens
ggtctctaggctgggg

SEQ ID NO: 3507019 - DNA, 16 bp, Homo sapiens
ggtctctctccattta

SEQ ID NO: 3507020 - DNA, 20 bp, Homo sapiens
ggtctctgcatttttctgca

SEQ ID NO: 3507021 - DNA, 22 bp, Homo sapiens
ggtctctgcatttttctgcaga

SEQ ID NO: 3507022 - DNA, 19 bp, Homo sapiens
ggtctgaggaatccagacc

SEQ ID NO: 3507023 - DNA, 19 bp, Homo sapiens
ggtctgagtctatgttcaa

SEQ ID NO: 3507024 - DNA, 14 bp, Homo sapiens
ggtctgcaggcagg

SEQ ID NO: 3507025 - DNA, 11 bp, Homo sapiens
ggtctgcctcc

SEQ ID NO: 3507026 - DNA, 19 bp, Homo sapiens
ggtctgggagtcaggcccg

SEQ ID NO: 3507027 - DNA, 14 bp, Homo sapiens
ggtctgtaaaatct

SEQ ID NO: 3507028 - DNA, 20 bp, Homo sapiens
ggtctgttggcaggctggcc

SEQ ID NO: 3507029 - DNA, 21 bp, Homo sapiens
ggtcttgaactcctggactca

SEQ ID NO: 3507030 - DNA, 22 bp, Homo sapiens
ggtcttgaactcctggcctcaa

SEQ ID NO: 3507031 - DNA, 22 bp, Homo sapiens
ggtcttgaagtcctggcttcag

SEQ ID NO: 3507032 - DNA, 18 bp, Homo sapiens
ggtctttcctaaggctgc

SEQ ID NO: 3507033 - DNA, 14 bp, Homo sapiens
ggtctttgtaagaa

SEQ ID NO: 3507034 - DNA, 18 bp, Homo sapiens
ggtgaaaattagggttgg

SEQ ID NO: 3507035 - DNA, 21 bp, Homo sapiens
ggtgagaacctgggttgcaga

SEQ ID NO: 3507036 - DNA, 17 bp, Homo sapiens
ggtgagaggaagggtgg

SEQ ID NO: 3507037 - DNA, 18 bp, Homo sapiens
ggtgagcagacaggacag

SEQ ID NO: 3507038 - DNA, 19 bp, Homo sapiens
ggtgaggcctgtctgtgac

SEQ ID NO: 3507039 - DNA, 15 bp, Homo sapiens
ggtgagggccttctt

SEQ ID NO: 3507040 - DNA, 20 bp, Homo sapiens
ggtgatatccattctttctg

SEQ ID NO: 3507041 - DNA, 17 bp, Homo sapiens
ggtgcagccagaggcac

SEQ ID NO: 3507042 - DNA, 15 bp, Homo sapiens
ggtgccaactggtgt

SEQ ID NO: 3507043 - DNA, 17 bp, Homo sapiens
ggtgcccaagccagagg

SEQ ID NO: 3507044 - DNA, 18 bp, Homo sapiens
ggtgcccaagccagaggc

SEQ ID NO: 3507045 - DNA, 14 bp, Homo sapiens
ggtgccccaggacc

SEQ ID NO: 3507046 - DNA, 22 bp, Homo sapiens
ggtgccccaggaccagctcagg

SEQ ID NO: 3507047 - DNA, 16 bp, Homo sapiens
ggtgcctgccatagcc

SEQ ID NO: 3507048 - DNA, 18 bp, Homo sapiens
ggtgcctttcaaatttag

SEQ ID NO: 3507049 - DNA, 19 bp, Homo sapiens
ggtgcgtctgggaggttgg

SEQ ID NO: 3507050 - DNA, 22 bp, Homo sapiens
ggtgctacacccttttccagct

SEQ ID NO: 3507051 - DNA, 12 bp, Homo sapiens
ggtgctctgtct

SEQ ID NO: 3507052 - DNA, 15 bp, Homo sapiens
ggtgctgacggccag

SEQ ID NO: 3507053 - DNA, 21 bp, Homo sapiens
ggtgctgacttcatctcccac

SEQ ID NO: 3507054 - DNA, 22 bp, Homo sapiens
ggtgctgagtagatgcgcagcc

SEQ ID NO: 3507055 - DNA, 15 bp, Homo sapiens
ggtgctgccatccag

SEQ ID NO: 3507056 - DNA, 22 bp, Homo sapiens
ggtgctggagcactgggctccc

SEQ ID NO: 3507057 - DNA, 11 bp, Homo sapiens
ggtgctgtcca

SEQ ID NO: 3507058 - DNA, 20 bp, Homo sapiens
ggtgctgtcctcaggtggcc

SEQ ID NO: 3507059 - DNA, 17 bp, Homo sapiens
ggtggaaggaccctgtg

SEQ ID NO: 3507060 - DNA, 18 bp, Homo sapiens
ggtggaggattgctgcca

SEQ ID NO: 3507061 - DNA, 21 bp, Homo sapiens
ggtggaggattgctgccagag

SEQ ID NO: 3507062 - DNA, 23 bp, Homo sapiens
ggtggagggccacatgggaggct

SEQ ID NO: 3507063 - DNA, 19 bp, Homo sapiens
ggtggagtgcagtggtgcg

SEQ ID NO: 3507064 - DNA, 23 bp, Homo sapiens
ggtggattctccctgggcctcag

SEQ ID NO: 3507065 - DNA, 20 bp, Homo sapiens
ggtggcaaggctgtgctccc

SEQ ID NO: 3507066 - DNA, 12 bp, Homo sapiens
ggtggcaagtgc

SEQ ID NO: 3507067 - DNA, 11 bp, Homo sapiens
ggtggcagctg

SEQ ID NO: 3507068 - DNA, 15 bp, Homo sapiens
ggtggcagctgcggt

SEQ ID NO: 3507069 - DNA, 23 bp, Homo sapiens
ggtggcagctgcggtccacccag

SEQ ID NO: 3507070 - DNA, 17 bp, Homo sapiens
ggtggccatgcctcagc

SEQ ID NO: 3507071 - DNA, 21 bp, Homo sapiens
ggtggccgctgagtggcaggg

SEQ ID NO: 3507072 - DNA, 21 bp, Homo sapiens
ggtggcgactctatagactct

SEQ ID NO: 3507073 - DNA, 12 bp, Homo sapiens
ggtggctgggca

SEQ ID NO: 3507074 - DNA, 12 bp, Homo sapiens
ggtggctgggtt

SEQ ID NO: 3507075 - DNA, 14 bp, Homo sapiens
ggtgggcaggaaaa

SEQ ID NO: 3507076 - DNA, 22 bp, Homo sapiens
ggtgggcccggcccgcgccaca

SEQ ID NO: 3507077 - DNA, 17 bp, Homo sapiens
ggtgggcttcagggcag

SEQ ID NO: 3507078 - DNA, 13 bp, Homo sapiens
ggtggggcagctt

SEQ ID NO: 3507079 - DNA, 17 bp, Homo sapiens
ggtgggggtgggtcaga

SEQ ID NO: 3507080 - DNA, 19 bp, Homo sapiens
ggtggggtcatgccctcct

SEQ ID NO: 3507081 - DNA, 10 bp, Homo sapiens
ggtgggtcca

SEQ ID NO: 3507082 - DNA, 20 bp, Homo sapiens
ggtgggtccatgggcagagc

SEQ ID NO: 3507083 - DNA, 17 bp, Homo sapiens
ggtggtctgcaggcagg

SEQ ID NO: 3507084 - DNA, 16 bp, Homo sapiens
ggtggtctgttggcag

SEQ ID NO: 3507085 - DNA, 14 bp, Homo sapiens
ggtggtgacctctg

SEQ ID NO: 3507086 - DNA, 15 bp, Homo sapiens
ggtggtgacctctgc

SEQ ID NO: 3507087 - DNA, 13 bp, Homo sapiens
ggtggtggagcca

SEQ ID NO: 3507088 - DNA, 21 bp, Homo sapiens
ggtggttgctgttttcctccc

SEQ ID NO: 3507089 - DNA, 23 bp, Homo sapiens
ggtggttgctgttttcctccctt

SEQ ID NO: 3507090 - DNA, 14 bp, Homo sapiens
ggtgtaatggagca

SEQ ID NO: 3507091 - DNA, 19 bp, Homo sapiens
ggtgtcaagagggtctgag

SEQ ID NO: 3507092 - DNA, 19 bp, Homo sapiens
ggtgtcacctgaagactca

SEQ ID NO: 3507093 - DNA, 21 bp, Homo sapiens
ggtgtccagcattgctggact

SEQ ID NO: 3507094 - DNA, 15 bp, Homo sapiens
ggtgtcctgcctgtc

SEQ ID NO: 3507095 - DNA, 18 bp, Homo sapiens
ggtgtcctgcctgtctgc

SEQ ID NO: 3507096 - DNA, 19 bp, Homo sapiens
ggtgtcctgcctgtctgcc

SEQ ID NO: 3507097 - DNA, 19 bp, Homo sapiens
ggtgtctccaaccccccag

SEQ ID NO: 3507098 - DNA, 20 bp, Homo sapiens
ggtgtcttgggcagagctgg

SEQ ID NO: 3507099 - DNA, 20 bp, Homo sapiens
ggtgtgcaatgtctgagtga

SEQ ID NO: 3507100 - DNA, 18 bp, Homo sapiens
ggtgtgcacatctctgct

SEQ ID NO: 3507101 - DNA, 17 bp, Homo sapiens
ggtgtgccttccagatc

SEQ ID NO: 3507102 - DNA, 22 bp, Homo sapiens
ggtgtgctgggagctccactct

SEQ ID NO: 3507103 - DNA, 11 bp, Homo sapiens
ggtgtggggga

SEQ ID NO: 3507104 - DNA, 17 bp, Homo sapiens
ggtgttttatttcctat

SEQ ID NO: 3507105 - DNA, 15 bp, Homo sapiens
ggttaaggctgagga

SEQ ID NO: 3507106 - DNA, 15 bp, Homo sapiens
ggttaataccagctt

SEQ ID NO: 3507107 - DNA, 16 bp, Homo sapiens
ggttacagagacctat

SEQ ID NO: 3507108 - DNA, 22 bp, Homo sapiens
ggttacagtatgcttgctctaa

SEQ ID NO: 3507109 - DNA, 22 bp, Homo sapiens
ggttagacagccaaaggctggc

SEQ ID NO: 3507110 - DNA, 19 bp, Homo sapiens
ggttcaagccttccaggga

SEQ ID NO: 3507111 - DNA, 21 bp, Homo sapiens
ggttcaagcgattcttctgct

SEQ ID NO: 3507112 - DNA, 22 bp, Homo sapiens
ggttcaagcgattcttctgctt

SEQ ID NO: 3507113 - DNA, 13 bp, Homo sapiens
ggttcaggcccgg

SEQ ID NO: 3507114 - DNA, 13 bp, Homo sapiens
ggttcccaagctc

SEQ ID NO: 3507115 - DNA, 16 bp, Homo sapiens
ggttcccaagctcaga

SEQ ID NO: 3507116 - DNA, 12 bp, Homo sapiens
ggttcccttcct

SEQ ID NO: 3507117 - DNA, 20 bp, Homo sapiens
ggttctccgttagctcctgt

SEQ ID NO: 3507118 - DNA, 21 bp, Homo sapiens
ggttctccgttagctcctgtg

SEQ ID NO: 3507119 - DNA, 21 bp, Homo sapiens
ggttctgatgatgtgcctggg

SEQ ID NO: 3507120 - DNA, 12 bp, Homo sapiens
ggttctgcctct

SEQ ID NO: 3507121 - DNA, 20 bp, Homo sapiens
ggttctgcctgccagctgca

SEQ ID NO: 3507122 - DNA, 13 bp, Homo sapiens
ggttctgcctgct

SEQ ID NO: 3507123 - DNA, 16 bp, Homo sapiens
ggttgactttcaggta

SEQ ID NO: 3507124 - DNA, 21 bp, Homo sapiens
ggttgctgttttcctcccttc

SEQ ID NO: 3507125 - DNA, 21 bp, Homo sapiens
ggttggcccctgcccggctgc

SEQ ID NO: 3507126 - DNA, 13 bp, Homo sapiens
ggttggctcccgc

SEQ ID NO: 3507127 - DNA, 15 bp, Homo sapiens
ggttgggatgggata

SEQ ID NO: 3507128 - DNA, 14 bp, Homo sapiens
ggttgggctggtgt

SEQ ID NO: 3507129 - DNA, 18 bp, Homo sapiens
ggttgtattagatgttct

SEQ ID NO: 3507130 - DNA, 19 bp, Homo sapiens
ggttgtattagatgttctc

SEQ ID NO: 3507131 - DNA, 13 bp, Homo sapiens
ggttgtcagctct

SEQ ID NO: 3507132 - DNA, 22 bp, Homo sapiens
ggtttaggctggtggcccagga

SEQ ID NO: 3507133 - DNA, 14 bp, Homo sapiens
gtgagctacaaatg

SEQ ID NO: 3507134 - DNA, 21 bp, Homo sapiens
gtgagctaggagaagggctga

SEQ ID NO: 3507135 - DNA, 23 bp, Homo sapiens
gtgaggcaatgggagctgaggcc

SEQ ID NO: 3507136 - DNA, 11 bp, Homo sapiens
gtgaggcctgt

SEQ ID NO: 3507137 - DNA, 15 bp, Homo sapiens
gtgaggcctgtctgt

SEQ ID NO: 3507138 - DNA, 17 bp, Homo sapiens
gtgagggagggctgtca

SEQ ID NO: 3507139 - DNA, 17 bp, Homo sapiens
gtgagggccttcttaag

SEQ ID NO: 3507140 - DNA, 19 bp, Homo sapiens
gtgagtcctagagctacag

SEQ ID NO: 3507141 - DNA, 13 bp, Homo sapiens
gtgagtgaaagtt

SEQ ID NO: 3507142 - DNA, 12 bp, Homo sapiens
gtgagtgccttt

SEQ ID NO: 3507143 - DNA, 17 bp, Homo sapiens
gtgagtgccttttgcag

SEQ ID NO: 3507144 - DNA, 21 bp, Homo sapiens
gtgatacagaactcttaaaaa

SEQ ID NO: 3507145 - DNA, 13 bp, Homo sapiens
gtgatagcacttt

SEQ ID NO: 3507146 - DNA, 13 bp, Homo sapiens
gtgatcaaagcca

SEQ ID NO: 3507147 - DNA, 15 bp, Homo sapiens
gtgatccacccacct

SEQ ID NO: 3507148 - DNA, 22 bp, Homo sapiens
gtgatccacccacctcagcctc

SEQ ID NO: 3507149 - DNA, 23 bp, Homo sapiens
gtgatccacccacctcagcctcc

SEQ ID NO: 3507150 - DNA, 23 bp, Homo sapiens
gtgatcctcccacctcagcctcc

SEQ ID NO: 3507151 - DNA, 15 bp, Homo sapiens
gtgatgtacacattt

SEQ ID NO: 3507152 - DNA, 19 bp, Homo sapiens
gtgatgtatattcctttga

SEQ ID NO: 3507153 - DNA, 17 bp, Homo sapiens
gtgattaccccgggaga

SEQ ID NO: 3507154 - DNA, 21 bp, Homo sapiens
gtgattgacagctttgctgct

SEQ ID NO: 3507155 - DNA, 22 bp, Homo sapiens
gtgattgacagctttgctgctg

SEQ ID NO: 3507156 - DNA, 14 bp, Homo sapiens
gtgattgtggaatg

SEQ ID NO: 3507157 - DNA, 18 bp, Homo sapiens
gtgattttaactctgtct

SEQ ID NO: 3507158 - DNA, 21 bp, Homo sapiens
gtgattttatgatcagtgttg

SEQ ID NO: 3507159 - DNA, 12 bp, Homo sapiens
gtgattttcatt

SEQ ID NO: 3507160 - DNA, 14 bp, Homo sapiens
gtgcacacaccaga

SEQ ID NO: 3507161 - DNA, 21 bp, Homo sapiens
gtgcacacaccagagcccacc

SEQ ID NO: 3507162 - DNA, 21 bp, Homo sapiens
gtgcacatgcacgtgtgtgca

SEQ ID NO: 3507163 - DNA, 16 bp, Homo sapiens
gtgcaccatccctttt

SEQ ID NO: 3507164 - DNA, 23 bp, Homo sapiens
gtgcaccatccctttttgaagtg

SEQ ID NO: 3507165 - DNA, 23 bp, Homo sapiens
gtgcacctagagcttttttataa

SEQ ID NO: 3507166 - DNA, 18 bp, Homo sapiens
gtgcacgcagtggccttc

SEQ ID NO: 3507167 - DNA, 18 bp, Homo sapiens
gtgcacgtacacacacat

SEQ ID NO: 3507168 - DNA, 15 bp, Homo sapiens
gtgcactgcccatgg

SEQ ID NO: 3507169 - DNA, 20 bp, Homo sapiens
gtgcactgcccatggacagg

SEQ ID NO: 3507170 - DNA, 19 bp, Homo sapiens
gtgcagcatatacaataat

SEQ ID NO: 3507171 - DNA, 14 bp, Homo sapiens
gtgcagccagaggc

SEQ ID NO: 3507172 - DNA, 22 bp, Homo sapiens
gtgcagctcaaggaaaggcctg

SEQ ID NO: 3507173 - DNA, 14 bp, Homo sapiens
gtgcagctcctcag

SEQ ID NO: 3507174 - DNA, 20 bp, Homo sapiens
gtgcagggagggcagttttc

SEQ ID NO: 3507175 - DNA, 16 bp, Homo sapiens
gtgcagtcctgatcag

SEQ ID NO: 3507176 - DNA, 13 bp, Homo sapiens
gtgcatatgtgtg

SEQ ID NO: 3507177 - DNA, 15 bp, Homo sapiens
gtgcatatgtgtgtg

SEQ ID NO: 3507178 - DNA, 19 bp, Homo sapiens
gtgcatgcgcctactcgct

SEQ ID NO: 3507179 - DNA, 20 bp, Homo sapiens
gtgcatgggacccacgaaac

SEQ ID NO: 3507180 - DNA, 14 bp, Homo sapiens
gtgcatgtcctttg

SEQ ID NO: 3507181 - DNA, 22 bp, Homo sapiens
gtgcattcttttaaaagacaag

SEQ ID NO: 3507182 - DNA, 23 bp, Homo sapiens
gtgcattcttttaaaagacaaga

SEQ ID NO: 3507183 - DNA, 13 bp, Homo sapiens
gtgcattgtgctt

SEQ ID NO: 3507184 - DNA, 19 bp, Homo sapiens
gtgcattgtttctgtgggc

SEQ ID NO: 3507185 - DNA, 16 bp, Homo sapiens
gtgccaccatgcctca

SEQ ID NO: 3507186 - DNA, 16 bp, Homo sapiens
gtgccaggaccagtca

SEQ ID NO: 3507187 - DNA, 22 bp, Homo sapiens
gtgccaggtttttggtctgacc

SEQ ID NO: 3507188 - DNA, 11 bp, Homo sapiens
gtgccatggaa

SEQ ID NO: 3507189 - DNA, 11 bp, Homo sapiens
gtgccatgtat

SEQ ID NO: 3507190 - DNA, 20 bp, Homo sapiens
gtgcccacaggatcagtctg

SEQ ID NO: 3507191 - DNA, 15 bp, Homo sapiens
gtgcccaggccagct

SEQ ID NO: 3507192 - DNA, 12 bp, Homo sapiens
gtgccccaggac

SEQ ID NO: 3507193 - DNA, 15 bp, Homo sapiens
gtgccgacagaagga

SEQ ID NO: 3507194 - DNA, 16 bp, Homo sapiens
gtgcctgactgcccag

SEQ ID NO: 3507195 - DNA, 12 bp, Homo sapiens
gtgcctgccata

SEQ ID NO: 3507196 - DNA, 18 bp, Homo sapiens
gtgcctgccatagccagg

SEQ ID NO: 3507197 - DNA, 20 bp, Homo sapiens
gtgcctgccatagccaggag

SEQ ID NO: 3507198 - DNA, 13 bp, Homo sapiens
gtgcctgtgtcca

SEQ ID NO: 3507199 - DNA, 22 bp, Homo sapiens
gtgccttccagatcctctctgg

SEQ ID NO: 3507200 - DNA, 23 bp, Homo sapiens
gtgccttccagatcctctctggg

SEQ ID NO: 3507201 - DNA, 19 bp, Homo sapiens
gtgccttcttcagggcctg

SEQ ID NO: 3507202 - DNA, 12 bp, Homo sapiens
gtgcctttcaaa

SEQ ID NO: 3507203 - DNA, 13 bp, Homo sapiens
gtgcctttcaaat

SEQ ID NO: 3507204 - DNA, 21 bp, Homo sapiens
gtgcgatctgggttcactgca

SEQ ID NO: 3507205 - DNA, 15 bp, Homo sapiens
gtgcgcagtggcatg

SEQ ID NO: 3507206 - DNA, 14 bp, Homo sapiens
gtgcgcctacagga

SEQ ID NO: 3507207 - DNA, 22 bp, Homo sapiens
gtgcgctgggcacttccctgct

SEQ ID NO: 3507208 - DNA, 23 bp, Homo sapiens
gtgcgctgggcacttccctgctg

SEQ ID NO: 3507209 - DNA, 13 bp, Homo sapiens
gtgctaagtgtga

SEQ ID NO: 3507210 - DNA, 16 bp, Homo sapiens
gtgctaagtgtgaact

SEQ ID NO: 3507211 - DNA, 17 bp, Homo sapiens
gtgctaagtgtgaactg

SEQ ID NO: 3507212 - DNA, 18 bp, Homo sapiens
gtgctaagtgtgaactgg

SEQ ID NO: 3507213 - DNA, 20 bp, Homo sapiens
gtgctaagtgtgaactggac

SEQ ID NO: 3507214 - DNA, 13 bp, Homo sapiens
gtgctatagtatt

SEQ ID NO: 3507215 - DNA, 14 bp, Homo sapiens
gtgctatagtattt

SEQ ID NO: 3507216 - DNA, 15 bp, Homo sapiens
gtgctatagtatttg

SEQ ID NO: 3507217 - DNA, 20 bp, Homo sapiens
gtgctcagggaaatggcctt

SEQ ID NO: 3507218 - DNA, 13 bp, Homo sapiens
gtgctcagggcta

SEQ ID NO: 3507219 - DNA, 13 bp, Homo sapiens
gtgctccaggcag

SEQ ID NO: 3507220 - DNA, 15 bp, Homo sapiens
gtgctccctaccacc

SEQ ID NO: 3507221 - DNA, 18 bp, Homo sapiens
gtgctccctaccacctcc

SEQ ID NO: 3507222 - DNA, 13 bp, Homo sapiens
gtgctccctctgt

SEQ ID NO: 3507223 - DNA, 14 bp, Homo sapiens
gtgctccctctgtc

SEQ ID NO: 3507224 - DNA, 19 bp, Homo sapiens
gtgctccctctgtcatcct

SEQ ID NO: 3507225 - DNA, 21 bp, Homo sapiens
gtgctcgagtcacattctgct

SEQ ID NO: 3507226 - DNA, 14 bp, Homo sapiens
gtgctcgccctgcg

SEQ ID NO: 3507227 - DNA, 22 bp, Homo sapiens
gtgctcgctgttgctgaatagg

SEQ ID NO: 3507228 - DNA, 14 bp, Homo sapiens
gtgctctaggctgc

SEQ ID NO: 3507229 - DNA, 15 bp, Homo sapiens
gtgctctggacaggc

SEQ ID NO: 3507230 - DNA, 18 bp, Homo sapiens
gtgctctggacaggcatg

SEQ ID NO: 3507231 - DNA, 16 bp, Homo sapiens
gtgctgacagctgctc

SEQ ID NO: 3507232 - DNA, 15 bp, Homo sapiens
gtgctgacggccagg

SEQ ID NO: 3507233 - DNA, 21 bp, Homo sapiens
gtgctgacggccagggagaag

SEQ ID NO: 3507234 - DNA, 23 bp, Homo sapiens
gtgctgacggccagggagaagct

SEQ ID NO: 3507235 - DNA, 13 bp, Homo sapiens
gtgctgagaagct

SEQ ID NO: 3507236 - DNA, 15 bp, Homo sapiens
gtgctgccatccagg

SEQ ID NO: 3507237 - DNA, 19 bp, Homo sapiens
gtgctgccatccaggttca

SEQ ID NO: 3507238 - DNA, 17 bp, Homo sapiens
gtgctggagcactgggc

SEQ ID NO: 3507239 - DNA, 15 bp, Homo sapiens
gtgctggcaaccact

SEQ ID NO: 3507240 - DNA, 22 bp, Homo sapiens
gtgctgggattacaagcgtgag

SEQ ID NO: 3507241 - DNA, 13 bp, Homo sapiens
gtgctgtataaaa

SEQ ID NO: 3507242 - DNA, 18 bp, Homo sapiens
gtgctgtcctcaggtggc

SEQ ID NO: 3507243 - DNA, 14 bp, Homo sapiens
gtgcttctttcttt

SEQ ID NO: 3507244 - DNA, 13 bp, Homo sapiens
gtgcttgaaggcc

SEQ ID NO: 3507245 - DNA, 18 bp, Homo sapiens
gtgcttgaaggccctgct

SEQ ID NO: 3507246 - DNA, 23 bp, Homo sapiens
gtgcttgtttgctcacctggggt

SEQ ID NO: 3507247 - DNA, 17 bp, Homo sapiens
gtgctttatgctgaaac

SEQ ID NO: 3507248 - DNA, 18 bp, Homo sapiens
gtggaaaaactgagacag

SEQ ID NO: 3507249 - DNA, 23 bp, Homo sapiens
gtggaaaaactgagacaggcagt

SEQ ID NO: 3507250 - DNA, 16 bp, Homo sapiens
gtggaatgttggataa

SEQ ID NO: 3507251 - DNA, 17 bp, Homo sapiens
gtggaatgttggataag

SEQ ID NO: 3507252 - DNA, 20 bp, Homo sapiens
gtggaatgttggataaggaa

SEQ ID NO: 3507253 - DNA, 17 bp, Homo sapiens
gtggaccttaggccttc

SEQ ID NO: 3507254 - DNA, 21 bp, Homo sapiens
gtggaccttaggccttcctct

SEQ ID NO: 3507255 - DNA, 21 bp, Homo sapiens
gtggactcagggcagcgccag

SEQ ID NO: 3507256 - DNA, 20 bp, Homo sapiens
gtggagaagccacaggcctg

SEQ ID NO: 3507257 - DNA, 19 bp, Homo sapiens
gtggagacaatgtctgcag

SEQ ID NO: 3507258 - DNA, 22 bp, Homo sapiens
gtggagacaatgtctgcagccc

SEQ ID NO: 3507259 - DNA, 13 bp, Homo sapiens
gtggagctgcctg

SEQ ID NO: 3507260 - DNA, 17 bp, Homo sapiens
gtggaggattgctgcca

SEQ ID NO: 3507261 - DNA, 18 bp, Homo sapiens
gtggaggattgctgccag

SEQ ID NO: 3507262 - DNA, 14 bp, Homo sapiens
gtggaggcacttta

SEQ ID NO: 3507263 - DNA, 18 bp, Homo sapiens
gtggaggtgggctgggcc

SEQ ID NO: 3507264 - DNA, 18 bp, Homo sapiens
gtggatgccgatttctgt

SEQ ID NO: 3507265 - DNA, 13 bp, Homo sapiens
gtggatggcccca

SEQ ID NO: 3507266 - DNA, 12 bp, Homo sapiens
taaataggattt

SEQ ID NO: 3507267 - DNA, 22 bp, Homo sapiens
taaataggttcttcttgttctg

SEQ ID NO: 3507268 - DNA, 15 bp, Homo sapiens
taaatagttaatata

SEQ ID NO: 3507269 - DNA, 15 bp, Homo sapiens
taaatatataaatat

SEQ ID NO: 3507270 - DNA, 15 bp, Homo sapiens
taaatatatataaac

SEQ ID NO: 3507271 - DNA, 18 bp, Homo sapiens
taaatatatataaaccta

SEQ ID NO: 3507272 - DNA, 12 bp, Homo sapiens
taaatatatatt

SEQ ID NO: 3507273 - DNA, 15 bp, Homo sapiens
taaatatatattatt

SEQ ID NO: 3507274 - DNA, 16 bp, Homo sapiens
taaatatatattattc

SEQ ID NO: 3507275 - DNA, 18 bp, Homo sapiens
taaatatatgctaagtct

SEQ ID NO: 3507276 - DNA, 22 bp, Homo sapiens
taaatatgaatctgctcacttt

SEQ ID NO: 3507277 - DNA, 16 bp, Homo sapiens
taaatattttctattt

SEQ ID NO: 3507278 - DNA, 17 bp, Homo sapiens
taaatattttctatttt

SEQ ID NO: 3507279 - DNA, 14 bp, Homo sapiens
taaatcacatcctt

SEQ ID NO: 3507280 - DNA, 11 bp, Homo sapiens
taaatcagtgg

SEQ ID NO: 3507281 - DNA, 13 bp, Homo sapiens
taaatccaaagaa

SEQ ID NO: 3507282 - DNA, 17 bp, Homo sapiens
taaatctgacccagtgc

SEQ ID NO: 3507283 - DNA, 16 bp, Homo sapiens
taaatggcctcatgtg

SEQ ID NO: 3507284 - DNA, 22 bp, Homo sapiens
taaatggcctcatgtggctgga

SEQ ID NO: 3507285 - DNA, 22 bp, Homo sapiens
taaatgtctctttaatgtcaca

SEQ ID NO: 3507286 - DNA, 23 bp, Homo sapiens
taaatgtgcattcttttaaaaga

SEQ ID NO: 3507287 - DNA, 15 bp, Homo sapiens
taaatgtgttttgtt

SEQ ID NO: 3507288 - DNA, 17 bp, Homo sapiens
taaattatatttgtgct

SEQ ID NO: 3507289 - DNA, 18 bp, Homo sapiens
taaattcacaaactttta

SEQ ID NO: 3507290 - DNA, 16 bp, Homo sapiens
taaattcactttcatt

SEQ ID NO: 3507291 - DNA, 16 bp, Homo sapiens
taaattcctctttgct

SEQ ID NO: 3507292 - DNA, 15 bp, Homo sapiens
taaattctgattctt

SEQ ID NO: 3507293 - DNA, 22 bp, Homo sapiens
taaattgccataatatgatgca

SEQ ID NO: 3507294 - DNA, 14 bp, Homo sapiens
taaattgtatattc

SEQ ID NO: 3507295 - DNA, 13 bp, Homo sapiens
taaattttgtaat

SEQ ID NO: 3507296 - DNA, 15 bp, Homo sapiens
taaattttgtaatga

SEQ ID NO: 3507297 - DNA, 19 bp, Homo sapiens
taacaacgtctttttgttt

SEQ ID NO: 3507298 - DNA, 13 bp, Homo sapiens
taacaagccaccc

SEQ ID NO: 3507299 - DNA, 16 bp, Homo sapiens
taacaattaggcagac

SEQ ID NO: 3507300 - DNA, 14 bp, Homo sapiens
taacaattcctcta

SEQ ID NO: 3507301 - DNA, 18 bp, Homo sapiens
taacaccatgattaacca

SEQ ID NO: 3507302 - DNA, 18 bp, Homo sapiens
taacacctgattaactga

SEQ ID NO: 3507303 - DNA, 15 bp, Homo sapiens
taacactgcaagaag

SEQ ID NO: 3507304 - DNA, 17 bp, Homo sapiens
taacagagagaatgaga

SEQ ID NO: 3507305 - DNA, 14 bp, Homo sapiens
taacagcatgacaa

SEQ ID NO: 3507306 - DNA, 20 bp, Homo sapiens
taacagcatgacaaaaatta

SEQ ID NO: 3507307 - DNA, 19 bp, Homo sapiens
taacagctgaattatctat

SEQ ID NO: 3507308 - DNA, 16 bp, Homo sapiens
taacataatttgtaca

SEQ ID NO: 3507309 - DNA, 19 bp, Homo sapiens
taacataatttgtacatat

SEQ ID NO: 3507310 - DNA, 12 bp, Homo sapiens
taacatgatgta

SEQ ID NO: 3507311 - DNA, 16 bp, Homo sapiens
taacatgatgtactaa

SEQ ID NO: 3507312 - DNA, 22 bp, Homo sapiens
taacatgatgtactaaagtaga

SEQ ID NO: 3507313 - DNA, 16 bp, Homo sapiens
taacatgatgttaact

SEQ ID NO: 3507314 - DNA, 16 bp, Homo sapiens
taacattcccactgcc

SEQ ID NO: 3507315 - DNA, 14 bp, Homo sapiens
taacatttaattta

SEQ ID NO: 3507316 - DNA, 21 bp, Homo sapiens
taacatttaatttagatattt

SEQ ID NO: 3507317 - DNA, 18 bp, Homo sapiens
taaccaaaggtgaaggaa

SEQ ID NO: 3507318 - DNA, 21 bp, Homo sapiens
taaccagatggttgtgtatgg

SEQ ID NO: 3507319 - DNA, 19 bp, Homo sapiens
taacccatttttgagccaa

SEQ ID NO: 3507320 - DNA, 19 bp, Homo sapiens
taacccttcatcttcctgt

SEQ ID NO: 3507321 - DNA, 13 bp, Homo sapiens
taaccgctccagg

SEQ ID NO: 3507322 - DNA, 22 bp, Homo sapiens
taacctcaagtgatcctcccac

SEQ ID NO: 3507323 - DNA, 14 bp, Homo sapiens
taacctcatcttct

SEQ ID NO: 3507324 - DNA, 15 bp, Homo sapiens
taacctcgccctctc

SEQ ID NO: 3507325 - DNA, 17 bp, Homo sapiens
taacctcgccctctcct

SEQ ID NO: 3507326 - DNA, 14 bp, Homo sapiens
taacggatcagaaa

SEQ ID NO: 3507327 - DNA, 22 bp, Homo sapiens
taactactatattgattgtcct

SEQ ID NO: 3507328 - DNA, 21 bp, Homo sapiens
taactactccggagacagggt

SEQ ID NO: 3507329 - DNA, 15 bp, Homo sapiens
taactagaatttatt

SEQ ID NO: 3507330 - DNA, 16 bp, Homo sapiens
taactagatggtgctg

SEQ ID NO: 3507331 - DNA, 22 bp, Homo sapiens
taactcagaaacatcagttact

SEQ ID NO: 3507332 - DNA, 12 bp, Homo sapiens
taactccctttt

SEQ ID NO: 3507333 - DNA, 21 bp, Homo sapiens
taactccctttttacacttta

SEQ ID NO: 3507334 - DNA, 15 bp, Homo sapiens
taactgagggctgat

SEQ ID NO: 3507335 - DNA, 23 bp, Homo sapiens
taactgagtagctctcctgactt

SEQ ID NO: 3507336 - DNA, 17 bp, Homo sapiens
taactgcattgagaact

SEQ ID NO: 3507337 - DNA, 15 bp, Homo sapiens
taactgccaatcctt

SEQ ID NO: 3507338 - DNA, 19 bp, Homo sapiens
taactggaacaaattattt

SEQ ID NO: 3507339 - DNA, 16 bp, Homo sapiens
taactggaaggctgct

SEQ ID NO: 3507340 - DNA, 17 bp, Homo sapiens
taactggtgcactttgt

SEQ ID NO: 3507341 - DNA, 22 bp, Homo sapiens
taactggtgcactttgtaaatt

SEQ ID NO: 3507342 - DNA, 12 bp, Homo sapiens
taactgtaaatc

SEQ ID NO: 3507343 - DNA, 14 bp, Homo sapiens
taactgtaaatcat

SEQ ID NO: 3507344 - DNA, 17 bp, Homo sapiens
taactgtttcaaagcca

SEQ ID NO: 3507345 - DNA, 14 bp, Homo sapiens
taacttacttccaa

SEQ ID NO: 3507346 - DNA, 15 bp, Homo sapiens
taacttatattaata

SEQ ID NO: 3507347 - DNA, 14 bp, Homo sapiens
taacttcatagaaa

SEQ ID NO: 3507348 - DNA, 12 bp, Homo sapiens
taacttctgtaa

SEQ ID NO: 3507349 - DNA, 22 bp, Homo sapiens
taacttctgtaatttaaaagct

SEQ ID NO: 3507350 - DNA, 23 bp, Homo sapiens
taacttcttatggaattgatttg

SEQ ID NO: 3507351 - DNA, 22 bp, Homo sapiens
taacttgaacctatgaagcaat

SEQ ID NO: 3507352 - DNA, 17 bp, Homo sapiens
taactttgtggtctaaa

SEQ ID NO: 3507353 - DNA, 22 bp, Homo sapiens
taactttttaaaaaaataaaac

SEQ ID NO: 3507354 - DNA, 14 bp, Homo sapiens
taactttttacatt

SEQ ID NO: 3507355 - DNA, 15 bp, Homo sapiens
taactttttacatta

SEQ ID NO: 3507356 - DNA, 18 bp, Homo sapiens
taactttttacattacag

SEQ ID NO: 3507357 - DNA, 13 bp, Homo sapiens
taagaaaaacttt

SEQ ID NO: 3507358 - DNA, 15 bp, Homo sapiens
taagaaaaacttttt

SEQ ID NO: 3507359 - DNA, 19 bp, Homo sapiens
taagaaaaacttttttggt

SEQ ID NO: 3507360 - DNA, 17 bp, Homo sapiens
taagaaaatattttgtc

SEQ ID NO: 3507361 - DNA, 20 bp, Homo sapiens
taagaaaatattttgtctaa

SEQ ID NO: 3507362 - DNA, 22 bp, Homo sapiens
taagaaaatattttgtctaaaa

SEQ ID NO: 3507363 - DNA, 21 bp, Homo sapiens
taagaaacaactctttgagaa

SEQ ID NO: 3507364 - DNA, 13 bp, Homo sapiens
taagaaacatcca

SEQ ID NO: 3507365 - DNA, 12 bp, Homo sapiens
taagaaagacat

SEQ ID NO: 3507366 - DNA, 11 bp, Homo sapiens
taagaagctct

SEQ ID NO: 3507367 - DNA, 16 bp, Homo sapiens
taagaagctctggccc

SEQ ID NO: 3507368 - DNA, 16 bp, Homo sapiens
taagaataaaatgttg

SEQ ID NO: 3507369 - DNA, 17 bp, Homo sapiens
taagaataaaatgttga

SEQ ID NO: 3507370 - DNA, 20 bp, Homo sapiens
taagaataaaatgttgaaaa

SEQ ID NO: 3507371 - DNA, 16 bp, Homo sapiens
taagacagagaaacag

SEQ ID NO: 3507372 - DNA, 12 bp, Homo sapiens
taagacctctga

SEQ ID NO: 3507373 - DNA, 11 bp, Homo sapiens
taagacctggc

SEQ ID NO: 3507374 - DNA, 13 bp, Homo sapiens
taagacctggcag

SEQ ID NO: 3507375 - DNA, 14 bp, Homo sapiens
taagacgacaagga

SEQ ID NO: 3507376 - DNA, 15 bp, Homo sapiens
taagacgtgtttgtg

SEQ ID NO: 3507377 - DNA, 19 bp, Homo sapiens
taagagaatattttaagta

SEQ ID NO: 3507378 - DNA, 13 bp, Homo sapiens
taagagacagtca

SEQ ID NO: 3507379 - DNA, 12 bp, Homo sapiens
taagaggcaggg

SEQ ID NO: 3507380 - DNA, 15 bp, Homo sapiens
taagaggcagggtct

SEQ ID NO: 3507381 - DNA, 21 bp, Homo sapiens
taagagtagaaactgcaggga

SEQ ID NO: 3507382 - DNA, 15 bp, Homo sapiens
taagatacaaatggt

SEQ ID NO: 3507383 - DNA, 20 bp, Homo sapiens
taagatgccttgaattgtct

SEQ ID NO: 3507384 - DNA, 17 bp, Homo sapiens
taagattccaaaaagca

SEQ ID NO: 3507385 - DNA, 13 bp, Homo sapiens
taagatttctgtc

SEQ ID NO: 3507386 - DNA, 15 bp, Homo sapiens
taagcaaaagaaaaa

SEQ ID NO: 3507387 - DNA, 19 bp, Homo sapiens
taagcaaaggggacagctg

SEQ ID NO: 3507388 - DNA, 22 bp, Homo sapiens
taagcagctaaattttctgaaa

SEQ ID NO: 3507389 - DNA, 18 bp, Homo sapiens
taagcatactttgtaaat

SEQ ID NO: 3507390 - DNA, 21 bp, Homo sapiens
taagcatatcgtaaagctgtt

SEQ ID NO: 3507391 - DNA, 17 bp, Homo sapiens
taagccccagcaagcaa

SEQ ID NO: 3507392 - DNA, 13 bp, Homo sapiens
taagccctggccc

SEQ ID NO: 3507393 - DNA, 13 bp, Homo sapiens
taagcctgtggct

SEQ ID NO: 3507394 - DNA, 18 bp, Homo sapiens
taagctagaagaagtgag

SEQ ID NO: 3507395 - DNA, 16 bp, Homo sapiens
taagctgtttccatag

SEQ ID NO: 3507396 - DNA, 20 bp, Homo sapiens
taaggaaatcaacttgctta

SEQ ID NO: 3507397 - DNA, 17 bp, Homo sapiens
taaggacactggggtct

SEQ ID NO: 3507398 - DNA, 22 bp, Homo sapiens
taaggaggggaaaaaaatgttg

SEQ ID NO: 3507399 - DNA, 13 bp, Homo sapiens
taaggatgtagct

SEQ ID NO: 3507400 - DNA, 22 bp, Homo sapiens
tagaactcagttttaactagaa

SEQ ID NO: 3507401 - DNA, 15 bp, Homo sapiens
tagaacttcatggat

SEQ ID NO: 3507402 - DNA, 22 bp, Homo sapiens
tagaacttggatgtacctgccc

SEQ ID NO: 3507403 - DNA, 19 bp, Homo sapiens
tagaactttaagcaacaag

SEQ ID NO: 3507404 - DNA, 19 bp, Homo sapiens
tagaagagggttttaggta

SEQ ID NO: 3507405 - DNA, 19 bp, Homo sapiens
tagaaggttctctcctccc

SEQ ID NO: 3507406 - DNA, 14 bp, Homo sapiens
tagaagtagaattg

SEQ ID NO: 3507407 - DNA, 14 bp, Homo sapiens
tagaagtagattct

SEQ ID NO: 3507408 - DNA, 15 bp, Homo sapiens
tagaagtctttcaga

SEQ ID NO: 3507409 - DNA, 18 bp, Homo sapiens
tagaagtgccatctcaat

SEQ ID NO: 3507410 - DNA, 16 bp, Homo sapiens
tagaagtgctcccctc

SEQ ID NO: 3507411 - DNA, 14 bp, Homo sapiens
tagaagttaccaaa

SEQ ID NO: 3507412 - DNA, 17 bp, Homo sapiens
tagaataacctttcaga

SEQ ID NO: 3507413 - DNA, 18 bp, Homo sapiens
tagaataacctttcagaa

SEQ ID NO: 3507414 - DNA, 14 bp, Homo sapiens
tagaatattcagac

SEQ ID NO: 3507415 - DNA, 15 bp, Homo sapiens
tagaatattcagaca

SEQ ID NO: 3507416 - DNA, 17 bp, Homo sapiens
tagaatattcagacaaa

SEQ ID NO: 3507417 - DNA, 22 bp, Homo sapiens
tagaatattcagacaaaatgga

SEQ ID NO: 3507418 - DNA, 15 bp, Homo sapiens
tagaatatttattac

SEQ ID NO: 3507419 - DNA, 14 bp, Homo sapiens
tagaatccaaactt

SEQ ID NO: 3507420 - DNA, 19 bp, Homo sapiens
tagaatgcatctcatcaac

SEQ ID NO: 3507421 - DNA, 23 bp, Homo sapiens
tagaattatttcacaaataatag

SEQ ID NO: 3507422 - DNA, 14 bp, Homo sapiens
tagaattgcattga

SEQ ID NO: 3507423 - DNA, 19 bp, Homo sapiens
tagaattggctgaactcat

SEQ ID NO: 3507424 - DNA, 15 bp, Homo sapiens
tagaatttattcaat

SEQ ID NO: 3507425 - DNA, 22 bp, Homo sapiens
tagacaagagaatgctgtcaat

SEQ ID NO: 3507426 - DNA, 17 bp, Homo sapiens
tagacaataaggaagga

SEQ ID NO: 3507427 - DNA, 10 bp, Homo sapiens
tagacagagt

SEQ ID NO: 3507428 - DNA, 23 bp, Homo sapiens
tagactgttggggtgggtataaa

SEQ ID NO: 3507429 - DNA, 13 bp, Homo sapiens
tagagaggaaaag

SEQ ID NO: 3507430 - DNA, 17 bp, Homo sapiens
tagagatggagtcttgc

SEQ ID NO: 3507431 - DNA, 18 bp, Homo sapiens
tagagattacctcctgag

SEQ ID NO: 3507432 - DNA, 17 bp, Homo sapiens
tagagcactgccaccag

SEQ ID NO: 3507433 - DNA, 22 bp, Homo sapiens
tagagcaggcgttcagctcact

SEQ ID NO: 3507434 - DNA, 17 bp, Homo sapiens
tagagcagtttctgtcc

SEQ ID NO: 3507435 - DNA, 22 bp, Homo sapiens
tagagcagtttctgtcctgctg

SEQ ID NO: 3507436 - DNA, 20 bp, Homo sapiens
tagagcctcttggggaaggg

SEQ ID NO: 3507437 - DNA, 16 bp, Homo sapiens
tagaggcagggctgca

SEQ ID NO: 3507438 - DNA, 20 bp, Homo sapiens
tagaggcagggctgcattgg

SEQ ID NO: 3507439 - DNA, 19 bp, Homo sapiens
tagagggacctctcccagg

SEQ ID NO: 3507440 - DNA, 21 bp, Homo sapiens
tagaggttctgggttttctga

SEQ ID NO: 3507441 - DNA, 23 bp, Homo sapiens
tagaggttctgggttttctgaaa

SEQ ID NO: 3507442 - DNA, 19 bp, Homo sapiens
tagatcaaggagcccagaa

SEQ ID NO: 3507443 - DNA, 13 bp, Homo sapiens
tagatcatttcta

SEQ ID NO: 3507444 - DNA, 15 bp, Homo sapiens
tagatctggcatgtt

SEQ ID NO: 3507445 - DNA, 14 bp, Homo sapiens
tagatgattatata

SEQ ID NO: 3507446 - DNA, 19 bp, Homo sapiens
tagatgcatgttgaccatg

SEQ ID NO: 3507447 - DNA, 19 bp, Homo sapiens
tagatgcgcagccccatct

SEQ ID NO: 3507448 - DNA, 20 bp, Homo sapiens
tagatgctttcctaaatcag

SEQ ID NO: 3507449 - DNA, 21 bp, Homo sapiens
tagatgggagggaggctcagg

SEQ ID NO: 3507450 - DNA, 15 bp, Homo sapiens
tagatggtggcacat

SEQ ID NO: 3507451 - DNA, 19 bp, Homo sapiens
tagatggtggcacattcct

SEQ ID NO: 3507452 - DNA, 12 bp, Homo sapiens
tagattgtaaac

SEQ ID NO: 3507453 - DNA, 13 bp, Homo sapiens
tagattttccaaa

SEQ ID NO: 3507454 - DNA, 18 bp, Homo sapiens
tagcaaaaacatgtatgt

SEQ ID NO: 3507455 - DNA, 21 bp, Homo sapiens
tagcacaacgtggtactattt

SEQ ID NO: 3507456 - DNA, 15 bp, Homo sapiens
tagcacatgcttcaa

SEQ ID NO: 3507457 - DNA, 16 bp, Homo sapiens
tagcacatgcttcaat

SEQ ID NO: 3507458 - DNA, 19 bp, Homo sapiens
tagcacatgcttcaatagt

SEQ ID NO: 3507459 - DNA, 16 bp, Homo sapiens
tagcactttgggaggc

SEQ ID NO: 3507460 - DNA, 23 bp, Homo sapiens
tagcagaaggttgcacctccccc

SEQ ID NO: 3507461 - DNA, 13 bp, Homo sapiens
tagcagacaggcc

SEQ ID NO: 3507462 - DNA, 14 bp, Homo sapiens
tagcagatggtttc

SEQ ID NO: 3507463 - DNA, 21 bp, Homo sapiens
tagcagatggtttccacattt

SEQ ID NO: 3507464 - DNA, 14 bp, Homo sapiens
tagcagctgctact

SEQ ID NO: 3507465 - DNA, 21 bp, Homo sapiens
tagcagctgctactagctctt

SEQ ID NO: 3507466 - DNA, 21 bp, Homo sapiens
tagcagggggggaaatgcatt

SEQ ID NO: 3507467 - DNA, 14 bp, Homo sapiens
tagcatatctgcct

SEQ ID NO: 3507468 - DNA, 16 bp, Homo sapiens
tagcatatctgccttt

SEQ ID NO: 3507469 - DNA, 15 bp, Homo sapiens
tagcatctgtacaaa

SEQ ID NO: 3507470 - DNA, 16 bp, Homo sapiens
tagcatgacatttctt

SEQ ID NO: 3507471 - DNA, 18 bp, Homo sapiens
tagcatgtcgtcaaagct

SEQ ID NO: 3507472 - DNA, 23 bp, Homo sapiens
tagccaaacaacaacaaaaacaa

SEQ ID NO: 3507473 - DNA, 14 bp, Homo sapiens
tagccacaccagga

SEQ ID NO: 3507474 - DNA, 17 bp, Homo sapiens
tagccacaccaggatag

SEQ ID NO: 3507475 - DNA, 16 bp, Homo sapiens
tagccacatttggaat

SEQ ID NO: 3507476 - DNA, 20 bp, Homo sapiens
tagccacatttggaatactt

SEQ ID NO: 3507477 - DNA, 21 bp, Homo sapiens
tagccacatttggaatacttt

SEQ ID NO: 3507478 - DNA, 15 bp, Homo sapiens
tagccagatttgtct

SEQ ID NO: 3507479 - DNA, 14 bp, Homo sapiens
tagccagctgctcc

SEQ ID NO: 3507480 - DNA, 21 bp, Homo sapiens
tagccatgatctgcaggggtc

SEQ ID NO: 3507481 - DNA, 18 bp, Homo sapiens
tagccatgtgaaactcat

SEQ ID NO: 3507482 - DNA, 23 bp, Homo sapiens
tagccatgtgaaactcatctcat

SEQ ID NO: 3507483 - DNA, 19 bp, Homo sapiens
tagccatttttcaaagcaa

SEQ ID NO: 3507484 - DNA, 22 bp, Homo sapiens
tagccatttttcaaagcaattg

SEQ ID NO: 3507485 - DNA, 15 bp, Homo sapiens
tagcccactctgctc

SEQ ID NO: 3507486 - DNA, 15 bp, Homo sapiens
tagcccagtgttttc

SEQ ID NO: 3507487 - DNA, 18 bp, Homo sapiens
tagccccctggcctctgt

SEQ ID NO: 3507488 - DNA, 14 bp, Homo sapiens
tagcccctcccaag

SEQ ID NO: 3507489 - DNA, 20 bp, Homo sapiens
tagcccctcccaagctggct

SEQ ID NO: 3507490 - DNA, 22 bp, Homo sapiens
tagccctctccctctaggctct

SEQ ID NO: 3507491 - DNA, 22 bp, Homo sapiens
tagccgatatcagaatttgtgt

SEQ ID NO: 3507492 - DNA, 16 bp, Homo sapiens
tagccggttcctgtcc

SEQ ID NO: 3507493 - DNA, 16 bp, Homo sapiens
tagcctaggtgacaga

SEQ ID NO: 3507494 - DNA, 17 bp, Homo sapiens
tagcctgcctcttctct

SEQ ID NO: 3507495 - DNA, 12 bp, Homo sapiens
tagcctgtggcc

SEQ ID NO: 3507496 - DNA, 16 bp, Homo sapiens
tagcctgtggccctgt

SEQ ID NO: 3507497 - DNA, 20 bp, Homo sapiens
tagccttagaagtcacacag

SEQ ID NO: 3507498 - DNA, 14 bp, Homo sapiens
tagcgcccagttgg

SEQ ID NO: 3507499 - DNA, 17 bp, Homo sapiens
tagcgcccagttgggtg

SEQ ID NO: 3507500 - DNA, 15 bp, Homo sapiens
tagctaactgtaaat

SEQ ID NO: 3507501 - DNA, 13 bp, Homo sapiens
tagctagaggaac

SEQ ID NO: 3507502 - DNA, 14 bp, Homo sapiens
tagctagaggaacc

SEQ ID NO: 3507503 - DNA, 23 bp, Homo sapiens
tagctataattgggtcatagaaa

SEQ ID NO: 3507504 - DNA, 16 bp, Homo sapiens
tagctcaggtgtccct

SEQ ID NO: 3507505 - DNA, 13 bp, Homo sapiens
tagctcctgtggc

SEQ ID NO: 3507506 - DNA, 14 bp, Homo sapiens
tagctcctgtggcc

SEQ ID NO: 3507507 - DNA, 22 bp, Homo sapiens
tagctcctgtggccccaccctg

SEQ ID NO: 3507508 - DNA, 17 bp, Homo sapiens
tagctctatgtttacaa

SEQ ID NO: 3507509 - DNA, 23 bp, Homo sapiens
tagctgacccagccccttgagaa

SEQ ID NO: 3507510 - DNA, 23 bp, Homo sapiens
tagctgcccatttcgtgagcccc

SEQ ID NO: 3507511 - DNA, 15 bp, Homo sapiens
tagctgggactacag

SEQ ID NO: 3507512 - DNA, 17 bp, Homo sapiens
tagctgggactacaggc

SEQ ID NO: 3507513 - DNA, 21 bp, Homo sapiens
tagctgtattcatatattgca

SEQ ID NO: 3507514 - DNA, 13 bp, Homo sapiens
tagctgtcaagcc

SEQ ID NO: 3507515 - DNA, 13 bp, Homo sapiens
tagctgttgagct

SEQ ID NO: 3507516 - DNA, 21 bp, Homo sapiens
tagcttcaccccaatcccagc

SEQ ID NO: 3507517 - DNA, 12 bp, Homo sapiens
tagcttcaggaa

SEQ ID NO: 3507518 - DNA, 18 bp, Homo sapiens
tagcttcaggaacctcga

SEQ ID NO: 3507519 - DNA, 17 bp, Homo sapiens
tagctttcaattccgta

SEQ ID NO: 3507520 - DNA, 22 bp, Homo sapiens
taggaatatcaatataatgttt

SEQ ID NO: 3507521 - DNA, 18 bp, Homo sapiens
taggaccaagcatcttgg

SEQ ID NO: 3507522 - DNA, 19 bp, Homo sapiens
taggacctttccaccacag

SEQ ID NO: 3507523 - DNA, 21 bp, Homo sapiens
taggacctttccaccacagcc

SEQ ID NO: 3507524 - DNA, 22 bp, Homo sapiens
taggacctttccaccacagcca

SEQ ID NO: 3507525 - DNA, 16 bp, Homo sapiens
taggacgccacccagc

SEQ ID NO: 3507526 - DNA, 20 bp, Homo sapiens
taggagaaccaaatctggaa

SEQ ID NO: 3507527 - DNA, 12 bp, Homo sapiens
taggagaagcca

SEQ ID NO: 3507528 - DNA, 14 bp, Homo sapiens
taggagaagggctg

SEQ ID NO: 3507529 - DNA, 16 bp, Homo sapiens
taggagggagttatct

SEQ ID NO: 3507530 - DNA, 21 bp, Homo sapiens
taggagggagttatctaaaag

SEQ ID NO: 3507531 - DNA, 19 bp, Homo sapiens
taggataattagcagtatc

SEQ ID NO: 3507532 - DNA, 18 bp, Homo sapiens
taggatacttaacaaata

SEQ ID NO: 3507533 - DNA, 19 bp, Homo sapiens
taggatacttaacaaatac

SEQ ID NO: 3507534 - DNA, 18 bp, Homo sapiens
taggatagctaactgtaa

SEQ ID NO: 3507535 - DNA, 20 bp, Homo sapiens
taggatattggaatgcacag

SEQ ID NO: 3507536 - DNA, 21 bp, Homo sapiens
taggatctaaggctgtttgct

SEQ ID NO: 3507537 - DNA, 13 bp, Homo sapiens
taggattttcaca

SEQ ID NO: 3507538 - DNA, 22 bp, Homo sapiens
taggattttcacattcttggct

SEQ ID NO: 3507539 - DNA, 12 bp, Homo sapiens
taggcaacatag

SEQ ID NO: 3507540 - DNA, 12 bp, Homo sapiens
taggcagacaca

SEQ ID NO: 3507541 - DNA, 14 bp, Homo sapiens
taggcatgtaaaca

SEQ ID NO: 3507542 - DNA, 12 bp, Homo sapiens
taggcctgcctt

SEQ ID NO: 3507543 - DNA, 13 bp, Homo sapiens
taggcctggccag

SEQ ID NO: 3507544 - DNA, 14 bp, Homo sapiens
taggcctggccaga

SEQ ID NO: 3507545 - DNA, 21 bp, Homo sapiens
taggccttcctctctccagat

SEQ ID NO: 3507546 - DNA, 12 bp, Homo sapiens
taggctcctctt

SEQ ID NO: 3507547 - DNA, 16 bp, Homo sapiens
taggctggagcccagg

SEQ ID NO: 3507548 - DNA, 19 bp, Homo sapiens
taggctggagcccagggag

SEQ ID NO: 3507549 - DNA, 15 bp, Homo sapiens
taggctggtggccca

SEQ ID NO: 3507550 - DNA, 16 bp, Homo sapiens
taggctggtggcccag

SEQ ID NO: 3507551 - DNA, 14 bp, Homo sapiens
taggctttcagctt

SEQ ID NO: 3507552 - DNA, 21 bp, Homo sapiens
tagggaaaaaccagcgtgtga

SEQ ID NO: 3507553 - DNA, 13 bp, Homo sapiens
tagggaaatgaaa

SEQ ID NO: 3507554 - DNA, 16 bp, Homo sapiens
tagggaaatgaaagaa

SEQ ID NO: 3507555 - DNA, 13 bp, Homo sapiens
tagggaagataat

SEQ ID NO: 3507556 - DNA, 14 bp, Homo sapiens
tagggaagggcctg

SEQ ID NO: 3507557 - DNA, 21 bp, Homo sapiens
tagggaagggtggtggagcca

SEQ ID NO: 3507558 - DNA, 14 bp, Homo sapiens
tagggaagtaacag

SEQ ID NO: 3507559 - DNA, 18 bp, Homo sapiens
tagggacctcagaggttt

SEQ ID NO: 3507560 - DNA, 23 bp, Homo sapiens
tagggatcaaccagctaagaaaa

SEQ ID NO: 3507561 - DNA, 16 bp, Homo sapiens
tagggccaagcccagc

SEQ ID NO: 3507562 - DNA, 23 bp, Homo sapiens
tagggccaagcccagcactgctt

SEQ ID NO: 3507563 - DNA, 15 bp, Homo sapiens
tagggttctgcctct

SEQ ID NO: 3507564 - DNA, 22 bp, Homo sapiens
taggtgaacagtcacgcctgaa

SEQ ID NO: 3507565 - DNA, 11 bp, Homo sapiens
taggtgacaga

SEQ ID NO: 3507566 - DNA, 15 bp, Homo sapiens
taggtgagaaaaaaa

SEQ ID NO: 3507567 - DNA, 17 bp, Homo sapiens
taggtgcagctcctcag

SEQ ID NO: 3507568 - DNA, 17 bp, Homo sapiens
taggtgtgggggaagca

SEQ ID NO: 3507569 - DNA, 13 bp, Homo sapiens
taggttaaaaaaa

SEQ ID NO: 3507570 - DNA, 15 bp, Homo sapiens
taggttaataaagat

SEQ ID NO: 3507571 - DNA, 15 bp, Homo sapiens
taggttcagccaagg

SEQ ID NO: 3507572 - DNA, 19 bp, Homo sapiens
taggtttttttgtatagta

SEQ ID NO: 3507573 - DNA, 16 bp, Homo sapiens
tagtaagcatctactt

SEQ ID NO: 3507574 - DNA, 17 bp, Homo sapiens
tagtaatgagtttaaaa

SEQ ID NO: 3507575 - DNA, 13 bp, Homo sapiens
tagtaatttccta

SEQ ID NO: 3507576 - DNA, 13 bp, Homo sapiens
tagtaatttcctt

SEQ ID NO: 3507577 - DNA, 20 bp, Homo sapiens
tagtaatttctttttttcct

SEQ ID NO: 3507578 - DNA, 21 bp, Homo sapiens
tagtaatttctttttttcctt

SEQ ID NO: 3507579 - DNA, 15 bp, Homo sapiens
tagtactagaaactg

SEQ ID NO: 3507580 - DNA, 14 bp, Homo sapiens
tagtagagacaggg

SEQ ID NO: 3507581 - DNA, 22 bp, Homo sapiens
tagtagagacagggttttgcca

SEQ ID NO: 3507582 - DNA, 16 bp, Homo sapiens
tagtaggcatttttac

SEQ ID NO: 3507583 - DNA, 17 bp, Homo sapiens
tagtatttgattcaaaa

SEQ ID NO: 3507584 - DNA, 13 bp, Homo sapiens
tagtcaagctcct

SEQ ID NO: 3507585 - DNA, 15 bp, Homo sapiens
tagtcaatcaagtct

SEQ ID NO: 3507586 - DNA, 20 bp, Homo sapiens
tagtcatgctgctagatctt

SEQ ID NO: 3507587 - DNA, 15 bp, Homo sapiens
tagtcctctagaaat

SEQ ID NO: 3507588 - DNA, 11 bp, Homo sapiens
tagtcctgtga

SEQ ID NO: 3507589 - DNA, 12 bp, Homo sapiens
tagtcctgtgaa

SEQ ID NO: 3507590 - DNA, 19 bp, Homo sapiens
tagtctagatggctcctct

SEQ ID NO: 3507591 - DNA, 13 bp, Homo sapiens
tagtctagtgtag

SEQ ID NO: 3507592 - DNA, 14 bp, Homo sapiens
tagtctattagcca

SEQ ID NO: 3507593 - DNA, 14 bp, Homo sapiens
tagtcttttgcttt

SEQ ID NO: 3507594 - DNA, 15 bp, Homo sapiens
tagtcttttgctttt

SEQ ID NO: 3507595 - DNA, 14 bp, Homo sapiens
tagtgaacttgaaa

SEQ ID NO: 3507596 - DNA, 20 bp, Homo sapiens
tagtgcattgtttctgtggg

SEQ ID NO: 3507597 - DNA, 16 bp, Homo sapiens
tagtggcttgtcctca

SEQ ID NO: 3507598 - DNA, 16 bp, Homo sapiens
tagtggttttaggata

SEQ ID NO: 3507599 - DNA, 22 bp, Homo sapiens
tagtgtacctcctctcagtgtt

SEQ ID NO: 3507600 - DNA, 23 bp, Homo sapiens
tagttaatattgtgaagaaaaat

SEQ ID NO: 3507601 - DNA, 20 bp, Homo sapiens
tagttactgaagccttacaa

SEQ ID NO: 3507602 - DNA, 19 bp, Homo sapiens
tagttactttggaacacta

SEQ ID NO: 3507603 - DNA, 13 bp, Homo sapiens
tagttaggcctgg

SEQ ID NO: 3507604 - DNA, 15 bp, Homo sapiens
tagttatataattgt

SEQ ID NO: 3507605 - DNA, 18 bp, Homo sapiens
tagttcaggtaacaggca

SEQ ID NO: 3507606 - DNA, 13 bp, Homo sapiens
tagttctgtagaa

SEQ ID NO: 3507607 - DNA, 14 bp, Homo sapiens
tagttctgtagaaa

SEQ ID NO: 3507608 - DNA, 16 bp, Homo sapiens
tagttctgtagaaatg

SEQ ID NO: 3507609 - DNA, 13 bp, Homo sapiens
tagttgatatgtt

SEQ ID NO: 3507610 - DNA, 16 bp, Homo sapiens
tagttgcactaactgc

SEQ ID NO: 3507611 - DNA, 17 bp, Homo sapiens
tagtttgactcagtata

SEQ ID NO: 3507612 - DNA, 14 bp, Homo sapiens
tagttttagttttc

SEQ ID NO: 3507613 - DNA, 17 bp, Homo sapiens
tagttttcagtttgtat

SEQ ID NO: 3507614 - DNA, 19 bp, Homo sapiens
tagttttcttgttgctttg

SEQ ID NO: 3507615 - DNA, 14 bp, Homo sapiens
tataaaataaatat

SEQ ID NO: 3507616 - DNA, 15 bp, Homo sapiens
tataaaataaatata

SEQ ID NO: 3507617 - DNA, 16 bp, Homo sapiens
tataaaataaatatat

SEQ ID NO: 3507618 - DNA, 17 bp, Homo sapiens
tataaaataaatatata

SEQ ID NO: 3507619 - DNA, 21 bp, Homo sapiens
tataaaataaatatatataaa

SEQ ID NO: 3507620 - DNA, 22 bp, Homo sapiens
tataaaataaatatatataaac

SEQ ID NO: 3507621 - DNA, 12 bp, Homo sapiens
tataaaataatg

SEQ ID NO: 3507622 - DNA, 16 bp, Homo sapiens
tataaaatcagccaat

SEQ ID NO: 3507623 - DNA, 17 bp, Homo sapiens
tataaaatcagccaatt

SEQ ID NO: 3507624 - DNA, 19 bp, Homo sapiens
tataaaatcagccaattat

SEQ ID NO: 3507625 - DNA, 20 bp, Homo sapiens
tataaaatcagccaattatg

SEQ ID NO: 3507626 - DNA, 18 bp, Homo sapiens
tataaaatgtaacactga

SEQ ID NO: 3507627 - DNA, 18 bp, Homo sapiens
tataaacctaaaaaagat

SEQ ID NO: 3507628 - DNA, 19 bp, Homo sapiens
tataaacctaaaaaagata

SEQ ID NO: 3507629 - DNA, 17 bp, Homo sapiens
tataaagagaagacgaa

SEQ ID NO: 3507630 - DNA, 14 bp, Homo sapiens
tataaagtagaaat

SEQ ID NO: 3507631 - DNA, 21 bp, Homo sapiens
tataaataaaatcatgtagtt

SEQ ID NO: 3507632 - DNA, 13 bp, Homo sapiens
tataaattcactt

SEQ ID NO: 3507633 - DNA, 21 bp, Homo sapiens
tataaattcctctttgctttg

SEQ ID NO: 3507634 - DNA, 20 bp, Homo sapiens
tataacaacgtctttttgtt

SEQ ID NO: 3507635 - DNA, 20 bp, Homo sapiens
tataacggtttaattctgtc

SEQ ID NO: 3507636 - DNA, 19 bp, Homo sapiens
tataactactccggagaca

SEQ ID NO: 3507637 - DNA, 11 bp, Homo sapiens
tataagaaaaa

SEQ ID NO: 3507638 - DNA, 17 bp, Homo sapiens
tataagaaagacatctt

SEQ ID NO: 3507639 - DNA, 19 bp, Homo sapiens
tataagaataaaatgttga

SEQ ID NO: 3507640 - DNA, 22 bp, Homo sapiens
tataagattccaaaaagcacat

SEQ ID NO: 3507641 - DNA, 14 bp, Homo sapiens
tataagtaagaaaa

SEQ ID NO: 3507642 - DNA, 18 bp, Homo sapiens
tataagtaagaaaatatt

SEQ ID NO: 3507643 - DNA, 19 bp, Homo sapiens
tataagtgctgtataaaat

SEQ ID NO: 3507644 - DNA, 18 bp, Homo sapiens
tataagtggaggcacttt

SEQ ID NO: 3507645 - DNA, 17 bp, Homo sapiens
tataagttgagaaggtg

SEQ ID NO: 3507646 - DNA, 14 bp, Homo sapiens
tataatatctaaag

SEQ ID NO: 3507647 - DNA, 20 bp, Homo sapiens
tataatggacagattaatat

SEQ ID NO: 3507648 - DNA, 15 bp, Homo sapiens
tataatggttgactg

SEQ ID NO: 3507649 - DNA, 11 bp, Homo sapiens
tataatttaat

SEQ ID NO: 3507650 - DNA, 18 bp, Homo sapiens
tataatttttttcaatat

SEQ ID NO: 3507651 - DNA, 18 bp, Homo sapiens
tatacaaattagaaaatg

SEQ ID NO: 3507652 - DNA, 18 bp, Homo sapiens
tatacaataatgtaattt

SEQ ID NO: 3507653 - DNA, 14 bp, Homo sapiens
tatacagtgatata

SEQ ID NO: 3507654 - DNA, 16 bp, Homo sapiens
tatacatagcatgaca

SEQ ID NO: 3507655 - DNA, 14 bp, Homo sapiens
tataccatttcctc

SEQ ID NO: 3507656 - DNA, 13 bp, Homo sapiens
tatacctgtgcct

SEQ ID NO: 3507657 - DNA, 20 bp, Homo sapiens
tatactagggagccatttga

SEQ ID NO: 3507658 - DNA, 21 bp, Homo sapiens
tatactgtacaataaaaacat

SEQ ID NO: 3507659 - DNA, 21 bp, Homo sapiens
tatacttgtggactaaaagat

SEQ ID NO: 3507660 - DNA, 20 bp, Homo sapiens
tatactttaatgttttaact

SEQ ID NO: 3507661 - DNA, 11 bp, Homo sapiens
tatactttttt

SEQ ID NO: 3507662 - DNA, 22 bp, Homo sapiens
tatagaaaaataaaaatctctt

SEQ ID NO: 3507663 - DNA, 13 bp, Homo sapiens
tatagaagcgatt

SEQ ID NO: 3507664 - DNA, 15 bp, Homo sapiens
tatagaatatttatt

SEQ ID NO: 3507665 - DNA, 15 bp, Homo sapiens
tatagaattagcttt

SEQ ID NO: 3507666 - DNA, 16 bp, Homo sapiens
tcaagcccgcggggac

SEQ ID NO: 3507667 - DNA, 19 bp, Homo sapiens
tcaagcgattcttctgctt

SEQ ID NO: 3507668 - DNA, 14 bp, Homo sapiens
tcaagctcctcctc

SEQ ID NO: 3507669 - DNA, 15 bp, Homo sapiens
tcaagctcctcctcc

SEQ ID NO: 3507670 - DNA, 16 bp, Homo sapiens
tcaagctcctcctccc

SEQ ID NO: 3507671 - DNA, 18 bp, Homo sapiens
tcaagctcctcctccctg

SEQ ID NO: 3507672 - DNA, 15 bp, Homo sapiens
tcaaggagcccagaa

SEQ ID NO: 3507673 - DNA, 14 bp, Homo sapiens
tcaaggatgttttt

SEQ ID NO: 3507674 - DNA, 18 bp, Homo sapiens
tcaaggatgtttttcttt

SEQ ID NO: 3507675 - DNA, 15 bp, Homo sapiens
tcaaggcactgcctg

SEQ ID NO: 3507676 - DNA, 13 bp, Homo sapiens
tcaaggccttcag

SEQ ID NO: 3507677 - DNA, 14 bp, Homo sapiens
tcaaggccttcagt

SEQ ID NO: 3507678 - DNA, 16 bp, Homo sapiens
tcaaggcggtgcttga

SEQ ID NO: 3507679 - DNA, 18 bp, Homo sapiens
tcaaggctgcttagaatc

SEQ ID NO: 3507680 - DNA, 15 bp, Homo sapiens
tcaagtcaaattaat

SEQ ID NO: 3507681 - DNA, 23 bp, Homo sapiens
tcaagtcccccagcagaaccagc

SEQ ID NO: 3507682 - DNA, 14 bp, Homo sapiens
tcaagtctctgctg

SEQ ID NO: 3507683 - DNA, 19 bp, Homo sapiens
tcaagtctgtttactgcaa

SEQ ID NO: 3507684 - DNA, 20 bp, Homo sapiens
tcaagtgattctcctgcctc

SEQ ID NO: 3507685 - DNA, 21 bp, Homo sapiens
tcaagttttgggtatgtttaa

SEQ ID NO: 3507686 - DNA, 17 bp, Homo sapiens
tcaataaaaaacaaata

SEQ ID NO: 3507687 - DNA, 12 bp, Homo sapiens
tcaataaagcat

SEQ ID NO: 3507688 - DNA, 15 bp, Homo sapiens
tcaataaagtattta

SEQ ID NO: 3507689 - DNA, 14 bp, Homo sapiens
tcaatagttcaagg

SEQ ID NO: 3507690 - DNA, 22 bp, Homo sapiens
tcaatattgaatttttcctatg

SEQ ID NO: 3507691 - DNA, 18 bp, Homo sapiens
tcaatattggtgtactgt

SEQ ID NO: 3507692 - DNA, 19 bp, Homo sapiens
tcaatattggtgtactgta

SEQ ID NO: 3507693 - DNA, 18 bp, Homo sapiens
tcaatctcaatcctgcag

SEQ ID NO: 3507694 - DNA, 15 bp, Homo sapiens
tcaatgaagccagct

SEQ ID NO: 3507695 - DNA, 16 bp, Homo sapiens
tcaatgaagccagctc

SEQ ID NO: 3507696 - DNA, 18 bp, Homo sapiens
tcaatgcactgacattgt

SEQ ID NO: 3507697 - DNA, 16 bp, Homo sapiens
tcaattcctctgggaa

SEQ ID NO: 3507698 - DNA, 15 bp, Homo sapiens
tcaattcttgccaaa

SEQ ID NO: 3507699 - DNA, 17 bp, Homo sapiens
tcaattgcatctcccag

SEQ ID NO: 3507700 - DNA, 13 bp, Homo sapiens
tcaatttcaggct

SEQ ID NO: 3507701 - DNA, 17 bp, Homo sapiens
tcacaaacttttatact

SEQ ID NO: 3507702 - DNA, 12 bp, Homo sapiens
tcacaaagccca

SEQ ID NO: 3507703 - DNA, 13 bp, Homo sapiens
tcacaaataatag

SEQ ID NO: 3507704 - DNA, 16 bp, Homo sapiens
tcacaacctgaaccta

SEQ ID NO: 3507705 - DNA, 16 bp, Homo sapiens
tcacaacgtgcattgt

SEQ ID NO: 3507706 - DNA, 20 bp, Homo sapiens
tcacaacgtgcattgtgctt

SEQ ID NO: 3507707 - DNA, 21 bp, Homo sapiens
tcacaacgtgcattgtgcttc

SEQ ID NO: 3507708 - DNA, 19 bp, Homo sapiens
tcacaattccatttccagt

SEQ ID NO: 3507709 - DNA, 24 bp, Homo sapiens
tcacacacacaaaaaatgcacaaa

SEQ ID NO: 3507710 - DNA, 21 bp, Homo sapiens
tcacacacccctcaaaaaaag

SEQ ID NO: 3507711 - DNA, 17 bp, Homo sapiens
tcacacgggggcagctg

SEQ ID NO: 3507712 - DNA, 18 bp, Homo sapiens
tcacacgggggcagctga

SEQ ID NO: 3507713 - DNA, 20 bp, Homo sapiens
tcacacttactgtaagacat

SEQ ID NO: 3507714 - DNA, 19 bp, Homo sapiens
tcacagaagggtgtggcat

SEQ ID NO: 3507715 - DNA, 23 bp, Homo sapiens
tcacagaagggtgtggcatttgg

SEQ ID NO: 3507716 - DNA, 19 bp, Homo sapiens
tcacagatcgcatttccta

SEQ ID NO: 3507717 - DNA, 21 bp, Homo sapiens
tcacagatcgcatttcctaag

SEQ ID NO: 3507718 - DNA, 19 bp, Homo sapiens
tcacagatgcctacttttg

SEQ ID NO: 3507719 - DNA, 13 bp, Homo sapiens
tcacagcggaggt

SEQ ID NO: 3507720 - DNA, 16 bp, Homo sapiens
tcacaggcaggtccag

SEQ ID NO: 3507721 - DNA, 17 bp, Homo sapiens
tcacagtgctgtgtgcc

SEQ ID NO: 3507722 - DNA, 15 bp, Homo sapiens
tcacagtgtttctta

SEQ ID NO: 3507723 - DNA, 21 bp, Homo sapiens
tcacagtgtttcttattcccc

SEQ ID NO: 3507724 - DNA, 16 bp, Homo sapiens
tcacagttcaaaattc

SEQ ID NO: 3507725 - DNA, 12 bp, Homo sapiens
tcacataataaa

SEQ ID NO: 3507726 - DNA, 15 bp, Homo sapiens
tcacatatctgtcat

SEQ ID NO: 3507727 - DNA, 14 bp, Homo sapiens
tcacatattctagt

SEQ ID NO: 3507728 - DNA, 15 bp, Homo sapiens
tcacatcttggcaca

SEQ ID NO: 3507729 - DNA, 13 bp, Homo sapiens
tcacatcttttaa

SEQ ID NO: 3507730 - DNA, 21 bp, Homo sapiens
tcacatggtgctacgcctgca

SEQ ID NO: 3507731 - DNA, 21 bp, Homo sapiens
tcacatgtcagtaccttcaaa

SEQ ID NO: 3507732 - DNA, 12 bp, Homo sapiens
tcacattagaag

SEQ ID NO: 3507733 - DNA, 14 bp, Homo sapiens
tcacattagaagac

SEQ ID NO: 3507734 - DNA, 15 bp, Homo sapiens
tcacattagaagaca

SEQ ID NO: 3507735 - DNA, 13 bp, Homo sapiens
tcacattagatct

SEQ ID NO: 3507736 - DNA, 17 bp, Homo sapiens
tcacattcccctgggga

SEQ ID NO: 3507737 - DNA, 15 bp, Homo sapiens
tcacattctgcttaa

SEQ ID NO: 3507738 - DNA, 21 bp, Homo sapiens
tcacattcttggcttaatcat

SEQ ID NO: 3507739 - DNA, 11 bp, Homo sapiens
tcacattgttt

SEQ ID NO: 3507740 - DNA, 18 bp, Homo sapiens
tcacatttattctgctca

SEQ ID NO: 3507741 - DNA, 19 bp, Homo sapiens
tcacatttattctgctcac

SEQ ID NO: 3507742 - DNA, 18 bp, Homo sapiens
tcaccaaaagacactgca

SEQ ID NO: 3507743 - DNA, 13 bp, Homo sapiens
tcaccaagcccag

SEQ ID NO: 3507744 - DNA, 12 bp, Homo sapiens
tcaccaaggaaa

SEQ ID NO: 3507745 - DNA, 12 bp, Homo sapiens
tcaccacaaact

SEQ ID NO: 3507746 - DNA, 22 bp, Homo sapiens
tcaccagccccagtgcccacag

SEQ ID NO: 3507747 - DNA, 15 bp, Homo sapiens
tcaccagctgcaaag

SEQ ID NO: 3507748 - DNA, 16 bp, Homo sapiens
tcaccagctgcaaagt

SEQ ID NO: 3507749 - DNA, 13 bp, Homo sapiens
tcaccatgtattt

SEQ ID NO: 3507750 - DNA, 14 bp, Homo sapiens
tcaccattctgcat

SEQ ID NO: 3507751 - DNA, 17 bp, Homo sapiens
tcaccattctgcattta

SEQ ID NO: 3507752 - DNA, 19 bp, Homo sapiens
tcaccattctgcatttagc

SEQ ID NO: 3507753 - DNA, 22 bp, Homo sapiens
tcaccatttgattatgtagcaa

SEQ ID NO: 3507754 - DNA, 12 bp, Homo sapiens
tcaccccaccct

SEQ ID NO: 3507755 - DNA, 19 bp, Homo sapiens
tcaccccatcccacaccct

SEQ ID NO: 3507756 - DNA, 16 bp, Homo sapiens
tcacccccttctccat

SEQ ID NO: 3507757 - DNA, 14 bp, Homo sapiens
tcacccctcccttt

SEQ ID NO: 3507758 - DNA, 17 bp, Homo sapiens
tcacccctccctttctc

SEQ ID NO: 3507759 - DNA, 20 bp, Homo sapiens
tcacccctccctttctcccc

SEQ ID NO: 3507760 - DNA, 15 bp, Homo sapiens
tcacccctggttctc

SEQ ID NO: 3507761 - DNA, 21 bp, Homo sapiens
tcacccctggttctcatcttt

SEQ ID NO: 3507762 - DNA, 22 bp, Homo sapiens
tcacccctggttctcatctttc

SEQ ID NO: 3507763 - DNA, 19 bp, Homo sapiens
tcaccctcataccatctgc

SEQ ID NO: 3507764 - DNA, 17 bp, Homo sapiens
tcaccctgcaggacttg

SEQ ID NO: 3507765 - DNA, 21 bp, Homo sapiens
tcaccgtggattcgcttgagt

SEQ ID NO: 3507766 - DNA, 13 bp, Homo sapiens
tcaccgtgggctc

SEQ ID NO: 3507767 - DNA, 16 bp, Homo sapiens
tcaccgtgggctccct

SEQ ID NO: 3507768 - DNA, 15 bp, Homo sapiens
tcacctcattctgaa

SEQ ID NO: 3507769 - DNA, 15 bp, Homo sapiens
tcacctccttcaatt

SEQ ID NO: 3507770 - DNA, 19 bp, Homo sapiens
tcacctgaagactcattct

SEQ ID NO: 3507771 - DNA, 22 bp, Homo sapiens
tcacctgagcaggacctctgaa

SEQ ID NO: 3507772 - DNA, 14 bp, Homo sapiens
tcacctgggctgtg

SEQ ID NO: 3507773 - DNA, 18 bp, Homo sapiens
tcacctggggctgctggc

SEQ ID NO: 3507774 - DNA, 14 bp, Homo sapiens
tcacctgtgcttcg

SEQ ID NO: 3507775 - DNA, 22 bp, Homo sapiens
tcacctgtttttaagctgtttc

SEQ ID NO: 3507776 - DNA, 15 bp, Homo sapiens
tcaccttaggcaggg

SEQ ID NO: 3507777 - DNA, 18 bp, Homo sapiens
tcaccttggcaccagaca

SEQ ID NO: 3507778 - DNA, 12 bp, Homo sapiens
tcacctttgtag

SEQ ID NO: 3507779 - DNA, 15 bp, Homo sapiens
tcacctttgtagcac

SEQ ID NO: 3507780 - DNA, 13 bp, Homo sapiens
tcacgccactgca

SEQ ID NO: 3507781 - DNA, 14 bp, Homo sapiens
tcacgccactgcac

SEQ ID NO: 3507782 - DNA, 15 bp, Homo sapiens
tcacgcctgaaactt

SEQ ID NO: 3507783 - DNA, 16 bp, Homo sapiens
tcacgcctgaaacttt

SEQ ID NO: 3507784 - DNA, 14 bp, Homo sapiens
tcacgcttcacagt

SEQ ID NO: 3507785 - DNA, 14 bp, Homo sapiens
tcacggaagagcct

SEQ ID NO: 3507786 - DNA, 16 bp, Homo sapiens
tcacggaagagccttg

SEQ ID NO: 3507787 - DNA, 16 bp, Homo sapiens
tcacggaagttttcaa

SEQ ID NO: 3507788 - DNA, 16 bp, Homo sapiens
tcacgtggaggagcag

SEQ ID NO: 3507789 - DNA, 21 bp, Homo sapiens
tcacgtggaggagcagtgcag

SEQ ID NO: 3507790 - DNA, 18 bp, Homo sapiens
tcacgttagaggaaaaat

SEQ ID NO: 3507791 - DNA, 15 bp, Homo sapiens
tcactaatttttgta

SEQ ID NO: 3507792 - DNA, 15 bp, Homo sapiens
tcactagcagctgca

SEQ ID NO: 3507793 - DNA, 16 bp, Homo sapiens
tcactagcagctgcag

SEQ ID NO: 3507794 - DNA, 17 bp, Homo sapiens
tcactagcagctgcagt

SEQ ID NO: 3507795 - DNA, 22 bp, Homo sapiens
tcactaggcccccacttgcctc

SEQ ID NO: 3507796 - DNA, 18 bp, Homo sapiens
tcactatgttgcccaggc

SEQ ID NO: 3507797 - DNA, 20 bp, Homo sapiens
tcactcaaggcggtgcttga

SEQ ID NO: 3507798 - DNA, 14 bp, Homo sapiens
tcactcaggctgga

SEQ ID NO: 3507799 - DNA, 17 bp, Homo sapiens
tcactcatacatctggc

SEQ ID NO: 3507800 - DNA, 18 bp, Homo sapiens
tccagctcctcatccagg

SEQ ID NO: 3507801 - DNA, 15 bp, Homo sapiens
tccagctctttcctc

SEQ ID NO: 3507802 - DNA, 18 bp, Homo sapiens
tccagctctttcctcctt

SEQ ID NO: 3507803 - DNA, 13 bp, Homo sapiens
tccagctgccccg

SEQ ID NO: 3507804 - DNA, 22 bp, Homo sapiens
tccagctgccccggcccctccc

SEQ ID NO: 3507805 - DNA, 13 bp, Homo sapiens
tccagcttgccag

SEQ ID NO: 3507806 - DNA, 23 bp, Homo sapiens
tccagcttgccagatgctgcaga

SEQ ID NO: 3507807 - DNA, 20 bp, Homo sapiens
tccaggagaaggccaattcc

SEQ ID NO: 3507808 - DNA, 16 bp, Homo sapiens
tccaggagcttcttgt

SEQ ID NO: 3507809 - DNA, 19 bp, Homo sapiens
tccaggaggagttagccaa

SEQ ID NO: 3507810 - DNA, 20 bp, Homo sapiens
tccaggaggagttagccaaa

SEQ ID NO: 3507811 - DNA, 15 bp, Homo sapiens
tccaggcaaaaggag

SEQ ID NO: 3507812 - DNA, 14 bp, Homo sapiens
tccaggcagatcca

SEQ ID NO: 3507813 - DNA, 15 bp, Homo sapiens
tccaggcagatccag

SEQ ID NO: 3507814 - DNA, 20 bp, Homo sapiens
tccaggcccaaggctcccgg

SEQ ID NO: 3507815 - DNA, 12 bp, Homo sapiens
tccaggctcctt

SEQ ID NO: 3507816 - DNA, 22 bp, Homo sapiens
tccaggctcctttagcgcccag

SEQ ID NO: 3507817 - DNA, 19 bp, Homo sapiens
tccagggagcattttcctc

SEQ ID NO: 3507818 - DNA, 13 bp, Homo sapiens
tccagggctctga

SEQ ID NO: 3507819 - DNA, 17 bp, Homo sapiens
tccagggctggactgag

SEQ ID NO: 3507820 - DNA, 23 bp, Homo sapiens
tccagggctggactgaggcctga

SEQ ID NO: 3507821 - DNA, 22 bp, Homo sapiens
tccaggggctgcttcctcctgg

SEQ ID NO: 3507822 - DNA, 17 bp, Homo sapiens
tccagggtccctctgtg

SEQ ID NO: 3507823 - DNA, 18 bp, Homo sapiens
tccagggtccctctgtgt

SEQ ID NO: 3507824 - DNA, 17 bp, Homo sapiens
tccagggtgtgtgctcg

SEQ ID NO: 3507825 - DNA, 17 bp, Homo sapiens
tccaggtaccttgacct

SEQ ID NO: 3507826 - DNA, 17 bp, Homo sapiens
tccaggtcttgaggaga

SEQ ID NO: 3507827 - DNA, 13 bp, Homo sapiens
tccaggtgcccag

SEQ ID NO: 3507828 - DNA, 15 bp, Homo sapiens
tccagtaatctaata

SEQ ID NO: 3507829 - DNA, 15 bp, Homo sapiens
tccagtaccttgctt

SEQ ID NO: 3507830 - DNA, 20 bp, Homo sapiens
tccagtagtggacaacaggt

SEQ ID NO: 3507831 - DNA, 16 bp, Homo sapiens
tccagtcaaatctggg

SEQ ID NO: 3507832 - DNA, 20 bp, Homo sapiens
tccagtcaaatctgggctca

SEQ ID NO: 3507833 - DNA, 18 bp, Homo sapiens
tccagtgaaacttgggca

SEQ ID NO: 3507834 - DNA, 20 bp, Homo sapiens
tccagtgacaaaccatccag

SEQ ID NO: 3507835 - DNA, 17 bp, Homo sapiens
tccagtgtccttagaac

SEQ ID NO: 3507836 - DNA, 20 bp, Homo sapiens
tccagtgtccttagaacatt

SEQ ID NO: 3507837 - DNA, 19 bp, Homo sapiens
tccagtgtgcacccctccc

SEQ ID NO: 3507838 - DNA, 19 bp, Homo sapiens
tccagttaaaaaaaatttt

SEQ ID NO: 3507839 - DNA, 20 bp, Homo sapiens
tccataaagacaatcactgc

SEQ ID NO: 3507840 - DNA, 21 bp, Homo sapiens
tccataaagacaatcactgcc

SEQ ID NO: 3507841 - DNA, 14 bp, Homo sapiens
tccataatgatgga

SEQ ID NO: 3507842 - DNA, 22 bp, Homo sapiens
tccataatgatggatttaacag

SEQ ID NO: 3507843 - DNA, 14 bp, Homo sapiens
tccatatattggca

SEQ ID NO: 3507844 - DNA, 20 bp, Homo sapiens
tccatatcagaactgtgcca

SEQ ID NO: 3507845 - DNA, 14 bp, Homo sapiens
tccatatcctggtg

SEQ ID NO: 3507846 - DNA, 13 bp, Homo sapiens
tccatccaaggcc

SEQ ID NO: 3507847 - DNA, 15 bp, Homo sapiens
tccatccacatggga

SEQ ID NO: 3507848 - DNA, 15 bp, Homo sapiens
tccatcctcatctct

SEQ ID NO: 3507849 - DNA, 20 bp, Homo sapiens
tccatctgggctaccccacc

SEQ ID NO: 3507850 - DNA, 13 bp, Homo sapiens
tccatctttacaa

SEQ ID NO: 3507851 - DNA, 18 bp, Homo sapiens
tccatctttcctgatggc

SEQ ID NO: 3507852 - DNA, 14 bp, Homo sapiens
tccatgatgctggg

SEQ ID NO: 3507853 - DNA, 15 bp, Homo sapiens
tccatgatgctggga

SEQ ID NO: 3507854 - DNA, 23 bp, Homo sapiens
tccatgggcagagcccaagggaa

SEQ ID NO: 3507855 - DNA, 14 bp, Homo sapiens
tccatgtacttgtt

SEQ ID NO: 3507856 - DNA, 18 bp, Homo sapiens
tccatgtacttgtttgca

SEQ ID NO: 3507857 - DNA, 18 bp, Homo sapiens
tccatgtcccctcccaga

SEQ ID NO: 3507858 - DNA, 20 bp, Homo sapiens
tccatgtgggctagttgggc

SEQ ID NO: 3507859 - DNA, 20 bp, Homo sapiens
tccattcagtgcagcatata

SEQ ID NO: 3507860 - DNA, 12 bp, Homo sapiens
tccattctttct

SEQ ID NO: 3507861 - DNA, 18 bp, Homo sapiens
tccattctttctgataac

SEQ ID NO: 3507862 - DNA, 19 bp, Homo sapiens
tccattctttctgataact

SEQ ID NO: 3507863 - DNA, 16 bp, Homo sapiens
tccattggatctcatt

SEQ ID NO: 3507864 - DNA, 22 bp, Homo sapiens
tccattggtttacctgtgaaat

SEQ ID NO: 3507865 - DNA, 12 bp, Homo sapiens
tccattgtttaa

SEQ ID NO: 3507866 - DNA, 17 bp, Homo sapiens
tccattgtttaaaaata

SEQ ID NO: 3507867 - DNA, 19 bp, Homo sapiens
tccattgtttaaaaataca

SEQ ID NO: 3507868 - DNA, 23 bp, Homo sapiens
tccattgtttaaaaatacacatg

SEQ ID NO: 3507869 - DNA, 12 bp, Homo sapiens
tccatttccagt

SEQ ID NO: 3507870 - DNA, 15 bp, Homo sapiens
tccatttccagttca

SEQ ID NO: 3507871 - DNA, 12 bp, Homo sapiens
tccatttgcaag

SEQ ID NO: 3507872 - DNA, 22 bp, Homo sapiens
tccattttcttattgcgctgct

SEQ ID NO: 3507873 - DNA, 22 bp, Homo sapiens
tcccaaacgccctttcctcctc

SEQ ID NO: 3507874 - DNA, 16 bp, Homo sapiens
tcccaaatccttccca

SEQ ID NO: 3507875 - DNA, 19 bp, Homo sapiens
tcccaaatccttcccaagt

SEQ ID NO: 3507876 - DNA, 22 bp, Homo sapiens
tcccaaatttgattgatttgaa

SEQ ID NO: 3507877 - DNA, 13 bp, Homo sapiens
tcccaaccccagc

SEQ ID NO: 3507878 - DNA, 22 bp, Homo sapiens
tcccaaccccagggcccccaca

SEQ ID NO: 3507879 - DNA, 23 bp, Homo sapiens
tcccaaccccagggcccccacag

SEQ ID NO: 3507880 - DNA, 21 bp, Homo sapiens
tcccaaccccttaagccctgg

SEQ ID NO: 3507881 - DNA, 14 bp, Homo sapiens
tcccaactctagct

SEQ ID NO: 3507882 - DNA, 12 bp, Homo sapiens
tcccaagctctg

SEQ ID NO: 3507883 - DNA, 14 bp, Homo sapiens
tcccaagctctgct

SEQ ID NO: 3507884 - DNA, 15 bp, Homo sapiens
tcccaagctctgctc

SEQ ID NO: 3507885 - DNA, 21 bp, Homo sapiens
tcccaaggtgaaatgaagcaa

SEQ ID NO: 3507886 - DNA, 17 bp, Homo sapiens
tcccaaggttggagccc

SEQ ID NO: 3507887 - DNA, 16 bp, Homo sapiens
tcccaatcttcttttt

SEQ ID NO: 3507888 - DNA, 23 bp, Homo sapiens
tcccaatttcagactcccattcc

SEQ ID NO: 3507889 - DNA, 16 bp, Homo sapiens
tcccacaagtggtggt

SEQ ID NO: 3507890 - DNA, 17 bp, Homo sapiens
tcccacacaagacccaa

SEQ ID NO: 3507891 - DNA, 23 bp, Homo sapiens
tcccacacaagacccaagtagct

SEQ ID NO: 3507892 - DNA, 17 bp, Homo sapiens
tcccaccctgctgctgc

SEQ ID NO: 3507893 - DNA, 15 bp, Homo sapiens
tcccacctcagcctc

SEQ ID NO: 3507894 - DNA, 13 bp, Homo sapiens
tcccaccttggct

SEQ ID NO: 3507895 - DNA, 19 bp, Homo sapiens
tcccaccttggctgcaggg

SEQ ID NO: 3507896 - DNA, 17 bp, Homo sapiens
tcccactcaagccaagc

SEQ ID NO: 3507897 - DNA, 18 bp, Homo sapiens
tcccactcaagccaagca

SEQ ID NO: 3507898 - DNA, 22 bp, Homo sapiens
tcccactggggtccagggagca

SEQ ID NO: 3507899 - DNA, 19 bp, Homo sapiens
tcccagagctggtggaccc

SEQ ID NO: 3507900 - DNA, 17 bp, Homo sapiens
tcccagaggctgcccca

SEQ ID NO: 3507901 - DNA, 16 bp, Homo sapiens
tcccagataatgtgaa

SEQ ID NO: 3507902 - DNA, 18 bp, Homo sapiens
tcccagatacttgggggg

SEQ ID NO: 3507903 - DNA, 18 bp, Homo sapiens
tcccagattggctcacac

SEQ ID NO: 3507904 - DNA, 22 bp, Homo sapiens
tcccagcactatgctttccttc

SEQ ID NO: 3507905 - DNA, 16 bp, Homo sapiens
tcccagcactttggga

SEQ ID NO: 3507906 - DNA, 16 bp, Homo sapiens
tcccagctacttggga

SEQ ID NO: 3507907 - DNA, 18 bp, Homo sapiens
tcccagctacttgggagg

SEQ ID NO: 3507908 - DNA, 23 bp, Homo sapiens
tcccagctaggaagagcaggact

SEQ ID NO: 3507909 - DNA, 21 bp, Homo sapiens
tcccagctgtgctctggacag

SEQ ID NO: 3507910 - DNA, 11 bp, Homo sapiens
tcccaggaccc

SEQ ID NO: 3507911 - DNA, 22 bp, Homo sapiens
tcccaggatgagcatcccagga

SEQ ID NO: 3507912 - DNA, 17 bp, Homo sapiens
tcccaggcccctggagg

SEQ ID NO: 3507913 - DNA, 22 bp, Homo sapiens
tcccaggcccctggaggctgcc

SEQ ID NO: 3507914 - DNA, 17 bp, Homo sapiens
tcccaggtgcagccaga

SEQ ID NO: 3507915 - DNA, 18 bp, Homo sapiens
tcccagtggctgctgccc

SEQ ID NO: 3507916 - DNA, 13 bp, Homo sapiens
tcccagttttgtt

SEQ ID NO: 3507917 - DNA, 18 bp, Homo sapiens
tcccatagatactctctt

SEQ ID NO: 3507918 - DNA, 14 bp, Homo sapiens
tcccatcaaaactc

SEQ ID NO: 3507919 - DNA, 20 bp, Homo sapiens
tcccatgacccaggctgggc

SEQ ID NO: 3507920 - DNA, 16 bp, Homo sapiens
tcccatgagcctcagc

SEQ ID NO: 3507921 - DNA, 17 bp, Homo sapiens
tcccatgagcctcagca

SEQ ID NO: 3507922 - DNA, 12 bp, Homo sapiens
tcccatgatgta

SEQ ID NO: 3507923 - DNA, 15 bp, Homo sapiens
tcccattcctgaaga

SEQ ID NO: 3507924 - DNA, 19 bp, Homo sapiens
tccccaaatccgaacctcc

SEQ ID NO: 3507925 - DNA, 20 bp, Homo sapiens
tccccaataattgcagaact

SEQ ID NO: 3507926 - DNA, 12 bp, Homo sapiens
tccccacagaac

SEQ ID NO: 3507927 - DNA, 12 bp, Homo sapiens
tccccaccctga

SEQ ID NO: 3507928 - DNA, 16 bp, Homo sapiens
tccccacgagggctgg

SEQ ID NO: 3507929 - DNA, 16 bp, Homo sapiens
tccccactgacagcct

SEQ ID NO: 3507930 - DNA, 15 bp, Homo sapiens
tccccactgtatcta

SEQ ID NO: 3507931 - DNA, 19 bp, Homo sapiens
tccccactgtatctaggca

SEQ ID NO: 3507932 - DNA, 14 bp, Homo sapiens
tctccaaaccactt

SEQ ID NO: 3507933 - DNA, 18 bp, Homo sapiens
tctccaaccccccagcac

SEQ ID NO: 3507934 - DNA, 22 bp, Homo sapiens
tctccaaccccccagcactgag

SEQ ID NO: 3507935 - DNA, 22 bp, Homo sapiens
tctccacagggcttgttttcca

SEQ ID NO: 3507936 - DNA, 12 bp, Homo sapiens
tctccaccctgc

SEQ ID NO: 3507937 - DNA, 13 bp, Homo sapiens
tctccaccctgct

SEQ ID NO: 3507938 - DNA, 15 bp, Homo sapiens
tctccagatgtttcc

SEQ ID NO: 3507939 - DNA, 17 bp, Homo sapiens
tctccaggggctgcttc

SEQ ID NO: 3507940 - DNA, 22 bp, Homo sapiens
tctccaggggctgcttcctcct

SEQ ID NO: 3507941 - DNA, 23 bp, Homo sapiens
tctccaggggctgcttcctcctg

SEQ ID NO: 3507942 - DNA, 15 bp, Homo sapiens
tctccatggccctgc

SEQ ID NO: 3507943 - DNA, 18 bp, Homo sapiens
tctccatggccctgcaaa

SEQ ID NO: 3507944 - DNA, 15 bp, Homo sapiens
tctccattttagccc

SEQ ID NO: 3507945 - DNA, 18 bp, Homo sapiens
tctcccagataatgtgaa

SEQ ID NO: 3507946 - DNA, 19 bp, Homo sapiens
tctcccatctcttccttga

SEQ ID NO: 3507947 - DNA, 19 bp, Homo sapiens
tctccccaatgagacttgc

SEQ ID NO: 3507948 - DNA, 14 bp, Homo sapiens
tctccccagcccag

SEQ ID NO: 3507949 - DNA, 15 bp, Homo sapiens
tctccccagcccaga

SEQ ID NO: 3507950 - DNA, 19 bp, Homo sapiens
tctccccagcccagagaca

SEQ ID NO: 3507951 - DNA, 12 bp, Homo sapiens
tctcccccaccc

SEQ ID NO: 3507952 - DNA, 19 bp, Homo sapiens
tctcccccaccccctcccc

SEQ ID NO: 3507953 - DNA, 20 bp, Homo sapiens
tctcccccaccccctccccg

SEQ ID NO: 3507954 - DNA, 14 bp, Homo sapiens
tctcccctcagctc

SEQ ID NO: 3507955 - DNA, 15 bp, Homo sapiens
tctcccctgccccca

SEQ ID NO: 3507956 - DNA, 23 bp, Homo sapiens
tctcccctgcccccaggactggg

SEQ ID NO: 3507957 - DNA, 18 bp, Homo sapiens
tctccctcccctgccatt

SEQ ID NO: 3507958 - DNA, 22 bp, Homo sapiens
tctccctctaggctctgccttc

SEQ ID NO: 3507959 - DNA, 13 bp, Homo sapiens
tctccctgggcct

SEQ ID NO: 3507960 - DNA, 14 bp, Homo sapiens
tctccggctcccag

SEQ ID NO: 3507961 - DNA, 18 bp, Homo sapiens
tctccggctcccagcctc

SEQ ID NO: 3507962 - DNA, 16 bp, Homo sapiens
tctccgttagctcctg

SEQ ID NO: 3507963 - DNA, 17 bp, Homo sapiens
tctccgttagctcctgt

SEQ ID NO: 3507964 - DNA, 18 bp, Homo sapiens
tctccgttagctcctgtg

SEQ ID NO: 3507965 - DNA, 14 bp, Homo sapiens
tctcctatgtgtaa

SEQ ID NO: 3507966 - DNA, 16 bp, Homo sapiens
tctcctcatgttctgc

SEQ ID NO: 3507967 - DNA, 17 bp, Homo sapiens
tctcctccgtggcacat

SEQ ID NO: 3507968 - DNA, 16 bp, Homo sapiens
tctcctcctgcccacc

SEQ ID NO: 3507969 - DNA, 22 bp, Homo sapiens
tctcctctccattttagcccag

SEQ ID NO: 3507970 - DNA, 15 bp, Homo sapiens
tctcctcttgtaaat

SEQ ID NO: 3507971 - DNA, 14 bp, Homo sapiens
tctcctgcctcagc

SEQ ID NO: 3507972 - DNA, 19 bp, Homo sapiens
tctcctgcctcagcctccc

SEQ ID NO: 3507973 - DNA, 12 bp, Homo sapiens
tctcctgccttt

SEQ ID NO: 3507974 - DNA, 17 bp, Homo sapiens
tctcctgcctttgcctc

SEQ ID NO: 3507975 - DNA, 19 bp, Homo sapiens
tctcctggagttgcattga

SEQ ID NO: 3507976 - DNA, 15 bp, Homo sapiens
tctcctgtcctccct

SEQ ID NO: 3507977 - DNA, 17 bp, Homo sapiens
tctcctgtcctccctca

SEQ ID NO: 3507978 - DNA, 13 bp, Homo sapiens
tctccttcctgtg

SEQ ID NO: 3507979 - DNA, 14 bp, Homo sapiens
tctccttggaggac

SEQ ID NO: 3507980 - DNA, 19 bp, Homo sapiens
tctcctttcaccaccccct

SEQ ID NO: 3507981 - DNA, 16 bp, Homo sapiens
tctcgcataggacctt

SEQ ID NO: 3507982 - DNA, 13 bp, Homo sapiens
tctcgccaagcag

SEQ ID NO: 3507983 - DNA, 16 bp, Homo sapiens
tctcgctccctcccag

SEQ ID NO: 3507984 - DNA, 21 bp, Homo sapiens
tctcggaactgcatgctgctg

SEQ ID NO: 3507985 - DNA, 20 bp, Homo sapiens
tctcggcttggatcctgggc

SEQ ID NO: 3507986 - DNA, 23 bp, Homo sapiens
tctcgggttctctctctctgtct

SEQ ID NO: 3507987 - DNA, 19 bp, Homo sapiens
tctctaaagagtttatttt

SEQ ID NO: 3507988 - DNA, 22 bp, Homo sapiens
tctctaaagagtttattttaag

SEQ ID NO: 3507989 - DNA, 22 bp, Homo sapiens
tctctaactcagaaacatcagt

SEQ ID NO: 3507990 - DNA, 16 bp, Homo sapiens
tctctacccatctccc

SEQ ID NO: 3507991 - DNA, 14 bp, Homo sapiens
tctctaggctgggg

SEQ ID NO: 3507992 - DNA, 13 bp, Homo sapiens
tctctataaaaaa

SEQ ID NO: 3507993 - DNA, 13 bp, Homo sapiens
tctctatttgaga

SEQ ID NO: 3507994 - DNA, 22 bp, Homo sapiens
tctctcaaacggcaacattcct

SEQ ID NO: 3507995 - DNA, 19 bp, Homo sapiens
tctctcaaccttggccttc

SEQ ID NO: 3507996 - DNA, 14 bp, Homo sapiens
tctctcatctctta

SEQ ID NO: 3507997 - DNA, 13 bp, Homo sapiens
tctctccagatgt

SEQ ID NO: 3507998 - DNA, 16 bp, Homo sapiens
tctctccagatgtttc

SEQ ID NO: 3507999 - DNA, 21 bp, Homo sapiens
tctctccctcccctgccattt

SEQ ID NO: 3508000 - DNA, 11 bp, Homo sapiens
tctctcctcct

SEQ ID NO: 3508001 - DNA, 14 bp, Homo sapiens
tctctctgcccaac

SEQ ID NO: 3508002 - DNA, 12 bp, Homo sapiens
tctctcttctta

SEQ ID NO: 3508003 - DNA, 22 bp, Homo sapiens
tctctcttgggccaagccagct

SEQ ID NO: 3508004 - DNA, 11 bp, Homo sapiens
tctctgaaccc

SEQ ID NO: 3508005 - DNA, 20 bp, Homo sapiens
tctctgcatttttctgcaga

SEQ ID NO: 3508006 - DNA, 12 bp, Homo sapiens
tctctgccctgt

SEQ ID NO: 3508007 - DNA, 12 bp, Homo sapiens
tctctgccttgc

SEQ ID NO: 3508008 - DNA, 17 bp, Homo sapiens
tctctgccttgccttta

SEQ ID NO: 3508009 - DNA, 18 bp, Homo sapiens
tctctgctctgcgtgtca

SEQ ID NO: 3508010 - DNA, 22 bp, Homo sapiens
tctctgctctgcgtgtcacctg

SEQ ID NO: 3508011 - DNA, 23 bp, Homo sapiens
tctctgctctgcgtgtcacctgt

SEQ ID NO: 3508012 - DNA, 13 bp, Homo sapiens
tctctgctgccgc

SEQ ID NO: 3508013 - DNA, 14 bp, Homo sapiens
tctctgctggccca

SEQ ID NO: 3508014 - DNA, 15 bp, Homo sapiens
tctctgctggcccag

SEQ ID NO: 3508015 - DNA, 19 bp, Homo sapiens
tctctgctggcccagccaa

SEQ ID NO: 3508016 - DNA, 14 bp, Homo sapiens
tctctggatgcctg

SEQ ID NO: 3508017 - DNA, 22 bp, Homo sapiens
tctctggcgacagttttccttc

SEQ ID NO: 3508018 - DNA, 12 bp, Homo sapiens
tctctgggctgc

SEQ ID NO: 3508019 - DNA, 22 bp, Homo sapiens
tctctgtccagcagtcacttcg

SEQ ID NO: 3508020 - DNA, 16 bp, Homo sapiens
tctctgtcccttgctg

SEQ ID NO: 3508021 - DNA, 18 bp, Homo sapiens
tctctgtcccttgctgta

SEQ ID NO: 3508022 - DNA, 20 bp, Homo sapiens
tctctgtcccttgctgtatg

SEQ ID NO: 3508023 - DNA, 15 bp, Homo sapiens
tctctgtctcatcca

SEQ ID NO: 3508024 - DNA, 21 bp, Homo sapiens
tctctgtctcatccatcatca

SEQ ID NO: 3508025 - DNA, 23 bp, Homo sapiens
tctctgtctcatccatcatcatg

SEQ ID NO: 3508026 - DNA, 23 bp, Homo sapiens
tctctgtgaacgatttagaaaga

SEQ ID NO: 3508027 - DNA, 14 bp, Homo sapiens
tctctgtgagactc

SEQ ID NO: 3508028 - DNA, 17 bp, Homo sapiens
tctctgtgccttcgtct

SEQ ID NO: 3508029 - DNA, 14 bp, Homo sapiens
tctctgttccatgt

SEQ ID NO: 3508030 - DNA, 22 bp, Homo sapiens
tctctgttccatgtctccttta

SEQ ID NO: 3508031 - DNA, 18 bp, Homo sapiens
tctctgttgactggctgt

SEQ ID NO: 3508032 - DNA, 19 bp, Homo sapiens
tctcttagctcccctccaa

SEQ ID NO: 3508033 - DNA, 15 bp, Homo sapiens
tctcttatagaatat

SEQ ID NO: 3508034 - DNA, 18 bp, Homo sapiens
tctcttatagaatattta

SEQ ID NO: 3508035 - DNA, 17 bp, Homo sapiens
tctcttccctgcgcctg

SEQ ID NO: 3508036 - DNA, 14 bp, Homo sapiens
tctcttgagtttgt

SEQ ID NO: 3508037 - DNA, 22 bp, Homo sapiens
tctcttgggccaagccagctgc

SEQ ID NO: 3508038 - DNA, 23 bp, Homo sapiens
tctcttgggccaagccagctgcc

SEQ ID NO: 3508039 - DNA, 20 bp, Homo sapiens
tctctttaatgtcacaggca

SEQ ID NO: 3508040 - DNA, 16 bp, Homo sapiens
tctctttattttacta

SEQ ID NO: 3508041 - DNA, 22 bp, Homo sapiens
tctcttttccactccattgtcg

SEQ ID NO: 3508042 - DNA, 22 bp, Homo sapiens
tctcttttcccctttcctgtcc

SEQ ID NO: 3508043 - DNA, 10 bp, Homo sapiens
tctgaaacag

SEQ ID NO: 3508044 - DNA, 15 bp, Homo sapiens
tctgaaacagctgcc

SEQ ID NO: 3508045 - DNA, 22 bp, Homo sapiens
tctgaaacagctgccttagctt

SEQ ID NO: 3508046 - DNA, 20 bp, Homo sapiens
tctgaaaccagtgttaggga

SEQ ID NO: 3508047 - DNA, 15 bp, Homo sapiens
tctgaaaccttagtt

SEQ ID NO: 3508048 - DNA, 22 bp, Homo sapiens
tctgaaaccttagtttcaagag

SEQ ID NO: 3508049 - DNA, 15 bp, Homo sapiens
tctgaaagttgtaca

SEQ ID NO: 3508050 - DNA, 20 bp, Homo sapiens
tctgaatgggcaattccaga

SEQ ID NO: 3508051 - DNA, 21 bp, Homo sapiens
tctgaattttggggattttca

SEQ ID NO: 3508052 - DNA, 16 bp, Homo sapiens
tctgacacacagctct

SEQ ID NO: 3508053 - DNA, 17 bp, Homo sapiens
tctgacacacagctctg

SEQ ID NO: 3508054 - DNA, 18 bp, Homo sapiens
tctgacacacagctctgt

SEQ ID NO: 3508055 - DNA, 22 bp, Homo sapiens
tctgacaggcaatgctggctgt

SEQ ID NO: 3508056 - DNA, 17 bp, Homo sapiens
tctgacagtttttctgt

SEQ ID NO: 3508057 - DNA, 20 bp, Homo sapiens
tctgacagtttttctgtttt

SEQ ID NO: 3508058 - DNA, 18 bp, Homo sapiens
tctgacatgattccttcc

SEQ ID NO: 3508059 - DNA, 19 bp, Homo sapiens
tctgacatgattccttcct

SEQ ID NO: 3508060 - DNA, 22 bp, Homo sapiens
tctgacatgattccttcctgtt

SEQ ID NO: 3508061 - DNA, 16 bp, Homo sapiens
tctgaccagcagcgcc

SEQ ID NO: 3508062 - DNA, 15 bp, Homo sapiens
tctgacccactgctt

SEQ ID NO: 3508063 - DNA, 13 bp, Homo sapiens
tctgacccagtgc

SEQ ID NO: 3508064 - DNA, 12 bp, Homo sapiens
tgaaacagaaaa

SEQ ID NO: 3508065 - DNA, 23 bp, Homo sapiens
tgaaacagaaaaatatgtaccaa

SEQ ID NO: 3508066 - DNA, 11 bp, Homo sapiens
tgaaacagctg

SEQ ID NO: 3508067 - DNA, 19 bp, Homo sapiens
tgaaacagctgccttagct

SEQ ID NO: 3508068 - DNA, 22 bp, Homo sapiens
tgaaacagctgccttagcttca

SEQ ID NO: 3508069 - DNA, 23 bp, Homo sapiens
tgaaacagctgccttagcttcag

SEQ ID NO: 3508070 - DNA, 21 bp, Homo sapiens
tgaaactatattttgtcatat

SEQ ID NO: 3508071 - DNA, 15 bp, Homo sapiens
tgaaactcatctcat

SEQ ID NO: 3508072 - DNA, 16 bp, Homo sapiens
tgaaactttgctttgg

SEQ ID NO: 3508073 - DNA, 17 bp, Homo sapiens
tgaaaggaacatttttt

SEQ ID NO: 3508074 - DNA, 16 bp, Homo sapiens
tgaaagggcccagaga

SEQ ID NO: 3508075 - DNA, 15 bp, Homo sapiens
tgaaaggtttacatt

SEQ ID NO: 3508076 - DNA, 16 bp, Homo sapiens
tgaaagtgacagagac

SEQ ID NO: 3508077 - DNA, 13 bp, Homo sapiens
tgaaagttgccat

SEQ ID NO: 3508078 - DNA, 19 bp, Homo sapiens
tgaaagttgccattattct

SEQ ID NO: 3508079 - DNA, 22 bp, Homo sapiens
tgaaagttgccattattctatg

SEQ ID NO: 3508080 - DNA, 14 bp, Homo sapiens
tgaaagttgtacat

SEQ ID NO: 3508081 - DNA, 19 bp, Homo sapiens
tgaaagttgtacatgaaat

SEQ ID NO: 3508082 - DNA, 19 bp, Homo sapiens
tgaaataaaattacacagt

SEQ ID NO: 3508083 - DNA, 18 bp, Homo sapiens
tgaaataaattctgattc

SEQ ID NO: 3508084 - DNA, 19 bp, Homo sapiens
tgaaatagttcaaagccaa

SEQ ID NO: 3508085 - DNA, 17 bp, Homo sapiens
tgaaatatcctgcttga

SEQ ID NO: 3508086 - DNA, 21 bp, Homo sapiens
tgaaatatgctcttttgtttg

SEQ ID NO: 3508087 - DNA, 18 bp, Homo sapiens
tgaaatatgctggctgga

SEQ ID NO: 3508088 - DNA, 18 bp, Homo sapiens
tgaaatatgtgaagccca

SEQ ID NO: 3508089 - DNA, 17 bp, Homo sapiens
tgaaatattgctgtata

SEQ ID NO: 3508090 - DNA, 21 bp, Homo sapiens
tgaaatctgtcaagagtagtt

SEQ ID NO: 3508091 - DNA, 13 bp, Homo sapiens
tgaaatgaagcaa

SEQ ID NO: 3508092 - DNA, 21 bp, Homo sapiens
tgaaatgaggcctactctaaa

SEQ ID NO: 3508093 - DNA, 19 bp, Homo sapiens
tgaaatggacttttgtaca

SEQ ID NO: 3508094 - DNA, 19 bp, Homo sapiens
tgaaatgtggttttcctga

SEQ ID NO: 3508095 - DNA, 18 bp, Homo sapiens
tgaaattaaccatagatg

SEQ ID NO: 3508096 - DNA, 22 bp, Homo sapiens
tgaaattaaccatagatgtaga

SEQ ID NO: 3508097 - DNA, 11 bp, Homo sapiens
tgaaattctga

SEQ ID NO: 3508098 - DNA, 12 bp, Homo sapiens
tgaaattctgaa

SEQ ID NO: 3508099 - DNA, 19 bp, Homo sapiens
tgaaattctgaatttgcaa

SEQ ID NO: 3508100 - DNA, 22 bp, Homo sapiens
tgaaattctgaatttgcaaagt

SEQ ID NO: 3508101 - DNA, 14 bp, Homo sapiens
tgaacaaagcagcc

SEQ ID NO: 3508102 - DNA, 15 bp, Homo sapiens
tgaacaaagcagcca

SEQ ID NO: 3508103 - DNA, 23 bp, Homo sapiens
tgaacaagcaaacccagacggct

SEQ ID NO: 3508104 - DNA, 23 bp, Homo sapiens
tgaacaagtgggccattagccag

SEQ ID NO: 3508105 - DNA, 17 bp, Homo sapiens
tgaacattagttgcact

SEQ ID NO: 3508106 - DNA, 18 bp, Homo sapiens
tgaacattagttgcacta

SEQ ID NO: 3508107 - DNA, 13 bp, Homo sapiens
tgaaccaatgcaa

SEQ ID NO: 3508108 - DNA, 22 bp, Homo sapiens
tgaaccacatcttgctctgctg

SEQ ID NO: 3508109 - DNA, 23 bp, Homo sapiens
tgaaccacatcttgctctgctga

SEQ ID NO: 3508110 - DNA, 22 bp, Homo sapiens
tgaaccaccacacccagcccac

SEQ ID NO: 3508111 - DNA, 12 bp, Homo sapiens
tgaaccctcagc

SEQ ID NO: 3508112 - DNA, 18 bp, Homo sapiens
tgaactcactttcctcct

SEQ ID NO: 3508113 - DNA, 15 bp, Homo sapiens
tgaactcctggcctc

SEQ ID NO: 3508114 - DNA, 16 bp, Homo sapiens
tgaactctgggctcaa

SEQ ID NO: 3508115 - DNA, 20 bp, Homo sapiens
tgaactgagcctagctacct

SEQ ID NO: 3508116 - DNA, 21 bp, Homo sapiens
tgaactggaccctgttgctaa

SEQ ID NO: 3508117 - DNA, 21 bp, Homo sapiens
tgaacttgaaatatcctgctt

SEQ ID NO: 3508118 - DNA, 16 bp, Homo sapiens
tgaacttgcctctttt

SEQ ID NO: 3508119 - DNA, 20 bp, Homo sapiens
tgaacttgcctcttttacct

SEQ ID NO: 3508120 - DNA, 18 bp, Homo sapiens
tgaactttgggaagcctt

SEQ ID NO: 3508121 - DNA, 13 bp, Homo sapiens
tgaagaacagtaa

SEQ ID NO: 3508122 - DNA, 19 bp, Homo sapiens
tgaagaaccagtcccccca

SEQ ID NO: 3508123 - DNA, 20 bp, Homo sapiens
tgaagaaccagtccccccac

SEQ ID NO: 3508124 - DNA, 16 bp, Homo sapiens
tgaagaactgcaggcc

SEQ ID NO: 3508125 - DNA, 17 bp, Homo sapiens
tgaagaactgcaggccc

SEQ ID NO: 3508126 - DNA, 21 bp, Homo sapiens
tgaagaatataccatttcaaa

SEQ ID NO: 3508127 - DNA, 21 bp, Homo sapiens
tgaagaatccttttgtagaat

SEQ ID NO: 3508128 - DNA, 21 bp, Homo sapiens
tgaagaatctgtttcccagca

SEQ ID NO: 3508129 - DNA, 19 bp, Homo sapiens
tgaagacacctgcagcctt

SEQ ID NO: 3508130 - DNA, 18 bp, Homo sapiens
tgaagactggaagctaat

SEQ ID NO: 3508131 - DNA, 19 bp, Homo sapiens
tgaagacttaaaagagctc

SEQ ID NO: 3508132 - DNA, 13 bp, Homo sapiens
tgaagagaaaaaa

SEQ ID NO: 3508133 - DNA, 14 bp, Homo sapiens
tgaagagaaaaaag

SEQ ID NO: 3508134 - DNA, 21 bp, Homo sapiens
tgaagagaaaaaggctgaaaa

SEQ ID NO: 3508135 - DNA, 17 bp, Homo sapiens
tgaagagccagcccaag

SEQ ID NO: 3508136 - DNA, 23 bp, Homo sapiens
tgaagagtaagtcaacctgcctg

SEQ ID NO: 3508137 - DNA, 17 bp, Homo sapiens
tgaagagtcctctgaat

SEQ ID NO: 3508138 - DNA, 23 bp, Homo sapiens
tgaagagtcctctgaatgaacct

SEQ ID NO: 3508139 - DNA, 22 bp, Homo sapiens
tgaagagttgccccgtctctgt

SEQ ID NO: 3508140 - DNA, 16 bp, Homo sapiens
tgaagattctttccca

SEQ ID NO: 3508141 - DNA, 13 bp, Homo sapiens
tgaagatttcaga

SEQ ID NO: 3508142 - DNA, 20 bp, Homo sapiens
tgaagatttcagaggctgca

SEQ ID NO: 3508143 - DNA, 17 bp, Homo sapiens
tgaagcaccaagctcaa

SEQ ID NO: 3508144 - DNA, 22 bp, Homo sapiens
tgaagcagatgcaaagaggcaa

SEQ ID NO: 3508145 - DNA, 19 bp, Homo sapiens
tgaagcaggttcccaagct

SEQ ID NO: 3508146 - DNA, 20 bp, Homo sapiens
tgaagcaggttcccaagctc

SEQ ID NO: 3508147 - DNA, 23 bp, Homo sapiens
tgaagccagctcacagtgctgtg

SEQ ID NO: 3508148 - DNA, 19 bp, Homo sapiens
tgaaggacattgcggacag

SEQ ID NO: 3508149 - DNA, 20 bp, Homo sapiens
tgaaggacattgcggacagc

SEQ ID NO: 3508150 - DNA, 22 bp, Homo sapiens
tgaaggagccccattcctggga

SEQ ID NO: 3508151 - DNA, 23 bp, Homo sapiens
tgaaggagccccattcctgggaa

SEQ ID NO: 3508152 - DNA, 17 bp, Homo sapiens
tgaaggcaaaattgcaa

SEQ ID NO: 3508153 - DNA, 14 bp, Homo sapiens
tgaaggccctgctg

SEQ ID NO: 3508154 - DNA, 11 bp, Homo sapiens
tgaaggctggc

SEQ ID NO: 3508155 - DNA, 13 bp, Homo sapiens
tgaaggctggcat

SEQ ID NO: 3508156 - DNA, 16 bp, Homo sapiens
tgaaggctggcatgat

SEQ ID NO: 3508157 - DNA, 12 bp, Homo sapiens
tgaagggccaga

SEQ ID NO: 3508158 - DNA, 17 bp, Homo sapiens
tgaagggccagagccag

SEQ ID NO: 3508159 - DNA, 22 bp, Homo sapiens
tgaaggggccaaggagggtgag

SEQ ID NO: 3508160 - DNA, 10 bp, Homo sapiens
tgaaggggcg

SEQ ID NO: 3508161 - DNA, 15 bp, Homo sapiens
tgaaggtgctgacgg

SEQ ID NO: 3508162 - DNA, 20 bp, Homo sapiens
tgaaggtgctgacggccagg

SEQ ID NO: 3508163 - DNA, 23 bp, Homo sapiens
tgaaggtttacaatttacaaagt

SEQ ID NO: 3508164 - DNA, 12 bp, Homo sapiens
tgaagtaccacc

SEQ ID NO: 3508165 - DNA, 21 bp, Homo sapiens
tgaagtcgtcttaactcacca

SEQ ID NO: 3508166 - DNA, 18 bp, Homo sapiens
tgaagtgttctgagctgt

SEQ ID NO: 3508167 - DNA, 18 bp, Homo sapiens
tgaagttgttactaacta

SEQ ID NO: 3508168 - DNA, 19 bp, Homo sapiens
tgaagtttccttggctggt

SEQ ID NO: 3508169 - DNA, 18 bp, Homo sapiens
tgaagtttgaatgttaaa

SEQ ID NO: 3508170 - DNA, 21 bp, Homo sapiens
tgaagtttgaatgttaaataa

SEQ ID NO: 3508171 - DNA, 17 bp, Homo sapiens
tgaagttttacattgtt

SEQ ID NO: 3508172 - DNA, 20 bp, Homo sapiens
tgaatactctgccctctaga

SEQ ID NO: 3508173 - DNA, 22 bp, Homo sapiens
tgaatactctgccctctagagc

SEQ ID NO: 3508174 - DNA, 16 bp, Homo sapiens
tgaatactgtattttg

SEQ ID NO: 3508175 - DNA, 18 bp, Homo sapiens
tgaatacttacattctct

SEQ ID NO: 3508176 - DNA, 20 bp, Homo sapiens
tgaatattttatctttcctt

SEQ ID NO: 3508177 - DNA, 16 bp, Homo sapiens
tgaatcagtataaaca

SEQ ID NO: 3508178 - DNA, 21 bp, Homo sapiens
tgaatcagtataaacaaagtt

SEQ ID NO: 3508179 - DNA, 22 bp, Homo sapiens
tgaatcagtataaacaaagtta

SEQ ID NO: 3508180 - DNA, 22 bp, Homo sapiens
tgaatctatgctggtgaaaaca

SEQ ID NO: 3508181 - DNA, 16 bp, Homo sapiens
tgaatctatttaagta

SEQ ID NO: 3508182 - DNA, 23 bp, Homo sapiens
tgaatcttgtctcaatgctcata

SEQ ID NO: 3508183 - DNA, 15 bp, Homo sapiens
tgaatgaacccctgg

SEQ ID NO: 3508184 - DNA, 21 bp, Homo sapiens
tgaatgaacccctggctcctt

SEQ ID NO: 3508185 - DNA, 16 bp, Homo sapiens
tgaatgaaccttctgg

SEQ ID NO: 3508186 - DNA, 18 bp, Homo sapiens
tgaatgagaatgtgccat

SEQ ID NO: 3508187 - DNA, 16 bp, Homo sapiens
tgaatgattcagtgtt

SEQ ID NO: 3508188 - DNA, 18 bp, Homo sapiens
tgaatgatttgtgtttct

SEQ ID NO: 3508189 - DNA, 13 bp, Homo sapiens
tgaatgcattttg

SEQ ID NO: 3508190 - DNA, 21 bp, Homo sapiens
tgaatgcattttgtttggtat

SEQ ID NO: 3508191 - DNA, 21 bp, Homo sapiens
tgaatgccactgccttcgctt

SEQ ID NO: 3508192 - DNA, 21 bp, Homo sapiens
tgaatgccgcgatgggtcagg

SEQ ID NO: 3508193 - DNA, 11 bp, Homo sapiens
tgaatgctggg

SEQ ID NO: 3508194 - DNA, 12 bp, Homo sapiens
tgaatgctggga

SEQ ID NO: 3508195 - DNA, 11 bp, Homo sapiens
tgactttgtct

SEQ ID NO: 3508196 - DNA, 22 bp, Homo sapiens
tgacttttctgtccgagctttg

SEQ ID NO: 3508197 - DNA, 14 bp, Homo sapiens
tgacttttctgtgg

SEQ ID NO: 3508198 - DNA, 19 bp, Homo sapiens
tgactttttataaaatggc

SEQ ID NO: 3508199 - DNA, 23 bp, Homo sapiens
tgagaaaccttattgtacctctc

SEQ ID NO: 3508200 - DNA, 13 bp, Homo sapiens
tgagaaagagcac

SEQ ID NO: 3508201 - DNA, 21 bp, Homo sapiens
tgagaaagccctgtcgggctt

SEQ ID NO: 3508202 - DNA, 14 bp, Homo sapiens
tgagaaagccttct

SEQ ID NO: 3508203 - DNA, 16 bp, Homo sapiens
tgagaaagccttcttt

SEQ ID NO: 3508204 - DNA, 23 bp, Homo sapiens
tgagaacctgggttgcagacagg

SEQ ID NO: 3508205 - DNA, 17 bp, Homo sapiens
tgagaagaaaacatcta

SEQ ID NO: 3508206 - DNA, 22 bp, Homo sapiens
tgagaagaaaatggaaccaggc

SEQ ID NO: 3508207 - DNA, 19 bp, Homo sapiens
tgagaaggtgttggacagg

SEQ ID NO: 3508208 - DNA, 16 bp, Homo sapiens
tgagaagtagccacag

SEQ ID NO: 3508209 - DNA, 20 bp, Homo sapiens
tgagaatcagatcatttcaa

SEQ ID NO: 3508210 - DNA, 22 bp, Homo sapiens
tgagaatcccaaatttgattga

SEQ ID NO: 3508211 - DNA, 20 bp, Homo sapiens
tgagaatctttattgagaaa

SEQ ID NO: 3508212 - DNA, 22 bp, Homo sapiens
tgagaatctttattgagaaaga

SEQ ID NO: 3508213 - DNA, 12 bp, Homo sapiens
tgagaatgtgcc

SEQ ID NO: 3508214 - DNA, 13 bp, Homo sapiens
tgagaatgtgcca

SEQ ID NO: 3508215 - DNA, 16 bp, Homo sapiens
tgagaatgtgccatgt

SEQ ID NO: 3508216 - DNA, 18 bp, Homo sapiens
tgagaatgtgccatgtat

SEQ ID NO: 3508217 - DNA, 17 bp, Homo sapiens
tgagacacggagcccag

SEQ ID NO: 3508218 - DNA, 13 bp, Homo sapiens
tgagacagagtct

SEQ ID NO: 3508219 - DNA, 15 bp, Homo sapiens
tgagacagtcttgct

SEQ ID NO: 3508220 - DNA, 14 bp, Homo sapiens
tgagaccaacctgg

SEQ ID NO: 3508221 - DNA, 14 bp, Homo sapiens
tgagaccagcctgg

SEQ ID NO: 3508222 - DNA, 19 bp, Homo sapiens
tgagaccagcctggccaac

SEQ ID NO: 3508223 - DNA, 20 bp, Homo sapiens
tgagacccagccctcatccc

SEQ ID NO: 3508224 - DNA, 12 bp, Homo sapiens
tgagaccctgtc

SEQ ID NO: 3508225 - DNA, 19 bp, Homo sapiens
tgagactacaagtgtgtgc

SEQ ID NO: 3508226 - DNA, 14 bp, Homo sapiens
tgagactctgtctc

SEQ ID NO: 3508227 - DNA, 19 bp, Homo sapiens
tgagacttgccttcctaag

SEQ ID NO: 3508228 - DNA, 18 bp, Homo sapiens
tgagagacggtgtcttgt

SEQ ID NO: 3508229 - DNA, 18 bp, Homo sapiens
tgagagcgacacagacgt

SEQ ID NO: 3508230 - DNA, 22 bp, Homo sapiens
tgagaggtttgactagatgatg

SEQ ID NO: 3508231 - DNA, 21 bp, Homo sapiens
tgagagtcagctctctgccct

SEQ ID NO: 3508232 - DNA, 22 bp, Homo sapiens
tgagagttttggatgcagtgct

SEQ ID NO: 3508233 - DNA, 17 bp, Homo sapiens
tgagataatacattccg

SEQ ID NO: 3508234 - DNA, 21 bp, Homo sapiens
tgagatacatacagaattact

SEQ ID NO: 3508235 - DNA, 20 bp, Homo sapiens
tgagataccagcgaggaggc

SEQ ID NO: 3508236 - DNA, 15 bp, Homo sapiens
tgagatcaaaacggt

SEQ ID NO: 3508237 - DNA, 15 bp, Homo sapiens
tgagatcagcctggg

SEQ ID NO: 3508238 - DNA, 20 bp, Homo sapiens
tgagatgatacatccaaagc

SEQ ID NO: 3508239 - DNA, 15 bp, Homo sapiens
tgagatgctggcttg

SEQ ID NO: 3508240 - DNA, 18 bp, Homo sapiens
tgagattcaatattgaat

SEQ ID NO: 3508241 - DNA, 12 bp, Homo sapiens
tgagattgtcct

SEQ ID NO: 3508242 - DNA, 14 bp, Homo sapiens
tgagatttcatctg

SEQ ID NO: 3508243 - DNA, 22 bp, Homo sapiens
tgagatttcatctgctctcctt

SEQ ID NO: 3508244 - DNA, 22 bp, Homo sapiens
tgagatttttaaaaaatatttt

SEQ ID NO: 3508245 - DNA, 16 bp, Homo sapiens
tgagcaaatcaccaca

SEQ ID NO: 3508246 - DNA, 16 bp, Homo sapiens
tgagcaactcttgatt

SEQ ID NO: 3508247 - DNA, 16 bp, Homo sapiens
tgagcaccctctggat

SEQ ID NO: 3508248 - DNA, 24 bp, Homo sapiens
tgagcacctttggaaacaacattt

SEQ ID NO: 3508249 - DNA, 21 bp, Homo sapiens
tgagcactaaggtgtgctctg

SEQ ID NO: 3508250 - DNA, 23 bp, Homo sapiens
tgagcactaaggtgtgctctgat

SEQ ID NO: 3508251 - DNA, 20 bp, Homo sapiens
tgagcagagcccggagctcc

SEQ ID NO: 3508252 - DNA, 15 bp, Homo sapiens
tgagcagggctcagc

SEQ ID NO: 3508253 - DNA, 12 bp, Homo sapiens
tgagcatcacag

SEQ ID NO: 3508254 - DNA, 13 bp, Homo sapiens
tgagcatcacaga

SEQ ID NO: 3508255 - DNA, 19 bp, Homo sapiens
tgagcatgacagcctgcag

SEQ ID NO: 3508256 - DNA, 14 bp, Homo sapiens
tgagcatggagctg

SEQ ID NO: 3508257 - DNA, 19 bp, Homo sapiens
tgagccaagcttcaaccct

SEQ ID NO: 3508258 - DNA, 16 bp, Homo sapiens
tgagccaccacacctg

SEQ ID NO: 3508259 - DNA, 21 bp, Homo sapiens
tgagccactgcaccgggccac

SEQ ID NO: 3508260 - DNA, 20 bp, Homo sapiens
tgagccagccaggccctgcc

SEQ ID NO: 3508261 - DNA, 21 bp, Homo sapiens
tgagccagccaggccctgcca

SEQ ID NO: 3508262 - DNA, 17 bp, Homo sapiens
tgagcccagctgggtca

SEQ ID NO: 3508263 - DNA, 17 bp, Homo sapiens
tgagccctcagaaccct

SEQ ID NO: 3508264 - DNA, 20 bp, Homo sapiens
tgagccctcagaacccttgg

SEQ ID NO: 3508265 - DNA, 17 bp, Homo sapiens
tgagcctagccctggga

SEQ ID NO: 3508266 - DNA, 13 bp, Homo sapiens
tgagcctcagcat

SEQ ID NO: 3508267 - DNA, 18 bp, Homo sapiens
tgagcctcagcatcctgg

SEQ ID NO: 3508268 - DNA, 14 bp, Homo sapiens
tgagcctctgctcc

SEQ ID NO: 3508269 - DNA, 17 bp, Homo sapiens
tgagcctctgctcccca

SEQ ID NO: 3508270 - DNA, 18 bp, Homo sapiens
tgagcctctgctccccag

SEQ ID NO: 3508271 - DNA, 13 bp, Homo sapiens
tgagcctgctgga

SEQ ID NO: 3508272 - DNA, 17 bp, Homo sapiens
tgagcctgctggaagcc

SEQ ID NO: 3508273 - DNA, 11 bp, Homo sapiens
tgagcctggca

SEQ ID NO: 3508274 - DNA, 19 bp, Homo sapiens
tgagcctgggaggtcaagg

SEQ ID NO: 3508275 - DNA, 15 bp, Homo sapiens
tgagccttaagaaat

SEQ ID NO: 3508276 - DNA, 14 bp, Homo sapiens
tgagcgctcctgcc

SEQ ID NO: 3508277 - DNA, 18 bp, Homo sapiens
tgagcgctcctgccgcag

SEQ ID NO: 3508278 - DNA, 22 bp, Homo sapiens
tgagcgctcctgccgcagagct

SEQ ID NO: 3508279 - DNA, 14 bp, Homo sapiens
tgagctacaaatgc

SEQ ID NO: 3508280 - DNA, 19 bp, Homo sapiens
tgagctctacccagggcct

SEQ ID NO: 3508281 - DNA, 20 bp, Homo sapiens
tgagctctcggaactgcatg

SEQ ID NO: 3508282 - DNA, 11 bp, Homo sapiens
tgagctgcttc

SEQ ID NO: 3508283 - DNA, 14 bp, Homo sapiens
tgagctgcttcact

SEQ ID NO: 3508284 - DNA, 14 bp, Homo sapiens
tgagctgggccgga

SEQ ID NO: 3508285 - DNA, 18 bp, Homo sapiens
tgagctgggccggagggt

SEQ ID NO: 3508286 - DNA, 16 bp, Homo sapiens
tgagcttctctgtgaa

SEQ ID NO: 3508287 - DNA, 23 bp, Homo sapiens
tgaggaaaaaaatcgtccaggga

SEQ ID NO: 3508288 - DNA, 16 bp, Homo sapiens
tgaggaaaggccagct

SEQ ID NO: 3508289 - DNA, 18 bp, Homo sapiens
tgaggaaagtcattggct

SEQ ID NO: 3508290 - DNA, 21 bp, Homo sapiens
tgaggaaagtcattggcttta

SEQ ID NO: 3508291 - DNA, 17 bp, Homo sapiens
tgaggaagaacggggct

SEQ ID NO: 3508292 - DNA, 19 bp, Homo sapiens
tgaggaagaacggggctct

SEQ ID NO: 3508293 - DNA, 24 bp, Homo sapiens
tgaggaagaacggggctcttctca

SEQ ID NO: 3508294 - DNA, 17 bp, Homo sapiens
tgaggaagcgtgaaggc

SEQ ID NO: 3508295 - DNA, 17 bp, Homo sapiens
tgaggaatgtatatgtt

SEQ ID NO: 3508296 - DNA, 22 bp, Homo sapiens
tgaggaccccttaatcttgctt

SEQ ID NO: 3508297 - DNA, 18 bp, Homo sapiens
tgaggagaaatttgataa

SEQ ID NO: 3508298 - DNA, 23 bp, Homo sapiens
tgaggagaaatttgataatgaca

SEQ ID NO: 3508299 - DNA, 21 bp, Homo sapiens
tgaggagagaaaatatatgta

SEQ ID NO: 3508300 - DNA, 13 bp, Homo sapiens
tgaggagctgggg

SEQ ID NO: 3508301 - DNA, 21 bp, Homo sapiens
tgaggataaattgccataata

SEQ ID NO: 3508302 - DNA, 16 bp, Homo sapiens
tgaggcaagtgtgggc

SEQ ID NO: 3508303 - DNA, 15 bp, Homo sapiens
tgaggcatccagcag

SEQ ID NO: 3508304 - DNA, 15 bp, Homo sapiens
tgaggcatcctctga

SEQ ID NO: 3508305 - DNA, 12 bp, Homo sapiens
tgaggccacact

SEQ ID NO: 3508306 - DNA, 23 bp, Homo sapiens
tgaggccacactcagcacaaggc

SEQ ID NO: 3508307 - DNA, 13 bp, Homo sapiens
tgaggccagggca

SEQ ID NO: 3508308 - DNA, 16 bp, Homo sapiens
tgaggccagggcagag

SEQ ID NO: 3508309 - DNA, 14 bp, Homo sapiens
tgaggctggcacag

SEQ ID NO: 3508310 - DNA, 12 bp, Homo sapiens
tgagggccttct

SEQ ID NO: 3508311 - DNA, 14 bp, Homo sapiens
tgagggccttctta

SEQ ID NO: 3508312 - DNA, 15 bp, Homo sapiens
tgagggctgatcttt

SEQ ID NO: 3508313 - DNA, 18 bp, Homo sapiens
tgagggtatcaaataaaa

SEQ ID NO: 3508314 - DNA, 22 bp, Homo sapiens
tgagggtcattctttattcttt

SEQ ID NO: 3508315 - DNA, 14 bp, Homo sapiens
tgagggtgtttctt

SEQ ID NO: 3508316 - DNA, 17 bp, Homo sapiens
tgaggtcagagcctgca

SEQ ID NO: 3508317 - DNA, 12 bp, Homo sapiens
tgaggtgggagg

SEQ ID NO: 3508318 - DNA, 19 bp, Homo sapiens
tgaggtttcaaacctccct

SEQ ID NO: 3508319 - DNA, 17 bp, Homo sapiens
tgagtagaaaggccttt

SEQ ID NO: 3508320 - DNA, 14 bp, Homo sapiens
tgagtcaccaagcc

SEQ ID NO: 3508321 - DNA, 16 bp, Homo sapiens
tgagtcaccaagccca

SEQ ID NO: 3508322 - DNA, 20 bp, Homo sapiens
tgagtcaggtttgagtagag

SEQ ID NO: 3508323 - DNA, 13 bp, Homo sapiens
tgagtcctggccc

SEQ ID NO: 3508324 - DNA, 18 bp, Homo sapiens
tgagtcgaggacagggag

SEQ ID NO: 3508325 - DNA, 18 bp, Homo sapiens
tgagtctatgttcaaaga

SEQ ID NO: 3508326 - DNA, 21 bp, Homo sapiens
tgagtgaaatactgtacaggg

SEQ ID NO: 3508327 - DNA, 15 bp, Homo sapiens
tgctaagtgtgaact

SEQ ID NO: 3508328 - DNA, 16 bp, Homo sapiens
tgctaagtgtgaactg

SEQ ID NO: 3508329 - DNA, 16 bp, Homo sapiens
tgctaatttaaagaga

SEQ ID NO: 3508330 - DNA, 15 bp, Homo sapiens
tgctaccgttgactt

SEQ ID NO: 3508331 - DNA, 15 bp, Homo sapiens
tgctacctcccttgc

SEQ ID NO: 3508332 - DNA, 15 bp, Homo sapiens
tgctaccttctttgg

SEQ ID NO: 3508333 - DNA, 20 bp, Homo sapiens
tgctacgcctgcatgtaaac

SEQ ID NO: 3508334 - DNA, 16 bp, Homo sapiens
tgctactctgttcctt

SEQ ID NO: 3508335 - DNA, 21 bp, Homo sapiens
tgctactgtcctacccaccct

SEQ ID NO: 3508336 - DNA, 14 bp, Homo sapiens
tgctagaaattttc

SEQ ID NO: 3508337 - DNA, 14 bp, Homo sapiens
tgctagcaggctgt

SEQ ID NO: 3508338 - DNA, 13 bp, Homo sapiens
tgctagctagctc

SEQ ID NO: 3508339 - DNA, 20 bp, Homo sapiens
tgctatagtatttgattcaa

SEQ ID NO: 3508340 - DNA, 17 bp, Homo sapiens
tgctatattgcccaggc

SEQ ID NO: 3508341 - DNA, 15 bp, Homo sapiens
tgctatggtgctctg

SEQ ID NO: 3508342 - DNA, 14 bp, Homo sapiens
tgctatgttctgtc

SEQ ID NO: 3508343 - DNA, 16 bp, Homo sapiens
tgctatgttctgtctt

SEQ ID NO: 3508344 - DNA, 21 bp, Homo sapiens
tgctattgacaataaaatatt

SEQ ID NO: 3508345 - DNA, 20 bp, Homo sapiens
tgctattggaggatcagttt

SEQ ID NO: 3508346 - DNA, 15 bp, Homo sapiens
tgctcacatatctgt

SEQ ID NO: 3508347 - DNA, 14 bp, Homo sapiens
tgctcacctggggt

SEQ ID NO: 3508348 - DNA, 21 bp, Homo sapiens
tgctcagaacttgctgctgtc

SEQ ID NO: 3508349 - DNA, 22 bp, Homo sapiens
tgctcagaacttgctgctgtct

SEQ ID NO: 3508350 - DNA, 14 bp, Homo sapiens
tgctcagaccagct

SEQ ID NO: 3508351 - DNA, 17 bp, Homo sapiens
tgctcagctctgggcca

SEQ ID NO: 3508352 - DNA, 21 bp, Homo sapiens
tgctcagcttctcctgtgtga

SEQ ID NO: 3508353 - DNA, 17 bp, Homo sapiens
tgctcaggactcagaag

SEQ ID NO: 3508354 - DNA, 19 bp, Homo sapiens
tgctcagggaaaagcagct

SEQ ID NO: 3508355 - DNA, 21 bp, Homo sapiens
tgctcagggaaaagcagctct

SEQ ID NO: 3508356 - DNA, 18 bp, Homo sapiens
tgctcagggaaatggcct

SEQ ID NO: 3508357 - DNA, 19 bp, Homo sapiens
tgctcagggaaatggcctt

SEQ ID NO: 3508358 - DNA, 20 bp, Homo sapiens
tgctcagggaaatggccttc

SEQ ID NO: 3508359 - DNA, 20 bp, Homo sapiens
tgctcagggtcaatttcttt

SEQ ID NO: 3508360 - DNA, 17 bp, Homo sapiens
tgctcaggtacttgtaa

SEQ ID NO: 3508361 - DNA, 21 bp, Homo sapiens
tgctcagtgggtaaaattaga

SEQ ID NO: 3508362 - DNA, 23 bp, Homo sapiens
tgctcagtgggtaaaattagatg

SEQ ID NO: 3508363 - DNA, 14 bp, Homo sapiens
tgctcataacggat

SEQ ID NO: 3508364 - DNA, 16 bp, Homo sapiens
tgctcataacggatca

SEQ ID NO: 3508365 - DNA, 17 bp, Homo sapiens
tgctcatcattctctgt

SEQ ID NO: 3508366 - DNA, 15 bp, Homo sapiens
tgctcatctgctggt

SEQ ID NO: 3508367 - DNA, 16 bp, Homo sapiens
tgctccagctgttcag

SEQ ID NO: 3508368 - DNA, 20 bp, Homo sapiens
tgctccagctgttcagctgg

SEQ ID NO: 3508369 - DNA, 21 bp, Homo sapiens
tgctccagctgttcagctggt

SEQ ID NO: 3508370 - DNA, 17 bp, Homo sapiens
tgctcccccgccctgcc

SEQ ID NO: 3508371 - DNA, 16 bp, Homo sapiens
tgctccctaccacctc

SEQ ID NO: 3508372 - DNA, 13 bp, Homo sapiens
tgctcctccctct

SEQ ID NO: 3508373 - DNA, 15 bp, Homo sapiens
tgctcctccctctga

SEQ ID NO: 3508374 - DNA, 18 bp, Homo sapiens
tgctcctccctctgaccc

SEQ ID NO: 3508375 - DNA, 14 bp, Homo sapiens
tgctcctctcccca

SEQ ID NO: 3508376 - DNA, 18 bp, Homo sapiens
tgctcctctccccagcaa

SEQ ID NO: 3508377 - DNA, 19 bp, Homo sapiens
tgctcctctccccagcaag

SEQ ID NO: 3508378 - DNA, 13 bp, Homo sapiens
tgctcctctcttt

SEQ ID NO: 3508379 - DNA, 19 bp, Homo sapiens
tgctccttgggccctttga

SEQ ID NO: 3508380 - DNA, 16 bp, Homo sapiens
tgctccttgttcctag

SEQ ID NO: 3508381 - DNA, 17 bp, Homo sapiens
tgctccttgttcctaga

SEQ ID NO: 3508382 - DNA, 23 bp, Homo sapiens
tgctcgagtcacattctgcttaa

SEQ ID NO: 3508383 - DNA, 14 bp, Homo sapiens
tgctcgccccagca

SEQ ID NO: 3508384 - DNA, 14 bp, Homo sapiens
tgctcgctgttgct

SEQ ID NO: 3508385 - DNA, 15 bp, Homo sapiens
tgctcgctgttgctg

SEQ ID NO: 3508386 - DNA, 18 bp, Homo sapiens
tgctcgctgttgctgaat

SEQ ID NO: 3508387 - DNA, 16 bp, Homo sapiens
tgctctagatgagctg

SEQ ID NO: 3508388 - DNA, 20 bp, Homo sapiens
tgctctagatgagctgggcc

SEQ ID NO: 3508389 - DNA, 12 bp, Homo sapiens
tgctctatgctt

SEQ ID NO: 3508390 - DNA, 15 bp, Homo sapiens
tgctctcagcctccc

SEQ ID NO: 3508391 - DNA, 12 bp, Homo sapiens
tgctctccttcc

SEQ ID NO: 3508392 - DNA, 17 bp, Homo sapiens
tgctctccttcctggag

SEQ ID NO: 3508393 - DNA, 18 bp, Homo sapiens
tgctctccttcctggagc

SEQ ID NO: 3508394 - DNA, 16 bp, Homo sapiens
tgctctgagccacagt

SEQ ID NO: 3508395 - DNA, 22 bp, Homo sapiens
tgctctgatcatccactgtgcc

SEQ ID NO: 3508396 - DNA, 13 bp, Homo sapiens
tgctctgatccct

SEQ ID NO: 3508397 - DNA, 21 bp, Homo sapiens
tgctctgcttgacaacatctg

SEQ ID NO: 3508398 - DNA, 17 bp, Homo sapiens
tgctctggacaggcatg

SEQ ID NO: 3508399 - DNA, 18 bp, Homo sapiens
tgctgaatacagaggcaa

SEQ ID NO: 3508400 - DNA, 23 bp, Homo sapiens
tgctgaatacagaggcaactgca

SEQ ID NO: 3508401 - DNA, 11 bp, Homo sapiens
tgctgaatagg

SEQ ID NO: 3508402 - DNA, 21 bp, Homo sapiens
tgctgaataggcgatcacaac

SEQ ID NO: 3508403 - DNA, 23 bp, Homo sapiens
tgctgaatgccgcgatgggtcag

SEQ ID NO: 3508404 - DNA, 16 bp, Homo sapiens
tgctgacagacacagg

SEQ ID NO: 3508405 - DNA, 13 bp, Homo sapiens
tgctgacagctct

SEQ ID NO: 3508406 - DNA, 14 bp, Homo sapiens
tgctgacagctgct

SEQ ID NO: 3508407 - DNA, 15 bp, Homo sapiens
tgctgacctccacag

SEQ ID NO: 3508408 - DNA, 15 bp, Homo sapiens
tgctgacggccaggg

SEQ ID NO: 3508409 - DNA, 22 bp, Homo sapiens
tgctgacggccagggagaagct

SEQ ID NO: 3508410 - DNA, 19 bp, Homo sapiens
tgctgagatacatacagaa

SEQ ID NO: 3508411 - DNA, 16 bp, Homo sapiens
tgctgagcctctgctc

SEQ ID NO: 3508412 - DNA, 14 bp, Homo sapiens
tgctgaggcctggg

SEQ ID NO: 3508413 - DNA, 17 bp, Homo sapiens
tgctgaggcctgggccg

SEQ ID NO: 3508414 - DNA, 19 bp, Homo sapiens
tgctgatcatcgccagagg

SEQ ID NO: 3508415 - DNA, 22 bp, Homo sapiens
tgctgcagagaaacttaagcaa

SEQ ID NO: 3508416 - DNA, 14 bp, Homo sapiens
tgctgcagctccct

SEQ ID NO: 3508417 - DNA, 21 bp, Homo sapiens
tgctgcaggacttgagaagac

SEQ ID NO: 3508418 - DNA, 18 bp, Homo sapiens
tgctgcatgccctctcag

SEQ ID NO: 3508419 - DNA, 19 bp, Homo sapiens
tgctgcatgccctctcagg

SEQ ID NO: 3508420 - DNA, 13 bp, Homo sapiens
tgctgccagagaa

SEQ ID NO: 3508421 - DNA, 23 bp, Homo sapiens
tgctgccagagaagtctggtcag

SEQ ID NO: 3508422 - DNA, 14 bp, Homo sapiens
tgctgccatccagg

SEQ ID NO: 3508423 - DNA, 19 bp, Homo sapiens
tgctgccccatcagtgctc

SEQ ID NO: 3508424 - DNA, 18 bp, Homo sapiens
tgctgccccgcttcccca

SEQ ID NO: 3508425 - DNA, 21 bp, Homo sapiens
tgctgccccgcttccccacag

SEQ ID NO: 3508426 - DNA, 21 bp, Homo sapiens
tgctgccgccccacccagatg

SEQ ID NO: 3508427 - DNA, 18 bp, Homo sapiens
tgctgccggcacagctgg

SEQ ID NO: 3508428 - DNA, 19 bp, Homo sapiens
tgctgccggcacagctggg

SEQ ID NO: 3508429 - DNA, 22 bp, Homo sapiens
tgctgccggcacagctgggata

SEQ ID NO: 3508430 - DNA, 14 bp, Homo sapiens
tgctgctgcctgcc

SEQ ID NO: 3508431 - DNA, 12 bp, Homo sapiens
tgctgctgctgc

SEQ ID NO: 3508432 - DNA, 16 bp, Homo sapiens
tgctgctgtccagtgc

SEQ ID NO: 3508433 - DNA, 21 bp, Homo sapiens
tgctgcttctgaatacaaatt

SEQ ID NO: 3508434 - DNA, 20 bp, Homo sapiens
tgctgcttttccttggggca

SEQ ID NO: 3508435 - DNA, 19 bp, Homo sapiens
tgctggaacctgcaaaaaa

SEQ ID NO: 3508436 - DNA, 12 bp, Homo sapiens
tgctggagaaat

SEQ ID NO: 3508437 - DNA, 16 bp, Homo sapiens
tgctggagaaatcttg

SEQ ID NO: 3508438 - DNA, 18 bp, Homo sapiens
tgctggagaaatcttgaa

SEQ ID NO: 3508439 - DNA, 17 bp, Homo sapiens
tgctggagtcatgtgcc

SEQ ID NO: 3508440 - DNA, 19 bp, Homo sapiens
tgctggccaaatagcaaag

SEQ ID NO: 3508441 - DNA, 16 bp, Homo sapiens
tgctggcccagggccc

SEQ ID NO: 3508442 - DNA, 17 bp, Homo sapiens
tgctggcccagggccca

SEQ ID NO: 3508443 - DNA, 18 bp, Homo sapiens
tgctggcccagggcccag

SEQ ID NO: 3508444 - DNA, 21 bp, Homo sapiens
tgctggctgttggctgggggc

SEQ ID NO: 3508445 - DNA, 15 bp, Homo sapiens
tgctgggagctccac

SEQ ID NO: 3508446 - DNA, 16 bp, Homo sapiens
tgctgggagctccact

SEQ ID NO: 3508447 - DNA, 16 bp, Homo sapiens
tgctgggatggtgggc

SEQ ID NO: 3508448 - DNA, 23 bp, Homo sapiens
tgctgggatggtgggcttcaggg

SEQ ID NO: 3508449 - DNA, 17 bp, Homo sapiens
tgctgggcttgtctgta

SEQ ID NO: 3508450 - DNA, 19 bp, Homo sapiens
tgctggtcccggggccagc

SEQ ID NO: 3508451 - DNA, 13 bp, Homo sapiens
tgctggtccgtgg

SEQ ID NO: 3508452 - DNA, 13 bp, Homo sapiens
tgctgtataaaat

SEQ ID NO: 3508453 - DNA, 14 bp, Homo sapiens
tgctgtataaaatc

SEQ ID NO: 3508454 - DNA, 17 bp, Homo sapiens
tgctgtataaaatcagc

SEQ ID NO: 3508455 - DNA, 16 bp, Homo sapiens
tgctgtcacttcttca

SEQ ID NO: 3508456 - DNA, 15 bp, Homo sapiens
tgctgtccagtgcct

SEQ ID NO: 3508457 - DNA, 16 bp, Homo sapiens
tgctgtccagtgccta

SEQ ID NO: 3508458 - DNA, 21 bp, Homo sapiens
tgctgtcccatagtccctgcc

SEQ ID NO: 3508459 - DNA, 12 bp, Homo sapiens
tgctgtcctcag

SEQ ID NO: 3508460 - DNA, 18 bp, Homo sapiens
tgggcgtacgctggtgct

SEQ ID NO: 3508461 - DNA, 16 bp, Homo sapiens
tgggctagttgggctt

SEQ ID NO: 3508462 - DNA, 11 bp, Homo sapiens
tgggctccctg

SEQ ID NO: 3508463 - DNA, 15 bp, Homo sapiens
tgggctccctgactg

SEQ ID NO: 3508464 - DNA, 13 bp, Homo sapiens
tgggctcctccag

SEQ ID NO: 3508465 - DNA, 23 bp, Homo sapiens
tgggctcctccagggtgtgtgct

SEQ ID NO: 3508466 - DNA, 12 bp, Homo sapiens
tgggctgaggga

SEQ ID NO: 3508467 - DNA, 18 bp, Homo sapiens
tgggctggaacagattca

SEQ ID NO: 3508468 - DNA, 18 bp, Homo sapiens
tgggctggaatcaggaat

SEQ ID NO: 3508469 - DNA, 13 bp, Homo sapiens
tgggctgggggct

SEQ ID NO: 3508470 - DNA, 19 bp, Homo sapiens
tgggctgtagtttggagac

SEQ ID NO: 3508471 - DNA, 11 bp, Homo sapiens
tgggcttcagc

SEQ ID NO: 3508472 - DNA, 12 bp, Homo sapiens
tgggcttcccag

SEQ ID NO: 3508473 - DNA, 14 bp, Homo sapiens
tgggcttgattctg

SEQ ID NO: 3508474 - DNA, 17 bp, Homo sapiens
tgggcttgtctgtagat

SEQ ID NO: 3508475 - DNA, 11 bp, Homo sapiens
tggggaaaggg

SEQ ID NO: 3508476 - DNA, 22 bp, Homo sapiens
tggggaaaggggtcggctgacc

SEQ ID NO: 3508477 - DNA, 15 bp, Homo sapiens
tggggaaggagccag

SEQ ID NO: 3508478 - DNA, 22 bp, Homo sapiens
tggggactccggctgtgctggg

SEQ ID NO: 3508479 - DNA, 16 bp, Homo sapiens
tggggagacagttgag

SEQ ID NO: 3508480 - DNA, 19 bp, Homo sapiens
tggggagtaggacatacca

SEQ ID NO: 3508481 - DNA, 16 bp, Homo sapiens
tggggagttaagacct

SEQ ID NO: 3508482 - DNA, 15 bp, Homo sapiens
tggggatgagaaagg

SEQ ID NO: 3508483 - DNA, 16 bp, Homo sapiens
tggggcacagatgcct

SEQ ID NO: 3508484 - DNA, 18 bp, Homo sapiens
tggggcacagatgcctgg

SEQ ID NO: 3508485 - DNA, 12 bp, Homo sapiens
tggggcaggcag

SEQ ID NO: 3508486 - DNA, 18 bp, Homo sapiens
tggggccagatccagcct

SEQ ID NO: 3508487 - DNA, 20 bp, Homo sapiens
tggggccagatccagcctgg

SEQ ID NO: 3508488 - DNA, 21 bp, Homo sapiens
tggggccagatccagcctggg

SEQ ID NO: 3508489 - DNA, 19 bp, Homo sapiens
tggggccctaattcagcca

SEQ ID NO: 3508490 - DNA, 20 bp, Homo sapiens
tggggcctccagaactcact

SEQ ID NO: 3508491 - DNA, 13 bp, Homo sapiens
tggggcctgactg

SEQ ID NO: 3508492 - DNA, 18 bp, Homo sapiens
tggggcggtgagagggga

SEQ ID NO: 3508493 - DNA, 17 bp, Homo sapiens
tggggctcacacacctg

SEQ ID NO: 3508494 - DNA, 15 bp, Homo sapiens
tggggctgagctggg

SEQ ID NO: 3508495 - DNA, 21 bp, Homo sapiens
tggggctgcgggacagaggac

SEQ ID NO: 3508496 - DNA, 12 bp, Homo sapiens
tggggctgctgg

SEQ ID NO: 3508497 - DNA, 20 bp, Homo sapiens
tgggggaactcagatccagg

SEQ ID NO: 3508498 - DNA, 17 bp, Homo sapiens
tgggggaagacctggca

SEQ ID NO: 3508499 - DNA, 17 bp, Homo sapiens
tgggggaccccttccca

SEQ ID NO: 3508500 - DNA, 19 bp, Homo sapiens
tgggggagtctgaagcaga

SEQ ID NO: 3508501 - DNA, 12 bp, Homo sapiens
tgggggctctgg

SEQ ID NO: 3508502 - DNA, 19 bp, Homo sapiens
tgggggctctggccaaggg

SEQ ID NO: 3508503 - DNA, 20 bp, Homo sapiens
tgggggctctggccaagggc

SEQ ID NO: 3508504 - DNA, 22 bp, Homo sapiens
tgggggctctggccaagggcca

SEQ ID NO: 3508505 - DNA, 23 bp, Homo sapiens
tgggggcttcatctctttagaga

SEQ ID NO: 3508506 - DNA, 23 bp, Homo sapiens
tgggggggctcccgtggcctgta

SEQ ID NO: 3508507 - DNA, 13 bp, Homo sapiens
tgggggggtggcc

SEQ ID NO: 3508508 - DNA, 14 bp, Homo sapiens
tgggggggtggccg

SEQ ID NO: 3508509 - DNA, 23 bp, Homo sapiens
tgggggggtggccgctgagtggc

SEQ ID NO: 3508510 - DNA, 19 bp, Homo sapiens
tggggtacccactgctctg

SEQ ID NO: 3508511 - DNA, 13 bp, Homo sapiens
tggggtccctcta

SEQ ID NO: 3508512 - DNA, 16 bp, Homo sapiens
tggggtcctggccatc

SEQ ID NO: 3508513 - DNA, 23 bp, Homo sapiens
tggggtctcacagtgttgcccag

SEQ ID NO: 3508514 - DNA, 13 bp, Homo sapiens
tggggtctgtaaa

SEQ ID NO: 3508515 - DNA, 19 bp, Homo sapiens
tggggtgagaattgggcgg

SEQ ID NO: 3508516 - DNA, 20 bp, Homo sapiens
tggggtggcctgtgtggcca

SEQ ID NO: 3508517 - DNA, 15 bp, Homo sapiens
tggggtgggtataaa

SEQ ID NO: 3508518 - DNA, 16 bp, Homo sapiens
tggggtgtttgggagg

SEQ ID NO: 3508519 - DNA, 13 bp, Homo sapiens
tggggtttcctgg

SEQ ID NO: 3508520 - DNA, 17 bp, Homo sapiens
tggggtttcctggcact

SEQ ID NO: 3508521 - DNA, 18 bp, Homo sapiens
tggggtttcgcagcctga

SEQ ID NO: 3508522 - DNA, 17 bp, Homo sapiens
tgggtataaaagatggg

SEQ ID NO: 3508523 - DNA, 15 bp, Homo sapiens
tgggtatgttaacct

SEQ ID NO: 3508524 - DNA, 21 bp, Homo sapiens
tgggtatgttaacctaggcag

SEQ ID NO: 3508525 - DNA, 18 bp, Homo sapiens
tgggtcagaaccctgcca

SEQ ID NO: 3508526 - DNA, 13 bp, Homo sapiens
tgggtcaggcagg

SEQ ID NO: 3508527 - DNA, 23 bp, Homo sapiens
tgggtcagtgtccaaagcagggt

SEQ ID NO: 3508528 - DNA, 12 bp, Homo sapiens
tgggtctctgga

SEQ ID NO: 3508529 - DNA, 14 bp, Homo sapiens
tgggtctctggaag

SEQ ID NO: 3508530 - DNA, 14 bp, Homo sapiens
tgggtctgtgcatt

SEQ ID NO: 3508531 - DNA, 14 bp, Homo sapiens
tgggtgaaggctgg

SEQ ID NO: 3508532 - DNA, 16 bp, Homo sapiens
tgggtgaaggctggca

SEQ ID NO: 3508533 - DNA, 19 bp, Homo sapiens
tgggtgaaggctggcatga

SEQ ID NO: 3508534 - DNA, 14 bp, Homo sapiens
tgggtgacagagca

SEQ ID NO: 3508535 - DNA, 16 bp, Homo sapiens
tgggtgaggtaataaa

SEQ ID NO: 3508536 - DNA, 23 bp, Homo sapiens
tgggtggatgcctggtggcagct

SEQ ID NO: 3508537 - DNA, 22 bp, Homo sapiens
tgggtggcaccagcagcctgga

SEQ ID NO: 3508538 - DNA, 15 bp, Homo sapiens
tgggtggcactgcca

SEQ ID NO: 3508539 - DNA, 23 bp, Homo sapiens
tgggttcaagcgattcttctgct

SEQ ID NO: 3508540 - DNA, 14 bp, Homo sapiens
tgggttgactttca

SEQ ID NO: 3508541 - DNA, 16 bp, Homo sapiens
tgggttgcagacagga

SEQ ID NO: 3508542 - DNA, 15 bp, Homo sapiens
tgggtttgaagctgc

SEQ ID NO: 3508543 - DNA, 19 bp, Homo sapiens
tgggtttgtttttcaaagc

SEQ ID NO: 3508544 - DNA, 16 bp, Homo sapiens
tgggttttatgagatg

SEQ ID NO: 3508545 - DNA, 21 bp, Homo sapiens
tgggttttgtattctctgagc

SEQ ID NO: 3508546 - DNA, 14 bp, Homo sapiens
tgggtttttccctg

SEQ ID NO: 3508547 - DNA, 15 bp, Homo sapiens
tggtaagacctctga

SEQ ID NO: 3508548 - DNA, 16 bp, Homo sapiens
tggtaagacctctgag

SEQ ID NO: 3508549 - DNA, 15 bp, Homo sapiens
tggtacaaaaataaa

SEQ ID NO: 3508550 - DNA, 20 bp, Homo sapiens
tggtacgtgaccctctgctg

SEQ ID NO: 3508551 - DNA, 13 bp, Homo sapiens
tggtagagatgga

SEQ ID NO: 3508552 - DNA, 20 bp, Homo sapiens
tggtagagtgtgcctgaagt

SEQ ID NO: 3508553 - DNA, 22 bp, Homo sapiens
tggtagtaatttcctttattat

SEQ ID NO: 3508554 - DNA, 18 bp, Homo sapiens
tggtatgatcacggctca

SEQ ID NO: 3508555 - DNA, 13 bp, Homo sapiens
tggtatgtctgcc

SEQ ID NO: 3508556 - DNA, 21 bp, Homo sapiens
tggtattctgttctggaggaa

SEQ ID NO: 3508557 - DNA, 15 bp, Homo sapiens
tggtattttcaacca

SEQ ID NO: 3508558 - DNA, 21 bp, Homo sapiens
tggtcaaacaaactctctgaa

SEQ ID NO: 3508559 - DNA, 18 bp, Homo sapiens
tggtcagagccacagggt

SEQ ID NO: 3508560 - DNA, 19 bp, Homo sapiens
tggtcagccctagggtgga

SEQ ID NO: 3508561 - DNA, 15 bp, Homo sapiens
tggtccacagggcac

SEQ ID NO: 3508562 - DNA, 21 bp, Homo sapiens
tggtccacagggcacctgcca

SEQ ID NO: 3508563 - DNA, 12 bp, Homo sapiens
tggtccaggaga

SEQ ID NO: 3508564 - DNA, 22 bp, Homo sapiens
tggtccatgggccatatgaaaa

SEQ ID NO: 3508565 - DNA, 22 bp, Homo sapiens
tggtccctgttttcccacgagg

SEQ ID NO: 3508566 - DNA, 17 bp, Homo sapiens
tggtcctagaggccctt

SEQ ID NO: 3508567 - DNA, 14 bp, Homo sapiens
tggtcctctctctg

SEQ ID NO: 3508568 - DNA, 15 bp, Homo sapiens
tggtcctctctctgt

SEQ ID NO: 3508569 - DNA, 16 bp, Homo sapiens
tggtcctctctctgtg

SEQ ID NO: 3508570 - DNA, 23 bp, Homo sapiens
tggtctcaaactcttgacctcag

SEQ ID NO: 3508571 - DNA, 16 bp, Homo sapiens
tggtctctaggctggg

SEQ ID NO: 3508572 - DNA, 18 bp, Homo sapiens
tggtctctaggctgggga

SEQ ID NO: 3508573 - DNA, 15 bp, Homo sapiens
tggtctctgcatttt

SEQ ID NO: 3508574 - DNA, 18 bp, Homo sapiens
tggtctgacccactgctt

SEQ ID NO: 3508575 - DNA, 12 bp, Homo sapiens
tggtctgtgtga

SEQ ID NO: 3508576 - DNA, 14 bp, Homo sapiens
tggtctgttggcag

SEQ ID NO: 3508577 - DNA, 18 bp, Homo sapiens
tggtctgttggcaggctg

SEQ ID NO: 3508578 - DNA, 16 bp, Homo sapiens
tggtgaatttcacaag

SEQ ID NO: 3508579 - DNA, 15 bp, Homo sapiens
tggtgacctctgcct

SEQ ID NO: 3508580 - DNA, 16 bp, Homo sapiens
tggtgacctctgcctg

SEQ ID NO: 3508581 - DNA, 17 bp, Homo sapiens
tggtgacctctgcctga

SEQ ID NO: 3508582 - DNA, 19 bp, Homo sapiens
tggtgcactttgtaaattc

SEQ ID NO: 3508583 - DNA, 15 bp, Homo sapiens
tggtgcagtgtgaaa

SEQ ID NO: 3508584 - DNA, 20 bp, Homo sapiens
tggtgccacaaataaaatgg

SEQ ID NO: 3508585 - DNA, 21 bp, Homo sapiens
tggtgccagatcctcttctca

SEQ ID NO: 3508586 - DNA, 18 bp, Homo sapiens
tggtgccatcattgctgt

SEQ ID NO: 3508587 - DNA, 14 bp, Homo sapiens
tggtgccccaggac

SEQ ID NO: 3508588 - DNA, 16 bp, Homo sapiens
tggtgccccaggacca

SEQ ID NO: 3508589 - DNA, 17 bp, Homo sapiens
tggtgccccaggaccag

SEQ ID NO: 3508590 - DNA, 20 bp, Homo sapiens
tggtgccccaggaccagctc

SEQ ID NO: 3508591 - DNA, 23 bp, Homo sapiens
tggtgccccaggaccagctcagg

SEQ ID NO: 3508592 - DNA, 16 bp, Homo sapiens
tggtgccccccacccc

SEQ ID NO: 3508593 - DNA, 19 bp, Homo sapiens
tgtgtcagtggggctctct

SEQ ID NO: 3508594 - DNA, 21 bp, Homo sapiens
tgtgtcagtggggctctctga

SEQ ID NO: 3508595 - DNA, 17 bp, Homo sapiens
tgtgtccacacatacat

SEQ ID NO: 3508596 - DNA, 18 bp, Homo sapiens
tgtgtccccctctgtcca

SEQ ID NO: 3508597 - DNA, 21 bp, Homo sapiens
tgtgtccccctctgtccaggc

SEQ ID NO: 3508598 - DNA, 15 bp, Homo sapiens
tgtgtgaaggcagag

SEQ ID NO: 3508599 - DNA, 12 bp, Homo sapiens
tgtgtgaatgaa

SEQ ID NO: 3508600 - DNA, 18 bp, Homo sapiens
tgtgtgactctttagcaa

SEQ ID NO: 3508601 - DNA, 19 bp, Homo sapiens
tgtgtgattgacagctttg

SEQ ID NO: 3508602 - DNA, 22 bp, Homo sapiens
tgtgtgcaacagggtatggact

SEQ ID NO: 3508603 - DNA, 19 bp, Homo sapiens
tgtgtgcatatgcatgtgt

SEQ ID NO: 3508604 - DNA, 20 bp, Homo sapiens
tgtgtggccacttctgtcca

SEQ ID NO: 3508605 - DNA, 16 bp, Homo sapiens
tgtgtgtccaaaactg

SEQ ID NO: 3508606 - DNA, 16 bp, Homo sapiens
tgtgtgtgaatgaaca

SEQ ID NO: 3508607 - DNA, 20 bp, Homo sapiens
tgtgtgtgaatgaacactct

SEQ ID NO: 3508608 - DNA, 12 bp, Homo sapiens
tgtgtgtgtctt

SEQ ID NO: 3508609 - DNA, 11 bp, Homo sapiens
tgtgtgtgtga

SEQ ID NO: 3508610 - DNA, 13 bp, Homo sapiens
tgtgtgtgtgaga

SEQ ID NO: 3508611 - DNA, 14 bp, Homo sapiens
tgtgtgtgtgtgtg

SEQ ID NO: 3508612 - DNA, 16 bp, Homo sapiens
tgtgtgttgccacagg

SEQ ID NO: 3508613 - DNA, 17 bp, Homo sapiens
tgtgtgttgccacagga

SEQ ID NO: 3508614 - DNA, 17 bp, Homo sapiens
tgtgttactgctttgca

SEQ ID NO: 3508615 - DNA, 20 bp, Homo sapiens
tgtgttactgctttgcaaag

SEQ ID NO: 3508616 - DNA, 21 bp, Homo sapiens
tgtgtttcaaaaccatgcctg

SEQ ID NO: 3508617 - DNA, 15 bp, Homo sapiens
tgtgtttgctttctg

SEQ ID NO: 3508618 - DNA, 16 bp, Homo sapiens
tgtgtttggctttcag

SEQ ID NO: 3508619 - DNA, 14 bp, Homo sapiens
tgtgtttgtcatta

SEQ ID NO: 3508620 - DNA, 19 bp, Homo sapiens
tgtgtttgtcattagcctg

SEQ ID NO: 3508621 - DNA, 15 bp, Homo sapiens
tgtgtttgtgtattt

SEQ ID NO: 3508622 - DNA, 16 bp, Homo sapiens
tgttaaaaataaatcc

SEQ ID NO: 3508623 - DNA, 14 bp, Homo sapiens
tgttaaaataacta

SEQ ID NO: 3508624 - DNA, 17 bp, Homo sapiens
tgttaaacagcctattc

SEQ ID NO: 3508625 - DNA, 18 bp, Homo sapiens
tgttaaactagcatatct

SEQ ID NO: 3508626 - DNA, 20 bp, Homo sapiens
tgttaaactagcatatctgc

SEQ ID NO: 3508627 - DNA, 20 bp, Homo sapiens
tgttaaataaattgtatatt

SEQ ID NO: 3508628 - DNA, 14 bp, Homo sapiens
tgttaacctaggca

SEQ ID NO: 3508629 - DNA, 15 bp, Homo sapiens
tgttaacctaggcag

SEQ ID NO: 3508630 - DNA, 15 bp, Homo sapiens
tgttaactacatatt

SEQ ID NO: 3508631 - DNA, 19 bp, Homo sapiens
tgttaactacatattgtct

SEQ ID NO: 3508632 - DNA, 24 bp, Homo sapiens
tgttaaggtcctgaaagtaactca

SEQ ID NO: 3508633 - DNA, 22 bp, Homo sapiens
tgttaattttttggtacaaaaa

SEQ ID NO: 3508634 - DNA, 16 bp, Homo sapiens
tgttacctgtcatttt

SEQ ID NO: 3508635 - DNA, 23 bp, Homo sapiens
tgttacctgtcattttgcactgt

SEQ ID NO: 3508636 - DNA, 13 bp, Homo sapiens
tgttacctgtgtg

SEQ ID NO: 3508637 - DNA, 17 bp, Homo sapiens
tgttactaactaaactc

SEQ ID NO: 3508638 - DNA, 21 bp, Homo sapiens
tgttaggattttcacattctt

SEQ ID NO: 3508639 - DNA, 20 bp, Homo sapiens
tgttaggtgtacatcctgca

SEQ ID NO: 3508640 - DNA, 21 bp, Homo sapiens
tgttatcagtcaatattttta

SEQ ID NO: 3508641 - DNA, 22 bp, Homo sapiens
tgttatcttatactgtacaata

SEQ ID NO: 3508642 - DNA, 20 bp, Homo sapiens
tgttatgtagtgtgcttttt

SEQ ID NO: 3508643 - DNA, 23 bp, Homo sapiens
tgttattagagattacctcctga

SEQ ID NO: 3508644 - DNA, 14 bp, Homo sapiens
tgttcagctccagc

SEQ ID NO: 3508645 - DNA, 15 bp, Homo sapiens
tgttcagctccagct

SEQ ID NO: 3508646 - DNA, 16 bp, Homo sapiens
tgttcagctccagctc

SEQ ID NO: 3508647 - DNA, 20 bp, Homo sapiens
tgttcagctccagctcacca

SEQ ID NO: 3508648 - DNA, 21 bp, Homo sapiens
tgttcagctccagctcaccag

SEQ ID NO: 3508649 - DNA, 15 bp, Homo sapiens
tgttcagtgtaaata

SEQ ID NO: 3508650 - DNA, 19 bp, Homo sapiens
tgttcatcccatgatgtag

SEQ ID NO: 3508651 - DNA, 17 bp, Homo sapiens
tgttccacttgtttgca

SEQ ID NO: 3508652 - DNA, 18 bp, Homo sapiens
tgttccagtaatctaata

SEQ ID NO: 3508653 - DNA, 16 bp, Homo sapiens
tgttccccctgtgcag

SEQ ID NO: 3508654 - DNA, 19 bp, Homo sapiens
tgttcccctcctccactct

SEQ ID NO: 3508655 - DNA, 14 bp, Homo sapiens
tgttccccttccac

SEQ ID NO: 3508656 - DNA, 18 bp, Homo sapiens
tgttccctctccctgttg

SEQ ID NO: 3508657 - DNA, 23 bp, Homo sapiens
tgttcctggaggtcagcatttga

SEQ ID NO: 3508658 - DNA, 19 bp, Homo sapiens
tgttcctggcagtttaaaa

SEQ ID NO: 3508659 - DNA, 16 bp, Homo sapiens
tgttctagttttcagt

SEQ ID NO: 3508660 - DNA, 22 bp, Homo sapiens
tgttctagttttcagtttgtat

SEQ ID NO: 3508661 - DNA, 18 bp, Homo sapiens
tgttctcattcctgttct

SEQ ID NO: 3508662 - DNA, 19 bp, Homo sapiens
tgttctcattcctgttctt

SEQ ID NO: 3508663 - DNA, 22 bp, Homo sapiens
tgttctcattcctgttctttct

SEQ ID NO: 3508664 - DNA, 15 bp, Homo sapiens
tgttctctatcattt

SEQ ID NO: 3508665 - DNA, 15 bp, Homo sapiens
tgttctctcttctcc

SEQ ID NO: 3508666 - DNA, 16 bp, Homo sapiens
tgttctctgaggacac

SEQ ID NO: 3508667 - DNA, 18 bp, Homo sapiens
tgttctctgaggacacta

SEQ ID NO: 3508668 - DNA, 17 bp, Homo sapiens
tgttctctgggagaaaa

SEQ ID NO: 3508669 - DNA, 23 bp, Homo sapiens
tgttctcttgggaactgaactca

SEQ ID NO: 3508670 - DNA, 15 bp, Homo sapiens
tgttctgaactgtgg

SEQ ID NO: 3508671 - DNA, 21 bp, Homo sapiens
tgttctgagattcaatattga

SEQ ID NO: 3508672 - DNA, 15 bp, Homo sapiens
tgttctgggacacag

SEQ ID NO: 3508673 - DNA, 19 bp, Homo sapiens
tgttctgggactccaggtc

SEQ ID NO: 3508674 - DNA, 22 bp, Homo sapiens
tgttctttagatggtggcacat

SEQ ID NO: 3508675 - DNA, 13 bp, Homo sapiens
tgttctttgggga

SEQ ID NO: 3508676 - DNA, 14 bp, Homo sapiens
tgttctttttattg

SEQ ID NO: 3508677 - DNA, 13 bp, Homo sapiens
tgttgaatacttt

SEQ ID NO: 3508678 - DNA, 20 bp, Homo sapiens
tgttgacatatttaatgttt

SEQ ID NO: 3508679 - DNA, 23 bp, Homo sapiens
tgttgacatatttaatgttttaa

SEQ ID NO: 3508680 - DNA, 16 bp, Homo sapiens
tgttgatccatccagc

SEQ ID NO: 3508681 - DNA, 20 bp, Homo sapiens
tgttgccaagctccaagccc

SEQ ID NO: 3508682 - DNA, 14 bp, Homo sapiens
tgttgccacaggac

SEQ ID NO: 3508683 - DNA, 15 bp, Homo sapiens
tgttgccacaggaca

SEQ ID NO: 3508684 - DNA, 16 bp, Homo sapiens
tgttgcccaggcaggt

SEQ ID NO: 3508685 - DNA, 18 bp, Homo sapiens
tgttgcccaggcaggtct

SEQ ID NO: 3508686 - DNA, 20 bp, Homo sapiens
tgttgcccaggctggcgtgc

SEQ ID NO: 3508687 - DNA, 16 bp, Homo sapiens
tgttgctggatcagga

SEQ ID NO: 3508688 - DNA, 20 bp, Homo sapiens
tgttggataaatcagtggtt

SEQ ID NO: 3508689 - DNA, 11 bp, Homo sapiens
tgttggataag

SEQ ID NO: 3508690 - DNA, 21 bp, Homo sapiens
tgttggataaggaattataga

SEQ ID NO: 3508691 - DNA, 15 bp, Homo sapiens
tgttggccaggctgg

SEQ ID NO: 3508692 - DNA, 22 bp, Homo sapiens
tgttggggtgggtataaaagat

SEQ ID NO: 3508693 - DNA, 18 bp, Homo sapiens
tgttggtcctctctctgt

SEQ ID NO: 3508694 - DNA, 23 bp, Homo sapiens
tgttggtgaattttcaaggcctt

SEQ ID NO: 3508695 - DNA, 14 bp, Homo sapiens
tgttgtatttaatt

SEQ ID NO: 3508696 - DNA, 14 bp, Homo sapiens
tgttgtcagctgaa

SEQ ID NO: 3508697 - DNA, 17 bp, Homo sapiens
tgttgtccaactattta

SEQ ID NO: 3508698 - DNA, 15 bp, Homo sapiens
tgttgtctcttgagt

SEQ ID NO: 3508699 - DNA, 16 bp, Homo sapiens
tgttgtgatgtacaca

SEQ ID NO: 3508700 - DNA, 15 bp, Homo sapiens
tgttgtgtgtgcagg

SEQ ID NO: 3508701 - DNA, 15 bp, Homo sapiens
tgtttaaaacatcat

SEQ ID NO: 3508702 - DNA, 19 bp, Homo sapiens
tgtttactagggatccctc

SEQ ID NO: 3508703 - DNA, 22 bp, Homo sapiens
tgtttagcagcagcctttaatg

SEQ ID NO: 3508704 - DNA, 16 bp, Homo sapiens
tgtttatacctttgcc

SEQ ID NO: 3508705 - DNA, 20 bp, Homo sapiens
tgtttattgttgctggttat

SEQ ID NO: 3508706 - DNA, 16 bp, Homo sapiens
tgtttcaaaataaaaa

SEQ ID NO: 3508707 - DNA, 23 bp, Homo sapiens
tgtttcacaccggaaggttttta

SEQ ID NO: 3508708 - DNA, 23 bp, Homo sapiens
tgtttccagacttccttgagaca

SEQ ID NO: 3508709 - DNA, 17 bp, Homo sapiens
tgtttcctaatatcaaa

SEQ ID NO: 3508710 - DNA, 21 bp, Homo sapiens
tgtttcctaatatcaaatgca

SEQ ID NO: 3508711 - DNA, 16 bp, Homo sapiens
tgtttcctgcaggcca

SEQ ID NO: 3508712 - DNA, 15 bp, Homo sapiens
tgtttctagggaaat

SEQ ID NO: 3508713 - DNA, 14 bp, Homo sapiens
tgtttctgtgggcg

SEQ ID NO: 3508714 - DNA, 16 bp, Homo sapiens
tgtttctttatatttt

SEQ ID NO: 3508715 - DNA, 13 bp, Homo sapiens
tgtttcttttgta

SEQ ID NO: 3508716 - DNA, 14 bp, Homo sapiens
tgtttcttttgtat

SEQ ID NO: 3508717 - DNA, 13 bp, Homo sapiens
tgtttgaaagtag

SEQ ID NO: 3508718 - DNA, 16 bp, Homo sapiens
tgtttgaaatcatcgg

SEQ ID NO: 3508719 - DNA, 23 bp, Homo sapiens
tgtttgcactgtgtgctgactga

SEQ ID NO: 3508720 - DNA, 13 bp, Homo sapiens
tgtttgctgctat

SEQ ID NO: 3508721 - DNA, 12 bp, Homo sapiens
tgtttgctttct

SEQ ID NO: 3508722 - DNA, 13 bp, Homo sapiens
tgtttgctttctg

SEQ ID NO: 3508723 - DNA, 18 bp, Homo sapiens
tgtttggaatattgtcca

SEQ ID NO: 3508724 - DNA, 16 bp, Homo sapiens
tgtttggcaaggaaag

SEQ ID NO: 3508725 - DNA, 22 bp, Homo sapiens
ttcacctgtttttaagctgttt

SEQ ID NO: 3508726 - DNA, 13 bp, Homo sapiens
ttcacggaagttt

SEQ ID NO: 3508727 - DNA, 22 bp, Homo sapiens
ttcacttatgaatgatttgcat

SEQ ID NO: 3508728 - DNA, 18 bp, Homo sapiens
ttcagaaagtgtgcttta

SEQ ID NO: 3508729 - DNA, 14 bp, Homo sapiens
ttcagaaatttaaa

SEQ ID NO: 3508730 - DNA, 11 bp, Homo sapiens
ttcagaagacc

SEQ ID NO: 3508731 - DNA, 15 bp, Homo sapiens
ttcagaatcacttct

SEQ ID NO: 3508732 - DNA, 17 bp, Homo sapiens
ttcagaatctttgttaa

SEQ ID NO: 3508733 - DNA, 15 bp, Homo sapiens
ttcagacacatgcta

SEQ ID NO: 3508734 - DNA, 20 bp, Homo sapiens
ttcagactcccattcctgaa

SEQ ID NO: 3508735 - DNA, 23 bp, Homo sapiens
ttcagacttgccatgtgactctg

SEQ ID NO: 3508736 - DNA, 19 bp, Homo sapiens
ttcagaggctgcaggactt

SEQ ID NO: 3508737 - DNA, 21 bp, Homo sapiens
ttcagagtttgtcatatactg

SEQ ID NO: 3508738 - DNA, 19 bp, Homo sapiens
ttcagatcttaatataaat

SEQ ID NO: 3508739 - DNA, 13 bp, Homo sapiens
ttcagatgtaatg

SEQ ID NO: 3508740 - DNA, 14 bp, Homo sapiens
ttcagatgtaatgt

SEQ ID NO: 3508741 - DNA, 18 bp, Homo sapiens
ttcagatgtgaaccatta

SEQ ID NO: 3508742 - DNA, 13 bp, Homo sapiens
ttcagcagactgg

SEQ ID NO: 3508743 - DNA, 17 bp, Homo sapiens
ttcagcagcaaattttc

SEQ ID NO: 3508744 - DNA, 23 bp, Homo sapiens
ttcagcatccgcaggtgctggtc

SEQ ID NO: 3508745 - DNA, 10 bp, Homo sapiens
ttcagccaag

SEQ ID NO: 3508746 - DNA, 12 bp, Homo sapiens
ttcagccctcac

SEQ ID NO: 3508747 - DNA, 23 bp, Homo sapiens
ttcagcctagtggcttgtcctca

SEQ ID NO: 3508748 - DNA, 12 bp, Homo sapiens
ttcagccttaat

SEQ ID NO: 3508749 - DNA, 13 bp, Homo sapiens
ttcagctcactgt

SEQ ID NO: 3508750 - DNA, 17 bp, Homo sapiens
ttcagctctgcaagaat

SEQ ID NO: 3508751 - DNA, 22 bp, Homo sapiens
ttcaggaacctcgagtactgtg

SEQ ID NO: 3508752 - DNA, 19 bp, Homo sapiens
ttcaggaatgtgtggcctg

SEQ ID NO: 3508753 - DNA, 16 bp, Homo sapiens
ttcaggagcagcctca

SEQ ID NO: 3508754 - DNA, 20 bp, Homo sapiens
ttcaggagcagcctcagaac

SEQ ID NO: 3508755 - DNA, 19 bp, Homo sapiens
ttcaggatacgctgctctc

SEQ ID NO: 3508756 - DNA, 17 bp, Homo sapiens
ttcaggcaattctcctg

SEQ ID NO: 3508757 - DNA, 17 bp, Homo sapiens
ttcaggctcgccaaggc

SEQ ID NO: 3508758 - DNA, 20 bp, Homo sapiens
ttcaggctcgccaaggccta

SEQ ID NO: 3508759 - DNA, 21 bp, Homo sapiens
ttcaggctcgccaaggcctag

SEQ ID NO: 3508760 - DNA, 22 bp, Homo sapiens
ttcaggctcgccaaggcctagg

SEQ ID NO: 3508761 - DNA, 19 bp, Homo sapiens
ttcagggcctggttgaaga

SEQ ID NO: 3508762 - DNA, 13 bp, Homo sapiens
ttcagggtcatag

SEQ ID NO: 3508763 - DNA, 15 bp, Homo sapiens
ttcaggtaacaggca

SEQ ID NO: 3508764 - DNA, 21 bp, Homo sapiens
ttcaggtatgtaaaagacttt

SEQ ID NO: 3508765 - DNA, 14 bp, Homo sapiens
ttcaggtccaggct

SEQ ID NO: 3508766 - DNA, 17 bp, Homo sapiens
ttcaggtgcagaggaag

SEQ ID NO: 3508767 - DNA, 18 bp, Homo sapiens
ttcaggtgcagaggaagt

SEQ ID NO: 3508768 - DNA, 19 bp, Homo sapiens
ttcaggttttgtaaagatg

SEQ ID NO: 3508769 - DNA, 23 bp, Homo sapiens
ttcagtactctacaattcctctg

SEQ ID NO: 3508770 - DNA, 21 bp, Homo sapiens
ttcagtacttttttaaatatt

SEQ ID NO: 3508771 - DNA, 17 bp, Homo sapiens
ttcagtccaataggtgt

SEQ ID NO: 3508772 - DNA, 17 bp, Homo sapiens
ttcagtggcagctgctt

SEQ ID NO: 3508773 - DNA, 13 bp, Homo sapiens
ttcagtgtaaata

SEQ ID NO: 3508774 - DNA, 12 bp, Homo sapiens
ttcagtgttaaa

SEQ ID NO: 3508775 - DNA, 22 bp, Homo sapiens
ttcagtgttaaatgtgatgaat

SEQ ID NO: 3508776 - DNA, 21 bp, Homo sapiens
ttcagttttcatttggttcat

SEQ ID NO: 3508777 - DNA, 16 bp, Homo sapiens
ttcataacttcctgta

SEQ ID NO: 3508778 - DNA, 17 bp, Homo sapiens
ttcataagtatttcaaa

SEQ ID NO: 3508779 - DNA, 14 bp, Homo sapiens
ttcataatctttgc

SEQ ID NO: 3508780 - DNA, 14 bp, Homo sapiens
ttcatatattgcat

SEQ ID NO: 3508781 - DNA, 21 bp, Homo sapiens
ttcatatattgcatttctgta

SEQ ID NO: 3508782 - DNA, 16 bp, Homo sapiens
ttcatattctttcaat

SEQ ID NO: 3508783 - DNA, 13 bp, Homo sapiens
ttcatattctttt

SEQ ID NO: 3508784 - DNA, 14 bp, Homo sapiens
ttcatattctttta

SEQ ID NO: 3508785 - DNA, 19 bp, Homo sapiens
ttcatcaaatggaagacac

SEQ ID NO: 3508786 - DNA, 17 bp, Homo sapiens
ttcatcattccctctca

SEQ ID NO: 3508787 - DNA, 20 bp, Homo sapiens
ttcatcattccctctcatct

SEQ ID NO: 3508788 - DNA, 14 bp, Homo sapiens
ttcatccccttacc

SEQ ID NO: 3508789 - DNA, 15 bp, Homo sapiens
ttcatccccttaccc

SEQ ID NO: 3508790 - DNA, 14 bp, Homo sapiens
ttcatccgcactgt

SEQ ID NO: 3508791 - DNA, 18 bp, Homo sapiens
ttcatcgaatctactaat

SEQ ID NO: 3508792 - DNA, 22 bp, Homo sapiens
ttcatctatggcagtccagcca

SEQ ID NO: 3508793 - DNA, 22 bp, Homo sapiens
ttcatctcccacctagcagcac

SEQ ID NO: 3508794 - DNA, 14 bp, Homo sapiens
ttcatctctttaga

SEQ ID NO: 3508795 - DNA, 16 bp, Homo sapiens
ttcatctctttagaga

SEQ ID NO: 3508796 - DNA, 13 bp, Homo sapiens
ttcatctgctctc

SEQ ID NO: 3508797 - DNA, 19 bp, Homo sapiens
ttcatgccaccatggccag

SEQ ID NO: 3508798 - DNA, 13 bp, Homo sapiens
ttcatggatcaga

SEQ ID NO: 3508799 - DNA, 17 bp, Homo sapiens
ttcatggcagaaggcaa

SEQ ID NO: 3508800 - DNA, 14 bp, Homo sapiens
ttcatgtaaactgt

SEQ ID NO: 3508801 - DNA, 18 bp, Homo sapiens
ttcatgtaaactgtgcac

SEQ ID NO: 3508802 - DNA, 18 bp, Homo sapiens
ttcatgtaatcctcaaga

SEQ ID NO: 3508803 - DNA, 15 bp, Homo sapiens
ttcattatttgtcaa

SEQ ID NO: 3508804 - DNA, 12 bp, Homo sapiens
ttcattccccag

SEQ ID NO: 3508805 - DNA, 19 bp, Homo sapiens
ttcattcttgaaagctgtg

SEQ ID NO: 3508806 - DNA, 21 bp, Homo sapiens
ttcattgaggataaattgcca

SEQ ID NO: 3508807 - DNA, 20 bp, Homo sapiens
ttcattgatttcctgtgtca

SEQ ID NO: 3508808 - DNA, 15 bp, Homo sapiens
ttcatttcctgtgtc

SEQ ID NO: 3508809 - DNA, 22 bp, Homo sapiens
ttcatttggttcattaattcta

SEQ ID NO: 3508810 - DNA, 22 bp, Homo sapiens
ttcatttgtggtgatatagaat

SEQ ID NO: 3508811 - DNA, 15 bp, Homo sapiens
ttcattttatgaaga

SEQ ID NO: 3508812 - DNA, 19 bp, Homo sapiens
ttcattttctagatacaat

SEQ ID NO: 3508813 - DNA, 15 bp, Homo sapiens
ttcatttttgtaata

SEQ ID NO: 3508814 - DNA, 14 bp, Homo sapiens
ttcatttttttcca

SEQ ID NO: 3508815 - DNA, 21 bp, Homo sapiens
ttccaaaagtggcctctttgt

SEQ ID NO: 3508816 - DNA, 22 bp, Homo sapiens
ttccaaaagtggcctctttgtc

SEQ ID NO: 3508817 - DNA, 21 bp, Homo sapiens
ttccaaagaaaagtattgttt

SEQ ID NO: 3508818 - DNA, 22 bp, Homo sapiens
ttccaaagagtagaattgcatt

SEQ ID NO: 3508819 - DNA, 21 bp, Homo sapiens
ttccaaatgtaataaacttta

SEQ ID NO: 3508820 - DNA, 15 bp, Homo sapiens
ttccaaattcacaag

SEQ ID NO: 3508821 - DNA, 15 bp, Homo sapiens
ttccaatgcttctta

SEQ ID NO: 3508822 - DNA, 18 bp, Homo sapiens
ttccacaccaagcagcaa

SEQ ID NO: 3508823 - DNA, 22 bp, Homo sapiens
ttccaccacagccagcacctgg

SEQ ID NO: 3508824 - DNA, 19 bp, Homo sapiens
ttccactattttcaaagaa

SEQ ID NO: 3508825 - DNA, 18 bp, Homo sapiens
ttccacttgtttgcactg

SEQ ID NO: 3508826 - DNA, 16 bp, Homo sapiens
ttccagaatgctgtac

SEQ ID NO: 3508827 - DNA, 18 bp, Homo sapiens
ttccagaatgctgtacat

SEQ ID NO: 3508828 - DNA, 20 bp, Homo sapiens
ttccagacttccttgagaca

SEQ ID NO: 3508829 - DNA, 16 bp, Homo sapiens
ttccagccagggctgc

SEQ ID NO: 3508830 - DNA, 13 bp, Homo sapiens
ttccagctcctca

SEQ ID NO: 3508831 - DNA, 18 bp, Homo sapiens
ttccagctggatgagaat

SEQ ID NO: 3508832 - DNA, 22 bp, Homo sapiens
ttccaggaggagttagccaaac

SEQ ID NO: 3508833 - DNA, 18 bp, Homo sapiens
ttccagggatttgcctca

SEQ ID NO: 3508834 - DNA, 18 bp, Homo sapiens
ttccagggtccctctgtg

SEQ ID NO: 3508835 - DNA, 17 bp, Homo sapiens
ttccaggtttaagctgt

SEQ ID NO: 3508836 - DNA, 11 bp, Homo sapiens
ttccagtctcc

SEQ ID NO: 3508837 - DNA, 20 bp, Homo sapiens
ttccagtctccaccaggaac

SEQ ID NO: 3508838 - DNA, 18 bp, Homo sapiens
ttccagtgtccttagaac

SEQ ID NO: 3508839 - DNA, 21 bp, Homo sapiens
ttccatagtgttaactgtcag

SEQ ID NO: 3508840 - DNA, 15 bp, Homo sapiens
ttccatatatccttt

SEQ ID NO: 3508841 - DNA, 13 bp, Homo sapiens
ttccatctttaca

SEQ ID NO: 3508842 - DNA, 16 bp, Homo sapiens
ttccatggccctcatt

SEQ ID NO: 3508843 - DNA, 12 bp, Homo sapiens
ttccatgggaat

SEQ ID NO: 3508844 - DNA, 20 bp, Homo sapiens
ttccatgtcccctcccagag

SEQ ID NO: 3508845 - DNA, 13 bp, Homo sapiens
ttccattcccttc

SEQ ID NO: 3508846 - DNA, 14 bp, Homo sapiens
ttccattcccttcg

SEQ ID NO: 3508847 - DNA, 16 bp, Homo sapiens
ttccattcccttcggc

SEQ ID NO: 3508848 - DNA, 22 bp, Homo sapiens
ttccattgtttaaaaatacaca

SEQ ID NO: 3508849 - DNA, 21 bp, Homo sapiens
ttccatttccagttcatctat

SEQ ID NO: 3508850 - DNA, 17 bp, Homo sapiens
ttcccaaaattagggag

SEQ ID NO: 3508851 - DNA, 21 bp, Homo sapiens
ttcccaaccccttaagccctg

SEQ ID NO: 3508852 - DNA, 15 bp, Homo sapiens
ttcccaactctagct

SEQ ID NO: 3508853 - DNA, 15 bp, Homo sapiens
ttcccaagatgcctg

SEQ ID NO: 3508854 - DNA, 13 bp, Homo sapiens
ttcccaagctctg

SEQ ID NO: 3508855 - DNA, 14 bp, Homo sapiens
ttcccaatcttctt

SEQ ID NO: 3508856 - DNA, 22 bp, Homo sapiens
ttcccagcactatgctttcctt

SEQ ID NO: 3508857 - DNA, 15 bp, Homo sapiens
ttgcactatctttca

SEQ ID NO: 3508858 - DNA, 16 bp, Homo sapiens
ttgcactccagcctgg

SEQ ID NO: 3508859 - DNA, 19 bp, Homo sapiens
ttgcactgaaatggaattc

SEQ ID NO: 3508860 - DNA, 21 bp, Homo sapiens
ttgcactgtgtgctgactgaa

SEQ ID NO: 3508861 - DNA, 15 bp, Homo sapiens
ttgcagaagagggtg

SEQ ID NO: 3508862 - DNA, 15 bp, Homo sapiens
ttgcagacaggaatc

SEQ ID NO: 3508863 - DNA, 16 bp, Homo sapiens
ttgcagacaggaatct

SEQ ID NO: 3508864 - DNA, 16 bp, Homo sapiens
ttgcagacaggcaagc

SEQ ID NO: 3508865 - DNA, 16 bp, Homo sapiens
ttgcaggttcatggat

SEQ ID NO: 3508866 - DNA, 13 bp, Homo sapiens
ttgcataaggttt

SEQ ID NO: 3508867 - DNA, 20 bp, Homo sapiens
ttgcatctcccagataatgt

SEQ ID NO: 3508868 - DNA, 13 bp, Homo sapiens
ttgcatctgtata

SEQ ID NO: 3508869 - DNA, 15 bp, Homo sapiens
ttgcatgtgactctg

SEQ ID NO: 3508870 - DNA, 20 bp, Homo sapiens
ttgcattaaattcacaaact

SEQ ID NO: 3508871 - DNA, 21 bp, Homo sapiens
ttgcattgaccgcgactaatt

SEQ ID NO: 3508872 - DNA, 14 bp, Homo sapiens
ttgcatttctgtat

SEQ ID NO: 3508873 - DNA, 13 bp, Homo sapiens
ttgccaaaattca

SEQ ID NO: 3508874 - DNA, 19 bp, Homo sapiens
ttgccagagatccaaaaga

SEQ ID NO: 3508875 - DNA, 18 bp, Homo sapiens
ttgccagatgctgcagag

SEQ ID NO: 3508876 - DNA, 18 bp, Homo sapiens
ttgccagccagaagcctc

SEQ ID NO: 3508877 - DNA, 11 bp, Homo sapiens
ttgccataata

SEQ ID NO: 3508878 - DNA, 13 bp, Homo sapiens
ttgccatattgca

SEQ ID NO: 3508879 - DNA, 19 bp, Homo sapiens
ttgccatattttcaccatt

SEQ ID NO: 3508880 - DNA, 17 bp, Homo sapiens
ttgccatccattctgga

SEQ ID NO: 3508881 - DNA, 20 bp, Homo sapiens
ttgccattctcttgcattgt

SEQ ID NO: 3508882 - DNA, 14 bp, Homo sapiens
ttgcccaggcaggt

SEQ ID NO: 3508883 - DNA, 14 bp, Homo sapiens
ttgcccaggctggc

SEQ ID NO: 3508884 - DNA, 19 bp, Homo sapiens
ttgcccctttctcttttcc

SEQ ID NO: 3508885 - DNA, 16 bp, Homo sapiens
ttgccctggggatcaa

SEQ ID NO: 3508886 - DNA, 21 bp, Homo sapiens
ttgccgcgtcgccctcccagg

SEQ ID NO: 3508887 - DNA, 22 bp, Homo sapiens
ttgccgcgtcgccctcccaggc

SEQ ID NO: 3508888 - DNA, 19 bp, Homo sapiens
ttgcctctgtgctgtgtgt

SEQ ID NO: 3508889 - DNA, 12 bp, Homo sapiens
ttgcctgcaggc

SEQ ID NO: 3508890 - DNA, 11 bp, Homo sapiens
ttgcctggcct

SEQ ID NO: 3508891 - DNA, 23 bp, Homo sapiens
ttgcctttagtgatcacagcagc

SEQ ID NO: 3508892 - DNA, 17 bp, Homo sapiens
ttgcctttcgaggcctg

SEQ ID NO: 3508893 - DNA, 17 bp, Homo sapiens
ttgcctttgaatgttaa

SEQ ID NO: 3508894 - DNA, 14 bp, Homo sapiens
ttgctaatgttgct

SEQ ID NO: 3508895 - DNA, 14 bp, Homo sapiens
ttgctctaggaaga

SEQ ID NO: 3508896 - DNA, 21 bp, Homo sapiens
ttgctgcaccaatgcactgag

SEQ ID NO: 3508897 - DNA, 21 bp, Homo sapiens
ttgctgcagagaaacttaagc

SEQ ID NO: 3508898 - DNA, 11 bp, Homo sapiens
ttgctgccaga

SEQ ID NO: 3508899 - DNA, 20 bp, Homo sapiens
ttgctgccccatcagtgctc

SEQ ID NO: 3508900 - DNA, 21 bp, Homo sapiens
ttgctgcctgaagaacagtaa

SEQ ID NO: 3508901 - DNA, 13 bp, Homo sapiens
ttgctgctgaagg

SEQ ID NO: 3508902 - DNA, 15 bp, Homo sapiens
ttgctgctgtccagt

SEQ ID NO: 3508903 - DNA, 16 bp, Homo sapiens
ttgctgcttgaggcaa

SEQ ID NO: 3508904 - DNA, 23 bp, Homo sapiens
ttgctgcttttccttggggcagg

SEQ ID NO: 3508905 - DNA, 16 bp, Homo sapiens
ttgctgtaagatgtct

SEQ ID NO: 3508906 - DNA, 21 bp, Homo sapiens
ttgctgtatgctgatcatcgc

SEQ ID NO: 3508907 - DNA, 20 bp, Homo sapiens
ttgctgtcacttcttcacct

SEQ ID NO: 3508908 - DNA, 14 bp, Homo sapiens
ttgctgttgtccaa

SEQ ID NO: 3508909 - DNA, 14 bp, Homo sapiens
ttgctgttttcctc

SEQ ID NO: 3508910 - DNA, 16 bp, Homo sapiens
ttgctgttttcctccc

SEQ ID NO: 3508911 - DNA, 18 bp, Homo sapiens
ttgctgttttcctccctt

SEQ ID NO: 3508912 - DNA, 20 bp, Homo sapiens
ttgctgttttcctcccttct

SEQ ID NO: 3508913 - DNA, 22 bp, Homo sapiens
ttgctgttttcctcccttctgc

SEQ ID NO: 3508914 - DNA, 19 bp, Homo sapiens
ttgcttatcaacttcctaa

SEQ ID NO: 3508915 - DNA, 15 bp, Homo sapiens
ttgcttcttactgat

SEQ ID NO: 3508916 - DNA, 14 bp, Homo sapiens
ttgctttgttgcac

SEQ ID NO: 3508917 - DNA, 13 bp, Homo sapiens
ttgcttttgcttc

SEQ ID NO: 3508918 - DNA, 15 bp, Homo sapiens
ttgctttttcttctc

SEQ ID NO: 3508919 - DNA, 21 bp, Homo sapiens
ttggaagatcctgtgaggagc

SEQ ID NO: 3508920 - DNA, 17 bp, Homo sapiens
ttggaagtgttccctga

SEQ ID NO: 3508921 - DNA, 13 bp, Homo sapiens
ttggaatactttt

SEQ ID NO: 3508922 - DNA, 22 bp, Homo sapiens
ttggaatgcacagggcaattga

SEQ ID NO: 3508923 - DNA, 22 bp, Homo sapiens
ttggaatgcagaggtctccaaa

SEQ ID NO: 3508924 - DNA, 18 bp, Homo sapiens
ttggaatgggcagctcat

SEQ ID NO: 3508925 - DNA, 16 bp, Homo sapiens
ttggacaggggattgg

SEQ ID NO: 3508926 - DNA, 15 bp, Homo sapiens
ttggacatcagtgtt

SEQ ID NO: 3508927 - DNA, 14 bp, Homo sapiens
ttggacccttccat

SEQ ID NO: 3508928 - DNA, 16 bp, Homo sapiens
ttggacccttccatgg

SEQ ID NO: 3508929 - DNA, 21 bp, Homo sapiens
ttggacctaaatggcctcatg

SEQ ID NO: 3508930 - DNA, 17 bp, Homo sapiens
ttggacggctgggcaca

SEQ ID NO: 3508931 - DNA, 14 bp, Homo sapiens
ttggactccatctc

SEQ ID NO: 3508932 - DNA, 18 bp, Homo sapiens
ttggagaatttaggtttt

SEQ ID NO: 3508933 - DNA, 22 bp, Homo sapiens
ttggagatgctgagggtgtttc

SEQ ID NO: 3508934 - DNA, 15 bp, Homo sapiens
ttggagcccagggca

SEQ ID NO: 3508935 - DNA, 16 bp, Homo sapiens
ttggagctattcaaga

SEQ ID NO: 3508936 - DNA, 15 bp, Homo sapiens
ttggaggacagtggg

SEQ ID NO: 3508937 - DNA, 15 bp, Homo sapiens
ttggaggccagccag

SEQ ID NO: 3508938 - DNA, 17 bp, Homo sapiens
ttggatctgtgacacat

SEQ ID NO: 3508939 - DNA, 12 bp, Homo sapiens
ttggatgaaggt

SEQ ID NO: 3508940 - DNA, 14 bp, Homo sapiens
ttggattgtatatt

SEQ ID NO: 3508941 - DNA, 16 bp, Homo sapiens
ttggatttttgactct

SEQ ID NO: 3508942 - DNA, 13 bp, Homo sapiens
ttggcaccagaca

SEQ ID NO: 3508943 - DNA, 21 bp, Homo sapiens
ttggcacctaatccaggcaga

SEQ ID NO: 3508944 - DNA, 19 bp, Homo sapiens
ttggcagtggactcagaaa

SEQ ID NO: 3508945 - DNA, 24 bp, Homo sapiens
ttggccaaagccaaagctaggcct

SEQ ID NO: 3508946 - DNA, 22 bp, Homo sapiens
ttggccactccgagaggtgggc

SEQ ID NO: 3508947 - DNA, 17 bp, Homo sapiens
ttggcctgatcagacca

SEQ ID NO: 3508948 - DNA, 19 bp, Homo sapiens
ttggcctgatcagaccacg

SEQ ID NO: 3508949 - DNA, 12 bp, Homo sapiens
ttggcctgggcc

SEQ ID NO: 3508950 - DNA, 21 bp, Homo sapiens
ttggccttctcccctcttctg

SEQ ID NO: 3508951 - DNA, 23 bp, Homo sapiens
ttggccttctcccctcttctgag

SEQ ID NO: 3508952 - DNA, 23 bp, Homo sapiens
ttggctattagagatcaacccct

SEQ ID NO: 3508953 - DNA, 17 bp, Homo sapiens
ttggctcacactgagaa

SEQ ID NO: 3508954 - DNA, 14 bp, Homo sapiens
ttggctcagacatg

SEQ ID NO: 3508955 - DNA, 14 bp, Homo sapiens
ttggctgtgtctaa

SEQ ID NO: 3508956 - DNA, 17 bp, Homo sapiens
ttggcttgcttatgtgt

SEQ ID NO: 3508957 - DNA, 17 bp, Homo sapiens
ttggcttgttattgcct

SEQ ID NO: 3508958 - DNA, 14 bp, Homo sapiens
ttggctttatcctc

SEQ ID NO: 3508959 - DNA, 21 bp, Homo sapiens
ttggctttatcctctttagag

SEQ ID NO: 3508960 - DNA, 18 bp, Homo sapiens
ttggctttttactattaa

SEQ ID NO: 3508961 - DNA, 19 bp, Homo sapiens
ttgggaatatttgaatctt

SEQ ID NO: 3508962 - DNA, 19 bp, Homo sapiens
ttgggagagcaggaatgaa

SEQ ID NO: 3508963 - DNA, 18 bp, Homo sapiens
ttgggagccactgccact

SEQ ID NO: 3508964 - DNA, 17 bp, Homo sapiens
ttgggaggccccactgg

SEQ ID NO: 3508965 - DNA, 18 bp, Homo sapiens
ttgggccaagccagctgc

SEQ ID NO: 3508966 - DNA, 21 bp, Homo sapiens
ttgggccaagccagctgccta

SEQ ID NO: 3508967 - DNA, 20 bp, Homo sapiens
ttgggcctgctccagacctg

SEQ ID NO: 3508968 - DNA, 19 bp, Homo sapiens
ttgggctggaacagattca

SEQ ID NO: 3508969 - DNA, 14 bp, Homo sapiens
ttgggcttcagcct

SEQ ID NO: 3508970 - DNA, 14 bp, Homo sapiens
ttggggaaggggca

SEQ ID NO: 3508971 - DNA, 20 bp, Homo sapiens
ttggggagttaagacctggc

SEQ ID NO: 3508972 - DNA, 21 bp, Homo sapiens
ttgggggggctcccgtggcct

SEQ ID NO: 3508973 - DNA, 22 bp, Homo sapiens
ttggggtacccactgctctggt

SEQ ID NO: 3508974 - DNA, 15 bp, Homo sapiens
ttggggtttgatttg

SEQ ID NO: 3508975 - DNA, 22 bp, Homo sapiens
ttggggtttgatttgcttttga

SEQ ID NO: 3508976 - DNA, 17 bp, Homo sapiens
ttgggtctctctccatt

SEQ ID NO: 3508977 - DNA, 22 bp, Homo sapiens
ttgggttcaagcgattcttctg

SEQ ID NO: 3508978 - DNA, 17 bp, Homo sapiens
ttggtactataaaagct

SEQ ID NO: 3508979 - DNA, 20 bp, Homo sapiens
ttggtctgacccactgcttt

SEQ ID NO: 3508980 - DNA, 16 bp, Homo sapiens
ttggtgttaattgaaa

SEQ ID NO: 3508981 - DNA, 17 bp, Homo sapiens
ttggttaaaaaaaagaa

SEQ ID NO: 3508982 - DNA, 18 bp, Homo sapiens
ttggttaatttttacatg

SEQ ID NO: 3508983 - DNA, 15 bp, Homo sapiens
ttggttctaatagaa

SEQ ID NO: 3508984 - DNA, 13 bp, Homo sapiens
ttggttctgtgtc

SEQ ID NO: 3508985 - DNA, 18 bp, Homo sapiens
ttggttgttttttccttt

SEQ ID NO: 3508986 - DNA, 14 bp, Homo sapiens
ttggtttattttca

SEQ ID NO: 3508987 - DNA, 18 bp, Homo sapiens
ttggtttttaaaacccag

SEQ ID NO: 3508988 - DNA, 18 bp, Homo sapiens
ttgtaaaaaaaaaaaaca

SEQ ID NO: 3508989 - DNA, 14 bp, Homo sapiens
ttgtaaaaaattca

SEQ ID NO: 3508990 - DNA, 18 bp, Homo sapiens
tttaagggaatgtgagca

SEQ ID NO: 3508991 - DNA, 19 bp, Homo sapiens
tttaagtattgtttcctga

SEQ ID NO: 3508992 - DNA, 17 bp, Homo sapiens
tttaagttaatagattt

SEQ ID NO: 3508993 - DNA, 16 bp, Homo sapiens
tttaatccccagtaaa

SEQ ID NO: 3508994 - DNA, 18 bp, Homo sapiens
tttaatctgttatgtact

SEQ ID NO: 3508995 - DNA, 22 bp, Homo sapiens
tttaatgcaagagaacatttta

SEQ ID NO: 3508996 - DNA, 18 bp, Homo sapiens
tttaatgcttaagatttg

SEQ ID NO: 3508997 - DNA, 19 bp, Homo sapiens
tttaatggacacttttcac

SEQ ID NO: 3508998 - DNA, 21 bp, Homo sapiens
tttaatggacacttttcacct

SEQ ID NO: 3508999 - DNA, 19 bp, Homo sapiens
tttaatgttttaaatgtac

SEQ ID NO: 3509000 - DNA, 16 bp, Homo sapiens
tttaatttagatattt

SEQ ID NO: 3509001 - DNA, 16 bp, Homo sapiens
tttaatttagtaaatg

SEQ ID NO: 3509002 - DNA, 19 bp, Homo sapiens
tttaatttagtaaatgtta

SEQ ID NO: 3509003 - DNA, 17 bp, Homo sapiens
tttaattttttaaataa

SEQ ID NO: 3509004 - DNA, 19 bp, Homo sapiens
tttacaaaactacatgaga

SEQ ID NO: 3509005 - DNA, 18 bp, Homo sapiens
tttacaaagtgtgtatta

SEQ ID NO: 3509006 - DNA, 21 bp, Homo sapiens
tttacaagcccccccttccac

SEQ ID NO: 3509007 - DNA, 21 bp, Homo sapiens
tttacaatcagccacattcta

SEQ ID NO: 3509008 - DNA, 15 bp, Homo sapiens
tttacaatgtcatat

SEQ ID NO: 3509009 - DNA, 19 bp, Homo sapiens
tttacaatttacaaagtgt

SEQ ID NO: 3509010 - DNA, 23 bp, Homo sapiens
tttacagccagtgggagatgtta

SEQ ID NO: 3509011 - DNA, 21 bp, Homo sapiens
tttacatacactgtatgttat

SEQ ID NO: 3509012 - DNA, 12 bp, Homo sapiens
tttacatttcta

SEQ ID NO: 3509013 - DNA, 17 bp, Homo sapiens
tttacggacaccccctc

SEQ ID NO: 3509014 - DNA, 18 bp, Homo sapiens
tttactagggatccctca

SEQ ID NO: 3509015 - DNA, 15 bp, Homo sapiens
tttactattaacatg

SEQ ID NO: 3509016 - DNA, 16 bp, Homo sapiens
tttactcctcacactt

SEQ ID NO: 3509017 - DNA, 18 bp, Homo sapiens
tttactgaccctggggct

SEQ ID NO: 3509018 - DNA, 14 bp, Homo sapiens
tttactgagcttct

SEQ ID NO: 3509019 - DNA, 20 bp, Homo sapiens
tttactttagaagcacagta

SEQ ID NO: 3509020 - DNA, 20 bp, Homo sapiens
tttagaaaaagaacatgcag

SEQ ID NO: 3509021 - DNA, 22 bp, Homo sapiens
tttagaaaaagaacatgcagtt

SEQ ID NO: 3509022 - DNA, 23 bp, Homo sapiens
tttagaaagaagcccaatattat

SEQ ID NO: 3509023 - DNA, 13 bp, Homo sapiens
tttagaaagcatt

SEQ ID NO: 3509024 - DNA, 19 bp, Homo sapiens
tttagaaatactgcaagaa

SEQ ID NO: 3509025 - DNA, 20 bp, Homo sapiens
tttagaaatactgcaagaaa

SEQ ID NO: 3509026 - DNA, 14 bp, Homo sapiens
tttagaagtagaat

SEQ ID NO: 3509027 - DNA, 13 bp, Homo sapiens
tttagaattaaaa

SEQ ID NO: 3509028 - DNA, 17 bp, Homo sapiens
tttagagaatgtgtttc

SEQ ID NO: 3509029 - DNA, 15 bp, Homo sapiens
tttagagaggaaaag

SEQ ID NO: 3509030 - DNA, 16 bp, Homo sapiens
tttagagttagactgt

SEQ ID NO: 3509031 - DNA, 15 bp, Homo sapiens
tttagatattttcca

SEQ ID NO: 3509032 - DNA, 17 bp, Homo sapiens
tttagatattttccata

SEQ ID NO: 3509033 - DNA, 18 bp, Homo sapiens
tttaggaatcctttggtg

SEQ ID NO: 3509034 - DNA, 20 bp, Homo sapiens
tttaggagggagttatctaa

SEQ ID NO: 3509035 - DNA, 13 bp, Homo sapiens
tttaggatactta

SEQ ID NO: 3509036 - DNA, 20 bp, Homo sapiens
tttagggctgtaaaatgcat

SEQ ID NO: 3509037 - DNA, 14 bp, Homo sapiens
tttaggtctttgta

SEQ ID NO: 3509038 - DNA, 17 bp, Homo sapiens
tttaggtctttgtaaga

SEQ ID NO: 3509039 - DNA, 16 bp, Homo sapiens
tttagtaaatgttatc

SEQ ID NO: 3509040 - DNA, 15 bp, Homo sapiens
tttagtaatttcttt

SEQ ID NO: 3509041 - DNA, 15 bp, Homo sapiens
tttagtagagacagg

SEQ ID NO: 3509042 - DNA, 18 bp, Homo sapiens
tttagtctaacacagttg

SEQ ID NO: 3509043 - DNA, 16 bp, Homo sapiens
tttagtctgcaaaatg

SEQ ID NO: 3509044 - DNA, 12 bp, Homo sapiens
tttataaacaga

SEQ ID NO: 3509045 - DNA, 20 bp, Homo sapiens
tttataaataaactgttgct

SEQ ID NO: 3509046 - DNA, 14 bp, Homo sapiens
tttataagaaaaac

SEQ ID NO: 3509047 - DNA, 18 bp, Homo sapiens
tttataagaaaaactttt

SEQ ID NO: 3509048 - DNA, 17 bp, Homo sapiens
tttataagtcattgtat

SEQ ID NO: 3509049 - DNA, 15 bp, Homo sapiens
tttataatgttgtat

SEQ ID NO: 3509050 - DNA, 17 bp, Homo sapiens
tttatacaaattagaaa

SEQ ID NO: 3509051 - DNA, 19 bp, Homo sapiens
tttatacaaattagaaaat

SEQ ID NO: 3509052 - DNA, 13 bp, Homo sapiens
tttatactgtata

SEQ ID NO: 3509053 - DNA, 14 bp, Homo sapiens
tttatagatcattt

SEQ ID NO: 3509054 - DNA, 18 bp, Homo sapiens
tttataggtgagaaaaaa

SEQ ID NO: 3509055 - DNA, 19 bp, Homo sapiens
tttatatatctaagttcac

SEQ ID NO: 3509056 - DNA, 22 bp, Homo sapiens
tttatatatctaagttcacagt

SEQ ID NO: 3509057 - DNA, 14 bp, Homo sapiens
tttatatgtacatg

SEQ ID NO: 3509058 - DNA, 17 bp, Homo sapiens
tttatatgtacatgaga

SEQ ID NO: 3509059 - DNA, 16 bp, Homo sapiens
tttatccaaaatgtgt

SEQ ID NO: 3509060 - DNA, 14 bp, Homo sapiens
tttatccataatga

SEQ ID NO: 3509061 - DNA, 16 bp, Homo sapiens
tttatccataatgatg

SEQ ID NO: 3509062 - DNA, 18 bp, Homo sapiens
tttatcctctttagagtt

SEQ ID NO: 3509063 - DNA, 14 bp, Homo sapiens
tttatctgtttcct

SEQ ID NO: 3509064 - DNA, 19 bp, Homo sapiens
tttatctttgattctcctt

SEQ ID NO: 3509065 - DNA, 21 bp, Homo sapiens
tttatgctgaaacagaatact

SEQ ID NO: 3509066 - DNA, 23 bp, Homo sapiens
tttatgtttgcacttgtgattat

SEQ ID NO: 3509067 - DNA, 14 bp, Homo sapiens
tttattaaacagat

SEQ ID NO: 3509068 - DNA, 16 bp, Homo sapiens
tttattaaacagatat

SEQ ID NO: 3509069 - DNA, 21 bp, Homo sapiens
tttattaaatacaaaacttcc

SEQ ID NO: 3509070 - DNA, 12 bp, Homo sapiens
tttattaaatag

SEQ ID NO: 3509071 - DNA, 13 bp, Homo sapiens
tttattacctctg

SEQ ID NO: 3509072 - DNA, 16 bp, Homo sapiens
tttattatttatttat

SEQ ID NO: 3509073 - DNA, 12 bp, Homo sapiens
tttattgacaat

SEQ ID NO: 3509074 - DNA, 22 bp, Homo sapiens
tttattgccttctcaccagctg

SEQ ID NO: 3509075 - DNA, 16 bp, Homo sapiens
tttattgtgtttgtca

SEQ ID NO: 3509076 - DNA, 22 bp, Homo sapiens
tttattgtgtttgtcattagcc

SEQ ID NO: 3509077 - DNA, 14 bp, Homo sapiens
tttatttatttaca

SEQ ID NO: 3509078 - DNA, 14 bp, Homo sapiens
tttatttgcttctt

SEQ ID NO: 3509079 - DNA, 12 bp, Homo sapiens
tttattttacta

SEQ ID NO: 3509080 - DNA, 17 bp, Homo sapiens
tttattttactagaaat

SEQ ID NO: 3509081 - DNA, 21 bp, Homo sapiens
tttattttcttttgtaaatgt

SEQ ID NO: 3509082 - DNA, 13 bp, Homo sapiens
tttattttggaac

SEQ ID NO: 3509083 - DNA, 18 bp, Homo sapiens
tttattttggaactatga

SEQ ID NO: 3509084 - DNA, 12 bp, Homo sapiens
tttatttttcat

SEQ ID NO: 3509085 - DNA, 20 bp, Homo sapiens
tttcaaaactcatttcctat

SEQ ID NO: 3509086 - DNA, 11 bp, Homo sapiens
tttcaaaatag

SEQ ID NO: 3509087 - DNA, 21 bp, Homo sapiens
tttcaaaatagaaaagttatt

SEQ ID NO: 3509088 - DNA, 12 bp, Homo sapiens
tttcaaaatgct

SEQ ID NO: 3509089 - DNA, 13 bp, Homo sapiens
tttcaaaatgctt

SEQ ID NO: 3509090 - DNA, 15 bp, Homo sapiens
tttcaaaccagcttc

SEQ ID NO: 3509091 - DNA, 12 bp, Homo sapiens
tttcaaagcaat

SEQ ID NO: 3509092 - DNA, 21 bp, Homo sapiens
tttcaaatctcttccttccct

SEQ ID NO: 3509093 - DNA, 23 bp, Homo sapiens
tttcaaatttagaaactaattga

SEQ ID NO: 3509094 - DNA, 17 bp, Homo sapiens
tttcaacagtgaagaca

SEQ ID NO: 3509095 - DNA, 19 bp, Homo sapiens
tttcaaccataaaagaagt

SEQ ID NO: 3509096 - DNA, 15 bp, Homo sapiens
tttcaactatgtagg

SEQ ID NO: 3509097 - DNA, 15 bp, Homo sapiens
tttcaaggccttcag

SEQ ID NO: 3509098 - DNA, 16 bp, Homo sapiens
tttcaaggccttcagt

SEQ ID NO: 3509099 - DNA, 18 bp, Homo sapiens
tttcaagtcaaattaata

SEQ ID NO: 3509100 - DNA, 19 bp, Homo sapiens
tttcaataaagcatttata

SEQ ID NO: 3509101 - DNA, 20 bp, Homo sapiens
tttcaataaagcatttataa

SEQ ID NO: 3509102 - DNA, 18 bp, Homo sapiens
tttcaattgcatctccca

SEQ ID NO: 3509103 - DNA, 17 bp, Homo sapiens
tttcacaaggtctttaa

SEQ ID NO: 3509104 - DNA, 20 bp, Homo sapiens
tttcacaccggaaggttttt

SEQ ID NO: 3509105 - DNA, 17 bp, Homo sapiens
tttcacattagaagaca

SEQ ID NO: 3509106 - DNA, 18 bp, Homo sapiens
tttcacattagaagacaa

SEQ ID NO: 3509107 - DNA, 19 bp, Homo sapiens
tttcacattgtttgctgct

SEQ ID NO: 3509108 - DNA, 17 bp, Homo sapiens
tttcacccctccctttc

SEQ ID NO: 3509109 - DNA, 22 bp, Homo sapiens
tttcacccctccctttctcccc

SEQ ID NO: 3509110 - DNA, 17 bp, Homo sapiens
tttcacctccttcaatt

SEQ ID NO: 3509111 - DNA, 19 bp, Homo sapiens
tttcacctttactttagaa

SEQ ID NO: 3509112 - DNA, 23 bp, Homo sapiens
tttcacggaagttttcaatgatg

SEQ ID NO: 3509113 - DNA, 24 bp, Homo sapiens
tttcactcttattgcccacgctgg

SEQ ID NO: 3509114 - DNA, 11 bp, Homo sapiens
tttcagactcc

SEQ ID NO: 3509115 - DNA, 15 bp, Homo sapiens
tttcagacttgtcaa

SEQ ID NO: 3509116 - DNA, 16 bp, Homo sapiens
tttcagagaccattgc

SEQ ID NO: 3509117 - DNA, 19 bp, Homo sapiens
tttcagatgtaatgttttc

SEQ ID NO: 3509118 - DNA, 18 bp, Homo sapiens
tttcagatgtgaaccatt

SEQ ID NO: 3509119 - DNA, 18 bp, Homo sapiens
tttcagcattaagctgtt

SEQ ID NO: 3509120 - DNA, 14 bp, Homo sapiens
tttcagcttacaca

SEQ ID NO: 3509121 - DNA, 21 bp, Homo sapiens
tttcaggctcgccaaggccta

SEQ ID NO: 3509122 - DNA, 18 bp, Homo sapiens
tttcataagtatttcaaa

SEQ ID NO: 3509123 - DNA, 14 bp, Homo sapiens
gccccactggggaa

SEQ ID NO: 3509124 - DNA, 12 bp, Homo sapiens
gccccagcccag

SEQ ID NO: 3509125 - DNA, 22 bp, Homo sapiens
gccccaggaaaggcccagccac

SEQ ID NO: 3509126 - DNA, 15 bp, Homo sapiens
gccccaggaccagct

SEQ ID NO: 3509127 - DNA, 16 bp, Homo sapiens
gccccaggaccagctc

SEQ ID NO: 3509128 - DNA, 19 bp, Homo sapiens
gccccaggaccagctcagg

SEQ ID NO: 3509129 - DNA, 21 bp, Homo sapiens
gccccaggcagggccaaccct

SEQ ID NO: 3509130 - DNA, 13 bp, Homo sapiens
gccccagtgccca

SEQ ID NO: 3509131 - DNA, 14 bp, Homo sapiens
gccccatcagtgct

SEQ ID NO: 3509132 - DNA, 14 bp, Homo sapiens
gccccatcctccag

SEQ ID NO: 3509133 - DNA, 18 bp, Homo sapiens
gccccatcctccagcagg

SEQ ID NO: 3509134 - DNA, 19 bp, Homo sapiens
gccccatctcccctcagct

SEQ ID NO: 3509135 - DNA, 21 bp, Homo sapiens
gccccattctgcctgcccagg

SEQ ID NO: 3509136 - DNA, 22 bp, Homo sapiens
gccccattctgcctgcccaggc

SEQ ID NO: 3509137 - DNA, 23 bp, Homo sapiens
gccccattcttttgtaatttaaa

SEQ ID NO: 3509138 - DNA, 12 bp, Homo sapiens
gcccccacaggc

SEQ ID NO: 3509139 - DNA, 18 bp, Homo sapiens
gcccccacagttgctcta

SEQ ID NO: 3509140 - DNA, 18 bp, Homo sapiens
gcccccaccgtgggcagg

SEQ ID NO: 3509141 - DNA, 20 bp, Homo sapiens
gcccccaccgtgggcaggga

SEQ ID NO: 3509142 - DNA, 22 bp, Homo sapiens
gcccccagcccagggctcctgc

SEQ ID NO: 3509143 - DNA, 18 bp, Homo sapiens
gcccccatctcatgcccc

SEQ ID NO: 3509144 - DNA, 19 bp, Homo sapiens
gccccccagccccggtggc

SEQ ID NO: 3509145 - DNA, 17 bp, Homo sapiens
gcccccccccacccctg

SEQ ID NO: 3509146 - DNA, 14 bp, Homo sapiens
gcccccccttccac

SEQ ID NO: 3509147 - DNA, 15 bp, Homo sapiens
gcccccccttccact

SEQ ID NO: 3509148 - DNA, 15 bp, Homo sapiens
gccccccgcagcacc

SEQ ID NO: 3509149 - DNA, 16 bp, Homo sapiens
gccccccgcagcaccc

SEQ ID NO: 3509150 - DNA, 14 bp, Homo sapiens
gcccccctgccctg

SEQ ID NO: 3509151 - DNA, 21 bp, Homo sapiens
gcccccctttggtttggcctc

SEQ ID NO: 3509152 - DNA, 22 bp, Homo sapiens
gcccccctttggtttggcctcc

SEQ ID NO: 3509153 - DNA, 18 bp, Homo sapiens
gccccctccgccctgcca

SEQ ID NO: 3509154 - DNA, 14 bp, Homo sapiens
gccccctgccctcc

SEQ ID NO: 3509155 - DNA, 15 bp, Homo sapiens
gccccctggcctctg

SEQ ID NO: 3509156 - DNA, 22 bp, Homo sapiens
gccccgaggccttctctgaagg

SEQ ID NO: 3509157 - DNA, 16 bp, Homo sapiens
gccccgcttccccaca

SEQ ID NO: 3509158 - DNA, 18 bp, Homo sapiens
gccccgcttccccacaga

SEQ ID NO: 3509159 - DNA, 15 bp, Homo sapiens
gccccgggtccccag

SEQ ID NO: 3509160 - DNA, 18 bp, Homo sapiens
gccccgggtccccagctc

SEQ ID NO: 3509161 - DNA, 19 bp, Homo sapiens
gccccgggtccccagctcc

SEQ ID NO: 3509162 - DNA, 20 bp, Homo sapiens
gccccgggtccccagctccc

SEQ ID NO: 3509163 - DNA, 23 bp, Homo sapiens
gccccgggtccccagctccccag

SEQ ID NO: 3509164 - DNA, 13 bp, Homo sapiens
gcccctactgctg

SEQ ID NO: 3509165 - DNA, 14 bp, Homo sapiens
gcccctactgctgt

SEQ ID NO: 3509166 - DNA, 18 bp, Homo sapiens
gcccctcccaagctggct

SEQ ID NO: 3509167 - DNA, 19 bp, Homo sapiens
gcccctcggctctggaggc

SEQ ID NO: 3509168 - DNA, 12 bp, Homo sapiens
gcccctctcctc

SEQ ID NO: 3509169 - DNA, 13 bp, Homo sapiens
gcccctctcctcc

SEQ ID NO: 3509170 - DNA, 21 bp, Homo sapiens
gcccctctcctccgtggcaca

SEQ ID NO: 3509171 - DNA, 19 bp, Homo sapiens
gcccctctggtcgctcctg

SEQ ID NO: 3509172 - DNA, 16 bp, Homo sapiens
gcccctgccaccctgg

SEQ ID NO: 3509173 - DNA, 14 bp, Homo sapiens
gcccctgcccggct

SEQ ID NO: 3509174 - DNA, 10 bp, Homo sapiens
gcccctgctg

SEQ ID NO: 3509175 - DNA, 22 bp, Homo sapiens
gcccctgctgctgtcacctctc

SEQ ID NO: 3509176 - DNA, 12 bp, Homo sapiens
gcccctgctggt

SEQ ID NO: 3509177 - DNA, 22 bp, Homo sapiens
gcccctgctggttcagggttgg

SEQ ID NO: 3509178 - DNA, 18 bp, Homo sapiens
gcccctgctgtctctctg

SEQ ID NO: 3509179 - DNA, 20 bp, Homo sapiens
gcccctgctgtctctctggg

SEQ ID NO: 3509180 - DNA, 21 bp, Homo sapiens
gcccctgctgtctctctgggc

SEQ ID NO: 3509181 - DNA, 19 bp, Homo sapiens
gcccctggacatgcctgtc

SEQ ID NO: 3509182 - DNA, 23 bp, Homo sapiens
gcccctggacatgcctgtcctga

SEQ ID NO: 3509183 - DNA, 19 bp, Homo sapiens
gcccctggaggctgcctcc

SEQ ID NO: 3509184 - DNA, 19 bp, Homo sapiens
gcccctggccccgcctgcc

SEQ ID NO: 3509185 - DNA, 12 bp, Homo sapiens
gcccctggctgg

SEQ ID NO: 3509186 - DNA, 14 bp, Homo sapiens
gcccctggctggga

SEQ ID NO: 3509187 - DNA, 19 bp, Homo sapiens
gcccctgtctagagaggga

SEQ ID NO: 3509188 - DNA, 21 bp, Homo sapiens
gccccttactatgatctcagg

SEQ ID NO: 3509189 - DNA, 23 bp, Homo sapiens
gccccttactatgatctcaggag

SEQ ID NO: 3509190 - DNA, 14 bp, Homo sapiens
gccccttctgctca

SEQ ID NO: 3509191 - DNA, 19 bp, Homo sapiens
gccccttctgctcagctct

SEQ ID NO: 3509192 - DNA, 20 bp, Homo sapiens
gccccttctgctcagctctg

SEQ ID NO: 3509193 - DNA, 13 bp, Homo sapiens
gccccttgccatc

SEQ ID NO: 3509194 - DNA, 22 bp, Homo sapiens
gcccctttacggacaccccctc

SEQ ID NO: 3509195 - DNA, 17 bp, Homo sapiens
gcccgcagacctctgga

SEQ ID NO: 3509196 - DNA, 15 bp, Homo sapiens
gcccgcgccacagga

SEQ ID NO: 3509197 - DNA, 15 bp, Homo sapiens
gcccggctccaggct

SEQ ID NO: 3509198 - DNA, 22 bp, Homo sapiens
gcccggggctgtcccgtgcatg

SEQ ID NO: 3509199 - DNA, 14 bp, Homo sapiens
gcccgtcctgcctg

SEQ ID NO: 3509200 - DNA, 16 bp, Homo sapiens
gcccgtcctgcctgtg

SEQ ID NO: 3509201 - DNA, 17 bp, Homo sapiens
gcccgtcctgcctgtgg

SEQ ID NO: 3509202 - DNA, 18 bp, Homo sapiens
gcccgtcctgcctgtggc

SEQ ID NO: 3509203 - DNA, 19 bp, Homo sapiens
gcccgtgccctaccacaca

SEQ ID NO: 3509204 - DNA, 14 bp, Homo sapiens
gcccgtgtacatag

SEQ ID NO: 3509205 - DNA, 22 bp, Homo sapiens
gccctaattcagccatgtacag

SEQ ID NO: 3509206 - DNA, 14 bp, Homo sapiens
gccctcagaaccct

SEQ ID NO: 3509207 - DNA, 21 bp, Homo sapiens
gccctccagctctttcctcct

SEQ ID NO: 3509208 - DNA, 21 bp, Homo sapiens
gccctcccaggctctcaacag

SEQ ID NO: 3509209 - DNA, 18 bp, Homo sapiens
gccctccccatggagcca

SEQ ID NO: 3509210 - DNA, 22 bp, Homo sapiens
gccctcccctccggactggtgc

SEQ ID NO: 3509211 - DNA, 23 bp, Homo sapiens
gccctcccctccggactggtgcc

SEQ ID NO: 3509212 - DNA, 21 bp, Homo sapiens
gccctccctgttccccagaga

SEQ ID NO: 3509213 - DNA, 16 bp, Homo sapiens
gccctccgccttcaca

SEQ ID NO: 3509214 - DNA, 24 bp, Homo sapiens
gccctcctaccctgcgcccagtcc

SEQ ID NO: 3509215 - DNA, 17 bp, Homo sapiens
gccctcctctcccattg

SEQ ID NO: 3509216 - DNA, 14 bp, Homo sapiens
gccctcgctgccag

SEQ ID NO: 3509217 - DNA, 19 bp, Homo sapiens
gccctctatcatggtgaaa

SEQ ID NO: 3509218 - DNA, 19 bp, Homo sapiens
gccctctcaggccggcagc

SEQ ID NO: 3509219 - DNA, 21 bp, Homo sapiens
gccctctccctctaggctctg

SEQ ID NO: 3509220 - DNA, 16 bp, Homo sapiens
gccctctctgctctgc

SEQ ID NO: 3509221 - DNA, 20 bp, Homo sapiens
gccctctggagtggccacta

SEQ ID NO: 3509222 - DNA, 22 bp, Homo sapiens
gccctctggagtggccactaag

SEQ ID NO: 3509223 - DNA, 17 bp, Homo sapiens
gccctgaccctgtggaa

SEQ ID NO: 3509224 - DNA, 16 bp, Homo sapiens
gccctgagctttctgc

SEQ ID NO: 3509225 - DNA, 14 bp, Homo sapiens
gccctgcaaaagga

SEQ ID NO: 3509226 - DNA, 21 bp, Homo sapiens
gccctgcaaaaggactctcag

SEQ ID NO: 3509227 - DNA, 15 bp, Homo sapiens
gccctgcagccagct

SEQ ID NO: 3509228 - DNA, 12 bp, Homo sapiens
gccctgccactc

SEQ ID NO: 3509229 - DNA, 21 bp, Homo sapiens
gccctgccactcactaggccc

SEQ ID NO: 3509230 - DNA, 16 bp, Homo sapiens
gccctgccagagcagg

SEQ ID NO: 3509231 - DNA, 15 bp, Homo sapiens
gccctgccctggcag

SEQ ID NO: 3509232 - DNA, 18 bp, Homo sapiens
gccctgcggagccggcac

SEQ ID NO: 3509233 - DNA, 14 bp, Homo sapiens
gccctggaggtggc

SEQ ID NO: 3509234 - DNA, 18 bp, Homo sapiens
gccctggaggtggctgag

SEQ ID NO: 3509235 - DNA, 20 bp, Homo sapiens
gccctggaggtggctgagcc

SEQ ID NO: 3509236 - DNA, 21 bp, Homo sapiens
gccctggcagggtcatcctgt

SEQ ID NO: 3509237 - DNA, 12 bp, Homo sapiens
gccctggcctcc

SEQ ID NO: 3509238 - DNA, 19 bp, Homo sapiens
gccctggcctcccctgcca

SEQ ID NO: 3509239 - DNA, 17 bp, Homo sapiens
gccctgggatcactgtg

SEQ ID NO: 3509240 - DNA, 12 bp, Homo sapiens
gccctgggctgg

SEQ ID NO: 3509241 - DNA, 18 bp, Homo sapiens
gccctgggctggaatcag

SEQ ID NO: 3509242 - DNA, 16 bp, Homo sapiens
gccctggtcctggcct

SEQ ID NO: 3509243 - DNA, 17 bp, Homo sapiens
gccctggtcctggcctc

SEQ ID NO: 3509244 - DNA, 18 bp, Homo sapiens
gccctggtcctggcctcc

SEQ ID NO: 3509245 - DNA, 17 bp, Homo sapiens
gccctggtggcagtggg

SEQ ID NO: 3509246 - DNA, 20 bp, Homo sapiens
gccctggtggcagtgggagc

SEQ ID NO: 3509247 - DNA, 20 bp, Homo sapiens
gccctgtcgggctttgtgtg

SEQ ID NO: 3509248 - DNA, 22 bp, Homo sapiens
gccctgtggatgagccctcaga

SEQ ID NO: 3509249 - DNA, 13 bp, Homo sapiens
gccctgtgtactt

SEQ ID NO: 3509250 - DNA, 17 bp, Homo sapiens
gccctgttctcctcccc

SEQ ID NO: 3509251 - DNA, 22 bp, Homo sapiens
gccctgttctctaccaagctat

SEQ ID NO: 3509252 - DNA, 18 bp, Homo sapiens
gcccttacttcttgccct

SEQ ID NO: 3509253 - DNA, 19 bp, Homo sapiens
gcccttacttcttgccctg

SEQ ID NO: 3509254 - DNA, 16 bp, Homo sapiens
gcccttatctgtgctc

SEQ ID NO: 3509255 - DNA, 20 bp, Homo sapiens
gcccttatctgtgctcagga

SEQ ID NO: 3509256 - DNA, 21 bp, Homo sapiens
gcccttgtcccactcaagcca

SEQ ID NO: 3509257 - DNA, 24 bp, Homo sapiens
gcccttgtcccactcaagccaagc

SEQ ID NO: 3509258 - DNA, 22 bp, Homo sapiens
gcccttttttctgcctccttta

SEQ ID NO: 3509259 - DNA, 15 bp, Homo sapiens
gccgaaccaaaagaa

SEQ ID NO: 3509260 - DNA, 19 bp, Homo sapiens
gccgagacagaccctctgc

SEQ ID NO: 3509261 - DNA, 18 bp, Homo sapiens
gccgagattgcaccactg

SEQ ID NO: 3509262 - DNA, 17 bp, Homo sapiens
gccgatttctgtaaact

SEQ ID NO: 3509263 - DNA, 17 bp, Homo sapiens
gccgcaaaccacactgg

SEQ ID NO: 3509264 - DNA, 21 bp, Homo sapiens
gccgcaaaccacactggactc

SEQ ID NO: 3509265 - DNA, 19 bp, Homo sapiens
gccgcacgcctctccctgc

SEQ ID NO: 3509266 - DNA, 12 bp, Homo sapiens
gccgcagagctg

SEQ ID NO: 3509267 - DNA, 17 bp, Homo sapiens
gccgccagtacttgtca

SEQ ID NO: 3509268 - DNA, 15 bp, Homo sapiens
gccgccatgctcctg

SEQ ID NO: 3509269 - DNA, 16 bp, Homo sapiens
gccgccatgctcctgg

SEQ ID NO: 3509270 - DNA, 14 bp, Homo sapiens
gccgcccaaggccc

SEQ ID NO: 3509271 - DNA, 13 bp, Homo sapiens
gccgccgcctctt

SEQ ID NO: 3509272 - DNA, 15 bp, Homo sapiens
gccgctacctccctc

SEQ ID NO: 3509273 - DNA, 17 bp, Homo sapiens
gccgctacctccctccc

SEQ ID NO: 3509274 - DNA, 15 bp, Homo sapiens
gccgctgagcgagga

SEQ ID NO: 3509275 - DNA, 16 bp, Homo sapiens
gccgctgagtggcagg

SEQ ID NO: 3509276 - DNA, 14 bp, Homo sapiens
gccgctgccaccca

SEQ ID NO: 3509277 - DNA, 12 bp, Homo sapiens
gccgctgccacg

SEQ ID NO: 3509278 - DNA, 14 bp, Homo sapiens
gccggagaggaaga

SEQ ID NO: 3509279 - DNA, 13 bp, Homo sapiens
gccggaggccagc

SEQ ID NO: 3509280 - DNA, 19 bp, Homo sapiens
gccggaggccagctatctg

SEQ ID NO: 3509281 - DNA, 13 bp, Homo sapiens
gccggcacagctg

SEQ ID NO: 3509282 - DNA, 23 bp, Homo sapiens
gccggcacctacatccccaggtc

SEQ ID NO: 3509283 - DNA, 19 bp, Homo sapiens
gccggcagccccagcctgc

SEQ ID NO: 3509284 - DNA, 12 bp, Homo sapiens
gccggccctggg

SEQ ID NO: 3509285 - DNA, 13 bp, Homo sapiens
gccggccctgggg

SEQ ID NO: 3509286 - DNA, 21 bp, Homo sapiens
gccggtgtgcctgactgccca

SEQ ID NO: 3509287 - DNA, 22 bp, Homo sapiens
gccggttcctgtccctgcgcct

SEQ ID NO: 3509288 - DNA, 21 bp, Homo sapiens
gccgtatctccggctcccagc

SEQ ID NO: 3509289 - DNA, 13 bp, Homo sapiens
gccgtccttgtct

SEQ ID NO: 3509290 - DNA, 14 bp, Homo sapiens
gccgtctccagggg

SEQ ID NO: 3509291 - DNA, 21 bp, Homo sapiens
gccgtctccaggggctgcttc

SEQ ID NO: 3509292 - DNA, 14 bp, Homo sapiens
gccgtgccctgccc

SEQ ID NO: 3509293 - DNA, 12 bp, Homo sapiens
gccgtggatgcg

SEQ ID NO: 3509294 - DNA, 15 bp, Homo sapiens
gccgtgggcctgggg

SEQ ID NO: 3509295 - DNA, 19 bp, Homo sapiens
gccgttgatgttggctggg

SEQ ID NO: 3509296 - DNA, 23 bp, Homo sapiens
gcctaaaagtgggcttgattctg

SEQ ID NO: 3509297 - DNA, 22 bp, Homo sapiens
gcctacatcccgggcctcagtg

SEQ ID NO: 3509298 - DNA, 14 bp, Homo sapiens
gcctaccccgcaga

SEQ ID NO: 3509299 - DNA, 21 bp, Homo sapiens
gcctaccccgcagacaccttg

SEQ ID NO: 3509300 - DNA, 15 bp, Homo sapiens
gcctacttttggcct

SEQ ID NO: 3509301 - DNA, 15 bp, Homo sapiens
gcctagccctgggac

SEQ ID NO: 3509302 - DNA, 22 bp, Homo sapiens
gcctagctaccttctctaccca

SEQ ID NO: 3509303 - DNA, 18 bp, Homo sapiens
gcctaggacctatgttgt

SEQ ID NO: 3509304 - DNA, 18 bp, Homo sapiens
gcctaggcctcagccaga

SEQ ID NO: 3509305 - DNA, 20 bp, Homo sapiens
gcctaggcctcagccagaga

SEQ ID NO: 3509306 - DNA, 13 bp, Homo sapiens
gcctaggtgacag

SEQ ID NO: 3509307 - DNA, 16 bp, Homo sapiens
gcctaggtgcagctcc

SEQ ID NO: 3509308 - DNA, 21 bp, Homo sapiens
gcctattgcttgggtctctct

SEQ ID NO: 3509309 - DNA, 19 bp, Homo sapiens
gcctcaaaaacgccctcaa

SEQ ID NO: 3509310 - DNA, 14 bp, Homo sapiens
gcctcaacctcctg

SEQ ID NO: 3509311 - DNA, 18 bp, Homo sapiens
gcctcaacctcctgggct

SEQ ID NO: 3509312 - DNA, 20 bp, Homo sapiens
gcctcaagtgattctcctgc

SEQ ID NO: 3509313 - DNA, 20 bp, Homo sapiens
gcctcacccacccctgcaca

SEQ ID NO: 3509314 - DNA, 13 bp, Homo sapiens
gcctcaccttggg

SEQ ID NO: 3509315 - DNA, 20 bp, Homo sapiens
gcctcaccttggggccttga

SEQ ID NO: 3509316 - DNA, 20 bp, Homo sapiens
gcctcacttctagggtatgg

SEQ ID NO: 3509317 - DNA, 17 bp, Homo sapiens
gcctcagatgatttccc

SEQ ID NO: 3509318 - DNA, 21 bp, Homo sapiens
gcctcagcatcctggcacccg

SEQ ID NO: 3509319 - DNA, 13 bp, Homo sapiens
gcctcagccagag

SEQ ID NO: 3509320 - DNA, 14 bp, Homo sapiens
gcctcagccagaga

SEQ ID NO: 3509321 - DNA, 16 bp, Homo sapiens
gcctcagccagagaag

SEQ ID NO: 3509322 - DNA, 14 bp, Homo sapiens
gcctcagcctactc

SEQ ID NO: 3509323 - DNA, 12 bp, Homo sapiens
gcctcagcctcc

SEQ ID NO: 3509324 - DNA, 23 bp, Homo sapiens
gcctcagcctcccaaagtgctgg

SEQ ID NO: 3509325 - DNA, 15 bp, Homo sapiens
gcctcaggtgctgtc

SEQ ID NO: 3509326 - DNA, 14 bp, Homo sapiens
gcctcagtgccact

SEQ ID NO: 3509327 - DNA, 13 bp, Homo sapiens
gcctcatgtggct

SEQ ID NO: 3509328 - DNA, 17 bp, Homo sapiens
gcctcatgtggctggaa

SEQ ID NO: 3509329 - DNA, 18 bp, Homo sapiens
gcctcatgtggctggaag

SEQ ID NO: 3509330 - DNA, 21 bp, Homo sapiens
gcctcatttagagaggaaaag

SEQ ID NO: 3509331 - DNA, 12 bp, Homo sapiens
gcctccagaact

SEQ ID NO: 3509332 - DNA, 17 bp, Homo sapiens
gcctccagaactcactg

SEQ ID NO: 3509333 - DNA, 19 bp, Homo sapiens
gcctccagaactcactggg

SEQ ID NO: 3509334 - DNA, 22 bp, Homo sapiens
gcctccagccaaacgggagctt

SEQ ID NO: 3509335 - DNA, 12 bp, Homo sapiens
gcctccaggagc

SEQ ID NO: 3509336 - DNA, 18 bp, Homo sapiens
gcctccaggagcctaccc

SEQ ID NO: 3509337 - DNA, 20 bp, Homo sapiens
gcctccaggagcctaccccc

SEQ ID NO: 3509338 - DNA, 12 bp, Homo sapiens
gcctccagggct

SEQ ID NO: 3509339 - DNA, 14 bp, Homo sapiens
gcctccagggctgg

SEQ ID NO: 3509340 - DNA, 16 bp, Homo sapiens
gcctccagggctggac

SEQ ID NO: 3509341 - DNA, 23 bp, Homo sapiens
gcctccagggctggactgaggcc

SEQ ID NO: 3509342 - DNA, 13 bp, Homo sapiens
gcctccatcctca

SEQ ID NO: 3509343 - DNA, 15 bp, Homo sapiens
gcctccatcctcatc

SEQ ID NO: 3509344 - DNA, 22 bp, Homo sapiens
gcctccattatccattcccaag

SEQ ID NO: 3509345 - DNA, 14 bp, Homo sapiens
gcctcccaaaagac

SEQ ID NO: 3509346 - DNA, 15 bp, Homo sapiens
gcctcccaaatgagc

SEQ ID NO: 3509347 - DNA, 23 bp, Homo sapiens
gcctcccaacagtggggaagagt

SEQ ID NO: 3509348 - DNA, 17 bp, Homo sapiens
gcctcccaaccccaggg

SEQ ID NO: 3509349 - DNA, 21 bp, Homo sapiens
gcctcccacgactgcccggca

SEQ ID NO: 3509350 - DNA, 12 bp, Homo sapiens
gcctcccactgg

SEQ ID NO: 3509351 - DNA, 14 bp, Homo sapiens
gcctcccactgggg

SEQ ID NO: 3509352 - DNA, 15 bp, Homo sapiens
gcctcccatccaggg

SEQ ID NO: 3509353 - DNA, 18 bp, Homo sapiens
gcctcccctctccttcct

SEQ ID NO: 3509354 - DNA, 15 bp, Homo sapiens
gcctcccctgccacc

SEQ ID NO: 3509355 - DNA, 16 bp, Homo sapiens
gcctcccctgccacca

SEQ ID NO: 3509356 - DNA, 21 bp, Homo sapiens
gcctcccgaatagctgggact

SEQ ID NO: 3509357 - DNA, 15 bp, Homo sapiens
gcctcccgagtagct

SEQ ID NO: 3509358 - DNA, 18 bp, Homo sapiens
gcctcccgagtagctggg

SEQ ID NO: 3509359 - DNA, 19 bp, Homo sapiens
gcctcccgagtagctggga

SEQ ID NO: 3509360 - DNA, 18 bp, Homo sapiens
gcctccgacgctgcctct

SEQ ID NO: 3509361 - DNA, 21 bp, Homo sapiens
gcctcctactccagtatgaca

SEQ ID NO: 3509362 - DNA, 22 bp, Homo sapiens
gcctcctactccagtatgacag

SEQ ID NO: 3509363 - DNA, 23 bp, Homo sapiens
gcctcctctctcagtttttatat

SEQ ID NO: 3509364 - DNA, 23 bp, Homo sapiens
gcctcctgtgtgtgcgcctacag

SEQ ID NO: 3509365 - DNA, 16 bp, Homo sapiens
gcctcgaaacacagaa

SEQ ID NO: 3509366 - DNA, 13 bp, Homo sapiens
gcctcgaactggc

SEQ ID NO: 3509367 - DNA, 19 bp, Homo sapiens
gcctcgaggtgccttcttc

SEQ ID NO: 3509368 - DNA, 23 bp, Homo sapiens
gcctcgaggtgccttcttcaggg

SEQ ID NO: 3509369 - DNA, 17 bp, Homo sapiens
gctcttcatctgcccaa

SEQ ID NO: 3509370 - DNA, 22 bp, Homo sapiens
gctcttctcatttcacccctcc

SEQ ID NO: 3509371 - DNA, 17 bp, Homo sapiens
gctcttctccttggagg

SEQ ID NO: 3509372 - DNA, 14 bp, Homo sapiens
gctcttctgccggc

SEQ ID NO: 3509373 - DNA, 21 bp, Homo sapiens
gctcttctgccggccctgggg

SEQ ID NO: 3509374 - DNA, 19 bp, Homo sapiens
gctcttgtgaggaaagtca

SEQ ID NO: 3509375 - DNA, 21 bp, Homo sapiens
gctctttatgaatgaaaaaac

SEQ ID NO: 3509376 - DNA, 17 bp, Homo sapiens
gctctttcctccttcca

SEQ ID NO: 3509377 - DNA, 20 bp, Homo sapiens
gctcttttactgggttctta

SEQ ID NO: 3509378 - DNA, 14 bp, Homo sapiens
gctgaaaaaaaatt

SEQ ID NO: 3509379 - DNA, 22 bp, Homo sapiens
gctgaatacagaggcaactgca

SEQ ID NO: 3509380 - DNA, 14 bp, Homo sapiens
gctgaattatctat

SEQ ID NO: 3509381 - DNA, 14 bp, Homo sapiens
gctgacagacacag

SEQ ID NO: 3509382 - DNA, 15 bp, Homo sapiens
gctgacagacacagg

SEQ ID NO: 3509383 - DNA, 20 bp, Homo sapiens
gctgacagacacaggcccgg

SEQ ID NO: 3509384 - DNA, 21 bp, Homo sapiens
gctgacagacacaggcccggc

SEQ ID NO: 3509385 - DNA, 13 bp, Homo sapiens
gctgaccacagca

SEQ ID NO: 3509386 - DNA, 16 bp, Homo sapiens
gctgaccacagcacag

SEQ ID NO: 3509387 - DNA, 14 bp, Homo sapiens
gctgacctccacag

SEQ ID NO: 3509388 - DNA, 16 bp, Homo sapiens
gctgacctccacagct

SEQ ID NO: 3509389 - DNA, 19 bp, Homo sapiens
gctgacgaacttccatggc

SEQ ID NO: 3509390 - DNA, 23 bp, Homo sapiens
gctgactctaggtgcccttggag

SEQ ID NO: 3509391 - DNA, 15 bp, Homo sapiens
gctgactgaacatta

SEQ ID NO: 3509392 - DNA, 14 bp, Homo sapiens
gctgagagaacctc

SEQ ID NO: 3509393 - DNA, 13 bp, Homo sapiens
gctgagcaccttt

SEQ ID NO: 3509394 - DNA, 22 bp, Homo sapiens
gctgagcacctttggaaacaac

SEQ ID NO: 3509395 - DNA, 22 bp, Homo sapiens
gctgagcccctgtctagagagg

SEQ ID NO: 3509396 - DNA, 23 bp, Homo sapiens
gctgagcccctgtctagagaggg

SEQ ID NO: 3509397 - DNA, 13 bp, Homo sapiens
gctgagcctctgc

SEQ ID NO: 3509398 - DNA, 14 bp, Homo sapiens
gctgagcgccagga

SEQ ID NO: 3509399 - DNA, 12 bp, Homo sapiens
gctgaggaaagg

SEQ ID NO: 3509400 - DNA, 15 bp, Homo sapiens
gctgaggaaaggcca

SEQ ID NO: 3509401 - DNA, 21 bp, Homo sapiens
gctgaggaaaggccagctggc

SEQ ID NO: 3509402 - DNA, 23 bp, Homo sapiens
gctgaggaaaggccagctggcag

SEQ ID NO: 3509403 - DNA, 13 bp, Homo sapiens
gctgaggcagcag

SEQ ID NO: 3509404 - DNA, 23 bp, Homo sapiens
gctgaggcagcagtgtgaggcca

SEQ ID NO: 3509405 - DNA, 14 bp, Homo sapiens
gctgaggcctgggc

SEQ ID NO: 3509406 - DNA, 17 bp, Homo sapiens
gctgaggcctgggccgc

SEQ ID NO: 3509407 - DNA, 15 bp, Homo sapiens
gctgaggctggggga

SEQ ID NO: 3509408 - DNA, 22 bp, Homo sapiens
gctgaggctgggggagagccgt

SEQ ID NO: 3509409 - DNA, 14 bp, Homo sapiens
gctgagggagcctg

SEQ ID NO: 3509410 - DNA, 12 bp, Homo sapiens
gctgagggcctg

SEQ ID NO: 3509411 - DNA, 16 bp, Homo sapiens
gctgagggcctgctgg

SEQ ID NO: 3509412 - DNA, 14 bp, Homo sapiens
gctgaggtgggagg

SEQ ID NO: 3509413 - DNA, 20 bp, Homo sapiens
gctgagtagatgcgcagccc

SEQ ID NO: 3509414 - DNA, 15 bp, Homo sapiens
gctgagtcatctgtt

SEQ ID NO: 3509415 - DNA, 17 bp, Homo sapiens
gctgagtctgcagatga

SEQ ID NO: 3509416 - DNA, 19 bp, Homo sapiens
gctgagtggcaggggacag

SEQ ID NO: 3509417 - DNA, 22 bp, Homo sapiens
gctgagtgggggatcacagcct

SEQ ID NO: 3509418 - DNA, 17 bp, Homo sapiens
gctgatatatgtgtttt

SEQ ID NO: 3509419 - DNA, 18 bp, Homo sapiens
gctgatatatgtgttttt

SEQ ID NO: 3509420 - DNA, 20 bp, Homo sapiens
gctgatatatgtgtttttca

SEQ ID NO: 3509421 - DNA, 20 bp, Homo sapiens
gctgatcatcgccagaggtg

SEQ ID NO: 3509422 - DNA, 15 bp, Homo sapiens
gctgatgcaggattt

SEQ ID NO: 3509423 - DNA, 17 bp, Homo sapiens
gctgatgtcaatttctg

SEQ ID NO: 3509424 - DNA, 20 bp, Homo sapiens
gctgatgtcctcaccacatg

SEQ ID NO: 3509425 - DNA, 13 bp, Homo sapiens
gctgcaaaggaca

SEQ ID NO: 3509426 - DNA, 23 bp, Homo sapiens
gctgcaaagggtatcaggtgctg

SEQ ID NO: 3509427 - DNA, 14 bp, Homo sapiens
gctgcaacaaaatg

SEQ ID NO: 3509428 - DNA, 19 bp, Homo sapiens
gctgcaccaatgcactgag

SEQ ID NO: 3509429 - DNA, 16 bp, Homo sapiens
gctgcaccctcaggca

SEQ ID NO: 3509430 - DNA, 19 bp, Homo sapiens
gctgcaccctcaggcaggt

SEQ ID NO: 3509431 - DNA, 20 bp, Homo sapiens
gctgcactgatgctgcccct

SEQ ID NO: 3509432 - DNA, 13 bp, Homo sapiens
gctgcagagaaac

SEQ ID NO: 3509433 - DNA, 18 bp, Homo sapiens
gctgcagaggccagaggc

SEQ ID NO: 3509434 - DNA, 15 bp, Homo sapiens
gctgcagagtcacaa

SEQ ID NO: 3509435 - DNA, 21 bp, Homo sapiens
gctgcagcctgcgccaccgcc

SEQ ID NO: 3509436 - DNA, 15 bp, Homo sapiens
gctgcagctccctgg

SEQ ID NO: 3509437 - DNA, 16 bp, Homo sapiens
gctgcagctccctggc

SEQ ID NO: 3509438 - DNA, 19 bp, Homo sapiens
gctgccacccacctccctg

SEQ ID NO: 3509439 - DNA, 23 bp, Homo sapiens
gctgccacccacctccctgcctc

SEQ ID NO: 3509440 - DNA, 14 bp, Homo sapiens
gctgccagagaagt

SEQ ID NO: 3509441 - DNA, 12 bp, Homo sapiens
gctgccagggct

SEQ ID NO: 3509442 - DNA, 17 bp, Homo sapiens
gctgccatccaggttca

SEQ ID NO: 3509443 - DNA, 21 bp, Homo sapiens
gctgccatccaggttcagctt

SEQ ID NO: 3509444 - DNA, 14 bp, Homo sapiens
gctgcccaggccca

SEQ ID NO: 3509445 - DNA, 16 bp, Homo sapiens
gctgcccatttcgtga

SEQ ID NO: 3509446 - DNA, 12 bp, Homo sapiens
gctgccccagcc

SEQ ID NO: 3509447 - DNA, 14 bp, Homo sapiens
gctgccccagccag

SEQ ID NO: 3509448 - DNA, 14 bp, Homo sapiens
gctgccccagcccc

SEQ ID NO: 3509449 - DNA, 21 bp, Homo sapiens
gctgccccgggtccccagctc

SEQ ID NO: 3509450 - DNA, 22 bp, Homo sapiens
gctgccccgggtccccagctcc

SEQ ID NO: 3509451 - DNA, 12 bp, Homo sapiens
gctgcccctctc

SEQ ID NO: 3509452 - DNA, 20 bp, Homo sapiens
gctgccctagttttctttcc

SEQ ID NO: 3509453 - DNA, 16 bp, Homo sapiens
gctgccctatgggcct

SEQ ID NO: 3509454 - DNA, 13 bp, Homo sapiens
gctgccggcacag

SEQ ID NO: 3509455 - DNA, 16 bp, Homo sapiens
gctgccggcacagctg

SEQ ID NO: 3509456 - DNA, 17 bp, Homo sapiens
gctgccgggccaggcgc

SEQ ID NO: 3509457 - DNA, 13 bp, Homo sapiens
gctgccgtggggc

SEQ ID NO: 3509458 - DNA, 21 bp, Homo sapiens
gctgcctaggtcccccaagca

SEQ ID NO: 3509459 - DNA, 14 bp, Homo sapiens
gctgcctcatttag

SEQ ID NO: 3509460 - DNA, 17 bp, Homo sapiens
gctgcctgcccacacag

SEQ ID NO: 3509461 - DNA, 22 bp, Homo sapiens
gctgcctgccggtaaacacgcc

SEQ ID NO: 3509462 - DNA, 17 bp, Homo sapiens
gctgcctgttcagctcc

SEQ ID NO: 3509463 - DNA, 19 bp, Homo sapiens
gctgcctgttcagctccag

SEQ ID NO: 3509464 - DNA, 12 bp, Homo sapiens
gctgccttagct

SEQ ID NO: 3509465 - DNA, 17 bp, Homo sapiens
gctgccttggctcagac

SEQ ID NO: 3509466 - DNA, 21 bp, Homo sapiens
gctgccttggctcagacatgt

SEQ ID NO: 3509467 - DNA, 18 bp, Homo sapiens
gctgcgggacagaggacc

SEQ ID NO: 3509468 - DNA, 14 bp, Homo sapiens
gctgcggtccaccc

SEQ ID NO: 3509469 - DNA, 16 bp, Homo sapiens
gctgcggtccacccag

SEQ ID NO: 3509470 - DNA, 17 bp, Homo sapiens
gctgcggtccacccagg

SEQ ID NO: 3509471 - DNA, 16 bp, Homo sapiens
gctgcgtgcccctgct

SEQ ID NO: 3509472 - DNA, 18 bp, Homo sapiens
gctgcgtgcccctgctgc

SEQ ID NO: 3509473 - DNA, 14 bp, Homo sapiens
gctgctagatcttt

SEQ ID NO: 3509474 - DNA, 15 bp, Homo sapiens
gctgctagatcttta

SEQ ID NO: 3509475 - DNA, 22 bp, Homo sapiens
gctgctagctattggcctccca

SEQ ID NO: 3509476 - DNA, 20 bp, Homo sapiens
gctgctcagggaaaagcagc

SEQ ID NO: 3509477 - DNA, 15 bp, Homo sapiens
gctgctcctagaggg

SEQ ID NO: 3509478 - DNA, 16 bp, Homo sapiens
gctgctcctagaggga

SEQ ID NO: 3509479 - DNA, 23 bp, Homo sapiens
gctgctcctagagggaggggcct

SEQ ID NO: 3509480 - DNA, 18 bp, Homo sapiens
gctgctgctcctccctct

SEQ ID NO: 3509481 - DNA, 11 bp, Homo sapiens
gctgctggcca

SEQ ID NO: 3509482 - DNA, 22 bp, Homo sapiens
gctgctggccaaatagcaaaga

SEQ ID NO: 3509483 - DNA, 20 bp, Homo sapiens
gctgctgggatggtgggctt

SEQ ID NO: 3509484 - DNA, 23 bp, Homo sapiens
gctgctgggatggtgggcttcag

SEQ ID NO: 3509485 - DNA, 18 bp, Homo sapiens
gctgcttccaggctgggc

SEQ ID NO: 3509486 - DNA, 11 bp, Homo sapiens
gctgcttccca

SEQ ID NO: 3509487 - DNA, 16 bp, Homo sapiens
gctgcttcctcctgga

SEQ ID NO: 3509488 - DNA, 22 bp, Homo sapiens
gctgcttttgtctatgggactc

SEQ ID NO: 3509489 - DNA, 21 bp, Homo sapiens
gctggaacagattcacactgt

SEQ ID NO: 3509490 - DNA, 17 bp, Homo sapiens
gctggaagatcctgcgg

SEQ ID NO: 3509491 - DNA, 18 bp, Homo sapiens
gctggaagatcctgcggg

SEQ ID NO: 3509492 - DNA, 12 bp, Homo sapiens
gctggaagccca

SEQ ID NO: 3509493 - DNA, 13 bp, Homo sapiens
gctggaagcccag

SEQ ID NO: 3509494 - DNA, 14 bp, Homo sapiens
gctggaagcccagc

SEQ ID NO: 3509495 - DNA, 22 bp, Homo sapiens
gctggaagcccagcccctactg

SEQ ID NO: 3509496 - DNA, 21 bp, Homo sapiens
gctggactctcagtctctgag

SEQ ID NO: 3509497 - DNA, 19 bp, Homo sapiens
gctggactgaggcctgagc

SEQ ID NO: 3509498 - DNA, 13 bp, Homo sapiens
gctggagactcct

SEQ ID NO: 3509499 - DNA, 21 bp, Homo sapiens
gctggagactcctaggcagga

SEQ ID NO: 3509500 - DNA, 18 bp, Homo sapiens
gcctcttttacctgctgc

SEQ ID NO: 3509501 - DNA, 14 bp, Homo sapiens
gcctgaaaggagcc

SEQ ID NO: 3509502 - DNA, 17 bp, Homo sapiens
gcctgaaaggagccctt

SEQ ID NO: 3509503 - DNA, 21 bp, Homo sapiens
gcctgaacctggggtcatcga

SEQ ID NO: 3509504 - DNA, 17 bp, Homo sapiens
gcctgaaggggcgtctg

SEQ ID NO: 3509505 - DNA, 18 bp, Homo sapiens
gcctgaaggggcgtctgt

SEQ ID NO: 3509506 - DNA, 16 bp, Homo sapiens
gcctgaagtcacacag

SEQ ID NO: 3509507 - DNA, 17 bp, Homo sapiens
gcctgaagtcacacagt

SEQ ID NO: 3509508 - DNA, 18 bp, Homo sapiens
gcctgaagtcacacagtg

SEQ ID NO: 3509509 - DNA, 17 bp, Homo sapiens
gcctgaatcatgagcct

SEQ ID NO: 3509510 - DNA, 23 bp, Homo sapiens
gcctgaatcatgagcctgctgga

SEQ ID NO: 3509511 - DNA, 14 bp, Homo sapiens
gcctgacaaggcca

SEQ ID NO: 3509512 - DNA, 18 bp, Homo sapiens
gcctgacaaggccagcac

SEQ ID NO: 3509513 - DNA, 12 bp, Homo sapiens
gcctgacaggct

SEQ ID NO: 3509514 - DNA, 13 bp, Homo sapiens
gcctgacaggctg

SEQ ID NO: 3509515 - DNA, 22 bp, Homo sapiens
gcctgacatttggagtgttccc

SEQ ID NO: 3509516 - DNA, 15 bp, Homo sapiens
gcctgaccaaacagc

SEQ ID NO: 3509517 - DNA, 18 bp, Homo sapiens
gcctgagatttcatctgc

SEQ ID NO: 3509518 - DNA, 23 bp, Homo sapiens
gcctgagatttcatctgctctcc

SEQ ID NO: 3509519 - DNA, 18 bp, Homo sapiens
gcctgagcaactcttgat

SEQ ID NO: 3509520 - DNA, 18 bp, Homo sapiens
gcctgagcctcccgaggc

SEQ ID NO: 3509521 - DNA, 14 bp, Homo sapiens
gcctgagcctggcc

SEQ ID NO: 3509522 - DNA, 22 bp, Homo sapiens
gcctgagcgctcctgccgcaga

SEQ ID NO: 3509523 - DNA, 12 bp, Homo sapiens
gcctgagctgct

SEQ ID NO: 3509524 - DNA, 15 bp, Homo sapiens
gcctgagctgcttca

SEQ ID NO: 3509525 - DNA, 17 bp, Homo sapiens
gcctgagctgcttcact

SEQ ID NO: 3509526 - DNA, 10 bp, Homo sapiens
gcctgaggga

SEQ ID NO: 3509527 - DNA, 16 bp, Homo sapiens
gcctgagtagaaaggc

SEQ ID NO: 3509528 - DNA, 13 bp, Homo sapiens
gcctgagtcacct

SEQ ID NO: 3509529 - DNA, 14 bp, Homo sapiens
gcctgatggacctg

SEQ ID NO: 3509530 - DNA, 18 bp, Homo sapiens
gcctgcaaacgctgcctg

SEQ ID NO: 3509531 - DNA, 20 bp, Homo sapiens
gcctgcaggacctgcctgta

SEQ ID NO: 3509532 - DNA, 21 bp, Homo sapiens
gcctgcaggacctgcctgtag

SEQ ID NO: 3509533 - DNA, 22 bp, Homo sapiens
gcctgcaggacctgcctgtagc

SEQ ID NO: 3509534 - DNA, 16 bp, Homo sapiens
gcctgcatgtaaacac

SEQ ID NO: 3509535 - DNA, 18 bp, Homo sapiens
gcctgccatagccaggag

SEQ ID NO: 3509536 - DNA, 19 bp, Homo sapiens
gcctgccatagccaggagc

SEQ ID NO: 3509537 - DNA, 11 bp, Homo sapiens
gcctgcccagg

SEQ ID NO: 3509538 - DNA, 12 bp, Homo sapiens
gcctgcccaggc

SEQ ID NO: 3509539 - DNA, 22 bp, Homo sapiens
gcctgcccaggcccctgccacc

SEQ ID NO: 3509540 - DNA, 17 bp, Homo sapiens
gcctgccccaaacaaat

SEQ ID NO: 3509541 - DNA, 15 bp, Homo sapiens
gcctgcccctcccag

SEQ ID NO: 3509542 - DNA, 16 bp, Homo sapiens
gcctgcccctcccaga

SEQ ID NO: 3509543 - DNA, 18 bp, Homo sapiens
gcctgcccctcccagaac

SEQ ID NO: 3509544 - DNA, 21 bp, Homo sapiens
gcctgcccgtaaacacgcctg

SEQ ID NO: 3509545 - DNA, 16 bp, Homo sapiens
gcctgccggtaaacac

SEQ ID NO: 3509546 - DNA, 16 bp, Homo sapiens
gcctgcctccagggct

SEQ ID NO: 3509547 - DNA, 17 bp, Homo sapiens
gcctgcctccagggctg

SEQ ID NO: 3509548 - DNA, 22 bp, Homo sapiens
gcctgcctccagggctggactg

SEQ ID NO: 3509549 - DNA, 15 bp, Homo sapiens
gcctgcctggcaggc

SEQ ID NO: 3509550 - DNA, 23 bp, Homo sapiens
gcctgctaattccccagattgca

SEQ ID NO: 3509551 - DNA, 12 bp, Homo sapiens
gcctgctccaga

SEQ ID NO: 3509552 - DNA, 21 bp, Homo sapiens
gcctgctccagacctgatcct

SEQ ID NO: 3509553 - DNA, 17 bp, Homo sapiens
gcctgctggaagcccag

SEQ ID NO: 3509554 - DNA, 23 bp, Homo sapiens
gcctgctgtcaagtcccccagca

SEQ ID NO: 3509555 - DNA, 20 bp, Homo sapiens
gcctgctgttggtcctctct

SEQ ID NO: 3509556 - DNA, 14 bp, Homo sapiens
gcctggaagacaga

SEQ ID NO: 3509557 - DNA, 16 bp, Homo sapiens
gcctggagatcctcct

SEQ ID NO: 3509558 - DNA, 17 bp, Homo sapiens
gcctggagatcctcctg

SEQ ID NO: 3509559 - DNA, 18 bp, Homo sapiens
gcctggagatcctcctgc

SEQ ID NO: 3509560 - DNA, 20 bp, Homo sapiens
gcctggagccctccgccttc

SEQ ID NO: 3509561 - DNA, 22 bp, Homo sapiens
gcctggagccctccgccttcac

SEQ ID NO: 3509562 - DNA, 14 bp, Homo sapiens
gcctggccagacac

SEQ ID NO: 3509563 - DNA, 16 bp, Homo sapiens
gcctggccagacacag

SEQ ID NO: 3509564 - DNA, 14 bp, Homo sapiens
gcctggccggctcc

SEQ ID NO: 3509565 - DNA, 12 bp, Homo sapiens
gcctggcctgat

SEQ ID NO: 3509566 - DNA, 21 bp, Homo sapiens
gcctgggaggtcaaggctgca

SEQ ID NO: 3509567 - DNA, 13 bp, Homo sapiens
gcctgggccagag

SEQ ID NO: 3509568 - DNA, 17 bp, Homo sapiens
gcctgggggtgccagga

SEQ ID NO: 3509569 - DNA, 21 bp, Homo sapiens
gcctgggggtgccaggaccag

SEQ ID NO: 3509570 - DNA, 14 bp, Homo sapiens
gcctggggtggggt

SEQ ID NO: 3509571 - DNA, 16 bp, Homo sapiens
gcctggggtggggtca

SEQ ID NO: 3509572 - DNA, 23 bp, Homo sapiens
gcctggtaggaaagggcaagtct

SEQ ID NO: 3509573 - DNA, 13 bp, Homo sapiens
gcctggtggcagc

SEQ ID NO: 3509574 - DNA, 14 bp, Homo sapiens
gcctggtggcagct

SEQ ID NO: 3509575 - DNA, 16 bp, Homo sapiens
gcctggtggcagctgc

SEQ ID NO: 3509576 - DNA, 15 bp, Homo sapiens
gcctgtaatcctagc

SEQ ID NO: 3509577 - DNA, 19 bp, Homo sapiens
gcctgtagaatagcctgtg

SEQ ID NO: 3509578 - DNA, 20 bp, Homo sapiens
gcctgtagaatagcctgtgg

SEQ ID NO: 3509579 - DNA, 12 bp, Homo sapiens
gcctgtcctgaa

SEQ ID NO: 3509580 - DNA, 23 bp, Homo sapiens
gcctgtcctgaaagcggctgcct

SEQ ID NO: 3509581 - DNA, 15 bp, Homo sapiens
gcctgtctgtgacct

SEQ ID NO: 3509582 - DNA, 14 bp, Homo sapiens
gcctgtctttcagc

SEQ ID NO: 3509583 - DNA, 20 bp, Homo sapiens
gcctgtctttcagcattcag

SEQ ID NO: 3509584 - DNA, 15 bp, Homo sapiens
gcctgtggccctgtc

SEQ ID NO: 3509585 - DNA, 17 bp, Homo sapiens
gcctgtggccctgtcct

SEQ ID NO: 3509586 - DNA, 23 bp, Homo sapiens
gcctgtggcgccgtctccagggg

SEQ ID NO: 3509587 - DNA, 14 bp, Homo sapiens
gcctgtggctgtgg

SEQ ID NO: 3509588 - DNA, 17 bp, Homo sapiens
gcctgtggctgtggaga

SEQ ID NO: 3509589 - DNA, 23 bp, Homo sapiens
gcctgtgtccatgcgctcagggc

SEQ ID NO: 3509590 - DNA, 16 bp, Homo sapiens
gcctgttcagctccag

SEQ ID NO: 3509591 - DNA, 20 bp, Homo sapiens
gcctgttttagaaggttctc

SEQ ID NO: 3509592 - DNA, 20 bp, Homo sapiens
gccttagaagtcacacagta

SEQ ID NO: 3509593 - DNA, 16 bp, Homo sapiens
gccttagcttcaggaa

SEQ ID NO: 3509594 - DNA, 19 bp, Homo sapiens
gccttagcttcaggaacct

SEQ ID NO: 3509595 - DNA, 23 bp, Homo sapiens
gccttatcgggctccagccatct

SEQ ID NO: 3509596 - DNA, 23 bp, Homo sapiens
gccttatctccaagaccagagat

SEQ ID NO: 3509597 - DNA, 19 bp, Homo sapiens
gccttattagagtgtcttt

SEQ ID NO: 3509598 - DNA, 23 bp, Homo sapiens
gccttcagacagagaggactgta

SEQ ID NO: 3509599 - DNA, 15 bp, Homo sapiens
gccttcagtttattt

SEQ ID NO: 3509600 - DNA, 19 bp, Homo sapiens
gccttcagtttatttccac

SEQ ID NO: 3509601 - DNA, 16 bp, Homo sapiens
gccttcattctgcaag

SEQ ID NO: 3509602 - DNA, 22 bp, Homo sapiens
gccttccacttggctacacagg

SEQ ID NO: 3509603 - DNA, 20 bp, Homo sapiens
gccttccagggatttgcctc

SEQ ID NO: 3509604 - DNA, 23 bp, Homo sapiens
gccttccagggatttgcctcacc

SEQ ID NO: 3509605 - DNA, 16 bp, Homo sapiens
gccttcccgccggagg

SEQ ID NO: 3509606 - DNA, 20 bp, Homo sapiens
gccttcccgccggaggccag

SEQ ID NO: 3509607 - DNA, 20 bp, Homo sapiens
gccttcctaagcctgtggct

SEQ ID NO: 3509608 - DNA, 21 bp, Homo sapiens
gccttcctaagcctgtggctg

SEQ ID NO: 3509609 - DNA, 22 bp, Homo sapiens
gccttcctaagcctgtggctgt

SEQ ID NO: 3509610 - DNA, 13 bp, Homo sapiens
gccttcctcctgg

SEQ ID NO: 3509611 - DNA, 17 bp, Homo sapiens
gccttcctctctccaga

SEQ ID NO: 3509612 - DNA, 22 bp, Homo sapiens
gccttcgcttcttgcctctgtg

SEQ ID NO: 3509613 - DNA, 19 bp, Homo sapiens
gccttcgtctttcccatgg

SEQ ID NO: 3509614 - DNA, 15 bp, Homo sapiens
gccttctaaaggtgt

SEQ ID NO: 3509615 - DNA, 12 bp, Homo sapiens
gccttctcacca

SEQ ID NO: 3509616 - DNA, 23 bp, Homo sapiens
gccttctcccctcttctgagcta

SEQ ID NO: 3509617 - DNA, 15 bp, Homo sapiens
gccttctctgaagga

SEQ ID NO: 3509618 - DNA, 14 bp, Homo sapiens
gccttctgtgggga

SEQ ID NO: 3509619 - DNA, 23 bp, Homo sapiens
gccttcttaagatacaaatggtg

SEQ ID NO: 3509620 - DNA, 15 bp, Homo sapiens
gccttcttttgatta

SEQ ID NO: 3509621 - DNA, 13 bp, Homo sapiens
gccttgaaaaaca

SEQ ID NO: 3509622 - DNA, 14 bp, Homo sapiens
gccttgaataataa

SEQ ID NO: 3509623 - DNA, 23 bp, Homo sapiens
gccttgatgactgccttgcctcc

SEQ ID NO: 3509624 - DNA, 14 bp, Homo sapiens
gccttgcataccca

SEQ ID NO: 3509625 - DNA, 13 bp, Homo sapiens
gccttgccagaga

SEQ ID NO: 3509626 - DNA, 17 bp, Homo sapiens
gccttgcctcctcagta

SEQ ID NO: 3509627 - DNA, 15 bp, Homo sapiens
gccttgcctggcctg

SEQ ID NO: 3509628 - DNA, 12 bp, Homo sapiens
gccttggctcag

SEQ ID NO: 3509629 - DNA, 15 bp, Homo sapiens
gccttggctcagaca

SEQ ID NO: 3509630 - DNA, 15 bp, Homo sapiens
gccttgggagccact

SEQ ID NO: 3509631 - DNA, 21 bp, Homo sapiens
gccttgggagccactgccact

SEQ ID NO: 3509632 - DNA, 13 bp, Homo sapiens
agaattactgtaa

SEQ ID NO: 3509633 - DNA, 15 bp, Homo sapiens
agaattagctttttc

SEQ ID NO: 3509634 - DNA, 20 bp, Homo sapiens
agaattcaaactggggcctc

SEQ ID NO: 3509635 - DNA, 23 bp, Homo sapiens
agaattcttacatgttttctttg

SEQ ID NO: 3509636 - DNA, 13 bp, Homo sapiens
agaattgggcggc

SEQ ID NO: 3509637 - DNA, 14 bp, Homo sapiens
agaatttattcaat

SEQ ID NO: 3509638 - DNA, 17 bp, Homo sapiens
agaatttgagtgctctg

SEQ ID NO: 3509639 - DNA, 15 bp, Homo sapiens
agaatttgtgttgaa

SEQ ID NO: 3509640 - DNA, 19 bp, Homo sapiens
agaatttgtgttgaaggaa

SEQ ID NO: 3509641 - DNA, 14 bp, Homo sapiens
agacaaaaagacaa

SEQ ID NO: 3509642 - DNA, 18 bp, Homo sapiens
agacaaaaagacaaacat

SEQ ID NO: 3509643 - DNA, 20 bp, Homo sapiens
agacaatatgtgagtgcctt

SEQ ID NO: 3509644 - DNA, 18 bp, Homo sapiens
acttataaagaaggttgg

SEQ ID NO: 3509645 - DNA, 18 bp, Homo sapiens
acttataaagtagaaatg

SEQ ID NO: 3509646 - DNA, 19 bp, Homo sapiens
acttatagttaatattttg

SEQ ID NO: 3509647 - DNA, 19 bp, Homo sapiens
acttatcctaaaacaaata

SEQ ID NO: 3509648 - DNA, 17 bp, Homo sapiens
acttatgaatgatttgc

SEQ ID NO: 3509649 - DNA, 20 bp, Homo sapiens
acttatgaatgatttgcata

SEQ ID NO: 3509650 - DNA, 13 bp, Homo sapiens
acttatgatttca

SEQ ID NO: 3509651 - DNA, 21 bp, Homo sapiens
acttattaacaattaggcaga

SEQ ID NO: 3509652 - DNA, 14 bp, Homo sapiens
acttcagattgaac

SEQ ID NO: 3509653 - DNA, 11 bp, Homo sapiens
acttcagctga

SEQ ID NO: 3509654 - DNA, 24 bp, Homo sapiens
acttcatattgctgagagaaatat

SEQ ID NO: 3509655 - DNA, 20 bp, Homo sapiens
acttcatcaaacatgggttt

SEQ ID NO: 3509656 - DNA, 16 bp, Homo sapiens
acttcatgcaggtgaa

SEQ ID NO: 3509657 - DNA, 13 bp, Homo sapiens
acttcatggacca

SEQ ID NO: 3509658 - DNA, 18 bp, Homo sapiens
acttcatggaccaagaat

SEQ ID NO: 3509659 - DNA, 14 bp, Homo sapiens
acttcattcttgaa

SEQ ID NO: 3509660 - DNA, 16 bp, Homo sapiens
acttcattttcagagt

SEQ ID NO: 3509661 - DNA, 15 bp, Homo sapiens
acttccattgtttaa

SEQ ID NO: 3509662 - DNA, 21 bp, Homo sapiens
acttcctgactctcacctgta

SEQ ID NO: 3509663 - DNA, 12 bp, Homo sapiens
acttcctgtact

SEQ ID NO: 3509664 - DNA, 18 bp, Homo sapiens
acttcctgtccagctcca

SEQ ID NO: 3509665 - DNA, 18 bp, Homo sapiens
acttccttatgcttcttt

SEQ ID NO: 3509666 - DNA, 14 bp, Homo sapiens
acttccttgagaca

SEQ ID NO: 3509667 - DNA, 14 bp, Homo sapiens
acttctccaccctg

SEQ ID NO: 3509668 - DNA, 15 bp, Homo sapiens
acttctccaccctgc

SEQ ID NO: 3509669 - DNA, 18 bp, Homo sapiens
acttctccaccctgctct

SEQ ID NO: 3509670 - DNA, 16 bp, Homo sapiens
acttctgcctggagac

SEQ ID NO: 3509671 - DNA, 12 bp, Homo sapiens
acttctgcctgt

SEQ ID NO: 3509672 - DNA, 16 bp, Homo sapiens
acttctggctccctct

SEQ ID NO: 3509673 - DNA, 23 bp, Homo sapiens
agaaatacaaaaatactcagata

SEQ ID NO: 3509674 - DNA, 19 bp, Homo sapiens
agaaatacaattctacatt

SEQ ID NO: 3509675 - DNA, 16 bp, Homo sapiens
agaaatacagattttg

SEQ ID NO: 3509676 - DNA, 16 bp, Homo sapiens
agaaatcttgaatagc

SEQ ID NO: 3509677 - DNA, 13 bp, Homo sapiens
agaaatgctgctg

SEQ ID NO: 3509678 - DNA, 15 bp, Homo sapiens
agaaatgggaatcat

SEQ ID NO: 3509679 - DNA, 17 bp, Homo sapiens
agaaatgggaatcatgg

SEQ ID NO: 3509680 - DNA, 22 bp, Homo sapiens
agaaatgggaatcatggcctct

SEQ ID NO: 3509681 - DNA, 16 bp, Homo sapiens
agaaatggttgtatta

SEQ ID NO: 3509682 - DNA, 18 bp, Homo sapiens
agaaatggttgtattaga

SEQ ID NO: 3509683 - DNA, 20 bp, Homo sapiens
agaaatggttgtattagatg

SEQ ID NO: 3509684 - DNA, 14 bp, Homo sapiens
agaaattgcctatc

SEQ ID NO: 3509685 - DNA, 13 bp, Homo sapiens
agaaatttatttc

SEQ ID NO: 3509686 - DNA, 15 bp, Homo sapiens
agaaatttatttcct

SEQ ID NO: 3509687 - DNA, 13 bp, Homo sapiens
agaaatttctagt

SEQ ID NO: 3509688 - DNA, 17 bp, Homo sapiens
agaaatttgataatgac

SEQ ID NO: 3509689 - DNA, 14 bp, Homo sapiens
agaacactgtgaaa

SEQ ID NO: 3509690 - DNA, 19 bp, Homo sapiens
agaacagggaaaataggca

SEQ ID NO: 3509691 - DNA, 20 bp, Homo sapiens
agaacagggaaaataggcag

SEQ ID NO: 3509692 - DNA, 20 bp, Homo sapiens
agaacagtatgaatttgagc

SEQ ID NO: 3509693 - DNA, 17 bp, Homo sapiens
agaacatccctgccagc

SEQ ID NO: 3509694 - DNA, 18 bp, Homo sapiens
agaacatccctgccagct

SEQ ID NO: 3509695 - DNA, 15 bp, Homo sapiens
agaacatgatgggcc

SEQ ID NO: 3509696 - DNA, 17 bp, Homo sapiens
agaacatgatgggcctg

SEQ ID NO: 3509697 - DNA, 12 bp, Homo sapiens
ctatgacacagt

SEQ ID NO: 3509698 - DNA, 16 bp, Homo sapiens
ctcacgtgagagtgtc

SEQ ID NO: 3509699 - DNA, 13 bp, Homo sapiens
ctcactaattttt

SEQ ID NO: 3509700 - DNA, 15 bp, Homo sapiens
ctcactaggccccca

SEQ ID NO: 3509701 - DNA, 17 bp, Homo sapiens
ctcactataccagtata

SEQ ID NO: 3509702 - DNA, 16 bp, Homo sapiens
ctcactatgttgccca

SEQ ID NO: 3509703 - DNA, 18 bp, Homo sapiens
ctcactatgttgcccagg

SEQ ID NO: 3509704 - DNA, 19 bp, Homo sapiens
ctcactatgttgcccaggc

SEQ ID NO: 3509705 - DNA, 23 bp, Homo sapiens
ctcactatgttgcccaggcaggt

SEQ ID NO: 3509706 - DNA, 21 bp, Homo sapiens
ctcactcaccccagcgagctc

SEQ ID NO: 3509707 - DNA, 19 bp, Homo sapiens
ctccctgttccccagagaa

SEQ ID NO: 3509708 - DNA, 14 bp, Homo sapiens
ctcccttctgctac

SEQ ID NO: 3509709 - DNA, 13 bp, Homo sapiens
ctcccttgggctc

SEQ ID NO: 3509710 - DNA, 12 bp, Homo sapiens
ctccctttctcc

SEQ ID NO: 3509711 - DNA, 14 bp, Homo sapiens
ctccctttctcccc

SEQ ID NO: 3509712 - DNA, 23 bp, Homo sapiens
ctccctttctcccctgcccccag

SEQ ID NO: 3509713 - DNA, 17 bp, Homo sapiens
ctccctttcttccctac

SEQ ID NO: 3509714 - DNA, 21 bp, Homo sapiens
ctccctttttatatcccattt

SEQ ID NO: 3509715 - DNA, 15 bp, Homo sapiens
ctccgaccagacacc

SEQ ID NO: 3509716 - DNA, 13 bp, Homo sapiens
ctccgagaggtgg

SEQ ID NO: 3509717 - DNA, 13 bp, Homo sapiens
ctccgcaggactt

SEQ ID NO: 3509718 - DNA, 22 bp, Homo sapiens
ctccgcaggacttccccggagg

SEQ ID NO: 3509719 - DNA, 23 bp, Homo sapiens
ctccgccaggcgagatggggtgg

SEQ ID NO: 3509720 - DNA, 14 bp, Homo sapiens
ctccgccctgccac

SEQ ID NO: 3509721 - DNA, 17 bp, Homo sapiens
ctccgccctgccactca

SEQ ID NO: 3509722 - DNA, 14 bp, Homo sapiens
ctccgcctgaggcc

SEQ ID NO: 3509723 - DNA, 19 bp, Homo sapiens
ctccgccttcacattcccc

SEQ ID NO: 3509724 - DNA, 13 bp, Homo sapiens
ctccggagacagg

SEQ ID NO: 3509725 - DNA, 12 bp, Homo sapiens
ctccggcctgct

SEQ ID NO: 3509726 - DNA, 13 bp, Homo sapiens
ctccggctgtgct

SEQ ID NO: 3509727 - DNA, 17 bp, Homo sapiens
ctccggctgtgctggga

SEQ ID NO: 3509728 - DNA, 18 bp, Homo sapiens
ctccggcttgacctgttt

SEQ ID NO: 3509729 - DNA, 13 bp, Homo sapiens
ctccgtccatatc

SEQ ID NO: 3509730 - DNA, 16 bp, Homo sapiens
ctccgttagctcctgt

SEQ ID NO: 3509731 - DNA, 12 bp, Homo sapiens
ctcctaagggac

SEQ ID NO: 3509732 - DNA, 16 bp, Homo sapiens
ctcattaatgacactt

SEQ ID NO: 3509733 - DNA, 18 bp, Homo sapiens
ctcattactgcttcattt

SEQ ID NO: 3509734 - DNA, 12 bp, Homo sapiens
ctcattccagat

SEQ ID NO: 3509735 - DNA, 14 bp, Homo sapiens
ctcattccagatcc

SEQ ID NO: 3509736 - DNA, 12 bp, Homo sapiens
ctcattcccaac

SEQ ID NO: 3509737 - DNA, 21 bp, Homo sapiens
ctcattcccaacgtgcaaagc

SEQ ID NO: 3509738 - DNA, 12 bp, Homo sapiens
ctcattcctgtt

SEQ ID NO: 3509739 - DNA, 14 bp, Homo sapiens
ctcattctgcacct

SEQ ID NO: 3509740 - DNA, 12 bp, Homo sapiens
ctcattcttctg

SEQ ID NO: 3509741 - DNA, 13 bp, Homo sapiens
ctcattcttctgt

SEQ ID NO: 3509742 - DNA, 23 bp, Homo sapiens
ctcattcttctgtacgtctgaca

SEQ ID NO: 3509743 - DNA, 13 bp, Homo sapiens
ctcattgttctgt

SEQ ID NO: 3509744 - DNA, 19 bp, Homo sapiens
ctcatttagtgccctcttt

SEQ ID NO: 3509745 - DNA, 21 bp, Homo sapiens
ctcatttcaggagcagcctca

SEQ ID NO: 3509746 - DNA, 17 bp, Homo sapiens
ctcatttggggtagcta

SEQ ID NO: 3509747 - DNA, 20 bp, Homo sapiens
ctcatttggggtagctagag

SEQ ID NO: 3509748 - DNA, 18 bp, Homo sapiens
ctcatttgtcacacactt

SEQ ID NO: 3509749 - DNA, 23 bp, Homo sapiens
ctgaccagtttaacctgatgcag

SEQ ID NO: 3509750 - DNA, 21 bp, Homo sapiens
ctgacccagtgcccccactga

SEQ ID NO: 3509751 - DNA, 20 bp, Homo sapiens
ctgaccctggggctggcttt

SEQ ID NO: 3509752 - DNA, 19 bp, Homo sapiens
ctgaccctgtatatagccc

SEQ ID NO: 3509753 - DNA, 21 bp, Homo sapiens
ctgaccctgtatatagcccag

SEQ ID NO: 3509754 - DNA, 22 bp, Homo sapiens
ctgaccctgtatatagcccagc

SEQ ID NO: 3509755 - DNA, 16 bp, Homo sapiens
ctgacctccacagctt

SEQ ID NO: 3509756 - DNA, 18 bp, Homo sapiens
ctgacctccctctaattt

SEQ ID NO: 3509757 - DNA, 21 bp, Homo sapiens
ctgacctccctctaatttatc

SEQ ID NO: 3509758 - DNA, 21 bp, Homo sapiens
ctgacctggtccacagggcac

SEQ ID NO: 3509759 - DNA, 22 bp, Homo sapiens
ctgaccttcagctcacgcttca

SEQ ID NO: 3509760 - DNA, 22 bp, Homo sapiens
ctgacctttaactgagggctga

SEQ ID NO: 3509761 - DNA, 15 bp, Homo sapiens
ctgacggccagggag

SEQ ID NO: 3509762 - DNA, 18 bp, Homo sapiens
ctgacgtagctgcaaagg

SEQ ID NO: 3509763 - DNA, 16 bp, Homo sapiens
ctgactcagggctcct

SEQ ID NO: 3509764 - DNA, 19 bp, Homo sapiens
ctgactcagggctcctggg

SEQ ID NO: 3509765 - DNA, 22 bp, Homo sapiens
ctgactgaacattagttgcact

SEQ ID NO: 3509766 - DNA, 15 bp, Homo sapiens
ctgactgcccagcat

SEQ ID NO: 3509767 - DNA, 13 bp, Homo sapiens
ctgactgctcaga

SEQ ID NO: 3509768 - DNA, 14 bp, Homo sapiens
ctgactgctcagaa

SEQ ID NO: 3509769 - DNA, 18 bp, Homo sapiens
ctgacttaagcaaaagaa

SEQ ID NO: 3509770 - DNA, 19 bp, Homo sapiens
ctgacttaagcaaaagaaa

SEQ ID NO: 3509771 - DNA, 23 bp, Homo sapiens
ctgacttcatctcccacctagca

SEQ ID NO: 3509772 - DNA, 15 bp, Homo sapiens
ctgacttctgcctgg

SEQ ID NO: 3509773 - DNA, 22 bp, Homo sapiens
ctgacttgtgttcatgtggagt

SEQ ID NO: 3509774 - DNA, 18 bp, Homo sapiens
ctgagaaacccaccagcc

SEQ ID NO: 3509775 - DNA, 19 bp, Homo sapiens
ctgagaaacccaccagcct

SEQ ID NO: 3509776 - DNA, 23 bp, Homo sapiens
ctgagaatataatactgtatttg

SEQ ID NO: 3509777 - DNA, 14 bp, Homo sapiens
ctgagaatctttat

SEQ ID NO: 3509778 - DNA, 22 bp, Homo sapiens
ctgagaatctttattgagaaag

SEQ ID NO: 3509779 - DNA, 19 bp, Homo sapiens
ctgagaatgtaagaactac

SEQ ID NO: 3509780 - DNA, 21 bp, Homo sapiens
ctgagaggacttttctttgtg

SEQ ID NO: 3509781 - DNA, 17 bp, Homo sapiens
ctgagatacatacagaa

SEQ ID NO: 3509782 - DNA, 18 bp, Homo sapiens
ctgagattcaatattgaa

SEQ ID NO: 3509783 - DNA, 15 bp, Homo sapiens
ctgagatttcatctg

SEQ ID NO: 3509784 - DNA, 16 bp, Homo sapiens
ctgagatttcatctgc

SEQ ID NO: 3509785 - DNA, 19 bp, Homo sapiens
ctgagatttcatctgctct

SEQ ID NO: 3509786 - DNA, 20 bp, Homo sapiens
ctgagatttcatctgctctc

SEQ ID NO: 3509787 - DNA, 22 bp, Homo sapiens
ctgagcaaactatttgcgactc

SEQ ID NO: 3509788 - DNA, 13 bp, Homo sapiens
ctgagcaccaggg

SEQ ID NO: 3509789 - DNA, 17 bp, Homo sapiens
ctgagcaccctctggat

SEQ ID NO: 3509790 - DNA, 20 bp, Homo sapiens
ctgagcaccgtgtcaagctg

SEQ ID NO: 3509791 - DNA, 20 bp, Homo sapiens
ctgagcagtgaatgattcag

SEQ ID NO: 3509792 - DNA, 12 bp, Homo sapiens
ctgagccacctg

SEQ ID NO: 3509793 - DNA, 22 bp, Homo sapiens
ctgagccagtgtcaggaggaag

SEQ ID NO: 3509794 - DNA, 15 bp, Homo sapiens
ctgagcctggccagc

SEQ ID NO: 3509795 - DNA, 20 bp, Homo sapiens
ctgagcgaggagatgctcct

SEQ ID NO: 3509796 - DNA, 23 bp, Homo sapiens
ctgagctagttggttgaattttt

SEQ ID NO: 3509797 - DNA, 15 bp, Homo sapiens
ctgagctgaggcagc

SEQ ID NO: 3509798 - DNA, 16 bp, Homo sapiens
ctgagctgcttcacta

SEQ ID NO: 3509799 - DNA, 12 bp, Homo sapiens
ctgagctgggga

SEQ ID NO: 3509800 - DNA, 13 bp, Homo sapiens
ctgagctggggaa

SEQ ID NO: 3509801 - DNA, 19 bp, Homo sapiens
ctgagctgtatcttgatgt

SEQ ID NO: 3509802 - DNA, 13 bp, Homo sapiens
ctgagctgtgcag

SEQ ID NO: 3509803 - DNA, 15 bp, Homo sapiens
ctgagcttctctgtg

SEQ ID NO: 3509804 - DNA, 22 bp, Homo sapiens
ctgaggaacccttacagtagga

SEQ ID NO: 3509805 - DNA, 23 bp, Homo sapiens
ctgaggaagaacggggctcttct

SEQ ID NO: 3509806 - DNA, 20 bp, Homo sapiens
ctgaggaatccagacccggc

SEQ ID NO: 3509807 - DNA, 12 bp, Homo sapiens
ctgaggcaagag

SEQ ID NO: 3509808 - DNA, 14 bp, Homo sapiens
ctgaggcagggaag

SEQ ID NO: 3509809 - DNA, 22 bp, Homo sapiens
ctgaggcagggaagtccccagg

SEQ ID NO: 3509810 - DNA, 22 bp, Homo sapiens
ctgaggcatccagcagtctctg

SEQ ID NO: 3509811 - DNA, 14 bp, Homo sapiens
ctgaggcatcctct

SEQ ID NO: 3509812 - DNA, 16 bp, Homo sapiens
ctgaggcatcctctga

SEQ ID NO: 3509813 - DNA, 21 bp, Homo sapiens
ctgaggccacactcagcacaa

SEQ ID NO: 3509814 - DNA, 24 bp, Homo sapiens
ctgaggccacactcagcacaaggc

SEQ ID NO: 3509815 - DNA, 17 bp, Homo sapiens
ctgaggcctgagcgctc

SEQ ID NO: 3509816 - DNA, 18 bp, Homo sapiens
ctgaggcctgagcgctcc

SEQ ID NO: 3509817 - DNA, 22 bp, Homo sapiens
ctgaggcctgagcgctcctgcc

SEQ ID NO: 3509818 - DNA, 15 bp, Homo sapiens
ctgaggcctgggccg

SEQ ID NO: 3509819 - DNA, 22 bp, Homo sapiens
ctgaggcctgggccgctgccac

SEQ ID NO: 3509820 - DNA, 18 bp, Homo sapiens
ctgaggctggcacaggac

SEQ ID NO: 3509821 - DNA, 20 bp, Homo sapiens
ctgaggctgtggtcacagcg

SEQ ID NO: 3509822 - DNA, 18 bp, Homo sapiens
ctgaggctttggatttga

SEQ ID NO: 3509823 - DNA, 13 bp, Homo sapiens
ctgagggaccctt

SEQ ID NO: 3509824 - DNA, 12 bp, Homo sapiens
ctgagggagcct

SEQ ID NO: 3509825 - DNA, 20 bp, Homo sapiens
ctgagggagctccaactcag

SEQ ID NO: 3509826 - DNA, 15 bp, Homo sapiens
ctgagggatctttac

SEQ ID NO: 3509827 - DNA, 16 bp, Homo sapiens
ctgagggcagtcgata

SEQ ID NO: 3509828 - DNA, 16 bp, Homo sapiens
ctgagggctgatcttt

SEQ ID NO: 3509829 - DNA, 16 bp, Homo sapiens
ctgagggtctgggcgg

SEQ ID NO: 3509830 - DNA, 20 bp, Homo sapiens
ctgagggtgtttcttcctgc

SEQ ID NO: 3509831 - DNA, 19 bp, Homo sapiens
ctgagtagctctcctgact

SEQ ID NO: 3509832 - DNA, 22 bp, Homo sapiens
ctgagtcatctgttagggcctt

SEQ ID NO: 3509833 - DNA, 13 bp, Homo sapiens
ctgagtcctggcc

SEQ ID NO: 3509834 - DNA, 14 bp, Homo sapiens
ctgagtctatgttc

SEQ ID NO: 3509835 - DNA, 19 bp, Homo sapiens
ctgagtctatgttcaaaga

SEQ ID NO: 3509836 - DNA, 23 bp, Homo sapiens
ctgagtctatgttcaaagactgt

SEQ ID NO: 3509837 - DNA, 17 bp, Homo sapiens
ctgagtgaacctgtata

SEQ ID NO: 3509838 - DNA, 13 bp, Homo sapiens
ctgagtgcctggc

SEQ ID NO: 3509839 - DNA, 13 bp, Homo sapiens
ctgagtgccttct

SEQ ID NO: 3509840 - DNA, 16 bp, Homo sapiens
ctgagtggcaggggac

SEQ ID NO: 3509841 - DNA, 18 bp, Homo sapiens
ctgagtggcaggggacag

SEQ ID NO: 3509842 - DNA, 22 bp, Homo sapiens
ctgagttttccatggcaggaag

SEQ ID NO: 3509843 - DNA, 18 bp, Homo sapiens
ctgataactagatggtgc

SEQ ID NO: 3509844 - DNA, 19 bp, Homo sapiens
ctgataactagatggtgct

SEQ ID NO: 3509845 - DNA, 20 bp, Homo sapiens
ctgataactagatggtgctg

SEQ ID NO: 3509846 - DNA, 21 bp, Homo sapiens
ctgataactagatggtgctga

SEQ ID NO: 3509847 - DNA, 23 bp, Homo sapiens
ctgataactagatggtgctgaga

SEQ ID NO: 3509848 - DNA, 15 bp, Homo sapiens
ctgatatatgtgttt

SEQ ID NO: 3509849 - DNA, 15 bp, Homo sapiens
ctgatcaaggcctta

SEQ ID NO: 3509850 - DNA, 19 bp, Homo sapiens
ctgatcagaaaccaaccat

SEQ ID NO: 3509851 - DNA, 19 bp, Homo sapiens
ctgatcatcgccagaggtg

SEQ ID NO: 3509852 - DNA, 13 bp, Homo sapiens
ctgatccctctgg

SEQ ID NO: 3509853 - DNA, 14 bp, Homo sapiens
ctgatccctctggg

SEQ ID NO: 3509854 - DNA, 15 bp, Homo sapiens
ctgatcctggaggcc

SEQ ID NO: 3509855 - DNA, 17 bp, Homo sapiens
ctgatcctggaggccca

SEQ ID NO: 3509856 - DNA, 20 bp, Homo sapiens
ctgatgatttcttgaaaagg

SEQ ID NO: 3509857 - DNA, 23 bp, Homo sapiens
ctgatgcagtcacgtggaggagc

SEQ ID NO: 3509858 - DNA, 14 bp, Homo sapiens
ctgatgctgcccct

SEQ ID NO: 3509859 - DNA, 18 bp, Homo sapiens
ctgatgcttacatctgga

SEQ ID NO: 3509860 - DNA, 19 bp, Homo sapiens
ctgatggcttctccagggt

SEQ ID NO: 3509861 - DNA, 22 bp, Homo sapiens
ctgatgggaaaactgccaatat

SEQ ID NO: 3509862 - DNA, 22 bp, Homo sapiens
ctgatgggcaacccccagcctg

SEQ ID NO: 3509863 - DNA, 22 bp, Homo sapiens
ctgatgtcaatttctgtgttgc

SEQ ID NO: 3509864 - DNA, 15 bp, Homo sapiens
ctgatgtcctcacca

SEQ ID NO: 3509865 - DNA, 17 bp, Homo sapiens
ctgattaaatatttgaa

SEQ ID NO: 3509866 - DNA, 15 bp, Homo sapiens
ctgattcaactaaaa

SEQ ID NO: 3509867 - DNA, 17 bp, Homo sapiens
ctgattcaactaaaaaa

SEQ ID NO: 3509868 - DNA, 18 bp, Homo sapiens
ctgattcaactaaaaaaa

SEQ ID NO: 3509869 - DNA, 18 bp, Homo sapiens
ctgattctcagggtctct

SEQ ID NO: 3509870 - DNA, 20 bp, Homo sapiens
ctgattctcagggtctctgc

SEQ ID NO: 3509871 - DNA, 21 bp, Homo sapiens
ctgattctcagggtctctgct

SEQ ID NO: 3509872 - DNA, 19 bp, Homo sapiens
ctgattcttctaaattaaa

SEQ ID NO: 3509873 - DNA, 17 bp, Homo sapiens
ctgatttaggagaagcc

SEQ ID NO: 3509874 - DNA, 20 bp, Homo sapiens
ctgatttaggagaagccagg

SEQ ID NO: 3509875 - DNA, 13 bp, Homo sapiens
ctgcaaacgctgc

SEQ ID NO: 3509876 - DNA, 23 bp, Homo sapiens
ctgcaaagatctgtcctcagcct

SEQ ID NO: 3509877 - DNA, 14 bp, Homo sapiens
ctgcaaaggacaga

SEQ ID NO: 3509878 - DNA, 23 bp, Homo sapiens
ctgcaaaggacagatccagggac

SEQ ID NO: 3509879 - DNA, 20 bp, Homo sapiens
ctgcaaagtgttttgtacca

SEQ ID NO: 3509880 - DNA, 23 bp, Homo sapiens
ctgcaaagtgttttgtaccagtg

SEQ ID NO: 3509881 - DNA, 22 bp, Homo sapiens
ctgcaacctccgcctcttgggt

SEQ ID NO: 3509882 - DNA, 17 bp, Homo sapiens
ctgcaactgctcagctc

SEQ ID NO: 3509883 - DNA, 14 bp, Homo sapiens
ctctgttcagtgta

SEQ ID NO: 3509884 - DNA, 16 bp, Homo sapiens
ctctgttccttcacat

SEQ ID NO: 3509885 - DNA, 18 bp, Homo sapiens
ctctgttcggcctttggg

SEQ ID NO: 3509886 - DNA, 13 bp, Homo sapiens
ctcttaaaaccca

SEQ ID NO: 3509887 - DNA, 15 bp, Homo sapiens
ctcttactctttcct

SEQ ID NO: 3509888 - DNA, 16 bp, Homo sapiens
ctcttactctttccta

SEQ ID NO: 3509889 - DNA, 20 bp, Homo sapiens
ctcttactctttcctatttc

SEQ ID NO: 3509890 - DNA, 15 bp, Homo sapiens
ctcttagaacattgt

SEQ ID NO: 3509891 - DNA, 17 bp, Homo sapiens
ctcttagctcccctcca

SEQ ID NO: 3509892 - DNA, 19 bp, Homo sapiens
ctcttaggaagagaaacca

SEQ ID NO: 3509893 - DNA, 18 bp, Homo sapiens
ctcttatagaatatttat

SEQ ID NO: 3509894 - DNA, 22 bp, Homo sapiens
ctcttatagaatatttattacc

SEQ ID NO: 3509895 - DNA, 14 bp, Homo sapiens
ctcttattgcccac

SEQ ID NO: 3509896 - DNA, 15 bp, Homo sapiens
ctcttattttacaat

SEQ ID NO: 3509897 - DNA, 18 bp, Homo sapiens
ctcttcactcttcaaatg

SEQ ID NO: 3509898 - DNA, 13 bp, Homo sapiens
ctcttcagaggcc

SEQ ID NO: 3509899 - DNA, 17 bp, Homo sapiens
ctcttcagaggccctcg

SEQ ID NO: 3509900 - DNA, 14 bp, Homo sapiens
ctcttcagttaatt

SEQ ID NO: 3509901 - DNA, 16 bp, Homo sapiens
ctcttccactccttct

SEQ ID NO: 3509902 - DNA, 15 bp, Homo sapiens
ctcttccctcagtcc

SEQ ID NO: 3509903 - DNA, 17 bp, Homo sapiens
ctcttcctaccctgcct

SEQ ID NO: 3509904 - DNA, 18 bp, Homo sapiens
ctcttcctaccctgcctc

SEQ ID NO: 3509905 - DNA, 15 bp, Homo sapiens
ctcttctcatttcac

SEQ ID NO: 3509906 - DNA, 15 bp, Homo sapiens
ctcttctccaggctg

SEQ ID NO: 3509907 - DNA, 16 bp, Homo sapiens
ctcttctccaggctgt

SEQ ID NO: 3509908 - DNA, 13 bp, Homo sapiens
ctcttctccccag

SEQ ID NO: 3509909 - DNA, 16 bp, Homo sapiens
ctcttctccccagagt

SEQ ID NO: 3509910 - DNA, 12 bp, Homo sapiens
ctcttctggcct

SEQ ID NO: 3509911 - DNA, 21 bp, Homo sapiens
ctcttctgggagggcagcagg

SEQ ID NO: 3509912 - DNA, 13 bp, Homo sapiens
ctcttctgtccct

SEQ ID NO: 3509913 - DNA, 12 bp, Homo sapiens
ctcttctttccc

SEQ ID NO: 3509914 - DNA, 15 bp, Homo sapiens
ctcttctttcccaaa

SEQ ID NO: 3509915 - DNA, 13 bp, Homo sapiens
ctcttgagcctgg

SEQ ID NO: 3509916 - DNA, 21 bp, Homo sapiens
ctcttgattatccatattgag

SEQ ID NO: 3509917 - DNA, 21 bp, Homo sapiens
ctcttgggaactgaactcact

SEQ ID NO: 3509918 - DNA, 17 bp, Homo sapiens
ctcttggggaaggggca

SEQ ID NO: 3509919 - DNA, 21 bp, Homo sapiens
ctcttgggttcaagcgattct

SEQ ID NO: 3509920 - DNA, 14 bp, Homo sapiens
ctcttgtaaataaa

SEQ ID NO: 3509921 - DNA, 19 bp, Homo sapiens
ctcttgtaaataaagccct

SEQ ID NO: 3509922 - DNA, 23 bp, Homo sapiens
ctcttgtaaataaagccctggga

SEQ ID NO: 3509923 - DNA, 21 bp, Homo sapiens
ctcttgtaatccgaatctctt

SEQ ID NO: 3509924 - DNA, 23 bp, Homo sapiens
ctctttaatgtcacaggcaggtc

SEQ ID NO: 3509925 - DNA, 17 bp, Homo sapiens
ctctttagagttagact

SEQ ID NO: 3509926 - DNA, 18 bp, Homo sapiens
ctctttagccagaatctc

SEQ ID NO: 3509927 - DNA, 16 bp, Homo sapiens
ctctttattttactag

SEQ ID NO: 3509928 - DNA, 12 bp, Homo sapiens
ctctttcaaaac

SEQ ID NO: 3509929 - DNA, 14 bp, Homo sapiens
ctctttcacattgt

SEQ ID NO: 3509930 - DNA, 16 bp, Homo sapiens
ctctttcacattgttt

SEQ ID NO: 3509931 - DNA, 14 bp, Homo sapiens
ctctttctgtatat

SEQ ID NO: 3509932 - DNA, 17 bp, Homo sapiens
ctctttgctgcagagaa

SEQ ID NO: 3509933 - DNA, 22 bp, Homo sapiens
ctctttgctttgctttctgctc

SEQ ID NO: 3509934 - DNA, 15 bp, Homo sapiens
ctctttgggaatgtt

SEQ ID NO: 3509935 - DNA, 14 bp, Homo sapiens
ctctttgtctaaaa

SEQ ID NO: 3509936 - DNA, 16 bp, Homo sapiens
ctctttgtctaaaaca

SEQ ID NO: 3509937 - DNA, 21 bp, Homo sapiens
ctctttgtctaaaacaataaa

SEQ ID NO: 3509938 - DNA, 22 bp, Homo sapiens
ctctttgtctaaaacaataaaa

SEQ ID NO: 3509939 - DNA, 22 bp, Homo sapiens
ctctttgtgggtttttcatctt

SEQ ID NO: 3509940 - DNA, 17 bp, Homo sapiens
ctcttttacctgctgct

SEQ ID NO: 3509941 - DNA, 14 bp, Homo sapiens
ctcttttcaaaaca

SEQ ID NO: 3509942 - DNA, 21 bp, Homo sapiens
ctcttttgctttattccagaa

SEQ ID NO: 3509943 - DNA, 15 bp, Homo sapiens
ctgaaaacctctcct

SEQ ID NO: 3509944 - DNA, 15 bp, Homo sapiens
ctgaaacaacttgga

SEQ ID NO: 3509945 - DNA, 20 bp, Homo sapiens
ctgaaacaacttggaaagat

SEQ ID NO: 3509946 - DNA, 15 bp, Homo sapiens
ctgaaacagctgcct

SEQ ID NO: 3509947 - DNA, 18 bp, Homo sapiens
ctgaaacagctgccttag

SEQ ID NO: 3509948 - DNA, 20 bp, Homo sapiens
ctgaaacagctgccttagct

SEQ ID NO: 3509949 - DNA, 23 bp, Homo sapiens
ctgaaaccttagtttcaagagtc

SEQ ID NO: 3509950 - DNA, 19 bp, Homo sapiens
ctgaaacgctcctttgtgt

SEQ ID NO: 3509951 - DNA, 20 bp, Homo sapiens
ctgaaacgctcctttgtgtg

SEQ ID NO: 3509952 - DNA, 20 bp, Homo sapiens
ctgaaactatattttgtcat

SEQ ID NO: 3509953 - DNA, 21 bp, Homo sapiens
ctgaaagactgaagaaagtgt

SEQ ID NO: 3509954 - DNA, 18 bp, Homo sapiens
ctgaaagccctgagcttt

SEQ ID NO: 3509955 - DNA, 13 bp, Homo sapiens
ctgaaagcggctg

SEQ ID NO: 3509956 - DNA, 16 bp, Homo sapiens
ctgaaagcggctgcct

SEQ ID NO: 3509957 - DNA, 18 bp, Homo sapiens
ctgaaagcggctgcctcc

SEQ ID NO: 3509958 - DNA, 18 bp, Homo sapiens
ctgaaagctggtggcaga

SEQ ID NO: 3509959 - DNA, 15 bp, Homo sapiens
ctgaaagttgtacat

SEQ ID NO: 3509960 - DNA, 21 bp, Homo sapiens
ctgaaatatcccgggggtggg

SEQ ID NO: 3509961 - DNA, 18 bp, Homo sapiens
ctgaaattctcctggagg

SEQ ID NO: 3509962 - DNA, 19 bp, Homo sapiens
ctgaaattctcctggaggt

SEQ ID NO: 3509963 - DNA, 17 bp, Homo sapiens
ctgaaccctcagccttg

SEQ ID NO: 3509964 - DNA, 22 bp, Homo sapiens
ctgaacctggggtcatcgattc

SEQ ID NO: 3509965 - DNA, 21 bp, Homo sapiens
ctgaacctgggtaactaggga

SEQ ID NO: 3509966 - DNA, 17 bp, Homo sapiens
ctgaactccttccccac

SEQ ID NO: 3509967 - DNA, 18 bp, Homo sapiens
ctgaactccttccccact

SEQ ID NO: 3509968 - DNA, 13 bp, Homo sapiens
ctgaactgagcct

SEQ ID NO: 3509969 - DNA, 21 bp, Homo sapiens
ctgaactttgggaagccttta

SEQ ID NO: 3509970 - DNA, 19 bp, Homo sapiens
ctgaagactcattcttctg

SEQ ID NO: 3509971 - DNA, 14 bp, Homo sapiens
ctgaagagtcctct

SEQ ID NO: 3509972 - DNA, 15 bp, Homo sapiens
ctgaagagtcctctg

SEQ ID NO: 3509973 - DNA, 23 bp, Homo sapiens
ctgaagagttgccccgtctctgt

SEQ ID NO: 3509974 - DNA, 17 bp, Homo sapiens
ctgaagatttcagaggc

SEQ ID NO: 3509975 - DNA, 20 bp, Homo sapiens
ctgaagatttcagaggctgc

SEQ ID NO: 3509976 - DNA, 14 bp, Homo sapiens
ctgaagcagcctct

SEQ ID NO: 3509977 - DNA, 19 bp, Homo sapiens
ctgaagcaggttcccaagc

SEQ ID NO: 3509978 - DNA, 23 bp, Homo sapiens
ctgaagcctttgcattttggaga

SEQ ID NO: 3509979 - DNA, 20 bp, Homo sapiens
ctgaaggacattgcggacag

SEQ ID NO: 3509980 - DNA, 12 bp, Homo sapiens
ctgaaggagccc

SEQ ID NO: 3509981 - DNA, 21 bp, Homo sapiens
ctgaaggagccccattcctgg

SEQ ID NO: 3509982 - DNA, 15 bp, Homo sapiens
ctgaaggggccatga

SEQ ID NO: 3509983 - DNA, 20 bp, Homo sapiens
ctgaaggggcgtctgttccc

SEQ ID NO: 3509984 - DNA, 15 bp, Homo sapiens
ctgaagtcacacagt

SEQ ID NO: 3509985 - DNA, 19 bp, Homo sapiens
ctgaagtcacacagtgagt

SEQ ID NO: 3509986 - DNA, 21 bp, Homo sapiens
ctgaataggcgatcacaacgt

SEQ ID NO: 3509987 - DNA, 11 bp, Homo sapiens
ctgaatgtatt

SEQ ID NO: 3509988 - DNA, 23 bp, Homo sapiens
ctgaattatctatacatatcttt

SEQ ID NO: 3509989 - DNA, 12 bp, Homo sapiens
ctgaatttgcaa

SEQ ID NO: 3509990 - DNA, 18 bp, Homo sapiens
ctgaatttgcaaagtact

SEQ ID NO: 3509991 - DNA, 20 bp, Homo sapiens
ctgaattttggggattttca

SEQ ID NO: 3509992 - DNA, 21 bp, Homo sapiens
ctgaattttggggattttcaa

SEQ ID NO: 3509993 - DNA, 13 bp, Homo sapiens
ctgacaacttgaa

SEQ ID NO: 3509994 - DNA, 12 bp, Homo sapiens
ctgacaaggcca

SEQ ID NO: 3509995 - DNA, 18 bp, Homo sapiens
ctgacacaaacctgcctg

SEQ ID NO: 3509996 - DNA, 20 bp, Homo sapiens
ctgacacaaacctgcctggg

SEQ ID NO: 3509997 - DNA, 15 bp, Homo sapiens
ctgacacacagctct

SEQ ID NO: 3509998 - DNA, 16 bp, Homo sapiens
ctgacacacagctctg

SEQ ID NO: 3509999 - DNA, 18 bp, Homo sapiens
ctgacacacagctctgtc

SEQ ID NO: 3510000 - DNA, 22 bp, Homo sapiens
ctgacacacagctctgtcctgg

SEQ ID NO: 3510001 - DNA, 23 bp, Homo sapiens
ctgacacacagctctgtcctggg

SEQ ID NO: 3510002 - DNA, 14 bp, Homo sapiens
ctgacacctttcat

SEQ ID NO: 3510003 - DNA, 18 bp, Homo sapiens
ctgacactaccttatcag

SEQ ID NO: 3510004 - DNA, 17 bp, Homo sapiens
ctgacactcccttgggc

SEQ ID NO: 3510005 - DNA, 14 bp, Homo sapiens
ctgacagacacagg

SEQ ID NO: 3510006 - DNA, 19 bp, Homo sapiens
ctgacagacacaggcccgg

SEQ ID NO: 3510007 - DNA, 20 bp, Homo sapiens
ctgacagcctcccaccccca

SEQ ID NO: 3510008 - DNA, 12 bp, Homo sapiens
ctgacagctgct

SEQ ID NO: 3510009 - DNA, 15 bp, Homo sapiens
ctgacaggctgtgac

SEQ ID NO: 3510010 - DNA, 20 bp, Homo sapiens
ctgacagtgtgggacaggct

SEQ ID NO: 3510011 - DNA, 23 bp, Homo sapiens
ctgacagtgtgggacaggctctt

SEQ ID NO: 3510012 - DNA, 15 bp, Homo sapiens
ctgacagtttttctg

SEQ ID NO: 3510013 - DNA, 15 bp, Homo sapiens
ctgacatgattcctt

SEQ ID NO: 3510014 - DNA, 17 bp, Homo sapiens
ctgacattgccaaaaag

SEQ ID NO: 3510015 - DNA, 14 bp, Homo sapiens
ctgaccacagcaca

SEQ ID NO: 3510016 - DNA, 13 bp, Homo sapiens
ctgaccagaacta

SEQ ID NO: 3510017 - DNA, 21 bp, Homo sapiens
ctgaccagcagcgcctttccc

SEQ ID NO: 3510018 - DNA, 20 bp, Homo sapiens
ctgaccagccgtgagcatgt

SEQ ID NO: 3510019 - DNA, 17 bp, Homo sapiens
ctgaccaggcgcccggg

SEQ ID NO: 3510020 - DNA, 17 bp, Homo sapiens
cttcacaaagcccaagg

SEQ ID NO: 3510021 - DNA, 14 bp, Homo sapiens
cttcacagatgcct

SEQ ID NO: 3510022 - DNA, 15 bp, Homo sapiens
cttcacagatgccta

SEQ ID NO: 3510023 - DNA, 23 bp, Homo sapiens
cttcacagatgcctacttttggc

SEQ ID NO: 3510024 - DNA, 17 bp, Homo sapiens
cttcacatccattgtct

SEQ ID NO: 3510025 - DNA, 19 bp, Homo sapiens
cttcacatccattgtctct

SEQ ID NO: 3510026 - DNA, 20 bp, Homo sapiens
cttcacatcctgtgtttcta

SEQ ID NO: 3510027 - DNA, 15 bp, Homo sapiens
cttcacccaggccta

SEQ ID NO: 3510028 - DNA, 13 bp, Homo sapiens
cttcacctcttcc

SEQ ID NO: 3510029 - DNA, 18 bp, Homo sapiens
cttcacctgattcaacta

SEQ ID NO: 3510030 - DNA, 18 bp, Homo sapiens
cttcactgtcctccaagc

SEQ ID NO: 3510031 - DNA, 19 bp, Homo sapiens
cttcagacagagaggactg

SEQ ID NO: 3510032 - DNA, 20 bp, Homo sapiens
cttcagagctgacacaggat

SEQ ID NO: 3510033 - DNA, 16 bp, Homo sapiens
cttcagagtttgtcat

SEQ ID NO: 3510034 - DNA, 15 bp, Homo sapiens
cttcagccctcaccc

SEQ ID NO: 3510035 - DNA, 19 bp, Homo sapiens
cttcagcctagtggcttgt

SEQ ID NO: 3510036 - DNA, 23 bp, Homo sapiens
cttcagcctagtggcttgtcctc

SEQ ID NO: 3510037 - DNA, 20 bp, Homo sapiens
cttcagcctcccgagtagct

SEQ ID NO: 3510038 - DNA, 11 bp, Homo sapiens
cttcagctgac

SEQ ID NO: 3510039 - DNA, 22 bp, Homo sapiens
cttcaggaacctcgagtactgt

SEQ ID NO: 3510040 - DNA, 11 bp, Homo sapiens
cttctgctact

SEQ ID NO: 3510041 - DNA, 20 bp, Homo sapiens
cttctgctactggcaaaagg

SEQ ID NO: 3510042 - DNA, 16 bp, Homo sapiens
cttctgctcagctctg

SEQ ID NO: 3510043 - DNA, 18 bp, Homo sapiens
cttctgcttcagcctccc

SEQ ID NO: 3510044 - DNA, 18 bp, Homo sapiens
cttctggaatttgttcaa

SEQ ID NO: 3510045 - DNA, 14 bp, Homo sapiens
cttctggcctccca

SEQ ID NO: 3510046 - DNA, 15 bp, Homo sapiens
cttctggcctcccac

SEQ ID NO: 3510047 - DNA, 12 bp, Homo sapiens
cttctggctcaa

SEQ ID NO: 3510048 - DNA, 22 bp, Homo sapiens
cttctggctccctcttctttca

SEQ ID NO: 3510049 - DNA, 14 bp, Homo sapiens
cttctgtacgtctg

SEQ ID NO: 3510050 - DNA, 15 bp, Homo sapiens
cttctgtacgtctga

SEQ ID NO: 3510051 - DNA, 18 bp, Homo sapiens
cttctgtacgtctgacag

SEQ ID NO: 3510052 - DNA, 21 bp, Homo sapiens
cttctgtacgtctgacaggca

SEQ ID NO: 3510053 - DNA, 16 bp, Homo sapiens
cttctgtcctactctg

SEQ ID NO: 3510054 - DNA, 17 bp, Homo sapiens
cttctgtcctactctgt

SEQ ID NO: 3510055 - DNA, 16 bp, Homo sapiens
cttctgttttcttctt

SEQ ID NO: 3510056 - DNA, 19 bp, Homo sapiens
cttctgttttgagttttgt

SEQ ID NO: 3510057 - DNA, 20 bp, Homo sapiens
cttctgttttgagttttgta

SEQ ID NO: 3510058 - DNA, 22 bp, Homo sapiens
cttcttatggaattgatttgca

SEQ ID NO: 3510059 - DNA, 15 bp, Homo sapiens
cttcttattacccaa

SEQ ID NO: 3510060 - DNA, 18 bp, Homo sapiens
cttcttattacccaaacc

SEQ ID NO: 3510061 - DNA, 13 bp, Homo sapiens
cttcttcacctct

SEQ ID NO: 3510062 - DNA, 17 bp, Homo sapiens
cttcttcacctcttcca

SEQ ID NO: 3510063 - DNA, 14 bp, Homo sapiens
cttcttcagagctg

SEQ ID NO: 3510064 - DNA, 16 bp, Homo sapiens
cttcttcagagctgac

SEQ ID NO: 3510065 - DNA, 14 bp, Homo sapiens
cttcttcagggcct

SEQ ID NO: 3510066 - DNA, 21 bp, Homo sapiens
cttcttgttctgagattcaat

SEQ ID NO: 3510067 - DNA, 22 bp, Homo sapiens
cttcttgttctgagattcaata

SEQ ID NO: 3510068 - DNA, 16 bp, Homo sapiens
cttcttgtttccttgt

SEQ ID NO: 3510069 - DNA, 14 bp, Homo sapiens
cttctttagaacag

SEQ ID NO: 3510070 - DNA, 13 bp, Homo sapiens
cttctttcccaaa

SEQ ID NO: 3510071 - DNA, 19 bp, Homo sapiens
cttctttgctttgcccagc

SEQ ID NO: 3510072 - DNA, 13 bp, Homo sapiens
cttcttttgatta

SEQ ID NO: 3510073 - DNA, 14 bp, Homo sapiens
cttcttttgattat

SEQ ID NO: 3510074 - DNA, 16 bp, Homo sapiens
cttcttttgattatgt

SEQ ID NO: 3510075 - DNA, 21 bp, Homo sapiens
cttgaaaaatacttttcctta

SEQ ID NO: 3510076 - DNA, 16 bp, Homo sapiens
cttgaaaataagaata

SEQ ID NO: 3510077 - DNA, 19 bp, Homo sapiens
cttgaaatatcctgcttga

SEQ ID NO: 3510078 - DNA, 20 bp, Homo sapiens
cttgaaatctaatatttcta

SEQ ID NO: 3510079 - DNA, 21 bp, Homo sapiens
cttgaaatctaatatttctag

SEQ ID NO: 3510080 - DNA, 15 bp, Homo sapiens
cttgaacccaggaga

SEQ ID NO: 3510081 - DNA, 22 bp, Homo sapiens
cttgaaccccaaatgctctctc

SEQ ID NO: 3510082 - DNA, 15 bp, Homo sapiens
cttgaactcctggcc

SEQ ID NO: 3510083 - DNA, 16 bp, Homo sapiens
cttgaactgggtactt

SEQ ID NO: 3510084 - DNA, 15 bp, Homo sapiens
cttgaacttgcctct

SEQ ID NO: 3510085 - DNA, 19 bp, Homo sapiens
cttgaactttcctggatgt

SEQ ID NO: 3510086 - DNA, 12 bp, Homo sapiens
cttgaagaactg

SEQ ID NO: 3510087 - DNA, 17 bp, Homo sapiens
cttgaagagaaaaaagt

SEQ ID NO: 3510088 - DNA, 15 bp, Homo sapiens
cttgaaggccctgct

SEQ ID NO: 3510089 - DNA, 15 bp, Homo sapiens
cttgaagggccagag

SEQ ID NO: 3510090 - DNA, 17 bp, Homo sapiens
cttgaagggccagagcc

SEQ ID NO: 3510091 - DNA, 19 bp, Homo sapiens
cttgaagggccagagccag

SEQ ID NO: 3510092 - DNA, 21 bp, Homo sapiens
cttgaagggccagagccaggg

SEQ ID NO: 3510093 - DNA, 17 bp, Homo sapiens
cttgaagtcctggcttc

SEQ ID NO: 3510094 - DNA, 18 bp, Homo sapiens
cttgaagtcctggcttca

SEQ ID NO: 3510095 - DNA, 20 bp, Homo sapiens
cttgaagtcctggcttcagg

SEQ ID NO: 3510096 - DNA, 19 bp, Homo sapiens
cttgaagtctaaaagcaga

SEQ ID NO: 3510097 - DNA, 19 bp, Homo sapiens
cttgaatactctgccctct

SEQ ID NO: 3510098 - DNA, 19 bp, Homo sapiens
cttgaatgtggcttgagaa

SEQ ID NO: 3510099 - DNA, 22 bp, Homo sapiens
cttgaattgtaactgttcttga

SEQ ID NO: 3510100 - DNA, 14 bp, Homo sapiens
cttgaattgtctag

SEQ ID NO: 3510101 - DNA, 15 bp, Homo sapiens
cttgaatttttttct

SEQ ID NO: 3510102 - DNA, 21 bp, Homo sapiens
cttgaatttttttctgcacag

SEQ ID NO: 3510103 - DNA, 24 bp, Homo sapiens
cttgaatttttttctgcacagctt

SEQ ID NO: 3510104 - DNA, 14 bp, Homo sapiens
cttgacaactggca

SEQ ID NO: 3510105 - DNA, 20 bp, Homo sapiens
cttgacaactggcaggcagg

SEQ ID NO: 3510106 - DNA, 15 bp, Homo sapiens
cttgacagaaagcag

SEQ ID NO: 3510107 - DNA, 18 bp, Homo sapiens
cttgacagaaagcagttc

SEQ ID NO: 3510108 - DNA, 12 bp, Homo sapiens
cttgacagggca

SEQ ID NO: 3510109 - DNA, 14 bp, Homo sapiens
cttgacagggcaca

SEQ ID NO: 3510110 - DNA, 20 bp, Homo sapiens
cttgacagggcacaccgggc

SEQ ID NO: 3510111 - DNA, 20 bp, Homo sapiens
cttgaccaagcaggaagctc

SEQ ID NO: 3510112 - DNA, 23 bp, Homo sapiens
cttgaccaagcaggaagctcaga

SEQ ID NO: 3510113 - DNA, 15 bp, Homo sapiens
cttgaccaggcctgg

SEQ ID NO: 3510114 - DNA, 17 bp, Homo sapiens
cttgaccaggcctgggc

SEQ ID NO: 3510115 - DNA, 15 bp, Homo sapiens
cttgaccctgagctg

SEQ ID NO: 3510116 - DNA, 17 bp, Homo sapiens
cttgacctgaggctgtg

SEQ ID NO: 3510117 - DNA, 20 bp, Homo sapiens
cttgacctgaggctgtggtc

SEQ ID NO: 3510118 - DNA, 11 bp, Homo sapiens
cttgagaaacc

SEQ ID NO: 3510119 - DNA, 12 bp, Homo sapiens
cttgagaaacct

SEQ ID NO: 3510120 - DNA, 22 bp, Homo sapiens
cttgagacacggagcccagccc

SEQ ID NO: 3510121 - DNA, 13 bp, Homo sapiens
cttgagctcagga

SEQ ID NO: 3510122 - DNA, 13 bp, Homo sapiens
cttgaggaaacaa

SEQ ID NO: 3510123 - DNA, 18 bp, Homo sapiens
cttgaggaaacaacagct

SEQ ID NO: 3510124 - DNA, 21 bp, Homo sapiens
cttgaggaaacaacagcttta

SEQ ID NO: 3510125 - DNA, 24 bp, Homo sapiens
cttgaggcttagctttgctctgcc

SEQ ID NO: 3510126 - DNA, 17 bp, Homo sapiens
cttgagtcatggatttc

SEQ ID NO: 3510127 - DNA, 18 bp, Homo sapiens
cttgagtcatggatttct

SEQ ID NO: 3510128 - DNA, 19 bp, Homo sapiens
cttgagttgattcagctct

SEQ ID NO: 3510129 - DNA, 21 bp, Homo sapiens
cttgagttgattcagctctgc

SEQ ID NO: 3510130 - DNA, 12 bp, Homo sapiens
cttgatagaaat

SEQ ID NO: 3510131 - DNA, 22 bp, Homo sapiens
cttgatagaaatgccaagcact

SEQ ID NO: 3510132 - DNA, 23 bp, Homo sapiens
cttgatcaacatcttttcttgcc

SEQ ID NO: 3510133 - DNA, 18 bp, Homo sapiens
cttgatgaccaaagtcct

SEQ ID NO: 3510134 - DNA, 12 bp, Homo sapiens
cttgatgactgc

SEQ ID NO: 3510135 - DNA, 16 bp, Homo sapiens
cttgatgactgccttg

SEQ ID NO: 3510136 - DNA, 21 bp, Homo sapiens
cttgatgcatgcactgttccc

SEQ ID NO: 3510137 - DNA, 19 bp, Homo sapiens
cttgatgggattctggaca

SEQ ID NO: 3510138 - DNA, 18 bp, Homo sapiens
cttgatttatttgcttct

SEQ ID NO: 3510139 - DNA, 14 bp, Homo sapiens
cttgcacagggatt

SEQ ID NO: 3510140 - DNA, 20 bp, Homo sapiens
cttgcacagggattctcaca

SEQ ID NO: 3510141 - DNA, 11 bp, Homo sapiens
cttgccagaga

SEQ ID NO: 3510142 - DNA, 12 bp, Homo sapiens
cttgccagagat

SEQ ID NO: 3510143 - DNA, 23 bp, Homo sapiens
cttgccagagatccaaaagaagc

SEQ ID NO: 3510144 - DNA, 23 bp, Homo sapiens
cttgccagccagaagcctctgcc

SEQ ID NO: 3510145 - DNA, 21 bp, Homo sapiens
cttgccatgtgactctggctt

SEQ ID NO: 3510146 - DNA, 19 bp, Homo sapiens
cttgccattctcttgcatt

SEQ ID NO: 3510147 - DNA, 15 bp, Homo sapiens
cttgcctctgtgctg

SEQ ID NO: 3510148 - DNA, 19 bp, Homo sapiens
cttgcctctgtgctgtgtg

SEQ ID NO: 3510149 - DNA, 20 bp, Homo sapiens
cttgcctctgtgctgtgtgt

SEQ ID NO: 3510150 - DNA, 18 bp, Homo sapiens
cttgcctcttccttgaag

SEQ ID NO: 3510151 - DNA, 22 bp, Homo sapiens
cttgcctcttttacctgctgct

SEQ ID NO: 3510152 - DNA, 16 bp, Homo sapiens
cttgcctgcacaaact

SEQ ID NO: 3510153 - DNA, 20 bp, Homo sapiens
cttgcctttcgaggcctgaa

SEQ ID NO: 3510154 - DNA, 16 bp, Homo sapiens
cttgctctgctgacag

SEQ ID NO: 3510155 - DNA, 22 bp, Homo sapiens
cttgctctgctgacagacacag

SEQ ID NO: 3510156 - DNA, 12 bp, Homo sapiens
cttgctgtcact

SEQ ID NO: 3510157 - DNA, 19 bp, Homo sapiens
cttgctgttgacatattta

SEQ ID NO: 3510158 - DNA, 21 bp, Homo sapiens
cttgctgttgacatatttaat

SEQ ID NO: 3510159 - DNA, 23 bp, Homo sapiens
cttgctgttgacatatttaatgt

SEQ ID NO: 3510160 - DNA, 15 bp, Homo sapiens
cttgcttatttgaca

SEQ ID NO: 3510161 - DNA, 13 bp, Homo sapiens
cttgcttccctaa

SEQ ID NO: 3510162 - DNA, 14 bp, Homo sapiens
cttggaagctccgc

SEQ ID NO: 3510163 - DNA, 19 bp, Homo sapiens
cttggacatcctcctccca

SEQ ID NO: 3510164 - DNA, 22 bp, Homo sapiens
cttggacatcctcctcccaccc

SEQ ID NO: 3510165 - DNA, 19 bp, Homo sapiens
ctgtgtcaggtggggcagc

SEQ ID NO: 3510166 - DNA, 19 bp, Homo sapiens
ctgtgtccatgcgctcagg

SEQ ID NO: 3510167 - DNA, 11 bp, Homo sapiens
ctgtgtctaaa

SEQ ID NO: 3510168 - DNA, 14 bp, Homo sapiens
ctgtgtctaaactg

SEQ ID NO: 3510169 - DNA, 15 bp, Homo sapiens
ctgtgtctaaactgc

SEQ ID NO: 3510170 - DNA, 19 bp, Homo sapiens
ctgtgtcttgcaatggcag

SEQ ID NO: 3510171 - DNA, 11 bp, Homo sapiens
ctgtgtctttt

SEQ ID NO: 3510172 - DNA, 15 bp, Homo sapiens
ctgtgtgcttggtct

SEQ ID NO: 3510173 - DNA, 21 bp, Homo sapiens
ctgtgtgttgccacaggacac

SEQ ID NO: 3510174 - DNA, 15 bp, Homo sapiens
ctgtgttactgcttt

SEQ ID NO: 3510175 - DNA, 14 bp, Homo sapiens
ctgtgttgccaagc

SEQ ID NO: 3510176 - DNA, 16 bp, Homo sapiens
ctgtgttgccaagctc

SEQ ID NO: 3510177 - DNA, 23 bp, Homo sapiens
ctgtgtttccatctcaaagaagg

SEQ ID NO: 3510178 - DNA, 18 bp, Homo sapiens
ctgtgtttggctttcagg

SEQ ID NO: 3510179 - DNA, 22 bp, Homo sapiens
ctgtgtttggctttcagggagg

SEQ ID NO: 3510180 - DNA, 16 bp, Homo sapiens
ctgtgtttttgccact

SEQ ID NO: 3510181 - DNA, 18 bp, Homo sapiens
ctgttaacgtcatctcag

SEQ ID NO: 3510182 - DNA, 13 bp, Homo sapiens
ctgttagcagaca

SEQ ID NO: 3510183 - DNA, 16 bp, Homo sapiens
ctgttattatatttga

SEQ ID NO: 3510184 - DNA, 19 bp, Homo sapiens
ctgttattatatttgacat

SEQ ID NO: 3510185 - DNA, 15 bp, Homo sapiens
ctgttcagctccagc

SEQ ID NO: 3510186 - DNA, 16 bp, Homo sapiens
ctgttcagctccagct

SEQ ID NO: 3510187 - DNA, 18 bp, Homo sapiens
ctgttcagctccagctca

SEQ ID NO: 3510188 - DNA, 16 bp, Homo sapiens
ctgttccccagagaaa

SEQ ID NO: 3510189 - DNA, 15 bp, Homo sapiens
ctgttccccctgtgc

SEQ ID NO: 3510190 - DNA, 16 bp, Homo sapiens
ctgttccccctgtgca

SEQ ID NO: 3510191 - DNA, 16 bp, Homo sapiens
ctgttcctgttcagta

SEQ ID NO: 3510192 - DNA, 15 bp, Homo sapiens
ctgttccttcacatc

SEQ ID NO: 3510193 - DNA, 18 bp, Homo sapiens
ctgttccttcacatcctg

SEQ ID NO: 3510194 - DNA, 18 bp, Homo sapiens
ctggcacccggcccctgc

SEQ ID NO: 3510195 - DNA, 19 bp, Homo sapiens
ctggcacccggcccctgct

SEQ ID NO: 3510196 - DNA, 20 bp, Homo sapiens
ctggcacccggcccctgctg

SEQ ID NO: 3510197 - DNA, 21 bp, Homo sapiens
ctggcactggatgcagaaaca

SEQ ID NO: 3510198 - DNA, 23 bp, Homo sapiens
ctggcagactgtgtaaaatgtaa

SEQ ID NO: 3510199 - DNA, 20 bp, Homo sapiens
ctggcagcctcccatccagg

SEQ ID NO: 3510200 - DNA, 12 bp, Homo sapiens
ctggcagctctg

SEQ ID NO: 3510201 - DNA, 21 bp, Homo sapiens
ctggcagctctggacagcccc

SEQ ID NO: 3510202 - DNA, 20 bp, Homo sapiens
ctggcagtttgttgatcttt

SEQ ID NO: 3510203 - DNA, 17 bp, Homo sapiens
ctggcatcgcaccattc

SEQ ID NO: 3510204 - DNA, 18 bp, Homo sapiens
ctggccaacatggcgaaa

SEQ ID NO: 3510205 - DNA, 15 bp, Homo sapiens
ctggccaagggccag

SEQ ID NO: 3510206 - DNA, 16 bp, Homo sapiens
ctggccaagggccaga

SEQ ID NO: 3510207 - DNA, 17 bp, Homo sapiens
ctggccaagggccagac

SEQ ID NO: 3510208 - DNA, 13 bp, Homo sapiens
ctggccagaatgc

SEQ ID NO: 3510209 - DNA, 13 bp, Homo sapiens
ctggccagacaca

SEQ ID NO: 3510210 - DNA, 18 bp, Homo sapiens
ctggccagacacaggccc

SEQ ID NO: 3510211 - DNA, 18 bp, Homo sapiens
ctggccagggccacgctc

SEQ ID NO: 3510212 - DNA, 20 bp, Homo sapiens
ctggccagggccacgctcca

SEQ ID NO: 3510213 - DNA, 22 bp, Homo sapiens
ctggccagggccacgctccagc

SEQ ID NO: 3510214 - DNA, 16 bp, Homo sapiens
ctggccagggcctgga

SEQ ID NO: 3510215 - DNA, 15 bp, Homo sapiens
ctggccaggggtcct

SEQ ID NO: 3510216 - DNA, 19 bp, Homo sapiens
ctggccagtccaggctgcc

SEQ ID NO: 3510217 - DNA, 13 bp, Homo sapiens
ctggcccactgca

SEQ ID NO: 3510218 - DNA, 15 bp, Homo sapiens
ctggcccactgcatc

SEQ ID NO: 3510219 - DNA, 13 bp, Homo sapiens
ctggcccagccaa

SEQ ID NO: 3510220 - DNA, 17 bp, Homo sapiens
ctggcccagggcccaga

SEQ ID NO: 3510221 - DNA, 18 bp, Homo sapiens
ctggcccagggcccagag

SEQ ID NO: 3510222 - DNA, 16 bp, Homo sapiens
ctggccccaggacctg

SEQ ID NO: 3510223 - DNA, 14 bp, Homo sapiens
ctggccccgccgcc

SEQ ID NO: 3510224 - DNA, 16 bp, Homo sapiens
ctggccccgccgcctg

SEQ ID NO: 3510225 - DNA, 23 bp, Homo sapiens
ctggccccgccgcctggtactca

SEQ ID NO: 3510226 - DNA, 16 bp, Homo sapiens
ctggccccgcctgcct

SEQ ID NO: 3510227 - DNA, 18 bp, Homo sapiens
ctggccgcctccaggagc

SEQ ID NO: 3510228 - DNA, 15 bp, Homo sapiens
ctggccgtccttgtc

SEQ ID NO: 3510229 - DNA, 23 bp, Homo sapiens
ctggccgttgatgttggctggga

SEQ ID NO: 3510230 - DNA, 14 bp, Homo sapiens
ctggcctcccaaat

SEQ ID NO: 3510231 - DNA, 13 bp, Homo sapiens
ctggcctcccaca

SEQ ID NO: 3510232 - DNA, 17 bp, Homo sapiens
ctggcctcccctgccac

SEQ ID NO: 3510233 - DNA, 11 bp, Homo sapiens
ctggcctctgt

SEQ ID NO: 3510234 - DNA, 16 bp, Homo sapiens
ctggcctctgtgcctt

SEQ ID NO: 3510235 - DNA, 20 bp, Homo sapiens
ctggcctgagagtcagctct

SEQ ID NO: 3510236 - DNA, 22 bp, Homo sapiens
ctggcgacacgtagcagcttag

SEQ ID NO: 3510237 - DNA, 19 bp, Homo sapiens
ctggcgacagttttccttc

SEQ ID NO: 3510238 - DNA, 19 bp, Homo sapiens
ctggcgagagtctggccct

SEQ ID NO: 3510239 - DNA, 19 bp, Homo sapiens
ctggcgtcatgcaaagtca

SEQ ID NO: 3510240 - DNA, 18 bp, Homo sapiens
ctggctcattctgcacct

SEQ ID NO: 3510241 - DNA, 13 bp, Homo sapiens
ctggctccttcac

SEQ ID NO: 3510242 - DNA, 14 bp, Homo sapiens
ctggctccttcacc

SEQ ID NO: 3510243 - DNA, 18 bp, Homo sapiens
ctggctccttcaccaccc

SEQ ID NO: 3510244 - DNA, 24 bp, Homo sapiens
ctggctctgagcgcctccatccaa

SEQ ID NO: 3510245 - DNA, 12 bp, Homo sapiens
ctggctctgggc

SEQ ID NO: 3510246 - DNA, 12 bp, Homo sapiens
ctggctgggacg

SEQ ID NO: 3510247 - DNA, 16 bp, Homo sapiens
ctggctgggacgtggc

SEQ ID NO: 3510248 - DNA, 19 bp, Homo sapiens
ctggctggggtggcctgtg

SEQ ID NO: 3510249 - DNA, 20 bp, Homo sapiens
ctggctggggtggcctgtgt

SEQ ID NO: 3510250 - DNA, 23 bp, Homo sapiens
ctggctggggtggcctgtgtggc

SEQ ID NO: 3510251 - DNA, 21 bp, Homo sapiens
ctggctgggtggcaccagcag

SEQ ID NO: 3510252 - DNA, 22 bp, Homo sapiens
ctggctgggtggcaccagcagc

SEQ ID NO: 3510253 - DNA, 20 bp, Homo sapiens
ctggctgttggctgggggcc

SEQ ID NO: 3510254 - DNA, 22 bp, Homo sapiens
ctggcttcaggcaattctcctg

SEQ ID NO: 3510255 - DNA, 16 bp, Homo sapiens
ctggcttcgcaaaatg

SEQ ID NO: 3510256 - DNA, 19 bp, Homo sapiens
ctggcttctggccaggaag

SEQ ID NO: 3510257 - DNA, 14 bp, Homo sapiens
ctggcttctgtggg

SEQ ID NO: 3510258 - DNA, 23 bp, Homo sapiens
ctggcttctgtggggcccctcac

SEQ ID NO: 3510259 - DNA, 16 bp, Homo sapiens
ctggcttgggcagcat

SEQ ID NO: 3510260 - DNA, 12 bp, Homo sapiens
ctggcttttctg

SEQ ID NO: 3510261 - DNA, 20 bp, Homo sapiens
ctggcttttctgtttcctgt

SEQ ID NO: 3510262 - DNA, 16 bp, Homo sapiens
ctgggaaacagaggct

SEQ ID NO: 3510263 - DNA, 11 bp, Homo sapiens
ctgggacacag

SEQ ID NO: 3510264 - DNA, 12 bp, Homo sapiens
ctgggacacagt

SEQ ID NO: 3510265 - DNA, 16 bp, Homo sapiens
ctgggacgtggctcag

SEQ ID NO: 3510266 - DNA, 20 bp, Homo sapiens
ctgggacgtggctcagccag

SEQ ID NO: 3510267 - DNA, 14 bp, Homo sapiens
ctgggactcagcct

SEQ ID NO: 3510268 - DNA, 18 bp, Homo sapiens
ctgggactcagccttcag

SEQ ID NO: 3510269 - DNA, 21 bp, Homo sapiens
ctgggactcagccttcagaca

SEQ ID NO: 3510270 - DNA, 15 bp, Homo sapiens
ctgggagaaaatcat

SEQ ID NO: 3510271 - DNA, 16 bp, Homo sapiens
ctgggagaaaatcatc

SEQ ID NO: 3510272 - DNA, 19 bp, Homo sapiens
ctgggagaaaatcatcaag

SEQ ID NO: 3510273 - DNA, 19 bp, Homo sapiens
ctgggagaaatctggcttc

SEQ ID NO: 3510274 - DNA, 15 bp, Homo sapiens
ctgggagattcaagg

SEQ ID NO: 3510275 - DNA, 17 bp, Homo sapiens
ctgggaggaatggacag

SEQ ID NO: 3510276 - DNA, 20 bp, Homo sapiens
ctgtagaatagcctgtggcc

SEQ ID NO: 3510277 - DNA, 15 bp, Homo sapiens
ctgtagagtgggagc

SEQ ID NO: 3510278 - DNA, 16 bp, Homo sapiens
ctgtagcacttactgg

SEQ ID NO: 3510279 - DNA, 16 bp, Homo sapiens
ctgtagcccactctgc

SEQ ID NO: 3510280 - DNA, 20 bp, Homo sapiens
ctgtagcccactctgctcgc

SEQ ID NO: 3510281 - DNA, 22 bp, Homo sapiens
ctgtagtaggcatttttaccat

SEQ ID NO: 3510282 - DNA, 14 bp, Homo sapiens
ctgtagtcagccga

SEQ ID NO: 3510283 - DNA, 14 bp, Homo sapiens
ctgtagttaggcct

SEQ ID NO: 3510284 - DNA, 19 bp, Homo sapiens
ctgtagttaggcctggctc

SEQ ID NO: 3510285 - DNA, 19 bp, Homo sapiens
ctgtagttgacaattctgc

SEQ ID NO: 3510286 - DNA, 22 bp, Homo sapiens
ctgtagttgacaattctgcatg

SEQ ID NO: 3510287 - DNA, 21 bp, Homo sapiens
ctgtataagtaagaaaatatt

SEQ ID NO: 3510288 - DNA, 15 bp, Homo sapiens
ctgtatatacaataa

SEQ ID NO: 3510289 - DNA, 18 bp, Homo sapiens
ctgtatatacaataacat

SEQ ID NO: 3510290 - DNA, 19 bp, Homo sapiens
ctgtatatacaataacata

SEQ ID NO: 3510291 - DNA, 22 bp, Homo sapiens
ctgtatatttgtgatagcactt

SEQ ID NO: 3510292 - DNA, 23 bp, Homo sapiens
ctgtatcaggacccagaggaagg

SEQ ID NO: 3510293 - DNA, 20 bp, Homo sapiens
ctgtatcccatgagcctcag

SEQ ID NO: 3510294 - DNA, 22 bp, Homo sapiens
ctgtatcccatgagcctcagca

SEQ ID NO: 3510295 - DNA, 22 bp, Homo sapiens
ctgtatgctgatcatcgccaga

SEQ ID NO: 3510296 - DNA, 12 bp, Homo sapiens
ctgtatgtctgt

SEQ ID NO: 3510297 - DNA, 15 bp, Homo sapiens
ctgtatgtctgtcat

SEQ ID NO: 3510298 - DNA, 17 bp, Homo sapiens
ctgtatgtctgtcattg

SEQ ID NO: 3510299 - DNA, 19 bp, Homo sapiens
ctgtatgtgctgtaattta

SEQ ID NO: 3510300 - DNA, 15 bp, Homo sapiens
ctgtattaagccact

SEQ ID NO: 3510301 - DNA, 18 bp, Homo sapiens
ctgtattcatatattgca

SEQ ID NO: 3510302 - DNA, 21 bp, Homo sapiens
ctgtatttttacctttttcct

SEQ ID NO: 3510303 - DNA, 18 bp, Homo sapiens
ctgtattttttgtttgta

SEQ ID NO: 3510304 - DNA, 17 bp, Homo sapiens
ctgtcaaacaaagccag

SEQ ID NO: 3510305 - DNA, 19 bp, Homo sapiens
ctgtcaaggctgcttagaa

SEQ ID NO: 3510306 - DNA, 15 bp, Homo sapiens
ctgtcaccaaggaaa

SEQ ID NO: 3510307 - DNA, 15 bp, Homo sapiens
ctgtcacctcttccg

SEQ ID NO: 3510308 - DNA, 19 bp, Homo sapiens
ctgtcactcaggctggagt

SEQ ID NO: 3510309 - DNA, 22 bp, Homo sapiens
ctgtcactcattgctgagcctc

SEQ ID NO: 3510310 - DNA, 14 bp, Homo sapiens
ctgtcatctgtgca

SEQ ID NO: 3510311 - DNA, 15 bp, Homo sapiens
ctgtcattgtattca

SEQ ID NO: 3510312 - DNA, 16 bp, Homo sapiens
ctgtcatttgagcagg

SEQ ID NO: 3510313 - DNA, 18 bp, Homo sapiens
ctgtcatttgagcagggc

SEQ ID NO: 3510314 - DNA, 21 bp, Homo sapiens
ctgtcatttgagcagggctca

SEQ ID NO: 3510315 - DNA, 15 bp, Homo sapiens
ctgtccacacccagc

SEQ ID NO: 3510316 - DNA, 17 bp, Homo sapiens
ctgtccagcagtcactt

SEQ ID NO: 3510317 - DNA, 19 bp, Homo sapiens
ctgtccagcagtcacttcg

SEQ ID NO: 3510318 - DNA, 12 bp, Homo sapiens
ctgtccagctcc

SEQ ID NO: 3510319 - DNA, 21 bp, Homo sapiens
ctgtccagctccaacctgcaa

SEQ ID NO: 3510320 - DNA, 13 bp, Homo sapiens
ctgtccaggctcg

SEQ ID NO: 3510321 - DNA, 22 bp, Homo sapiens
ctgtccatatttataggtaccc

SEQ ID NO: 3510322 - DNA, 23 bp, Homo sapiens
ctgtcccaaggtgaaatgaagca

SEQ ID NO: 3510323 - DNA, 12 bp, Homo sapiens
ctgtccctcact

SEQ ID NO: 3510324 - DNA, 11 bp, Homo sapiens
ctgtccctgcg

SEQ ID NO: 3510325 - DNA, 17 bp, Homo sapiens
ctgtcccttctgtccct

SEQ ID NO: 3510326 - DNA, 18 bp, Homo sapiens
ctgtcccttctgtccctc

SEQ ID NO: 3510327 - DNA, 19 bp, Homo sapiens
ctgtcccttctgtccctca

SEQ ID NO: 3510328 - DNA, 15 bp, Homo sapiens
ctgtccgagctttga

SEQ ID NO: 3510329 - DNA, 14 bp, Homo sapiens
ctgtcctacccacc

SEQ ID NO: 3510330 - DNA, 16 bp, Homo sapiens
ctgtcctactctgtgt

SEQ ID NO: 3510331 - DNA, 18 bp, Homo sapiens
ctgtcctactctgtgtca

SEQ ID NO: 3510332 - DNA, 21 bp, Homo sapiens
ctgtcctactctgtgtcaggt

SEQ ID NO: 3510333 - DNA, 18 bp, Homo sapiens
ctgtcctcagccttgcca

SEQ ID NO: 3510334 - DNA, 22 bp, Homo sapiens
ctgtcctcagccttgccagaga

SEQ ID NO: 3510335 - DNA, 12 bp, Homo sapiens
ctgtcctcaggt

SEQ ID NO: 3510336 - DNA, 20 bp, Homo sapiens
ctgtcctgggagtgagctgg

SEQ ID NO: 3510337 - DNA, 18 bp, Homo sapiens
ctgtcctgggcctgcaga

SEQ ID NO: 3510338 - DNA, 17 bp, Homo sapiens
ctgtccttacccatctg

SEQ ID NO: 3510339 - DNA, 12 bp, Homo sapiens
ctgtcctttcct

SEQ ID NO: 3510340 - DNA, 15 bp, Homo sapiens
ctgtcgcccagtctg

SEQ ID NO: 3510341 - DNA, 16 bp, Homo sapiens
ctgtcgcccagtctgg

SEQ ID NO: 3510342 - DNA, 20 bp, Homo sapiens
ctgtcggcgctgccccatct

SEQ ID NO: 3510343 - DNA, 21 bp, Homo sapiens
ctgtcgtgatggggcaagggc

SEQ ID NO: 3510344 - DNA, 16 bp, Homo sapiens
ctgtctcaaaaaaaga

SEQ ID NO: 3510345 - DNA, 15 bp, Homo sapiens
ctgtctcagcctccc

SEQ ID NO: 3510346 - DNA, 16 bp, Homo sapiens
ctgtctcagcctccca

SEQ ID NO: 3510347 - DNA, 20 bp, Homo sapiens
ctgtctccttaacactgagc

SEQ ID NO: 3510348 - DNA, 14 bp, Homo sapiens
ctgtctctactaaa

SEQ ID NO: 3510349 - DNA, 14 bp, Homo sapiens
ctgtctctgcctct

SEQ ID NO: 3510350 - DNA, 13 bp, Homo sapiens
ctgtctctggcct

SEQ ID NO: 3510351 - DNA, 12 bp, Homo sapiens
ctgtctgcagcc

SEQ ID NO: 3510352 - DNA, 22 bp, Homo sapiens
ctgtcttcatagcagattttaa

SEQ ID NO: 3510353 - DNA, 18 bp, Homo sapiens
ctgtcttcctctgcaagt

SEQ ID NO: 3510354 - DNA, 23 bp, Homo sapiens
ctgtcttcctctgcaagtgctca

SEQ ID NO: 3510355 - DNA, 14 bp, Homo sapiens
ctgtcttctggact

SEQ ID NO: 3510356 - DNA, 22 bp, Homo sapiens
ctgtcttgttgcggatggatgg

SEQ ID NO: 3510357 - DNA, 22 bp, Homo sapiens
ctgtctttcagcattcagtccg

SEQ ID NO: 3510358 - DNA, 20 bp, Homo sapiens
ctgtctttcctaagacctgg

SEQ ID NO: 3510359 - DNA, 14 bp, Homo sapiens
ctgtctttcctaga

SEQ ID NO: 3510360 - DNA, 18 bp, Homo sapiens
ctgtgaacagcttgctgt

SEQ ID NO: 3510361 - DNA, 19 bp, Homo sapiens
ctgtgaacagcttgctgtc

SEQ ID NO: 3510362 - DNA, 21 bp, Homo sapiens
ctgtgaacagcttgctgtcac

SEQ ID NO: 3510363 - DNA, 18 bp, Homo sapiens
ctgtgaacgatttagaaa

SEQ ID NO: 3510364 - DNA, 22 bp, Homo sapiens
ctgtgaacgatttagaaagaag

SEQ ID NO: 3510365 - DNA, 23 bp, Homo sapiens
ctgtgaagcattcgagacagaac

SEQ ID NO: 3510366 - DNA, 15 bp, Homo sapiens
ctgtgacacatcgtt

SEQ ID NO: 3510367 - DNA, 15 bp, Homo sapiens
ctgtgaccaatgtct

SEQ ID NO: 3510368 - DNA, 16 bp, Homo sapiens
ctgtgaccaatgtctt

SEQ ID NO: 3510369 - DNA, 15 bp, Homo sapiens
ctgtgacccccagct

SEQ ID NO: 3510370 - DNA, 21 bp, Homo sapiens
ctgtgacccccagctccggcc

SEQ ID NO: 3510371 - DNA, 18 bp, Homo sapiens
ctgtgactcttctctcaa

SEQ ID NO: 3510372 - DNA, 20 bp, Homo sapiens
ctgtgagctcccaggtgcag

SEQ ID NO: 3510373 - DNA, 17 bp, Homo sapiens
ctgtgaggagccccatc

SEQ ID NO: 3510374 - DNA, 15 bp, Homo sapiens
ctgtgcaaaaaaatt

SEQ ID NO: 3510375 - DNA, 16 bp, Homo sapiens
ctgtgcaaaaaaatta

SEQ ID NO: 3510376 - DNA, 18 bp, Homo sapiens
ctgtgcacatctgtgtct

SEQ ID NO: 3510377 - DNA, 19 bp, Homo sapiens
ctgtgcacatctgtgtctt

SEQ ID NO: 3510378 - DNA, 21 bp, Homo sapiens
ctgtgcacatctgtgtcttgt

SEQ ID NO: 3510379 - DNA, 14 bp, Homo sapiens
ctgtgcaccaagca

SEQ ID NO: 3510380 - DNA, 16 bp, Homo sapiens
ctgtgcagccgctgag

SEQ ID NO: 3510381 - DNA, 17 bp, Homo sapiens
ctgtgcagccgctgagc

SEQ ID NO: 3510382 - DNA, 16 bp, Homo sapiens
ctgtgccatgtgccag

SEQ ID NO: 3510383 - DNA, 17 bp, Homo sapiens
ctgtgcccaggccagct

SEQ ID NO: 3510384 - DNA, 14 bp, Homo sapiens
ctgtgccctcctga

SEQ ID NO: 3510385 - DNA, 17 bp, Homo sapiens
ctgtgccctcctgaccc

SEQ ID NO: 3510386 - DNA, 14 bp, Homo sapiens
ctgtgccctccttc

SEQ ID NO: 3510387 - DNA, 13 bp, Homo sapiens
ctgtgcctcggct

SEQ ID NO: 3510388 - DNA, 22 bp, Homo sapiens
ctgtgcctcggcttttctcagc

SEQ ID NO: 3510389 - DNA, 23 bp, Homo sapiens
ctgtgcctcggcttttctcagct

SEQ ID NO: 3510390 - DNA, 19 bp, Homo sapiens
ctgtgccttcttttgatta

SEQ ID NO: 3510391 - DNA, 19 bp, Homo sapiens
ctgtgctatggtgctctgt

SEQ ID NO: 3510392 - DNA, 21 bp, Homo sapiens
ctgtgctcggaggccatctcg

SEQ ID NO: 3510393 - DNA, 18 bp, Homo sapiens
ctgtgctctggacaggca

SEQ ID NO: 3510394 - DNA, 11 bp, Homo sapiens
ctgtgctgtgt

SEQ ID NO: 3510395 - DNA, 17 bp, Homo sapiens
ctgtgcttcgggccctt

SEQ ID NO: 3510396 - DNA, 22 bp, Homo sapiens
ctgtgcttctctatgataatta

SEQ ID NO: 3510397 - DNA, 19 bp, Homo sapiens
ctgtggagacaatgtctgc

SEQ ID NO: 3510398 - DNA, 19 bp, Homo sapiens
ctgtggatgagccctcaga

SEQ ID NO: 3510399 - DNA, 17 bp, Homo sapiens
ctgtggatgataaaaca

SEQ ID NO: 3510400 - DNA, 23 bp, Homo sapiens
ctgtggccagcttgttatttata

SEQ ID NO: 3510401 - DNA, 15 bp, Homo sapiens
ctgtggccctgtcct

SEQ ID NO: 3510402 - DNA, 20 bp, Homo sapiens
ctgtggcgccgtctccaggg

SEQ ID NO: 3510403 - DNA, 13 bp, Homo sapiens
ctgtggctgtgga

SEQ ID NO: 3510404 - DNA, 16 bp, Homo sapiens
ctgtgggaaggccagc

SEQ ID NO: 3510405 - DNA, 20 bp, Homo sapiens
ctgtgggaaggccagctgcc

SEQ ID NO: 3510406 - DNA, 14 bp, Homo sapiens
ctgtgggatgggat

SEQ ID NO: 3510407 - DNA, 18 bp, Homo sapiens
ctgtgggcgggcccagca

SEQ ID NO: 3510408 - DNA, 23 bp, Homo sapiens
ctgtggggactccggctgtgctg

SEQ ID NO: 3510409 - DNA, 17 bp, Homo sapiens
ctgtgtaaaaagagagc

SEQ ID NO: 3510410 - DNA, 16 bp, Homo sapiens
ctgtgtaaccttgggt

SEQ ID NO: 3510411 - DNA, 20 bp, Homo sapiens
ctgtgtcaatccagatggtg

SEQ ID NO: 3510412 - DNA, 21 bp, Homo sapiens
ctgccaccaccctgtcttcct

SEQ ID NO: 3510413 - DNA, 22 bp, Homo sapiens
ctgccaccaccctgtcttcctc

SEQ ID NO: 3510414 - DNA, 23 bp, Homo sapiens
ctgccaccaccctgtcttcctct

SEQ ID NO: 3510415 - DNA, 13 bp, Homo sapiens
ctgccaccaggcc

SEQ ID NO: 3510416 - DNA, 14 bp, Homo sapiens
ctgccaccaggcca

SEQ ID NO: 3510417 - DNA, 15 bp, Homo sapiens
ctgccaccaggccac

SEQ ID NO: 3510418 - DNA, 20 bp, Homo sapiens
ctgccacccacctccctgcc

SEQ ID NO: 3510419 - DNA, 22 bp, Homo sapiens
ctgccaccctgccccttgccat

SEQ ID NO: 3510420 - DNA, 16 bp, Homo sapiens
ctgccaccctgggcct

SEQ ID NO: 3510421 - DNA, 20 bp, Homo sapiens
ctgccaccctggggagaaag

SEQ ID NO: 3510422 - DNA, 21 bp, Homo sapiens
ctgccaccctggggagaaagt

SEQ ID NO: 3510423 - DNA, 16 bp, Homo sapiens
ctgccactccagtcct

SEQ ID NO: 3510424 - DNA, 20 bp, Homo sapiens
ctgccactccagtcctgcca

SEQ ID NO: 3510425 - DNA, 12 bp, Homo sapiens
ctgccagagaag

SEQ ID NO: 3510426 - DNA, 15 bp, Homo sapiens
ctgccagagaagtct

SEQ ID NO: 3510427 - DNA, 16 bp, Homo sapiens
ctgccagagaagtctg

SEQ ID NO: 3510428 - DNA, 12 bp, Homo sapiens
ctgccagagcag

SEQ ID NO: 3510429 - DNA, 17 bp, Homo sapiens
ctgccagctctgtatca

SEQ ID NO: 3510430 - DNA, 11 bp, Homo sapiens
ctgccagctgc

SEQ ID NO: 3510431 - DNA, 12 bp, Homo sapiens
ctgccagctgca

SEQ ID NO: 3510432 - DNA, 18 bp, Homo sapiens
ctgccaggcccccaagcc

SEQ ID NO: 3510433 - DNA, 12 bp, Homo sapiens
ctgccagggcag

SEQ ID NO: 3510434 - DNA, 11 bp, Homo sapiens
ctgccagggcc

SEQ ID NO: 3510435 - DNA, 13 bp, Homo sapiens
ctgccagggcttc

SEQ ID NO: 3510436 - DNA, 18 bp, Homo sapiens
ctgccagtctcactgtgg

SEQ ID NO: 3510437 - DNA, 23 bp, Homo sapiens
ctgccatattctgttggccagtg

SEQ ID NO: 3510438 - DNA, 16 bp, Homo sapiens
ctgccatccaggttca

SEQ ID NO: 3510439 - DNA, 21 bp, Homo sapiens
ctgccatccaggttcagcttg

SEQ ID NO: 3510440 - DNA, 17 bp, Homo sapiens
ctgccatgccagcttat

SEQ ID NO: 3510441 - DNA, 19 bp, Homo sapiens
ctgccatgccagcttatct

SEQ ID NO: 3510442 - DNA, 16 bp, Homo sapiens
ctgccatgttgcccct

SEQ ID NO: 3510443 - DNA, 15 bp, Homo sapiens
ctgccatttctgaga

SEQ ID NO: 3510444 - DNA, 17 bp, Homo sapiens
ctgcccagtcgacccca

SEQ ID NO: 3510445 - DNA, 19 bp, Homo sapiens
ctgcccagtcgaccccaaa

SEQ ID NO: 3510446 - DNA, 16 bp, Homo sapiens
ctgcccatggacaggc

SEQ ID NO: 3510447 - DNA, 20 bp, Homo sapiens
ctgcccatggacaggctggc

SEQ ID NO: 3510448 - DNA, 18 bp, Homo sapiens
ctgcccatttcatattct

SEQ ID NO: 3510449 - DNA, 13 bp, Homo sapiens
ctgccccatcctc

SEQ ID NO: 3510450 - DNA, 20 bp, Homo sapiens
ctgccccatctcccctcagc

SEQ ID NO: 3510451 - DNA, 13 bp, Homo sapiens
ctgcccccaggac

SEQ ID NO: 3510452 - DNA, 19 bp, Homo sapiens
ctgccccgcttccccacag

SEQ ID NO: 3510453 - DNA, 18 bp, Homo sapiens
ctgccccgggtccccagc

SEQ ID NO: 3510454 - DNA, 19 bp, Homo sapiens
ctgccccgggtccccagct

SEQ ID NO: 3510455 - DNA, 20 bp, Homo sapiens
ctgcccctaatctctgtagg

SEQ ID NO: 3510456 - DNA, 14 bp, Homo sapiens
ctgcccctctctgg

SEQ ID NO: 3510457 - DNA, 22 bp, Homo sapiens
ctgcccctctctgggcctcaga

SEQ ID NO: 3510458 - DNA, 20 bp, Homo sapiens
ctgcccgcagacctctggat

SEQ ID NO: 3510459 - DNA, 19 bp, Homo sapiens
ctgcccgtaaacacgcctg

SEQ ID NO: 3510460 - DNA, 20 bp, Homo sapiens
ctgccctatgggcctgccgg

SEQ ID NO: 3510461 - DNA, 20 bp, Homo sapiens
ctgccctcccctctctgcac

SEQ ID NO: 3510462 - DNA, 20 bp, Homo sapiens
ctgccctctagagccttcag

SEQ ID NO: 3510463 - DNA, 15 bp, Homo sapiens
ctgccctggctccag

SEQ ID NO: 3510464 - DNA, 19 bp, Homo sapiens
ctgcccttttttctgcctc

SEQ ID NO: 3510465 - DNA, 19 bp, Homo sapiens
ctgccgctgcttccaggct

SEQ ID NO: 3510466 - DNA, 15 bp, Homo sapiens
ctgccggagaggaag

SEQ ID NO: 3510467 - DNA, 22 bp, Homo sapiens
ctgccgggctgagggcctgctg

SEQ ID NO: 3510468 - DNA, 21 bp, Homo sapiens
ctgccggtaaacacgcctgca

SEQ ID NO: 3510469 - DNA, 19 bp, Homo sapiens
ctgcctaaggccctttgtg

SEQ ID NO: 3510470 - DNA, 15 bp, Homo sapiens
ctgcctcagcctccc

SEQ ID NO: 3510471 - DNA, 23 bp, Homo sapiens
ctgcctcaggaggcaggaccttc

SEQ ID NO: 3510472 - DNA, 23 bp, Homo sapiens
ctgcctccagccaaacgggagct

SEQ ID NO: 3510473 - DNA, 13 bp, Homo sapiens
ctgcctccaggaa

SEQ ID NO: 3510474 - DNA, 17 bp, Homo sapiens
ctgcctccagggctgga

SEQ ID NO: 3510475 - DNA, 20 bp, Homo sapiens
ctgcctccattatccattcc

SEQ ID NO: 3510476 - DNA, 22 bp, Homo sapiens
ctgcctccattatccattccca

SEQ ID NO: 3510477 - DNA, 13 bp, Homo sapiens
ctgcctcccatgc

SEQ ID NO: 3510478 - DNA, 15 bp, Homo sapiens
ctctaataagaaaac

SEQ ID NO: 3510479 - DNA, 14 bp, Homo sapiens
ctctacaattcctc

SEQ ID NO: 3510480 - DNA, 13 bp, Homo sapiens
ctctacagaggcc

SEQ ID NO: 3510481 - DNA, 20 bp, Homo sapiens
ctctaccagataactgagga

SEQ ID NO: 3510482 - DNA, 21 bp, Homo sapiens
ctctaccctgtgctaagcacg

SEQ ID NO: 3510483 - DNA, 22 bp, Homo sapiens
ctctactaaaaatacaaaaatt

SEQ ID NO: 3510484 - DNA, 19 bp, Homo sapiens
ctctagaagtgccatctca

SEQ ID NO: 3510485 - DNA, 21 bp, Homo sapiens
ctctagatacctaaaacataa

SEQ ID NO: 3510486 - DNA, 15 bp, Homo sapiens
ctctagatgagctgg

SEQ ID NO: 3510487 - DNA, 19 bp, Homo sapiens
ctctagccaaatggtttaa

SEQ ID NO: 3510488 - DNA, 15 bp, Homo sapiens
ctctaggctctgcct

SEQ ID NO: 3510489 - DNA, 16 bp, Homo sapiens
ctctaggctctgcctt

SEQ ID NO: 3510490 - DNA, 15 bp, Homo sapiens
ctctaggctggggaa

SEQ ID NO: 3510491 - DNA, 18 bp, Homo sapiens
ctctagttctttgttcat

SEQ ID NO: 3510492 - DNA, 22 bp, Homo sapiens
ctctatatttagattgttaaaa

SEQ ID NO: 3510493 - DNA, 15 bp, Homo sapiens
ctctatcatttaata

SEQ ID NO: 3510494 - DNA, 14 bp, Homo sapiens
ctctatgctttcca

SEQ ID NO: 3510495 - DNA, 19 bp, Homo sapiens
ctctatggggcatcctctt

SEQ ID NO: 3510496 - DNA, 15 bp, Homo sapiens
ctctatgtttacaaa

SEQ ID NO: 3510497 - DNA, 18 bp, Homo sapiens
ctctattgaccaccagtt

SEQ ID NO: 3510498 - DNA, 19 bp, Homo sapiens
ctctcaaacggcaacattc

SEQ ID NO: 3510499 - DNA, 14 bp, Homo sapiens
ctctcagcctccca

SEQ ID NO: 3510500 - DNA, 19 bp, Homo sapiens
ctctcagcctcccaacccc

SEQ ID NO: 3510501 - DNA, 17 bp, Homo sapiens
ctctcaggaccaaagct

SEQ ID NO: 3510502 - DNA, 18 bp, Homo sapiens
ctctcaggccggcagccc

SEQ ID NO: 3510503 - DNA, 21 bp, Homo sapiens
ctctcaggccggcagccccag

SEQ ID NO: 3510504 - DNA, 18 bp, Homo sapiens
ctctcagtactttggagg

SEQ ID NO: 3510505 - DNA, 18 bp, Homo sapiens
ctctcagtgttttggact

SEQ ID NO: 3510506 - DNA, 13 bp, Homo sapiens
ctctcatctcagg

SEQ ID NO: 3510507 - DNA, 11 bp, Homo sapiens
ctctcatctga

SEQ ID NO: 3510508 - DNA, 15 bp, Homo sapiens
ctctccaaaccactt

SEQ ID NO: 3510509 - DNA, 16 bp, Homo sapiens
ctctccaaaccacttt

SEQ ID NO: 3510510 - DNA, 16 bp, Homo sapiens
ctctcccattgtccct

SEQ ID NO: 3510511 - DNA, 19 bp, Homo sapiens
ctctcccattgtccctctg

SEQ ID NO: 3510512 - DNA, 20 bp, Homo sapiens
gaggcctgcctccagggctg

SEQ ID NO: 3510513 - DNA, 22 bp, Homo sapiens
gaggcctgcctccagggctgga

SEQ ID NO: 3510514 - DNA, 21 bp, Homo sapiens
gaggcctgggccgctgccacg

SEQ ID NO: 3510515 - DNA, 22 bp, Homo sapiens
gaggcctgggccgctgccacgt

SEQ ID NO: 3510516 - DNA, 12 bp, Homo sapiens
gaggcctgtctg

SEQ ID NO: 3510517 - DNA, 19 bp, Homo sapiens
gaggcctgtctgtgacctg

SEQ ID NO: 3510518 - DNA, 18 bp, Homo sapiens
gaggccttctctgaagga

SEQ ID NO: 3510519 - DNA, 14 bp, Homo sapiens
gaggcggaagaatc

SEQ ID NO: 3510520 - DNA, 19 bp, Homo sapiens
gaggcgggtggatcacttg

SEQ ID NO: 3510521 - DNA, 12 bp, Homo sapiens
gaggctcaggtc

SEQ ID NO: 3510522 - DNA, 16 bp, Homo sapiens
gaggctcatggccctg

SEQ ID NO: 3510523 - DNA, 15 bp, Homo sapiens
gaggctgaggctggc

SEQ ID NO: 3510524 - DNA, 19 bp, Homo sapiens
gaggctgaggctggcacag

SEQ ID NO: 3510525 - DNA, 23 bp, Homo sapiens
gaggctgccccacccctccccat

SEQ ID NO: 3510526 - DNA, 19 bp, Homo sapiens
gaggctgggaggagcccct

SEQ ID NO: 3510527 - DNA, 17 bp, Homo sapiens
gaggctgggggagagcc

SEQ ID NO: 3510528 - DNA, 14 bp, Homo sapiens
gagggacctctccc

SEQ ID NO: 3510529 - DNA, 15 bp, Homo sapiens
gagggacctctccca

SEQ ID NO: 3510530 - DNA, 16 bp, Homo sapiens
gagggacgcctggggg

SEQ ID NO: 3510531 - DNA, 23 bp, Homo sapiens
gagggacgcctgggggtgccagg

SEQ ID NO: 3510532 - DNA, 16 bp, Homo sapiens
gagggactgagccaga

SEQ ID NO: 3510533 - DNA, 13 bp, Homo sapiens
gagggagtgacag

SEQ ID NO: 3510534 - DNA, 14 bp, Homo sapiens
gagggagtgacaga

SEQ ID NO: 3510535 - DNA, 16 bp, Homo sapiens
gagggagtgacagagg

SEQ ID NO: 3510536 - DNA, 22 bp, Homo sapiens
gagggagtgacagaggcagccc

SEQ ID NO: 3510537 - DNA, 12 bp, Homo sapiens
gagggcacacac

SEQ ID NO: 3510538 - DNA, 12 bp, Homo sapiens
gagggcagcagg

SEQ ID NO: 3510539 - DNA, 16 bp, Homo sapiens
gagggccacatgggag

SEQ ID NO: 3510540 - DNA, 13 bp, Homo sapiens
gagggcggcaggg

SEQ ID NO: 3510541 - DNA, 19 bp, Homo sapiens
gagggctggaggcccaggc

SEQ ID NO: 3510542 - DNA, 20 bp, Homo sapiens
gagggctggaggcccaggct

SEQ ID NO: 3510543 - DNA, 23 bp, Homo sapiens
gagggctggaggcccaggctggg

SEQ ID NO: 3510544 - DNA, 14 bp, Homo sapiens
gagggctggctggc

SEQ ID NO: 3510545 - DNA, 14 bp, Homo sapiens
gaggggacgcaggc

SEQ ID NO: 3510546 - DNA, 11 bp, Homo sapiens
gaggggagagg

SEQ ID NO: 3510547 - DNA, 17 bp, Homo sapiens
gaggggcccccctgccc

SEQ ID NO: 3510548 - DNA, 17 bp, Homo sapiens
gaggggcctaggcctca

SEQ ID NO: 3510549 - DNA, 19 bp, Homo sapiens
gaggggcctaggcctcagc

SEQ ID NO: 3510550 - DNA, 13 bp, Homo sapiens
gagggtgagggcc

SEQ ID NO: 3510551 - DNA, 14 bp, Homo sapiens
gagggtgagggcct

SEQ ID NO: 3510552 - DNA, 15 bp, Homo sapiens
gagggtgagggcctt

SEQ ID NO: 3510553 - DNA, 18 bp, Homo sapiens
gagggtgagggccttctt

SEQ ID NO: 3510554 - DNA, 15 bp, Homo sapiens
gagggtgagtgcaag

SEQ ID NO: 3510555 - DNA, 12 bp, Homo sapiens
gaggtcactgct

SEQ ID NO: 3510556 - DNA, 23 bp, Homo sapiens
gaggtgaacaagcaaacccagac

SEQ ID NO: 3510557 - DNA, 12 bp, Homo sapiens
gaggtgccttct

SEQ ID NO: 3510558 - DNA, 20 bp, Homo sapiens
gaggtgcggccaccacccta

SEQ ID NO: 3510559 - DNA, 22 bp, Homo sapiens
gaggtggaaggaccctgtgccc

SEQ ID NO: 3510560 - DNA, 17 bp, Homo sapiens
gaggtgggccagtctgt

SEQ ID NO: 3510561 - DNA, 14 bp, Homo sapiens
gagtactgtgggca

SEQ ID NO: 3510562 - DNA, 15 bp, Homo sapiens
gagtactgtgggcaa

SEQ ID NO: 3510563 - DNA, 22 bp, Homo sapiens
gagtactgtgggcaatttagaa

SEQ ID NO: 3510564 - DNA, 19 bp, Homo sapiens
gagtagaaactgcagggaa

SEQ ID NO: 3510565 - DNA, 23 bp, Homo sapiens
gagtagaaaggcctttaaaattt

SEQ ID NO: 3510566 - DNA, 12 bp, Homo sapiens
gagtagagaagt

SEQ ID NO: 3510567 - DNA, 12 bp, Homo sapiens
gagtagctggga

SEQ ID NO: 3510568 - DNA, 14 bp, Homo sapiens
gagtagctgggact

SEQ ID NO: 3510569 - DNA, 22 bp, Homo sapiens
gagtagctgggactacaggcac

SEQ ID NO: 3510570 - DNA, 12 bp, Homo sapiens
gagtatatgcac

SEQ ID NO: 3510571 - DNA, 14 bp, Homo sapiens
gagtatatgcactt

SEQ ID NO: 3510572 - DNA, 23 bp, Homo sapiens
gagtatctcctcgcaagctgggt

SEQ ID NO: 3510573 - DNA, 12 bp, Homo sapiens
gagtcaggcccg

SEQ ID NO: 3510574 - DNA, 14 bp, Homo sapiens
gagtcaggcccggc

SEQ ID NO: 3510575 - DNA, 19 bp, Homo sapiens
gagtcaggcccggcctatt

SEQ ID NO: 3510576 - DNA, 22 bp, Homo sapiens
gagtcatgtgcctctgtcctta

SEQ ID NO: 3510577 - DNA, 14 bp, Homo sapiens
gagtcattgctgta

SEQ ID NO: 3510578 - DNA, 12 bp, Homo sapiens
gagtccaagctg

SEQ ID NO: 3510579 - DNA, 13 bp, Homo sapiens
gagtccactttgt

SEQ ID NO: 3510580 - DNA, 13 bp, Homo sapiens
gagtcccaccttg

SEQ ID NO: 3510581 - DNA, 15 bp, Homo sapiens
gagtcgaggacaggg

SEQ ID NO: 3510582 - DNA, 19 bp, Homo sapiens
gagtcgtggggtgtgctgg

SEQ ID NO: 3510583 - DNA, 22 bp, Homo sapiens
gagtcgtggggtgtgctgggag

SEQ ID NO: 3510584 - DNA, 19 bp, Homo sapiens
gagtctcactgttgcccag

SEQ ID NO: 3510585 - DNA, 19 bp, Homo sapiens
gagcccactgtcctgggcc

SEQ ID NO: 3510586 - DNA, 17 bp, Homo sapiens
gagcccagaaaacctcc

SEQ ID NO: 3510587 - DNA, 14 bp, Homo sapiens
gagcccagctccaa

SEQ ID NO: 3510588 - DNA, 21 bp, Homo sapiens
gagcccagctctgaaaccagt

SEQ ID NO: 3510589 - DNA, 19 bp, Homo sapiens
gagcccagctgggtcaggc

SEQ ID NO: 3510590 - DNA, 22 bp, Homo sapiens
gagcccagggcatcttgctggc

SEQ ID NO: 3510591 - DNA, 12 bp, Homo sapiens
gagccccatctt

SEQ ID NO: 3510592 - DNA, 13 bp, Homo sapiens
gagccccatcttc

SEQ ID NO: 3510593 - DNA, 16 bp, Homo sapiens
gagccccattcctggg

SEQ ID NO: 3510594 - DNA, 14 bp, Homo sapiens
gagccccgaggcct

SEQ ID NO: 3510595 - DNA, 19 bp, Homo sapiens
gagcccctcggctctggag

SEQ ID NO: 3510596 - DNA, 18 bp, Homo sapiens
gagcccctggacatgcct

SEQ ID NO: 3510597 - DNA, 18 bp, Homo sapiens
gagccctccgccttcaca

SEQ ID NO: 3510598 - DNA, 23 bp, Homo sapiens
gagccctccgccttcacattccc

SEQ ID NO: 3510599 - DNA, 14 bp, Homo sapiens
gagccctggtggca

SEQ ID NO: 3510600 - DNA, 16 bp, Homo sapiens
gagccctggtggcagt

SEQ ID NO: 3510601 - DNA, 22 bp, Homo sapiens
gagccctgtggatgagccctca

SEQ ID NO: 3510602 - DNA, 21 bp, Homo sapiens
gagccgagatcacgccactgc

SEQ ID NO: 3510603 - DNA, 20 bp, Homo sapiens
gagccgggtctgcctcttct

SEQ ID NO: 3510604 - DNA, 21 bp, Homo sapiens
gagccgggtctgcctcttctg

SEQ ID NO: 3510605 - DNA, 19 bp, Homo sapiens
gagccgtggtccctgagga

SEQ ID NO: 3510606 - DNA, 20 bp, Homo sapiens
gagccgtggtccctgaggat

SEQ ID NO: 3510607 - DNA, 19 bp, Homo sapiens
gagcctcagcatcctggca

SEQ ID NO: 3510608 - DNA, 13 bp, Homo sapiens
gagcctcttgggg

SEQ ID NO: 3510609 - DNA, 20 bp, Homo sapiens
gagcctgctggaagcccagc

SEQ ID NO: 3510610 - DNA, 10 bp, Homo sapiens
gagcctggca

SEQ ID NO: 3510611 - DNA, 15 bp, Homo sapiens
gagcctggccagcct

SEQ ID NO: 3510612 - DNA, 14 bp, Homo sapiens
gagcctggtgccct

SEQ ID NO: 3510613 - DNA, 17 bp, Homo sapiens
gagccttgggagccact

SEQ ID NO: 3510614 - DNA, 18 bp, Homo sapiens
gagccttgggagccactg

SEQ ID NO: 3510615 - DNA, 19 bp, Homo sapiens
gagccttgggagccactgc

SEQ ID NO: 3510616 - DNA, 15 bp, Homo sapiens
gagcgcctgcccctc

SEQ ID NO: 3510617 - DNA, 16 bp, Homo sapiens
gagcgcctgcccctcc

SEQ ID NO: 3510618 - DNA, 18 bp, Homo sapiens
gagcgcctgcccctccca

SEQ ID NO: 3510619 - DNA, 23 bp, Homo sapiens
gagcgctcctgccgcagagctgg

SEQ ID NO: 3510620 - DNA, 13 bp, Homo sapiens
gagcggaaagcag

SEQ ID NO: 3510621 - DNA, 17 bp, Homo sapiens
gagcggaaagcagctca

SEQ ID NO: 3510622 - DNA, 18 bp, Homo sapiens
gagctaaactccttcctg

SEQ ID NO: 3510623 - DNA, 19 bp, Homo sapiens
gagctaaactccttcctgg

SEQ ID NO: 3510624 - DNA, 12 bp, Homo sapiens
gagctacaaatg

SEQ ID NO: 3510625 - DNA, 14 bp, Homo sapiens
gagctacaaatgca

SEQ ID NO: 3510626 - DNA, 14 bp, Homo sapiens
gagctagccagagg

SEQ ID NO: 3510627 - DNA, 18 bp, Homo sapiens
gagctagccagaggactg

SEQ ID NO: 3510628 - DNA, 17 bp, Homo sapiens
gagctaggagaagggct

SEQ ID NO: 3510629 - DNA, 21 bp, Homo sapiens
gagctcagagagggcaggcat

SEQ ID NO: 3510630 - DNA, 18 bp, Homo sapiens
gagctccaactcagaagg

SEQ ID NO: 3510631 - DNA, 16 bp, Homo sapiens
gagctccactctgctt

SEQ ID NO: 3510632 - DNA, 18 bp, Homo sapiens
gagctccactctgcttct

SEQ ID NO: 3510633 - DNA, 21 bp, Homo sapiens
gagctccactctgcttctctg

SEQ ID NO: 3510634 - DNA, 22 bp, Homo sapiens
gagctccactctgcttctctga

SEQ ID NO: 3510635 - DNA, 16 bp, Homo sapiens
gagctcccaggtgcag

SEQ ID NO: 3510636 - DNA, 19 bp, Homo sapiens
gagctctaagtacctttcc

SEQ ID NO: 3510637 - DNA, 19 bp, Homo sapiens
gagctctgtgggtctctgg

SEQ ID NO: 3510638 - DNA, 17 bp, Homo sapiens
gagctcttgacagaaag

SEQ ID NO: 3510639 - DNA, 19 bp, Homo sapiens
gagctcttgacagaaagca

SEQ ID NO: 3510640 - DNA, 21 bp, Homo sapiens
gagctcttgtgaggaaagtca

SEQ ID NO: 3510641 - DNA, 14 bp, Homo sapiens
gagctgaccagccg

SEQ ID NO: 3510642 - DNA, 17 bp, Homo sapiens
gagctgaggccacactc

SEQ ID NO: 3510643 - DNA, 18 bp, Homo sapiens
gagctgcccctctctggg

SEQ ID NO: 3510644 - DNA, 19 bp, Homo sapiens
gagctgcctgttcagctcc

SEQ ID NO: 3510645 - DNA, 22 bp, Homo sapiens
gagctgccttggctcagacatg

SEQ ID NO: 3510646 - DNA, 23 bp, Homo sapiens
gagctggccaaagagcctttcca

SEQ ID NO: 3510647 - DNA, 23 bp, Homo sapiens
gagctggccgcgccaaataatgt

SEQ ID NO: 3510648 - DNA, 19 bp, Homo sapiens
gagctggccgtgggcctgg

SEQ ID NO: 3510649 - DNA, 20 bp, Homo sapiens
gagctggccgtgggcctggg

SEQ ID NO: 3510650 - DNA, 16 bp, Homo sapiens
gagctgggatcctaag

SEQ ID NO: 3510651 - DNA, 18 bp, Homo sapiens
gagctgggtgtcaagagg

SEQ ID NO: 3510652 - DNA, 21 bp, Homo sapiens
gagctgtatcttgatgtttag

SEQ ID NO: 3510653 - DNA, 16 bp, Homo sapiens
gagctgtcaccaagga

SEQ ID NO: 3510654 - DNA, 16 bp, Homo sapiens
gagcttcatggcagaa

SEQ ID NO: 3510655 - DNA, 18 bp, Homo sapiens
gagcttcttgtttccttg

SEQ ID NO: 3510656 - DNA, 21 bp, Homo sapiens
gagcttgcaagaagcaggaag

SEQ ID NO: 3510657 - DNA, 22 bp, Homo sapiens
gagctttctgctatcaaagagg

SEQ ID NO: 3510658 - DNA, 20 bp, Homo sapiens
gagctttgaaaattcagtgg

SEQ ID NO: 3510659 - DNA, 21 bp, Homo sapiens
gaggaaaataatgtaattgta

SEQ ID NO: 3510660 - DNA, 18 bp, Homo sapiens
gaggaaactactgccttt

SEQ ID NO: 3510661 - DNA, 19 bp, Homo sapiens
gaggaaaggccagctggca

SEQ ID NO: 3510662 - DNA, 23 bp, Homo sapiens
gaggaaaggccagctggcagcag

SEQ ID NO: 3510663 - DNA, 14 bp, Homo sapiens
gaggaagaggctgc

SEQ ID NO: 3510664 - DNA, 14 bp, Homo sapiens
gacttttctgcaaa

SEQ ID NO: 3510665 - DNA, 13 bp, Homo sapiens
gagaaaaaaacaa

SEQ ID NO: 3510666 - DNA, 21 bp, Homo sapiens
gagaaaaaggctgaaaagaag

SEQ ID NO: 3510667 - DNA, 18 bp, Homo sapiens
gagaaaatatatgtattt

SEQ ID NO: 3510668 - DNA, 19 bp, Homo sapiens
gagaaaatatatgtatttt

SEQ ID NO: 3510669 - DNA, 15 bp, Homo sapiens
gagaaaatcatcaag

SEQ ID NO: 3510670 - DNA, 23 bp, Homo sapiens
gagaaaatcatcaagaagggctg

SEQ ID NO: 3510671 - DNA, 20 bp, Homo sapiens
gagaaaccctaaaaagagaa

SEQ ID NO: 3510672 - DNA, 21 bp, Homo sapiens
gagaaaccttattgtacctct

SEQ ID NO: 3510673 - DNA, 19 bp, Homo sapiens
gagaaagagcacttaagag

SEQ ID NO: 3510674 - DNA, 23 bp, Homo sapiens
gagaaataaagtttgcttagaaa

SEQ ID NO: 3510675 - DNA, 14 bp, Homo sapiens
gagaaatacaaaaa

SEQ ID NO: 3510676 - DNA, 15 bp, Homo sapiens
gagaaatacaaaaat

SEQ ID NO: 3510677 - DNA, 20 bp, Homo sapiens
gagaaatatggacacttaat

SEQ ID NO: 3510678 - DNA, 13 bp, Homo sapiens
gagaacaggacta

SEQ ID NO: 3510679 - DNA, 11 bp, Homo sapiens
gagaacatttt

SEQ ID NO: 3510680 - DNA, 21 bp, Homo sapiens
gagaacctgggttgcagacag

SEQ ID NO: 3510681 - DNA, 23 bp, Homo sapiens
gagaacctgggttgcagacagga

SEQ ID NO: 3510682 - DNA, 16 bp, Homo sapiens
gagaagcagaggaagg

SEQ ID NO: 3510683 - DNA, 17 bp, Homo sapiens
gagaagccacaggcctg

SEQ ID NO: 3510684 - DNA, 15 bp, Homo sapiens
gagaagcggctggca

SEQ ID NO: 3510685 - DNA, 22 bp, Homo sapiens
gagaagctcctctccccagccc

SEQ ID NO: 3510686 - DNA, 21 bp, Homo sapiens
gagaagctctcgggctaggaa

SEQ ID NO: 3510687 - DNA, 21 bp, Homo sapiens
gagaagcttttgaataaaaac

SEQ ID NO: 3510688 - DNA, 15 bp, Homo sapiens
gagaagggctggggc

SEQ ID NO: 3510689 - DNA, 16 bp, Homo sapiens
gagaaggggtgtgcat

SEQ ID NO: 3510690 - DNA, 20 bp, Homo sapiens
gagaagtctggtcagagcca

SEQ ID NO: 3510691 - DNA, 17 bp, Homo sapiens
gagaagtgaatgctggg

SEQ ID NO: 3510692 - DNA, 20 bp, Homo sapiens
gagaagtgaatgctgggact

SEQ ID NO: 3510693 - DNA, 23 bp, Homo sapiens
gagaatacaagatattatgtata

SEQ ID NO: 3510694 - DNA, 19 bp, Homo sapiens
gagaatattttaagtattg

SEQ ID NO: 3510695 - DNA, 23 bp, Homo sapiens
gagaatgaaagggcccagagagg

SEQ ID NO: 3510696 - DNA, 19 bp, Homo sapiens
gagaatgagagcgacacag

SEQ ID NO: 3510697 - DNA, 22 bp, Homo sapiens
gagaatgagagcgacacagacg

SEQ ID NO: 3510698 - DNA, 13 bp, Homo sapiens
gagaatgagggtc

SEQ ID NO: 3510699 - DNA, 19 bp, Homo sapiens
gagaatgtgccatgtataa

SEQ ID NO: 3510700 - DNA, 14 bp, Homo sapiens
gagacaatgtctgc

SEQ ID NO: 3510701 - DNA, 20 bp, Homo sapiens
gagacacaacaactcctagg

SEQ ID NO: 3510702 - DNA, 13 bp, Homo sapiens
gagacagggtttg

SEQ ID NO: 3510703 - DNA, 17 bp, Homo sapiens
gagacagtccagcctgg

SEQ ID NO: 3510704 - DNA, 17 bp, Homo sapiens
gagacagttgagagcgg

SEQ ID NO: 3510705 - DNA, 22 bp, Homo sapiens
gagacagttgggtgagaacaac

SEQ ID NO: 3510706 - DNA, 23 bp, Homo sapiens
gagacagttgggtgagaacaacc

SEQ ID NO: 3510707 - DNA, 15 bp, Homo sapiens
gagacatacttgaag

SEQ ID NO: 3510708 - DNA, 20 bp, Homo sapiens
gagacatacttgaagggcca

SEQ ID NO: 3510709 - DNA, 21 bp, Homo sapiens
gagacatacttgaagggccag

SEQ ID NO: 3510710 - DNA, 14 bp, Homo sapiens
gagaccagcctggc

SEQ ID NO: 3510711 - DNA, 16 bp, Homo sapiens
gagaccagcctggcca

SEQ ID NO: 3510712 - DNA, 14 bp, Homo sapiens
gagaccaggcaaag

SEQ ID NO: 3510713 - DNA, 21 bp, Homo sapiens
gagaccctgtctcaaaaaaag

SEQ ID NO: 3510714 - DNA, 16 bp, Homo sapiens
gagacctatgtaagaa

SEQ ID NO: 3510715 - DNA, 16 bp, Homo sapiens
gagacctcctgcctcc

SEQ ID NO: 3510716 - DNA, 20 bp, Homo sapiens
gagacctggacacaggcctg

SEQ ID NO: 3510717 - DNA, 19 bp, Homo sapiens
gagacggagtcccaccttg

SEQ ID NO: 3510718 - DNA, 15 bp, Homo sapiens
gagactcgagaactt

SEQ ID NO: 3510719 - DNA, 14 bp, Homo sapiens
gagactctgtctca

SEQ ID NO: 3510720 - DNA, 16 bp, Homo sapiens
gagactgggctctggc

SEQ ID NO: 3510721 - DNA, 18 bp, Homo sapiens
gagacttagggcaccagg

SEQ ID NO: 3510722 - DNA, 21 bp, Homo sapiens
gagacttagggcaccaggggt

SEQ ID NO: 3510723 - DNA, 13 bp, Homo sapiens
gagacttgccttc

SEQ ID NO: 3510724 - DNA, 11 bp, Homo sapiens
gagagaaaaaa

SEQ ID NO: 3510725 - DNA, 16 bp, Homo sapiens
gagagaatggatcctc

SEQ ID NO: 3510726 - DNA, 16 bp, Homo sapiens
gagagaccaggcaaag

SEQ ID NO: 3510727 - DNA, 11 bp, Homo sapiens
gagagagaaaa

SEQ ID NO: 3510728 - DNA, 18 bp, Homo sapiens
gagagaggcaatggctcc

SEQ ID NO: 3510729 - DNA, 18 bp, Homo sapiens
gagagatagcctgtggcc

SEQ ID NO: 3510730 - DNA, 15 bp, Homo sapiens
gagagccaaacagag

SEQ ID NO: 3510731 - DNA, 19 bp, Homo sapiens
gagagccgtggtccctgag

SEQ ID NO: 3510732 - DNA, 18 bp, Homo sapiens
gagagccttgggagccac

SEQ ID NO: 3510733 - DNA, 23 bp, Homo sapiens
gagagccttgggagccactgcca

SEQ ID NO: 3510734 - DNA, 14 bp, Homo sapiens
gagagcgacacaga

SEQ ID NO: 3510735 - DNA, 20 bp, Homo sapiens
gagagctgggtgtcaagagg

SEQ ID NO: 3510736 - DNA, 16 bp, Homo sapiens
gagagcttaatgataa

SEQ ID NO: 3510737 - DNA, 21 bp, Homo sapiens
gagaggaaatattgctggggt

SEQ ID NO: 3510738 - DNA, 18 bp, Homo sapiens
gagaggagacggagggga

SEQ ID NO: 3510739 - DNA, 13 bp, Homo sapiens
gagaggaggcaac

SEQ ID NO: 3510740 - DNA, 15 bp, Homo sapiens
gagaggcaatggcca

SEQ ID NO: 3510741 - DNA, 17 bp, Homo sapiens
gagaggccaaaggctgg

SEQ ID NO: 3510742 - DNA, 16 bp, Homo sapiens
gagaggccctctggag

SEQ ID NO: 3510743 - DNA, 20 bp, Homo sapiens
gagaggccctctggagtggc

SEQ ID NO: 3510744 - DNA, 23 bp, Homo sapiens
gagaggccctctggagtggccac

SEQ ID NO: 3510745 - DNA, 19 bp, Homo sapiens
gagaggggaacagactgga

SEQ ID NO: 3510746 - DNA, 18 bp, Homo sapiens
gagaggggacgcaggccc

SEQ ID NO: 3510747 - DNA, 13 bp, Homo sapiens
gagaggggcacag

SEQ ID NO: 3510748 - DNA, 19 bp, Homo sapiens
gagagggggcctgggactt

SEQ ID NO: 3510749 - DNA, 22 bp, Homo sapiens
gagaggtgggccagtctgtgga

SEQ ID NO: 3510750 - DNA, 23 bp, Homo sapiens
gagaggtgggccagtctgtggat

SEQ ID NO: 3510751 - DNA, 20 bp, Homo sapiens
gagagtcagctctctgccct

SEQ ID NO: 3510752 - DNA, 17 bp, Homo sapiens
gaccacgcccgtcctgc

SEQ ID NO: 3510753 - DNA, 19 bp, Homo sapiens
gaccacgcccgtcctgcct

SEQ ID NO: 3510754 - DNA, 21 bp, Homo sapiens
gaccacgcccgtcctgcctgt

SEQ ID NO: 3510755 - DNA, 21 bp, Homo sapiens
gaccacgctttctagctgttg

SEQ ID NO: 3510756 - DNA, 13 bp, Homo sapiens
gaccacggctcga

SEQ ID NO: 3510757 - DNA, 22 bp, Homo sapiens
gaccagcctggccaacatggta

SEQ ID NO: 3510758 - DNA, 14 bp, Homo sapiens
gaccaggctgtgtc

SEQ ID NO: 3510759 - DNA, 18 bp, Homo sapiens
gaccagtcaacctgggca

SEQ ID NO: 3510760 - DNA, 18 bp, Homo sapiens
gacccaatgtaggagctg

SEQ ID NO: 3510761 - DNA, 22 bp, Homo sapiens
gacccacgaaactgccctggct

SEQ ID NO: 3510762 - DNA, 18 bp, Homo sapiens
gacccacgtggctgcgtg

SEQ ID NO: 3510763 - DNA, 12 bp, Homo sapiens
gacccactgctt

SEQ ID NO: 3510764 - DNA, 17 bp, Homo sapiens
gacccagatctcatgga

SEQ ID NO: 3510765 - DNA, 16 bp, Homo sapiens
gacccagccctcatcc

SEQ ID NO: 3510766 - DNA, 17 bp, Homo sapiens
gacccagccctcatccc

SEQ ID NO: 3510767 - DNA, 15 bp, Homo sapiens
gacccagggaacagc

SEQ ID NO: 3510768 - DNA, 13 bp, Homo sapiens
gacccattgctgt

SEQ ID NO: 3510769 - DNA, 19 bp, Homo sapiens
gaccccagcaagtggtcct

SEQ ID NO: 3510770 - DNA, 13 bp, Homo sapiens
gacccccagctcc

SEQ ID NO: 3510771 - DNA, 18 bp, Homo sapiens
gacccccgccccctgccc

SEQ ID NO: 3510772 - DNA, 13 bp, Homo sapiens
gacccctccatgt

SEQ ID NO: 3510773 - DNA, 20 bp, Homo sapiens
gaccccttaatcttgctttc

SEQ ID NO: 3510774 - DNA, 16 bp, Homo sapiens
gaccctggggctggct

SEQ ID NO: 3510775 - DNA, 12 bp, Homo sapiens
gaccctgtctca

SEQ ID NO: 3510776 - DNA, 22 bp, Homo sapiens
gaccctgtgccctccttcccaa

SEQ ID NO: 3510777 - DNA, 20 bp, Homo sapiens
gacctaaatggcctcatgtg

SEQ ID NO: 3510778 - DNA, 19 bp, Homo sapiens
gacctcaggtgagaagcag

SEQ ID NO: 3510779 - DNA, 21 bp, Homo sapiens
gacctcaggtgagaagcagag

SEQ ID NO: 3510780 - DNA, 13 bp, Homo sapiens
gacctctgcctga

SEQ ID NO: 3510781 - DNA, 16 bp, Homo sapiens
gacctcttctggagat

SEQ ID NO: 3510782 - DNA, 14 bp, Homo sapiens
gacctgatcctgga

SEQ ID NO: 3510783 - DNA, 15 bp, Homo sapiens
gacctgatcctggag

SEQ ID NO: 3510784 - DNA, 17 bp, Homo sapiens
gacctggcaaggacaca

SEQ ID NO: 3510785 - DNA, 18 bp, Homo sapiens
gacctggcactggatgca

SEQ ID NO: 3510786 - DNA, 15 bp, Homo sapiens
gacctggcagctctg

SEQ ID NO: 3510787 - DNA, 17 bp, Homo sapiens
gacctggtgctgcctct

SEQ ID NO: 3510788 - DNA, 22 bp, Homo sapiens
gacctggtgctgcctctacctg

SEQ ID NO: 3510789 - DNA, 19 bp, Homo sapiens
gacctgtcaccctgcagga

SEQ ID NO: 3510790 - DNA, 15 bp, Homo sapiens
gacctgtgagcccag

SEQ ID NO: 3510791 - DNA, 17 bp, Homo sapiens
gacctgttagcagacag

SEQ ID NO: 3510792 - DNA, 18 bp, Homo sapiens
gaccttaggccttcctct

SEQ ID NO: 3510793 - DNA, 18 bp, Homo sapiens
gaccttcagctcacgctt

SEQ ID NO: 3510794 - DNA, 18 bp, Homo sapiens
gaccttcgggctgtgccc

SEQ ID NO: 3510795 - DNA, 14 bp, Homo sapiens
gaccttgaactggg

SEQ ID NO: 3510796 - DNA, 18 bp, Homo sapiens
gaccttttttttttttcc

SEQ ID NO: 3510797 - DNA, 14 bp, Homo sapiens
gacgaacttccatg

SEQ ID NO: 3510798 - DNA, 19 bp, Homo sapiens
gacgcagcaggaggccagg

SEQ ID NO: 3510799 - DNA, 12 bp, Homo sapiens
gacgcaggcccc

SEQ ID NO: 3510800 - DNA, 18 bp, Homo sapiens
gacgcaggcccctctcct

SEQ ID NO: 3510801 - DNA, 14 bp, Homo sapiens
gacgcctgaggaac

SEQ ID NO: 3510802 - DNA, 19 bp, Homo sapiens
gacgcctgggggtgccagg

SEQ ID NO: 3510803 - DNA, 13 bp, Homo sapiens
gacggagtcccac

SEQ ID NO: 3510804 - DNA, 14 bp, Homo sapiens
gacggagtcccacc

SEQ ID NO: 3510805 - DNA, 18 bp, Homo sapiens
gacggctccactaggact

SEQ ID NO: 3510806 - DNA, 22 bp, Homo sapiens
gacggctgggcacacgcctccc

SEQ ID NO: 3510807 - DNA, 13 bp, Homo sapiens
gacggtgtcttgt

SEQ ID NO: 3510808 - DNA, 12 bp, Homo sapiens
gacgtagctgca

SEQ ID NO: 3510809 - DNA, 20 bp, Homo sapiens
gacgtaggaacggtaaattt

SEQ ID NO: 3510810 - DNA, 15 bp, Homo sapiens
gacgtcatgtggctt

SEQ ID NO: 3510811 - DNA, 16 bp, Homo sapiens
gacgtggctcagccag

SEQ ID NO: 3510812 - DNA, 22 bp, Homo sapiens
gacgtgttacccactgccatgc

SEQ ID NO: 3510813 - DNA, 20 bp, Homo sapiens
gacgttaggcatttcctgct

SEQ ID NO: 3510814 - DNA, 18 bp, Homo sapiens
gacgtttacaagcccccc

SEQ ID NO: 3510815 - DNA, 20 bp, Homo sapiens
gactaaaagatataagtgct

SEQ ID NO: 3510816 - DNA, 15 bp, Homo sapiens
gactaattttacatg

SEQ ID NO: 3510817 - DNA, 13 bp, Homo sapiens
gactacaggcacc

SEQ ID NO: 3510818 - DNA, 17 bp, Homo sapiens
gactagagggacctctc

SEQ ID NO: 3510819 - DNA, 18 bp, Homo sapiens
gactatctgtctggtggc

SEQ ID NO: 3510820 - DNA, 18 bp, Homo sapiens
gactatgcagaggcctgg

SEQ ID NO: 3510821 - DNA, 22 bp, Homo sapiens
gactcaaaacccatctgggctc

SEQ ID NO: 3510822 - DNA, 14 bp, Homo sapiens
gactcaatgcactg

SEQ ID NO: 3510823 - DNA, 13 bp, Homo sapiens
gactcagaagcct

SEQ ID NO: 3510824 - DNA, 14 bp, Homo sapiens
gactcagccttcag

SEQ ID NO: 3510825 - DNA, 14 bp, Homo sapiens
gactcagctcccca

SEQ ID NO: 3510826 - DNA, 16 bp, Homo sapiens
gactcagggcagcgcc

SEQ ID NO: 3510827 - DNA, 18 bp, Homo sapiens
gactcagggcagcgccag

SEQ ID NO: 3510828 - DNA, 13 bp, Homo sapiens
gactcagggctcc

SEQ ID NO: 3510829 - DNA, 16 bp, Homo sapiens
gactcagggctcctgg

SEQ ID NO: 3510830 - DNA, 13 bp, Homo sapiens
gactcatgaggag

SEQ ID NO: 3510831 - DNA, 16 bp, Homo sapiens
gactcattctgaagga

SEQ ID NO: 3510832 - DNA, 15 bp, Homo sapiens
gactcattcttctgt

SEQ ID NO: 3510833 - DNA, 18 bp, Homo sapiens
gactccaggcccaaggct

SEQ ID NO: 3510834 - DNA, 12 bp, Homo sapiens
gactccaggtct

SEQ ID NO: 3510835 - DNA, 12 bp, Homo sapiens
gactccatctct

SEQ ID NO: 3510836 - DNA, 17 bp, Homo sapiens
gactccatctctcatcc

SEQ ID NO: 3510837 - DNA, 15 bp, Homo sapiens
gactccggctgtgct

SEQ ID NO: 3510838 - DNA, 16 bp, Homo sapiens
gactcctgtgcaactt

SEQ ID NO: 3510839 - DNA, 16 bp, Homo sapiens
gactcgggggtgggga

SEQ ID NO: 3510840 - DNA, 18 bp, Homo sapiens
gactcggggtgcttcctt

SEQ ID NO: 3510841 - DNA, 21 bp, Homo sapiens
gactctacagaggccatgggc

SEQ ID NO: 3510842 - DNA, 14 bp, Homo sapiens
gactctcagtctct

SEQ ID NO: 3510843 - DNA, 20 bp, Homo sapiens
gactctggaagattttcatt

SEQ ID NO: 3510844 - DNA, 17 bp, Homo sapiens
gactctggcttggccta

SEQ ID NO: 3510845 - DNA, 19 bp, Homo sapiens
gactctgggtccttcctga

SEQ ID NO: 3510846 - DNA, 16 bp, Homo sapiens
gactctgtccagctcc

SEQ ID NO: 3510847 - DNA, 13 bp, Homo sapiens
gactcttctctca

SEQ ID NO: 3510848 - DNA, 16 bp, Homo sapiens
gactctttatgcttgc

SEQ ID NO: 3510849 - DNA, 16 bp, Homo sapiens
gactgaaaacctctcc

SEQ ID NO: 3510850 - DNA, 18 bp, Homo sapiens
ctttctcccctgccccca

SEQ ID NO: 3510851 - DNA, 19 bp, Homo sapiens
ctttctcccctgcccccag

SEQ ID NO: 3510852 - DNA, 23 bp, Homo sapiens
ctttctcctttgtactttgtgct

SEQ ID NO: 3510853 - DNA, 13 bp, Homo sapiens
ctttctcttttcc

SEQ ID NO: 3510854 - DNA, 21 bp, Homo sapiens
ctttctcttttcccctttcct

SEQ ID NO: 3510855 - DNA, 22 bp, Homo sapiens
ctttctcttttcccctttcctg

SEQ ID NO: 3510856 - DNA, 14 bp, Homo sapiens
ctttctgaccttca

SEQ ID NO: 3510857 - DNA, 23 bp, Homo sapiens
ctttctgataactagatggtgct

SEQ ID NO: 3510858 - DNA, 15 bp, Homo sapiens
ctttctgatcaaggc

SEQ ID NO: 3510859 - DNA, 16 bp, Homo sapiens
ctttctgatcaaggcc

SEQ ID NO: 3510860 - DNA, 14 bp, Homo sapiens
ctttctgcctggag

SEQ ID NO: 3510861 - DNA, 16 bp, Homo sapiens
ctttctgctcagcttc

SEQ ID NO: 3510862 - DNA, 18 bp, Homo sapiens
ctttctggcaggtcctcc

SEQ ID NO: 3510863 - DNA, 13 bp, Homo sapiens
ctttctgtatata

SEQ ID NO: 3510864 - DNA, 12 bp, Homo sapiens
ctttcttaaaaa

SEQ ID NO: 3510865 - DNA, 21 bp, Homo sapiens
ctttcttgatcaacatctttt

SEQ ID NO: 3510866 - DNA, 15 bp, Homo sapiens
ctttctttagaattt

SEQ ID NO: 3510867 - DNA, 20 bp, Homo sapiens
ctttctttgggaatatttga

SEQ ID NO: 3510868 - DNA, 21 bp, Homo sapiens
ctttctttgggaatatttgaa

SEQ ID NO: 3510869 - DNA, 23 bp, Homo sapiens
ctttctttgggaatatttgaatc

SEQ ID NO: 3510870 - DNA, 22 bp, Homo sapiens
ctttgaataaagaatacttgaa

SEQ ID NO: 3510871 - DNA, 17 bp, Homo sapiens
ctttgaatgttaatttt

SEQ ID NO: 3510872 - DNA, 14 bp, Homo sapiens
ctttgactttcttc

SEQ ID NO: 3510873 - DNA, 22 bp, Homo sapiens
ctttgagctactgccgtcagtg

SEQ ID NO: 3510874 - DNA, 17 bp, Homo sapiens
ctttgaggataactttt

SEQ ID NO: 3510875 - DNA, 15 bp, Homo sapiens
ctttgatcaggtggg

SEQ ID NO: 3510876 - DNA, 23 bp, Homo sapiens
ctttgattagttttcttgttgct

SEQ ID NO: 3510877 - DNA, 12 bp, Homo sapiens
ctttgattcata

SEQ ID NO: 3510878 - DNA, 19 bp, Homo sapiens
ctttgattcatagtaactt

SEQ ID NO: 3510879 - DNA, 22 bp, Homo sapiens
ctttgattctccttcagccctc

SEQ ID NO: 3510880 - DNA, 20 bp, Homo sapiens
ctttgcaaagtattgtaaat

SEQ ID NO: 3510881 - DNA, 22 bp, Homo sapiens
ctttgcaaagtattgtaaatta

SEQ ID NO: 3510882 - DNA, 19 bp, Homo sapiens
ctttgccagtcattcagca

SEQ ID NO: 3510883 - DNA, 21 bp, Homo sapiens
ctttgcctccagaagcactgg

SEQ ID NO: 3510884 - DNA, 16 bp, Homo sapiens
ctttgcggaggctgct

SEQ ID NO: 3510885 - DNA, 15 bp, Homo sapiens
ctttgctgcagagaa

SEQ ID NO: 3510886 - DNA, 11 bp, Homo sapiens
ctttgctgcca

SEQ ID NO: 3510887 - DNA, 11 bp, Homo sapiens
ctttgctgctg

SEQ ID NO: 3510888 - DNA, 17 bp, Homo sapiens
ctttgctgtaagatgtc

SEQ ID NO: 3510889 - DNA, 19 bp, Homo sapiens
ctttgctgtaagatgtctg

SEQ ID NO: 3510890 - DNA, 15 bp, Homo sapiens
ctttgctttctgctc

SEQ ID NO: 3510891 - DNA, 19 bp, Homo sapiens
ctttgctttctgctcagct

SEQ ID NO: 3510892 - DNA, 12 bp, Homo sapiens
ctttgctttggg

SEQ ID NO: 3510893 - DNA, 20 bp, Homo sapiens
ctttgctttgggtttgtggc

SEQ ID NO: 3510894 - DNA, 16 bp, Homo sapiens
ctttggaaacaacatt

SEQ ID NO: 3510895 - DNA, 20 bp, Homo sapiens
ctttggacctaaatggcctc

SEQ ID NO: 3510896 - DNA, 16 bp, Homo sapiens
ctttggagatcaagga

SEQ ID NO: 3510897 - DNA, 17 bp, Homo sapiens
ctttggatttgacattg

SEQ ID NO: 3510898 - DNA, 11 bp, Homo sapiens
ctttggcagtg

SEQ ID NO: 3510899 - DNA, 17 bp, Homo sapiens
ctttgggaatatttgaa

SEQ ID NO: 3510900 - DNA, 23 bp, Homo sapiens
ctttgggaatatttgaatcttgt

SEQ ID NO: 3510901 - DNA, 23 bp, Homo sapiens
ctttggggccgattgggagaaag

SEQ ID NO: 3510902 - DNA, 14 bp, Homo sapiens
ctttggttctggcc

SEQ ID NO: 3510903 - DNA, 21 bp, Homo sapiens
ctttggttctggccagaatgc

SEQ ID NO: 3510904 - DNA, 17 bp, Homo sapiens
ctttgtcctttttgtta

SEQ ID NO: 3510905 - DNA, 14 bp, Homo sapiens
ctttgtgaatattt

SEQ ID NO: 3510906 - DNA, 11 bp, Homo sapiens
ctttgtggcca

SEQ ID NO: 3510907 - DNA, 15 bp, Homo sapiens
ctttgtggccaagga

SEQ ID NO: 3510908 - DNA, 20 bp, Homo sapiens
ctttgtggccaaggagctgc

SEQ ID NO: 3510909 - DNA, 19 bp, Homo sapiens
ctttgtggtctaaagtgtt

SEQ ID NO: 3510910 - DNA, 17 bp, Homo sapiens
ctttgttaagttctatt

SEQ ID NO: 3510911 - DNA, 14 bp, Homo sapiens
ctttgttataccat

SEQ ID NO: 3510912 - DNA, 18 bp, Homo sapiens
ctttgttcatagcccagt

SEQ ID NO: 3510913 - DNA, 14 bp, Homo sapiens
ctttgttcccggct

SEQ ID NO: 3510914 - DNA, 11 bp, Homo sapiens
ctttgttgcac

SEQ ID NO: 3510915 - DNA, 18 bp, Homo sapiens
ctttgtttgttgtcagct

SEQ ID NO: 3510916 - DNA, 23 bp, Homo sapiens
ctttgttttgcacactttgccat

SEQ ID NO: 3510917 - DNA, 16 bp, Homo sapiens
cttttaaaagacaaga

SEQ ID NO: 3510918 - DNA, 22 bp, Homo sapiens
cttttaaaagacaagacttcag

SEQ ID NO: 3510919 - DNA, 13 bp, Homo sapiens
cttttacatactg

SEQ ID NO: 3510920 - DNA, 18 bp, Homo sapiens
cttttacctgctgcttct

SEQ ID NO: 3510921 - DNA, 21 bp, Homo sapiens
cttttagaaatactgcaagaa

SEQ ID NO: 3510922 - DNA, 20 bp, Homo sapiens
cttttaggagaaagtgtatt

SEQ ID NO: 3510923 - DNA, 17 bp, Homo sapiens
cttttatactctttctg

SEQ ID NO: 3510924 - DNA, 16 bp, Homo sapiens
cttttatagatggtca

SEQ ID NO: 3510925 - DNA, 21 bp, Homo sapiens
cttttataggtgagaaaaaaa

SEQ ID NO: 3510926 - DNA, 13 bp, Homo sapiens
cttttatatttgt

SEQ ID NO: 3510927 - DNA, 14 bp, Homo sapiens
cttttattttggaa

SEQ ID NO: 3510928 - DNA, 22 bp, Homo sapiens
cttttattttggaactatgaag

SEQ ID NO: 3510929 - DNA, 15 bp, Homo sapiens
cttttcaatgacatt

SEQ ID NO: 3510930 - DNA, 16 bp, Homo sapiens
cttttcacctccttca

SEQ ID NO: 3510931 - DNA, 18 bp, Homo sapiens
cttttcacctccttcaat

SEQ ID NO: 3510932 - DNA, 19 bp, Homo sapiens
cttttcacctccttcaatt

SEQ ID NO: 3510933 - DNA, 21 bp, Homo sapiens
cttttcacctttactttagaa

SEQ ID NO: 3510934 - DNA, 22 bp, Homo sapiens
cttttcataacctagccttaga

SEQ ID NO: 3510935 - DNA, 14 bp, Homo sapiens
cttttcattccctg

SEQ ID NO: 3510936 - DNA, 15 bp, Homo sapiens
cttttcattccctgt

SEQ ID NO: 3510937 - DNA, 17 bp, Homo sapiens
cttttcattctctttta

SEQ ID NO: 3510938 - DNA, 13 bp, Homo sapiens
cttttccttggca

SEQ ID NO: 3510939 - DNA, 17 bp, Homo sapiens
cttttccttggggcagg

SEQ ID NO: 3510940 - DNA, 18 bp, Homo sapiens
cttttctaaaagacttcc

SEQ ID NO: 3510941 - DNA, 13 bp, Homo sapiens
cttttctcagctg

SEQ ID NO: 3510942 - DNA, 21 bp, Homo sapiens
cttttctgggtttgaagctgc

SEQ ID NO: 3510943 - DNA, 23 bp, Homo sapiens
cttttctgggtttgaagctgctg

SEQ ID NO: 3510944 - DNA, 18 bp, Homo sapiens
cttttctgtccgagcttt

SEQ ID NO: 3510945 - DNA, 18 bp, Homo sapiens
cttttgaacccaggagtt

SEQ ID NO: 3510946 - DNA, 21 bp, Homo sapiens
cttttgaacgcccccccccac

SEQ ID NO: 3510947 - DNA, 16 bp, Homo sapiens
cttttgaattgttaca

SEQ ID NO: 3510948 - DNA, 17 bp, Homo sapiens
cttttgacaaaggcaag

SEQ ID NO: 3510949 - DNA, 15 bp, Homo sapiens
cttttgacattttat

SEQ ID NO: 3510950 - DNA, 16 bp, Homo sapiens
cttttgacattttatt

SEQ ID NO: 3510951 - DNA, 15 bp, Homo sapiens
cttttgccctttgat

SEQ ID NO: 3510952 - DNA, 15 bp, Homo sapiens
cttttgcttttggca

SEQ ID NO: 3510953 - DNA, 17 bp, Homo sapiens
cttttgcttttggcaaa

SEQ ID NO: 3510954 - DNA, 23 bp, Homo sapiens
cttttggcctcatctctgcctga

SEQ ID NO: 3510955 - DNA, 16 bp, Homo sapiens
cttttggtctgtgtga

SEQ ID NO: 3510956 - DNA, 14 bp, Homo sapiens
cttttgtaataaac

SEQ ID NO: 3510957 - DNA, 13 bp, Homo sapiens
cttttgtatgtaa

SEQ ID NO: 3510958 - DNA, 21 bp, Homo sapiens
cttttgtatgtaaatgtgcat

SEQ ID NO: 3510959 - DNA, 13 bp, Homo sapiens
ctttttaaaaata

SEQ ID NO: 3510960 - DNA, 16 bp, Homo sapiens
ctttttaacctgcaaa

SEQ ID NO: 3510961 - DNA, 20 bp, Homo sapiens
ctttttaataaaaaggcacc

SEQ ID NO: 3510962 - DNA, 16 bp, Homo sapiens
ctttttacattacaga

SEQ ID NO: 3510963 - DNA, 18 bp, Homo sapiens
ctttttacattacagaat

SEQ ID NO: 3510964 - DNA, 20 bp, Homo sapiens
ctttttactattaacatgat

SEQ ID NO: 3510965 - DNA, 14 bp, Homo sapiens
ctttttattgaatc

SEQ ID NO: 3510966 - DNA, 15 bp, Homo sapiens
ctttttattgaatct

SEQ ID NO: 3510967 - DNA, 11 bp, Homo sapiens
ctttttattgc

SEQ ID NO: 3510968 - DNA, 20 bp, Homo sapiens
ctttttatttctaaagttgt

SEQ ID NO: 3510969 - DNA, 15 bp, Homo sapiens
ctttttcatcccctt

SEQ ID NO: 3510970 - DNA, 18 bp, Homo sapiens
ctttttcgccaaactgtc

SEQ ID NO: 3510971 - DNA, 21 bp, Homo sapiens
ctttttcgccaaactgtctct

SEQ ID NO: 3510972 - DNA, 12 bp, Homo sapiens
ctttttctaatg

SEQ ID NO: 3510973 - DNA, 13 bp, Homo sapiens
ctttttctaatga

SEQ ID NO: 3510974 - DNA, 11 bp, Homo sapiens
ctttttctacc

SEQ ID NO: 3510975 - DNA, 22 bp, Homo sapiens
ctttttgaacttttcattccct

SEQ ID NO: 3510976 - DNA, 21 bp, Homo sapiens
ctttttgaagtgtaggcagac

SEQ ID NO: 3510977 - DNA, 13 bp, Homo sapiens
ctttttgcagctt

SEQ ID NO: 3510978 - DNA, 16 bp, Homo sapiens
cttggcaccagacacc

SEQ ID NO: 3510979 - DNA, 19 bp, Homo sapiens
cttggcaccagacacccag

SEQ ID NO: 3510980 - DNA, 22 bp, Homo sapiens
cttggcattccgcatccctacc

SEQ ID NO: 3510981 - DNA, 21 bp, Homo sapiens
cttggcctatctcctagggct

SEQ ID NO: 3510982 - DNA, 13 bp, Homo sapiens
cttggccttctcc

SEQ ID NO: 3510983 - DNA, 16 bp, Homo sapiens
cttggccttctcccct

SEQ ID NO: 3510984 - DNA, 12 bp, Homo sapiens
cttggctcagac

SEQ ID NO: 3510985 - DNA, 12 bp, Homo sapiens
cttggctgcagg

SEQ ID NO: 3510986 - DNA, 16 bp, Homo sapiens
cttggctggtgcacct

SEQ ID NO: 3510987 - DNA, 17 bp, Homo sapiens
cttgggaagaggacttc

SEQ ID NO: 3510988 - DNA, 14 bp, Homo sapiens
cttgggaggcccca

SEQ ID NO: 3510989 - DNA, 21 bp, Homo sapiens
cttgggaggccccactgggga

SEQ ID NO: 3510990 - DNA, 22 bp, Homo sapiens
cttgggaggccccactggggaa

SEQ ID NO: 3510991 - DNA, 14 bp, Homo sapiens
cttgggcagagctg

SEQ ID NO: 3510992 - DNA, 18 bp, Homo sapiens
cttgggcagagctggctc

SEQ ID NO: 3510993 - DNA, 20 bp, Homo sapiens
cttgggcagagctggctctg

SEQ ID NO: 3510994 - DNA, 19 bp, Homo sapiens
cttgggccaagccagctgc

SEQ ID NO: 3510995 - DNA, 22 bp, Homo sapiens
cttgggccaagccagctgccta

SEQ ID NO: 3510996 - DNA, 14 bp, Homo sapiens
cttgggccctttga

SEQ ID NO: 3510997 - DNA, 15 bp, Homo sapiens
cttggggaaggggca

SEQ ID NO: 3510998 - DNA, 20 bp, Homo sapiens
cttggggagttaagacctgg

SEQ ID NO: 3510999 - DNA, 20 bp, Homo sapiens
cttggggcaacattgttcac

SEQ ID NO: 3511000 - DNA, 16 bp, Homo sapiens
cttggggggctgaggt

SEQ ID NO: 3511001 - DNA, 19 bp, Homo sapiens
cttggttagtggctgcctc

SEQ ID NO: 3511002 - DNA, 14 bp, Homo sapiens
cttggttggctggc

SEQ ID NO: 3511003 - DNA, 16 bp, Homo sapiens
cttggttggctggcct

SEQ ID NO: 3511004 - DNA, 15 bp, Homo sapiens
cttggtttgccttcc

SEQ ID NO: 3511005 - DNA, 15 bp, Homo sapiens
cttgtaaataaagcc

SEQ ID NO: 3511006 - DNA, 18 bp, Homo sapiens
cttgtaaatagctcaggt

SEQ ID NO: 3511007 - DNA, 23 bp, Homo sapiens
cttgtaccgatgcagctctcttt

SEQ ID NO: 3511008 - DNA, 22 bp, Homo sapiens
cttgtataggttttaaagacct

SEQ ID NO: 3511009 - DNA, 18 bp, Homo sapiens
cttgtcaagcctgtgcaa

SEQ ID NO: 3511010 - DNA, 23 bp, Homo sapiens
cttgtcaagcctgtgcaaaaaaa

SEQ ID NO: 3511011 - DNA, 17 bp, Homo sapiens
cttgtcactagcagctg

SEQ ID NO: 3511012 - DNA, 19 bp, Homo sapiens
cttgtcactagcagctgca

SEQ ID NO: 3511013 - DNA, 12 bp, Homo sapiens
cttgtccagctg

SEQ ID NO: 3511014 - DNA, 13 bp, Homo sapiens
cttgtccagctga

SEQ ID NO: 3511015 - DNA, 18 bp, Homo sapiens
cttgtcccactcaagcca

SEQ ID NO: 3511016 - DNA, 19 bp, Homo sapiens
cttgtcccactcaagccaa

SEQ ID NO: 3511017 - DNA, 14 bp, Homo sapiens
cttgtccccaaatc

SEQ ID NO: 3511018 - DNA, 16 bp, Homo sapiens
cttgtctcaatgctca

SEQ ID NO: 3511019 - DNA, 19 bp, Homo sapiens
cttgtctcttcatctaata

SEQ ID NO: 3511020 - DNA, 13 bp, Homo sapiens
cttgtgaggaaag

SEQ ID NO: 3511021 - DNA, 16 bp, Homo sapiens
cttgtgaggaaagtca

SEQ ID NO: 3511022 - DNA, 19 bp, Homo sapiens
cttgtgaggaaagtcattg

SEQ ID NO: 3511023 - DNA, 18 bp, Homo sapiens
cttgtgccaacactcaag

SEQ ID NO: 3511024 - DNA, 15 bp, Homo sapiens
cttgtggacacagct

SEQ ID NO: 3511025 - DNA, 16 bp, Homo sapiens
cttgtggacacagctc

SEQ ID NO: 3511026 - DNA, 21 bp, Homo sapiens
cttgtggacacagctcttctc

SEQ ID NO: 3511027 - DNA, 17 bp, Homo sapiens
cttgtgttcatgtggag

SEQ ID NO: 3511028 - DNA, 18 bp, Homo sapiens
cttgttacccatgaaaaa

SEQ ID NO: 3511029 - DNA, 17 bp, Homo sapiens
cttgttattgaagtgtt

SEQ ID NO: 3511030 - DNA, 16 bp, Homo sapiens
cttgttccaaggccag

SEQ ID NO: 3511031 - DNA, 12 bp, Homo sapiens
cttgttcctaga

SEQ ID NO: 3511032 - DNA, 14 bp, Homo sapiens
cttgttgctttgtt

SEQ ID NO: 3511033 - DNA, 16 bp, Homo sapiens
cttgttgctttgttgc

SEQ ID NO: 3511034 - DNA, 13 bp, Homo sapiens
cttgtttccttgt

SEQ ID NO: 3511035 - DNA, 14 bp, Homo sapiens
cttgtttgcactgt

SEQ ID NO: 3511036 - DNA, 12 bp, Homo sapiens
cttgttttccaa

SEQ ID NO: 3511037 - DNA, 23 bp, Homo sapiens
ctttaaaaaagaaaagtgcatat

SEQ ID NO: 3511038 - DNA, 18 bp, Homo sapiens
ctttaaaagatgctttta

SEQ ID NO: 3511039 - DNA, 22 bp, Homo sapiens
ctttaaacctgtttttttttca

SEQ ID NO: 3511040 - DNA, 13 bp, Homo sapiens
ctttaaatatata

SEQ ID NO: 3511041 - DNA, 15 bp, Homo sapiens
ctttaaatatatatt

SEQ ID NO: 3511042 - DNA, 14 bp, Homo sapiens
ctttaatgcatcta

SEQ ID NO: 3511043 - DNA, 22 bp, Homo sapiens
ctttaatgtcacaggcaggtcc

SEQ ID NO: 3511044 - DNA, 23 bp, Homo sapiens
ctttaatgtcacaggcaggtcca

SEQ ID NO: 3511045 - DNA, 12 bp, Homo sapiens
ctttaatttatg

SEQ ID NO: 3511046 - DNA, 14 bp, Homo sapiens
ctttaccctctttg

SEQ ID NO: 3511047 - DNA, 16 bp, Homo sapiens
ctttacgcccatctca

SEQ ID NO: 3511048 - DNA, 15 bp, Homo sapiens
ctttactattaaaat

SEQ ID NO: 3511049 - DNA, 14 bp, Homo sapiens
ctttactcctcaca

SEQ ID NO: 3511050 - DNA, 17 bp, Homo sapiens
ctttactcctcacactt

SEQ ID NO: 3511051 - DNA, 16 bp, Homo sapiens
ctttactgaccctggg

SEQ ID NO: 3511052 - DNA, 18 bp, Homo sapiens
ctttactttagaagcaca

SEQ ID NO: 3511053 - DNA, 19 bp, Homo sapiens
ctttagaaagctgacattg

SEQ ID NO: 3511054 - DNA, 19 bp, Homo sapiens
ctttagaaaggttttgagc

SEQ ID NO: 3511055 - DNA, 20 bp, Homo sapiens
ctttagaaaggttttgagca

SEQ ID NO: 3511056 - DNA, 20 bp, Homo sapiens
ctttagaattaatttattaa

SEQ ID NO: 3511057 - DNA, 14 bp, Homo sapiens
ctttagagttagac

SEQ ID NO: 3511058 - DNA, 19 bp, Homo sapiens
ctttagatggtggcacatt

SEQ ID NO: 3511059 - DNA, 22 bp, Homo sapiens
ctttagatggtggcacattcct

SEQ ID NO: 3511060 - DNA, 22 bp, Homo sapiens
ctttagcccctcccaagctggc

SEQ ID NO: 3511061 - DNA, 22 bp, Homo sapiens
ctttagttcctactttagccac

SEQ ID NO: 3511062 - DNA, 17 bp, Homo sapiens
ctttatcacctcattct

SEQ ID NO: 3511063 - DNA, 17 bp, Homo sapiens
ctttatggtaagtagca

SEQ ID NO: 3511064 - DNA, 12 bp, Homo sapiens
ctttatgtcttt

SEQ ID NO: 3511065 - DNA, 18 bp, Homo sapiens
ctttattatggaaaacat

SEQ ID NO: 3511066 - DNA, 20 bp, Homo sapiens
ctttattccagaatgctgta

SEQ ID NO: 3511067 - DNA, 23 bp, Homo sapiens
ctttattgtgtttgtcattagcc

SEQ ID NO: 3511068 - DNA, 17 bp, Homo sapiens
ctttatttttgttaata

SEQ ID NO: 3511069 - DNA, 21 bp, Homo sapiens
ctttatttttgttaatattaa

SEQ ID NO: 3511070 - DNA, 16 bp, Homo sapiens
ctttcaaaccagcttc

SEQ ID NO: 3511071 - DNA, 18 bp, Homo sapiens
ctttcaaaccagcttcat

SEQ ID NO: 3511072 - DNA, 19 bp, Homo sapiens
ctttcaaatttagaaacta

SEQ ID NO: 3511073 - DNA, 20 bp, Homo sapiens
ctttcacaaaattttattcc

SEQ ID NO: 3511074 - DNA, 22 bp, Homo sapiens
ctttcacattgtttgctgctat

SEQ ID NO: 3511075 - DNA, 18 bp, Homo sapiens
ctttcactctttagaaat

SEQ ID NO: 3511076 - DNA, 14 bp, Homo sapiens
ctttcagtactttt

SEQ ID NO: 3511077 - DNA, 15 bp, Homo sapiens
ctttcagtacttttt

SEQ ID NO: 3511078 - DNA, 18 bp, Homo sapiens
ctttcataatctttgctt

SEQ ID NO: 3511079 - DNA, 16 bp, Homo sapiens
ctttcatcacactggg

SEQ ID NO: 3511080 - DNA, 18 bp, Homo sapiens
ctttcatcacactgggtg

SEQ ID NO: 3511081 - DNA, 19 bp, Homo sapiens
ctttcatcacactgggtgg

SEQ ID NO: 3511082 - DNA, 18 bp, Homo sapiens
ctttcatgagtttttccc

SEQ ID NO: 3511083 - DNA, 20 bp, Homo sapiens
ctttcatgtaaactgtgcac

SEQ ID NO: 3511084 - DNA, 21 bp, Homo sapiens
ctttcatgtaaactgtgcacc

SEQ ID NO: 3511085 - DNA, 22 bp, Homo sapiens
ctttcatgtgtgccaaggctga

SEQ ID NO: 3511086 - DNA, 22 bp, Homo sapiens
ctttcattcagcctttagaaat

SEQ ID NO: 3511087 - DNA, 15 bp, Homo sapiens
ctttcatttttttcc

SEQ ID NO: 3511088 - DNA, 20 bp, Homo sapiens
ctttcatttttttccaggct

SEQ ID NO: 3511089 - DNA, 22 bp, Homo sapiens
ctttcatttttttccaggctgg

SEQ ID NO: 3511090 - DNA, 18 bp, Homo sapiens
ctttccaaaccttatctc

SEQ ID NO: 3511091 - DNA, 16 bp, Homo sapiens
ctttccaaatgcccag

SEQ ID NO: 3511092 - DNA, 17 bp, Homo sapiens
ctttccaacgtttggaa

SEQ ID NO: 3511093 - DNA, 23 bp, Homo sapiens
ctttccaccacagccagcacctg

SEQ ID NO: 3511094 - DNA, 22 bp, Homo sapiens
ctttccacggagccactcctct

SEQ ID NO: 3511095 - DNA, 19 bp, Homo sapiens
ctttcccaaaattagggag

SEQ ID NO: 3511096 - DNA, 20 bp, Homo sapiens
ctttcccaaaattagggagc

SEQ ID NO: 3511097 - DNA, 17 bp, Homo sapiens
ctttccccttcctttta

SEQ ID NO: 3511098 - DNA, 22 bp, Homo sapiens
ctttccgtcaacgttgtactgt

SEQ ID NO: 3511099 - DNA, 16 bp, Homo sapiens
ctttcctaaggctgca

SEQ ID NO: 3511100 - DNA, 14 bp, Homo sapiens
ctttcctcctctga

SEQ ID NO: 3511101 - DNA, 13 bp, Homo sapiens
ctttcctccttcc

SEQ ID NO: 3511102 - DNA, 14 bp, Homo sapiens
ctttcctccttcca

SEQ ID NO: 3511103 - DNA, 12 bp, Homo sapiens
ctttcctccttt

SEQ ID NO: 3511104 - DNA, 13 bp, Homo sapiens
ctttcctggatgt

SEQ ID NO: 3511105 - DNA, 16 bp, Homo sapiens
ctttcctggatgtctg

SEQ ID NO: 3511106 - DNA, 10 bp, Homo sapiens
ctttcctgtc

SEQ ID NO: 3511107 - DNA, 18 bp, Homo sapiens
ctttccttttttaaaaat

SEQ ID NO: 3511108 - DNA, 21 bp, Homo sapiens
ctttcggaatttttaaaataa

SEQ ID NO: 3511109 - DNA, 21 bp, Homo sapiens
ctttcgtccacagcttcctgt

SEQ ID NO: 3511110 - DNA, 18 bp, Homo sapiens
gaattcaaactggggcct

SEQ ID NO: 3511111 - DNA, 22 bp, Homo sapiens
gaattcaaactggggcctccag

SEQ ID NO: 3511112 - DNA, 15 bp, Homo sapiens
gaattcattccccag

SEQ ID NO: 3511113 - DNA, 14 bp, Homo sapiens
gaattccaaagcaa

SEQ ID NO: 3511114 - DNA, 19 bp, Homo sapiens
gaattccttcgaaaggcct

SEQ ID NO: 3511115 - DNA, 21 bp, Homo sapiens
gaattccttcgaaaggccttc

SEQ ID NO: 3511116 - DNA, 22 bp, Homo sapiens
gaattcttacatgttttctttg

SEQ ID NO: 3511117 - DNA, 12 bp, Homo sapiens
gaattgtacaga

SEQ ID NO: 3511118 - DNA, 22 bp, Homo sapiens
gaattgttgacaaatgtaaaca

SEQ ID NO: 3511119 - DNA, 17 bp, Homo sapiens
gaatttattcaattcct

SEQ ID NO: 3511120 - DNA, 14 bp, Homo sapiens
gaatttcccaggac

SEQ ID NO: 3511121 - DNA, 16 bp, Homo sapiens
gaatttcccaggaccc

SEQ ID NO: 3511122 - DNA, 17 bp, Homo sapiens
gaattttcaaggccttc

SEQ ID NO: 3511123 - DNA, 20 bp, Homo sapiens
gaattttcaaggccttcagt

SEQ ID NO: 3511124 - DNA, 20 bp, Homo sapiens
gaattttggggattttcaaa

SEQ ID NO: 3511125 - DNA, 17 bp, Homo sapiens
gaattttgttctctggg

SEQ ID NO: 3511126 - DNA, 23 bp, Homo sapiens
gaattttgttctctgggagaaaa

SEQ ID NO: 3511127 - DNA, 15 bp, Homo sapiens
gaatttttgcaataa

SEQ ID NO: 3511128 - DNA, 16 bp, Homo sapiens
gaatttttgcaataat

SEQ ID NO: 3511129 - DNA, 22 bp, Homo sapiens
gaatttttttcatcttctctgg

SEQ ID NO: 3511130 - DNA, 18 bp, Homo sapiens
gaatttttttctgcacag

SEQ ID NO: 3511131 - DNA, 21 bp, Homo sapiens
gaatttttttctgcacagctt

SEQ ID NO: 3511132 - DNA, 18 bp, Homo sapiens
gacaaaaaatgttttaaa

SEQ ID NO: 3511133 - DNA, 16 bp, Homo sapiens
gacaaagaattccaaa

SEQ ID NO: 3511134 - DNA, 14 bp, Homo sapiens
gacaaagacaaatt

SEQ ID NO: 3511135 - DNA, 13 bp, Homo sapiens
gacaaaggcaagc

SEQ ID NO: 3511136 - DNA, 15 bp, Homo sapiens
gacaaattgcacaga

SEQ ID NO: 3511137 - DNA, 19 bp, Homo sapiens
gacaacactgggaaacaga

SEQ ID NO: 3511138 - DNA, 21 bp, Homo sapiens
gacaacaggttttcaccatag

SEQ ID NO: 3511139 - DNA, 16 bp, Homo sapiens
gacaacgaggaagccc

SEQ ID NO: 3511140 - DNA, 15 bp, Homo sapiens
gacaagacccccagc

SEQ ID NO: 3511141 - DNA, 18 bp, Homo sapiens
gacaaggattgctactgt

SEQ ID NO: 3511142 - DNA, 19 bp, Homo sapiens
gacaaggattgctactgtc

SEQ ID NO: 3511143 - DNA, 21 bp, Homo sapiens
gacaaggattgctactgtcct

SEQ ID NO: 3511144 - DNA, 10 bp, Homo sapiens
gacaaggcca

SEQ ID NO: 3511145 - DNA, 22 bp, Homo sapiens
gacaaggttcttcccttttaca

SEQ ID NO: 3511146 - DNA, 20 bp, Homo sapiens
gacaagtggactcagggcag

SEQ ID NO: 3511147 - DNA, 12 bp, Homo sapiens
gacaatcactgc

SEQ ID NO: 3511148 - DNA, 14 bp, Homo sapiens
gacaattctgcatg

SEQ ID NO: 3511149 - DNA, 16 bp, Homo sapiens
gacacaaaaagtagat

SEQ ID NO: 3511150 - DNA, 19 bp, Homo sapiens
gacacaaacacacacaaaa

SEQ ID NO: 3511151 - DNA, 22 bp, Homo sapiens
gacacaagtggaccttaggcct

SEQ ID NO: 3511152 - DNA, 13 bp, Homo sapiens
gacacacagctct

SEQ ID NO: 3511153 - DNA, 19 bp, Homo sapiens
gacacacagctctgtcctg

SEQ ID NO: 3511154 - DNA, 11 bp, Homo sapiens
gacacagaaaa

SEQ ID NO: 3511155 - DNA, 16 bp, Homo sapiens
gacacagaaaatgttg

SEQ ID NO: 3511156 - DNA, 18 bp, Homo sapiens
gacacagaaaatgttgag

SEQ ID NO: 3511157 - DNA, 19 bp, Homo sapiens
gacacagaaaatgttgaga

SEQ ID NO: 3511158 - DNA, 14 bp, Homo sapiens
gacacagctcttct

SEQ ID NO: 3511159 - DNA, 16 bp, Homo sapiens
gacacagctcttctcc

SEQ ID NO: 3511160 - DNA, 17 bp, Homo sapiens
gacacagctcttctcca

SEQ ID NO: 3511161 - DNA, 22 bp, Homo sapiens
gacacagctcttctccaggctg

SEQ ID NO: 3511162 - DNA, 23 bp, Homo sapiens
gacacagctcttctccaggctgt

SEQ ID NO: 3511163 - DNA, 17 bp, Homo sapiens
gacacaggatgaaggca

SEQ ID NO: 3511164 - DNA, 15 bp, Homo sapiens
gacacaggcccggct

SEQ ID NO: 3511165 - DNA, 17 bp, Homo sapiens
gacacaggcccggctcc

SEQ ID NO: 3511166 - DNA, 19 bp, Homo sapiens
gacacaggcccggctccag

SEQ ID NO: 3511167 - DNA, 21 bp, Homo sapiens
gacacaggcccggctccaggc

SEQ ID NO: 3511168 - DNA, 13 bp, Homo sapiens
gacacaggccctc

SEQ ID NO: 3511169 - DNA, 16 bp, Homo sapiens
gacacagggacttgaa

SEQ ID NO: 3511170 - DNA, 18 bp, Homo sapiens
gacacagttatcaaaaag

SEQ ID NO: 3511171 - DNA, 14 bp, Homo sapiens
gacacatgctatgt

SEQ ID NO: 3511172 - DNA, 16 bp, Homo sapiens
gacacatgctatgttc

SEQ ID NO: 3511173 - DNA, 13 bp, Homo sapiens
gacacccaggact

SEQ ID NO: 3511174 - DNA, 14 bp, Homo sapiens
gacacccaggactt

SEQ ID NO: 3511175 - DNA, 13 bp, Homo sapiens
gacaccccctcgc

SEQ ID NO: 3511176 - DNA, 18 bp, Homo sapiens
gacacctgcagcctttgg

SEQ ID NO: 3511177 - DNA, 20 bp, Homo sapiens
gacacctggccgcctccagg

SEQ ID NO: 3511178 - DNA, 18 bp, Homo sapiens
gacacctgggagaaatct

SEQ ID NO: 3511179 - DNA, 18 bp, Homo sapiens
gacaccttgacagggcac

SEQ ID NO: 3511180 - DNA, 20 bp, Homo sapiens
gacaccttgacagggcacac

SEQ ID NO: 3511181 - DNA, 19 bp, Homo sapiens
gacacggatctgagaatct

SEQ ID NO: 3511182 - DNA, 20 bp, Homo sapiens
gacacggatctgagaatctt

SEQ ID NO: 3511183 - DNA, 21 bp, Homo sapiens
gacactcccttgggctccctg

SEQ ID NO: 3511184 - DNA, 20 bp, Homo sapiens
gacactctataagattccaa

SEQ ID NO: 3511185 - DNA, 23 bp, Homo sapiens
gacactgcagaaaccctgagcag

SEQ ID NO: 3511186 - DNA, 14 bp, Homo sapiens
gacactggggtctg

SEQ ID NO: 3511187 - DNA, 19 bp, Homo sapiens
gacactggggtctgtttct

SEQ ID NO: 3511188 - DNA, 19 bp, Homo sapiens
gacactggtattcctgcct

SEQ ID NO: 3511189 - DNA, 16 bp, Homo sapiens
gacacttccattgttt

SEQ ID NO: 3511190 - DNA, 14 bp, Homo sapiens
gacacttgtcccca

SEQ ID NO: 3511191 - DNA, 15 bp, Homo sapiens
gacagaagtttgcac

SEQ ID NO: 3511192 - DNA, 23 bp, Homo sapiens
gacagacaacactgggaaacaga

SEQ ID NO: 3511193 - DNA, 15 bp, Homo sapiens
gacagacacacacac

SEQ ID NO: 3511194 - DNA, 12 bp, Homo sapiens
gacagacacagg

SEQ ID NO: 3511195 - DNA, 14 bp, Homo sapiens
gacagacacaggcc

SEQ ID NO: 3511196 - DNA, 17 bp, Homo sapiens
gacagacacaggcccgg

SEQ ID NO: 3511197 - DNA, 22 bp, Homo sapiens
gacagacacaggcccggctcca

SEQ ID NO: 3511198 - DNA, 23 bp, Homo sapiens
gacagactcacaacctgaaccta

SEQ ID NO: 3511199 - DNA, 15 bp, Homo sapiens
gacagagacccagat

SEQ ID NO: 3511200 - DNA, 18 bp, Homo sapiens
gacagagacccagatctc

SEQ ID NO: 3511201 - DNA, 15 bp, Homo sapiens
gacagaggatgagct

SEQ ID NO: 3511202 - DNA, 14 bp, Homo sapiens
gacagaggcagccc

SEQ ID NO: 3511203 - DNA, 17 bp, Homo sapiens
gacagaggcagccccat

SEQ ID NO: 3511204 - DNA, 19 bp, Homo sapiens
gacagaggccccagcctcc

SEQ ID NO: 3511205 - DNA, 21 bp, Homo sapiens
gacagagtctcactgttgccc

SEQ ID NO: 3511206 - DNA, 14 bp, Homo sapiens
gacagattaatatt

SEQ ID NO: 3511207 - DNA, 18 bp, Homo sapiens
gacagccaaaggctggcg

SEQ ID NO: 3511208 - DNA, 13 bp, Homo sapiens
gacagccacggcc

SEQ ID NO: 3511209 - DNA, 14 bp, Homo sapiens
gacagccagagcct

SEQ ID NO: 3511210 - DNA, 12 bp, Homo sapiens
gacagctccacc

SEQ ID NO: 3511211 - DNA, 18 bp, Homo sapiens
gacagctccaccctggcc

SEQ ID NO: 3511212 - DNA, 11 bp, Homo sapiens
gacagctcctt

SEQ ID NO: 3511213 - DNA, 14 bp, Homo sapiens
gacagctccttctg

SEQ ID NO: 3511214 - DNA, 21 bp, Homo sapiens
gacagcttctcatcctgcagg

SEQ ID NO: 3511215 - DNA, 22 bp, Homo sapiens
gacagcttctcatcctgcaggc

SEQ ID NO: 3511216 - DNA, 18 bp, Homo sapiens
gacaggagacctggcact

SEQ ID NO: 3511217 - DNA, 19 bp, Homo sapiens
gacaggatgtgtttgcttt

SEQ ID NO: 3511218 - DNA, 21 bp, Homo sapiens
gacaggcaagcacctcctgcc

SEQ ID NO: 3511219 - DNA, 23 bp, Homo sapiens
gacaggcaatgctggctgttggc

SEQ ID NO: 3511220 - DNA, 14 bp, Homo sapiens
gacaggcagagctg

SEQ ID NO: 3511221 - DNA, 20 bp, Homo sapiens
gacaggcatgttctctgagg

SEQ ID NO: 3511222 - DNA, 16 bp, Homo sapiens
gacaggctcttctttc

SEQ ID NO: 3511223 - DNA, 18 bp, Homo sapiens
gacaggctcttctttccc

SEQ ID NO: 3511224 - DNA, 21 bp, Homo sapiens
gacaggctcttctttcccaaa

SEQ ID NO: 3511225 - DNA, 12 bp, Homo sapiens
gacaggctggct

SEQ ID NO: 3511226 - DNA, 14 bp, Homo sapiens
gacaggctggctcc

SEQ ID NO: 3511227 - DNA, 22 bp, Homo sapiens
gacaggctgtgactcttctctc

SEQ ID NO: 3511228 - DNA, 17 bp, Homo sapiens
gacagggtttcaccatg

SEQ ID NO: 3511229 - DNA, 23 bp, Homo sapiens
gacagggtttggctgtgtctaaa

SEQ ID NO: 3511230 - DNA, 22 bp, Homo sapiens
gacagggttttgccatgttggc

SEQ ID NO: 3511231 - DNA, 16 bp, Homo sapiens
gacaggtgtgccgaca

SEQ ID NO: 3511232 - DNA, 17 bp, Homo sapiens
gacagtatcactgtctt

SEQ ID NO: 3511233 - DNA, 21 bp, Homo sapiens
gacagtgctctaggctgcccc

SEQ ID NO: 3511234 - DNA, 20 bp, Homo sapiens
gacagtggattgcatttctt

SEQ ID NO: 3511235 - DNA, 18 bp, Homo sapiens
gacagttgggtgagaaca

SEQ ID NO: 3511236 - DNA, 22 bp, Homo sapiens
gacataatggggtcctggccat

SEQ ID NO: 3511237 - DNA, 16 bp, Homo sapiens
gacatacgcttttaat

SEQ ID NO: 3511238 - DNA, 14 bp, Homo sapiens
gacatacttgaagg

SEQ ID NO: 3511239 - DNA, 15 bp, Homo sapiens
gacatacttgaaggg

SEQ ID NO: 3511240 - DNA, 20 bp, Homo sapiens
gacatacttgaagggccaga

SEQ ID NO: 3511241 - DNA, 15 bp, Homo sapiens
gacatatttaactgg

SEQ ID NO: 3511242 - DNA, 16 bp, Homo sapiens
ctttttttaactggtg

SEQ ID NO: 3511243 - DNA, 19 bp, Homo sapiens
ctttttttaactggtgaag

SEQ ID NO: 3511244 - DNA, 18 bp, Homo sapiens
ctttttttattaaacaga

SEQ ID NO: 3511245 - DNA, 19 bp, Homo sapiens
ctttttttccatctttaca

SEQ ID NO: 3511246 - DNA, 20 bp, Homo sapiens
gaaaaaaaatgttctttggg

SEQ ID NO: 3511247 - DNA, 18 bp, Homo sapiens
gaaaaaaaccacacaaag

SEQ ID NO: 3511248 - DNA, 13 bp, Homo sapiens
gaaaaaagtcacc

SEQ ID NO: 3511249 - DNA, 19 bp, Homo sapiens
gaaaaacaaattcatcaaa

SEQ ID NO: 3511250 - DNA, 11 bp, Homo sapiens
gaaaaacaggt

SEQ ID NO: 3511251 - DNA, 17 bp, Homo sapiens
gaaaaactggcaacatt

SEQ ID NO: 3511252 - DNA, 17 bp, Homo sapiens
gaaaaataaacactaca

SEQ ID NO: 3511253 - DNA, 16 bp, Homo sapiens
gaaaaatatttattca

SEQ ID NO: 3511254 - DNA, 20 bp, Homo sapiens
gaaaaatgcccttaaatcat

SEQ ID NO: 3511255 - DNA, 18 bp, Homo sapiens
gaaaagaaaaatgagcct

SEQ ID NO: 3511256 - DNA, 23 bp, Homo sapiens
gaaaagaaaaatgagcctggcaa

SEQ ID NO: 3511257 - DNA, 21 bp, Homo sapiens
gaaaagaaagaagttattttc

SEQ ID NO: 3511258 - DNA, 23 bp, Homo sapiens
gaaaagattttaatcaagttgaa

SEQ ID NO: 3511259 - DNA, 20 bp, Homo sapiens
gaaaagcggacatcagctgg

SEQ ID NO: 3511260 - DNA, 13 bp, Homo sapiens
gaaaagctgctga

SEQ ID NO: 3511261 - DNA, 23 bp, Homo sapiens
gaaaaggaatcacgttagaggaa

SEQ ID NO: 3511262 - DNA, 13 bp, Homo sapiens
gaaaagtcaaact

SEQ ID NO: 3511263 - DNA, 10 bp, Homo sapiens
gaaaagttat

SEQ ID NO: 3511264 - DNA, 14 bp, Homo sapiens
gaaaatataagtaa

SEQ ID NO: 3511265 - DNA, 15 bp, Homo sapiens
gaaaatatatgtatt

SEQ ID NO: 3511266 - DNA, 16 bp, Homo sapiens
gaaaatatatgtattt

SEQ ID NO: 3511267 - DNA, 22 bp, Homo sapiens
gaaaatatatgtatttttatat

SEQ ID NO: 3511268 - DNA, 18 bp, Homo sapiens
gaaaatattttgtctaaa

SEQ ID NO: 3511269 - DNA, 22 bp, Homo sapiens
gaaaatcatcaagaagggctgc

SEQ ID NO: 3511270 - DNA, 21 bp, Homo sapiens
gaaaatctagaggaaaagaaa

SEQ ID NO: 3511271 - DNA, 14 bp, Homo sapiens
gaaaatgcagcagg

SEQ ID NO: 3511272 - DNA, 23 bp, Homo sapiens
gaaaatgcagcagggatgccctg

SEQ ID NO: 3511273 - DNA, 18 bp, Homo sapiens
gaaaatggaaccaggctt

SEQ ID NO: 3511274 - DNA, 15 bp, Homo sapiens
gaaaatgttatttaa

SEQ ID NO: 3511275 - DNA, 15 bp, Homo sapiens
gaaaatgttgagaat

SEQ ID NO: 3511276 - DNA, 18 bp, Homo sapiens
gaaaattcctataaggaa

SEQ ID NO: 3511277 - DNA, 20 bp, Homo sapiens
gaaacaactctttgagaaac

SEQ ID NO: 3511278 - DNA, 16 bp, Homo sapiens
gaaacacactgaggca

SEQ ID NO: 3511279 - DNA, 11 bp, Homo sapiens
gaaacagaaaa

SEQ ID NO: 3511280 - DNA, 13 bp, Homo sapiens
gaaacagctgcct

SEQ ID NO: 3511281 - DNA, 21 bp, Homo sapiens
gaaacaggttgggatgggata

SEQ ID NO: 3511282 - DNA, 15 bp, Homo sapiens
gaaaccctgagcaga

SEQ ID NO: 3511283 - DNA, 21 bp, Homo sapiens
gaaaccctggaccagtggtct

SEQ ID NO: 3511284 - DNA, 18 bp, Homo sapiens
gaaacctgtcattgtatt

SEQ ID NO: 3511285 - DNA, 20 bp, Homo sapiens
gaaaccttattgtacctctc

SEQ ID NO: 3511286 - DNA, 19 bp, Homo sapiens
gaaactactgcctttagaa

SEQ ID NO: 3511287 - DNA, 21 bp, Homo sapiens
gaaactccaccttgcggggat

SEQ ID NO: 3511288 - DNA, 15 bp, Homo sapiens
gaaactgcagggaaa

SEQ ID NO: 3511289 - DNA, 16 bp, Homo sapiens
gaaactggccaggggt

SEQ ID NO: 3511290 - DNA, 21 bp, Homo sapiens
gaaactgtcggtttgctttga

SEQ ID NO: 3511291 - DNA, 23 bp, Homo sapiens
gaaacttatagttaatattttgt

SEQ ID NO: 3511292 - DNA, 13 bp, Homo sapiens
gaaactttccttt

SEQ ID NO: 3511293 - DNA, 18 bp, Homo sapiens
gaaactttcctttaactc

SEQ ID NO: 3511294 - DNA, 21 bp, Homo sapiens
gaaactttgaggataactttt

SEQ ID NO: 3511295 - DNA, 17 bp, Homo sapiens
gaaagacagcttctcat

SEQ ID NO: 3511296 - DNA, 19 bp, Homo sapiens
gaaagactgaagaaagtgt

SEQ ID NO: 3511297 - DNA, 21 bp, Homo sapiens
gaaagagcacttaagagaata

SEQ ID NO: 3511298 - DNA, 19 bp, Homo sapiens
gaaagcagctcaaaggcac

SEQ ID NO: 3511299 - DNA, 20 bp, Homo sapiens
gaaagcagctcaaaggcaca

SEQ ID NO: 3511300 - DNA, 18 bp, Homo sapiens
gaaagcatttgaatgcat

SEQ ID NO: 3511301 - DNA, 20 bp, Homo sapiens
gaaagcatttgaatgcattt

SEQ ID NO: 3511302 - DNA, 21 bp, Homo sapiens
gaaagcatttgaatgcatttt

SEQ ID NO: 3511303 - DNA, 22 bp, Homo sapiens
gaaagccctgagctttctgcta

SEQ ID NO: 3511304 - DNA, 14 bp, Homo sapiens
gaaagccttctttt

SEQ ID NO: 3511305 - DNA, 14 bp, Homo sapiens
gaaagcggctgcct

SEQ ID NO: 3511306 - DNA, 19 bp, Homo sapiens
gaaagctggtggcagagtc

SEQ ID NO: 3511307 - DNA, 14 bp, Homo sapiens
gaaaggaacatttt

SEQ ID NO: 3511308 - DNA, 15 bp, Homo sapiens
gaaaggagtagaaaa

SEQ ID NO: 3511309 - DNA, 15 bp, Homo sapiens
gaaaggatgagcaga

SEQ ID NO: 3511310 - DNA, 16 bp, Homo sapiens
gaaaggcattctctga

SEQ ID NO: 3511311 - DNA, 16 bp, Homo sapiens
gaaaggccagctggca

SEQ ID NO: 3511312 - DNA, 14 bp, Homo sapiens
gaaaggccttcaga

SEQ ID NO: 3511313 - DNA, 19 bp, Homo sapiens
gaaaggccttcagacacat

SEQ ID NO: 3511314 - DNA, 21 bp, Homo sapiens
gaaaggccttcagacacatgc

SEQ ID NO: 3511315 - DNA, 14 bp, Homo sapiens
gaaaggcctttaaa

SEQ ID NO: 3511316 - DNA, 15 bp, Homo sapiens
gaaaggcctttaaaa

SEQ ID NO: 3511317 - DNA, 18 bp, Homo sapiens
gaaaggcctttaaaattt

SEQ ID NO: 3511318 - DNA, 13 bp, Homo sapiens
gaaagggcccaga

SEQ ID NO: 3511319 - DNA, 16 bp, Homo sapiens
gaaagggcccagagag

SEQ ID NO: 3511320 - DNA, 17 bp, Homo sapiens
gaaaggggacaaggaag

SEQ ID NO: 3511321 - DNA, 15 bp, Homo sapiens
gaaaggggagcccac

SEQ ID NO: 3511322 - DNA, 22 bp, Homo sapiens
gaaaggtgccatggaagaggct

SEQ ID NO: 3511323 - DNA, 17 bp, Homo sapiens
gaaaggtggtgtttctg

SEQ ID NO: 3511324 - DNA, 13 bp, Homo sapiens
gaaagtgaggaaa

SEQ ID NO: 3511325 - DNA, 19 bp, Homo sapiens
gaaagttgcacggctgctg

SEQ ID NO: 3511326 - DNA, 20 bp, Homo sapiens
gaaataaaggatgtgattgt

SEQ ID NO: 3511327 - DNA, 17 bp, Homo sapiens
gaaataaagtttgctta

SEQ ID NO: 3511328 - DNA, 14 bp, Homo sapiens
gaaataacagagag

SEQ ID NO: 3511329 - DNA, 13 bp, Homo sapiens
gaaatacaaaaat

SEQ ID NO: 3511330 - DNA, 14 bp, Homo sapiens
gaaatacaaaaata

SEQ ID NO: 3511331 - DNA, 13 bp, Homo sapiens
gaaatatgcatct

SEQ ID NO: 3511332 - DNA, 14 bp, Homo sapiens
gaaatatgctcttt

SEQ ID NO: 3511333 - DNA, 18 bp, Homo sapiens
gaaatatgctcttttgtt

SEQ ID NO: 3511334 - DNA, 16 bp, Homo sapiens
gaaatattgctggggt

SEQ ID NO: 3511335 - DNA, 23 bp, Homo sapiens
gaaatcaagtcatctatagttga

SEQ ID NO: 3511336 - DNA, 14 bp, Homo sapiens
gaaatccattcaca

SEQ ID NO: 3511337 - DNA, 20 bp, Homo sapiens
gaaatctggcttctggccag

SEQ ID NO: 3511338 - DNA, 19 bp, Homo sapiens
gaaatctgggatgtactgt

SEQ ID NO: 3511339 - DNA, 19 bp, Homo sapiens
gaaatcttacagctgggtg

SEQ ID NO: 3511340 - DNA, 19 bp, Homo sapiens
gaaatgactaaaaaacaaa

SEQ ID NO: 3511341 - DNA, 18 bp, Homo sapiens
gaaatgaggtcagagcct

SEQ ID NO: 3511342 - DNA, 22 bp, Homo sapiens
gaaatgcattgctctggatctg

SEQ ID NO: 3511343 - DNA, 16 bp, Homo sapiens
gaaatgctgctggcca

SEQ ID NO: 3511344 - DNA, 12 bp, Homo sapiens
gaaatggccttc

SEQ ID NO: 3511345 - DNA, 13 bp, Homo sapiens
gaaatggccttcc

SEQ ID NO: 3511346 - DNA, 15 bp, Homo sapiens
gaaatggccttcccg

SEQ ID NO: 3511347 - DNA, 13 bp, Homo sapiens
gaaatggttgtat

SEQ ID NO: 3511348 - DNA, 20 bp, Homo sapiens
gaaattaaaactattcatgc

SEQ ID NO: 3511349 - DNA, 18 bp, Homo sapiens
gaaattctgaatttgcaa

SEQ ID NO: 3511350 - DNA, 14 bp, Homo sapiens
gaaatttaaaagca

SEQ ID NO: 3511351 - DNA, 16 bp, Homo sapiens
gaaatttaattcatgt

SEQ ID NO: 3511352 - DNA, 22 bp, Homo sapiens
gaaatttatttcctagttctgt

SEQ ID NO: 3511353 - DNA, 23 bp, Homo sapiens
gaaatttatttcctagttctgta

SEQ ID NO: 3511354 - DNA, 15 bp, Homo sapiens
gaaatttgataatga

SEQ ID NO: 3511355 - DNA, 14 bp, Homo sapiens
gaaatttttgtaaa

SEQ ID NO: 3511356 - DNA, 15 bp, Homo sapiens
gaaatttttgtaaat

SEQ ID NO: 3511357 - DNA, 21 bp, Homo sapiens
gaaatttttgtaaatcacatc

SEQ ID NO: 3511358 - DNA, 16 bp, Homo sapiens
gaacaaaaaaatctgc

SEQ ID NO: 3511359 - DNA, 14 bp, Homo sapiens
gaacaaattatttt

SEQ ID NO: 3511360 - DNA, 13 bp, Homo sapiens
gaacaagcctaaa

SEQ ID NO: 3511361 - DNA, 18 bp, Homo sapiens
gaacaagctcatctattt

SEQ ID NO: 3511362 - DNA, 21 bp, Homo sapiens
gaacaatgtgctatgtgaaga

SEQ ID NO: 3511363 - DNA, 19 bp, Homo sapiens
gaagctctcgggctaggaa

SEQ ID NO: 3511364 - DNA, 14 bp, Homo sapiens
gaagctgagcacca

SEQ ID NO: 3511365 - DNA, 17 bp, Homo sapiens
gaagctgagcaccaggg

SEQ ID NO: 3511366 - DNA, 19 bp, Homo sapiens
gaagctgagcaccagggga

SEQ ID NO: 3511367 - DNA, 13 bp, Homo sapiens
gaagctgctccgt

SEQ ID NO: 3511368 - DNA, 12 bp, Homo sapiens
gaagctgctgtc

SEQ ID NO: 3511369 - DNA, 15 bp, Homo sapiens
gaagctgctgtctct

SEQ ID NO: 3511370 - DNA, 14 bp, Homo sapiens
gaagctttggtgag

SEQ ID NO: 3511371 - DNA, 20 bp, Homo sapiens
gaagctttggtgagaacctg

SEQ ID NO: 3511372 - DNA, 23 bp, Homo sapiens
gaaggaacttgtctcttcatcta

SEQ ID NO: 3511373 - DNA, 20 bp, Homo sapiens
gaaggacattgcggacagcc

SEQ ID NO: 3511374 - DNA, 21 bp, Homo sapiens
gaaggacattgcggacagcca

SEQ ID NO: 3511375 - DNA, 18 bp, Homo sapiens
gaaggagacaggcagagc

SEQ ID NO: 3511376 - DNA, 22 bp, Homo sapiens
gaaggagccccattcctgggaa

SEQ ID NO: 3511377 - DNA, 22 bp, Homo sapiens
gaaggcagagaaagggacaatg

SEQ ID NO: 3511378 - DNA, 18 bp, Homo sapiens
gaaggcattgtcctgtga

SEQ ID NO: 3511379 - DNA, 19 bp, Homo sapiens
gaaggcatttgcagggtcc

SEQ ID NO: 3511380 - DNA, 16 bp, Homo sapiens
gaaggccctgctgagt

SEQ ID NO: 3511381 - DNA, 17 bp, Homo sapiens
gaaggccgagaagcaag

SEQ ID NO: 3511382 - DNA, 15 bp, Homo sapiens
gcaagaccagttgaa

SEQ ID NO: 3511383 - DNA, 16 bp, Homo sapiens
gcaagagaacatttta

SEQ ID NO: 3511384 - DNA, 19 bp, Homo sapiens
gcaagagaattgcttgaac

SEQ ID NO: 3511385 - DNA, 17 bp, Homo sapiens
gcaagatacaggaaaaa

SEQ ID NO: 3511386 - DNA, 15 bp, Homo sapiens
gcaagcccctgctcc

SEQ ID NO: 3511387 - DNA, 15 bp, Homo sapiens
gcaagctccgcagga

SEQ ID NO: 3511388 - DNA, 13 bp, Homo sapiens
gcaagctgggtaa

SEQ ID NO: 3511389 - DNA, 10 bp, Homo sapiens
gcaaggaaag

SEQ ID NO: 3511390 - DNA, 23 bp, Homo sapiens
gcaaggcggtggacttgaacttt

SEQ ID NO: 3511391 - DNA, 12 bp, Homo sapiens
gcaagggactgt

SEQ ID NO: 3511392 - DNA, 18 bp, Homo sapiens
gcaagggttaaggcctga

SEQ ID NO: 3511393 - DNA, 18 bp, Homo sapiens
gcaagggttccctcaaga

SEQ ID NO: 3511394 - DNA, 23 bp, Homo sapiens
gcaaggtttaggctggtggccca

SEQ ID NO: 3511395 - DNA, 15 bp, Homo sapiens
gcaagtccttttgta

SEQ ID NO: 3511396 - DNA, 17 bp, Homo sapiens
gcaagtccttttgtaaa

SEQ ID NO: 3511397 - DNA, 18 bp, Homo sapiens
gcaagtctgagggtctgg

SEQ ID NO: 3511398 - DNA, 21 bp, Homo sapiens
gcaagtctttaggtctttgta

SEQ ID NO: 3511399 - DNA, 18 bp, Homo sapiens
gcaagtgaaggtttacaa

SEQ ID NO: 3511400 - DNA, 15 bp, Homo sapiens
gcaagtgctcaggga

SEQ ID NO: 3511401 - DNA, 21 bp, Homo sapiens
gcaagtgctcagggaaatggc

SEQ ID NO: 3511402 - DNA, 18 bp, Homo sapiens
gcaataaatctgacccag

SEQ ID NO: 3511403 - DNA, 19 bp, Homo sapiens
gcaataaatctgacccagt

SEQ ID NO: 3511404 - DNA, 21 bp, Homo sapiens
gcaataaatctgacccagtgc

SEQ ID NO: 3511405 - DNA, 13 bp, Homo sapiens
gcaataatgcagt

SEQ ID NO: 3511406 - DNA, 15 bp, Homo sapiens
gcaatgccatcatct

SEQ ID NO: 3511407 - DNA, 19 bp, Homo sapiens
gcaatgccatcatctcctg

SEQ ID NO: 3511408 - DNA, 22 bp, Homo sapiens
gcaatgctggctgttggctggg

SEQ ID NO: 3511409 - DNA, 15 bp, Homo sapiens
gcaatggcagccttg

SEQ ID NO: 3511410 - DNA, 19 bp, Homo sapiens
gcaatgggagctgaggcca

SEQ ID NO: 3511411 - DNA, 15 bp, Homo sapiens
gcaattccagaaatc

SEQ ID NO: 3511412 - DNA, 17 bp, Homo sapiens
gcaattccgcatttaat

SEQ ID NO: 3511413 - DNA, 20 bp, Homo sapiens
gcacaaaatgatggcagtgg

SEQ ID NO: 3511414 - DNA, 14 bp, Homo sapiens
gcacaagctgcacc

SEQ ID NO: 3511415 - DNA, 15 bp, Homo sapiens
gcacaatagtaacct

SEQ ID NO: 3511416 - DNA, 22 bp, Homo sapiens
gcacacaccaccacgcctggct

SEQ ID NO: 3511417 - DNA, 15 bp, Homo sapiens
gcacacaccagagcc

SEQ ID NO: 3511418 - DNA, 16 bp, Homo sapiens
gcacacaccagagccc

SEQ ID NO: 3511419 - DNA, 17 bp, Homo sapiens
gcacacaccagagccca

SEQ ID NO: 3511420 - DNA, 18 bp, Homo sapiens
gcacacagctactctccc

SEQ ID NO: 3511421 - DNA, 18 bp, Homo sapiens
gcacacccactcagctcc

SEQ ID NO: 3511422 - DNA, 14 bp, Homo sapiens
gcacaccgggcact

SEQ ID NO: 3511423 - DNA, 17 bp, Homo sapiens
gcacacgcctcccactg

SEQ ID NO: 3511424 - DNA, 19 bp, Homo sapiens
gcacacgcctcccactggg

SEQ ID NO: 3511425 - DNA, 13 bp, Homo sapiens
gcacactttgcca

SEQ ID NO: 3511426 - DNA, 14 bp, Homo sapiens
gcacactttgccat

SEQ ID NO: 3511427 - DNA, 13 bp, Homo sapiens
gcacagaagtcct

SEQ ID NO: 3511428 - DNA, 15 bp, Homo sapiens
gcacagcagcctggg

SEQ ID NO: 3511429 - DNA, 23 bp, Homo sapiens
gcagcctgcgccaccgcccagag

SEQ ID NO: 3511430 - DNA, 10 bp, Homo sapiens
gcagcctggg

SEQ ID NO: 3511431 - DNA, 20 bp, Homo sapiens
gcagccttgaactctgggct

SEQ ID NO: 3511432 - DNA, 15 bp, Homo sapiens
gcagcctttaatgca

SEQ ID NO: 3511433 - DNA, 17 bp, Homo sapiens
gcagcctttgcctcccc

SEQ ID NO: 3511434 - DNA, 15 bp, Homo sapiens
gcagcgaccccagga

SEQ ID NO: 3511435 - DNA, 21 bp, Homo sapiens
gcagcgagggcggagccggcc

SEQ ID NO: 3511436 - DNA, 13 bp, Homo sapiens
gcagcgccaggct

SEQ ID NO: 3511437 - DNA, 13 bp, Homo sapiens
gcagcgcctttcc

SEQ ID NO: 3511438 - DNA, 15 bp, Homo sapiens
gcagcgcctttccca

SEQ ID NO: 3511439 - DNA, 16 bp, Homo sapiens
gcagctcaagagatcc

SEQ ID NO: 3511440 - DNA, 18 bp, Homo sapiens
gcagctcaagagatccca

SEQ ID NO: 3511441 - DNA, 19 bp, Homo sapiens
gcagctcatctctgtccca

SEQ ID NO: 3511442 - DNA, 21 bp, Homo sapiens
gcagctcatctctgtcccact

SEQ ID NO: 3511443 - DNA, 20 bp, Homo sapiens
gcagctctggacagccccac

SEQ ID NO: 3511444 - DNA, 18 bp, Homo sapiens
gcagctgaaatatgctgg

SEQ ID NO: 3511445 - DNA, 19 bp, Homo sapiens
gcagctgaaatatgctggc

SEQ ID NO: 3511446 - DNA, 22 bp, Homo sapiens
gcagctgaaatatgctggctgg

SEQ ID NO: 3511447 - DNA, 11 bp, Homo sapiens
gcagctgagca

SEQ ID NO: 3511448 - DNA, 17 bp, Homo sapiens
gcagctgcggtccaccc

SEQ ID NO: 3511449 - DNA, 20 bp, Homo sapiens
gcagctgcttttgtctatgg

SEQ ID NO: 3511450 - DNA, 23 bp, Homo sapiens
gcagcttgagagggcaaacccaa

SEQ ID NO: 3511451 - DNA, 21 bp, Homo sapiens
gcagcttgagggttgggctgg

SEQ ID NO: 3511452 - DNA, 21 bp, Homo sapiens
gcaggaaatgaaaatgtcttg

SEQ ID NO: 3511453 - DNA, 23 bp, Homo sapiens
gcaggaaatgaaaatgtcttgtg

SEQ ID NO: 3511454 - DNA, 16 bp, Homo sapiens
gcaggaagctgctccg

SEQ ID NO: 3511455 - DNA, 13 bp, Homo sapiens
gcaggaatgaaaa

SEQ ID NO: 3511456 - DNA, 12 bp, Homo sapiens
gcaggacctctg

SEQ ID NO: 3511457 - DNA, 16 bp, Homo sapiens
gcaggacctgcctgta

SEQ ID NO: 3511458 - DNA, 20 bp, Homo sapiens
gcaggacctgcctgtagccc

SEQ ID NO: 3511459 - DNA, 22 bp, Homo sapiens
gcaggactccaggcccaaggct

SEQ ID NO: 3511460 - DNA, 20 bp, Homo sapiens
gcaggactgcagagcagatg

SEQ ID NO: 3511461 - DNA, 16 bp, Homo sapiens
gcaggagcacacccag

SEQ ID NO: 3511462 - DNA, 20 bp, Homo sapiens
gcaggagcacacccagcccc

SEQ ID NO: 3511463 - DNA, 20 bp, Homo sapiens
gcaggaggatcacttgagtc

SEQ ID NO: 3511464 - DNA, 16 bp, Homo sapiens
gcaggaggccaggccg

SEQ ID NO: 3511465 - DNA, 16 bp, Homo sapiens
gcaggatggcctggcc

SEQ ID NO: 3511466 - DNA, 24 bp, Homo sapiens
gcaggatggcctggccagggcctg

SEQ ID NO: 3511467 - DNA, 16 bp, Homo sapiens
gcaggatttgttctct

SEQ ID NO: 3511468 - DNA, 17 bp, Homo sapiens
gcaggatttgttctctg

SEQ ID NO: 3511469 - DNA, 10 bp, Homo sapiens
gcaggcagac

SEQ ID NO: 3511470 - DNA, 11 bp, Homo sapiens
gcaggcagaca

SEQ ID NO: 3511471 - DNA, 12 bp, Homo sapiens
gcaggcagacac

SEQ ID NO: 3511472 - DNA, 16 bp, Homo sapiens
gcaggccaggccagct

SEQ ID NO: 3511473 - DNA, 16 bp, Homo sapiens
gcaggcccctctcctc

SEQ ID NO: 3511474 - DNA, 17 bp, Homo sapiens
gcaggcccctctcctcc

SEQ ID NO: 3511475 - DNA, 23 bp, Homo sapiens
gcaggcccctctcctccgtggca

SEQ ID NO: 3511476 - DNA, 20 bp, Homo sapiens
gcaggctaaggcgtggagct

SEQ ID NO: 3511477 - DNA, 21 bp, Homo sapiens
gcaggctaaggcgtggagctg

SEQ ID NO: 3511478 - DNA, 14 bp, Homo sapiens
gcaggctcccaggg

SEQ ID NO: 3511479 - DNA, 22 bp, Homo sapiens
gcaggctcccagggacacctgg

SEQ ID NO: 3511480 - DNA, 17 bp, Homo sapiens
gcaggctgtctggccag

SEQ ID NO: 3511481 - DNA, 13 bp, Homo sapiens
gcagggaaacagc

SEQ ID NO: 3511482 - DNA, 14 bp, Homo sapiens
gcagggagggcagt

SEQ ID NO: 3511483 - DNA, 16 bp, Homo sapiens
gcagggagggcttctg

SEQ ID NO: 3511484 - DNA, 19 bp, Homo sapiens
gcagggctcagcggggaca

SEQ ID NO: 3511485 - DNA, 13 bp, Homo sapiens
gcagggctgtgct

SEQ ID NO: 3511486 - DNA, 22 bp, Homo sapiens
gcaggggtctgggagtcaggcc

SEQ ID NO: 3511487 - DNA, 16 bp, Homo sapiens
gcagggtctcactctg

SEQ ID NO: 3511488 - DNA, 14 bp, Homo sapiens
gcagggtctgggca

SEQ ID NO: 3511489 - DNA, 19 bp, Homo sapiens
gcagggttcaagccttcca

SEQ ID NO: 3511490 - DNA, 17 bp, Homo sapiens
gcaggtagcctgctggt

SEQ ID NO: 3511491 - DNA, 20 bp, Homo sapiens
gcaggtcttgaactcctggc

SEQ ID NO: 3511492 - DNA, 16 bp, Homo sapiens
gcaggtgaaacccagt

SEQ ID NO: 3511493 - DNA, 17 bp, Homo sapiens
gcaggtgagcagacagg

SEQ ID NO: 3511494 - DNA, 17 bp, Homo sapiens
gcaggtgctggtcccgg

SEQ ID NO: 3511495 - DNA, 19 bp, Homo sapiens
gcaggttctgcctgctttg

SEQ ID NO: 3511496 - DNA, 19 bp, Homo sapiens
gcagtagaaataatatgca

SEQ ID NO: 3511497 - DNA, 20 bp, Homo sapiens
gcagtagaaataatatgcat

SEQ ID NO: 3511498 - DNA, 21 bp, Homo sapiens
gcagtagaaataatatgcatt

SEQ ID NO: 3511499 - DNA, 20 bp, Homo sapiens
gcagtaggccggtgtgcctg

SEQ ID NO: 3511500 - DNA, 12 bp, Homo sapiens
gcagtatatttc

SEQ ID NO: 3511501 - DNA, 13 bp, Homo sapiens
gcagtatggtaca

SEQ ID NO: 3511502 - DNA, 16 bp, Homo sapiens
gcagtattttgtgtcc

SEQ ID NO: 3511503 - DNA, 17 bp, Homo sapiens
gcagtattttgtgtcct

SEQ ID NO: 3511504 - DNA, 23 bp, Homo sapiens
gcagtattttgtgtcctccagga

SEQ ID NO: 3511505 - DNA, 19 bp, Homo sapiens
gcagtcaacagttcaaaga

SEQ ID NO: 3511506 - DNA, 17 bp, Homo sapiens
gcagtcacatctcttcc

SEQ ID NO: 3511507 - DNA, 19 bp, Homo sapiens
gcagtcattatccaggtaa

SEQ ID NO: 3511508 - DNA, 13 bp, Homo sapiens
gcagtccagccag

SEQ ID NO: 3511509 - DNA, 19 bp, Homo sapiens
gcagtcctgatcagagccg

SEQ ID NO: 3511510 - DNA, 16 bp, Homo sapiens
gcagtcgtgcctgtgt

SEQ ID NO: 3511511 - DNA, 19 bp, Homo sapiens
gcagtggcgcattctaggc

SEQ ID NO: 3511512 - DNA, 13 bp, Homo sapiens
gcagtgggagctg

SEQ ID NO: 3511513 - DNA, 15 bp, Homo sapiens
gcagtgggagctgcc

SEQ ID NO: 3511514 - DNA, 14 bp, Homo sapiens
gcagtggtgcgatc

SEQ ID NO: 3511515 - DNA, 16 bp, Homo sapiens
gcagtggtgcgatctc

SEQ ID NO: 3511516 - DNA, 19 bp, Homo sapiens
gcagtggtgcgatctgggt

SEQ ID NO: 3511517 - DNA, 21 bp, Homo sapiens
gcagtggtgcgatctgggttc

SEQ ID NO: 3511518 - DNA, 22 bp, Homo sapiens
gcagtggtgcgatctgggttca

SEQ ID NO: 3511519 - DNA, 18 bp, Homo sapiens
gcagtggtgtggagaagc

SEQ ID NO: 3511520 - DNA, 13 bp, Homo sapiens
gcagtgtgccccc

SEQ ID NO: 3511521 - DNA, 19 bp, Homo sapiens
gcagttcatccgcactgta

SEQ ID NO: 3511522 - DNA, 21 bp, Homo sapiens
gcagtttcagagatggacaga

SEQ ID NO: 3511523 - DNA, 11 bp, Homo sapiens
gcagtttgaaa

SEQ ID NO: 3511524 - DNA, 17 bp, Homo sapiens
gcagtttgaaattctga

SEQ ID NO: 3511525 - DNA, 16 bp, Homo sapiens
gcataaaaacatttta

SEQ ID NO: 3511526 - DNA, 15 bp, Homo sapiens
gcataaaaattagcc

SEQ ID NO: 3511527 - DNA, 16 bp, Homo sapiens
gcataacaattcctct

SEQ ID NO: 3511528 - DNA, 15 bp, Homo sapiens
gcatactttgtaaat

SEQ ID NO: 3511529 - DNA, 16 bp, Homo sapiens
gcatactttgtaaata

SEQ ID NO: 3511530 - DNA, 13 bp, Homo sapiens
gcatagaagtaaa

SEQ ID NO: 3511531 - DNA, 19 bp, Homo sapiens
gcataggacctttccacca

SEQ ID NO: 3511532 - DNA, 16 bp, Homo sapiens
gcatatacaataatgt

SEQ ID NO: 3511533 - DNA, 21 bp, Homo sapiens
gcatatctgcctttattgtgt

SEQ ID NO: 3511534 - DNA, 12 bp, Homo sapiens
gcatatgttgaa

SEQ ID NO: 3511535 - DNA, 23 bp, Homo sapiens
gcatatttatccaaaatgtgtat

SEQ ID NO: 3511536 - DNA, 17 bp, Homo sapiens
gcatcagctggcgtcat

SEQ ID NO: 3511537 - DNA, 21 bp, Homo sapiens
gcatcagctggcgtcatgcaa

SEQ ID NO: 3511538 - DNA, 12 bp, Homo sapiens
gcatcagggtta

SEQ ID NO: 3511539 - DNA, 23 bp, Homo sapiens
gcatccacttctttcagcagact

SEQ ID NO: 3511540 - DNA, 21 bp, Homo sapiens
gcatccctaccgacccagggt

SEQ ID NO: 3511541 - DNA, 20 bp, Homo sapiens
gcatcccttgaccaggcctg

SEQ ID NO: 3511542 - DNA, 22 bp, Homo sapiens
gcatcccttgaccaggcctggg

SEQ ID NO: 3511543 - DNA, 17 bp, Homo sapiens
gcatccgcaggtgctgg

SEQ ID NO: 3511544 - DNA, 18 bp, Homo sapiens
gcatccgcaggtgctggt

SEQ ID NO: 3511545 - DNA, 16 bp, Homo sapiens
gcatcctctgactcca

SEQ ID NO: 3511546 - DNA, 23 bp, Homo sapiens
gcatcctggcacccggcccctgc

SEQ ID NO: 3511547 - DNA, 23 bp, Homo sapiens
gcatctattctttgtaccatctg

SEQ ID NO: 3511548 - DNA, 14 bp, Homo sapiens
gcatctcaatggaa

SEQ ID NO: 3511549 - DNA, 12 bp, Homo sapiens
gcatctcccaga

SEQ ID NO: 3511550 - DNA, 13 bp, Homo sapiens
gcatctcccagat

SEQ ID NO: 3511551 - DNA, 21 bp, Homo sapiens
gcatctcccagataatgtgaa

SEQ ID NO: 3511552 - DNA, 17 bp, Homo sapiens
gcatctgaccagcagcg

SEQ ID NO: 3511553 - DNA, 12 bp, Homo sapiens
gcatctgtacaa

SEQ ID NO: 3511554 - DNA, 15 bp, Homo sapiens
gcatctgtacaaagg

SEQ ID NO: 3511555 - DNA, 13 bp, Homo sapiens
gcatctgtataag

SEQ ID NO: 3511556 - DNA, 15 bp, Homo sapiens
gcatcttactgaagg

SEQ ID NO: 3511557 - DNA, 15 bp, Homo sapiens
gcatcttgctggcta

SEQ ID NO: 3511558 - DNA, 22 bp, Homo sapiens
gcatcttgggggggtggccgct

SEQ ID NO: 3511559 - DNA, 18 bp, Homo sapiens
gcatctttttttcatttt

SEQ ID NO: 3511560 - DNA, 15 bp, Homo sapiens
gcatgacagcctgca

SEQ ID NO: 3511561 - DNA, 17 bp, Homo sapiens
gatgggcctttgagcct

SEQ ID NO: 3511562 - DNA, 13 bp, Homo sapiens
gatggggaaggag

SEQ ID NO: 3511563 - DNA, 21 bp, Homo sapiens
gatgggggaaagcacaggtgg

SEQ ID NO: 3511564 - DNA, 20 bp, Homo sapiens
gatgggggaactcagatcca

SEQ ID NO: 3511565 - DNA, 21 bp, Homo sapiens
gatgggggagtctgaagcaga

SEQ ID NO: 3511566 - DNA, 21 bp, Homo sapiens
gatggtcatcgagatggagct

SEQ ID NO: 3511567 - DNA, 13 bp, Homo sapiens
gatggtctggtct

SEQ ID NO: 3511568 - DNA, 13 bp, Homo sapiens
gatggtgggatgt

SEQ ID NO: 3511569 - DNA, 17 bp, Homo sapiens
gatggtgtgggtgtcct

SEQ ID NO: 3511570 - DNA, 12 bp, Homo sapiens
gatggttgtgta

SEQ ID NO: 3511571 - DNA, 18 bp, Homo sapiens
gatgtaaggccttagcca

SEQ ID NO: 3511572 - DNA, 15 bp, Homo sapiens
gatgtacatttccaa

SEQ ID NO: 3511573 - DNA, 14 bp, Homo sapiens
gatgtatattcctt

SEQ ID NO: 3511574 - DNA, 15 bp, Homo sapiens
gatgtcaatttctgt

SEQ ID NO: 3511575 - DNA, 18 bp, Homo sapiens
gatgtcaatttctgtgtt

SEQ ID NO: 3511576 - DNA, 15 bp, Homo sapiens
gatgtccagagctgg

SEQ ID NO: 3511577 - DNA, 15 bp, Homo sapiens
gatgtgattgtggaa

SEQ ID NO: 3511578 - DNA, 16 bp, Homo sapiens
gatgtgattgtggaat

SEQ ID NO: 3511579 - DNA, 14 bp, Homo sapiens
gatgtgtttgcttt

SEQ ID NO: 3511580 - DNA, 19 bp, Homo sapiens
gatgttctaagtctttcca

SEQ ID NO: 3511581 - DNA, 14 bp, Homo sapiens
gatgttggctggga

SEQ ID NO: 3511582 - DNA, 13 bp, Homo sapiens
gatgtttccagac

SEQ ID NO: 3511583 - DNA, 19 bp, Homo sapiens
gatgtttccagacttcctt

SEQ ID NO: 3511584 - DNA, 14 bp, Homo sapiens
gattaaaaattata

SEQ ID NO: 3511585 - DNA, 18 bp, Homo sapiens
gattaaccacttcagctg

SEQ ID NO: 3511586 - DNA, 22 bp, Homo sapiens
gattaagagatgggtttgacaa

SEQ ID NO: 3511587 - DNA, 18 bp, Homo sapiens
gattaagatgccttgaat

SEQ ID NO: 3511588 - DNA, 18 bp, Homo sapiens
gattaatatgaaaactta

SEQ ID NO: 3511589 - DNA, 22 bp, Homo sapiens
gattacaagcgtgagccactgc

SEQ ID NO: 3511590 - DNA, 23 bp, Homo sapiens
gattacaagcgtgagccactgca

SEQ ID NO: 3511591 - DNA, 13 bp, Homo sapiens
gattacctcctga

SEQ ID NO: 3511592 - DNA, 14 bp, Homo sapiens
gattacctcctgag

SEQ ID NO: 3511593 - DNA, 20 bp, Homo sapiens
gattacttctctataaaaaa

SEQ ID NO: 3511594 - DNA, 19 bp, Homo sapiens
gattaggtatgtttgtaac

SEQ ID NO: 3511595 - DNA, 20 bp, Homo sapiens
gattaggtttcagcagagct

SEQ ID NO: 3511596 - DNA, 14 bp, Homo sapiens
gattatggagcttt

SEQ ID NO: 3511597 - DNA, 13 bp, Homo sapiens
gattattcagtgt

SEQ ID NO: 3511598 - DNA, 13 bp, Homo sapiens
gattattgaaata

SEQ ID NO: 3511599 - DNA, 18 bp, Homo sapiens
gattcaaaatatttaaaa

SEQ ID NO: 3511600 - DNA, 22 bp, Homo sapiens
gattcaaaatatttaaaaatgt

SEQ ID NO: 3511601 - DNA, 12 bp, Homo sapiens
gattcacactgt

SEQ ID NO: 3511602 - DNA, 14 bp, Homo sapiens
gattcacctgagca

SEQ ID NO: 3511603 - DNA, 20 bp, Homo sapiens
gattcaggtgcagaggaagt

SEQ ID NO: 3511604 - DNA, 18 bp, Homo sapiens
gattccaaagagtagaat

SEQ ID NO: 3511605 - DNA, 23 bp, Homo sapiens
gattccaggaggagttagccaaa

SEQ ID NO: 3511606 - DNA, 17 bp, Homo sapiens
gattcccaagctctgct

SEQ ID NO: 3511607 - DNA, 23 bp, Homo sapiens
gattcccactgccgctgcccgct

SEQ ID NO: 3511608 - DNA, 14 bp, Homo sapiens
gattcccctgtgtc

SEQ ID NO: 3511609 - DNA, 15 bp, Homo sapiens
gattcctgagccagt

SEQ ID NO: 3511610 - DNA, 13 bp, Homo sapiens
gattccttcctgt

SEQ ID NO: 3511611 - DNA, 15 bp, Homo sapiens
gattccttcctgttc

SEQ ID NO: 3511612 - DNA, 22 bp, Homo sapiens
gattctcagggtctctgctgcc

SEQ ID NO: 3511613 - DNA, 23 bp, Homo sapiens
gattctcagggtctctgctgccg

SEQ ID NO: 3511614 - DNA, 13 bp, Homo sapiens
gattctccctggg

SEQ ID NO: 3511615 - DNA, 14 bp, Homo sapiens
gattctcctgcctc

SEQ ID NO: 3511616 - DNA, 19 bp, Homo sapiens
gattctcctgcctcagcct

SEQ ID NO: 3511617 - DNA, 14 bp, Homo sapiens
gatacttaacaaat

SEQ ID NO: 3511618 - DNA, 18 bp, Homo sapiens
gatacttaacaaatacat

SEQ ID NO: 3511619 - DNA, 17 bp, Homo sapiens
gatagatgctggcccag

SEQ ID NO: 3511620 - DNA, 18 bp, Homo sapiens
gatagatgctggcccagg

SEQ ID NO: 3511621 - DNA, 20 bp, Homo sapiens
gatagctaactgtaaatcat

SEQ ID NO: 3511622 - DNA, 23 bp, Homo sapiens
gatagcttcaccccaatcccagc

SEQ ID NO: 3511623 - DNA, 23 bp, Homo sapiens
gatagtcttttgcttttggcaaa

SEQ ID NO: 3511624 - DNA, 16 bp, Homo sapiens
gatatagaacagtgct

SEQ ID NO: 3511625 - DNA, 22 bp, Homo sapiens
gatatatgtgtttttcacattt

SEQ ID NO: 3511626 - DNA, 13 bp, Homo sapiens
gatatattaaaaa

SEQ ID NO: 3511627 - DNA, 20 bp, Homo sapiens
gatatattaaaaatataaaa

SEQ ID NO: 3511628 - DNA, 19 bp, Homo sapiens
gatatatttaaaaatattt

SEQ ID NO: 3511629 - DNA, 13 bp, Homo sapiens
gatatcagaattt

SEQ ID NO: 3511630 - DNA, 17 bp, Homo sapiens
gatatcagaatttgtgt

SEQ ID NO: 3511631 - DNA, 19 bp, Homo sapiens
gatatccattctttctgat

SEQ ID NO: 3511632 - DNA, 15 bp, Homo sapiens
gatatgtttttattt

SEQ ID NO: 3511633 - DNA, 19 bp, Homo sapiens
gatattatgtataaaatgt

SEQ ID NO: 3511634 - DNA, 17 bp, Homo sapiens
gatattccaaaataaaa

SEQ ID NO: 3511635 - DNA, 14 bp, Homo sapiens
gatcaacatctttt

SEQ ID NO: 3511636 - DNA, 17 bp, Homo sapiens
gatcaacatcttttctt

SEQ ID NO: 3511637 - DNA, 20 bp, Homo sapiens
gatcaacatcttttcttgcc

SEQ ID NO: 3511638 - DNA, 16 bp, Homo sapiens
gatcaaggagaggagg

SEQ ID NO: 3511639 - DNA, 21 bp, Homo sapiens
gatcacaacgtgcattgtgct

SEQ ID NO: 3511640 - DNA, 22 bp, Homo sapiens
gatcacaacgtgcattgtgctt

SEQ ID NO: 3511641 - DNA, 16 bp, Homo sapiens
gatcacatattctagt

SEQ ID NO: 3511642 - DNA, 15 bp, Homo sapiens
gatcacgccactgca

SEQ ID NO: 3511643 - DNA, 18 bp, Homo sapiens
gatcacgccactgcacta

SEQ ID NO: 3511644 - DNA, 16 bp, Homo sapiens
gatcacggctcactgc

SEQ ID NO: 3511645 - DNA, 18 bp, Homo sapiens
gatcacggctcactgcag

SEQ ID NO: 3511646 - DNA, 22 bp, Homo sapiens
gatcagaaaaatggagcaaagt

SEQ ID NO: 3511647 - DNA, 23 bp, Homo sapiens
gatcagattgcatgtgactctga

SEQ ID NO: 3511648 - DNA, 12 bp, Homo sapiens
gatcagcctggg

SEQ ID NO: 3511649 - DNA, 17 bp, Homo sapiens
gatcagggcattgcctg

SEQ ID NO: 3511650 - DNA, 22 bp, Homo sapiens
gatcagtctgattcccaagctc

SEQ ID NO: 3511651 - DNA, 19 bp, Homo sapiens
gatcatccactgtgccatg

SEQ ID NO: 3511652 - DNA, 21 bp, Homo sapiens
gatcatcgccagaggtgcttc

SEQ ID NO: 3511653 - DNA, 19 bp, Homo sapiens
gatcatgaaagtagacagt

SEQ ID NO: 3511654 - DNA, 18 bp, Homo sapiens
gatcatgttttggtgaaa

SEQ ID NO: 3511655 - DNA, 23 bp, Homo sapiens
gatccaaaagaagcccccagcta

SEQ ID NO: 3511656 - DNA, 16 bp, Homo sapiens
gatccaagctggtccc

SEQ ID NO: 3511657 - DNA, 14 bp, Homo sapiens
gatccacctgtctc

SEQ ID NO: 3511658 - DNA, 15 bp, Homo sapiens
gatccagggacagag

SEQ ID NO: 3511659 - DNA, 18 bp, Homo sapiens
gatccagggacagaggcc

SEQ ID NO: 3511660 - DNA, 15 bp, Homo sapiens
gatcccaggcccctg

SEQ ID NO: 3511661 - DNA, 18 bp, Homo sapiens
gatcccaggcccctggag

SEQ ID NO: 3511662 - DNA, 19 bp, Homo sapiens
gatccctcccccccatgca

SEQ ID NO: 3511663 - DNA, 14 bp, Homo sapiens
gatccgactgcttt

SEQ ID NO: 3511664 - DNA, 17 bp, Homo sapiens
gatccgactgctttgga

SEQ ID NO: 3511665 - DNA, 15 bp, Homo sapiens
gatccgtttgaccaa

SEQ ID NO: 3511666 - DNA, 16 bp, Homo sapiens
gatccgtttgaccaat

SEQ ID NO: 3511667 - DNA, 16 bp, Homo sapiens
gatcctcctgcagacc

SEQ ID NO: 3511668 - DNA, 22 bp, Homo sapiens
gatcctcctgcagaccacgccc

SEQ ID NO: 3511669 - DNA, 15 bp, Homo sapiens
gatcctggaggccca

SEQ ID NO: 3511670 - DNA, 20 bp, Homo sapiens
gatcctgtattcagacagat

SEQ ID NO: 3511671 - DNA, 23 bp, Homo sapiens
gatcctgtgaggagccccatctg

SEQ ID NO: 3511672 - DNA, 20 bp, Homo sapiens
gatcgcaagagccatgtaga

SEQ ID NO: 3511673 - DNA, 14 bp, Homo sapiens
gatcgcatttccta

SEQ ID NO: 3511674 - DNA, 21 bp, Homo sapiens
gatcgcggcggagctggcccc

SEQ ID NO: 3511675 - DNA, 14 bp, Homo sapiens
gatctaaggctgtt

SEQ ID NO: 3511676 - DNA, 15 bp, Homo sapiens
gatctcactctgccc

SEQ ID NO: 3511677 - DNA, 12 bp, Homo sapiens
gatctcaggagc

SEQ ID NO: 3511678 - DNA, 13 bp, Homo sapiens
gatctcaggagct

SEQ ID NO: 3511679 - DNA, 12 bp, Homo sapiens
gatctcttgagc

SEQ ID NO: 3511680 - DNA, 22 bp, Homo sapiens
ggatttgcacagaagcacatgc

SEQ ID NO: 3511681 - DNA, 23 bp, Homo sapiens
ggatttgcctcaccttggggcct

SEQ ID NO: 3511682 - DNA, 14 bp, Homo sapiens
ggatttgttctctg

SEQ ID NO: 3511683 - DNA, 15 bp, Homo sapiens
ggatttgttctctgt

SEQ ID NO: 3511684 - DNA, 16 bp, Homo sapiens
ggattttgtcaagcag

SEQ ID NO: 3511685 - DNA, 13 bp, Homo sapiens
ggatttttgagtc

SEQ ID NO: 3511686 - DNA, 15 bp, Homo sapiens
ggcaaaaaggcagga

SEQ ID NO: 3511687 - DNA, 18 bp, Homo sapiens
ggcaaaattgtgaagcta

SEQ ID NO: 3511688 - DNA, 16 bp, Homo sapiens
ggcaaaggaaggtgga

SEQ ID NO: 3511689 - DNA, 13 bp, Homo sapiens
ggcaaatgcccaa

SEQ ID NO: 3511690 - DNA, 16 bp, Homo sapiens
ggcaaatgcccaaggg

SEQ ID NO: 3511691 - DNA, 14 bp, Homo sapiens
ggcaacacagaggc

SEQ ID NO: 3511692 - DNA, 16 bp, Homo sapiens
ggcaaccactaagaat

SEQ ID NO: 3511693 - DNA, 17 bp, Homo sapiens
ggcaacccccagcctgc

SEQ ID NO: 3511694 - DNA, 19 bp, Homo sapiens
ggcaacccccagcctgcta

SEQ ID NO: 3511695 - DNA, 22 bp, Homo sapiens
ggcaactttccttgttccccat

SEQ ID NO: 3511696 - DNA, 23 bp, Homo sapiens
ggcaagagaatcgcttgaaccca

SEQ ID NO: 3511697 - DNA, 14 bp, Homo sapiens
ggcaaggctgtgct

SEQ ID NO: 3511698 - DNA, 14 bp, Homo sapiens
ggcaatgctggctg

SEQ ID NO: 3511699 - DNA, 19 bp, Homo sapiens
ggcaattctcctgcctttg

SEQ ID NO: 3511700 - DNA, 12 bp, Homo sapiens
ggcacacgcctc

SEQ ID NO: 3511701 - DNA, 15 bp, Homo sapiens
ggcacacgcctccca

SEQ ID NO: 3511702 - DNA, 17 bp, Homo sapiens
ggcacacgcctcccact

SEQ ID NO: 3511703 - DNA, 19 bp, Homo sapiens
ggcacacgcctcccactgg

SEQ ID NO: 3511704 - DNA, 13 bp, Homo sapiens
ggcacagatgcct

SEQ ID NO: 3511705 - DNA, 22 bp, Homo sapiens
ggcacagcatctgtagtcagcc

SEQ ID NO: 3511706 - DNA, 20 bp, Homo sapiens
ggcacagcggagtctgtcct

SEQ ID NO: 3511707 - DNA, 13 bp, Homo sapiens
ggcacagctggga

SEQ ID NO: 3511708 - DNA, 14 bp, Homo sapiens
ggcacagctgggat

SEQ ID NO: 3511709 - DNA, 17 bp, Homo sapiens
ggcacagtatgtcccat

SEQ ID NO: 3511710 - DNA, 17 bp, Homo sapiens
ggcaccagacacccagg

SEQ ID NO: 3511711 - DNA, 16 bp, Homo sapiens
ggcaccagcagcctgg

SEQ ID NO: 3511712 - DNA, 17 bp, Homo sapiens
ggcaccagcagcctgga

SEQ ID NO: 3511713 - DNA, 17 bp, Homo sapiens
ggcaccaggggtttctc

SEQ ID NO: 3511714 - DNA, 18 bp, Homo sapiens
ggcaccagtccctgtccg

SEQ ID NO: 3511715 - DNA, 12 bp, Homo sapiens
ggagcctggtgc

SEQ ID NO: 3511716 - DNA, 20 bp, Homo sapiens
ggagcggccggccagcccct

SEQ ID NO: 3511717 - DNA, 14 bp, Homo sapiens
ggagctcagagagg

SEQ ID NO: 3511718 - DNA, 17 bp, Homo sapiens
ggagctccactctgctt

SEQ ID NO: 3511719 - DNA, 15 bp, Homo sapiens
ggagctgcccctctc

SEQ ID NO: 3511720 - DNA, 18 bp, Homo sapiens
ggagctgctatagcctgg

SEQ ID NO: 3511721 - DNA, 19 bp, Homo sapiens
ggagctgctatagcctggg

SEQ ID NO: 3511722 - DNA, 16 bp, Homo sapiens
ggagctggccccgccg

SEQ ID NO: 3511723 - DNA, 20 bp, Homo sapiens
ggagctggccccgccgcctg

SEQ ID NO: 3511724 - DNA, 21 bp, Homo sapiens
ggagctggcggggaaccctgg

SEQ ID NO: 3511725 - DNA, 19 bp, Homo sapiens
ggagctgtcaccaaggaaa

SEQ ID NO: 3511726 - DNA, 20 bp, Homo sapiens
ggagctgttctctgtcgtga

SEQ ID NO: 3511727 - DNA, 16 bp, Homo sapiens
ggagcttttggtgaga

SEQ ID NO: 3511728 - DNA, 21 bp, Homo sapiens
ggagcttttggtgagaaggtg

SEQ ID NO: 3511729 - DNA, 21 bp, Homo sapiens
ggagcttttttccttaatcca

SEQ ID NO: 3511730 - DNA, 12 bp, Homo sapiens
ggaggaagagaa

SEQ ID NO: 3511731 - DNA, 22 bp, Homo sapiens
ggaggacaggcgggaggaggtg

SEQ ID NO: 3511732 - DNA, 22 bp, Homo sapiens
ggaggacagtgggaactggagg

SEQ ID NO: 3511733 - DNA, 17 bp, Homo sapiens
ggaggaccacaggtgtg

SEQ ID NO: 3511734 - DNA, 20 bp, Homo sapiens
ggaggaccacaggtgtgagc

SEQ ID NO: 3511735 - DNA, 23 bp, Homo sapiens
ggaggagcccctggacatgcctg

SEQ ID NO: 3511736 - DNA, 15 bp, Homo sapiens
ggaggagggttgtgc

SEQ ID NO: 3511737 - DNA, 15 bp, Homo sapiens
ggaggatattaaaat

SEQ ID NO: 3511738 - DNA, 20 bp, Homo sapiens
ggaggatcttttgaacccag

SEQ ID NO: 3511739 - DNA, 16 bp, Homo sapiens
ggaggatgtaaggcct

SEQ ID NO: 3511740 - DNA, 17 bp, Homo sapiens
ggaagtaacttttttcc

SEQ ID NO: 3511741 - DNA, 15 bp, Homo sapiens
ggaagtccaatgtgg

SEQ ID NO: 3511742 - DNA, 23 bp, Homo sapiens
ggaagtccccaggccccaggaag

SEQ ID NO: 3511743 - DNA, 14 bp, Homo sapiens
ggaagtcctctggg

SEQ ID NO: 3511744 - DNA, 12 bp, Homo sapiens
ggaatacttttt

SEQ ID NO: 3511745 - DNA, 17 bp, Homo sapiens
ggaatactttttgttat

SEQ ID NO: 3511746 - DNA, 18 bp, Homo sapiens
ggaatatatgtgtgccta

SEQ ID NO: 3511747 - DNA, 16 bp, Homo sapiens
ggaatcagcaagaaga

SEQ ID NO: 3511748 - DNA, 14 bp, Homo sapiens
ggaatcagcttcta

SEQ ID NO: 3511749 - DNA, 20 bp, Homo sapiens
ggaatcatggcctcttgaag

SEQ ID NO: 3511750 - DNA, 14 bp, Homo sapiens
ggaatcctcctcca

SEQ ID NO: 3511751 - DNA, 12 bp, Homo sapiens
ggaatctgaggc

SEQ ID NO: 3511752 - DNA, 19 bp, Homo sapiens
ggaatctgaggcatcctct

SEQ ID NO: 3511753 - DNA, 20 bp, Homo sapiens
ggaatgcacagggcaattga

SEQ ID NO: 3511754 - DNA, 19 bp, Homo sapiens
ggaatgtttgcctctgcct

SEQ ID NO: 3511755 - DNA, 15 bp, Homo sapiens
ggaatttcccaggac

SEQ ID NO: 3511756 - DNA, 19 bp, Homo sapiens
ggaatttcccaggaccctg

SEQ ID NO: 3511757 - DNA, 14 bp, Homo sapiens
ggacaaagaacctt

SEQ ID NO: 3511758 - DNA, 17 bp, Homo sapiens
ggacaacgaggaagccc

SEQ ID NO: 3511759 - DNA, 15 bp, Homo sapiens
gccaccaccctgtct

SEQ ID NO: 3511760 - DNA, 22 bp, Homo sapiens
gccaccaggatcagccaggagg

SEQ ID NO: 3511761 - DNA, 20 bp, Homo sapiens
gccaccaggccacctcccca

SEQ ID NO: 3511762 - DNA, 17 bp, Homo sapiens
gccacccacctccctgc

SEQ ID NO: 3511763 - DNA, 16 bp, Homo sapiens
gccacccccagttcct

SEQ ID NO: 3511764 - DNA, 17 bp, Homo sapiens
gccacccccccacccca

SEQ ID NO: 3511765 - DNA, 18 bp, Homo sapiens
gccacccctaaactccag

SEQ ID NO: 3511766 - DNA, 13 bp, Homo sapiens
gccaccctgcccc

SEQ ID NO: 3511767 - DNA, 14 bp, Homo sapiens
gccaccctgcccct

SEQ ID NO: 3511768 - DNA, 14 bp, Homo sapiens
gccacgctccagct

SEQ ID NO: 3511769 - DNA, 17 bp, Homo sapiens
gccacggccaggccaga

SEQ ID NO: 3511770 - DNA, 23 bp, Homo sapiens
gccacgtgtttgtgctgtggtgt

SEQ ID NO: 3511771 - DNA, 14 bp, Homo sapiens
gccactcactaggc

SEQ ID NO: 3511772 - DNA, 14 bp, Homo sapiens
gccactccagtcct

SEQ ID NO: 3511773 - DNA, 21 bp, Homo sapiens
gccactccagtcctgccacca

SEQ ID NO: 3511774 - DNA, 14 bp, Homo sapiens
gccactcctctgac

SEQ ID NO: 3511775 - DNA, 17 bp, Homo sapiens
gccactcctctgactca

SEQ ID NO: 3511776 - DNA, 17 bp, Homo sapiens
gccactgcaccgggcca

SEQ ID NO: 3511777 - DNA, 20 bp, Homo sapiens
gccactgcaccgggccacag

SEQ ID NO: 3511778 - DNA, 21 bp, Homo sapiens
gccactgcaccgggccacaga

SEQ ID NO: 3511779 - DNA, 13 bp, Homo sapiens
gccactgccactc

SEQ ID NO: 3511780 - DNA, 15 bp, Homo sapiens
gccactgccactcca

SEQ ID NO: 3511781 - DNA, 17 bp, Homo sapiens
gccactggtttctcaga

SEQ ID NO: 3511782 - DNA, 16 bp, Homo sapiens
gccactgtggtggcag

SEQ ID NO: 3511783 - DNA, 15 bp, Homo sapiens
gccacttctgtccat

SEQ ID NO: 3511784 - DNA, 15 bp, Homo sapiens
gccagaatctcatta

SEQ ID NO: 3511785 - DNA, 23 bp, Homo sapiens
gccagaatctcattactgcttca

SEQ ID NO: 3511786 - DNA, 18 bp, Homo sapiens
gccagacagaccttcaca

SEQ ID NO: 3511787 - DNA, 18 bp, Homo sapiens
gccagacatgccacaagg

SEQ ID NO: 3511788 - DNA, 13 bp, Homo sapiens
gccagagaagcta

SEQ ID NO: 3511789 - DNA, 15 bp, Homo sapiens
gcttctagaggctca

SEQ ID NO: 3511790 - DNA, 20 bp, Homo sapiens
gcttctagaggctcatggcc

SEQ ID NO: 3511791 - DNA, 21 bp, Homo sapiens
gcttctagaggctcatggccc

SEQ ID NO: 3511792 - DNA, 18 bp, Homo sapiens
gcttctcatcctgcaggc

SEQ ID NO: 3511793 - DNA, 20 bp, Homo sapiens
gcttctccaaaaatctgcct

SEQ ID NO: 3511794 - DNA, 22 bp, Homo sapiens
gcttctccaaaaatctgcctgg

SEQ ID NO: 3511795 - DNA, 23 bp, Homo sapiens
gcttctccaaaaatctgcctggg

SEQ ID NO: 3511796 - DNA, 22 bp, Homo sapiens
gcttctcggcttggatcctggg

SEQ ID NO: 3511797 - DNA, 17 bp, Homo sapiens
gcttctctgacttctgc

SEQ ID NO: 3511798 - DNA, 18 bp, Homo sapiens
gcttctctgacttctgcc

SEQ ID NO: 3511799 - DNA, 16 bp, Homo sapiens
ccctggaggctgcctc

SEQ ID NO: 3511800 - DNA, 18 bp, Homo sapiens
ccctggaggctgcctccc

SEQ ID NO: 3511801 - DNA, 19 bp, Homo sapiens
ccctggaggctgcctccca

SEQ ID NO: 3511802 - DNA, 16 bp, Homo sapiens
ccctggccccctgagt

SEQ ID NO: 3511803 - DNA, 18 bp, Homo sapiens
ccctggccccgcctgcct

SEQ ID NO: 3511804 - DNA, 13 bp, Homo sapiens
ccctggcctctgt

SEQ ID NO: 3511805 - DNA, 21 bp, Homo sapiens
ccctggcctctgtgccttctt

SEQ ID NO: 3511806 - DNA, 14 bp, Homo sapiens
ccctggctctgggc

SEQ ID NO: 3511807 - DNA, 23 bp, Homo sapiens
ccctgggacatcaggagactggg

SEQ ID NO: 3511808 - DNA, 13 bp, Homo sapiens
ccctgggccctgg

SEQ ID NO: 3511809 - DNA, 19 bp, Homo sapiens
ccctgggccctgggctgga

SEQ ID NO: 3511810 - DNA, 13 bp, Homo sapiens
ccctgggctgaga

SEQ ID NO: 3511811 - DNA, 18 bp, Homo sapiens
ccctggggaaggagccag

SEQ ID NO: 3511812 - DNA, 20 bp, Homo sapiens
ccctggggcctgactgctca

SEQ ID NO: 3511813 - DNA, 21 bp, Homo sapiens
ccctggggcctgactgctcag

SEQ ID NO: 3511814 - DNA, 14 bp, Homo sapiens
ccctggggctggct

SEQ ID NO: 3511815 - DNA, 17 bp, Homo sapiens
ccctggtcctggcctcc

SEQ ID NO: 3511816 - DNA, 18 bp, Homo sapiens
ccctggtcctggcctcct

SEQ ID NO: 3511817 - DNA, 21 bp, Homo sapiens
ccctggtggcagtgggagctg

SEQ ID NO: 3511818 - DNA, 14 bp, Homo sapiens
ccctggttctcatc

SEQ ID NO: 3511819 - DNA, 16 bp, Homo sapiens
ccctggttctcatctt

SEQ ID NO: 3511820 - DNA, 17 bp, Homo sapiens
ccctgtcgggctttgtg

SEQ ID NO: 3511821 - DNA, 16 bp, Homo sapiens
ccctgtctagagaggg

SEQ ID NO: 3511822 - DNA, 20 bp, Homo sapiens
ccctgtctcaaaaaaagaaa

SEQ ID NO: 3511823 - DNA, 16 bp, Homo sapiens
ccctgtctgccagggc

SEQ ID NO: 3511824 - DNA, 19 bp, Homo sapiens
ccctgtctttactcctcac

SEQ ID NO: 3511825 - DNA, 22 bp, Homo sapiens
ccctgtgcaacctcttggcctg

SEQ ID NO: 3511826 - DNA, 19 bp, Homo sapiens
ccctgtgccctccttccca

SEQ ID NO: 3511827 - DNA, 13 bp, Homo sapiens
ccctgtgtctttt

SEQ ID NO: 3511828 - DNA, 17 bp, Homo sapiens
cccttaagccctggccc

SEQ ID NO: 3511829 - DNA, 20 bp, Homo sapiens
cccttaagtcaccctagccc

SEQ ID NO: 3511830 - DNA, 15 bp, Homo sapiens
cccttaatcttgctt

SEQ ID NO: 3511831 - DNA, 14 bp, Homo sapiens
cccttacagtagga

SEQ ID NO: 3511832 - DNA, 19 bp, Homo sapiens
cccttactatgatctcagg

SEQ ID NO: 3511833 - DNA, 22 bp, Homo sapiens
cccttactatgatctcaggagc

SEQ ID NO: 3511834 - DNA, 21 bp, Homo sapiens
cccttcattgatttcctgtgt

SEQ ID NO: 3511835 - DNA, 13 bp, Homo sapiens
cccttccactgag

SEQ ID NO: 3511836 - DNA, 11 bp, Homo sapiens
cccttccttta

SEQ ID NO: 3511837 - DNA, 15 bp, Homo sapiens
cccttcggccaaaca

SEQ ID NO: 3511838 - DNA, 18 bp, Homo sapiens
cccttgacaactggcagg

SEQ ID NO: 3511839 - DNA, 19 bp, Homo sapiens
cccttgacaactggcaggc

SEQ ID NO: 3511840 - DNA, 21 bp, Homo sapiens
cccttgatttaaacacacaga

SEQ ID NO: 3511841 - DNA, 14 bp, Homo sapiens
cccttgctgtatgc

SEQ ID NO: 3511842 - DNA, 18 bp, Homo sapiens
cccttggaggccagccag

SEQ ID NO: 3511843 - DNA, 20 bp, Homo sapiens
cccttgtacctatggctgcc

SEQ ID NO: 3511844 - DNA, 21 bp, Homo sapiens
cccttgttgtaaaaagcccag

SEQ ID NO: 3511845 - DNA, 22 bp, Homo sapiens
ccctttctcccctgcccccagg

SEQ ID NO: 3511846 - DNA, 15 bp, Homo sapiens
cccttttccagcctc

SEQ ID NO: 3511847 - DNA, 15 bp, Homo sapiens
ccctttttgaagtgt

SEQ ID NO: 3511848 - DNA, 15 bp, Homo sapiens
ccgaacctcctctgt

SEQ ID NO: 3511849 - DNA, 22 bp, Homo sapiens
ccgacaactatttcggcctttt

SEQ ID NO: 3511850 - DNA, 13 bp, Homo sapiens
ccgaccagacacc

SEQ ID NO: 3511851 - DNA, 17 bp, Homo sapiens
ccgaccagacaccttga

SEQ ID NO: 3511852 - DNA, 13 bp, Homo sapiens
ccgagaagcaaga

SEQ ID NO: 3511853 - DNA, 15 bp, Homo sapiens
ccgagagccaaacag

SEQ ID NO: 3511854 - DNA, 18 bp, Homo sapiens
ccgagatcacgccactgc

SEQ ID NO: 3511855 - DNA, 21 bp, Homo sapiens
ccgagattgcaccactgcact

SEQ ID NO: 3511856 - DNA, 14 bp, Homo sapiens
ccgaggaaactcag

SEQ ID NO: 3511857 - DNA, 11 bp, Homo sapiens
ccgaggccagt

SEQ ID NO: 3511858 - DNA, 22 bp, Homo sapiens
ccgaggcctaccccgcagacac

SEQ ID NO: 3511859 - DNA, 20 bp, Homo sapiens
ccgagtagctgggattacag

SEQ ID NO: 3511860 - DNA, 20 bp, Homo sapiens
ccgagtcattcgttctgtgg

SEQ ID NO: 3511861 - DNA, 17 bp, Homo sapiens
ccgatatcagaatttgt

SEQ ID NO: 3511862 - DNA, 16 bp, Homo sapiens
ccgattcacctgagca

SEQ ID NO: 3511863 - DNA, 14 bp, Homo sapiens
ccgcagacaccttg

SEQ ID NO: 3511864 - DNA, 15 bp, Homo sapiens
ccgcagacctctgga

SEQ ID NO: 3511865 - DNA, 21 bp, Homo sapiens
ccgcagagcgcgcccctagcc

SEQ ID NO: 3511866 - DNA, 14 bp, Homo sapiens
ccgcagcagctccc

SEQ ID NO: 3511867 - DNA, 23 bp, Homo sapiens
ccgcagtgtgcactaaggggccc

SEQ ID NO: 3511868 - DNA, 12 bp, Homo sapiens
ccgccctgccac

SEQ ID NO: 3511869 - DNA, 16 bp, Homo sapiens
ccgccggaggccagct

SEQ ID NO: 3511870 - DNA, 12 bp, Homo sapiens
ccgcctccagga

SEQ ID NO: 3511871 - DNA, 21 bp, Homo sapiens
ccgcgatgggtcaggtagggg

SEQ ID NO: 3511872 - DNA, 17 bp, Homo sapiens
ccgcgcccccaccccag

SEQ ID NO: 3511873 - DNA, 20 bp, Homo sapiens
ccgcggggacattgggaagg

SEQ ID NO: 3511874 - DNA, 17 bp, Homo sapiens
ccgcgtcgccctcccag

SEQ ID NO: 3511875 - DNA, 17 bp, Homo sapiens
ccgcgttgtaaaatata

SEQ ID NO: 3511876 - DNA, 20 bp, Homo sapiens
ccgctccaggtaccttgacc

SEQ ID NO: 3511877 - DNA, 23 bp, Homo sapiens
ccgctgccacccacctccctgcc

SEQ ID NO: 3511878 - DNA, 16 bp, Homo sapiens
ccgctgccccagcccc

SEQ ID NO: 3511879 - DNA, 14 bp, Homo sapiens
ccgctgtgggaaac

SEQ ID NO: 3511880 - DNA, 19 bp, Homo sapiens
ccgcttgaaaagctagtgt

SEQ ID NO: 3511881 - DNA, 17 bp, Homo sapiens
ccgcttggagcagaggg

SEQ ID NO: 3511882 - DNA, 12 bp, Homo sapiens
ccgctttctacc

SEQ ID NO: 3511883 - DNA, 23 bp, Homo sapiens
ccgctttctacccagcgagccct

SEQ ID NO: 3511884 - DNA, 20 bp, Homo sapiens
ccggaatgccacccacatct

SEQ ID NO: 3511885 - DNA, 21 bp, Homo sapiens
ccggaccctctaacctcgccc

SEQ ID NO: 3511886 - DNA, 13 bp, Homo sapiens
ccggactggtgcc

SEQ ID NO: 3511887 - DNA, 17 bp, Homo sapiens
ccggactggtgccctcc

SEQ ID NO: 3511888 - DNA, 20 bp, Homo sapiens
ccggagctgcccctctctgg

SEQ ID NO: 3511889 - DNA, 13 bp, Homo sapiens
ccggaggccagct

SEQ ID NO: 3511890 - DNA, 18 bp, Homo sapiens
ccggaggccagctatctg

SEQ ID NO: 3511891 - DNA, 19 bp, Homo sapiens
ccggaggccagctatctgc

SEQ ID NO: 3511892 - DNA, 17 bp, Homo sapiens
ccggcacagctgggata

SEQ ID NO: 3511893 - DNA, 20 bp, Homo sapiens
ccggcacctacatccccagg

SEQ ID NO: 3511894 - DNA, 18 bp, Homo sapiens
ccggcagccccagcctgc

SEQ ID NO: 3511895 - DNA, 19 bp, Homo sapiens
ccggcagccccagcctgct

SEQ ID NO: 3511896 - DNA, 21 bp, Homo sapiens
ccggcagccccagcctgctag

SEQ ID NO: 3511897 - DNA, 18 bp, Homo sapiens
ccggcatgtttccagcag

SEQ ID NO: 3511898 - DNA, 17 bp, Homo sapiens
ccggcccgcgccacagg

SEQ ID NO: 3511899 - DNA, 13 bp, Homo sapiens
ccggccctggggc

SEQ ID NO: 3511900 - DNA, 18 bp, Homo sapiens
ccggctaatttttgtaat

SEQ ID NO: 3511901 - DNA, 23 bp, Homo sapiens
ccggctcgagcagtcctgcctca

SEQ ID NO: 3511902 - DNA, 20 bp, Homo sapiens
ccgggaacctccccagcctg

SEQ ID NO: 3511903 - DNA, 22 bp, Homo sapiens
ccgggcactcagaagacactga

SEQ ID NO: 3511904 - DNA, 13 bp, Homo sapiens
ccgggccacagag

SEQ ID NO: 3511905 - DNA, 15 bp, Homo sapiens
ccgggccagggctgc

SEQ ID NO: 3511906 - DNA, 13 bp, Homo sapiens
ccgggccccacag

SEQ ID NO: 3511907 - DNA, 13 bp, Homo sapiens
ccgggtccccagc

SEQ ID NO: 3511908 - DNA, 18 bp, Homo sapiens
ccgggtccccagctcccc

SEQ ID NO: 3511909 - DNA, 22 bp, Homo sapiens
ccggtaaacacgcctgcaaacg

SEQ ID NO: 3511910 - DNA, 19 bp, Homo sapiens
ccggtcacctagcaagctg

SEQ ID NO: 3511911 - DNA, 22 bp, Homo sapiens
ccggtctatgtcgagagctggc

SEQ ID NO: 3511912 - DNA, 21 bp, Homo sapiens
ccggtgtgcctgactgcccag

SEQ ID NO: 3511913 - DNA, 13 bp, Homo sapiens
ccgtcctgcctgt

SEQ ID NO: 3511914 - DNA, 17 bp, Homo sapiens
ccgtgaaaacggagctg

SEQ ID NO: 3511915 - DNA, 17 bp, Homo sapiens
ccgtgctcgccccagca

SEQ ID NO: 3511916 - DNA, 18 bp, Homo sapiens
ccgtgctgacagctgctc

SEQ ID NO: 3511917 - DNA, 21 bp, Homo sapiens
ccgtgctgacagctgctccta

SEQ ID NO: 3511918 - DNA, 22 bp, Homo sapiens
ccgtgcttgtttgctcacctgg

SEQ ID NO: 3511919 - DNA, 19 bp, Homo sapiens
ccgtgtacatagtgcattg

SEQ ID NO: 3511920 - DNA, 23 bp, Homo sapiens
ccgtgtcaagctgctctgagcca

SEQ ID NO: 3511921 - DNA, 22 bp, Homo sapiens
ccgtgtgagaagtgaatgctgg

SEQ ID NO: 3511922 - DNA, 15 bp, Homo sapiens
ccgttagctcctgtg

SEQ ID NO: 3511923 - DNA, 20 bp, Homo sapiens
ccgttccttccgatgacagt

SEQ ID NO: 3511924 - DNA, 18 bp, Homo sapiens
ccgttgatgttggctggg

SEQ ID NO: 3511925 - DNA, 19 bp, Homo sapiens
ccgttgatgttggctggga

SEQ ID NO: 3511926 - DNA, 14 bp, Homo sapiens
cctaaaaaagatat

SEQ ID NO: 3511927 - DNA, 14 bp, Homo sapiens
cctaaaaacacaga

SEQ ID NO: 3511928 - DNA, 17 bp, Homo sapiens
cctaaaacataagatca

SEQ ID NO: 3511929 - DNA, 18 bp, Homo sapiens
cctaaaagcacactcatc

SEQ ID NO: 3511930 - DNA, 21 bp, Homo sapiens
cctaaaatattacaaaataag

SEQ ID NO: 3511931 - DNA, 15 bp, Homo sapiens
cctaaaattcagtgg

SEQ ID NO: 3511932 - DNA, 16 bp, Homo sapiens
cctaaaattcagtgga

SEQ ID NO: 3511933 - DNA, 13 bp, Homo sapiens
cctaaacatatga

SEQ ID NO: 3511934 - DNA, 21 bp, Homo sapiens
cctaaaccaaaaactgaaagt

SEQ ID NO: 3511935 - DNA, 16 bp, Homo sapiens
cccgacttcctgactc

SEQ ID NO: 3511936 - DNA, 23 bp, Homo sapiens
cccgagggaggggaagcttctgt

SEQ ID NO: 3511937 - DNA, 14 bp, Homo sapiens
cccgagtagctggg

SEQ ID NO: 3511938 - DNA, 18 bp, Homo sapiens
cccgagtagctgggacta

SEQ ID NO: 3511939 - DNA, 22 bp, Homo sapiens
cccgagtagctgggactacagg

SEQ ID NO: 3511940 - DNA, 21 bp, Homo sapiens
cccgagtcattcgttctgtgg

SEQ ID NO: 3511941 - DNA, 15 bp, Homo sapiens
cccgcagacctctgg

SEQ ID NO: 3511942 - DNA, 17 bp, Homo sapiens
cccgccccctgccctcc

SEQ ID NO: 3511943 - DNA, 11 bp, Homo sapiens
cccgcctgcct

SEQ ID NO: 3511944 - DNA, 17 bp, Homo sapiens
cccgcgccacaggaccc

SEQ ID NO: 3511945 - DNA, 21 bp, Homo sapiens
cccgcggggacattgggaagg

SEQ ID NO: 3511946 - DNA, 16 bp, Homo sapiens
cccgcttccccacaga

SEQ ID NO: 3511947 - DNA, 19 bp, Homo sapiens
cccgcttccccacagaact

SEQ ID NO: 3511948 - DNA, 14 bp, Homo sapiens
cccggaacaagcct

SEQ ID NO: 3511949 - DNA, 18 bp, Homo sapiens
cccggagaaggccgctgc

SEQ ID NO: 3511950 - DNA, 22 bp, Homo sapiens
cccggcacagatgctccaggga

SEQ ID NO: 3511951 - DNA, 21 bp, Homo sapiens
cccggcagggcgggcagaggg

SEQ ID NO: 3511952 - DNA, 16 bp, Homo sapiens
cccggcagggtcctag

SEQ ID NO: 3511953 - DNA, 22 bp, Homo sapiens
cccggcctattgcttgggtctc

SEQ ID NO: 3511954 - DNA, 12 bp, Homo sapiens
cccggctccagg

SEQ ID NO: 3511955 - DNA, 16 bp, Homo sapiens
cccggctccaggctcc

SEQ ID NO: 3511956 - DNA, 22 bp, Homo sapiens
cccggctctgtgggtgatgggg

SEQ ID NO: 3511957 - DNA, 16 bp, Homo sapiens
cccggctgcagaggcc

SEQ ID NO: 3511958 - DNA, 18 bp, Homo sapiens
cccgggacgcagcaggag

SEQ ID NO: 3511959 - DNA, 14 bp, Homo sapiens
cccgggccagggct

SEQ ID NO: 3511960 - DNA, 15 bp, Homo sapiens
cccgggccagggctg

SEQ ID NO: 3511961 - DNA, 16 bp, Homo sapiens
cccggggcccagggca

SEQ ID NO: 3511962 - DNA, 14 bp, Homo sapiens
cccggtgctccctc

SEQ ID NO: 3511963 - DNA, 14 bp, Homo sapiens
cccgtcctgcctgt

SEQ ID NO: 3511964 - DNA, 16 bp, Homo sapiens
cccgtcctgcctgtgg

SEQ ID NO: 3511965 - DNA, 17 bp, Homo sapiens
cccgtcctgcctgtggc

SEQ ID NO: 3511966 - DNA, 14 bp, Homo sapiens
cccgtttctggtgg

SEQ ID NO: 3511967 - DNA, 11 bp, Homo sapiens
ccctaacttct

SEQ ID NO: 3511968 - DNA, 18 bp, Homo sapiens
ccctaaggcatgtgtgaa

SEQ ID NO: 3511969 - DNA, 15 bp, Homo sapiens
ccctaatctatggtc

SEQ ID NO: 3511970 - DNA, 22 bp, Homo sapiens
ccctaatctatggtcgggagac

SEQ ID NO: 3511971 - DNA, 16 bp, Homo sapiens
ccctaattcagccatg

SEQ ID NO: 3511972 - DNA, 23 bp, Homo sapiens
ccctactattcagtggcgagaaa

SEQ ID NO: 3511973 - DNA, 18 bp, Homo sapiens
ccctagccggttcctgtc

SEQ ID NO: 3511974 - DNA, 11 bp, Homo sapiens
ccctataaatc

SEQ ID NO: 3511975 - DNA, 23 bp, Homo sapiens
ccctatactgcttggagctgagc

SEQ ID NO: 3511976 - DNA, 18 bp, Homo sapiens
ccctattagagaagagat

SEQ ID NO: 3511977 - DNA, 17 bp, Homo sapiens
ccctcaaaaaaagcctt

SEQ ID NO: 3511978 - DNA, 16 bp, Homo sapiens
ccctcaacctcttctg

SEQ ID NO: 3511979 - DNA, 17 bp, Homo sapiens
ccctcaagaggaagtga

SEQ ID NO: 3511980 - DNA, 13 bp, Homo sapiens
ccctcacccctgg

SEQ ID NO: 3511981 - DNA, 22 bp, Homo sapiens
ccctcacccctggttctcatct

SEQ ID NO: 3511982 - DNA, 14 bp, Homo sapiens
ccctcacctccctt

SEQ ID NO: 3511983 - DNA, 21 bp, Homo sapiens
ccctcaccttggcaccagaca

SEQ ID NO: 3511984 - DNA, 17 bp, Homo sapiens
ccctcagaacccttggc

SEQ ID NO: 3511985 - DNA, 18 bp, Homo sapiens
ccctcagttgtgcagctt

SEQ ID NO: 3511986 - DNA, 16 bp, Homo sapiens
ccctcatttcaggagc

SEQ ID NO: 3511987 - DNA, 16 bp, Homo sapiens
ccctccccattcacag

SEQ ID NO: 3511988 - DNA, 14 bp, Homo sapiens
ccctcccccactgc

SEQ ID NO: 3511989 - DNA, 18 bp, Homo sapiens
ccctcccccccatgcact

SEQ ID NO: 3511990 - DNA, 20 bp, Homo sapiens
ccctcccccccatgcactgt

SEQ ID NO: 3511991 - DNA, 19 bp, Homo sapiens
ccctccctgttccccagag

SEQ ID NO: 3511992 - DNA, 16 bp, Homo sapiens
ccctccctttctcccc

SEQ ID NO: 3511993 - DNA, 16 bp, Homo sapiens
ccctccgccctgccac

SEQ ID NO: 3511994 - DNA, 19 bp, Homo sapiens
ccctccgccctgccactca

SEQ ID NO: 3511995 - DNA, 18 bp, Homo sapiens
ccctcctaccctgcgccc

SEQ ID NO: 3511996 - DNA, 12 bp, Homo sapiens
ccctcctccact

SEQ ID NO: 3511997 - DNA, 14 bp, Homo sapiens
ccctcctctgaaac

SEQ ID NO: 3511998 - DNA, 15 bp, Homo sapiens
ccctcctctgaaaca

SEQ ID NO: 3511999 - DNA, 19 bp, Homo sapiens
ccctcctctgaaacagctg

SEQ ID NO: 3512000 - DNA, 13 bp, Homo sapiens
ccctccttcccaa

SEQ ID NO: 3512001 - DNA, 20 bp, Homo sapiens
ccctccttcccaatcttctt

SEQ ID NO: 3512002 - DNA, 14 bp, Homo sapiens
ccctcctttcacca

SEQ ID NO: 3512003 - DNA, 23 bp, Homo sapiens
ccctcgcttggacggctgggcac

SEQ ID NO: 3512004 - DNA, 21 bp, Homo sapiens
ccctctacagagcttccctga

SEQ ID NO: 3512005 - DNA, 19 bp, Homo sapiens
ccctctaggctctgccttc

SEQ ID NO: 3512006 - DNA, 23 bp, Homo sapiens
ccctctccaactgcctaaggccc

SEQ ID NO: 3512007 - DNA, 16 bp, Homo sapiens
ccctctccctctaggc

SEQ ID NO: 3512008 - DNA, 17 bp, Homo sapiens
ccctctccctctaggct

SEQ ID NO: 3512009 - DNA, 13 bp, Homo sapiens
ccctctcctccgt

SEQ ID NO: 3512010 - DNA, 14 bp, Homo sapiens
ccctctccttcctg

SEQ ID NO: 3512011 - DNA, 16 bp, Homo sapiens
ccctctctgctctgcg

SEQ ID NO: 3512012 - DNA, 19 bp, Homo sapiens
ccctctgaaagttgtacat

SEQ ID NO: 3512013 - DNA, 18 bp, Homo sapiens
ccctctgccccatcctcc

SEQ ID NO: 3512014 - DNA, 21 bp, Homo sapiens
ccctctgctgaagacttgccc

SEQ ID NO: 3512015 - DNA, 21 bp, Homo sapiens
ccctctgggggctctggccaa

SEQ ID NO: 3512016 - DNA, 19 bp, Homo sapiens
ccctctggtcgctcctgcc

SEQ ID NO: 3512017 - DNA, 20 bp, Homo sapiens
ccctctgtccaggcactgag

SEQ ID NO: 3512018 - DNA, 24 bp, Homo sapiens
ccctctgtccaggcactgagatac

SEQ ID NO: 3512019 - DNA, 15 bp, Homo sapiens
ccctcttctgagcac

SEQ ID NO: 3512020 - DNA, 19 bp, Homo sapiens
cccattctacacagagcag

SEQ ID NO: 3512021 - DNA, 20 bp, Homo sapiens
cccattcttttgtaatttaa

SEQ ID NO: 3512022 - DNA, 15 bp, Homo sapiens
cccattgtccctctg

SEQ ID NO: 3512023 - DNA, 18 bp, Homo sapiens
cccattgtccctctgccc

SEQ ID NO: 3512024 - DNA, 20 bp, Homo sapiens
cccattgtccctctgcccca

SEQ ID NO: 3512025 - DNA, 21 bp, Homo sapiens
cccatttcgtgagccccatct

SEQ ID NO: 3512026 - DNA, 15 bp, Homo sapiens
cccatttctatttat

SEQ ID NO: 3512027 - DNA, 16 bp, Homo sapiens
cccatttctatttatt

SEQ ID NO: 3512028 - DNA, 17 bp, Homo sapiens
cccatttctatttattt

SEQ ID NO: 3512029 - DNA, 19 bp, Homo sapiens
cccatttctatttatttac

SEQ ID NO: 3512030 - DNA, 22 bp, Homo sapiens
cccatttttgagccaagcttca

SEQ ID NO: 3512031 - DNA, 21 bp, Homo sapiens
cccattttttaaaaaagcaag

SEQ ID NO: 3512032 - DNA, 15 bp, Homo sapiens
ccccaaaggaacact

SEQ ID NO: 3512033 - DNA, 20 bp, Homo sapiens
ccccaactacccccagctgt

SEQ ID NO: 3512034 - DNA, 15 bp, Homo sapiens
ccccaaggagggaga

SEQ ID NO: 3512035 - DNA, 19 bp, Homo sapiens
ccccaccatatgaattgta

SEQ ID NO: 3512036 - DNA, 12 bp, Homo sapiens
ccccacccctgg

SEQ ID NO: 3512037 - DNA, 19 bp, Homo sapiens
ccccacccctgggggctct

SEQ ID NO: 3512038 - DNA, 12 bp, Homo sapiens
ccccaccctggg

SEQ ID NO: 3512039 - DNA, 14 bp, Homo sapiens
ccccaccctgggcc

SEQ ID NO: 3512040 - DNA, 20 bp, Homo sapiens
ccccaccctggtgggccaac

SEQ ID NO: 3512041 - DNA, 17 bp, Homo sapiens
ccccacctctccctgac

SEQ ID NO: 3512042 - DNA, 13 bp, Homo sapiens
ccccacgagggct

SEQ ID NO: 3512043 - DNA, 14 bp, Homo sapiens
ccccactctgcctg

SEQ ID NO: 3512044 - DNA, 14 bp, Homo sapiens
ccccactgccacac

SEQ ID NO: 3512045 - DNA, 20 bp, Homo sapiens
ccccactggactgacctggt

SEQ ID NO: 3512046 - DNA, 22 bp, Homo sapiens
ccccactggggaaataacagct

SEQ ID NO: 3512047 - DNA, 17 bp, Homo sapiens
ccccagaagcagagagc

SEQ ID NO: 3512048 - DNA, 23 bp, Homo sapiens
ccccagattgcaacaggctgggc

SEQ ID NO: 3512049 - DNA, 17 bp, Homo sapiens
ccccagcaagtgagagc

SEQ ID NO: 3512050 - DNA, 16 bp, Homo sapiens
ccccagcactgaggaa

SEQ ID NO: 3512051 - DNA, 11 bp, Homo sapiens
ccccagcactt

SEQ ID NO: 3512052 - DNA, 19 bp, Homo sapiens
ccccagcattctcaggcac

SEQ ID NO: 3512053 - DNA, 16 bp, Homo sapiens
ccccagcccagagaca

SEQ ID NO: 3512054 - DNA, 12 bp, Homo sapiens
ccccagcccagg

SEQ ID NO: 3512055 - DNA, 21 bp, Homo sapiens
ccccagcccagggctcctgca

SEQ ID NO: 3512056 - DNA, 10 bp, Homo sapiens
ccccagcctg

SEQ ID NO: 3512057 - DNA, 12 bp, Homo sapiens
ccccagcctgcg

SEQ ID NO: 3512058 - DNA, 18 bp, Homo sapiens
ccccagcctgcgcctgct

SEQ ID NO: 3512059 - DNA, 19 bp, Homo sapiens
ccccagcctgcgcctgctg

SEQ ID NO: 3512060 - DNA, 20 bp, Homo sapiens
ccccagcctgctagctagct

SEQ ID NO: 3512061 - DNA, 19 bp, Homo sapiens
ccccagctactctgatccc

SEQ ID NO: 3512062 - DNA, 11 bp, Homo sapiens
ccccagctccg

SEQ ID NO: 3512063 - DNA, 11 bp, Homo sapiens
ccccaggacca

SEQ ID NO: 3512064 - DNA, 13 bp, Homo sapiens
ccccaggaccagc

SEQ ID NO: 3512065 - DNA, 19 bp, Homo sapiens
ccccaggaccagctcagga

SEQ ID NO: 3512066 - DNA, 13 bp, Homo sapiens
ccccaggactggg

SEQ ID NO: 3512067 - DNA, 22 bp, Homo sapiens
ccccaggactgggccacttctg

SEQ ID NO: 3512068 - DNA, 12 bp, Homo sapiens
ccccaggcccca

SEQ ID NO: 3512069 - DNA, 18 bp, Homo sapiens
ccccaggccccaggaagc

SEQ ID NO: 3512070 - DNA, 20 bp, Homo sapiens
ccccaggcctgagctgcttc

SEQ ID NO: 3512071 - DNA, 19 bp, Homo sapiens
ccccagggcccccacaggc

SEQ ID NO: 3512072 - DNA, 14 bp, Homo sapiens
ccccagggcctgag

SEQ ID NO: 3512073 - DNA, 15 bp, Homo sapiens
ccccagggcctgagc

SEQ ID NO: 3512074 - DNA, 16 bp, Homo sapiens
ccccagggcctgagcc

SEQ ID NO: 3512075 - DNA, 21 bp, Homo sapiens
ccccagggcctgagcctggcc

SEQ ID NO: 3512076 - DNA, 16 bp, Homo sapiens
ccccaggtctctccac

SEQ ID NO: 3512077 - DNA, 17 bp, Homo sapiens
ccccaggtctctccact

SEQ ID NO: 3512078 - DNA, 22 bp, Homo sapiens
ccccaggtggttatggagaggg

SEQ ID NO: 3512079 - DNA, 13 bp, Homo sapiens
ccccagtaaaatt

SEQ ID NO: 3512080 - DNA, 15 bp, Homo sapiens
ccccagttcctatga

SEQ ID NO: 3512081 - DNA, 14 bp, Homo sapiens
ccccatcagtgctc

SEQ ID NO: 3512082 - DNA, 20 bp, Homo sapiens
ccccatcagtgctccctcac

SEQ ID NO: 3512083 - DNA, 13 bp, Homo sapiens
ccccatctcaggc

SEQ ID NO: 3512084 - DNA, 13 bp, Homo sapiens
ccccatctgtgca

SEQ ID NO: 3512085 - DNA, 21 bp, Homo sapiens
ccccatctgtgcattctcctg

SEQ ID NO: 3512086 - DNA, 17 bp, Homo sapiens
ccccatcttcacccagg

SEQ ID NO: 3512087 - DNA, 14 bp, Homo sapiens
ccccatcttgcttc

SEQ ID NO: 3512088 - DNA, 17 bp, Homo sapiens
ccccatggctgcacagt

SEQ ID NO: 3512089 - DNA, 23 bp, Homo sapiens
ccccatggggctgcgggacagag

SEQ ID NO: 3512090 - DNA, 23 bp, Homo sapiens
ccccattagctttcaattccgta

SEQ ID NO: 3512091 - DNA, 16 bp, Homo sapiens
ccccattcacagagcc

SEQ ID NO: 3512092 - DNA, 23 bp, Homo sapiens
ccccattcctgggaaatattccc

SEQ ID NO: 3512093 - DNA, 22 bp, Homo sapiens
ccccattcgcgctctgctcagt

SEQ ID NO: 3512094 - DNA, 13 bp, Homo sapiens
ccccattctgcct

SEQ ID NO: 3512095 - DNA, 14 bp, Homo sapiens
ccccattctgcctg

SEQ ID NO: 3512096 - DNA, 14 bp, Homo sapiens
cccccaagcctgca

SEQ ID NO: 3512097 - DNA, 22 bp, Homo sapiens
cccccacaggccccccgcagca

SEQ ID NO: 3512098 - DNA, 18 bp, Homo sapiens
cccccagcactgaggaag

SEQ ID NO: 3512099 - DNA, 13 bp, Homo sapiens
cccccagcccagg

SEQ ID NO: 3512100 - DNA, 12 bp, Homo sapiens
cccccagcctgc

SEQ ID NO: 3512101 - DNA, 13 bp, Homo sapiens
cccccagctaaga

SEQ ID NO: 3512102 - DNA, 15 bp, Homo sapiens
cccccagctccggcc

SEQ ID NO: 3512103 - DNA, 15 bp, Homo sapiens
cccccaggactgggc

SEQ ID NO: 3512104 - DNA, 14 bp, Homo sapiens
ccccccagcactga

SEQ ID NO: 3512105 - DNA, 12 bp, Homo sapiens
cccccccttcca

SEQ ID NO: 3512106 - DNA, 13 bp, Homo sapiens
ccccccgcagcac

SEQ ID NO: 3512107 - DNA, 11 bp, Homo sapiens
cccccttccac

SEQ ID NO: 3512108 - DNA, 16 bp, Homo sapiens
ccccgacttcctgact

SEQ ID NO: 3512109 - DNA, 21 bp, Homo sapiens
ccccgccccctgccctcccct

SEQ ID NO: 3512110 - DNA, 17 bp, Homo sapiens
ccccgggtccccagctc

SEQ ID NO: 3512111 - DNA, 18 bp, Homo sapiens
ccccgggtccccagctcc

SEQ ID NO: 3512112 - DNA, 15 bp, Homo sapiens
ccccggtggctgggc

SEQ ID NO: 3512113 - DNA, 14 bp, Homo sapiens
ccccgtctctacta

SEQ ID NO: 3512114 - DNA, 18 bp, Homo sapiens
cccctcagctcggctcag

SEQ ID NO: 3512115 - DNA, 14 bp, Homo sapiens
cccctccaacctgg

SEQ ID NO: 3512116 - DNA, 12 bp, Homo sapiens
cccctccatgtg

SEQ ID NO: 3512117 - DNA, 12 bp, Homo sapiens
cccctccctttc

SEQ ID NO: 3512118 - DNA, 18 bp, Homo sapiens
cccctccggactggtgcc

SEQ ID NO: 3512119 - DNA, 22 bp, Homo sapiens
cccctcctctgaaacagctgcc

SEQ ID NO: 3512120 - DNA, 12 bp, Homo sapiens
cccctccttctc

SEQ ID NO: 3512121 - DNA, 21 bp, Homo sapiens
cccctcgcttggacggctggg

SEQ ID NO: 3512122 - DNA, 17 bp, Homo sapiens
cccctcggctctggagg

SEQ ID NO: 3512123 - DNA, 11 bp, Homo sapiens
cccctctcctc

SEQ ID NO: 3512124 - DNA, 12 bp, Homo sapiens
cccctctctcct

SEQ ID NO: 3512125 - DNA, 13 bp, Homo sapiens
cccctctctgggc

SEQ ID NO: 3512126 - DNA, 12 bp, Homo sapiens
cccctctgtcca

SEQ ID NO: 3512127 - DNA, 14 bp, Homo sapiens
cccctctgtccagg

SEQ ID NO: 3512128 - DNA, 22 bp, Homo sapiens
cccctctgtccaggcactgaga

SEQ ID NO: 3512129 - DNA, 12 bp, Homo sapiens
cccctcttctga

SEQ ID NO: 3512130 - DNA, 15 bp, Homo sapiens
cccctgacctgtgag

SEQ ID NO: 3512131 - DNA, 17 bp, Homo sapiens
cccctgcacaagccatg

SEQ ID NO: 3512132 - DNA, 14 bp, Homo sapiens
cccctgccaccctg

SEQ ID NO: 3512133 - DNA, 11 bp, Homo sapiens
cccctgctggt

SEQ ID NO: 3512134 - DNA, 15 bp, Homo sapiens
cccctgctggttcag

SEQ ID NO: 3512135 - DNA, 17 bp, Homo sapiens
cccctgctgtctctctg

SEQ ID NO: 3512136 - DNA, 17 bp, Homo sapiens
cccctggaagagcccag

SEQ ID NO: 3512137 - DNA, 18 bp, Homo sapiens
cccctggaagagcccagt

SEQ ID NO: 3512138 - DNA, 20 bp, Homo sapiens
cccctggaagagcccagtct

SEQ ID NO: 3512139 - DNA, 16 bp, Homo sapiens
cccctggacatgcctg

SEQ ID NO: 3512140 - DNA, 18 bp, Homo sapiens
cccctggacatgcctgtc

SEQ ID NO: 3512141 - DNA, 19 bp, Homo sapiens
cccctggacatgcctgtcc

SEQ ID NO: 3512142 - DNA, 20 bp, Homo sapiens
cccctggacatgcctgtcct

SEQ ID NO: 3512143 - DNA, 15 bp, Homo sapiens
cccctggctccttca

SEQ ID NO: 3512144 - DNA, 19 bp, Homo sapiens
cccctgggggctctcatgt

SEQ ID NO: 3512145 - DNA, 11 bp, Homo sapiens
cccctgtgcag

SEQ ID NO: 3512146 - DNA, 19 bp, Homo sapiens
cccctgtgcagccgctgag

SEQ ID NO: 3512147 - DNA, 16 bp, Homo sapiens
ccccttaagccctggc

SEQ ID NO: 3512148 - DNA, 22 bp, Homo sapiens
ccccttactatgatctcaggag

SEQ ID NO: 3512149 - DNA, 10 bp, Homo sapiens
ccccttagat

SEQ ID NO: 3512150 - DNA, 14 bp, Homo sapiens
ccccttccactgag

SEQ ID NO: 3512151 - DNA, 13 bp, Homo sapiens
ccccttctctcat

SEQ ID NO: 3512152 - DNA, 19 bp, Homo sapiens
ccccttctgctcagctctg

SEQ ID NO: 3512153 - DNA, 18 bp, Homo sapiens
ccccttgacaactggcag

SEQ ID NO: 3512154 - DNA, 23 bp, Homo sapiens
ccccttgacaactggcaggcagg

SEQ ID NO: 3512155 - DNA, 21 bp, Homo sapiens
ccccttgatttaaacacacag

SEQ ID NO: 3512156 - DNA, 20 bp, Homo sapiens
cccctttggtttggcctcca

SEQ ID NO: 3512157 - DNA, 17 bp, Homo sapiens
cccgaatagctgggact

SEQ ID NO: 3512158 - DNA, 18 bp, Homo sapiens
cccgaatagctgggacta

SEQ ID NO: 3512159 - DNA, 22 bp, Homo sapiens
cccaccttggctcaagtcctct

SEQ ID NO: 3512160 - DNA, 15 bp, Homo sapiens
cccaccttggctgca

SEQ ID NO: 3512161 - DNA, 20 bp, Homo sapiens
cccacgaaactgccctggct

SEQ ID NO: 3512162 - DNA, 22 bp, Homo sapiens
cccacgattggtatgatgctgc

SEQ ID NO: 3512163 - DNA, 21 bp, Homo sapiens
cccacgctggagtgcagtgag

SEQ ID NO: 3512164 - DNA, 15 bp, Homo sapiens
cccacgctgggtatt

SEQ ID NO: 3512165 - DNA, 17 bp, Homo sapiens
cccacgggacctggggc

SEQ ID NO: 3512166 - DNA, 18 bp, Homo sapiens
cccactagcctaggtcat

SEQ ID NO: 3512167 - DNA, 14 bp, Homo sapiens
cccactctgcctgc

SEQ ID NO: 3512168 - DNA, 16 bp, Homo sapiens
cccactctgcctgcct

SEQ ID NO: 3512169 - DNA, 17 bp, Homo sapiens
cccactctgcctgcctg

SEQ ID NO: 3512170 - DNA, 14 bp, Homo sapiens
cccactgaccagaa

SEQ ID NO: 3512171 - DNA, 22 bp, Homo sapiens
cccactgccaggggttcttgag

SEQ ID NO: 3512172 - DNA, 19 bp, Homo sapiens
cccactgcttttggtctgt

SEQ ID NO: 3512173 - DNA, 16 bp, Homo sapiens
cccactgtcctgggcc

SEQ ID NO: 3512174 - DNA, 12 bp, Homo sapiens
cccacttctgcc

SEQ ID NO: 3512175 - DNA, 13 bp, Homo sapiens
cccacttgcctct

SEQ ID NO: 3512176 - DNA, 15 bp, Homo sapiens
cccacttgcctcttc

SEQ ID NO: 3512177 - DNA, 14 bp, Homo sapiens
cccagaacacactc

SEQ ID NO: 3512178 - DNA, 18 bp, Homo sapiens
cccagaacacactccatc

SEQ ID NO: 3512179 - DNA, 14 bp, Homo sapiens
cccagaccgctggc

SEQ ID NO: 3512180 - DNA, 12 bp, Homo sapiens
cccagactcaga

SEQ ID NO: 3512181 - DNA, 13 bp, Homo sapiens
cccagactcagac

SEQ ID NO: 3512182 - DNA, 18 bp, Homo sapiens
cccagagacatacttgaa

SEQ ID NO: 3512183 - DNA, 23 bp, Homo sapiens
cccagagacatacttgaagggcc

SEQ ID NO: 3512184 - DNA, 20 bp, Homo sapiens
cccagagaccaggctgtgtc

SEQ ID NO: 3512185 - DNA, 12 bp, Homo sapiens
cccagagcccag

SEQ ID NO: 3512186 - DNA, 15 bp, Homo sapiens
cccagagcccagctc

SEQ ID NO: 3512187 - DNA, 16 bp, Homo sapiens
cccagagcccagctcc

SEQ ID NO: 3512188 - DNA, 16 bp, Homo sapiens
cccagaggattgctgc

SEQ ID NO: 3512189 - DNA, 15 bp, Homo sapiens
cccagagtcatctga

SEQ ID NO: 3512190 - DNA, 14 bp, Homo sapiens
cccagatcagactc

SEQ ID NO: 3512191 - DNA, 20 bp, Homo sapiens
cccagatcatgttttggtga

SEQ ID NO: 3512192 - DNA, 17 bp, Homo sapiens
cccagattcccctgtgt

SEQ ID NO: 3512193 - DNA, 19 bp, Homo sapiens
cccagattcccctgtgtca

SEQ ID NO: 3512194 - DNA, 21 bp, Homo sapiens
cccagattgcaacaggctggg

SEQ ID NO: 3512195 - DNA, 23 bp, Homo sapiens
cccagattgcaacaggctgggct

SEQ ID NO: 3512196 - DNA, 20 bp, Homo sapiens
cccagattggctcacactga

SEQ ID NO: 3512197 - DNA, 21 bp, Homo sapiens
cccagattttgctgtatattt

SEQ ID NO: 3512198 - DNA, 19 bp, Homo sapiens
cccagcaagtgagagctgg

SEQ ID NO: 3512199 - DNA, 18 bp, Homo sapiens
cccagcagaaccagcctc

SEQ ID NO: 3512200 - DNA, 19 bp, Homo sapiens
cccagcagaaccagcctca

SEQ ID NO: 3512201 - DNA, 18 bp, Homo sapiens
cccagcattccagcccct

SEQ ID NO: 3512202 - DNA, 17 bp, Homo sapiens
cccagccaaaccctgtc

SEQ ID NO: 3512203 - DNA, 21 bp, Homo sapiens
cccagccaggccccaggcagg

SEQ ID NO: 3512204 - DNA, 14 bp, Homo sapiens
cccagcccacttct

SEQ ID NO: 3512205 - DNA, 12 bp, Homo sapiens
cccagcccagat

SEQ ID NO: 3512206 - DNA, 21 bp, Homo sapiens
cccagcccagattcccctgtg

SEQ ID NO: 3512207 - DNA, 15 bp, Homo sapiens
cccagccctcatccc

SEQ ID NO: 3512208 - DNA, 22 bp, Homo sapiens
cccagcctcagcgcggccctcc

SEQ ID NO: 3512209 - DNA, 23 bp, Homo sapiens
cccagcctgcgcctgctgcatgc

SEQ ID NO: 3512210 - DNA, 11 bp, Homo sapiens
cccagcctgct

SEQ ID NO: 3512211 - DNA, 14 bp, Homo sapiens
cccagcgagccctg

SEQ ID NO: 3512212 - DNA, 18 bp, Homo sapiens
cccagcgagccctggtgg

SEQ ID NO: 3512213 - DNA, 19 bp, Homo sapiens
cccagcgagccctggtggc

SEQ ID NO: 3512214 - DNA, 19 bp, Homo sapiens
cccagctaagaacctggaa

SEQ ID NO: 3512215 - DNA, 21 bp, Homo sapiens
cccagctaatacccagagcac

SEQ ID NO: 3512216 - DNA, 22 bp, Homo sapiens
cccagctactctgatccctctg

SEQ ID NO: 3512217 - DNA, 13 bp, Homo sapiens
cccagctaggaag

SEQ ID NO: 3512218 - DNA, 23 bp, Homo sapiens
cccagctaggaagagcaggactc

SEQ ID NO: 3512219 - DNA, 20 bp, Homo sapiens
cccagctatacctgtgcctc

SEQ ID NO: 3512220 - DNA, 17 bp, Homo sapiens
cccagctccggcctgtc

SEQ ID NO: 3512221 - DNA, 14 bp, Homo sapiens
cccagctctgaaac

SEQ ID NO: 3512222 - DNA, 17 bp, Homo sapiens
cccagctgggtcaggca

SEQ ID NO: 3512223 - DNA, 19 bp, Homo sapiens
cccagctgggtcaggcagg

SEQ ID NO: 3512224 - DNA, 21 bp, Homo sapiens
cccagctgtgctctggacagg

SEQ ID NO: 3512225 - DNA, 23 bp, Homo sapiens
cccagctgtgctctggacaggca

SEQ ID NO: 3512226 - DNA, 16 bp, Homo sapiens
cccaggaaaggcccag

SEQ ID NO: 3512227 - DNA, 16 bp, Homo sapiens
cccaggacctggctgc

SEQ ID NO: 3512228 - DNA, 15 bp, Homo sapiens
cccaggactctgacc

SEQ ID NO: 3512229 - DNA, 19 bp, Homo sapiens
cccaggactctgaccccag

SEQ ID NO: 3512230 - DNA, 21 bp, Homo sapiens
cccaggagccccgaggccttc

SEQ ID NO: 3512231 - DNA, 15 bp, Homo sapiens
cccaggcagggccaa

SEQ ID NO: 3512232 - DNA, 23 bp, Homo sapiens
cccaggcagggccaacccttctc

SEQ ID NO: 3512233 - DNA, 17 bp, Homo sapiens
cccaggcaggtcttgaa

SEQ ID NO: 3512234 - DNA, 12 bp, Homo sapiens
cccaggcccctg

SEQ ID NO: 3512235 - DNA, 14 bp, Homo sapiens
cccaggcctatgtt

SEQ ID NO: 3512236 - DNA, 19 bp, Homo sapiens
cccaggctggcgtgcagtg

SEQ ID NO: 3512237 - DNA, 19 bp, Homo sapiens
cccaggcttgtcactagca

SEQ ID NO: 3512238 - DNA, 23 bp, Homo sapiens
cccagggcaagggttaaggcctg

SEQ ID NO: 3512239 - DNA, 13 bp, Homo sapiens
cccagggcccaga

SEQ ID NO: 3512240 - DNA, 16 bp, Homo sapiens
cccagggcccccacag

SEQ ID NO: 3512241 - DNA, 17 bp, Homo sapiens
cccagggcccccacagg

SEQ ID NO: 3512242 - DNA, 20 bp, Homo sapiens
cccagggcccccacaggccc

SEQ ID NO: 3512243 - DNA, 16 bp, Homo sapiens
cccagggcctgcagga

SEQ ID NO: 3512244 - DNA, 19 bp, Homo sapiens
cccagggcctgcaggacct

SEQ ID NO: 3512245 - DNA, 19 bp, Homo sapiens
cccagggtggagtgcagtg

SEQ ID NO: 3512246 - DNA, 14 bp, Homo sapiens
cccaggtccagctc

SEQ ID NO: 3512247 - DNA, 14 bp, Homo sapiens
cccaggtctctcca

SEQ ID NO: 3512248 - DNA, 18 bp, Homo sapiens
cccaggtctctccactgc

SEQ ID NO: 3512249 - DNA, 20 bp, Homo sapiens
cccaggtgcagccagaggca

SEQ ID NO: 3512250 - DNA, 21 bp, Homo sapiens
cccaggtgcagccagaggcac

SEQ ID NO: 3512251 - DNA, 15 bp, Homo sapiens
cccaggtgggtcccg

SEQ ID NO: 3512252 - DNA, 13 bp, Homo sapiens
cccaggtttctat

SEQ ID NO: 3512253 - DNA, 22 bp, Homo sapiens
cccaggtttctggtctctaggc

SEQ ID NO: 3512254 - DNA, 12 bp, Homo sapiens
cccagtaaaatt

SEQ ID NO: 3512255 - DNA, 13 bp, Homo sapiens
cccagtaaaattg

SEQ ID NO: 3512256 - DNA, 17 bp, Homo sapiens
cccagtaaaattgccat

SEQ ID NO: 3512257 - DNA, 20 bp, Homo sapiens
cccagtacctcctgtctctg

SEQ ID NO: 3512258 - DNA, 21 bp, Homo sapiens
cccagtacctcctgtctctgg

SEQ ID NO: 3512259 - DNA, 21 bp, Homo sapiens
cccagtcccaccctgctgctg

SEQ ID NO: 3512260 - DNA, 14 bp, Homo sapiens
cccagtctcctctc

SEQ ID NO: 3512261 - DNA, 10 bp, Homo sapiens
cccagtctgg

SEQ ID NO: 3512262 - DNA, 20 bp, Homo sapiens
cccagtctggaatgcagtgg

SEQ ID NO: 3512263 - DNA, 21 bp, Homo sapiens
cccagtgcccacaggatcagt

SEQ ID NO: 3512264 - DNA, 15 bp, Homo sapiens
cccagtgccgagaag

SEQ ID NO: 3512265 - DNA, 18 bp, Homo sapiens
cccagtggctgctgccca

SEQ ID NO: 3512266 - DNA, 21 bp, Homo sapiens
cccagtggctgctgcccaggc

SEQ ID NO: 3512267 - DNA, 18 bp, Homo sapiens
cccagttcctatgacaca

SEQ ID NO: 3512268 - DNA, 19 bp, Homo sapiens
cccagttttgttgccccag

SEQ ID NO: 3512269 - DNA, 22 bp, Homo sapiens
cccataataaaggttgtgaatg

SEQ ID NO: 3512270 - DNA, 13 bp, Homo sapiens
cccatccagggcc

SEQ ID NO: 3512271 - DNA, 21 bp, Homo sapiens
cccatctatgtcccttgctgt

SEQ ID NO: 3512272 - DNA, 16 bp, Homo sapiens
cccatctcaggccaga

SEQ ID NO: 3512273 - DNA, 14 bp, Homo sapiens
cccatctcatgccc

SEQ ID NO: 3512274 - DNA, 21 bp, Homo sapiens
cccatctcatgcccctggctg

SEQ ID NO: 3512275 - DNA, 22 bp, Homo sapiens
cccatctcatgcccctggctgg

SEQ ID NO: 3512276 - DNA, 16 bp, Homo sapiens
cccatctcccctcagc

SEQ ID NO: 3512277 - DNA, 13 bp, Homo sapiens
cccatctctccct

SEQ ID NO: 3512278 - DNA, 18 bp, Homo sapiens
cccatctctccctcccct

SEQ ID NO: 3512279 - DNA, 21 bp, Homo sapiens
cccatcttcgggaccaggatt

SEQ ID NO: 3512280 - DNA, 17 bp, Homo sapiens
cccatgacccaggctgg

SEQ ID NO: 3512281 - DNA, 22 bp, Homo sapiens
cccatgaccttatccttcctct

SEQ ID NO: 3512282 - DNA, 14 bp, Homo sapiens
cccatgagcctcag

SEQ ID NO: 3512283 - DNA, 22 bp, Homo sapiens
cccatgagcctcagcatcctgg

SEQ ID NO: 3512284 - DNA, 19 bp, Homo sapiens
cccatgcactgtgaaggac

SEQ ID NO: 3512285 - DNA, 20 bp, Homo sapiens
cccatgcttacgtgatcctc

SEQ ID NO: 3512286 - DNA, 17 bp, Homo sapiens
cccatggccctcccagt

SEQ ID NO: 3512287 - DNA, 13 bp, Homo sapiens
cccatggctctat

SEQ ID NO: 3512288 - DNA, 21 bp, Homo sapiens
cccatggctctatttcttctt

SEQ ID NO: 3512289 - DNA, 19 bp, Homo sapiens
cccatggggagggattctg

SEQ ID NO: 3512290 - DNA, 14 bp, Homo sapiens
cccatgtagccccc

SEQ ID NO: 3512291 - DNA, 22 bp, Homo sapiens
cccatgtagccccctggcctct

SEQ ID NO: 3512292 - DNA, 12 bp, Homo sapiens
cccattcctgaa

SEQ ID NO: 3512293 - DNA, 17 bp, Homo sapiens
cccattcgcgctctgct

SEQ ID NO: 3512294 - DNA, 21 bp, Homo sapiens
cccattcggtgtggtgcagtg

SEQ ID NO: 3512295 - DNA, 22 bp, Homo sapiens
ccatcattgctgtctgcagcct

SEQ ID NO: 3512296 - DNA, 18 bp, Homo sapiens
ccatccagtgacaaacca

SEQ ID NO: 3512297 - DNA, 14 bp, Homo sapiens
ccatccattctgga

SEQ ID NO: 3512298 - DNA, 12 bp, Homo sapiens
ccatcccacacc

SEQ ID NO: 3512299 - DNA, 14 bp, Homo sapiens
ccatcccacaccct

SEQ ID NO: 3512300 - DNA, 16 bp, Homo sapiens
ccatcccctgtagagt

SEQ ID NO: 3512301 - DNA, 13 bp, Homo sapiens
ccatcctcaaaca

SEQ ID NO: 3512302 - DNA, 21 bp, Homo sapiens
ccatcctcatctctcttgggc

SEQ ID NO: 3512303 - DNA, 14 bp, Homo sapiens
ccatcctccagcag

SEQ ID NO: 3512304 - DNA, 13 bp, Homo sapiens
ccatcctggctgc

SEQ ID NO: 3512305 - DNA, 20 bp, Homo sapiens
ccatccttccctgtctgcca

SEQ ID NO: 3512306 - DNA, 21 bp, Homo sapiens
ccatctcaggacacttccgta

SEQ ID NO: 3512307 - DNA, 11 bp, Homo sapiens
ccatctcaggc

SEQ ID NO: 3512308 - DNA, 20 bp, Homo sapiens
ccatctcatgcccctggctg

SEQ ID NO: 3512309 - DNA, 20 bp, Homo sapiens
ccatctcccccatcccccac

SEQ ID NO: 3512310 - DNA, 14 bp, Homo sapiens
ccatctcccctcag

SEQ ID NO: 3512311 - DNA, 18 bp, Homo sapiens
ccatctcccctcagctcg

SEQ ID NO: 3512312 - DNA, 20 bp, Homo sapiens
ccatctcgggcacaggccca

SEQ ID NO: 3512313 - DNA, 18 bp, Homo sapiens
ccatctctcatcctccag

SEQ ID NO: 3512314 - DNA, 15 bp, Homo sapiens
ccatctctggatgcc

SEQ ID NO: 3512315 - DNA, 22 bp, Homo sapiens
ccatctgctgccccgcttcccc

SEQ ID NO: 3512316 - DNA, 22 bp, Homo sapiens
ccatctggttaggatggcagga

SEQ ID NO: 3512317 - DNA, 11 bp, Homo sapiens
ccatctgtctt

SEQ ID NO: 3512318 - DNA, 20 bp, Homo sapiens
ccatctgtcttgccagccag

SEQ ID NO: 3512319 - DNA, 21 bp, Homo sapiens
ccatctgtcttgccagccaga

SEQ ID NO: 3512320 - DNA, 14 bp, Homo sapiens
ccatctgtgcattc

SEQ ID NO: 3512321 - DNA, 20 bp, Homo sapiens
ccatcttcgggaccaggatt

SEQ ID NO: 3512322 - DNA, 21 bp, Homo sapiens
ccatcttgcttccctaatcta

SEQ ID NO: 3512323 - DNA, 19 bp, Homo sapiens
ccatgagcctcagcatcct

SEQ ID NO: 3512324 - DNA, 21 bp, Homo sapiens
ccatgagttggggtctggcag

SEQ ID NO: 3512325 - DNA, 23 bp, Homo sapiens
ccatgagttggggtctggcagcc

SEQ ID NO: 3512326 - DNA, 20 bp, Homo sapiens
ccatgatctgcaggggtctg

SEQ ID NO: 3512327 - DNA, 20 bp, Homo sapiens
ccatgatgcctctgtcttct

SEQ ID NO: 3512328 - DNA, 12 bp, Homo sapiens
ccatgatgctgg

SEQ ID NO: 3512329 - DNA, 15 bp, Homo sapiens
ccatgatggcaacag

SEQ ID NO: 3512330 - DNA, 18 bp, Homo sapiens
ccatgatgtagtgcctct

SEQ ID NO: 3512331 - DNA, 21 bp, Homo sapiens
ccatgattaaccacttcagct

SEQ ID NO: 3512332 - DNA, 13 bp, Homo sapiens
ccatgcactgtga

SEQ ID NO: 3512333 - DNA, 15 bp, Homo sapiens
ccatgcactgtgaag

SEQ ID NO: 3512334 - DNA, 16 bp, Homo sapiens
ccatgcactgtgaagg

SEQ ID NO: 3512335 - DNA, 20 bp, Homo sapiens
ccatgcactgtgaaggaccc

SEQ ID NO: 3512336 - DNA, 12 bp, Homo sapiens
ccatgcctcagc

SEQ ID NO: 3512337 - DNA, 21 bp, Homo sapiens
ccatgcctcagccctgaccct

SEQ ID NO: 3512338 - DNA, 22 bp, Homo sapiens
ccatgcgacactgggaggccag

SEQ ID NO: 3512339 - DNA, 14 bp, Homo sapiens
ccatgcgccccctc

SEQ ID NO: 3512340 - DNA, 22 bp, Homo sapiens
ccatgcgccccctccgccctgc

SEQ ID NO: 3512341 - DNA, 13 bp, Homo sapiens
ccatgcgctcagg

SEQ ID NO: 3512342 - DNA, 16 bp, Homo sapiens
ccatgcgctcagggcc

SEQ ID NO: 3512343 - DNA, 16 bp, Homo sapiens
ccatgctgaggcctgg

SEQ ID NO: 3512344 - DNA, 12 bp, Homo sapiens
ccatggaacctg

SEQ ID NO: 3512345 - DNA, 14 bp, Homo sapiens
ccatggacaggctg

SEQ ID NO: 3512346 - DNA, 18 bp, Homo sapiens
ccatggagagctggagcc

SEQ ID NO: 3512347 - DNA, 19 bp, Homo sapiens
ccatggagagctggagcct

SEQ ID NO: 3512348 - DNA, 17 bp, Homo sapiens
ccatggagccagctccc

SEQ ID NO: 3512349 - DNA, 13 bp, Homo sapiens
ccatggctctatt

SEQ ID NO: 3512350 - DNA, 20 bp, Homo sapiens
ccatggctctatttcttctt

SEQ ID NO: 3512351 - DNA, 11 bp, Homo sapiens
ccatgggacca

SEQ ID NO: 3512352 - DNA, 15 bp, Homo sapiens
ccatgggaccacaac

SEQ ID NO: 3512353 - DNA, 14 bp, Homo sapiens
ccatgggcagagcc

SEQ ID NO: 3512354 - DNA, 17 bp, Homo sapiens
ccatgggcagagcccaa

SEQ ID NO: 3512355 - DNA, 23 bp, Homo sapiens
ccatgtaaatccccactgggacc

SEQ ID NO: 3512356 - DNA, 16 bp, Homo sapiens
ccatgtagaaaatttg

SEQ ID NO: 3512357 - DNA, 14 bp, Homo sapiens
ccatgtagccccct

SEQ ID NO: 3512358 - DNA, 22 bp, Homo sapiens
ccatgtagccccctggcctctg

SEQ ID NO: 3512359 - DNA, 23 bp, Homo sapiens
ccatgtagccccctggcctctgt

SEQ ID NO: 3512360 - DNA, 15 bp, Homo sapiens
ccatgtcccctccca

SEQ ID NO: 3512361 - DNA, 20 bp, Homo sapiens
ccatgtgaaactcatctcat

SEQ ID NO: 3512362 - DNA, 18 bp, Homo sapiens
ccatgtgactctggcttg

SEQ ID NO: 3512363 - DNA, 17 bp, Homo sapiens
ccatgtggtgatgatgt

SEQ ID NO: 3512364 - DNA, 20 bp, Homo sapiens
ccatgttaagtcctccctga

SEQ ID NO: 3512365 - DNA, 21 bp, Homo sapiens
ccatgttaagtcctccctgac

SEQ ID NO: 3512366 - DNA, 17 bp, Homo sapiens
ccatgttggccaggctg

SEQ ID NO: 3512367 - DNA, 22 bp, Homo sapiens
ccattaaccagatctagtcaat

SEQ ID NO: 3512368 - DNA, 18 bp, Homo sapiens
ccattatccattcccaag

SEQ ID NO: 3512369 - DNA, 15 bp, Homo sapiens
ccattcacagagcct

SEQ ID NO: 3512370 - DNA, 16 bp, Homo sapiens
ccattcagacacttca

SEQ ID NO: 3512371 - DNA, 22 bp, Homo sapiens
ccattccagtcaaatctgggct

SEQ ID NO: 3512372 - DNA, 16 bp, Homo sapiens
ccattcccaagatgcc

SEQ ID NO: 3512373 - DNA, 19 bp, Homo sapiens
ccattcccaagatgcctga

SEQ ID NO: 3512374 - DNA, 16 bp, Homo sapiens
ccattcccttcggcca

SEQ ID NO: 3512375 - DNA, 13 bp, Homo sapiens
ccattctccacag

SEQ ID NO: 3512376 - DNA, 16 bp, Homo sapiens
ccattctccacagcaa

SEQ ID NO: 3512377 - DNA, 18 bp, Homo sapiens
ccattctccacagcaacc

SEQ ID NO: 3512378 - DNA, 14 bp, Homo sapiens
ccattctctctcct

SEQ ID NO: 3512379 - DNA, 20 bp, Homo sapiens
ccattctgactcggtttctc

SEQ ID NO: 3512380 - DNA, 16 bp, Homo sapiens
ccattctgcctgccca

SEQ ID NO: 3512381 - DNA, 18 bp, Homo sapiens
ccattctgcctgcccagg

SEQ ID NO: 3512382 - DNA, 20 bp, Homo sapiens
ccattcttgagtcatggatt

SEQ ID NO: 3512383 - DNA, 12 bp, Homo sapiens
ccattctttctg

SEQ ID NO: 3512384 - DNA, 18 bp, Homo sapiens
ccattcttttgtaattta

SEQ ID NO: 3512385 - DNA, 19 bp, Homo sapiens
ccattgtccaatcctatgt

SEQ ID NO: 3512386 - DNA, 19 bp, Homo sapiens
ccattgtgaaccaatgcaa

SEQ ID NO: 3512387 - DNA, 19 bp, Homo sapiens
ccatttcatattctttcaa

SEQ ID NO: 3512388 - DNA, 14 bp, Homo sapiens
ccatttccagttca

SEQ ID NO: 3512389 - DNA, 19 bp, Homo sapiens
ccatttgtaaaacattcca

SEQ ID NO: 3512390 - DNA, 15 bp, Homo sapiens
ccattttaagtccct

SEQ ID NO: 3512391 - DNA, 23 bp, Homo sapiens
ccattttcttattgcgctgctac

SEQ ID NO: 3512392 - DNA, 15 bp, Homo sapiens
ccatttttcaaagca

SEQ ID NO: 3512393 - DNA, 15 bp, Homo sapiens
ccatttttgagccaa

SEQ ID NO: 3512394 - DNA, 23 bp, Homo sapiens
cccaaaacctcatgacagccaga

SEQ ID NO: 3512395 - DNA, 16 bp, Homo sapiens
cccaaacgccctttcc

SEQ ID NO: 3512396 - DNA, 22 bp, Homo sapiens
cccaaacttttaaaagtaggaa

SEQ ID NO: 3512397 - DNA, 18 bp, Homo sapiens
cccaaatccgaacctcct

SEQ ID NO: 3512398 - DNA, 15 bp, Homo sapiens
cccaaccccagggcc

SEQ ID NO: 3512399 - DNA, 23 bp, Homo sapiens
cccaaccccttaagccctggccc

SEQ ID NO: 3512400 - DNA, 14 bp, Homo sapiens
cccaagatgcctga

SEQ ID NO: 3512401 - DNA, 15 bp, Homo sapiens
cccaagatgcctgat

SEQ ID NO: 3512402 - DNA, 14 bp, Homo sapiens
cccaagcagagaag

SEQ ID NO: 3512403 - DNA, 16 bp, Homo sapiens
cccaagccagaggctg

SEQ ID NO: 3512404 - DNA, 14 bp, Homo sapiens
cccaagctctgctc

SEQ ID NO: 3512405 - DNA, 16 bp, Homo sapiens
cccaagctggctgggg

SEQ ID NO: 3512406 - DNA, 19 bp, Homo sapiens
cccaaggctcccggaattc

SEQ ID NO: 3512407 - DNA, 19 bp, Homo sapiens
cccaagtgccaagacacag

SEQ ID NO: 3512408 - DNA, 16 bp, Homo sapiens
cccaagtggcagagct

SEQ ID NO: 3512409 - DNA, 15 bp, Homo sapiens
cccaatattataatt

SEQ ID NO: 3512410 - DNA, 14 bp, Homo sapiens
cccaattgctggag

SEQ ID NO: 3512411 - DNA, 15 bp, Homo sapiens
cccaatttcagactc

SEQ ID NO: 3512412 - DNA, 15 bp, Homo sapiens
cccacaaaggcaaag

SEQ ID NO: 3512413 - DNA, 14 bp, Homo sapiens
cccacaagtggtgg

SEQ ID NO: 3512414 - DNA, 12 bp, Homo sapiens
cccacagaactg

SEQ ID NO: 3512415 - DNA, 23 bp, Homo sapiens
cccacagacaaaagcgcttttcc

SEQ ID NO: 3512416 - DNA, 23 bp, Homo sapiens
cccacagactcaaatgctcagac

SEQ ID NO: 3512417 - DNA, 20 bp, Homo sapiens
cccacaggacatttctctaa

SEQ ID NO: 3512418 - DNA, 21 bp, Homo sapiens
cccacaggccccccgcagcac

SEQ ID NO: 3512419 - DNA, 11 bp, Homo sapiens
cccaccagcct

SEQ ID NO: 3512420 - DNA, 16 bp, Homo sapiens
cccaccatatgaattg

SEQ ID NO: 3512421 - DNA, 13 bp, Homo sapiens
cccaccccaggcc

SEQ ID NO: 3512422 - DNA, 22 bp, Homo sapiens
cccacccctgggggctctcatg

SEQ ID NO: 3512423 - DNA, 13 bp, Homo sapiens
cccaccctgggcc

SEQ ID NO: 3512424 - DNA, 18 bp, Homo sapiens
cccaccctggtgggccaa

SEQ ID NO: 3512425 - DNA, 17 bp, Homo sapiens
cccaccgtgggcaggga

SEQ ID NO: 3512426 - DNA, 21 bp, Homo sapiens
cccacctcagcctcccaaagt

SEQ ID NO: 3512427 - DNA, 14 bp, Homo sapiens
cccacctccctgcc

SEQ ID NO: 3512428 - DNA, 16 bp, Homo sapiens
cccacctccctgcctc

SEQ ID NO: 3512429 - DNA, 17 bp, Homo sapiens
cccacctccctgcctcc

SEQ ID NO: 3512430 - DNA, 19 bp, Homo sapiens
cccacctgcatctggggcc

SEQ ID NO: 3512431 - DNA, 23 bp, Homo sapiens
cccacctgtcaaacaaagccaga

SEQ ID NO: 3512432 - DNA, 16 bp, Homo sapiens
ccagaaaacaaaactg

SEQ ID NO: 3512433 - DNA, 16 bp, Homo sapiens
ccagaaaacctccagt

SEQ ID NO: 3512434 - DNA, 22 bp, Homo sapiens
ccagaaaggtgattccaggagg

SEQ ID NO: 3512435 - DNA, 12 bp, Homo sapiens
ccagaagcctct

SEQ ID NO: 3512436 - DNA, 20 bp, Homo sapiens
ccagaagctgagcaccaggg

SEQ ID NO: 3512437 - DNA, 17 bp, Homo sapiens
ccagaaggagacaggca

SEQ ID NO: 3512438 - DNA, 18 bp, Homo sapiens
ccagaaggagacaggcag

SEQ ID NO: 3512439 - DNA, 16 bp, Homo sapiens
ccagaatgctgtacat

SEQ ID NO: 3512440 - DNA, 21 bp, Homo sapiens
ccagaatgctgtacatctatt

SEQ ID NO: 3512441 - DNA, 13 bp, Homo sapiens
ccagacacccagg

SEQ ID NO: 3512442 - DNA, 15 bp, Homo sapiens
ccagacacccaggac

SEQ ID NO: 3512443 - DNA, 17 bp, Homo sapiens
ccagacaccttgacagg

SEQ ID NO: 3512444 - DNA, 20 bp, Homo sapiens
ccagacaccttgacagggca

SEQ ID NO: 3512445 - DNA, 21 bp, Homo sapiens
ccagacaccttgacagggcac

SEQ ID NO: 3512446 - DNA, 17 bp, Homo sapiens
ccagacagacaacactg

SEQ ID NO: 3512447 - DNA, 21 bp, Homo sapiens
ccagacagaccttcacagatg

SEQ ID NO: 3512448 - DNA, 14 bp, Homo sapiens
ccagacatgccaca

SEQ ID NO: 3512449 - DNA, 14 bp, Homo sapiens
ccagacccggctgc

SEQ ID NO: 3512450 - DNA, 15 bp, Homo sapiens
ccagacccggctgcg

SEQ ID NO: 3512451 - DNA, 16 bp, Homo sapiens
ccagacccggctgcgt

SEQ ID NO: 3512452 - DNA, 19 bp, Homo sapiens
ccagaccctgaagatttca

SEQ ID NO: 3512453 - DNA, 18 bp, Homo sapiens
ccagacctgatcctggag

SEQ ID NO: 3512454 - DNA, 20 bp, Homo sapiens
ccagacctgatcctggaggc

SEQ ID NO: 3512455 - DNA, 21 bp, Homo sapiens
ccagactccgcctgaggccag

SEQ ID NO: 3512456 - DNA, 23 bp, Homo sapiens
ccagagaaaggggagcccactgt

SEQ ID NO: 3512457 - DNA, 21 bp, Homo sapiens
ccagagagcctggtgctgctg

SEQ ID NO: 3512458 - DNA, 22 bp, Homo sapiens
ccagagagcctggtgctgctgc

SEQ ID NO: 3512459 - DNA, 14 bp, Homo sapiens
ccagagagggtggt

SEQ ID NO: 3512460 - DNA, 13 bp, Homo sapiens
ccagagatccaaa

SEQ ID NO: 3512461 - DNA, 15 bp, Homo sapiens
ccagagattcatttt

SEQ ID NO: 3512462 - DNA, 19 bp, Homo sapiens
ccagagcacccagatcaga

SEQ ID NO: 3512463 - DNA, 11 bp, Homo sapiens
ccagagccaaa

SEQ ID NO: 3512464 - DNA, 11 bp, Homo sapiens
ccagagccagg

SEQ ID NO: 3512465 - DNA, 12 bp, Homo sapiens
ccagagccaggg

SEQ ID NO: 3512466 - DNA, 22 bp, Homo sapiens
ccagagcccaccttggctcaag

SEQ ID NO: 3512467 - DNA, 22 bp, Homo sapiens
ccagaggaaggggccagaggct

SEQ ID NO: 3512468 - DNA, 12 bp, Homo sapiens
ccagaggagggc

SEQ ID NO: 3512469 - DNA, 21 bp, Homo sapiens
ccagaggattgctgccccatc

SEQ ID NO: 3512470 - DNA, 15 bp, Homo sapiens
ccagaggcccccagc

SEQ ID NO: 3512471 - DNA, 22 bp, Homo sapiens
ccagaggcctcttttcctgaag

SEQ ID NO: 3512472 - DNA, 15 bp, Homo sapiens
ccagaggctgggttc

SEQ ID NO: 3512473 - DNA, 20 bp, Homo sapiens
ccagagggagtgacagaggc

SEQ ID NO: 3512474 - DNA, 21 bp, Homo sapiens
ccagagtggggatgacatgca

SEQ ID NO: 3512475 - DNA, 13 bp, Homo sapiens
ccagatccagcct

SEQ ID NO: 3512476 - DNA, 16 bp, Homo sapiens
ccagatccagcctggg

SEQ ID NO: 3512477 - DNA, 13 bp, Homo sapiens
ccagatcccaggc

SEQ ID NO: 3512478 - DNA, 19 bp, Homo sapiens
ccagatcccaggcccctgg

SEQ ID NO: 3512479 - DNA, 14 bp, Homo sapiens
ccagatctcatgga

SEQ ID NO: 3512480 - DNA, 13 bp, Homo sapiens
ccagatgcaccag

SEQ ID NO: 3512481 - DNA, 23 bp, Homo sapiens
ccagatgcaccagcccttagcag

SEQ ID NO: 3512482 - DNA, 14 bp, Homo sapiens
ccagatgcagggca

SEQ ID NO: 3512483 - DNA, 14 bp, Homo sapiens
ccagatgctgcaga

SEQ ID NO: 3512484 - DNA, 19 bp, Homo sapiens
ccagatgctgcagagtcac

SEQ ID NO: 3512485 - DNA, 17 bp, Homo sapiens
ccagattcccctgtgtc

SEQ ID NO: 3512486 - DNA, 14 bp, Homo sapiens
ccagattgcaacag

SEQ ID NO: 3512487 - DNA, 15 bp, Homo sapiens
ccagattttgctgta

SEQ ID NO: 3512488 - DNA, 15 bp, Homo sapiens
ccagcaagtgagagc

SEQ ID NO: 3512489 - DNA, 21 bp, Homo sapiens
ccagcaagtgagagctgggtg

SEQ ID NO: 3512490 - DNA, 22 bp, Homo sapiens
ccagcaagtgagagctgggtgt

SEQ ID NO: 3512491 - DNA, 21 bp, Homo sapiens
ccagcactatgctttccttct

SEQ ID NO: 3512492 - DNA, 12 bp, Homo sapiens
ccagcactgagg

SEQ ID NO: 3512493 - DNA, 15 bp, Homo sapiens
ccagcactgaggaag

SEQ ID NO: 3512494 - DNA, 19 bp, Homo sapiens
ccagcacttgtccagctga

SEQ ID NO: 3512495 - DNA, 15 bp, Homo sapiens
ccagcagaagacaaa

SEQ ID NO: 3512496 - DNA, 15 bp, Homo sapiens
ccagcagcagcccaa

SEQ ID NO: 3512497 - DNA, 17 bp, Homo sapiens
ccagcagcgcctttccc

SEQ ID NO: 3512498 - DNA, 23 bp, Homo sapiens
ccagcagtctctgccttgccttt

SEQ ID NO: 3512499 - DNA, 15 bp, Homo sapiens
ccagcagttttcaag

SEQ ID NO: 3512500 - DNA, 12 bp, Homo sapiens
ccagcatctctg

SEQ ID NO: 3512501 - DNA, 16 bp, Homo sapiens
ccagcattccagcccc

SEQ ID NO: 3512502 - DNA, 20 bp, Homo sapiens
ccagcattccagcccctctg

SEQ ID NO: 3512503 - DNA, 21 bp, Homo sapiens
ccagcattccagcccctctgg

SEQ ID NO: 3512504 - DNA, 22 bp, Homo sapiens
ccagcattccagcccctctggt

SEQ ID NO: 3512505 - DNA, 18 bp, Homo sapiens
ccagcattttactgattc

SEQ ID NO: 3512506 - DNA, 17 bp, Homo sapiens
ccagccaaaccctgtct

SEQ ID NO: 3512507 - DNA, 18 bp, Homo sapiens
ccagccaaaccctgtctg

SEQ ID NO: 3512508 - DNA, 17 bp, Homo sapiens
ccagccaaacgggagct

SEQ ID NO: 3512509 - DNA, 22 bp, Homo sapiens
ccagccaacttttgcatgtttt

SEQ ID NO: 3512510 - DNA, 13 bp, Homo sapiens
ccagccagaagcc

SEQ ID NO: 3512511 - DNA, 15 bp, Homo sapiens
ccagccaggccctgc

SEQ ID NO: 3512512 - DNA, 13 bp, Homo sapiens
ccagccagggctg

SEQ ID NO: 3512513 - DNA, 20 bp, Homo sapiens
ccagccagtgacctgaggaa

SEQ ID NO: 3512514 - DNA, 18 bp, Homo sapiens
ccagcccaagtagagggg

SEQ ID NO: 3512515 - DNA, 17 bp, Homo sapiens
ccagcccacttctgcca

SEQ ID NO: 3512516 - DNA, 11 bp, Homo sapiens
ccagcccagag

SEQ ID NO: 3512517 - DNA, 23 bp, Homo sapiens
ccagcccagagacatacttgaag

SEQ ID NO: 3512518 - DNA, 15 bp, Homo sapiens
ccagcccagggctcc

SEQ ID NO: 3512519 - DNA, 14 bp, Homo sapiens
ccagcccctactgc

SEQ ID NO: 3512520 - DNA, 15 bp, Homo sapiens
ccagcccctctggtc

SEQ ID NO: 3512521 - DNA, 17 bp, Homo sapiens
ccagcccctctggtcgc

SEQ ID NO: 3512522 - DNA, 13 bp, Homo sapiens
ccagcccctggcc

SEQ ID NO: 3512523 - DNA, 23 bp, Homo sapiens
ccagcccctggccccaggacctg

SEQ ID NO: 3512524 - DNA, 21 bp, Homo sapiens
ccagccccttctcagaatcta

SEQ ID NO: 3512525 - DNA, 18 bp, Homo sapiens
ccagccgccatgctcctg

SEQ ID NO: 3512526 - DNA, 16 bp, Homo sapiens
ccagcctaagaagctc

SEQ ID NO: 3512527 - DNA, 14 bp, Homo sapiens
ccagcctcagctct

SEQ ID NO: 3512528 - DNA, 21 bp, Homo sapiens
ccagcctccctgaagcctttg

SEQ ID NO: 3512529 - DNA, 13 bp, Homo sapiens
ccagcctgcgcct

SEQ ID NO: 3512530 - DNA, 15 bp, Homo sapiens
ccagcctgctagcta

SEQ ID NO: 3512531 - DNA, 13 bp, Homo sapiens
ccagcctggagat

SEQ ID NO: 3512532 - DNA, 20 bp, Homo sapiens
ccagcctggagatgaaatct

SEQ ID NO: 3512533 - DNA, 13 bp, Homo sapiens
ccagcgagccctg

SEQ ID NO: 3512534 - DNA, 15 bp, Homo sapiens
ccagcgagccctggt

SEQ ID NO: 3512535 - DNA, 16 bp, Homo sapiens
ccagcgagccctggtg

SEQ ID NO: 3512536 - DNA, 16 bp, Homo sapiens
ccagcgaggaggctcc

SEQ ID NO: 3512537 - DNA, 17 bp, Homo sapiens
ccagcgggaatggcagc

SEQ ID NO: 3512538 - DNA, 22 bp, Homo sapiens
ccagcgtatatataagaaagac

SEQ ID NO: 3512539 - DNA, 13 bp, Homo sapiens
ccagcgtcctcct

SEQ ID NO: 3512540 - DNA, 21 bp, Homo sapiens
ccagctactcgggaggctgag

SEQ ID NO: 3512541 - DNA, 23 bp, Homo sapiens
ccagctaggaagagcaggactcc

SEQ ID NO: 3512542 - DNA, 15 bp, Homo sapiens
ccagctatacctgtg

SEQ ID NO: 3512543 - DNA, 16 bp, Homo sapiens
ccagctatacctgtgc

SEQ ID NO: 3512544 - DNA, 14 bp, Homo sapiens
ccagctatctgcct

SEQ ID NO: 3512545 - DNA, 17 bp, Homo sapiens
ccagctatctgcctgac

SEQ ID NO: 3512546 - DNA, 13 bp, Homo sapiens
ccagctcacagtg

SEQ ID NO: 3512547 - DNA, 16 bp, Homo sapiens
ccagctcaccagcccc

SEQ ID NO: 3512548 - DNA, 13 bp, Homo sapiens
ccagctcaggaca

SEQ ID NO: 3512549 - DNA, 19 bp, Homo sapiens
ccagctcaggacagatgcc

SEQ ID NO: 3512550 - DNA, 15 bp, Homo sapiens
ccagctccaacctgc

SEQ ID NO: 3512551 - DNA, 22 bp, Homo sapiens
ccagctccaaggggaatcagaa

SEQ ID NO: 3512552 - DNA, 14 bp, Homo sapiens
ccagctccccagga

SEQ ID NO: 3512553 - DNA, 16 bp, Homo sapiens
ccagctccctctattt

SEQ ID NO: 3512554 - DNA, 15 bp, Homo sapiens
ccagctctgaaacca

SEQ ID NO: 3512555 - DNA, 20 bp, Homo sapiens
ccagctctgaaaccagtgtt

SEQ ID NO: 3512556 - DNA, 19 bp, Homo sapiens
ccagctctggaggggaggg

SEQ ID NO: 3512557 - DNA, 16 bp, Homo sapiens
ccagctctttcctcct

SEQ ID NO: 3512558 - DNA, 13 bp, Homo sapiens
ccagctgcactga

SEQ ID NO: 3512559 - DNA, 19 bp, Homo sapiens
catgtggctcctcccagcc

SEQ ID NO: 3512560 - DNA, 13 bp, Homo sapiens
catgtgggcttca

SEQ ID NO: 3512561 - DNA, 15 bp, Homo sapiens
catgttctctgagga

SEQ ID NO: 3512562 - DNA, 22 bp, Homo sapiens
catgttgcacacccactcagct

SEQ ID NO: 3512563 - DNA, 20 bp, Homo sapiens
catgttggaggagagagcct

SEQ ID NO: 3512564 - DNA, 21 bp, Homo sapiens
catgttggaggagagagcctt

SEQ ID NO: 3512565 - DNA, 13 bp, Homo sapiens
catgttggccagg

SEQ ID NO: 3512566 - DNA, 18 bp, Homo sapiens
catgttggccaggctggt

SEQ ID NO: 3512567 - DNA, 19 bp, Homo sapiens
catgttgggaaacttggct

SEQ ID NO: 3512568 - DNA, 21 bp, Homo sapiens
catgttgggaaacttggctcg

SEQ ID NO: 3512569 - DNA, 23 bp, Homo sapiens
catgtttataaatcttatgctct

SEQ ID NO: 3512570 - DNA, 14 bp, Homo sapiens
catgtttccagcag

SEQ ID NO: 3512571 - DNA, 18 bp, Homo sapiens
catgttttaaagcttgct

SEQ ID NO: 3512572 - DNA, 18 bp, Homo sapiens
catgttttccagctcctc

SEQ ID NO: 3512573 - DNA, 15 bp, Homo sapiens
catgttttgtttacg

SEQ ID NO: 3512574 - DNA, 18 bp, Homo sapiens
catgtttttaaagggcta

SEQ ID NO: 3512575 - DNA, 12 bp, Homo sapiens
cattaaaacaat

SEQ ID NO: 3512576 - DNA, 13 bp, Homo sapiens
cattaaattacct

SEQ ID NO: 3512577 - DNA, 18 bp, Homo sapiens
cattaaattcacaaactt

SEQ ID NO: 3512578 - DNA, 13 bp, Homo sapiens
cattaagaaaatc

SEQ ID NO: 3512579 - DNA, 14 bp, Homo sapiens
ccaagtttatatac

SEQ ID NO: 3512580 - DNA, 14 bp, Homo sapiens
ccaatagctgccca

SEQ ID NO: 3512581 - DNA, 18 bp, Homo sapiens
ccaatattaaatctgctg

SEQ ID NO: 3512582 - DNA, 17 bp, Homo sapiens
ccaatatttaccagacc

SEQ ID NO: 3512583 - DNA, 22 bp, Homo sapiens
ccaatattttctttaatgcttt

SEQ ID NO: 3512584 - DNA, 22 bp, Homo sapiens
ccaatcagagaccaggccctgg

SEQ ID NO: 3512585 - DNA, 16 bp, Homo sapiens
ccaatcctactaataa

SEQ ID NO: 3512586 - DNA, 21 bp, Homo sapiens
ccaatcctactaataaaccag

SEQ ID NO: 3512587 - DNA, 13 bp, Homo sapiens
ccaatcctatgtt

SEQ ID NO: 3512588 - DNA, 14 bp, Homo sapiens
ccaatgctgatgtc

SEQ ID NO: 3512589 - DNA, 14 bp, Homo sapiens
ccaattatgttaaa

SEQ ID NO: 3512590 - DNA, 16 bp, Homo sapiens
ccaattttaatttagt

SEQ ID NO: 3512591 - DNA, 23 bp, Homo sapiens
ccaattttaatttagtaaatgtt

SEQ ID NO: 3512592 - DNA, 16 bp, Homo sapiens
ccacaaaggcaaaggg

SEQ ID NO: 3512593 - DNA, 13 bp, Homo sapiens
ccacaacctcttc

SEQ ID NO: 3512594 - DNA, 15 bp, Homo sapiens
ccacaacctcttccc

SEQ ID NO: 3512595 - DNA, 21 bp, Homo sapiens
ccacaagtggtggtaaccctg

SEQ ID NO: 3512596 - DNA, 22 bp, Homo sapiens
ccacacaaggatagatgctggc

SEQ ID NO: 3512597 - DNA, 22 bp, Homo sapiens
ccacacactgttttttggcttg

SEQ ID NO: 3512598 - DNA, 15 bp, Homo sapiens
ccacacatctgtgga

SEQ ID NO: 3512599 - DNA, 14 bp, Homo sapiens
ccacaccaagcagc

SEQ ID NO: 3512600 - DNA, 12 bp, Homo sapiens
ccacacccagcc

SEQ ID NO: 3512601 - DNA, 16 bp, Homo sapiens
ccacacccagctcagc

SEQ ID NO: 3512602 - DNA, 12 bp, Homo sapiens
ccacaccctccc

SEQ ID NO: 3512603 - DNA, 15 bp, Homo sapiens
ccacactcccaaggt

SEQ ID NO: 3512604 - DNA, 23 bp, Homo sapiens
ccacagacaaaagcgcttttcct

SEQ ID NO: 3512605 - DNA, 17 bp, Homo sapiens
ccacagccagcacctgg

SEQ ID NO: 3512606 - DNA, 19 bp, Homo sapiens
ccacagccagcacctggca

SEQ ID NO: 3512607 - DNA, 19 bp, Homo sapiens
ccacagcctcccctgccag

SEQ ID NO: 3512608 - DNA, 20 bp, Homo sapiens
ccacagcctcccctgccagg

SEQ ID NO: 3512609 - DNA, 14 bp, Homo sapiens
ccacagctgctgga

SEQ ID NO: 3512610 - DNA, 11 bp, Homo sapiens
ccacagcttcc

SEQ ID NO: 3512611 - DNA, 12 bp, Homo sapiens
ccacagcttcct

SEQ ID NO: 3512612 - DNA, 17 bp, Homo sapiens
ccacaggaagtgaagaa

SEQ ID NO: 3512613 - DNA, 21 bp, Homo sapiens
ccacaggacatttctctaaga

SEQ ID NO: 3512614 - DNA, 16 bp, Homo sapiens
ccacaggatcagtctg

SEQ ID NO: 3512615 - DNA, 21 bp, Homo sapiens
ccacaggccccccgcagcacc

SEQ ID NO: 3512616 - DNA, 17 bp, Homo sapiens
ccacaggccgccctgcg

SEQ ID NO: 3512617 - DNA, 12 bp, Homo sapiens
ccacaggcctga

SEQ ID NO: 3512618 - DNA, 14 bp, Homo sapiens
ccacaggcctgaga

SEQ ID NO: 3512619 - DNA, 18 bp, Homo sapiens
ccacagggcttgttttcc

SEQ ID NO: 3512620 - DNA, 22 bp, Homo sapiens
ccacatctaagcctgaaggggc

SEQ ID NO: 3512621 - DNA, 16 bp, Homo sapiens
ccacatcttgctctgc

SEQ ID NO: 3512622 - DNA, 23 bp, Homo sapiens
ccacatcttgctctgctgacaga

SEQ ID NO: 3512623 - DNA, 16 bp, Homo sapiens
ccacatgtgcacatgc

SEQ ID NO: 3512624 - DNA, 14 bp, Homo sapiens
ccaccacacccagc

SEQ ID NO: 3512625 - DNA, 16 bp, Homo sapiens
ccaccacacccagccc

SEQ ID NO: 3512626 - DNA, 15 bp, Homo sapiens
ccaccacagccagca

SEQ ID NO: 3512627 - DNA, 18 bp, Homo sapiens
ccaccacagccagcacct

SEQ ID NO: 3512628 - DNA, 17 bp, Homo sapiens
ccaccaccctgtcttcc

SEQ ID NO: 3512629 - DNA, 15 bp, Homo sapiens
ccaccagcctaagaa

SEQ ID NO: 3512630 - DNA, 13 bp, Homo sapiens
ccaccaggccacc

SEQ ID NO: 3512631 - DNA, 20 bp, Homo sapiens
ccaccaggtgcctttcaaat

SEQ ID NO: 3512632 - DNA, 20 bp, Homo sapiens
ccaccatatgaattgtacag

SEQ ID NO: 3512633 - DNA, 13 bp, Homo sapiens
ccaccccaggccc

SEQ ID NO: 3512634 - DNA, 15 bp, Homo sapiens
ccaccccaggccctg

SEQ ID NO: 3512635 - DNA, 19 bp, Homo sapiens
ccacccctcaacacctctg

SEQ ID NO: 3512636 - DNA, 21 bp, Homo sapiens
ccacccctggaagagcccagt

SEQ ID NO: 3512637 - DNA, 17 bp, Homo sapiens
ccaccctgaaagccctg

SEQ ID NO: 3512638 - DNA, 18 bp, Homo sapiens
ccaccctgaaagccctga

SEQ ID NO: 3512639 - DNA, 12 bp, Homo sapiens
ccaccctgggac

SEQ ID NO: 3512640 - DNA, 22 bp, Homo sapiens
ccaccctgggccctgggctgga

SEQ ID NO: 3512641 - DNA, 21 bp, Homo sapiens
ccaccctgtcttcctctgcaa

SEQ ID NO: 3512642 - DNA, 22 bp, Homo sapiens
ccaccctgtcttcctctgcaag

SEQ ID NO: 3512643 - DNA, 14 bp, Homo sapiens
ccacctagcagcac

SEQ ID NO: 3512644 - DNA, 12 bp, Homo sapiens
ccacctcagcct

SEQ ID NO: 3512645 - DNA, 17 bp, Homo sapiens
ccacctcccacaaagga

SEQ ID NO: 3512646 - DNA, 14 bp, Homo sapiens
ccacctccctgcct

SEQ ID NO: 3512647 - DNA, 16 bp, Homo sapiens
ccacctctccctgacc

SEQ ID NO: 3512648 - DNA, 18 bp, Homo sapiens
ccacctctccctgaccct

SEQ ID NO: 3512649 - DNA, 17 bp, Homo sapiens
ccacctgcatctggggc

SEQ ID NO: 3512650 - DNA, 22 bp, Homo sapiens
ccacctgtcaaacaaagccaga

SEQ ID NO: 3512651 - DNA, 11 bp, Homo sapiens
ccacctgtctc

SEQ ID NO: 3512652 - DNA, 18 bp, Homo sapiens
ccacctgtctcagcctcc

SEQ ID NO: 3512653 - DNA, 20 bp, Homo sapiens
ccacctgtctcagcctccca

SEQ ID NO: 3512654 - DNA, 13 bp, Homo sapiens
ccaccttggctca

SEQ ID NO: 3512655 - DNA, 16 bp, Homo sapiens
ccaccttggctcaagt

SEQ ID NO: 3512656 - DNA, 12 bp, Homo sapiens
ccaccttggctg

SEQ ID NO: 3512657 - DNA, 18 bp, Homo sapiens
ccaccttggctgcaggga

SEQ ID NO: 3512658 - DNA, 17 bp, Homo sapiens
ccacgagggctggctgg

SEQ ID NO: 3512659 - DNA, 20 bp, Homo sapiens
ccacgagggctggctggcct

SEQ ID NO: 3512660 - DNA, 23 bp, Homo sapiens
ccacgattggtatgatgctgccg

SEQ ID NO: 3512661 - DNA, 15 bp, Homo sapiens
ccacgcccgtcctgc

SEQ ID NO: 3512662 - DNA, 18 bp, Homo sapiens
ccacgcgggggccttgag

SEQ ID NO: 3512663 - DNA, 21 bp, Homo sapiens
ccacggagccactcctctgac

SEQ ID NO: 3512664 - DNA, 12 bp, Homo sapiens
ccacggccaggc

SEQ ID NO: 3512665 - DNA, 16 bp, Homo sapiens
ccacggccaggccaga

SEQ ID NO: 3512666 - DNA, 18 bp, Homo sapiens
ccacggccaggccagagg

SEQ ID NO: 3512667 - DNA, 14 bp, Homo sapiens
ccacggcctgccca

SEQ ID NO: 3512668 - DNA, 23 bp, Homo sapiens
ccacgttctgctcatcattctct

SEQ ID NO: 3512669 - DNA, 13 bp, Homo sapiens
ccactaagcagag

SEQ ID NO: 3512670 - DNA, 16 bp, Homo sapiens
ccactaagcagaggag

SEQ ID NO: 3512671 - DNA, 13 bp, Homo sapiens
ccactattttcaa

SEQ ID NO: 3512672 - DNA, 17 bp, Homo sapiens
ccactcaaagagggtga

SEQ ID NO: 3512673 - DNA, 15 bp, Homo sapiens
ccactcagctccgtg

SEQ ID NO: 3512674 - DNA, 23 bp, Homo sapiens
ccactccgagaggtgggccagtc

SEQ ID NO: 3512675 - DNA, 13 bp, Homo sapiens
ccactcctccctc

SEQ ID NO: 3512676 - DNA, 15 bp, Homo sapiens
ccactcctccctccg

SEQ ID NO: 3512677 - DNA, 14 bp, Homo sapiens
ccactcctctgact

SEQ ID NO: 3512678 - DNA, 15 bp, Homo sapiens
ccactctgatagaat

SEQ ID NO: 3512679 - DNA, 17 bp, Homo sapiens
ccactctgcttctctga

SEQ ID NO: 3512680 - DNA, 15 bp, Homo sapiens
ccactgacagcctcc

SEQ ID NO: 3512681 - DNA, 19 bp, Homo sapiens
ccactgacagcctcccacc

SEQ ID NO: 3512682 - DNA, 13 bp, Homo sapiens
ccactgaccagaa

SEQ ID NO: 3512683 - DNA, 22 bp, Homo sapiens
ccactgatagatgtctattctt

SEQ ID NO: 3512684 - DNA, 18 bp, Homo sapiens
ccactgcaagtccttttg

SEQ ID NO: 3512685 - DNA, 13 bp, Homo sapiens
ccactgcaccggg

SEQ ID NO: 3512686 - DNA, 14 bp, Homo sapiens
ccactgcaccgggc

SEQ ID NO: 3512687 - DNA, 18 bp, Homo sapiens
ccactgcactccagcctg

SEQ ID NO: 3512688 - DNA, 23 bp, Homo sapiens
ccactgcactccagcctgggtga

SEQ ID NO: 3512689 - DNA, 20 bp, Homo sapiens
ccactgccacaccctcccca

SEQ ID NO: 3512690 - DNA, 22 bp, Homo sapiens
ccactgccttcgcttcttgcct

SEQ ID NO: 3512691 - DNA, 17 bp, Homo sapiens
ccactgctctcagcctc

SEQ ID NO: 3512692 - DNA, 18 bp, Homo sapiens
ccactgctctcagcctcc

SEQ ID NO: 3512693 - DNA, 19 bp, Homo sapiens
ccactgctctcagcctccc

SEQ ID NO: 3512694 - DNA, 20 bp, Homo sapiens
ccactgctctcagcctccca

SEQ ID NO: 3512695 - DNA, 11 bp, Homo sapiens
ccactgctctg

SEQ ID NO: 3512696 - DNA, 16 bp, Homo sapiens
ccactgggaccaaccc

SEQ ID NO: 3512697 - DNA, 17 bp, Homo sapiens
ccactgggaccaaccct

SEQ ID NO: 3512698 - DNA, 19 bp, Homo sapiens
ccactgggccctgagccag

SEQ ID NO: 3512699 - DNA, 11 bp, Homo sapiens
ccactggggaa

SEQ ID NO: 3512700 - DNA, 18 bp, Homo sapiens
ccactggggtccagggag

SEQ ID NO: 3512701 - DNA, 15 bp, Homo sapiens
ccactggtttctcag

SEQ ID NO: 3512702 - DNA, 17 bp, Homo sapiens
ccactggtttctcagaa

SEQ ID NO: 3512703 - DNA, 20 bp, Homo sapiens
ccactgtcctgggcctgcag

SEQ ID NO: 3512704 - DNA, 15 bp, Homo sapiens
ccactgtgccatgtg

SEQ ID NO: 3512705 - DNA, 16 bp, Homo sapiens
ccactgtgccatgtgc

SEQ ID NO: 3512706 - DNA, 18 bp, Homo sapiens
ccacttaattgctttcct

SEQ ID NO: 3512707 - DNA, 14 bp, Homo sapiens
ccacttcagctgac

SEQ ID NO: 3512708 - DNA, 14 bp, Homo sapiens
ccacttctgtgcca

SEQ ID NO: 3512709 - DNA, 20 bp, Homo sapiens
ccacttcttgttccccactg

SEQ ID NO: 3512710 - DNA, 12 bp, Homo sapiens
ccacttgcctct

SEQ ID NO: 3512711 - DNA, 14 bp, Homo sapiens
ccacttgtttgcac

SEQ ID NO: 3512712 - DNA, 22 bp, Homo sapiens
ccactttgtttcgtggggaggt

SEQ ID NO: 3512713 - DNA, 15 bp, Homo sapiens
catcttgctctgctg

SEQ ID NO: 3512714 - DNA, 17 bp, Homo sapiens
catcttgctctgctgac

SEQ ID NO: 3512715 - DNA, 20 bp, Homo sapiens
catcttgctctgctgacaga

SEQ ID NO: 3512716 - DNA, 16 bp, Homo sapiens
catctttcttctattt

SEQ ID NO: 3512717 - DNA, 15 bp, Homo sapiens
catcttttaaagaaa

SEQ ID NO: 3512718 - DNA, 17 bp, Homo sapiens
catcttttattttggaa

SEQ ID NO: 3512719 - DNA, 18 bp, Homo sapiens
catcttttattttggaac

SEQ ID NO: 3512720 - DNA, 22 bp, Homo sapiens
catcttttattttggaactatg

SEQ ID NO: 3512721 - DNA, 21 bp, Homo sapiens
catcttttcttgcctctgtcc

SEQ ID NO: 3512722 - DNA, 21 bp, Homo sapiens
catctttttaacctgcaaaat

SEQ ID NO: 3512723 - DNA, 13 bp, Homo sapiens
catgaaacaaagc

SEQ ID NO: 3512724 - DNA, 18 bp, Homo sapiens
catgaaatttttgtaaat

SEQ ID NO: 3512725 - DNA, 20 bp, Homo sapiens
catgaagtttccttggctgg

SEQ ID NO: 3512726 - DNA, 22 bp, Homo sapiens
catgaagtttccttggctggtg

SEQ ID NO: 3512727 - DNA, 22 bp, Homo sapiens
catgaatttattgcacattgtt

SEQ ID NO: 3512728 - DNA, 13 bp, Homo sapiens
catgacatttctt

SEQ ID NO: 3512729 - DNA, 15 bp, Homo sapiens
catgacccaggctgg

SEQ ID NO: 3512730 - DNA, 17 bp, Homo sapiens
catgacccaggctgggc

SEQ ID NO: 3512731 - DNA, 19 bp, Homo sapiens
catgacccaggctgggcaa

SEQ ID NO: 3512732 - DNA, 22 bp, Homo sapiens
catgagaaatacaaaaatactc

SEQ ID NO: 3512733 - DNA, 20 bp, Homo sapiens
catgagcctcagcatcctgg

SEQ ID NO: 3512734 - DNA, 23 bp, Homo sapiens
catgagcctgctggaagcccagc

SEQ ID NO: 3512735 - DNA, 22 bp, Homo sapiens
catgaggaggggcccccctgcc

SEQ ID NO: 3512736 - DNA, 14 bp, Homo sapiens
catgaggggagagg

SEQ ID NO: 3512737 - DNA, 18 bp, Homo sapiens
catgaggggagaggagac

SEQ ID NO: 3512738 - DNA, 14 bp, Homo sapiens
catgagtgcgtgct

SEQ ID NO: 3512739 - DNA, 20 bp, Homo sapiens
catgatccaagcaagactga

SEQ ID NO: 3512740 - DNA, 17 bp, Homo sapiens
catgatctgcaggggtc

SEQ ID NO: 3512741 - DNA, 16 bp, Homo sapiens
cagtgcaacctctgct

SEQ ID NO: 3512742 - DNA, 21 bp, Homo sapiens
cagtgcaacctctgcttccca

SEQ ID NO: 3512743 - DNA, 14 bp, Homo sapiens
cagtgcaggcacag

SEQ ID NO: 3512744 - DNA, 12 bp, Homo sapiens
cagtgcccacag

SEQ ID NO: 3512745 - DNA, 13 bp, Homo sapiens
cagtgcccacagg

SEQ ID NO: 3512746 - DNA, 18 bp, Homo sapiens
cagtgcccacaggatcag

SEQ ID NO: 3512747 - DNA, 18 bp, Homo sapiens
cagtgccgagaaggaagc

SEQ ID NO: 3512748 - DNA, 22 bp, Homo sapiens
cagtgcctacatcccgggcctc

SEQ ID NO: 3512749 - DNA, 14 bp, Homo sapiens
cagtgctccctcac

SEQ ID NO: 3512750 - DNA, 14 bp, Homo sapiens
cagtgctcgctgtt

SEQ ID NO: 3512751 - DNA, 12 bp, Homo sapiens
cagtgctgtgct

SEQ ID NO: 3512752 - DNA, 22 bp, Homo sapiens
cagtgctgtgctgtgctatggt

SEQ ID NO: 3512753 - DNA, 16 bp, Homo sapiens
cagtggattgcatttc

SEQ ID NO: 3512754 - DNA, 12 bp, Homo sapiens
cagtggcagctg

SEQ ID NO: 3512755 - DNA, 13 bp, Homo sapiens
cagtggcagctgc

SEQ ID NO: 3512756 - DNA, 16 bp, Homo sapiens
cagtggcagctgcttt

SEQ ID NO: 3512757 - DNA, 14 bp, Homo sapiens
cagtggctgctgcc

SEQ ID NO: 3512758 - DNA, 15 bp, Homo sapiens
cagtggctgctgccc

SEQ ID NO: 3512759 - DNA, 17 bp, Homo sapiens
cagtggctgctgcccag

SEQ ID NO: 3512760 - DNA, 15 bp, Homo sapiens
cagtgggaactggag

SEQ ID NO: 3512761 - DNA, 20 bp, Homo sapiens
cagtgggagctgcctgttca

SEQ ID NO: 3512762 - DNA, 23 bp, Homo sapiens
cagtgggagctgcctgttcagct

SEQ ID NO: 3512763 - DNA, 16 bp, Homo sapiens
cagtgggaggcaaatg

SEQ ID NO: 3512764 - DNA, 16 bp, Homo sapiens
cagtggggctctctga

SEQ ID NO: 3512765 - DNA, 21 bp, Homo sapiens
cagtggtatgatcacggctca

SEQ ID NO: 3512766 - DNA, 17 bp, Homo sapiens
cagtgtaaatagttact

SEQ ID NO: 3512767 - DNA, 23 bp, Homo sapiens
cagtgtatttgtatttttttgca

SEQ ID NO: 3512768 - DNA, 17 bp, Homo sapiens
cagtgtccaaagcaggg

SEQ ID NO: 3512769 - DNA, 22 bp, Homo sapiens
cagtgtctttcggaatttttaa

SEQ ID NO: 3512770 - DNA, 20 bp, Homo sapiens
cagtgtgcacccctccccat

SEQ ID NO: 3512771 - DNA, 23 bp, Homo sapiens
cagtgtgcactaaggggcccggc

SEQ ID NO: 3512772 - DNA, 14 bp, Homo sapiens
cagtgtgcccatct

SEQ ID NO: 3512773 - DNA, 23 bp, Homo sapiens
cagtgttgttgctctaggaagac

SEQ ID NO: 3512774 - DNA, 15 bp, Homo sapiens
cagtgttttctttga

SEQ ID NO: 3512775 - DNA, 22 bp, Homo sapiens
cagttacataattcactctgag

SEQ ID NO: 3512776 - DNA, 15 bp, Homo sapiens
cagttattacatgta

SEQ ID NO: 3512777 - DNA, 12 bp, Homo sapiens
cagttcatctat

SEQ ID NO: 3512778 - DNA, 17 bp, Homo sapiens
cagttcatctatggcag

SEQ ID NO: 3512779 - DNA, 17 bp, Homo sapiens
cagttcgcctggagccc

SEQ ID NO: 3512780 - DNA, 22 bp, Homo sapiens
cagttcggtgagctacaaatgc

SEQ ID NO: 3512781 - DNA, 19 bp, Homo sapiens
cagttctttgggccagaca

SEQ ID NO: 3512782 - DNA, 19 bp, Homo sapiens
cagttgaaaaacagctgag

SEQ ID NO: 3512783 - DNA, 15 bp, Homo sapiens
cagttgaccctattt

SEQ ID NO: 3512784 - DNA, 17 bp, Homo sapiens
cagttgattttctggat

SEQ ID NO: 3512785 - DNA, 16 bp, Homo sapiens
cagttgctctatgctt

SEQ ID NO: 3512786 - DNA, 16 bp, Homo sapiens
cagttggccagagagc

SEQ ID NO: 3512787 - DNA, 13 bp, Homo sapiens
caggggtttctcg

SEQ ID NO: 3512788 - DNA, 20 bp, Homo sapiens
cagggtattccagagtgggg

SEQ ID NO: 3512789 - DNA, 16 bp, Homo sapiens
cagggtcagaaacagg

SEQ ID NO: 3512790 - DNA, 20 bp, Homo sapiens
cagggtcctcttctgggcct

SEQ ID NO: 3512791 - DNA, 17 bp, Homo sapiens
cagggtctcactctgtc

SEQ ID NO: 3512792 - DNA, 18 bp, Homo sapiens
cagggtctcactctgtcg

SEQ ID NO: 3512793 - DNA, 13 bp, Homo sapiens
cagggtctctgct

SEQ ID NO: 3512794 - DNA, 13 bp, Homo sapiens
cagggtctgcctc

SEQ ID NO: 3512795 - DNA, 14 bp, Homo sapiens
cagggtctgggcag

SEQ ID NO: 3512796 - DNA, 16 bp, Homo sapiens
cagggtctgggcagga

SEQ ID NO: 3512797 - DNA, 20 bp, Homo sapiens
cagggtgcagtatcatgccc

SEQ ID NO: 3512798 - DNA, 20 bp, Homo sapiens
cagggtggagtgcagtggtg

SEQ ID NO: 3512799 - DNA, 19 bp, Homo sapiens
cagggttcccgcggggctg

SEQ ID NO: 3512800 - DNA, 21 bp, Homo sapiens
cagggttcccgcggggctgtc

SEQ ID NO: 3512801 - DNA, 12 bp, Homo sapiens
cagggttggccc

SEQ ID NO: 3512802 - DNA, 19 bp, Homo sapiens
cagggtttcaccatgttgc

SEQ ID NO: 3512803 - DNA, 21 bp, Homo sapiens
caggtacccttctcgcttttg

SEQ ID NO: 3512804 - DNA, 23 bp, Homo sapiens
caggtaccttgacctttgtacag

SEQ ID NO: 3512805 - DNA, 21 bp, Homo sapiens
caggtacttgtaaattattaa

SEQ ID NO: 3512806 - DNA, 14 bp, Homo sapiens
caggtagctgcccc

SEQ ID NO: 3512807 - DNA, 19 bp, Homo sapiens
caggtagctgcccctggct

SEQ ID NO: 3512808 - DNA, 20 bp, Homo sapiens
caggtagctgcccctggctc

SEQ ID NO: 3512809 - DNA, 13 bp, Homo sapiens
caggtccagctct

SEQ ID NO: 3512810 - DNA, 14 bp, Homo sapiens
caggtccagctctg

SEQ ID NO: 3512811 - DNA, 16 bp, Homo sapiens
caggtccagctctgga

SEQ ID NO: 3512812 - DNA, 19 bp, Homo sapiens
caggtccagctctggaggg

SEQ ID NO: 3512813 - DNA, 13 bp, Homo sapiens
caggtccaggctg

SEQ ID NO: 3512814 - DNA, 14 bp, Homo sapiens
caggtctctccact

SEQ ID NO: 3512815 - DNA, 19 bp, Homo sapiens
caggtctctccactgctct

SEQ ID NO: 3512816 - DNA, 14 bp, Homo sapiens
caggtctttcctaa

SEQ ID NO: 3512817 - DNA, 17 bp, Homo sapiens
caggtgagcccatggcc

SEQ ID NO: 3512818 - DNA, 20 bp, Homo sapiens
caggtgagtcctagagctac

SEQ ID NO: 3512819 - DNA, 16 bp, Homo sapiens
caggtgatccacccac

SEQ ID NO: 3512820 - DNA, 22 bp, Homo sapiens
caggtgatccacccacctcagc

SEQ ID NO: 3512821 - DNA, 13 bp, Homo sapiens
caggtgcagagga

SEQ ID NO: 3512822 - DNA, 16 bp, Homo sapiens
caggtgcagccagagg

SEQ ID NO: 3512823 - DNA, 22 bp, Homo sapiens
caggtgcccagctatacctgtg

SEQ ID NO: 3512824 - DNA, 13 bp, Homo sapiens
caggtgctgccat

SEQ ID NO: 3512825 - DNA, 23 bp, Homo sapiens
caggtgctggagcactgggctcc

SEQ ID NO: 3512826 - DNA, 15 bp, Homo sapiens
caggtgctggtcccg

SEQ ID NO: 3512827 - DNA, 13 bp, Homo sapiens
caggtggccatgc

SEQ ID NO: 3512828 - DNA, 15 bp, Homo sapiens
caggtggcctagcag

SEQ ID NO: 3512829 - DNA, 16 bp, Homo sapiens
caggtgggcttcccag

SEQ ID NO: 3512830 - DNA, 23 bp, Homo sapiens
caggtgggcttcccagtggctgc

SEQ ID NO: 3512831 - DNA, 13 bp, Homo sapiens
caggtgggtcccg

SEQ ID NO: 3512832 - DNA, 16 bp, Homo sapiens
caggtgtcagccattg

SEQ ID NO: 3512833 - DNA, 16 bp, Homo sapiens
caggtgtccctgcact

SEQ ID NO: 3512834 - DNA, 18 bp, Homo sapiens
caggtgtccctgcacttg

SEQ ID NO: 3512835 - DNA, 21 bp, Homo sapiens
caggtgtgagtcaccaagccc

SEQ ID NO: 3512836 - DNA, 22 bp, Homo sapiens
caggttcaagcgattctcctgc

SEQ ID NO: 3512837 - DNA, 14 bp, Homo sapiens
caggttcccaagct

SEQ ID NO: 3512838 - DNA, 15 bp, Homo sapiens
caggttcccaagctc

SEQ ID NO: 3512839 - DNA, 20 bp, Homo sapiens
caggttctccgttagctcct

SEQ ID NO: 3512840 - DNA, 22 bp, Homo sapiens
caggttctccgttagctcctgt

SEQ ID NO: 3512841 - DNA, 17 bp, Homo sapiens
cagcaaccccaggctga

SEQ ID NO: 3512842 - DNA, 16 bp, Homo sapiens
cagcaagaagggagtt

SEQ ID NO: 3512843 - DNA, 15 bp, Homo sapiens
cagcaagtgagagct

SEQ ID NO: 3512844 - DNA, 17 bp, Homo sapiens
cagcaagtgagagctgg

SEQ ID NO: 3512845 - DNA, 14 bp, Homo sapiens
cagcaagtggtcct

SEQ ID NO: 3512846 - DNA, 21 bp, Homo sapiens
cagcacagcttgacctgaggc

SEQ ID NO: 3512847 - DNA, 22 bp, Homo sapiens
cagcacagcttgacctgaggct

SEQ ID NO: 3512848 - DNA, 15 bp, Homo sapiens
cagcacccaaagggt

SEQ ID NO: 3512849 - DNA, 16 bp, Homo sapiens
cagcaccctataaatc

SEQ ID NO: 3512850 - DNA, 14 bp, Homo sapiens
cagcaccctgcaga

SEQ ID NO: 3512851 - DNA, 15 bp, Homo sapiens
cagcaccctgcagag

SEQ ID NO: 3512852 - DNA, 17 bp, Homo sapiens
cagcaccgttctgtgca

SEQ ID NO: 3512853 - DNA, 19 bp, Homo sapiens
cagcactatgctttccttc

SEQ ID NO: 3512854 - DNA, 20 bp, Homo sapiens
cagcactatgctttccttct

SEQ ID NO: 3512855 - DNA, 16 bp, Homo sapiens
cagcactgcttgagga

SEQ ID NO: 3512856 - DNA, 13 bp, Homo sapiens
cagcacttccatg

SEQ ID NO: 3512857 - DNA, 17 bp, Homo sapiens
cagcacttgtccagctg

SEQ ID NO: 3512858 - DNA, 13 bp, Homo sapiens
cagcagaaggggg

SEQ ID NO: 3512859 - DNA, 17 bp, Homo sapiens
cagcagaagggggtggt

SEQ ID NO: 3512860 - DNA, 13 bp, Homo sapiens
cagcagagtgtgg

SEQ ID NO: 3512861 - DNA, 15 bp, Homo sapiens
cagcagcagcccaag

SEQ ID NO: 3512862 - DNA, 16 bp, Homo sapiens
cagcagcagcccaagc

SEQ ID NO: 3512863 - DNA, 10 bp, Homo sapiens
cagcagcata

SEQ ID NO: 3512864 - DNA, 18 bp, Homo sapiens
cagcagcccaagcttccc

SEQ ID NO: 3512865 - DNA, 14 bp, Homo sapiens
cagcagcctggacc

SEQ ID NO: 3512866 - DNA, 19 bp, Homo sapiens
cagcagcctggaccctgtg

SEQ ID NO: 3512867 - DNA, 21 bp, Homo sapiens
cagcagcctggggctggcctc

SEQ ID NO: 3512868 - DNA, 18 bp, Homo sapiens
cagcaggatcgaagggtt

SEQ ID NO: 3512869 - DNA, 18 bp, Homo sapiens
cagcagggatgccctgga

SEQ ID NO: 3512870 - DNA, 19 bp, Homo sapiens
cagcagggctaccctgagc

SEQ ID NO: 3512871 - DNA, 13 bp, Homo sapiens
cagcagtctctgc

SEQ ID NO: 3512872 - DNA, 15 bp, Homo sapiens
cagcagtctctgcct

SEQ ID NO: 3512873 - DNA, 16 bp, Homo sapiens
cagcagtctctgcctt

SEQ ID NO: 3512874 - DNA, 22 bp, Homo sapiens
cagcagtgtgaggccagggcag

SEQ ID NO: 3512875 - DNA, 22 bp, Homo sapiens
cagcatcccttgaccaggcctg

SEQ ID NO: 3512876 - DNA, 12 bp, Homo sapiens
cagcatccgcag

SEQ ID NO: 3512877 - DNA, 14 bp, Homo sapiens
cagcatcctggcac

SEQ ID NO: 3512878 - DNA, 15 bp, Homo sapiens
cagcatcctggcacc

SEQ ID NO: 3512879 - DNA, 16 bp, Homo sapiens
cagcattccagcccct

SEQ ID NO: 3512880 - DNA, 20 bp, Homo sapiens
cagcattccagcccctctgg

SEQ ID NO: 3512881 - DNA, 21 bp, Homo sapiens
cagcatttccacaccaagcag

SEQ ID NO: 3512882 - DNA, 17 bp, Homo sapiens
cagccaaaccctgtctg

SEQ ID NO: 3512883 - DNA, 17 bp, Homo sapiens
cagccaactagcccctg

SEQ ID NO: 3512884 - DNA, 19 bp, Homo sapiens
cagccaactagcccctggg

SEQ ID NO: 3512885 - DNA, 22 bp, Homo sapiens
cagccaactagcccctggggtg

SEQ ID NO: 3512886 - DNA, 17 bp, Homo sapiens
cagccaattatgttaaa

SEQ ID NO: 3512887 - DNA, 14 bp, Homo sapiens
cagccacaggggat

SEQ ID NO: 3512888 - DNA, 17 bp, Homo sapiens
cagccacggccaggcca

SEQ ID NO: 3512889 - DNA, 18 bp, Homo sapiens
cagccacggccaggccag

SEQ ID NO: 3512890 - DNA, 19 bp, Homo sapiens
cagctctttcctccttcca

SEQ ID NO: 3512891 - DNA, 16 bp, Homo sapiens
cagctgaattatctat

SEQ ID NO: 3512892 - DNA, 16 bp, Homo sapiens
cagctgacctttgtca

SEQ ID NO: 3512893 - DNA, 12 bp, Homo sapiens
cagctgaggctg

SEQ ID NO: 3512894 - DNA, 19 bp, Homo sapiens
cagctgagggtgagtgggt

SEQ ID NO: 3512895 - DNA, 20 bp, Homo sapiens
cagctgatgagttacagcct

SEQ ID NO: 3512896 - DNA, 15 bp, Homo sapiens
cagctgcaaagtgtt

SEQ ID NO: 3512897 - DNA, 16 bp, Homo sapiens
cagctgcaagggagtt

SEQ ID NO: 3512898 - DNA, 18 bp, Homo sapiens
cagctgcactgatgctgc

SEQ ID NO: 3512899 - DNA, 17 bp, Homo sapiens
cagctgcagtcaacagt

SEQ ID NO: 3512900 - DNA, 15 bp, Homo sapiens
cagctgccctatggg

SEQ ID NO: 3512901 - DNA, 18 bp, Homo sapiens
cagctgccctatgggcct

SEQ ID NO: 3512902 - DNA, 20 bp, Homo sapiens
cagctgccttagcttcagga

SEQ ID NO: 3512903 - DNA, 20 bp, Homo sapiens
cagctgcggtccacccagga

SEQ ID NO: 3512904 - DNA, 21 bp, Homo sapiens
cagctgcggtccacccaggag

SEQ ID NO: 3512905 - DNA, 18 bp, Homo sapiens
cagctgctcctagaggga

SEQ ID NO: 3512906 - DNA, 14 bp, Homo sapiens
cagctggcagcaga

SEQ ID NO: 3512907 - DNA, 22 bp, Homo sapiens
cagctgggatacacacggctcc

SEQ ID NO: 3512908 - DNA, 20 bp, Homo sapiens
cagctgggtggcactgccat

SEQ ID NO: 3512909 - DNA, 18 bp, Homo sapiens
cagctgtgctctggacag

SEQ ID NO: 3512910 - DNA, 16 bp, Homo sapiens
cagctgttcagctggt

SEQ ID NO: 3512911 - DNA, 19 bp, Homo sapiens
cagctgttcagctggttga

SEQ ID NO: 3512912 - DNA, 21 bp, Homo sapiens
cagcttacacaaatctattta

SEQ ID NO: 3512913 - DNA, 17 bp, Homo sapiens
cagcttaggggctgctg

SEQ ID NO: 3512914 - DNA, 23 bp, Homo sapiens
cagcttatctcttttatatttgt

SEQ ID NO: 3512915 - DNA, 18 bp, Homo sapiens
cagcttcccctctctcct

SEQ ID NO: 3512916 - DNA, 23 bp, Homo sapiens
cagcttcccctctctcctcctgc

SEQ ID NO: 3512917 - DNA, 18 bp, Homo sapiens
cagcttctatccttgact

SEQ ID NO: 3512918 - DNA, 18 bp, Homo sapiens
cagcttctcatcctgcag

SEQ ID NO: 3512919 - DNA, 20 bp, Homo sapiens
cagcttctcatcctgcaggc

SEQ ID NO: 3512920 - DNA, 21 bp, Homo sapiens
cagcttctcatcctgcaggca

SEQ ID NO: 3512921 - DNA, 15 bp, Homo sapiens
cagcttgagggttgg

SEQ ID NO: 3512922 - DNA, 18 bp, Homo sapiens
cagcttgagggttgggct

SEQ ID NO: 3512923 - DNA, 15 bp, Homo sapiens
cagcttggacatcag

SEQ ID NO: 3512924 - DNA, 16 bp, Homo sapiens
cagcttggacatcagt

SEQ ID NO: 3512925 - DNA, 19 bp, Homo sapiens
cagcttggacatcagtgtt

SEQ ID NO: 3512926 - DNA, 21 bp, Homo sapiens
cagctttgtttgttgtcagct

SEQ ID NO: 3512927 - DNA, 18 bp, Homo sapiens
caggaaaagctgctgaca

SEQ ID NO: 3512928 - DNA, 20 bp, Homo sapiens
caggaaatgaaaatgtcttg

SEQ ID NO: 3512929 - DNA, 20 bp, Homo sapiens
caggaacctcgagtactgtg

SEQ ID NO: 3512930 - DNA, 23 bp, Homo sapiens
caggaacctcgagtactgtgggc

SEQ ID NO: 3512931 - DNA, 17 bp, Homo sapiens
caggaagaaagaatgtt

SEQ ID NO: 3512932 - DNA, 16 bp, Homo sapiens
caggaagcccaattgc

SEQ ID NO: 3512933 - DNA, 18 bp, Homo sapiens
caggaagcccaattgctg

SEQ ID NO: 3512934 - DNA, 12 bp, Homo sapiens
caggaagctcag

SEQ ID NO: 3512935 - DNA, 18 bp, Homo sapiens
caggaagctgctccgtgc

SEQ ID NO: 3512936 - DNA, 22 bp, Homo sapiens
caggaagctttggtgagaacct

SEQ ID NO: 3512937 - DNA, 18 bp, Homo sapiens
caggaatctcagagacag

SEQ ID NO: 3512938 - DNA, 15 bp, Homo sapiens
caggaatcttaaggt

SEQ ID NO: 3512939 - DNA, 17 bp, Homo sapiens
caggaatgtgtggcctg

SEQ ID NO: 3512940 - DNA, 17 bp, Homo sapiens
caggaatttcccaggac

SEQ ID NO: 3512941 - DNA, 19 bp, Homo sapiens
caggaatttcccaggaccc

SEQ ID NO: 3512942 - DNA, 16 bp, Homo sapiens
caggacaacgaggaag

SEQ ID NO: 3512943 - DNA, 19 bp, Homo sapiens
caggacaacgaggaagccc

SEQ ID NO: 3512944 - DNA, 18 bp, Homo sapiens
caggacacctggccgcct

SEQ ID NO: 3512945 - DNA, 20 bp, Homo sapiens
caggacatgcggtagccagc

SEQ ID NO: 3512946 - DNA, 22 bp, Homo sapiens
caggacatgcggtagccagcac

SEQ ID NO: 3512947 - DNA, 16 bp, Homo sapiens
caggacatgctgaagc

SEQ ID NO: 3512948 - DNA, 20 bp, Homo sapiens
caggaccagccagcagcagc

SEQ ID NO: 3512949 - DNA, 13 bp, Homo sapiens
caggaccagctca

SEQ ID NO: 3512950 - DNA, 14 bp, Homo sapiens
caggaccagctcag

SEQ ID NO: 3512951 - DNA, 16 bp, Homo sapiens
caggaccagctcagga

SEQ ID NO: 3512952 - DNA, 20 bp, Homo sapiens
caggaccagctcaggacaga

SEQ ID NO: 3512953 - DNA, 13 bp, Homo sapiens
caggacccagagg

SEQ ID NO: 3512954 - DNA, 13 bp, Homo sapiens
caggaccctcgcc

SEQ ID NO: 3512955 - DNA, 13 bp, Homo sapiens
caggacctcaggt

SEQ ID NO: 3512956 - DNA, 23 bp, Homo sapiens
caggacctccaagccactgagca

SEQ ID NO: 3512957 - DNA, 13 bp, Homo sapiens
caggacctgcctg

SEQ ID NO: 3512958 - DNA, 14 bp, Homo sapiens
caggacctgcctgt

SEQ ID NO: 3512959 - DNA, 19 bp, Homo sapiens
caggacctgcctgtagccc

SEQ ID NO: 3512960 - DNA, 16 bp, Homo sapiens
cagggaaatggccttc

SEQ ID NO: 3512961 - DNA, 19 bp, Homo sapiens
cagggaaatggccttcccg

SEQ ID NO: 3512962 - DNA, 23 bp, Homo sapiens
cagggaagtccccaggccccagg

SEQ ID NO: 3512963 - DNA, 21 bp, Homo sapiens
cagggaagtgtaagaaacaca

SEQ ID NO: 3512964 - DNA, 23 bp, Homo sapiens
cagggaatgcctgagtgcctggc

SEQ ID NO: 3512965 - DNA, 17 bp, Homo sapiens
cagggacacctgggaga

SEQ ID NO: 3512966 - DNA, 14 bp, Homo sapiens
cagggacagaggcc

SEQ ID NO: 3512967 - DNA, 18 bp, Homo sapiens
cagggacagaggccccag

SEQ ID NO: 3512968 - DNA, 23 bp, Homo sapiens
cagggacagaggccccagcctcc

SEQ ID NO: 3512969 - DNA, 20 bp, Homo sapiens
cagggactgaaaacctctcc

SEQ ID NO: 3512970 - DNA, 20 bp, Homo sapiens
cagggagacctggacacagg

SEQ ID NO: 3512971 - DNA, 21 bp, Homo sapiens
cagggagcaggcggtgggcac

SEQ ID NO: 3512972 - DNA, 22 bp, Homo sapiens
cagggagcctttggttctggcc

SEQ ID NO: 3512973 - DNA, 18 bp, Homo sapiens
cagggagcggaaagcagc

SEQ ID NO: 3512974 - DNA, 19 bp, Homo sapiens
cagggagcggaaagcagct

SEQ ID NO: 3512975 - DNA, 15 bp, Homo sapiens
cagggagcggccggc

SEQ ID NO: 3512976 - DNA, 23 bp, Homo sapiens
cagggagcggccggccagcccct

SEQ ID NO: 3512977 - DNA, 14 bp, Homo sapiens
cagggaggtggaag

SEQ ID NO: 3512978 - DNA, 16 bp, Homo sapiens
cagggagtgggggagg

SEQ ID NO: 3512979 - DNA, 16 bp, Homo sapiens
cagggatgagcatgga

SEQ ID NO: 3512980 - DNA, 22 bp, Homo sapiens
cagggatgagcatggagctggc

SEQ ID NO: 3512981 - DNA, 16 bp, Homo sapiens
cagggatgccctggag

SEQ ID NO: 3512982 - DNA, 21 bp, Homo sapiens
cagggatgccctggaggtggc

SEQ ID NO: 3512983 - DNA, 22 bp, Homo sapiens
cagggatgccctggaggtggct

SEQ ID NO: 3512984 - DNA, 17 bp, Homo sapiens
cagggatttgcctcacc

SEQ ID NO: 3512985 - DNA, 18 bp, Homo sapiens
cagggatttgcctcacct

SEQ ID NO: 3512986 - DNA, 20 bp, Homo sapiens
cagggatttgcctcaccttg

SEQ ID NO: 3512987 - DNA, 18 bp, Homo sapiens
cagggcaagctccgcagg

SEQ ID NO: 3512988 - DNA, 22 bp, Homo sapiens
cagggcaagctccgcaggactt

SEQ ID NO: 3512989 - DNA, 18 bp, Homo sapiens
cagggcaatgatgaatga

SEQ ID NO: 3512990 - DNA, 14 bp, Homo sapiens
cagggcacaccggg

SEQ ID NO: 3512991 - DNA, 15 bp, Homo sapiens
cagggcacaccgggc

SEQ ID NO: 3512992 - DNA, 17 bp, Homo sapiens
cagggcacaccgggcac

SEQ ID NO: 3512993 - DNA, 19 bp, Homo sapiens
cagggcacaccgggcactc

SEQ ID NO: 3512994 - DNA, 23 bp, Homo sapiens
cagggcacaccgggcactcagaa

SEQ ID NO: 3512995 - DNA, 13 bp, Homo sapiens
cagggcagagtga

SEQ ID NO: 3512996 - DNA, 13 bp, Homo sapiens
cagggcagcgcca

SEQ ID NO: 3512997 - DNA, 16 bp, Homo sapiens
cagggcagcgccaggc

SEQ ID NO: 3512998 - DNA, 21 bp, Homo sapiens
cagggcagtcattggctgtct

SEQ ID NO: 3512999 - DNA, 18 bp, Homo sapiens
cagggcatcttgctggct

SEQ ID NO: 3513000 - DNA, 19 bp, Homo sapiens
cagggcatcttgctggcta

SEQ ID NO: 3513001 - DNA, 20 bp, Homo sapiens
cagggcatcttgctggctac

SEQ ID NO: 3513002 - DNA, 13 bp, Homo sapiens
cagggccaaccct

SEQ ID NO: 3513003 - DNA, 18 bp, Homo sapiens
cagggccaacccttctcc

SEQ ID NO: 3513004 - DNA, 20 bp, Homo sapiens
cagggccacgctccagctgc

SEQ ID NO: 3513005 - DNA, 14 bp, Homo sapiens
cagggccatgctga

SEQ ID NO: 3513006 - DNA, 17 bp, Homo sapiens
cagggccatgctgaggc

SEQ ID NO: 3513007 - DNA, 18 bp, Homo sapiens
cagggccatgctgaggcc

SEQ ID NO: 3513008 - DNA, 22 bp, Homo sapiens
cagggccatgctgaggcctggg

SEQ ID NO: 3513009 - DNA, 14 bp, Homo sapiens
cagggcccccacag

SEQ ID NO: 3513010 - DNA, 21 bp, Homo sapiens
cagggcccccatctcatgccc

SEQ ID NO: 3513011 - DNA, 22 bp, Homo sapiens
cagggccgccagggagacctgg

SEQ ID NO: 3513012 - DNA, 18 bp, Homo sapiens
cagggcctgagcctggcc

SEQ ID NO: 3513013 - DNA, 22 bp, Homo sapiens
cagggcctgcaggacctgcctg

SEQ ID NO: 3513014 - DNA, 18 bp, Homo sapiens
cagggcctggaagacaga

SEQ ID NO: 3513015 - DNA, 11 bp, Homo sapiens
cagggcctggt

SEQ ID NO: 3513016 - DNA, 19 bp, Homo sapiens
cagggcctggttgaagaag

SEQ ID NO: 3513017 - DNA, 21 bp, Homo sapiens
cagggcgggcagagggctgga

SEQ ID NO: 3513018 - DNA, 16 bp, Homo sapiens
cagggctaccctgagc

SEQ ID NO: 3513019 - DNA, 22 bp, Homo sapiens
cagggctaccctgagctgaggc

SEQ ID NO: 3513020 - DNA, 12 bp, Homo sapiens
cagggctcagcg

SEQ ID NO: 3513021 - DNA, 12 bp, Homo sapiens
cagggctcctgg

SEQ ID NO: 3513022 - DNA, 16 bp, Homo sapiens
cagggctggactgagg

SEQ ID NO: 3513023 - DNA, 21 bp, Homo sapiens
cagggctggactgaggcctga

SEQ ID NO: 3513024 - DNA, 19 bp, Homo sapiens
cagggctgtgcttgaaggc

SEQ ID NO: 3513025 - DNA, 12 bp, Homo sapiens
caggggcctgga

SEQ ID NO: 3513026 - DNA, 13 bp, Homo sapiens
caggggcctggag

SEQ ID NO: 3513027 - DNA, 15 bp, Homo sapiens
caggggcctggagat

SEQ ID NO: 3513028 - DNA, 22 bp, Homo sapiens
caggggcctggagatcctcctg

SEQ ID NO: 3513029 - DNA, 20 bp, Homo sapiens
caggggctgcttcctcctgg

SEQ ID NO: 3513030 - DNA, 18 bp, Homo sapiens
caggggggtgaggagctg

SEQ ID NO: 3513031 - DNA, 22 bp, Homo sapiens
caggggtctgggagtcaggccc

SEQ ID NO: 3513032 - DNA, 19 bp, Homo sapiens
caggggttcttgagccagc

SEQ ID NO: 3513033 - DNA, 12 bp, Homo sapiens
cacaaataaaat

SEQ ID NO: 3513034 - DNA, 14 bp, Homo sapiens
cacaacctgaacct

SEQ ID NO: 3513035 - DNA, 23 bp, Homo sapiens
cacaagctgcaccctcaggcagg

SEQ ID NO: 3513036 - DNA, 12 bp, Homo sapiens
cacaaggacttc

SEQ ID NO: 3513037 - DNA, 16 bp, Homo sapiens
cacaaggacttcctgt

SEQ ID NO: 3513038 - DNA, 22 bp, Homo sapiens
cacaaggacttcctgtccagct

SEQ ID NO: 3513039 - DNA, 17 bp, Homo sapiens
cacaaggatagatgctg

SEQ ID NO: 3513040 - DNA, 12 bp, Homo sapiens
caaacctccaaa

SEQ ID NO: 3513041 - DNA, 13 bp, Homo sapiens
caaacctctgttc

SEQ ID NO: 3513042 - DNA, 19 bp, Homo sapiens
caaacctctgttcagtgta

SEQ ID NO: 3513043 - DNA, 23 bp, Homo sapiens
caaacctctgttcagtgtaaata

SEQ ID NO: 3513044 - DNA, 12 bp, Homo sapiens
caaacctgcctg

SEQ ID NO: 3513045 - DNA, 13 bp, Homo sapiens
caaacctgcctgg

SEQ ID NO: 3513046 - DNA, 16 bp, Homo sapiens
caaacctgcctgggtt

SEQ ID NO: 3513047 - DNA, 22 bp, Homo sapiens
caaacgccctttcctcctcagg

SEQ ID NO: 3513048 - DNA, 14 bp, Homo sapiens
caaacgctgcctgc

SEQ ID NO: 3513049 - DNA, 14 bp, Homo sapiens
caaacggcaacatt

SEQ ID NO: 3513050 - DNA, 14 bp, Homo sapiens
caaactacttgatt

SEQ ID NO: 3513051 - DNA, 19 bp, Homo sapiens
caaactagggccaagccca

SEQ ID NO: 3513052 - DNA, 14 bp, Homo sapiens
caaactcttcagtt

SEQ ID NO: 3513053 - DNA, 17 bp, Homo sapiens
caaactcttgacctcag

SEQ ID NO: 3513054 - DNA, 23 bp, Homo sapiens
caaactgattaaatatttgaaga

SEQ ID NO: 3513055 - DNA, 15 bp, Homo sapiens
attttcaaagaaaat

SEQ ID NO: 3513056 - DNA, 13 bp, Homo sapiens
attttcaaggcct

SEQ ID NO: 3513057 - DNA, 19 bp, Homo sapiens
attttcacattcttggctt

SEQ ID NO: 3513058 - DNA, 21 bp, Homo sapiens
attttcacctgtttttaagct

SEQ ID NO: 3513059 - DNA, 14 bp, Homo sapiens
attttccaaagagt

SEQ ID NO: 3513060 - DNA, 19 bp, Homo sapiens
attttccctattagagaag

SEQ ID NO: 3513061 - DNA, 14 bp, Homo sapiens
attttctagataca

SEQ ID NO: 3513062 - DNA, 16 bp, Homo sapiens
attttctagatacaat

SEQ ID NO: 3513063 - DNA, 14 bp, Homo sapiens
attttctataattt

SEQ ID NO: 3513064 - DNA, 18 bp, Homo sapiens
attttctataatttaaat

SEQ ID NO: 3513065 - DNA, 23 bp, Homo sapiens
attttctattttaagactgattt

SEQ ID NO: 3513066 - DNA, 14 bp, Homo sapiens
attttctctgtact

SEQ ID NO: 3513067 - DNA, 16 bp, Homo sapiens
attttctctgtacttt

SEQ ID NO: 3513068 - DNA, 21 bp, Homo sapiens
attttcttattgcgctgctac

SEQ ID NO: 3513069 - DNA, 12 bp, Homo sapiens
attttctttaat

SEQ ID NO: 3513070 - DNA, 15 bp, Homo sapiens
attttctttaatgct

SEQ ID NO: 3513071 - DNA, 20 bp, Homo sapiens
attttctttttaataaaaag

SEQ ID NO: 3513072 - DNA, 20 bp, Homo sapiens
attttctttttttaactggt

SEQ ID NO: 3513073 - DNA, 22 bp, Homo sapiens
attttctttttttattaaacag

SEQ ID NO: 3513074 - DNA, 20 bp, Homo sapiens
attttgaaactttgctttgg

SEQ ID NO: 3513075 - DNA, 20 bp, Homo sapiens
attttgaataaataaatgta

SEQ ID NO: 3513076 - DNA, 15 bp, Homo sapiens
attttgagaacaaag

SEQ ID NO: 3513077 - DNA, 18 bp, Homo sapiens
attttgagtatttttaaa

SEQ ID NO: 3513078 - DNA, 16 bp, Homo sapiens
attcattatttgtcaa

SEQ ID NO: 3513079 - DNA, 13 bp, Homo sapiens
attcattttctag

SEQ ID NO: 3513080 - DNA, 16 bp, Homo sapiens
attcattttctagata

SEQ ID NO: 3513081 - DNA, 22 bp, Homo sapiens
attcattttctagatacaataa

SEQ ID NO: 3513082 - DNA, 15 bp, Homo sapiens
attccaaaataaaag

SEQ ID NO: 3513083 - DNA, 20 bp, Homo sapiens
attccaaagagtagaattgc

SEQ ID NO: 3513084 - DNA, 19 bp, Homo sapiens
attccaactcgtatagcat

SEQ ID NO: 3513085 - DNA, 23 bp, Homo sapiens
attccaactcgtatagcatgcat

SEQ ID NO: 3513086 - DNA, 17 bp, Homo sapiens
attccaagtgattgaaa

SEQ ID NO: 3513087 - DNA, 19 bp, Homo sapiens
attccagaatgctgtacat

SEQ ID NO: 3513088 - DNA, 23 bp, Homo sapiens
attccagaatgctgtacatctat

SEQ ID NO: 3513089 - DNA, 23 bp, Homo sapiens
attccaggaggagttagccaaac

SEQ ID NO: 3513090 - DNA, 22 bp, Homo sapiens
attccagtcaaatctgggctca

SEQ ID NO: 3513091 - DNA, 19 bp, Homo sapiens
attccattcccttcggcca

SEQ ID NO: 3513092 - DNA, 20 bp, Homo sapiens
attcccaagatgcctgatca

SEQ ID NO: 3513093 - DNA, 14 bp, Homo sapiens
attcccaagctctg

SEQ ID NO: 3513094 - DNA, 15 bp, Homo sapiens
attcccactgccagg

SEQ ID NO: 3513095 - DNA, 22 bp, Homo sapiens
attccccaccctgaaagccctg

SEQ ID NO: 3513096 - DNA, 19 bp, Homo sapiens
attcccggtcagcagtatc

SEQ ID NO: 3513097 - DNA, 12 bp, Homo sapiens
attccgtcacca

SEQ ID NO: 3513098 - DNA, 18 bp, Homo sapiens
attccgttgtctgtggat

SEQ ID NO: 3513099 - DNA, 17 bp, Homo sapiens
attcctcaacgtattgt

SEQ ID NO: 3513100 - DNA, 23 bp, Homo sapiens
attcctctgataatatattttca

SEQ ID NO: 3513101 - DNA, 24 bp, Homo sapiens
attcctgaactataacacctgcca

SEQ ID NO: 3513102 - DNA, 16 bp, Homo sapiens
attcctgttctttctt

SEQ ID NO: 3513103 - DNA, 23 bp, Homo sapiens
attccttctcccatctcttcctt

SEQ ID NO: 3513104 - DNA, 14 bp, Homo sapiens
attcctttgggtat

SEQ ID NO: 3513105 - DNA, 23 bp, Homo sapiens
attcggtgtggtgcagtgtgaaa

SEQ ID NO: 3513106 - DNA, 17 bp, Homo sapiens
attctaaacagactcat

SEQ ID NO: 3513107 - DNA, 19 bp, Homo sapiens
attctagtgtaacactgca

SEQ ID NO: 3513108 - DNA, 23 bp, Homo sapiens
attctatgtagtggttttaggat

SEQ ID NO: 3513109 - DNA, 19 bp, Homo sapiens
attctattgactttcttaa

SEQ ID NO: 3513110 - DNA, 20 bp, Homo sapiens
attctatttatatgtacatg

SEQ ID NO: 3513111 - DNA, 15 bp, Homo sapiens
attctccaacagctg

SEQ ID NO: 3513112 - DNA, 13 bp, Homo sapiens
attctccacagca

SEQ ID NO: 3513113 - DNA, 14 bp, Homo sapiens
attctccctgggcc

SEQ ID NO: 3513114 - DNA, 16 bp, Homo sapiens
attctccctgggcctc

SEQ ID NO: 3513115 - DNA, 11 bp, Homo sapiens
attctcctgcc

SEQ ID NO: 3513116 - DNA, 12 bp, Homo sapiens
attctcctgcct

SEQ ID NO: 3513117 - DNA, 14 bp, Homo sapiens
attctcctgcctca

SEQ ID NO: 3513118 - DNA, 11 bp, Homo sapiens
attctcctgga

SEQ ID NO: 3513119 - DNA, 22 bp, Homo sapiens
attctccttcagccctcacccc

SEQ ID NO: 3513120 - DNA, 23 bp, Homo sapiens
attctccttcagccctcacccct

SEQ ID NO: 3513121 - DNA, 18 bp, Homo sapiens
attctccttgttgttggt

SEQ ID NO: 3513122 - DNA, 13 bp, Homo sapiens
attctctgtctca

SEQ ID NO: 3513123 - DNA, 14 bp, Homo sapiens
attctctgtctcat

SEQ ID NO: 3513124 - DNA, 20 bp, Homo sapiens
attctgaatttgcaaagtac

SEQ ID NO: 3513125 - DNA, 16 bp, Homo sapiens
attctgataatgctca

SEQ ID NO: 3513126 - DNA, 15 bp, Homo sapiens
attctgattcttcta

SEQ ID NO: 3513127 - DNA, 20 bp, Homo sapiens
attctgattcttctaaatta

SEQ ID NO: 3513128 - DNA, 19 bp, Homo sapiens
attctgcaagcacatctgc

SEQ ID NO: 3513129 - DNA, 15 bp, Homo sapiens
attctgcaccttgcc

SEQ ID NO: 3513130 - DNA, 17 bp, Homo sapiens
attctgcagtaaatctt

SEQ ID NO: 3513131 - DNA, 21 bp, Homo sapiens
attctgcagtaaatcttttac

SEQ ID NO: 3513132 - DNA, 23 bp, Homo sapiens
attctgcagtaaatcttttacaa

SEQ ID NO: 3513133 - DNA, 13 bp, Homo sapiens
attctgcatgtac

SEQ ID NO: 3513134 - DNA, 15 bp, Homo sapiens
attctgcatgtacta

SEQ ID NO: 3513135 - DNA, 12 bp, Homo sapiens
attctgcattta

SEQ ID NO: 3513136 - DNA, 14 bp, Homo sapiens
attctgcatttagc

SEQ ID NO: 3513137 - DNA, 18 bp, Homo sapiens
attctgcatttagctgta

SEQ ID NO: 3513138 - DNA, 21 bp, Homo sapiens
attctgcatttagctgtattc

SEQ ID NO: 3513139 - DNA, 14 bp, Homo sapiens
attctgcctgccca

SEQ ID NO: 3513140 - DNA, 19 bp, Homo sapiens
attctgcctgcccaggccc

SEQ ID NO: 3513141 - DNA, 20 bp, Homo sapiens
attctgcctgcccaggcccc

SEQ ID NO: 3513142 - DNA, 21 bp, Homo sapiens
attctgcctgcccaggcccct

SEQ ID NO: 3513143 - DNA, 20 bp, Homo sapiens
attctgctcacatatctgtc

SEQ ID NO: 3513144 - DNA, 21 bp, Homo sapiens
attctgctcacatatctgtca

SEQ ID NO: 3513145 - DNA, 20 bp, Homo sapiens
attctggacagtcagctctt

SEQ ID NO: 3513146 - DNA, 22 bp, Homo sapiens
attctggacagtcagctcttca

SEQ ID NO: 3513147 - DNA, 19 bp, Homo sapiens
attctggttccagggtccc

SEQ ID NO: 3513148 - DNA, 11 bp, Homo sapiens
attctgtcttg

SEQ ID NO: 3513149 - DNA, 12 bp, Homo sapiens
attctgtttctt

SEQ ID NO: 3513150 - DNA, 19 bp, Homo sapiens
attctgtttttaatgctat

SEQ ID NO: 3513151 - DNA, 17 bp, Homo sapiens
attcttacatgttttct

SEQ ID NO: 3513152 - DNA, 11 bp, Homo sapiens
attcttctgct

SEQ ID NO: 3513153 - DNA, 16 bp, Homo sapiens
attcttgaaagctgtg

SEQ ID NO: 3513154 - DNA, 18 bp, Homo sapiens
attcttggcttaatcatt

SEQ ID NO: 3513155 - DNA, 18 bp, Homo sapiens
attcttggttgaggaaac

SEQ ID NO: 3513156 - DNA, 18 bp, Homo sapiens
attcttgtgcttttcctg

SEQ ID NO: 3513157 - DNA, 14 bp, Homo sapiens
attctttcaattct

SEQ ID NO: 3513158 - DNA, 16 bp, Homo sapiens
attcttttgtaattta

SEQ ID NO: 3513159 - DNA, 17 bp, Homo sapiens
attcttttgtaatttaa

SEQ ID NO: 3513160 - DNA, 14 bp, Homo sapiens
attgaaaaaataga

SEQ ID NO: 3513161 - DNA, 19 bp, Homo sapiens
attgaaaaaatagagcctg

SEQ ID NO: 3513162 - DNA, 15 bp, Homo sapiens
attgaacacaaactg

SEQ ID NO: 3513163 - DNA, 20 bp, Homo sapiens
attgaacacaaactgtaaat

SEQ ID NO: 3513164 - DNA, 22 bp, Homo sapiens
attgaacttactgtagcctcag

SEQ ID NO: 3513165 - DNA, 19 bp, Homo sapiens
attgaagtgttctgagctg

SEQ ID NO: 3513166 - DNA, 23 bp, Homo sapiens
attgaatataatatatttgtgta

SEQ ID NO: 3513167 - DNA, 16 bp, Homo sapiens
atgttgtaattttact

SEQ ID NO: 3513168 - DNA, 21 bp, Homo sapiens
atgttgtgtttctgttcacct

SEQ ID NO: 3513169 - DNA, 17 bp, Homo sapiens
atgtttaatctgttatg

SEQ ID NO: 3513170 - DNA, 19 bp, Homo sapiens
atgtttacagtgtctgtgt

SEQ ID NO: 3513171 - DNA, 17 bp, Homo sapiens
atgtttcacaaggtctt

SEQ ID NO: 3513172 - DNA, 21 bp, Homo sapiens
atgtttcacaccggaaggttt

SEQ ID NO: 3513173 - DNA, 19 bp, Homo sapiens
atgtttcacgaagtttgtt

SEQ ID NO: 3513174 - DNA, 18 bp, Homo sapiens
atgtttcttaaatgggct

SEQ ID NO: 3513175 - DNA, 19 bp, Homo sapiens
atgtttcttttgtatgtaa

SEQ ID NO: 3513176 - DNA, 20 bp, Homo sapiens
atgtttcttttgtatgtaaa

SEQ ID NO: 3513177 - DNA, 13 bp, Homo sapiens
atgtttgcccaaa

SEQ ID NO: 3513178 - DNA, 19 bp, Homo sapiens
atgtttgcctctgcctctg

SEQ ID NO: 3513179 - DNA, 14 bp, Homo sapiens
atgtttgtaacttt

SEQ ID NO: 3513180 - DNA, 18 bp, Homo sapiens
atgttttaaatgtacaga

SEQ ID NO: 3513181 - DNA, 15 bp, Homo sapiens
atgttttaacaaaaa

SEQ ID NO: 3513182 - DNA, 23 bp, Homo sapiens
atgttttatttcattggttaatt

SEQ ID NO: 3513183 - DNA, 16 bp, Homo sapiens
atgttttccagctcct

SEQ ID NO: 3513184 - DNA, 11 bp, Homo sapiens
atgttttctgg

SEQ ID NO: 3513185 - DNA, 14 bp, Homo sapiens
attaaaaaaaaaga

SEQ ID NO: 3513186 - DNA, 20 bp, Homo sapiens
attaaaaaaaacaaaaagaa

SEQ ID NO: 3513187 - DNA, 18 bp, Homo sapiens
attaaaaaagcatacttc

SEQ ID NO: 3513188 - DNA, 18 bp, Homo sapiens
attaaaaaggtttacaga

SEQ ID NO: 3513189 - DNA, 17 bp, Homo sapiens
attaaaaagtctgtatg

SEQ ID NO: 3513190 - DNA, 23 bp, Homo sapiens
attaaaaagtctgtatggcatga

SEQ ID NO: 3513191 - DNA, 13 bp, Homo sapiens
attaaaaatataa

SEQ ID NO: 3513192 - DNA, 17 bp, Homo sapiens
attaaaaatataaaact

SEQ ID NO: 3513193 - DNA, 21 bp, Homo sapiens
attaaaacaatattgtttcta

SEQ ID NO: 3513194 - DNA, 11 bp, Homo sapiens
attaaaaccac

SEQ ID NO: 3513195 - DNA, 23 bp, Homo sapiens
attaaaagatgtctctgcaaacc

SEQ ID NO: 3513196 - DNA, 13 bp, Homo sapiens
attaaaatggatg

SEQ ID NO: 3513197 - DNA, 14 bp, Homo sapiens
attaaaattctgaa

SEQ ID NO: 3513198 - DNA, 23 bp, Homo sapiens
attaaacagatatcttcagttta

SEQ ID NO: 3513199 - DNA, 19 bp, Homo sapiens
attaaacagatgtgaatat

SEQ ID NO: 3513200 - DNA, 15 bp, Homo sapiens
attaaagactccagt

SEQ ID NO: 3513201 - DNA, 18 bp, Homo sapiens
attaaagctaaagtatct

SEQ ID NO: 3513202 - DNA, 13 bp, Homo sapiens
attaaataaaatg

SEQ ID NO: 3513203 - DNA, 16 bp, Homo sapiens
attaaatacaaaactt

SEQ ID NO: 3513204 - DNA, 19 bp, Homo sapiens
attaaatacaaaacttcca

SEQ ID NO: 3513205 - DNA, 15 bp, Homo sapiens
attaaatatttgaag

SEQ ID NO: 3513206 - DNA, 12 bp, Homo sapiens
attaaattacct

SEQ ID NO: 3513207 - DNA, 16 bp, Homo sapiens
attaaattcacaaact

SEQ ID NO: 3513208 - DNA, 17 bp, Homo sapiens
attaaattcacaaactt

SEQ ID NO: 3513209 - DNA, 16 bp, Homo sapiens
attaacatgatgtact

SEQ ID NO: 3513210 - DNA, 20 bp, Homo sapiens
attaaccacttcagctgact

SEQ ID NO: 3513211 - DNA, 12 bp, Homo sapiens
attaagaaaatc

SEQ ID NO: 3513212 - DNA, 14 bp, Homo sapiens
attaagaaaatcat

SEQ ID NO: 3513213 - DNA, 15 bp, Homo sapiens
attaagaaggcaaaa

SEQ ID NO: 3513214 - DNA, 22 bp, Homo sapiens
attaagaaggcaaaaatgtaaa

SEQ ID NO: 3513215 - DNA, 17 bp, Homo sapiens
attaagccacttaaaat

SEQ ID NO: 3513216 - DNA, 14 bp, Homo sapiens
attaaggatgtagc

SEQ ID NO: 3513217 - DNA, 18 bp, Homo sapiens
attaatagtaatttgtaa

SEQ ID NO: 3513218 - DNA, 20 bp, Homo sapiens
attaatagtaatttgtaaag

SEQ ID NO: 3513219 - DNA, 14 bp, Homo sapiens
attaatatgaaaac

SEQ ID NO: 3513220 - DNA, 19 bp, Homo sapiens
attaattcaccttccagtg

SEQ ID NO: 3513221 - DNA, 14 bp, Homo sapiens
attaattctataag

SEQ ID NO: 3513222 - DNA, 22 bp, Homo sapiens
attacaagcgtgagccactgca

SEQ ID NO: 3513223 - DNA, 13 bp, Homo sapiens
attacaattttat

SEQ ID NO: 3513224 - DNA, 20 bp, Homo sapiens
attacaggcacctgccacca

SEQ ID NO: 3513225 - DNA, 22 bp, Homo sapiens
attacaggcacctgccaccatg

SEQ ID NO: 3513226 - DNA, 22 bp, Homo sapiens
attacatctttcacattggcta

SEQ ID NO: 3513227 - DNA, 16 bp, Homo sapiens
attacatgtaaaacat

SEQ ID NO: 3513228 - DNA, 19 bp, Homo sapiens
attaccatgtaaataatct

SEQ ID NO: 3513229 - DNA, 21 bp, Homo sapiens
attaccatgtaaataatctgt

SEQ ID NO: 3513230 - DNA, 22 bp, Homo sapiens
attacccaaacccatggctcta

SEQ ID NO: 3513231 - DNA, 15 bp, Homo sapiens
attactgcttcattt

SEQ ID NO: 3513232 - DNA, 22 bp, Homo sapiens
attagaatagtgttctgcaaaa

SEQ ID NO: 3513233 - DNA, 14 bp, Homo sapiens
attagatgcatgtt

SEQ ID NO: 3513234 - DNA, 21 bp, Homo sapiens
attagatgcatgttgaccatg

SEQ ID NO: 3513235 - DNA, 13 bp, Homo sapiens
attagatgttctc

SEQ ID NO: 3513236 - DNA, 21 bp, Homo sapiens
attagatgttctctatcattt

SEQ ID NO: 3513237 - DNA, 15 bp, Homo sapiens
attagcttcaggata

SEQ ID NO: 3513238 - DNA, 20 bp, Homo sapiens
attagggagaaaattcaatt

SEQ ID NO: 3513239 - DNA, 17 bp, Homo sapiens
attaggtatgtttgtaa

SEQ ID NO: 3513240 - DNA, 21 bp, Homo sapiens
attaggtatgtttgtaacttt

SEQ ID NO: 3513241 - DNA, 23 bp, Homo sapiens
attagtgcagccaagtagcctct

SEQ ID NO: 3513242 - DNA, 18 bp, Homo sapiens
attagtgctaagtgtgaa

SEQ ID NO: 3513243 - DNA, 15 bp, Homo sapiens
attagttgccaatat

SEQ ID NO: 3513244 - DNA, 21 bp, Homo sapiens
attagttttcttgttgctttg

SEQ ID NO: 3513245 - DNA, 17 bp, Homo sapiens
attataatttaatgcat

SEQ ID NO: 3513246 - DNA, 23 bp, Homo sapiens
attataatttttttcaatattta

SEQ ID NO: 3513247 - DNA, 13 bp, Homo sapiens
atgtaaataatct

SEQ ID NO: 3513248 - DNA, 16 bp, Homo sapiens
atgtaaataatctgtg

SEQ ID NO: 3513249 - DNA, 13 bp, Homo sapiens
atgtaaatgtgca

SEQ ID NO: 3513250 - DNA, 19 bp, Homo sapiens
atgtaacatgatgttaact

SEQ ID NO: 3513251 - DNA, 19 bp, Homo sapiens
atgtaagcatactttgtaa

SEQ ID NO: 3513252 - DNA, 17 bp, Homo sapiens
atgtaatcccagctact

SEQ ID NO: 3513253 - DNA, 15 bp, Homo sapiens
atgtaatgcaactac

SEQ ID NO: 3513254 - DNA, 21 bp, Homo sapiens
atgtaatgttttctttgcaaa

SEQ ID NO: 3513255 - DNA, 22 bp, Homo sapiens
atgtaatttagtctaacacagt

SEQ ID NO: 3513256 - DNA, 16 bp, Homo sapiens
atgtacagttgaaata

SEQ ID NO: 3513257 - DNA, 20 bp, Homo sapiens
atgtactcctctttacactg

SEQ ID NO: 3513258 - DNA, 15 bp, Homo sapiens
atgtactctcctttt

SEQ ID NO: 3513259 - DNA, 14 bp, Homo sapiens
atgtagaaaatttg

SEQ ID NO: 3513260 - DNA, 20 bp, Homo sapiens
atgtagaatattcagacaaa

SEQ ID NO: 3513261 - DNA, 23 bp, Homo sapiens
atgtagccccctggcctctgtgc

SEQ ID NO: 3513262 - DNA, 22 bp, Homo sapiens
atgtagccttcacacagataga

SEQ ID NO: 3513263 - DNA, 18 bp, Homo sapiens
atgtagcttttcaccttt

SEQ ID NO: 3513264 - DNA, 16 bp, Homo sapiens
atgtaggaaaaaaata

SEQ ID NO: 3513265 - DNA, 21 bp, Homo sapiens
atgtaggaaaaaaatagtcta

SEQ ID NO: 3513266 - DNA, 14 bp, Homo sapiens
atgtaggaagtagg

SEQ ID NO: 3513267 - DNA, 16 bp, Homo sapiens
atgtagtaattgacat

SEQ ID NO: 3513268 - DNA, 22 bp, Homo sapiens
atgtagtggttttaggatactt

SEQ ID NO: 3513269 - DNA, 18 bp, Homo sapiens
atgtataatttttttctt

SEQ ID NO: 3513270 - DNA, 19 bp, Homo sapiens
atgtataatttttttcttg

SEQ ID NO: 3513271 - DNA, 21 bp, Homo sapiens
atgtataatttttttcttgta

SEQ ID NO: 3513272 - DNA, 16 bp, Homo sapiens
atgtatagttttccct

SEQ ID NO: 3513273 - DNA, 15 bp, Homo sapiens
atgtatattcctttg

SEQ ID NO: 3513274 - DNA, 17 bp, Homo sapiens
atgtatcataattacca

SEQ ID NO: 3513275 - DNA, 21 bp, Homo sapiens
atgtatcataattaccaagtg

SEQ ID NO: 3513276 - DNA, 14 bp, Homo sapiens
atgtatgtgcattt

SEQ ID NO: 3513277 - DNA, 14 bp, Homo sapiens
atgtattgagatat

SEQ ID NO: 3513278 - DNA, 14 bp, Homo sapiens
atgtattgataaga

SEQ ID NO: 3513279 - DNA, 17 bp, Homo sapiens
atgtatttaccaaaaat

SEQ ID NO: 3513280 - DNA, 22 bp, Homo sapiens
atgtatttaccaaaaattttgt

SEQ ID NO: 3513281 - DNA, 22 bp, Homo sapiens
atgtcaatgccaggatttctca

SEQ ID NO: 3513282 - DNA, 16 bp, Homo sapiens
atgtcaatttctgtgt

SEQ ID NO: 3513283 - DNA, 19 bp, Homo sapiens
atgtcaatttctgtgttgc

SEQ ID NO: 3513284 - DNA, 13 bp, Homo sapiens
atgtcacaggcag

SEQ ID NO: 3513285 - DNA, 16 bp, Homo sapiens
atgtcacaggcaggtc

SEQ ID NO: 3513286 - DNA, 19 bp, Homo sapiens
atgtcacaggcaggtccag

SEQ ID NO: 3513287 - DNA, 16 bp, Homo sapiens
atgtcagcaaaaagca

SEQ ID NO: 3513288 - DNA, 15 bp, Homo sapiens
atgtcctcaccacat

SEQ ID NO: 3513289 - DNA, 14 bp, Homo sapiens
atgtcgagagctgg

SEQ ID NO: 3513290 - DNA, 19 bp, Homo sapiens
atgtctactcagcatttga

SEQ ID NO: 3513291 - DNA, 20 bp, Homo sapiens
atgtctattccattcccttc

SEQ ID NO: 3513292 - DNA, 12 bp, Homo sapiens
atgtctccatac

SEQ ID NO: 3513293 - DNA, 23 bp, Homo sapiens
atgtctctgtgagactcgagaac

SEQ ID NO: 3513294 - DNA, 14 bp, Homo sapiens
atgtctgaactttg

SEQ ID NO: 3513295 - DNA, 22 bp, Homo sapiens
atgtctgagtgaacctgtataa

SEQ ID NO: 3513296 - DNA, 20 bp, Homo sapiens
atgtctgcagtgtgcccccc

SEQ ID NO: 3513297 - DNA, 14 bp, Homo sapiens
atgtctgcatttcg

SEQ ID NO: 3513298 - DNA, 19 bp, Homo sapiens
atgtctgctcctttcccct

SEQ ID NO: 3513299 - DNA, 13 bp, Homo sapiens
atgtctgtttgct

SEQ ID NO: 3513300 - DNA, 21 bp, Homo sapiens
atgtcttaatgaagtttgaat

SEQ ID NO: 3513301 - DNA, 19 bp, Homo sapiens
atgtcttcaaggcttcagt

SEQ ID NO: 3513302 - DNA, 14 bp, Homo sapiens
atgtcttctcacaa

SEQ ID NO: 3513303 - DNA, 20 bp, Homo sapiens
atgtcttctcacaagccagc

SEQ ID NO: 3513304 - DNA, 20 bp, Homo sapiens
atgtcttgctgttgacatat

SEQ ID NO: 3513305 - DNA, 22 bp, Homo sapiens
atgtcttgctgttgacatattt

SEQ ID NO: 3513306 - DNA, 10 bp, Homo sapiens
atgtcttgtg

SEQ ID NO: 3513307 - DNA, 14 bp, Homo sapiens
atgtcttttaaaat

SEQ ID NO: 3513308 - DNA, 18 bp, Homo sapiens
atgtgaaactcatctcat

SEQ ID NO: 3513309 - DNA, 16 bp, Homo sapiens
atgtgaaaggaacatt

SEQ ID NO: 3513310 - DNA, 15 bp, Homo sapiens
atgtgaactttatta

SEQ ID NO: 3513311 - DNA, 22 bp, Homo sapiens
atgtgaagacacctgcagcctt

SEQ ID NO: 3513312 - DNA, 12 bp, Homo sapiens
atgtgaagccaa

SEQ ID NO: 3513313 - DNA, 21 bp, Homo sapiens
atgtgaagccaattcagacag

SEQ ID NO: 3513314 - DNA, 22 bp, Homo sapiens
atgtgaagccaattcagacagg

SEQ ID NO: 3513315 - DNA, 16 bp, Homo sapiens
atgtgaatctatgctg

SEQ ID NO: 3513316 - DNA, 22 bp, Homo sapiens
atgtgaatctatgctggtgaaa

SEQ ID NO: 3513317 - DNA, 22 bp, Homo sapiens
atgtgacatgcccaaggccacg

SEQ ID NO: 3513318 - DNA, 20 bp, Homo sapiens
atcttatcatggtctcagtc

SEQ ID NO: 3513319 - DNA, 15 bp, Homo sapiens
atcttcagtttaatg

SEQ ID NO: 3513320 - DNA, 14 bp, Homo sapiens
atcttcctgtgtcc

SEQ ID NO: 3513321 - DNA, 13 bp, Homo sapiens
atcttctaaatgg

SEQ ID NO: 3513322 - DNA, 23 bp, Homo sapiens
atcttgaaattaagaaggcaaaa

SEQ ID NO: 3513323 - DNA, 18 bp, Homo sapiens
atcttgaatactctgccc

SEQ ID NO: 3513324 - DNA, 19 bp, Homo sapiens
atcttgaatactctgccct

SEQ ID NO: 3513325 - DNA, 18 bp, Homo sapiens
atcttgaatagcttatgt

SEQ ID NO: 3513326 - DNA, 16 bp, Homo sapiens
atcttgaattgtaact

SEQ ID NO: 3513327 - DNA, 23 bp, Homo sapiens
atcttgaccaagcaggaagctca

SEQ ID NO: 3513328 - DNA, 17 bp, Homo sapiens
atcttgactacagtcag

SEQ ID NO: 3513329 - DNA, 21 bp, Homo sapiens
atcttgataccacctatatag

SEQ ID NO: 3513330 - DNA, 15 bp, Homo sapiens
atcttgatgtttaga

SEQ ID NO: 3513331 - DNA, 12 bp, Homo sapiens
atcttgctttct

SEQ ID NO: 3513332 - DNA, 23 bp, Homo sapiens
atcttggcacatttaagagacag

SEQ ID NO: 3513333 - DNA, 20 bp, Homo sapiens
atcttggcctaaacctcagt

SEQ ID NO: 3513334 - DNA, 21 bp, Homo sapiens
atcttggtttgccttccagaa

SEQ ID NO: 3513335 - DNA, 13 bp, Homo sapiens
atcttgtctcaat

SEQ ID NO: 3513336 - DNA, 15 bp, Homo sapiens
atcttgtctcaatgc

SEQ ID NO: 3513337 - DNA, 14 bp, Homo sapiens
atcttgtctctggg

SEQ ID NO: 3513338 - DNA, 15 bp, Homo sapiens
atcttgtctctgggc

SEQ ID NO: 3513339 - DNA, 11 bp, Homo sapiens
atctttaactg

SEQ ID NO: 3513340 - DNA, 21 bp, Homo sapiens
atctttattatggaaaacatt

SEQ ID NO: 3513341 - DNA, 22 bp, Homo sapiens
atctttcttctattttattccc

SEQ ID NO: 3513342 - DNA, 17 bp, Homo sapiens
atctttctttcttagaa

SEQ ID NO: 3513343 - DNA, 14 bp, Homo sapiens
atctttgattctcc

SEQ ID NO: 3513344 - DNA, 17 bp, Homo sapiens
atctttgcagacaggca

SEQ ID NO: 3513345 - DNA, 18 bp, Homo sapiens
atctttgcagacaggcaa

SEQ ID NO: 3513346 - DNA, 15 bp, Homo sapiens
atctttgtggccaag

SEQ ID NO: 3513347 - DNA, 21 bp, Homo sapiens
atctttgttaaggtcctgaaa

SEQ ID NO: 3513348 - DNA, 22 bp, Homo sapiens
atcttttacaactgcctcgaaa

SEQ ID NO: 3513349 - DNA, 11 bp, Homo sapiens
atcttttacat

SEQ ID NO: 3513350 - DNA, 15 bp, Homo sapiens
atcttttattttgga

SEQ ID NO: 3513351 - DNA, 18 bp, Homo sapiens
atcttttattttggaact

SEQ ID NO: 3513352 - DNA, 14 bp, Homo sapiens
atcttttcttgcct

SEQ ID NO: 3513353 - DNA, 23 bp, Homo sapiens
atctttttttcatttttaaatgt

SEQ ID NO: 3513354 - DNA, 15 bp, Homo sapiens
atgaaaacattcaga

SEQ ID NO: 3513355 - DNA, 12 bp, Homo sapiens
atgaaaggagag

SEQ ID NO: 3513356 - DNA, 19 bp, Homo sapiens
atgaaagggcccagagagg

SEQ ID NO: 3513357 - DNA, 17 bp, Homo sapiens
atgaaaggtgccatgga

SEQ ID NO: 3513358 - DNA, 22 bp, Homo sapiens
atgaaaggtgccatggaagagg

SEQ ID NO: 3513359 - DNA, 16 bp, Homo sapiens
atgaaaggtttacatt

SEQ ID NO: 3513360 - DNA, 21 bp, Homo sapiens
atgaaaggtttacattgtcaa

SEQ ID NO: 3513361 - DNA, 15 bp, Homo sapiens
atgaaatatgcatct

SEQ ID NO: 3513362 - DNA, 17 bp, Homo sapiens
atgaaatattgctgtat

SEQ ID NO: 3513363 - DNA, 20 bp, Homo sapiens
atgaacattagaaaaatagc

SEQ ID NO: 3513364 - DNA, 23 bp, Homo sapiens
atgaaccacatcttgctctgctg

SEQ ID NO: 3513365 - DNA, 14 bp, Homo sapiens
atgaaccttctggc

SEQ ID NO: 3513366 - DNA, 19 bp, Homo sapiens
atgaagaatataccatttc

SEQ ID NO: 3513367 - DNA, 22 bp, Homo sapiens
atgaagacttaaaagagctcag

SEQ ID NO: 3513368 - DNA, 13 bp, Homo sapiens
atgaagcaacaga

SEQ ID NO: 3513369 - DNA, 12 bp, Homo sapiens
atgaagccagct

SEQ ID NO: 3513370 - DNA, 20 bp, Homo sapiens
atgaaggtaatattgataag

SEQ ID NO: 3513371 - DNA, 16 bp, Homo sapiens
atgaagtttgaatgtt

SEQ ID NO: 3513372 - DNA, 21 bp, Homo sapiens
atgaatactgtattttgtatt

SEQ ID NO: 3513373 - DNA, 23 bp, Homo sapiens
atgaatatatttaagcaacatct

SEQ ID NO: 3513374 - DNA, 22 bp, Homo sapiens
atgaatgtcttttttcaaactt

SEQ ID NO: 3513375 - DNA, 16 bp, Homo sapiens
atgaattcctagaatt

SEQ ID NO: 3513376 - DNA, 22 bp, Homo sapiens
atgaatttttttcatcttctct

SEQ ID NO: 3513377 - DNA, 15 bp, Homo sapiens
atgacaaaaattatt

SEQ ID NO: 3513378 - DNA, 17 bp, Homo sapiens
atgacaagatggtacaa

SEQ ID NO: 3513379 - DNA, 17 bp, Homo sapiens
atgacactgtttcctga

SEQ ID NO: 3513380 - DNA, 18 bp, Homo sapiens
atgacactgtttcctgat

SEQ ID NO: 3513381 - DNA, 23 bp, Homo sapiens
atgacagaggaggatgtaaggcc

SEQ ID NO: 3513382 - DNA, 15 bp, Homo sapiens
atgacagccagagcc

SEQ ID NO: 3513383 - DNA, 15 bp, Homo sapiens
atgacagcctgcagc

SEQ ID NO: 3513384 - DNA, 16 bp, Homo sapiens
atgacattcatgcctg

SEQ ID NO: 3513385 - DNA, 17 bp, Homo sapiens
atgacattcatgcctgg

SEQ ID NO: 3513386 - DNA, 17 bp, Homo sapiens
atgaccaacctgtttct

SEQ ID NO: 3513387 - DNA, 12 bp, Homo sapiens
atgacccaggct

SEQ ID NO: 3513388 - DNA, 14 bp, Homo sapiens
atgacccaggctgg

SEQ ID NO: 3513389 - DNA, 15 bp, Homo sapiens
atgacccaggctggg

SEQ ID NO: 3513390 - DNA, 11 bp, Homo sapiens
atgactgcctt

SEQ ID NO: 3513391 - DNA, 17 bp, Homo sapiens
atgactgtagaatttgt

SEQ ID NO: 3513392 - DNA, 19 bp, Homo sapiens
atgacttcccctgcctcct

SEQ ID NO: 3513393 - DNA, 14 bp, Homo sapiens
atgagaaagccttc

SEQ ID NO: 3513394 - DNA, 22 bp, Homo sapiens
atgagaaaggttgaagcaccaa

SEQ ID NO: 3513395 - DNA, 15 bp, Homo sapiens
atgagaaatacaaaa

SEQ ID NO: 3513396 - DNA, 22 bp, Homo sapiens
atgagaagttgatatagaacag

SEQ ID NO: 3513397 - DNA, 15 bp, Homo sapiens
atgagaatgtgccat

SEQ ID NO: 3513398 - DNA, 16 bp, Homo sapiens
atgagagcgacacaga

SEQ ID NO: 3513399 - DNA, 18 bp, Homo sapiens
atgagagttttggatgca

SEQ ID NO: 3513400 - DNA, 22 bp, Homo sapiens
atgctctcactgtttgttttta

SEQ ID NO: 3513401 - DNA, 12 bp, Homo sapiens
atgctctctctt

SEQ ID NO: 3513402 - DNA, 14 bp, Homo sapiens
atgctctctcttct

SEQ ID NO: 3513403 - DNA, 19 bp, Homo sapiens
atgctctctcttcttatta

SEQ ID NO: 3513404 - DNA, 19 bp, Homo sapiens
atgctgaagccaaagccaa

SEQ ID NO: 3513405 - DNA, 13 bp, Homo sapiens
atgctgacagctc

SEQ ID NO: 3513406 - DNA, 19 bp, Homo sapiens
atgctgacattcacctgcc

SEQ ID NO: 3513407 - DNA, 14 bp, Homo sapiens
atgctgatgtcctc

SEQ ID NO: 3513408 - DNA, 16 bp, Homo sapiens
atgctgatgtcctcac

SEQ ID NO: 3513409 - DNA, 18 bp, Homo sapiens
atgctgcaacaaaatgta

SEQ ID NO: 3513410 - DNA, 19 bp, Homo sapiens
atgctgccggcacagctgg

SEQ ID NO: 3513411 - DNA, 23 bp, Homo sapiens
atgctggaacctgcaaaaaatac

SEQ ID NO: 3513412 - DNA, 13 bp, Homo sapiens
atgctggcccagg

SEQ ID NO: 3513413 - DNA, 20 bp, Homo sapiens
atgctggcccagggcccaga

SEQ ID NO: 3513414 - DNA, 21 bp, Homo sapiens
atgctggcccagggcccagag

SEQ ID NO: 3513415 - DNA, 23 bp, Homo sapiens
atgctggcccagggcccagagcc

SEQ ID NO: 3513416 - DNA, 10 bp, Homo sapiens
atgctgggac

SEQ ID NO: 3513417 - DNA, 16 bp, Homo sapiens
atgctgggactcagcc

SEQ ID NO: 3513418 - DNA, 20 bp, Homo sapiens
atgctgtcaatattggtgta

SEQ ID NO: 3513419 - DNA, 12 bp, Homo sapiens
atgcttaagatt

SEQ ID NO: 3513420 - DNA, 20 bp, Homo sapiens
atgcttacatctggaatctg

SEQ ID NO: 3513421 - DNA, 20 bp, Homo sapiens
atgcttcatcattccctctc

SEQ ID NO: 3513422 - DNA, 22 bp, Homo sapiens
atgcttcatcattccctctcat

SEQ ID NO: 3513423 - DNA, 16 bp, Homo sapiens
atgcttgcaaaaacta

SEQ ID NO: 3513424 - DNA, 13 bp, Homo sapiens
atgcttgtgttat

SEQ ID NO: 3513425 - DNA, 14 bp, Homo sapiens
atgctttacagtca

SEQ ID NO: 3513426 - DNA, 18 bp, Homo sapiens
atgctttgaaacagaaaa

SEQ ID NO: 3513427 - DNA, 21 bp, Homo sapiens
atgcttttactgaactttctt

SEQ ID NO: 3513428 - DNA, 22 bp, Homo sapiens
atgcttttatatttttttaaaa

SEQ ID NO: 3513429 - DNA, 19 bp, Homo sapiens
atgctttttatttctgcat

SEQ ID NO: 3513430 - DNA, 19 bp, Homo sapiens
atgctttttgagtttcatg

SEQ ID NO: 3513431 - DNA, 21 bp, Homo sapiens
atgctttttgagtttcatgtt

SEQ ID NO: 3513432 - DNA, 18 bp, Homo sapiens
atggaaccgcaggaagct

SEQ ID NO: 3513433 - DNA, 20 bp, Homo sapiens
atggaaccgcaggaagctgc

SEQ ID NO: 3513434 - DNA, 18 bp, Homo sapiens
atggaacctgacgtagct

SEQ ID NO: 3513435 - DNA, 17 bp, Homo sapiens
atggaaggggcttctgg

SEQ ID NO: 3513436 - DNA, 21 bp, Homo sapiens
atggaatcccactgtatgatt

SEQ ID NO: 3513437 - DNA, 14 bp, Homo sapiens
atggaattgatttg

SEQ ID NO: 3513438 - DNA, 17 bp, Homo sapiens
atggaattgatttgcat

SEQ ID NO: 3513439 - DNA, 14 bp, Homo sapiens
atggacagattaat

SEQ ID NO: 3513440 - DNA, 19 bp, Homo sapiens
atggacaggctggctccag

SEQ ID NO: 3513441 - DNA, 14 bp, Homo sapiens
atggacctgtcacg

SEQ ID NO: 3513442 - DNA, 20 bp, Homo sapiens
atggactatctgtctggtgg

SEQ ID NO: 3513443 - DNA, 21 bp, Homo sapiens
atggactatctgtctggtggc

SEQ ID NO: 3513444 - DNA, 21 bp, Homo sapiens
atggactccagcctgcctggc

SEQ ID NO: 3513445 - DNA, 13 bp, Homo sapiens
atggagagaaaac

SEQ ID NO: 3513446 - DNA, 19 bp, Homo sapiens
atggagattcagttttcat

SEQ ID NO: 3513447 - DNA, 20 bp, Homo sapiens
atggagattcagttttcatt

SEQ ID NO: 3513448 - DNA, 15 bp, Homo sapiens
atggagccagctccc

SEQ ID NO: 3513449 - DNA, 19 bp, Homo sapiens
atggagttaacatcatgaa

SEQ ID NO: 3513450 - DNA, 14 bp, Homo sapiens
atggatacataaag

SEQ ID NO: 3513451 - DNA, 21 bp, Homo sapiens
atggatatttgtactgtttaa

SEQ ID NO: 3513452 - DNA, 23 bp, Homo sapiens
atggatgccaatattaaatctgc

SEQ ID NO: 3513453 - DNA, 19 bp, Homo sapiens
atggatgggggaactcaga

SEQ ID NO: 3513454 - DNA, 18 bp, Homo sapiens
atggatttccagccaaag

SEQ ID NO: 3513455 - DNA, 24 bp, Homo sapiens
atggcaacagatctggaacctcag

SEQ ID NO: 3513456 - DNA, 13 bp, Homo sapiens
atggcagaaggca

SEQ ID NO: 3513457 - DNA, 15 bp, Homo sapiens
atggcagaaggcaaa

SEQ ID NO: 3513458 - DNA, 20 bp, Homo sapiens
atggcagaaggcaaacccat

SEQ ID NO: 3513459 - DNA, 20 bp, Homo sapiens
atggcagagttgtaaatata

SEQ ID NO: 3513460 - DNA, 21 bp, Homo sapiens
atggcagagttgtaaatatat

SEQ ID NO: 3513461 - DNA, 16 bp, Homo sapiens
atggcagatgcacatg

SEQ ID NO: 3513462 - DNA, 18 bp, Homo sapiens
ataagtacctcagcattt

SEQ ID NO: 3513463 - DNA, 16 bp, Homo sapiens
ataagtgaaaatctta

SEQ ID NO: 3513464 - DNA, 19 bp, Homo sapiens
ataagtgctgtataaaatc

SEQ ID NO: 3513465 - DNA, 22 bp, Homo sapiens
ataagtgctgtataaaatcagc

SEQ ID NO: 3513466 - DNA, 20 bp, Homo sapiens
ataagtggaggcactttagg

SEQ ID NO: 3513467 - DNA, 18 bp, Homo sapiens
ataagtggtgcttagaaa

SEQ ID NO: 3513468 - DNA, 14 bp, Homo sapiens
ataagtgtattttt

SEQ ID NO: 3513469 - DNA, 16 bp, Homo sapiens
ataagtgtctttctgg

SEQ ID NO: 3513470 - DNA, 12 bp, Homo sapiens
ataagttatttt

SEQ ID NO: 3513471 - DNA, 19 bp, Homo sapiens
ataagttatttttgtacat

SEQ ID NO: 3513472 - DNA, 20 bp, Homo sapiens
ataagttgagaaggtgcctg

SEQ ID NO: 3513473 - DNA, 13 bp, Homo sapiens
ataataaaatagt

SEQ ID NO: 3513474 - DNA, 13 bp, Homo sapiens
ataatacattccg

SEQ ID NO: 3513475 - DNA, 22 bp, Homo sapiens
ataatactgctgagatacatac

SEQ ID NO: 3513476 - DNA, 20 bp, Homo sapiens
ataatatacttgtggactaa

SEQ ID NO: 3513477 - DNA, 13 bp, Homo sapiens
ataatatattttc

SEQ ID NO: 3513478 - DNA, 18 bp, Homo sapiens
agttgccccgtctctgtt

SEQ ID NO: 3513479 - DNA, 19 bp, Homo sapiens
agttgccccgtctctgttc

SEQ ID NO: 3513480 - DNA, 16 bp, Homo sapiens
agttgcttttttgact

SEQ ID NO: 3513481 - DNA, 23 bp, Homo sapiens
agttggacccattgccagtgagt

SEQ ID NO: 3513482 - DNA, 16 bp, Homo sapiens
agttggccagagagcc

SEQ ID NO: 3513483 - DNA, 23 bp, Homo sapiens
agttgggaacttcagatggacct

SEQ ID NO: 3513484 - DNA, 17 bp, Homo sapiens
agttgggtggatgcctg

SEQ ID NO: 3513485 - DNA, 21 bp, Homo sapiens
agttgggtggatgcctggtgg

SEQ ID NO: 3513486 - DNA, 19 bp, Homo sapiens
atagtaacttcttatggaa

SEQ ID NO: 3513487 - DNA, 21 bp, Homo sapiens
atagtaacttcttatggaatt

SEQ ID NO: 3513488 - DNA, 19 bp, Homo sapiens
atagtaatttgtaaagttg

SEQ ID NO: 3513489 - DNA, 19 bp, Homo sapiens
atagtaccatttatacaaa

SEQ ID NO: 3513490 - DNA, 21 bp, Homo sapiens
atagtaccatttatacaaatt

SEQ ID NO: 3513491 - DNA, 17 bp, Homo sapiens
atagtatggtggctggg

SEQ ID NO: 3513492 - DNA, 18 bp, Homo sapiens
atagtatggtggctgggt

SEQ ID NO: 3513493 - DNA, 21 bp, Homo sapiens
atagtatttgattcaaaatat

SEQ ID NO: 3513494 - DNA, 17 bp, Homo sapiens
atagtctagtgtagtat

SEQ ID NO: 3513495 - DNA, 16 bp, Homo sapiens
atagtcttttgctttt

SEQ ID NO: 3513496 - DNA, 17 bp, Homo sapiens
atagtcttttgcttttg

SEQ ID NO: 3513497 - DNA, 17 bp, Homo sapiens
atagtgaaataaattct

SEQ ID NO: 3513498 - DNA, 15 bp, Homo sapiens
atagtgcaactgttt

SEQ ID NO: 3513499 - DNA, 22 bp, Homo sapiens
atagtgcattgtttctgtgggc

SEQ ID NO: 3513500 - DNA, 14 bp, Homo sapiens
atagttaatatagt

SEQ ID NO: 3513501 - DNA, 16 bp, Homo sapiens
atagttaatattttgt

SEQ ID NO: 3513502 - DNA, 15 bp, Homo sapiens
atagttagaacctgg

SEQ ID NO: 3513503 - DNA, 15 bp, Homo sapiens
atagttcaaagccaa

SEQ ID NO: 3513504 - DNA, 15 bp, Homo sapiens
atagttcaaggaact

SEQ ID NO: 3513505 - DNA, 20 bp, Homo sapiens
atagtttgggcttcagccta

SEQ ID NO: 3513506 - DNA, 15 bp, Homo sapiens
atataaaataaatat

SEQ ID NO: 3513507 - DNA, 16 bp, Homo sapiens
atataaaataaatata

SEQ ID NO: 3513508 - DNA, 18 bp, Homo sapiens
atataaaataaatatata

SEQ ID NO: 3513509 - DNA, 24 bp, Homo sapiens
atataaaataaatatatataaacc

SEQ ID NO: 3513510 - DNA, 19 bp, Homo sapiens
atatttattcattatttgt

SEQ ID NO: 3513511 - DNA, 19 bp, Homo sapiens
atatttcagatgtaatgtt

SEQ ID NO: 3513512 - DNA, 21 bp, Homo sapiens
atatttcagatgtaatgtttt

SEQ ID NO: 3513513 - DNA, 16 bp, Homo sapiens
atatttctattgaatt

SEQ ID NO: 3513514 - DNA, 14 bp, Homo sapiens
atatttgaatcttg

SEQ ID NO: 3513515 - DNA, 20 bp, Homo sapiens
atatttgtgatagcactttc

SEQ ID NO: 3513516 - DNA, 21 bp, Homo sapiens
atatttgtgatagcactttct

SEQ ID NO: 3513517 - DNA, 22 bp, Homo sapiens
atatttgtgatagcactttcta

SEQ ID NO: 3513518 - DNA, 13 bp, Homo sapiens
atattttcaacta

SEQ ID NO: 3513519 - DNA, 18 bp, Homo sapiens
atattttcaactatgtag

SEQ ID NO: 3513520 - DNA, 21 bp, Homo sapiens
atattttcaccatttgattat

SEQ ID NO: 3513521 - DNA, 14 bp, Homo sapiens
atattttgttctta

SEQ ID NO: 3513522 - DNA, 19 bp, Homo sapiens
atatttttatagacaaata

SEQ ID NO: 3513523 - DNA, 14 bp, Homo sapiens
atattttttctgta

SEQ ID NO: 3513524 - DNA, 21 bp, Homo sapiens
atatttttttaaaatgttaaa

SEQ ID NO: 3513525 - DNA, 17 bp, Homo sapiens
atcaaaatcctacagat

SEQ ID NO: 3513526 - DNA, 12 bp, Homo sapiens
atcaaaatgctt

SEQ ID NO: 3513527 - DNA, 23 bp, Homo sapiens
atcaaagaggttttaaaaaaatc

SEQ ID NO: 3513528 - DNA, 15 bp, Homo sapiens
atcaaagttctgctt

SEQ ID NO: 3513529 - DNA, 16 bp, Homo sapiens
atcaaagttctgcttt

SEQ ID NO: 3513530 - DNA, 21 bp, Homo sapiens
atcaaatggaagacacattga

SEQ ID NO: 3513531 - DNA, 16 bp, Homo sapiens
atcaacaaaaattgtc

SEQ ID NO: 3513532 - DNA, 13 bp, Homo sapiens
atcaacatctttt

SEQ ID NO: 3513533 - DNA, 15 bp, Homo sapiens
atcaacatcttttct

SEQ ID NO: 3513534 - DNA, 20 bp, Homo sapiens
atcaaccccttcgctcctgt

SEQ ID NO: 3513535 - DNA, 15 bp, Homo sapiens
atcaacttaaaagtc

SEQ ID NO: 3513536 - DNA, 14 bp, Homo sapiens
atcaagaagggctg

SEQ ID NO: 3513537 - DNA, 20 bp, Homo sapiens
atcaagaagggctgcatgat

SEQ ID NO: 3513538 - DNA, 22 bp, Homo sapiens
atcaagatgagagaactggagg

SEQ ID NO: 3513539 - DNA, 16 bp, Homo sapiens
atcaaggcactgcctg

SEQ ID NO: 3513540 - DNA, 18 bp, Homo sapiens
atcaaggccttattggaa

SEQ ID NO: 3513541 - DNA, 16 bp, Homo sapiens
atcaagtatttgggaa

SEQ ID NO: 3513542 - DNA, 21 bp, Homo sapiens
atcaagtatttgggaagtgaa

SEQ ID NO: 3513543 - DNA, 17 bp, Homo sapiens
atcaagtcctttgtgaa

SEQ ID NO: 3513544 - DNA, 19 bp, Homo sapiens
atcaagtcctttgtgaata

SEQ ID NO: 3513545 - DNA, 13 bp, Homo sapiens
atcaagtctgttt

SEQ ID NO: 3513546 - DNA, 15 bp, Homo sapiens
atcaagttgaattga

SEQ ID NO: 3513547 - DNA, 19 bp, Homo sapiens
atcaataaaaaacaaatat

SEQ ID NO: 3513548 - DNA, 18 bp, Homo sapiens
atcaatagtgcaactgtt

SEQ ID NO: 3513549 - DNA, 22 bp, Homo sapiens
atcaatagtgcaactgttttga

SEQ ID NO: 3513550 - DNA, 23 bp, Homo sapiens
atcaatgtaccttttttggtagt

SEQ ID NO: 3513551 - DNA, 17 bp, Homo sapiens
atcaattttaccctgag

SEQ ID NO: 3513552 - DNA, 21 bp, Homo sapiens
atcacaacgtgcattgtgctt

SEQ ID NO: 3513553 - DNA, 11 bp, Homo sapiens
atcacacacac

SEQ ID NO: 3513554 - DNA, 21 bp, Homo sapiens
atcacagcctctgaaaaccaa

SEQ ID NO: 3513555 - DNA, 23 bp, Homo sapiens
atcaccacaaactgtaatacaat

SEQ ID NO: 3513556 - DNA, 19 bp, Homo sapiens
atcaccgtgggctccctga

SEQ ID NO: 3513557 - DNA, 14 bp, Homo sapiens
atcacctatttcca

SEQ ID NO: 3513558 - DNA, 16 bp, Homo sapiens
atcacctcattctgaa

SEQ ID NO: 3513559 - DNA, 16 bp, Homo sapiens
atcaccttaggcaggg

SEQ ID NO: 3513560 - DNA, 15 bp, Homo sapiens
atcacgccactgcac

SEQ ID NO: 3513561 - DNA, 22 bp, Homo sapiens
atcacggctcactgcagcctca

SEQ ID NO: 3513562 - DNA, 21 bp, Homo sapiens
atcacgttagaggaaaaatat

SEQ ID NO: 3513563 - DNA, 17 bp, Homo sapiens
atcactgagttttccat

SEQ ID NO: 3513564 - DNA, 23 bp, Homo sapiens
atcactgccagagataaactaat

SEQ ID NO: 3513565 - DNA, 12 bp, Homo sapiens
atcactgtcttt

SEQ ID NO: 3513566 - DNA, 17 bp, Homo sapiens
atcactgtggctgtctg

SEQ ID NO: 3513567 - DNA, 16 bp, Homo sapiens
atcactgttcatgctg

SEQ ID NO: 3513568 - DNA, 18 bp, Homo sapiens
atcagaaaaatggagcaa

SEQ ID NO: 3513569 - DNA, 22 bp, Homo sapiens
atcagaactcaaatggggccag

SEQ ID NO: 3513570 - DNA, 13 bp, Homo sapiens
atcagaatttgtg

SEQ ID NO: 3513571 - DNA, 23 bp, Homo sapiens
atcagagcctttcctcaaaactg

SEQ ID NO: 3513572 - DNA, 21 bp, Homo sapiens
atcagattgcatgtgactctg

SEQ ID NO: 3513573 - DNA, 12 bp, Homo sapiens
atcagcaaaaaa

SEQ ID NO: 3513574 - DNA, 16 bp, Homo sapiens
atcagccaattatgtt

SEQ ID NO: 3513575 - DNA, 17 bp, Homo sapiens
atcagcctgctccagct

SEQ ID NO: 3513576 - DNA, 19 bp, Homo sapiens
atcagcctgctccagctgt

SEQ ID NO: 3513577 - DNA, 11 bp, Homo sapiens
atcagcctggg

SEQ ID NO: 3513578 - DNA, 15 bp, Homo sapiens
atcagctccttcctg

SEQ ID NO: 3513579 - DNA, 22 bp, Homo sapiens
atcaggaatattttccaaagag

SEQ ID NO: 3513580 - DNA, 14 bp, Homo sapiens
atcagtataaacaa

SEQ ID NO: 3513581 - DNA, 18 bp, Homo sapiens
atcagtataaacaaagtt

SEQ ID NO: 3513582 - DNA, 13 bp, Homo sapiens
atcagtggagcca

SEQ ID NO: 3513583 - DNA, 10 bp, Homo sapiens
atcagtgttg

SEQ ID NO: 3513584 - DNA, 20 bp, Homo sapiens
atcagttacccactcggtcc

SEQ ID NO: 3513585 - DNA, 18 bp, Homo sapiens
atcagttactctgaaggg

SEQ ID NO: 3513586 - DNA, 14 bp, Homo sapiens
atcatcaagaaggg

SEQ ID NO: 3513587 - DNA, 23 bp, Homo sapiens
atcatccactgtgccatgtgcca

SEQ ID NO: 3513588 - DNA, 15 bp, Homo sapiens
atcatcgccagaggt

SEQ ID NO: 3513589 - DNA, 16 bp, Homo sapiens
atcatcgccagaggtg

SEQ ID NO: 3513590 - DNA, 20 bp, Homo sapiens
atcatcgccagaggtgcttc

SEQ ID NO: 3513591 - DNA, 22 bp, Homo sapiens
atcatcgccagaggtgcttcac

SEQ ID NO: 3513592 - DNA, 20 bp, Homo sapiens
atcatctcctgccttcctcc

SEQ ID NO: 3513593 - DNA, 14 bp, Homo sapiens
atcatgaaatatgc

SEQ ID NO: 3513594 - DNA, 15 bp, Homo sapiens
atcatgaaatatgca

SEQ ID NO: 3513595 - DNA, 18 bp, Homo sapiens
atcatgaaatatgcatct

SEQ ID NO: 3513596 - DNA, 13 bp, Homo sapiens
atcatgagcctgc

SEQ ID NO: 3513597 - DNA, 21 bp, Homo sapiens
atcatgagcctgctggaagcc

SEQ ID NO: 3513598 - DNA, 19 bp, Homo sapiens
atcatgctggaacctgcaa

SEQ ID NO: 3513599 - DNA, 22 bp, Homo sapiens
atcatgctggaacctgcaaaaa

SEQ ID NO: 3513600 - DNA, 17 bp, Homo sapiens
atcatgtactttttagt

SEQ ID NO: 3513601 - DNA, 18 bp, Homo sapiens
atcatgtactttttagta

SEQ ID NO: 3513602 - DNA, 14 bp, Homo sapiens
atcatgtctggcta

SEQ ID NO: 3513603 - DNA, 19 bp, Homo sapiens
atcatgttgatcatgtact

SEQ ID NO: 3513604 - DNA, 19 bp, Homo sapiens
atcatgttttggtgaaaat

SEQ ID NO: 3513605 - DNA, 19 bp, Homo sapiens
atcattagggggaactcta

SEQ ID NO: 3513606 - DNA, 15 bp, Homo sapiens
atcattccctctcat

SEQ ID NO: 3513607 - DNA, 16 bp, Homo sapiens
atcattctctgtctca

SEQ ID NO: 3513608 - DNA, 21 bp, Homo sapiens
atcattctctgtctcatccat

SEQ ID NO: 3513609 - DNA, 24 bp, Homo sapiens
atcattctctgtctcatccatcat

SEQ ID NO: 3513610 - DNA, 22 bp, Homo sapiens
atcattgctgtctgcagccttg

SEQ ID NO: 3513611 - DNA, 13 bp, Homo sapiens
atcatttaataat

SEQ ID NO: 3513612 - DNA, 19 bp, Homo sapiens
atcatttaataatatactt

SEQ ID NO: 3513613 - DNA, 12 bp, Homo sapiens
atcatttctagg

SEQ ID NO: 3513614 - DNA, 11 bp, Homo sapiens
atcattttcat

SEQ ID NO: 3513615 - DNA, 18 bp, Homo sapiens
atccaaaagaagccccca

SEQ ID NO: 3513616 - DNA, 21 bp, Homo sapiens
atccaagctggtcccactcag

SEQ ID NO: 3513617 - DNA, 19 bp, Homo sapiens
atccaatattttctttaat

SEQ ID NO: 3513618 - DNA, 22 bp, Homo sapiens
atccaatattttctttaatgct

SEQ ID NO: 3513619 - DNA, 13 bp, Homo sapiens
atccacccacctc

SEQ ID NO: 3513620 - DNA, 21 bp, Homo sapiens
atccacctgtctcagcctccc

SEQ ID NO: 3513621 - DNA, 14 bp, Homo sapiens
atccacttctttca

SEQ ID NO: 3513622 - DNA, 22 bp, Homo sapiens
atccacttctttcagcagactg

SEQ ID NO: 3513623 - DNA, 15 bp, Homo sapiens
atccagacccggctg

SEQ ID NO: 3513624 - DNA, 19 bp, Homo sapiens
atccagacccggctgcgtg

SEQ ID NO: 3513625 - DNA, 17 bp, Homo sapiens
atccagagattcatttt

SEQ ID NO: 3513626 - DNA, 19 bp, Homo sapiens
atccagagattcattttct

SEQ ID NO: 3513627 - DNA, 22 bp, Homo sapiens
atccagagattcattttctaga

SEQ ID NO: 3513628 - DNA, 14 bp, Homo sapiens
atccagatggtggg

SEQ ID NO: 3513629 - DNA, 20 bp, Homo sapiens
atccagatggtgggatgtgg

SEQ ID NO: 3513630 - DNA, 18 bp, Homo sapiens
atccagcagtctctgcct

SEQ ID NO: 3513631 - DNA, 12 bp, Homo sapiens
atccagcctggg

SEQ ID NO: 3513632 - DNA, 15 bp, Homo sapiens
atccaggcagatcca

SEQ ID NO: 3513633 - DNA, 16 bp, Homo sapiens
atccaggcagatccag

SEQ ID NO: 3513634 - DNA, 22 bp, Homo sapiens
atccaggcagatccaggactat

SEQ ID NO: 3513635 - DNA, 12 bp, Homo sapiens
atccagggacag

SEQ ID NO: 3513636 - DNA, 19 bp, Homo sapiens
atccagggacagaggcccc

SEQ ID NO: 3513637 - DNA, 21 bp, Homo sapiens
atccagggacagaggccccag

SEQ ID NO: 3513638 - DNA, 14 bp, Homo sapiens
atccaggtaatcca

SEQ ID NO: 3513639 - DNA, 15 bp, Homo sapiens
atccaggttcagctt

SEQ ID NO: 3513640 - DNA, 17 bp, Homo sapiens
atccaggttcagcttgt

SEQ ID NO: 3513641 - DNA, 14 bp, Homo sapiens
atccataatgatgg

SEQ ID NO: 3513642 - DNA, 15 bp, Homo sapiens
atccataatgatgga

SEQ ID NO: 3513643 - DNA, 17 bp, Homo sapiens
atccatccagcttgcca

SEQ ID NO: 3513644 - DNA, 15 bp, Homo sapiens
atcccaactgtcttt

SEQ ID NO: 3513645 - DNA, 17 bp, Homo sapiens
atcccaactgtcttttt

SEQ ID NO: 3513646 - DNA, 19 bp, Homo sapiens
atcccagcactttgggagg

SEQ ID NO: 3513647 - DNA, 20 bp, Homo sapiens
atcccagctactcgggaggc

SEQ ID NO: 3513648 - DNA, 16 bp, Homo sapiens
atcccatgagcctcag

SEQ ID NO: 3513649 - DNA, 17 bp, Homo sapiens
atcccatgagcctcagc

SEQ ID NO: 3513650 - DNA, 18 bp, Homo sapiens
atcccatgagcctcagca

SEQ ID NO: 3513651 - DNA, 19 bp, Homo sapiens
atcccatgagcctcagcat

SEQ ID NO: 3513652 - DNA, 20 bp, Homo sapiens
atccccccatcttgcttccc

SEQ ID NO: 3513653 - DNA, 13 bp, Homo sapiens
atccccttaccct

SEQ ID NO: 3513654 - DNA, 19 bp, Homo sapiens
atcccgagcacctccacat

SEQ ID NO: 3513655 - DNA, 19 bp, Homo sapiens
atcccgggcctcagtgccc

SEQ ID NO: 3513656 - DNA, 22 bp, Homo sapiens
atcccgggcctcagtgccccat

SEQ ID NO: 3513657 - DNA, 16 bp, Homo sapiens
atccctaatgctgcag

SEQ ID NO: 3513658 - DNA, 17 bp, Homo sapiens
atccctaccgacccagg

SEQ ID NO: 3513659 - DNA, 21 bp, Homo sapiens
atccctcccccccatgcactg

SEQ ID NO: 3513660 - DNA, 22 bp, Homo sapiens
atccctcccccccatgcactgt

SEQ ID NO: 3513661 - DNA, 16 bp, Homo sapiens
atccctgtctttccta

SEQ ID NO: 3513662 - DNA, 14 bp, Homo sapiens
atcccttgaccagg

SEQ ID NO: 3513663 - DNA, 14 bp, Homo sapiens
atccctttattacc

SEQ ID NO: 3513664 - DNA, 19 bp, Homo sapiens
atccgaacctcctctgtga

SEQ ID NO: 3513665 - DNA, 14 bp, Homo sapiens
atccgaatctcttt

SEQ ID NO: 3513666 - DNA, 17 bp, Homo sapiens
atccgactgctttggac

SEQ ID NO: 3513667 - DNA, 22 bp, Homo sapiens
atccgtttgaccaatttgcacc

SEQ ID NO: 3513668 - DNA, 15 bp, Homo sapiens
atcctaccttgcttt

SEQ ID NO: 3513669 - DNA, 17 bp, Homo sapiens
atcctactaataaacca

SEQ ID NO: 3513670 - DNA, 21 bp, Homo sapiens
atcctagccctcattttaatt

SEQ ID NO: 3513671 - DNA, 16 bp, Homo sapiens
atcctaggcatttgct

SEQ ID NO: 3513672 - DNA, 16 bp, Homo sapiens
atcctcaaacactgca

SEQ ID NO: 3513673 - DNA, 12 bp, Homo sapiens
atcctcaatcca

SEQ ID NO: 3513674 - DNA, 12 bp, Homo sapiens
atcctcatctct

SEQ ID NO: 3513675 - DNA, 16 bp, Homo sapiens
atcctcatctctcttg

SEQ ID NO: 3513676 - DNA, 23 bp, Homo sapiens
atcctcatttggggtagctagag

SEQ ID NO: 3513677 - DNA, 13 bp, Homo sapiens
atcctccagcagg

SEQ ID NO: 3513678 - DNA, 15 bp, Homo sapiens
atcctcccacctcag

SEQ ID NO: 3513679 - DNA, 20 bp, Homo sapiens
atcctcccacctcagcctcc

SEQ ID NO: 3513680 - DNA, 14 bp, Homo sapiens
atcctcctcccacc

SEQ ID NO: 3513681 - DNA, 11 bp, Homo sapiens
atcctcctgca

SEQ ID NO: 3513682 - DNA, 14 bp, Homo sapiens
atcctcctgttctg

SEQ ID NO: 3513683 - DNA, 19 bp, Homo sapiens
atcctcttctcaaagctgg

SEQ ID NO: 3513684 - DNA, 20 bp, Homo sapiens
atcctcttctcaaagctggg

SEQ ID NO: 3513685 - DNA, 21 bp, Homo sapiens
atcctctttagagttagactg

SEQ ID NO: 3513686 - DNA, 14 bp, Homo sapiens
atcctggaggccca

SEQ ID NO: 3513687 - DNA, 19 bp, Homo sapiens
atcctggaggcccagttca

SEQ ID NO: 3513688 - DNA, 20 bp, Homo sapiens
atcctggcacccggcccctg

SEQ ID NO: 3513689 - DNA, 21 bp, Homo sapiens
atcctggcacccggcccctgc

SEQ ID NO: 3513690 - DNA, 12 bp, Homo sapiens
atcctgggctgg

SEQ ID NO: 3513691 - DNA, 20 bp, Homo sapiens
atcctggggcattaaaaaaa

SEQ ID NO: 3513692 - DNA, 22 bp, Homo sapiens
atcctgggtggtctgcaggcag

SEQ ID NO: 3513693 - DNA, 23 bp, Homo sapiens
atcctgggtggtctgcaggcagg

SEQ ID NO: 3513694 - DNA, 14 bp, Homo sapiens
atcctggtttcata

SEQ ID NO: 3513695 - DNA, 21 bp, Homo sapiens
atcctgtgaggagccccatct

SEQ ID NO: 3513696 - DNA, 14 bp, Homo sapiens
atcctgtgtttcta

SEQ ID NO: 3513697 - DNA, 18 bp, Homo sapiens
atccttcccaagtaagag

SEQ ID NO: 3513698 - DNA, 19 bp, Homo sapiens
atccttccctgtctgccag

SEQ ID NO: 3513699 - DNA, 17 bp, Homo sapiens
atccttccctttggaga

SEQ ID NO: 3513700 - DNA, 17 bp, Homo sapiens
atccttcctcacaccag

SEQ ID NO: 3513701 - DNA, 21 bp, Homo sapiens
atcctttagggttctgcctct

SEQ ID NO: 3513702 - DNA, 22 bp, Homo sapiens
atcctttcctcattaaattacc

SEQ ID NO: 3513703 - DNA, 11 bp, Homo sapiens
atccttttgta

SEQ ID NO: 3513704 - DNA, 13 bp, Homo sapiens
atccttttgtaga

SEQ ID NO: 3513705 - DNA, 21 bp, Homo sapiens
atcgaagggtttttagagaat

SEQ ID NO: 3513706 - DNA, 14 bp, Homo sapiens
atcgagatggagct

SEQ ID NO: 3513707 - DNA, 13 bp, Homo sapiens
atcgatgttatgt

SEQ ID NO: 3513708 - DNA, 18 bp, Homo sapiens
atcgcaccattctgactc

SEQ ID NO: 3513709 - DNA, 14 bp, Homo sapiens
atcgcatttcctaa

SEQ ID NO: 3513710 - DNA, 18 bp, Homo sapiens
atcggagtcagccaggag

SEQ ID NO: 3513711 - DNA, 12 bp, Homo sapiens
atcgtccaggga

SEQ ID NO: 3513712 - DNA, 13 bp, Homo sapiens
atcgtccagggag

SEQ ID NO: 3513713 - DNA, 13 bp, Homo sapiens
atcgtctaaactt

SEQ ID NO: 3513714 - DNA, 12 bp, Homo sapiens
atctaaagttat

SEQ ID NO: 3513715 - DNA, 13 bp, Homo sapiens
atctaaagttata

SEQ ID NO: 3513716 - DNA, 15 bp, Homo sapiens
atctaaagttatatt

SEQ ID NO: 3513717 - DNA, 20 bp, Homo sapiens
atctaagaatacagctttct

SEQ ID NO: 3513718 - DNA, 21 bp, Homo sapiens
atctaagcccatgggacaaat

SEQ ID NO: 3513719 - DNA, 22 bp, Homo sapiens
atctactaaaaatacaaaaatt

SEQ ID NO: 3513720 - DNA, 21 bp, Homo sapiens
atctatagttgatatgtttta

SEQ ID NO: 3513721 - DNA, 13 bp, Homo sapiens
atctatgctggtg

SEQ ID NO: 3513722 - DNA, 16 bp, Homo sapiens
atctatgctggtgaaa

SEQ ID NO: 3513723 - DNA, 19 bp, Homo sapiens
atctatggcagtccagcca

SEQ ID NO: 3513724 - DNA, 23 bp, Homo sapiens
atctattctctccaaaaatgcac

SEQ ID NO: 3513725 - DNA, 22 bp, Homo sapiens
atctattttggattgtatattg

SEQ ID NO: 3513726 - DNA, 22 bp, Homo sapiens
atctcaactttggttcctgtga

SEQ ID NO: 3513727 - DNA, 22 bp, Homo sapiens
atctcaagatgggggcagggct

SEQ ID NO: 3513728 - DNA, 23 bp, Homo sapiens
atctcaagatgggggcagggctg

SEQ ID NO: 3513729 - DNA, 17 bp, Homo sapiens
atctcaattgtgctttg

SEQ ID NO: 3513730 - DNA, 22 bp, Homo sapiens
atctcacttgtgccaacactca

SEQ ID NO: 3513731 - DNA, 14 bp, Homo sapiens
atctcaggccagag

SEQ ID NO: 3513732 - DNA, 18 bp, Homo sapiens
atctcaggccagagccaa

SEQ ID NO: 3513733 - DNA, 21 bp, Homo sapiens
atctcagttgattttctggat

SEQ ID NO: 3513734 - DNA, 17 bp, Homo sapiens
atctcatggaaactggc

SEQ ID NO: 3513735 - DNA, 21 bp, Homo sapiens
atctcatggaaactggccagg

SEQ ID NO: 3513736 - DNA, 19 bp, Homo sapiens
atctcattggacccttcca

SEQ ID NO: 3513737 - DNA, 20 bp, Homo sapiens
atctcattggacccttccat

SEQ ID NO: 3513738 - DNA, 18 bp, Homo sapiens
atctcccacctagcagca

SEQ ID NO: 3513739 - DNA, 20 bp, Homo sapiens
atctcccagataatgtgaaa

SEQ ID NO: 3513740 - DNA, 15 bp, Homo sapiens
atctcccctcagctc

SEQ ID NO: 3513741 - DNA, 21 bp, Homo sapiens
atctccggctcccagcctcag

SEQ ID NO: 3513742 - DNA, 17 bp, Homo sapiens
atctcctagggctatgg

SEQ ID NO: 3513743 - DNA, 20 bp, Homo sapiens
atctcctcgcaagctgggta

SEQ ID NO: 3513744 - DNA, 18 bp, Homo sapiens
atctctaacagctcagga

SEQ ID NO: 3513745 - DNA, 20 bp, Homo sapiens
atctctaacagctcaggatc

SEQ ID NO: 3513746 - DNA, 12 bp, Homo sapiens
atctctcatcct

SEQ ID NO: 3513747 - DNA, 14 bp, Homo sapiens
atctctccctcccc

SEQ ID NO: 3513748 - DNA, 15 bp, Homo sapiens
atctctccctcccct

SEQ ID NO: 3513749 - DNA, 20 bp, Homo sapiens
atctctcttgggccaagcca

SEQ ID NO: 3513750 - DNA, 18 bp, Homo sapiens
atctctgtactttgcttg

SEQ ID NO: 3513751 - DNA, 13 bp, Homo sapiens
atctctgtgcctt

SEQ ID NO: 3513752 - DNA, 13 bp, Homo sapiens
atctcttagctcc

SEQ ID NO: 3513753 - DNA, 16 bp, Homo sapiens
atctcttagctcccct

SEQ ID NO: 3513754 - DNA, 19 bp, Homo sapiens
atctcttagctcccctcca

SEQ ID NO: 3513755 - DNA, 22 bp, Homo sapiens
atctcttagctcccctccaacc

SEQ ID NO: 3513756 - DNA, 19 bp, Homo sapiens
atctcttattttacaataa

SEQ ID NO: 3513757 - DNA, 18 bp, Homo sapiens
atctcttgagcctgggag

SEQ ID NO: 3513758 - DNA, 23 bp, Homo sapiens
atctgaaggggcaaattcttttg

SEQ ID NO: 3513759 - DNA, 21 bp, Homo sapiens
atctgacactaccttatcagg

SEQ ID NO: 3513760 - DNA, 23 bp, Homo sapiens
atctgacatgattccttcctgtt

SEQ ID NO: 3513761 - DNA, 15 bp, Homo sapiens
atctgaccagcagcg

SEQ ID NO: 3513762 - DNA, 20 bp, Homo sapiens
atctgaccagcagcgccttt

SEQ ID NO: 3513763 - DNA, 21 bp, Homo sapiens
atctgacccagtgcccccact

SEQ ID NO: 3513764 - DNA, 21 bp, Homo sapiens
atctgagaaactctacatgta

SEQ ID NO: 3513765 - DNA, 19 bp, Homo sapiens
atctgaggcatcctctgac

SEQ ID NO: 3513766 - DNA, 17 bp, Homo sapiens
atctgatggcttctcca

SEQ ID NO: 3513767 - DNA, 22 bp, Homo sapiens
atctgattgttgtcaggccata

SEQ ID NO: 3513768 - DNA, 18 bp, Homo sapiens
atctgcacccccctgggc

SEQ ID NO: 3513769 - DNA, 21 bp, Homo sapiens
atctgcacccccctgggctga

SEQ ID NO: 3513770 - DNA, 11 bp, Homo sapiens
atctgcagaag

SEQ ID NO: 3513771 - DNA, 14 bp, Homo sapiens
atctgcagaaggaa

SEQ ID NO: 3513772 - DNA, 22 bp, Homo sapiens
atctgcagaaggaaaaatgtgt

SEQ ID NO: 3513773 - DNA, 15 bp, Homo sapiens
atctgcatgtctact

SEQ ID NO: 3513774 - DNA, 16 bp, Homo sapiens
atctgcattgcccagt

SEQ ID NO: 3513775 - DNA, 21 bp, Homo sapiens
atctgcattgcccagtctttc

SEQ ID NO: 3513776 - DNA, 22 bp, Homo sapiens
atctgcattgcccagtctttca

SEQ ID NO: 3513777 - DNA, 19 bp, Homo sapiens
atctgcattttcaccccac

SEQ ID NO: 3513778 - DNA, 22 bp, Homo sapiens
atctgcattttcaccccaccct

SEQ ID NO: 3513779 - DNA, 16 bp, Homo sapiens
atctgcctgacaggct

SEQ ID NO: 3513780 - DNA, 12 bp, Homo sapiens
atctgcctgggt

SEQ ID NO: 3513781 - DNA, 15 bp, Homo sapiens
atctgcgatcatcgt

SEQ ID NO: 3513782 - DNA, 13 bp, Homo sapiens
atctgctctcctt

SEQ ID NO: 3513783 - DNA, 12 bp, Homo sapiens
atctgctgcccc

SEQ ID NO: 3513784 - DNA, 15 bp, Homo sapiens
atctggaacccagac

SEQ ID NO: 3513785 - DNA, 17 bp, Homo sapiens
atctggaacccagactc

SEQ ID NO: 3513786 - DNA, 19 bp, Homo sapiens
atctggaacccagactcag

SEQ ID NO: 3513787 - DNA, 23 bp, Homo sapiens
atctggaacccagactcagacat

SEQ ID NO: 3513788 - DNA, 11 bp, Homo sapiens
atctggaacct

SEQ ID NO: 3513789 - DNA, 14 bp, Homo sapiens
atctggaagaaaaa

SEQ ID NO: 3513790 - DNA, 15 bp, Homo sapiens
atctggaatctgagg

SEQ ID NO: 3513791 - DNA, 20 bp, Homo sapiens
atctggagaccagggagcct

SEQ ID NO: 3513792 - DNA, 20 bp, Homo sapiens
atctggctgtgacagcctct

SEQ ID NO: 3513793 - DNA, 20 bp, Homo sapiens
atctggcttctggccaggaa

SEQ ID NO: 3513794 - DNA, 14 bp, Homo sapiens
atctggtcatttgg

SEQ ID NO: 3513795 - DNA, 23 bp, Homo sapiens
atctgtacaaaggggaaagaaca

SEQ ID NO: 3513796 - DNA, 23 bp, Homo sapiens
atctgtagggaattcttctgtta

SEQ ID NO: 3513797 - DNA, 21 bp, Homo sapiens
atctgtcaagagtagttatat

SEQ ID NO: 3513798 - DNA, 12 bp, Homo sapiens
atctgtcatttg

SEQ ID NO: 3513799 - DNA, 15 bp, Homo sapiens
atctgtcctcagcct

SEQ ID NO: 3513800 - DNA, 17 bp, Homo sapiens
atctgtcctcagccttg

SEQ ID NO: 3513801 - DNA, 14 bp, Homo sapiens
atctgtctggtggc

SEQ ID NO: 3513802 - DNA, 19 bp, Homo sapiens
atctgtcttgccagccaga

SEQ ID NO: 3513803 - DNA, 22 bp, Homo sapiens
atctgtgagtgaaagttgccat

SEQ ID NO: 3513804 - DNA, 16 bp, Homo sapiens
atctgtgcactgccca

SEQ ID NO: 3513805 - DNA, 14 bp, Homo sapiens
atctgtttcccagc

SEQ ID NO: 3513806 - DNA, 21 bp, Homo sapiens
atcttacaacaggcttatgaa

SEQ ID NO: 3513807 - DNA, 22 bp, Homo sapiens
atcttacaacaggcttatgaat

SEQ ID NO: 3513808 - DNA, 13 bp, Homo sapiens
atcttacagctgg

SEQ ID NO: 3513809 - DNA, 14 bp, Homo sapiens
atcttactgaaggt

SEQ ID NO: 3513810 - DNA, 15 bp, Homo sapiens
atcttactgaaggta

SEQ ID NO: 3513811 - DNA, 14 bp, Homo sapiens
atcttataatttaa

SEQ ID NO: 3513812 - DNA, 16 bp, Homo sapiens
atcttataatttaaaa

SEQ ID NO: 3513813 - DNA, 17 bp, Homo sapiens
atcttatactgtacaat

SEQ ID NO: 3513814 - DNA, 18 bp, Homo sapiens
tgtacatgaaatttttgt

SEQ ID NO: 3513815 - DNA, 19 bp, Homo sapiens
tgtacatgaaatttttgta

SEQ ID NO: 3513816 - DNA, 21 bp, Homo sapiens
tgtacatgttcgggtgtgggt

SEQ ID NO: 3513817 - DNA, 21 bp, Homo sapiens
tgtacatttccaaattcacaa

SEQ ID NO: 3513818 - DNA, 22 bp, Homo sapiens
tgtaccagtgaatttttgcaat

SEQ ID NO: 3513819 - DNA, 12 bp, Homo sapiens
tgtacccttaag

SEQ ID NO: 3513820 - DNA, 14 bp, Homo sapiens
tgtacctaacttga

SEQ ID NO: 3513821 - DNA, 19 bp, Homo sapiens
tgtacctatggctgcctgc

SEQ ID NO: 3513822 - DNA, 15 bp, Homo sapiens
tgtacctcctctcag

SEQ ID NO: 3513823 - DNA, 18 bp, Homo sapiens
tgtacctgcccccaatcc

SEQ ID NO: 3513824 - DNA, 15 bp, Homo sapiens
tgtactaaagccaaa

SEQ ID NO: 3513825 - DNA, 20 bp, Homo sapiens
tgtactaaagccaaacatat

SEQ ID NO: 3513826 - DNA, 18 bp, Homo sapiens
tgtactagtcctctagaa

SEQ ID NO: 3513827 - DNA, 19 bp, Homo sapiens
tgtactagtcctctagaaa

SEQ ID NO: 3513828 - DNA, 18 bp, Homo sapiens
tgtactattgcagacctg

SEQ ID NO: 3513829 - DNA, 24 bp, Homo sapiens
tgtactgtttaatgttctgtgata

SEQ ID NO: 3513830 - DNA, 18 bp, Homo sapiens
tgtacttcccgggccagg

SEQ ID NO: 3513831 - DNA, 12 bp, Homo sapiens
tgtacttttcat

SEQ ID NO: 3513832 - DNA, 13 bp, Homo sapiens
tgtacttttcatt

SEQ ID NO: 3513833 - DNA, 22 bp, Homo sapiens
tgtacttttcattctcttttaa

SEQ ID NO: 3513834 - DNA, 20 bp, Homo sapiens
tgtactttttagtaatttct

SEQ ID NO: 3513835 - DNA, 21 bp, Homo sapiens
tgtactttttagtaatttctt

SEQ ID NO: 3513836 - DNA, 15 bp, Homo sapiens
tgtagaatattcaga

SEQ ID NO: 3513837 - DNA, 23 bp, Homo sapiens
tgtagagaacacgcgtatttaca

SEQ ID NO: 3513838 - DNA, 12 bp, Homo sapiens
tgtagagccagg

SEQ ID NO: 3513839 - DNA, 16 bp, Homo sapiens
tgtagatggaaaaact

SEQ ID NO: 3513840 - DNA, 17 bp, Homo sapiens
tgtagcaaccatttgta

SEQ ID NO: 3513841 - DNA, 16 bp, Homo sapiens
tgtagcccactctgct

SEQ ID NO: 3513842 - DNA, 17 bp, Homo sapiens
tgtagcccactctgctc

SEQ ID NO: 3513843 - DNA, 22 bp, Homo sapiens
tgtagcccactctgctcgcctt

SEQ ID NO: 3513844 - DNA, 23 bp, Homo sapiens
tgtagcccatccttccctttgga

SEQ ID NO: 3513845 - DNA, 13 bp, Homo sapiens
tgtagcttttcac

SEQ ID NO: 3513846 - DNA, 15 bp, Homo sapiens
tgtagcttttcacct

SEQ ID NO: 3513847 - DNA, 21 bp, Homo sapiens
tgtaggaaccgtggtatgtct

SEQ ID NO: 3513848 - DNA, 13 bp, Homo sapiens
tgtaggagaaact

SEQ ID NO: 3513849 - DNA, 22 bp, Homo sapiens
tgtaggagctgccttggctcag

SEQ ID NO: 3513850 - DNA, 17 bp, Homo sapiens
tgtaggataattagcag

SEQ ID NO: 3513851 - DNA, 14 bp, Homo sapiens
tgtaggatctactt

SEQ ID NO: 3513852 - DNA, 22 bp, Homo sapiens
tgtagggagggcggcaggggcc

SEQ ID NO: 3513853 - DNA, 23 bp, Homo sapiens
tgtaggtgaacagtcacgcctga

SEQ ID NO: 3513854 - DNA, 16 bp, Homo sapiens
tgtagtaattgacatg

SEQ ID NO: 3513855 - DNA, 17 bp, Homo sapiens
tgtagtcctcataaaaa

SEQ ID NO: 3513856 - DNA, 21 bp, Homo sapiens
tgtagtgcctctttcatccac

SEQ ID NO: 3513857 - DNA, 13 bp, Homo sapiens
tgtagtggtttta

SEQ ID NO: 3513858 - DNA, 17 bp, Homo sapiens
tgtagtggttttaggat

SEQ ID NO: 3513859 - DNA, 20 bp, Homo sapiens
tgtagttgacaattctgcat

SEQ ID NO: 3513860 - DNA, 13 bp, Homo sapiens
tgtataaaatgta

SEQ ID NO: 3513861 - DNA, 18 bp, Homo sapiens
tgtataaagtgattgact

SEQ ID NO: 3513862 - DNA, 16 bp, Homo sapiens
tgtataagtggaggca

SEQ ID NO: 3513863 - DNA, 23 bp, Homo sapiens
tgtataagtggaggcactttagg

SEQ ID NO: 3513864 - DNA, 13 bp, Homo sapiens
tgtataagttatt

SEQ ID NO: 3513865 - DNA, 21 bp, Homo sapiens
tgtatagtactggcatggtac

SEQ ID NO: 3513866 - DNA, 15 bp, Homo sapiens
tgtatatacaataac

SEQ ID NO: 3513867 - DNA, 15 bp, Homo sapiens
tgtatatacatatat

SEQ ID NO: 3513868 - DNA, 17 bp, Homo sapiens
tgtatatatatgtatgt

SEQ ID NO: 3513869 - DNA, 20 bp, Homo sapiens
tgtatattgtgtttgtgtat

SEQ ID NO: 3513870 - DNA, 21 bp, Homo sapiens
tgtatatttgtgatagcactt

SEQ ID NO: 3513871 - DNA, 23 bp, Homo sapiens
tgtatatttgtgatagcactttc

SEQ ID NO: 3513872 - DNA, 23 bp, Homo sapiens
tgtatcagtcagtgctggagaaa

SEQ ID NO: 3513873 - DNA, 16 bp, Homo sapiens
tgtatcataattacca

SEQ ID NO: 3513874 - DNA, 15 bp, Homo sapiens
tgtatccaggcctgg

SEQ ID NO: 3513875 - DNA, 15 bp, Homo sapiens
tgtatcccatgagcc

SEQ ID NO: 3513876 - DNA, 16 bp, Homo sapiens
tgtatcccatgagcct

SEQ ID NO: 3513877 - DNA, 20 bp, Homo sapiens
tgtatcgggaagatttctaa

SEQ ID NO: 3513878 - DNA, 17 bp, Homo sapiens
tgtatctgcaggcagac

SEQ ID NO: 3513879 - DNA, 16 bp, Homo sapiens
tgtatcttgatgttta

SEQ ID NO: 3513880 - DNA, 17 bp, Homo sapiens
tgtatcttgatgtttag

SEQ ID NO: 3513881 - DNA, 16 bp, Homo sapiens
tgtatgactgcacatg

SEQ ID NO: 3513882 - DNA, 19 bp, Homo sapiens
tgtatgggtagcactacta

SEQ ID NO: 3513883 - DNA, 10 bp, Homo sapiens
tgtatgtaaa

SEQ ID NO: 3513884 - DNA, 16 bp, Homo sapiens
tgtatgtgtgtgtgta

SEQ ID NO: 3513885 - DNA, 17 bp, Homo sapiens
tgtatgttttttttctg

SEQ ID NO: 3513886 - DNA, 13 bp, Homo sapiens
tgtattagatgtt

SEQ ID NO: 3513887 - DNA, 17 bp, Homo sapiens
tgtattcatatattgca

SEQ ID NO: 3513888 - DNA, 18 bp, Homo sapiens
tgtatttaacagggaggg

SEQ ID NO: 3513889 - DNA, 20 bp, Homo sapiens
tgtatttacgctttgattca

SEQ ID NO: 3513890 - DNA, 21 bp, Homo sapiens
tgtatttacgctttgattcat

SEQ ID NO: 3513891 - DNA, 23 bp, Homo sapiens
tgtatttacgctttgattcatag

SEQ ID NO: 3513892 - DNA, 13 bp, Homo sapiens
tgtatttattcaa

SEQ ID NO: 3513893 - DNA, 19 bp, Homo sapiens
tgtatttattcaataaagt

SEQ ID NO: 3513894 - DNA, 14 bp, Homo sapiens
tgtatttgcttttt

SEQ ID NO: 3513895 - DNA, 14 bp, Homo sapiens
tgtattttgtattg

SEQ ID NO: 3513896 - DNA, 17 bp, Homo sapiens
tgtatttttttgcaagt

SEQ ID NO: 3513897 - DNA, 21 bp, Homo sapiens
tgtcaaacaaagccagaagct

SEQ ID NO: 3513898 - DNA, 13 bp, Homo sapiens
tgtcaacattgtg

SEQ ID NO: 3513899 - DNA, 14 bp, Homo sapiens
tgtcaacattgtga

SEQ ID NO: 3513900 - DNA, 17 bp, Homo sapiens
tgtcaacatttggaggc

SEQ ID NO: 3513901 - DNA, 17 bp, Homo sapiens
tgtcaagcctgtgcaaa

SEQ ID NO: 3513902 - DNA, 12 bp, Homo sapiens
tgtcacaggcag

SEQ ID NO: 3513903 - DNA, 14 bp, Homo sapiens
tgtcacaggcaggt

SEQ ID NO: 3513904 - DNA, 15 bp, Homo sapiens
tgtcaccaaggaaac

SEQ ID NO: 3513905 - DNA, 17 bp, Homo sapiens
tgtcaccctgcaggact

SEQ ID NO: 3513906 - DNA, 19 bp, Homo sapiens
tgtcaccggatcctgggtg

SEQ ID NO: 3513907 - DNA, 16 bp, Homo sapiens
tgtcacctcttccgac

SEQ ID NO: 3513908 - DNA, 14 bp, Homo sapiens
tgtcacctgtgctt

SEQ ID NO: 3513909 - DNA, 20 bp, Homo sapiens
tgtcacgttttgttttgtgc

SEQ ID NO: 3513910 - DNA, 18 bp, Homo sapiens
tgtcactagcagctgcag

SEQ ID NO: 3513911 - DNA, 13 bp, Homo sapiens
tgtcactgctttt

SEQ ID NO: 3513912 - DNA, 15 bp, Homo sapiens
tgtcagatgcccgag

SEQ ID NO: 3513913 - DNA, 13 bp, Homo sapiens
tgtcagcaaaaag

SEQ ID NO: 3513914 - DNA, 14 bp, Homo sapiens
tgtcagcaaaaagc

SEQ ID NO: 3513915 - DNA, 13 bp, Homo sapiens
tgtcagctgaggc

SEQ ID NO: 3513916 - DNA, 14 bp, Homo sapiens
tgtcagctgaggct

SEQ ID NO: 3513917 - DNA, 22 bp, Homo sapiens
tgtcaggggcggggagggtgac

SEQ ID NO: 3513918 - DNA, 16 bp, Homo sapiens
tgtcaggtggggcagc

SEQ ID NO: 3513919 - DNA, 20 bp, Homo sapiens
tgtcagtaccttcaaactag

SEQ ID NO: 3513920 - DNA, 15 bp, Homo sapiens
tgtcagtcacagcca

SEQ ID NO: 3513921 - DNA, 17 bp, Homo sapiens
tgtcagtcacagccacc

SEQ ID NO: 3513922 - DNA, 18 bp, Homo sapiens
tgtcagtcacagccaccc

SEQ ID NO: 3513923 - DNA, 22 bp, Homo sapiens
tgtcagtcacagccacccctga

SEQ ID NO: 3513924 - DNA, 18 bp, Homo sapiens
tgtcatctgcatgtctac

SEQ ID NO: 3513925 - DNA, 13 bp, Homo sapiens
tgtcattgtattc

SEQ ID NO: 3513926 - DNA, 16 bp, Homo sapiens
tgtcatttgagcaggg

SEQ ID NO: 3513927 - DNA, 20 bp, Homo sapiens
tgtcatttgagcagggctca

SEQ ID NO: 3513928 - DNA, 13 bp, Homo sapiens
tgtcatttgttaa

SEQ ID NO: 3513929 - DNA, 15 bp, Homo sapiens
tgtcattttgcactg

SEQ ID NO: 3513930 - DNA, 16 bp, Homo sapiens
tgtcattttgcactgt

SEQ ID NO: 3513931 - DNA, 15 bp, Homo sapiens
tgtccaaaactgcct

SEQ ID NO: 3513932 - DNA, 14 bp, Homo sapiens
tgctggcccagggc

SEQ ID NO: 3513933 - DNA, 21 bp, Homo sapiens
tgctggcccagggcccagagc

SEQ ID NO: 3513934 - DNA, 22 bp, Homo sapiens
tgctggcccagggcccagagcc

SEQ ID NO: 3513935 - DNA, 23 bp, Homo sapiens
tgctggcccagggcccagagccc

SEQ ID NO: 3513936 - DNA, 14 bp, Homo sapiens
tgctggccctgcct

SEQ ID NO: 3513937 - DNA, 18 bp, Homo sapiens
tgctgggactcagccttc

SEQ ID NO: 3513938 - DNA, 22 bp, Homo sapiens
tgctgggagctccactctgctt

SEQ ID NO: 3513939 - DNA, 23 bp, Homo sapiens
tgctgggagctccactctgcttc

SEQ ID NO: 3513940 - DNA, 20 bp, Homo sapiens
tgctgggatggtgggcttca

SEQ ID NO: 3513941 - DNA, 21 bp, Homo sapiens
tgctgggattacaagcgtgag

SEQ ID NO: 3513942 - DNA, 16 bp, Homo sapiens
tgctgggattacagac

SEQ ID NO: 3513943 - DNA, 20 bp, Homo sapiens
tgctgggattacaggtgtga

SEQ ID NO: 3513944 - DNA, 15 bp, Homo sapiens
tgctgtaagatgtct

SEQ ID NO: 3513945 - DNA, 21 bp, Homo sapiens
tgctgtacatctattttggat

SEQ ID NO: 3513946 - DNA, 16 bp, Homo sapiens
tgctgtataaaatcag

SEQ ID NO: 3513947 - DNA, 18 bp, Homo sapiens
tgctgtataaaatcagcc

SEQ ID NO: 3513948 - DNA, 16 bp, Homo sapiens
tgctgtataagttatt

SEQ ID NO: 3513949 - DNA, 22 bp, Homo sapiens
tgctgtatgctgatcatcgcca

SEQ ID NO: 3513950 - DNA, 17 bp, Homo sapiens
tgctgtccagtgcctac

SEQ ID NO: 3513951 - DNA, 13 bp, Homo sapiens
tgctgtctctctg

SEQ ID NO: 3513952 - DNA, 14 bp, Homo sapiens
tgctgtctctctgg

SEQ ID NO: 3513953 - DNA, 12 bp, Homo sapiens
tgctgtctgcag

SEQ ID NO: 3513954 - DNA, 17 bp, Homo sapiens
tgctgtctgcagccttg

SEQ ID NO: 3513955 - DNA, 22 bp, Homo sapiens
tgctgtgaaccctggggcctga

SEQ ID NO: 3513956 - DNA, 16 bp, Homo sapiens
tgctgtggtgtgtccc

SEQ ID NO: 3513957 - DNA, 23 bp, Homo sapiens
tgctgtggtgtgtccccctctgt

SEQ ID NO: 3513958 - DNA, 21 bp, Homo sapiens
tgctgttgacatatttaatgt

SEQ ID NO: 3513959 - DNA, 18 bp, Homo sapiens
tgctgttgtccaactatt

SEQ ID NO: 3513960 - DNA, 13 bp, Homo sapiens
tgctgtttcacaa

SEQ ID NO: 3513961 - DNA, 14 bp, Homo sapiens
tgcttaaaaatgta

SEQ ID NO: 3513962 - DNA, 12 bp, Homo sapiens
tgcttacatctg

SEQ ID NO: 3513963 - DNA, 19 bp, Homo sapiens
tgcttagaatccaaacttg

SEQ ID NO: 3513964 - DNA, 23 bp, Homo sapiens
tgcttagagggatttctttgctg

SEQ ID NO: 3513965 - DNA, 18 bp, Homo sapiens
tgcttataggtggcctct

SEQ ID NO: 3513966 - DNA, 14 bp, Homo sapiens
tgcttatggtacca

SEQ ID NO: 3513967 - DNA, 12 bp, Homo sapiens
tgcttatgtgta

SEQ ID NO: 3513968 - DNA, 23 bp, Homo sapiens
tgcttatttgacaacgtttcagc

SEQ ID NO: 3513969 - DNA, 13 bp, Homo sapiens
tgcttcaatagtt

SEQ ID NO: 3513970 - DNA, 22 bp, Homo sapiens
tgcttcaatagttcaaggaact

SEQ ID NO: 3513971 - DNA, 17 bp, Homo sapiens
tgcttcatcattccctc

SEQ ID NO: 3513972 - DNA, 23 bp, Homo sapiens
tgcttcatcattccctctcatct

SEQ ID NO: 3513973 - DNA, 13 bp, Homo sapiens
tgcttcatttttg

SEQ ID NO: 3513974 - DNA, 15 bp, Homo sapiens
tgcttccaggctggg

SEQ ID NO: 3513975 - DNA, 13 bp, Homo sapiens
tgcttcgggccct

SEQ ID NO: 3513976 - DNA, 14 bp, Homo sapiens
tgcttctagagctt

SEQ ID NO: 3513977 - DNA, 12 bp, Homo sapiens
tgcttctctgac

SEQ ID NO: 3513978 - DNA, 22 bp, Homo sapiens
tgcttctctgacttctgcctgg

SEQ ID NO: 3513979 - DNA, 15 bp, Homo sapiens
tgcttcttactgata

SEQ ID NO: 3513980 - DNA, 17 bp, Homo sapiens
tgcttcttactgataat

SEQ ID NO: 3513981 - DNA, 23 bp, Homo sapiens
tgcttcttctcctatgtgtaagg

SEQ ID NO: 3513982 - DNA, 19 bp, Homo sapiens
tgcttgaaggccctgctga

SEQ ID NO: 3513983 - DNA, 13 bp, Homo sapiens
tgcttgaggaaaa

SEQ ID NO: 3513984 - DNA, 14 bp, Homo sapiens
tgcttgagtcaggt

SEQ ID NO: 3513985 - DNA, 20 bp, Homo sapiens
tgcttgagtcaggtttgagt

SEQ ID NO: 3513986 - DNA, 13 bp, Homo sapiens
tgcttgatagaaa

SEQ ID NO: 3513987 - DNA, 19 bp, Homo sapiens
tgcttgatgggattctgga

SEQ ID NO: 3513988 - DNA, 17 bp, Homo sapiens
tgcttgccacagagcgg

SEQ ID NO: 3513989 - DNA, 21 bp, Homo sapiens
tgcttgggtctctctccattt

SEQ ID NO: 3513990 - DNA, 13 bp, Homo sapiens
tgcttggtctgtt

SEQ ID NO: 3513991 - DNA, 15 bp, Homo sapiens
tgcttggtctgtttg

SEQ ID NO: 3513992 - DNA, 13 bp, Homo sapiens
tgctttatgctga

SEQ ID NO: 3513993 - DNA, 13 bp, Homo sapiens
tgctttccctctt

SEQ ID NO: 3513994 - DNA, 20 bp, Homo sapiens
tgctttccgtggcactgcat

SEQ ID NO: 3513995 - DNA, 14 bp, Homo sapiens
tgctttcctgcctc

SEQ ID NO: 3513996 - DNA, 18 bp, Homo sapiens
tgctttcgaactgctagt

SEQ ID NO: 3513997 - DNA, 19 bp, Homo sapiens
tgctttctgctcagcttct

SEQ ID NO: 3513998 - DNA, 20 bp, Homo sapiens
tgctttctgctcagcttctc

SEQ ID NO: 3513999 - DNA, 20 bp, Homo sapiens
tgctttctttagaattttta

SEQ ID NO: 3514000 - DNA, 19 bp, Homo sapiens
tgctttgctttctgctcag

SEQ ID NO: 3514001 - DNA, 21 bp, Homo sapiens
tgctttggacctaaatggcct

SEQ ID NO: 3514002 - DNA, 23 bp, Homo sapiens
tgctttggacctaaatggcctca

SEQ ID NO: 3514003 - DNA, 15 bp, Homo sapiens
tgctttgggaagccg

SEQ ID NO: 3514004 - DNA, 17 bp, Homo sapiens
tgctttgtatcagtcag

SEQ ID NO: 3514005 - DNA, 18 bp, Homo sapiens
tgcttttggtctgtgtga

SEQ ID NO: 3514006 - DNA, 20 bp, Homo sapiens
tgcttttgtctatgggactc

SEQ ID NO: 3514007 - DNA, 23 bp, Homo sapiens
tgcttttgttccaatgtcaatgt

SEQ ID NO: 3514008 - DNA, 20 bp, Homo sapiens
tgctttttgagtttcatgtt

SEQ ID NO: 3514009 - DNA, 19 bp, Homo sapiens
tgctttttgcgtacacaga

SEQ ID NO: 3514010 - DNA, 16 bp, Homo sapiens
tggaaaaaaaaaagac

SEQ ID NO: 3514011 - DNA, 17 bp, Homo sapiens
tggaaaaatagcctgcc

SEQ ID NO: 3514012 - DNA, 15 bp, Homo sapiens
tggaaaacatttcaa

SEQ ID NO: 3514013 - DNA, 21 bp, Homo sapiens
tggaaaacatttcaagtttac

SEQ ID NO: 3514014 - DNA, 15 bp, Homo sapiens
tggaaaagtttgaaa

SEQ ID NO: 3514015 - DNA, 19 bp, Homo sapiens
tggaaagacagcttctcat

SEQ ID NO: 3514016 - DNA, 18 bp, Homo sapiens
tggaaagataactaggaa

SEQ ID NO: 3514017 - DNA, 20 bp, Homo sapiens
tggaacactactcttacatg

SEQ ID NO: 3514018 - DNA, 19 bp, Homo sapiens
tggaacagattcacactgt

SEQ ID NO: 3514019 - DNA, 23 bp, Homo sapiens
tggaacatcatcaaggcactgcc

SEQ ID NO: 3514020 - DNA, 13 bp, Homo sapiens
tggaaccaggctt

SEQ ID NO: 3514021 - DNA, 12 bp, Homo sapiens
tggaacccagac

SEQ ID NO: 3514022 - DNA, 15 bp, Homo sapiens
tggaacccagactca

SEQ ID NO: 3514023 - DNA, 16 bp, Homo sapiens
tggaaccgcaggaagc

SEQ ID NO: 3514024 - DNA, 17 bp, Homo sapiens
tggaaccgcaggaagct

SEQ ID NO: 3514025 - DNA, 18 bp, Homo sapiens
tggaacctcagcctggcc

SEQ ID NO: 3514026 - DNA, 16 bp, Homo sapiens
tggaacctgcaaaaaa

SEQ ID NO: 3514027 - DNA, 19 bp, Homo sapiens
tggaacctgcaaaaaatac

SEQ ID NO: 3514028 - DNA, 20 bp, Homo sapiens
tggaactatgcagtgtgctc

SEQ ID NO: 3514029 - DNA, 13 bp, Homo sapiens
tggaagacagaga

SEQ ID NO: 3514030 - DNA, 17 bp, Homo sapiens
tggaagagcccagtctg

SEQ ID NO: 3514031 - DNA, 15 bp, Homo sapiens
tggaagatcctgtga

SEQ ID NO: 3514032 - DNA, 17 bp, Homo sapiens
tggaagatcctgtgagg

SEQ ID NO: 3514033 - DNA, 14 bp, Homo sapiens
tggaagcttgttga

SEQ ID NO: 3514034 - DNA, 13 bp, Homo sapiens
tggaaggtgggga

SEQ ID NO: 3514035 - DNA, 21 bp, Homo sapiens
tggaagtgttccctgagaaac

SEQ ID NO: 3514036 - DNA, 18 bp, Homo sapiens
tggaagttgcatggcatc

SEQ ID NO: 3514037 - DNA, 15 bp, Homo sapiens
tggaatctgaggcat

SEQ ID NO: 3514038 - DNA, 22 bp, Homo sapiens
tggaatctgaggcatcctctga

SEQ ID NO: 3514039 - DNA, 20 bp, Homo sapiens
tggaatgcagaggtctccaa

SEQ ID NO: 3514040 - DNA, 21 bp, Homo sapiens
tgggtgcatatgtacagaaga

SEQ ID NO: 3514041 - DNA, 13 bp, Homo sapiens
tgggtgctcccta

SEQ ID NO: 3514042 - DNA, 14 bp, Homo sapiens
tgggtggatgcctg

SEQ ID NO: 3514043 - DNA, 17 bp, Homo sapiens
tgggtggcaccagcagc

SEQ ID NO: 3514044 - DNA, 12 bp, Homo sapiens
tgggtgtcctgc

SEQ ID NO: 3514045 - DNA, 13 bp, Homo sapiens
tgggtgtcctgcc

SEQ ID NO: 3514046 - DNA, 15 bp, Homo sapiens
tgggtgtcctgcctg

SEQ ID NO: 3514047 - DNA, 17 bp, Homo sapiens
tgggtgtcctgcctgtc

SEQ ID NO: 3514048 - DNA, 19 bp, Homo sapiens
tgggtgtcctgcctgtctg

SEQ ID NO: 3514049 - DNA, 21 bp, Homo sapiens
tgggttcatcctattctttcg

SEQ ID NO: 3514050 - DNA, 21 bp, Homo sapiens
tgggttctgcctgccagctgc

SEQ ID NO: 3514051 - DNA, 22 bp, Homo sapiens
tgggttctgcctgccagctgca

SEQ ID NO: 3514052 - DNA, 18 bp, Homo sapiens
tgggtttgaagctgctgt

SEQ ID NO: 3514053 - DNA, 19 bp, Homo sapiens
tgggttttgtattctctga

SEQ ID NO: 3514054 - DNA, 19 bp, Homo sapiens
tggtacaaaaataaattta

SEQ ID NO: 3514055 - DNA, 21 bp, Homo sapiens
tggtacaaaaataaatttata

SEQ ID NO: 3514056 - DNA, 15 bp, Homo sapiens
tggtacctatttgac

SEQ ID NO: 3514057 - DNA, 16 bp, Homo sapiens
tggtaggaccaagcat

SEQ ID NO: 3514058 - DNA, 22 bp, Homo sapiens
tggtaggaccaagcatcttggg

SEQ ID NO: 3514059 - DNA, 19 bp, Homo sapiens
tggtagggggaaaatgtgt

SEQ ID NO: 3514060 - DNA, 14 bp, Homo sapiens
tggtaggtactttt

SEQ ID NO: 3514061 - DNA, 20 bp, Homo sapiens
tggtaggtactttttgtgaa

SEQ ID NO: 3514062 - DNA, 15 bp, Homo sapiens
tggtatgatgctgcc

SEQ ID NO: 3514063 - DNA, 16 bp, Homo sapiens
tggtatgatgctgccg

SEQ ID NO: 3514064 - DNA, 12 bp, Homo sapiens
tggtattgtatt

SEQ ID NO: 3514065 - DNA, 13 bp, Homo sapiens
tggtattgtattt

SEQ ID NO: 3514066 - DNA, 14 bp, Homo sapiens
tggtattgtattta

SEQ ID NO: 3514067 - DNA, 19 bp, Homo sapiens
tggtattgtatttattcaa

SEQ ID NO: 3514068 - DNA, 15 bp, Homo sapiens
tggtcacaagcacaa

SEQ ID NO: 3514069 - DNA, 16 bp, Homo sapiens
tggtcacacactgatg

SEQ ID NO: 3514070 - DNA, 21 bp, Homo sapiens
tggtcacagcggaggtgtgga

SEQ ID NO: 3514071 - DNA, 12 bp, Homo sapiens
tggtcagagcca

SEQ ID NO: 3514072 - DNA, 16 bp, Homo sapiens
tggtccaggagaaggc

SEQ ID NO: 3514073 - DNA, 19 bp, Homo sapiens
tggtccaggccctgtggca

SEQ ID NO: 3514074 - DNA, 13 bp, Homo sapiens
tggtccctgagga

SEQ ID NO: 3514075 - DNA, 20 bp, Homo sapiens
tggtccgtgggacggtgccc

SEQ ID NO: 3514076 - DNA, 12 bp, Homo sapiens
tggtcctggcct

SEQ ID NO: 3514077 - DNA, 12 bp, Homo sapiens
tggtcctttggg

SEQ ID NO: 3514078 - DNA, 14 bp, Homo sapiens
tggtctaaagtgtt

SEQ ID NO: 3514079 - DNA, 16 bp, Homo sapiens
tggtctgacccactgc

SEQ ID NO: 3514080 - DNA, 14 bp, Homo sapiens
tggtcttcagcctc

SEQ ID NO: 3514081 - DNA, 15 bp, Homo sapiens
tggtcttgaagtcct

SEQ ID NO: 3514082 - DNA, 20 bp, Homo sapiens
tggtcttggcagcacctgtc

SEQ ID NO: 3514083 - DNA, 20 bp, Homo sapiens
tggtgaattttcaaggcctt

SEQ ID NO: 3514084 - DNA, 13 bp, Homo sapiens
tggtgagaaggtg

SEQ ID NO: 3514085 - DNA, 20 bp, Homo sapiens
tggtgagcctagccctggga

SEQ ID NO: 3514086 - DNA, 15 bp, Homo sapiens
tggtgatatagaatt

SEQ ID NO: 3514087 - DNA, 15 bp, Homo sapiens
tggtgcactttgtaa

SEQ ID NO: 3514088 - DNA, 17 bp, Homo sapiens
tggtgcactttgtaaat

SEQ ID NO: 3514089 - DNA, 17 bp, Homo sapiens
tggtgcatagcagatgg

SEQ ID NO: 3514090 - DNA, 19 bp, Homo sapiens
tggtgccccaggaccagct

SEQ ID NO: 3514091 - DNA, 23 bp, Homo sapiens
tggtgccccccacccctggaaga

SEQ ID NO: 3514092 - DNA, 17 bp, Homo sapiens
tggtgccctcctcactc

SEQ ID NO: 3514093 - DNA, 20 bp, Homo sapiens
tggtgccctgttctctacca

SEQ ID NO: 3514094 - DNA, 16 bp, Homo sapiens
tggtgcgatctgggtt

SEQ ID NO: 3514095 - DNA, 13 bp, Homo sapiens
tggtgctgagaag

SEQ ID NO: 3514096 - DNA, 17 bp, Homo sapiens
tggtggcagagtcctgg

SEQ ID NO: 3514097 - DNA, 13 bp, Homo sapiens
tggtggcagctgc

SEQ ID NO: 3514098 - DNA, 14 bp, Homo sapiens
tggtggcagctgcg

SEQ ID NO: 3514099 - DNA, 17 bp, Homo sapiens
tggtggcagtggaggtg

SEQ ID NO: 3514100 - DNA, 18 bp, Homo sapiens
tggtggcagtgggagctg

SEQ ID NO: 3514101 - DNA, 15 bp, Homo sapiens
tggtggcctggtccc

SEQ ID NO: 3514102 - DNA, 14 bp, Homo sapiens
tggtgggcttcagg

SEQ ID NO: 3514103 - DNA, 16 bp, Homo sapiens
tggtgggggcctcggt

SEQ ID NO: 3514104 - DNA, 18 bp, Homo sapiens
tggtgggggcctcggtgt

SEQ ID NO: 3514105 - DNA, 18 bp, Homo sapiens
tggtgggtccatgggcag

SEQ ID NO: 3514106 - DNA, 16 bp, Homo sapiens
tggtggtaaccctggt

SEQ ID NO: 3514107 - DNA, 17 bp, Homo sapiens
tggtggtaaccctggtg

SEQ ID NO: 3514108 - DNA, 15 bp, Homo sapiens
tggtggtctgttggc

SEQ ID NO: 3514109 - DNA, 17 bp, Homo sapiens
tggtgtgggtgtcctgc

SEQ ID NO: 3514110 - DNA, 22 bp, Homo sapiens
tggtgtgggtgtcctgcctgtc

SEQ ID NO: 3514111 - DNA, 14 bp, Homo sapiens
tggttatggagagg

SEQ ID NO: 3514112 - DNA, 22 bp, Homo sapiens
tggttcagggttggcccctgcc

SEQ ID NO: 3514113 - DNA, 21 bp, Homo sapiens
tggttccagggtccctctgtg

SEQ ID NO: 3514114 - DNA, 14 bp, Homo sapiens
tggttcccttccta

SEQ ID NO: 3514115 - DNA, 17 bp, Homo sapiens
tggttctcatctttctt

SEQ ID NO: 3514116 - DNA, 12 bp, Homo sapiens
tggttcttctca

SEQ ID NO: 3514117 - DNA, 12 bp, Homo sapiens
tggttgaagaag

SEQ ID NO: 3514118 - DNA, 13 bp, Homo sapiens
tggttgaattttt

SEQ ID NO: 3514119 - DNA, 18 bp, Homo sapiens
tggttgatgatctttgca

SEQ ID NO: 3514120 - DNA, 12 bp, Homo sapiens
tggttggataag

SEQ ID NO: 3514121 - DNA, 24 bp, Homo sapiens
tggttggttttgacttcagattga

SEQ ID NO: 3514122 - DNA, 12 bp, Homo sapiens
tggttgtattag

SEQ ID NO: 3514123 - DNA, 23 bp, Homo sapiens
tggtttaatgcaatagaagtgct

SEQ ID NO: 3514124 - DNA, 15 bp, Homo sapiens
tggtttcgaactcct

SEQ ID NO: 3514125 - DNA, 18 bp, Homo sapiens
tggtttgattgtttacag

SEQ ID NO: 3514126 - DNA, 12 bp, Homo sapiens
tggtttggcctc

SEQ ID NO: 3514127 - DNA, 13 bp, Homo sapiens
tggtttgtcctga

SEQ ID NO: 3514128 - DNA, 12 bp, Homo sapiens
tggttttacatt

SEQ ID NO: 3514129 - DNA, 14 bp, Homo sapiens
tggttttcttaagg

SEQ ID NO: 3514130 - DNA, 17 bp, Homo sapiens
tggttttgttcccctcc

SEQ ID NO: 3514131 - DNA, 21 bp, Homo sapiens
tggtttttaaaaaactgctga

SEQ ID NO: 3514132 - DNA, 23 bp, Homo sapiens
tggtttttaaaaaactgctgact

SEQ ID NO: 3514133 - DNA, 21 bp, Homo sapiens
tgtaaaatatagctgtacaaa

SEQ ID NO: 3514134 - DNA, 23 bp, Homo sapiens
tgtaaaatctttctttcttagaa

SEQ ID NO: 3514135 - DNA, 22 bp, Homo sapiens
tgtaaacaaaccacagcaggat

SEQ ID NO: 3514136 - DNA, 14 bp, Homo sapiens
tgtaaaccgctttg

SEQ ID NO: 3514137 - DNA, 19 bp, Homo sapiens
tgtaaaccgctttggcctg

SEQ ID NO: 3514138 - DNA, 15 bp, Homo sapiens
tgtaaactgtgcacc

SEQ ID NO: 3514139 - DNA, 13 bp, Homo sapiens
tgtaaagccatgc

SEQ ID NO: 3514140 - DNA, 19 bp, Homo sapiens
tgtaaagtgaagaatcctt

SEQ ID NO: 3514141 - DNA, 20 bp, Homo sapiens
tgtaaagtgaagaatccttt

SEQ ID NO: 3514142 - DNA, 17 bp, Homo sapiens
tgtaaataggattttta

SEQ ID NO: 3514143 - DNA, 15 bp, Homo sapiens
tgtaaatatataaat

SEQ ID NO: 3514144 - DNA, 21 bp, Homo sapiens
tgtaaatatataaatatatat

SEQ ID NO: 3514145 - DNA, 21 bp, Homo sapiens
tgtaaatcatgttgatcatgt

SEQ ID NO: 3514146 - DNA, 17 bp, Homo sapiens
tgtaaattgaatcagta

SEQ ID NO: 3514147 - DNA, 22 bp, Homo sapiens
tgtaaattgaatcagtataaac

SEQ ID NO: 3514148 - DNA, 20 bp, Homo sapiens
tgtaacactttacaatgttc

SEQ ID NO: 3514149 - DNA, 11 bp, Homo sapiens
tgtaacatgta

SEQ ID NO: 3514150 - DNA, 24 bp, Homo sapiens
tgtaacttgaacctatgaagcaat

SEQ ID NO: 3514151 - DNA, 22 bp, Homo sapiens
tgtaagaactaaagaagatctg

SEQ ID NO: 3514152 - DNA, 16 bp, Homo sapiens
tgtaagaattcagaag

SEQ ID NO: 3514153 - DNA, 14 bp, Homo sapiens
tgtaagatgtctgt

SEQ ID NO: 3514154 - DNA, 11 bp, Homo sapiens
tgtaaggcctt

SEQ ID NO: 3514155 - DNA, 14 bp, Homo sapiens
tgtaaggccttagc

SEQ ID NO: 3514156 - DNA, 23 bp, Homo sapiens
tgtaataacatttaatttagata

SEQ ID NO: 3514157 - DNA, 14 bp, Homo sapiens
tgtaatcatttgtt

SEQ ID NO: 3514158 - DNA, 19 bp, Homo sapiens
tgtaatcatttgtttacat

SEQ ID NO: 3514159 - DNA, 15 bp, Homo sapiens
tgtaatcccagcact

SEQ ID NO: 3514160 - DNA, 22 bp, Homo sapiens
tgtaatcccagcactttgggag

SEQ ID NO: 3514161 - DNA, 15 bp, Homo sapiens
tgtaatcccagctac

SEQ ID NO: 3514162 - DNA, 16 bp, Homo sapiens
tgtaatcccagctact

SEQ ID NO: 3514163 - DNA, 14 bp, Homo sapiens
tgtaatgtgaatct

SEQ ID NO: 3514164 - DNA, 18 bp, Homo sapiens
tgtaatgttttctttgca

SEQ ID NO: 3514165 - DNA, 21 bp, Homo sapiens
tgtaatgttttctttgcaaag

SEQ ID NO: 3514166 - DNA, 22 bp, Homo sapiens
tgtaattacttatccctgccca

SEQ ID NO: 3514167 - DNA, 15 bp, Homo sapiens
tgggactacaggcac

SEQ ID NO: 3514168 - DNA, 18 bp, Homo sapiens
tgggactacaggcaccca

SEQ ID NO: 3514169 - DNA, 16 bp, Homo sapiens
tgggactacaggtgtg

SEQ ID NO: 3514170 - DNA, 13 bp, Homo sapiens
tgggactcagcct

SEQ ID NO: 3514171 - DNA, 14 bp, Homo sapiens
tgggacttaactcc

SEQ ID NO: 3514172 - DNA, 14 bp, Homo sapiens
tgggagccactgcc

SEQ ID NO: 3514173 - DNA, 18 bp, Homo sapiens
tgggagccgggtctgcct

SEQ ID NO: 3514174 - DNA, 19 bp, Homo sapiens
tgggagctccactctgctt

SEQ ID NO: 3514175 - DNA, 12 bp, Homo sapiens
tgggagctgcct

SEQ ID NO: 3514176 - DNA, 16 bp, Homo sapiens
tgggaggatctcttga

SEQ ID NO: 3514177 - DNA, 21 bp, Homo sapiens
tgggaggatctcttgagcctg

SEQ ID NO: 3514178 - DNA, 14 bp, Homo sapiens
tgggaggcaaatgg

SEQ ID NO: 3514179 - DNA, 19 bp, Homo sapiens
tgggaggccaaggtgggag

SEQ ID NO: 3514180 - DNA, 13 bp, Homo sapiens
tgggaggctcacc

SEQ ID NO: 3514181 - DNA, 22 bp, Homo sapiens
tgggagggaggctcaggtccct

SEQ ID NO: 3514182 - DNA, 17 bp, Homo sapiens
tgggagggcagcagggc

SEQ ID NO: 3514183 - DNA, 18 bp, Homo sapiens
tgggagggcagcagggct

SEQ ID NO: 3514184 - DNA, 19 bp, Homo sapiens
tgggagggcagcagggcta

SEQ ID NO: 3514185 - DNA, 20 bp, Homo sapiens
tgggaggtatgggctggggg

SEQ ID NO: 3514186 - DNA, 19 bp, Homo sapiens
tgggaggtcaaggctgcag

SEQ ID NO: 3514187 - DNA, 20 bp, Homo sapiens
tgggaggtcaaggctgcagt

SEQ ID NO: 3514188 - DNA, 14 bp, Homo sapiens
tgggagtacaaaag

SEQ ID NO: 3514189 - DNA, 23 bp, Homo sapiens
tgggagtcacacagtgttggagg

SEQ ID NO: 3514190 - DNA, 15 bp, Homo sapiens
tgggagtgagctggt

SEQ ID NO: 3514191 - DNA, 20 bp, Homo sapiens
tgggatcacaggtgtcagcc

SEQ ID NO: 3514192 - DNA, 23 bp, Homo sapiens
tgggatcagggcattgcctgtga

SEQ ID NO: 3514193 - DNA, 19 bp, Homo sapiens
tgggatccctgtctttcct

SEQ ID NO: 3514194 - DNA, 23 bp, Homo sapiens
tgggatccctgtctttcctaaga

SEQ ID NO: 3514195 - DNA, 17 bp, Homo sapiens
tgggatggtggagggcc

SEQ ID NO: 3514196 - DNA, 20 bp, Homo sapiens
tgggatggtgggcttcaggg

SEQ ID NO: 3514197 - DNA, 14 bp, Homo sapiens
tgggcaaacaggca

SEQ ID NO: 3514198 - DNA, 15 bp, Homo sapiens
tgggcaaagcctagt

SEQ ID NO: 3514199 - DNA, 21 bp, Homo sapiens
tgggcaacccccagcctgcta

SEQ ID NO: 3514200 - DNA, 18 bp, Homo sapiens
tgggcaattccagaaatc

SEQ ID NO: 3514201 - DNA, 15 bp, Homo sapiens
tgggcaatttagaaa

SEQ ID NO: 3514202 - DNA, 16 bp, Homo sapiens
tgggcaatttagaaaa

SEQ ID NO: 3514203 - DNA, 16 bp, Homo sapiens
tgggcacatgctcagg

SEQ ID NO: 3514204 - DNA, 16 bp, Homo sapiens
tgggcacttccctgct

SEQ ID NO: 3514205 - DNA, 17 bp, Homo sapiens
tgggcacttccctgctg

SEQ ID NO: 3514206 - DNA, 16 bp, Homo sapiens
tgggcagagctgcatc

SEQ ID NO: 3514207 - DNA, 19 bp, Homo sapiens
tgggcagcttgagagggca

SEQ ID NO: 3514208 - DNA, 21 bp, Homo sapiens
tgggcaggactcagctcccca

SEQ ID NO: 3514209 - DNA, 23 bp, Homo sapiens
tgggcaggactcagctccccaga

SEQ ID NO: 3514210 - DNA, 13 bp, Homo sapiens
tgggcagggagcg

SEQ ID NO: 3514211 - DNA, 14 bp, Homo sapiens
tgggcatgtgggct

SEQ ID NO: 3514212 - DNA, 18 bp, Homo sapiens
tgggcattgatggggaag

SEQ ID NO: 3514213 - DNA, 13 bp, Homo sapiens
tgggccaagccag

SEQ ID NO: 3514214 - DNA, 18 bp, Homo sapiens
tgggccaagccagctgcc

SEQ ID NO: 3514215 - DNA, 20 bp, Homo sapiens
tgggccaagccagctgccta

SEQ ID NO: 3514216 - DNA, 13 bp, Homo sapiens
tgggccagacatg

SEQ ID NO: 3514217 - DNA, 18 bp, Homo sapiens
tgggccagacatgccaca

SEQ ID NO: 3514218 - DNA, 16 bp, Homo sapiens
tgggccagtctgtgga

SEQ ID NO: 3514219 - DNA, 20 bp, Homo sapiens
tgggccagtctgtggatcag

SEQ ID NO: 3514220 - DNA, 15 bp, Homo sapiens
tgggcccctggcccc

SEQ ID NO: 3514221 - DNA, 15 bp, Homo sapiens
tgggccctgagccag

SEQ ID NO: 3514222 - DNA, 16 bp, Homo sapiens
tgggccctgggctgga

SEQ ID NO: 3514223 - DNA, 13 bp, Homo sapiens
tgggccctttgag

SEQ ID NO: 3514224 - DNA, 19 bp, Homo sapiens
tgggcctcagtgtgcccat

SEQ ID NO: 3514225 - DNA, 13 bp, Homo sapiens
tgggcctcctcac

SEQ ID NO: 3514226 - DNA, 13 bp, Homo sapiens
tgggcctgcagaa

SEQ ID NO: 3514227 - DNA, 19 bp, Homo sapiens
tgggcctgccgggctgagg

SEQ ID NO: 3514228 - DNA, 16 bp, Homo sapiens
tgggcctgctccagac

SEQ ID NO: 3514229 - DNA, 20 bp, Homo sapiens
tgggcctgctccagacctga

SEQ ID NO: 3514230 - DNA, 16 bp, Homo sapiens
tgggcggctctgaagc

SEQ ID NO: 3514231 - DNA, 21 bp, Homo sapiens
tgggcgtacgctggtgctgag

SEQ ID NO: 3514232 - DNA, 16 bp, Homo sapiens
tgggctactttgtcct

SEQ ID NO: 3514233 - DNA, 19 bp, Homo sapiens
tgggctccctgactgggag

SEQ ID NO: 3514234 - DNA, 18 bp, Homo sapiens
tgggctgaactgagccta

SEQ ID NO: 3514235 - DNA, 16 bp, Homo sapiens
tgggctgcagagtctg

SEQ ID NO: 3514236 - DNA, 20 bp, Homo sapiens
tgggctgcagagtctgcccc

SEQ ID NO: 3514237 - DNA, 21 bp, Homo sapiens
tgggctgggccctctcttctc

SEQ ID NO: 3514238 - DNA, 22 bp, Homo sapiens
tgggctgggccctctcttctca

SEQ ID NO: 3514239 - DNA, 18 bp, Homo sapiens
tgggctgggtggcccctg

SEQ ID NO: 3514240 - DNA, 14 bp, Homo sapiens
tgggcttagagcag

SEQ ID NO: 3514241 - DNA, 19 bp, Homo sapiens
tgggcttcagcctagtggc

SEQ ID NO: 3514242 - DNA, 15 bp, Homo sapiens
tgggcttcagtggca

SEQ ID NO: 3514243 - DNA, 17 bp, Homo sapiens
tgggcttcagtggcagc

SEQ ID NO: 3514244 - DNA, 18 bp, Homo sapiens
tgggcttcagtggcagct

SEQ ID NO: 3514245 - DNA, 20 bp, Homo sapiens
tgggcttcagtggcagctgc

SEQ ID NO: 3514246 - DNA, 11 bp, Homo sapiens
tggggacccac

SEQ ID NO: 3514247 - DNA, 23 bp, Homo sapiens
tggggactccggctgtgctggga

SEQ ID NO: 3514248 - DNA, 21 bp, Homo sapiens
tggggagacagttgagagcgg

SEQ ID NO: 3514249 - DNA, 21 bp, Homo sapiens
tggggagactgggctgaggga

SEQ ID NO: 3514250 - DNA, 22 bp, Homo sapiens
tggggagccaacagaagcttcc

SEQ ID NO: 3514251 - DNA, 20 bp, Homo sapiens
tggggccaccctggcccggc

SEQ ID NO: 3514252 - DNA, 13 bp, Homo sapiens
tggggccagatcc

SEQ ID NO: 3514253 - DNA, 16 bp, Homo sapiens
tggggccagatccagc

SEQ ID NO: 3514254 - DNA, 20 bp, Homo sapiens
tggggccctaattcagccat

SEQ ID NO: 3514255 - DNA, 20 bp, Homo sapiens
tggggccgattgggagaaag

SEQ ID NO: 3514256 - DNA, 15 bp, Homo sapiens
tggggccggggctga

SEQ ID NO: 3514257 - DNA, 18 bp, Homo sapiens
tggggcctacagctttga

SEQ ID NO: 3514258 - DNA, 17 bp, Homo sapiens
tggggcctgactgctca

SEQ ID NO: 3514259 - DNA, 18 bp, Homo sapiens
tggggcctgactgctcag

SEQ ID NO: 3514260 - DNA, 21 bp, Homo sapiens
tggggccttgatgactgcctt

SEQ ID NO: 3514261 - DNA, 22 bp, Homo sapiens
tggggccttgatgactgccttg

SEQ ID NO: 3514262 - DNA, 13 bp, Homo sapiens
tggggctctggga

SEQ ID NO: 3514263 - DNA, 20 bp, Homo sapiens
tggggctgcgggacagagga

SEQ ID NO: 3514264 - DNA, 18 bp, Homo sapiens
tggggctggcttttctgt

SEQ ID NO: 3514265 - DNA, 22 bp, Homo sapiens
tggggctttcgtccacagcttc

SEQ ID NO: 3514266 - DNA, 18 bp, Homo sapiens
tgggggaccccttcccac

SEQ ID NO: 3514267 - DNA, 14 bp, Homo sapiens
tgggggcagggctg

SEQ ID NO: 3514268 - DNA, 15 bp, Homo sapiens
tgggggcagggctgt

SEQ ID NO: 3514269 - DNA, 16 bp, Homo sapiens
tgggggtgggccaggc

SEQ ID NO: 3514270 - DNA, 11 bp, Homo sapiens
tgggggtgggt

SEQ ID NO: 3514271 - DNA, 14 bp, Homo sapiens
tgggggtgggtcag

SEQ ID NO: 3514272 - DNA, 12 bp, Homo sapiens
tgggggttgctg

SEQ ID NO: 3514273 - DNA, 16 bp, Homo sapiens
tggggtacccactgct

SEQ ID NO: 3514274 - DNA, 17 bp, Homo sapiens
tggggtacccactgctc

SEQ ID NO: 3514275 - DNA, 22 bp, Homo sapiens
tggggtcacttgggaagaggac

SEQ ID NO: 3514276 - DNA, 13 bp, Homo sapiens
tggggtcatgccc

SEQ ID NO: 3514277 - DNA, 18 bp, Homo sapiens
tggggtcatgccctcctc

SEQ ID NO: 3514278 - DNA, 15 bp, Homo sapiens
tggggtcctggccat

SEQ ID NO: 3514279 - DNA, 21 bp, Homo sapiens
tggggtctcacagtgttgccc

SEQ ID NO: 3514280 - DNA, 21 bp, Homo sapiens
tggggtctggagttgatctgg

SEQ ID NO: 3514281 - DNA, 14 bp, Homo sapiens
tggggtctggcagc

SEQ ID NO: 3514282 - DNA, 17 bp, Homo sapiens
tggggtctggcagcctc

SEQ ID NO: 3514283 - DNA, 18 bp, Homo sapiens
tggggtctggcagcctcc

SEQ ID NO: 3514284 - DNA, 19 bp, Homo sapiens
tggggtgggtataaaagat

SEQ ID NO: 3514285 - DNA, 15 bp, Homo sapiens
tggggtgtgctggga

SEQ ID NO: 3514286 - DNA, 15 bp, Homo sapiens
tggggtgtgggaggc

SEQ ID NO: 3514287 - DNA, 14 bp, Homo sapiens
tggggtttcctggc

SEQ ID NO: 3514288 - DNA, 15 bp, Homo sapiens
tggggtttcctggca

SEQ ID NO: 3514289 - DNA, 15 bp, Homo sapiens
tggggtttcgcagcc

SEQ ID NO: 3514290 - DNA, 14 bp, Homo sapiens
tgggtaaaattaga

SEQ ID NO: 3514291 - DNA, 23 bp, Homo sapiens
tgggtaacagggagactgcatct

SEQ ID NO: 3514292 - DNA, 18 bp, Homo sapiens
tgggtaatcgatggggga

SEQ ID NO: 3514293 - DNA, 20 bp, Homo sapiens
tgggtaatttagattgtaaa

SEQ ID NO: 3514294 - DNA, 16 bp, Homo sapiens
tgggtacttcttgaag

SEQ ID NO: 3514295 - DNA, 19 bp, Homo sapiens
tgggtacttcttgaaggtg

SEQ ID NO: 3514296 - DNA, 17 bp, Homo sapiens
tgggtacttgtggacac

SEQ ID NO: 3514297 - DNA, 12 bp, Homo sapiens
tgggtataaaag

SEQ ID NO: 3514298 - DNA, 18 bp, Homo sapiens
tgggtattttataatgtt

SEQ ID NO: 3514299 - DNA, 14 bp, Homo sapiens
tgggtcatagaaat

SEQ ID NO: 3514300 - DNA, 14 bp, Homo sapiens
tgggtccatgggca

SEQ ID NO: 3514301 - DNA, 17 bp, Homo sapiens
tgggtcgggagagggga

SEQ ID NO: 3514302 - DNA, 20 bp, Homo sapiens
tgggtctcgctttgttgccc

SEQ ID NO: 3514303 - DNA, 13 bp, Homo sapiens
tgggtctctctcc

SEQ ID NO: 3514304 - DNA, 21 bp, Homo sapiens
tggcaggacacacatggtgag

SEQ ID NO: 3514305 - DNA, 20 bp, Homo sapiens
tggcaggacgtgggctgggc

SEQ ID NO: 3514306 - DNA, 18 bp, Homo sapiens
tggcaggatggcctggcc

SEQ ID NO: 3514307 - DNA, 12 bp, Homo sapiens
tggcaggctggc

SEQ ID NO: 3514308 - DNA, 21 bp, Homo sapiens
tggcaggggtggctgcctcat

SEQ ID NO: 3514309 - DNA, 23 bp, Homo sapiens
tggcaggggtggctgcctcattt

SEQ ID NO: 3514310 - DNA, 15 bp, Homo sapiens
tggcaggtcctcccc

SEQ ID NO: 3514311 - DNA, 15 bp, Homo sapiens
tggcagtccagccag

SEQ ID NO: 3514312 - DNA, 19 bp, Homo sapiens
tggcagtgggagctgcctg

SEQ ID NO: 3514313 - DNA, 23 bp, Homo sapiens
tggcatcaccttaggcagggaag

SEQ ID NO: 3514314 - DNA, 14 bp, Homo sapiens
tggcatgacaacta

SEQ ID NO: 3514315 - DNA, 18 bp, Homo sapiens
tggcatgagaaatacaaa

SEQ ID NO: 3514316 - DNA, 16 bp, Homo sapiens
tggcatgatccaagca

SEQ ID NO: 3514317 - DNA, 16 bp, Homo sapiens
tggcatggaaggggct

SEQ ID NO: 3514318 - DNA, 19 bp, Homo sapiens
tggcatggaaggggcttct

SEQ ID NO: 3514319 - DNA, 21 bp, Homo sapiens
tggcatgtccacgtgtgtgtg

SEQ ID NO: 3514320 - DNA, 20 bp, Homo sapiens
tggcatgttagcccttcctc

SEQ ID NO: 3514321 - DNA, 15 bp, Homo sapiens
tggccaaagagcctt

SEQ ID NO: 3514322 - DNA, 23 bp, Homo sapiens
tggccaaagccaaagctaggcct

SEQ ID NO: 3514323 - DNA, 15 bp, Homo sapiens
tggccaaggagctgc

SEQ ID NO: 3514324 - DNA, 19 bp, Homo sapiens
tggccaccccatctggctg

SEQ ID NO: 3514325 - DNA, 12 bp, Homo sapiens
tggccactaagc

SEQ ID NO: 3514326 - DNA, 18 bp, Homo sapiens
tggccactaagcagagga

SEQ ID NO: 3514327 - DNA, 17 bp, Homo sapiens
tggccacttctgtccat

SEQ ID NO: 3514328 - DNA, 18 bp, Homo sapiens
tggccagacacaggccct

SEQ ID NO: 3514329 - DNA, 15 bp, Homo sapiens
tggccagatgcacca

SEQ ID NO: 3514330 - DNA, 19 bp, Homo sapiens
tggccagatgcaccagccc

SEQ ID NO: 3514331 - DNA, 20 bp, Homo sapiens
tggccaggctggtcttgaac

SEQ ID NO: 3514332 - DNA, 22 bp, Homo sapiens
tggccagggccacgctccagct

SEQ ID NO: 3514333 - DNA, 23 bp, Homo sapiens
tggccagggcctggaagacagag

SEQ ID NO: 3514334 - DNA, 15 bp, Homo sapiens
tggccagtccaggct

SEQ ID NO: 3514335 - DNA, 18 bp, Homo sapiens
tggccatgcctcagccct

SEQ ID NO: 3514336 - DNA, 13 bp, Homo sapiens
tggcccacgcact

SEQ ID NO: 3514337 - DNA, 18 bp, Homo sapiens
tggcccagggcccagagc

SEQ ID NO: 3514338 - DNA, 21 bp, Homo sapiens
tggcccagggcccagagccca

SEQ ID NO: 3514339 - DNA, 17 bp, Homo sapiens
tggcccaggtgagtcct

SEQ ID NO: 3514340 - DNA, 13 bp, Homo sapiens
tggccccaccctg

SEQ ID NO: 3514341 - DNA, 13 bp, Homo sapiens
tggccccagcaca

SEQ ID NO: 3514342 - DNA, 20 bp, Homo sapiens
tggccccaggacctggctgc

SEQ ID NO: 3514343 - DNA, 23 bp, Homo sapiens
tggcccccaaaatctgtcactac

SEQ ID NO: 3514344 - DNA, 21 bp, Homo sapiens
tggccccgccgcctggtactc

SEQ ID NO: 3514345 - DNA, 16 bp, Homo sapiens
tggccccgcctgcctg

SEQ ID NO: 3514346 - DNA, 19 bp, Homo sapiens
tggccccgcctgcctgcca

SEQ ID NO: 3514347 - DNA, 16 bp, Homo sapiens
tggcccctgcccggct

SEQ ID NO: 3514348 - DNA, 13 bp, Homo sapiens
tggccctagactc

SEQ ID NO: 3514349 - DNA, 21 bp, Homo sapiens
tggccctcccagtacctcctg

SEQ ID NO: 3514350 - DNA, 15 bp, Homo sapiens
tggccctgcaaaagg

SEQ ID NO: 3514351 - DNA, 21 bp, Homo sapiens
tggccctgttctcctccccaa

SEQ ID NO: 3514352 - DNA, 19 bp, Homo sapiens
tggccgcacgcctctccct

SEQ ID NO: 3514353 - DNA, 17 bp, Homo sapiens
tggccgcctccaggagc

SEQ ID NO: 3514354 - DNA, 14 bp, Homo sapiens
tggccggctccagt

SEQ ID NO: 3514355 - DNA, 23 bp, Homo sapiens
tggccgggcgcggtggctcacgc

SEQ ID NO: 3514356 - DNA, 14 bp, Homo sapiens
tggccgtgggcctg

SEQ ID NO: 3514357 - DNA, 19 bp, Homo sapiens
tggccgtgggcctggggta

SEQ ID NO: 3514358 - DNA, 21 bp, Homo sapiens
tggcctaaacctcagttatta

SEQ ID NO: 3514359 - DNA, 16 bp, Homo sapiens
tggcctatctcctagg

SEQ ID NO: 3514360 - DNA, 23 bp, Homo sapiens
tggcctcaagtgattctcctgcc

SEQ ID NO: 3514361 - DNA, 15 bp, Homo sapiens
tggcctcatctctgc

SEQ ID NO: 3514362 - DNA, 16 bp, Homo sapiens
tggcctcatctctgcc

SEQ ID NO: 3514363 - DNA, 19 bp, Homo sapiens
tggcctcatctctgcctga

SEQ ID NO: 3514364 - DNA, 13 bp, Homo sapiens
tggcctcatgtgg

SEQ ID NO: 3514365 - DNA, 18 bp, Homo sapiens
tggcctcatgtggctgga

SEQ ID NO: 3514366 - DNA, 21 bp, Homo sapiens
tggcctcatgtggctggaaga

SEQ ID NO: 3514367 - DNA, 14 bp, Homo sapiens
tggcctccatcctc

SEQ ID NO: 3514368 - DNA, 15 bp, Homo sapiens
tggcctccatcctca

SEQ ID NO: 3514369 - DNA, 20 bp, Homo sapiens
tggcctccatcctcatctct

SEQ ID NO: 3514370 - DNA, 14 bp, Homo sapiens
tggcctcccctgcc

SEQ ID NO: 3514371 - DNA, 20 bp, Homo sapiens
tggcctcccctgccaccagg

SEQ ID NO: 3514372 - DNA, 21 bp, Homo sapiens
tggcctcccctgccaccaggc

SEQ ID NO: 3514373 - DNA, 19 bp, Homo sapiens
tggcctctgcaactgctca

SEQ ID NO: 3514374 - DNA, 22 bp, Homo sapiens
tggcctctttgtctaaaacaat

SEQ ID NO: 3514375 - DNA, 11 bp, Homo sapiens
tggcctgggcc

SEQ ID NO: 3514376 - DNA, 21 bp, Homo sapiens
tggcctgtagaatagcctgtg

SEQ ID NO: 3514377 - DNA, 12 bp, Homo sapiens
tggcctgtgtgg

SEQ ID NO: 3514378 - DNA, 20 bp, Homo sapiens
tggcctgtgtggccacttct

SEQ ID NO: 3514379 - DNA, 21 bp, Homo sapiens
tggccttcccgccggaggcca

SEQ ID NO: 3514380 - DNA, 23 bp, Homo sapiens
tggccttctcccctcttctgagc

SEQ ID NO: 3514381 - DNA, 14 bp, Homo sapiens
tggcggggaaccct

SEQ ID NO: 3514382 - DNA, 15 bp, Homo sapiens
tggctaagagtgtcc

SEQ ID NO: 3514383 - DNA, 15 bp, Homo sapiens
tggctacgcctcttc

SEQ ID NO: 3514384 - DNA, 22 bp, Homo sapiens
tggctacgcctcttctgtccct

SEQ ID NO: 3514385 - DNA, 17 bp, Homo sapiens
tggctagtcaagctcct

SEQ ID NO: 3514386 - DNA, 12 bp, Homo sapiens
tggctcacactg

SEQ ID NO: 3514387 - DNA, 14 bp, Homo sapiens
tggctcacactgag

SEQ ID NO: 3514388 - DNA, 12 bp, Homo sapiens
tggctcagccag

SEQ ID NO: 3514389 - DNA, 13 bp, Homo sapiens
tggctcagccagc

SEQ ID NO: 3514390 - DNA, 23 bp, Homo sapiens
tggctccagatgcagggcagtca

SEQ ID NO: 3514391 - DNA, 17 bp, Homo sapiens
tggctccctcttctttc

SEQ ID NO: 3514392 - DNA, 17 bp, Homo sapiens
tggctccttcaccaccc

SEQ ID NO: 3514393 - DNA, 21 bp, Homo sapiens
tggctgaaattctcctggagg

SEQ ID NO: 3514394 - DNA, 23 bp, Homo sapiens
tggctgcaaagggtatcaggtgc

SEQ ID NO: 3514395 - DNA, 14 bp, Homo sapiens
tggctgcaggaatc

SEQ ID NO: 3514396 - DNA, 19 bp, Homo sapiens
tggctgcaggaatctttaa

SEQ ID NO: 3514397 - DNA, 13 bp, Homo sapiens
tggctgcagggag

SEQ ID NO: 3514398 - DNA, 14 bp, Homo sapiens
tggctgcagggagt

SEQ ID NO: 3514399 - DNA, 15 bp, Homo sapiens
tggctggcctcaccc

SEQ ID NO: 3514400 - DNA, 15 bp, Homo sapiens
tggctgggaactcac

SEQ ID NO: 3514401 - DNA, 23 bp, Homo sapiens
tggctgggacgtggctcagccag

SEQ ID NO: 3514402 - DNA, 16 bp, Homo sapiens
tggctgggggcctcag

SEQ ID NO: 3514403 - DNA, 17 bp, Homo sapiens
tggctgggggcctcagt

SEQ ID NO: 3514404 - DNA, 21 bp, Homo sapiens
tggctgggggcctcagtgcca

SEQ ID NO: 3514405 - DNA, 21 bp, Homo sapiens
tggctggggtggcctgtgtgg

SEQ ID NO: 3514406 - DNA, 17 bp, Homo sapiens
tggctgtatcttgtttt

SEQ ID NO: 3514407 - DNA, 18 bp, Homo sapiens
tggctgtctggaaagccc

SEQ ID NO: 3514408 - DNA, 19 bp, Homo sapiens
tggctgtgtctaaactgca

SEQ ID NO: 3514409 - DNA, 17 bp, Homo sapiens
tggcttcacggaagagc

SEQ ID NO: 3514410 - DNA, 20 bp, Homo sapiens
tggcttcacggaagagcctt

SEQ ID NO: 3514411 - DNA, 22 bp, Homo sapiens
tggcttcacggaagagccttgc

SEQ ID NO: 3514412 - DNA, 22 bp, Homo sapiens
tggcttcctaaaattcagtgga

SEQ ID NO: 3514413 - DNA, 20 bp, Homo sapiens
tggcttctctctctctttga

SEQ ID NO: 3514414 - DNA, 19 bp, Homo sapiens
tggcttctggccaggaagc

SEQ ID NO: 3514415 - DNA, 20 bp, Homo sapiens
tggcttctgtggggcccctc

SEQ ID NO: 3514416 - DNA, 15 bp, Homo sapiens
tggcttgagaaatat

SEQ ID NO: 3514417 - DNA, 14 bp, Homo sapiens
tggcttgcttatgt

SEQ ID NO: 3514418 - DNA, 15 bp, Homo sapiens
tggcttgcttatgtg

SEQ ID NO: 3514419 - DNA, 22 bp, Homo sapiens
tggcttggcctatctcctaggg

SEQ ID NO: 3514420 - DNA, 16 bp, Homo sapiens
tggctttatcctcttt

SEQ ID NO: 3514421 - DNA, 21 bp, Homo sapiens
tggctttatcctctttagagt

SEQ ID NO: 3514422 - DNA, 14 bp, Homo sapiens
tggctttcagggag

SEQ ID NO: 3514423 - DNA, 16 bp, Homo sapiens
tggcttttctgtttcc

SEQ ID NO: 3514424 - DNA, 17 bp, Homo sapiens
tgggaaaggagtagaaa

SEQ ID NO: 3514425 - DNA, 17 bp, Homo sapiens
tgggaactcacctgggg

SEQ ID NO: 3514426 - DNA, 18 bp, Homo sapiens
tgggaactcacctggggc

SEQ ID NO: 3514427 - DNA, 16 bp, Homo sapiens
tgggaagaggacttcg

SEQ ID NO: 3514428 - DNA, 15 bp, Homo sapiens
tgggaaggccagctg

SEQ ID NO: 3514429 - DNA, 16 bp, Homo sapiens
tgggaaggccagctgc

SEQ ID NO: 3514430 - DNA, 15 bp, Homo sapiens
tgggaagtgaagact

SEQ ID NO: 3514431 - DNA, 19 bp, Homo sapiens
tgggaatatttgaatcttg

SEQ ID NO: 3514432 - DNA, 20 bp, Homo sapiens
tgggaatatttgaatcttgt

SEQ ID NO: 3514433 - DNA, 12 bp, Homo sapiens
tgggaatcatgg

SEQ ID NO: 3514434 - DNA, 12 bp, Homo sapiens
tgggacaggctc

SEQ ID NO: 3514435 - DNA, 13 bp, Homo sapiens
tgggacaggctct

SEQ ID NO: 3514436 - DNA, 15 bp, Homo sapiens
tgggacaggctcttc

SEQ ID NO: 3514437 - DNA, 23 bp, Homo sapiens
tgggaccaaccctggggaaggag

SEQ ID NO: 3514438 - DNA, 19 bp, Homo sapiens
tgggacctaggggcgccgc

SEQ ID NO: 3514439 - DNA, 16 bp, Homo sapiens
tgggacgtggctcagc

SEQ ID NO: 3514440 - DNA, 16 bp, Homo sapiens
tggaatgttggataag

SEQ ID NO: 3514441 - DNA, 21 bp, Homo sapiens
tggaatgttggataaggaatt

SEQ ID NO: 3514442 - DNA, 12 bp, Homo sapiens
tggaattgattt

SEQ ID NO: 3514443 - DNA, 15 bp, Homo sapiens
tggaattgatttgca

SEQ ID NO: 3514444 - DNA, 16 bp, Homo sapiens
tggaattgatttgcat

SEQ ID NO: 3514445 - DNA, 20 bp, Homo sapiens
tggaattgatttgcattgaa

SEQ ID NO: 3514446 - DNA, 23 bp, Homo sapiens
tggaattgatttgcattgaacac

SEQ ID NO: 3514447 - DNA, 13 bp, Homo sapiens
tggaatttgttca

SEQ ID NO: 3514448 - DNA, 13 bp, Homo sapiens
tggacaaaggaat

SEQ ID NO: 3514449 - DNA, 16 bp, Homo sapiens
tggacaatcatgaaat

SEQ ID NO: 3514450 - DNA, 16 bp, Homo sapiens
tggacacagctcttct

SEQ ID NO: 3514451 - DNA, 13 bp, Homo sapiens
tggacacaggcct

SEQ ID NO: 3514452 - DNA, 12 bp, Homo sapiens
tggacagcccca

SEQ ID NO: 3514453 - DNA, 18 bp, Homo sapiens
tggacaggatgtgtttgc

SEQ ID NO: 3514454 - DNA, 21 bp, Homo sapiens
tggacaggggattggcgcccc

SEQ ID NO: 3514455 - DNA, 21 bp, Homo sapiens
tggacatcagtgtttgttgga

SEQ ID NO: 3514456 - DNA, 18 bp, Homo sapiens
tggacatgcctgtcctga

SEQ ID NO: 3514457 - DNA, 19 bp, Homo sapiens
tggaccagaggaagcccct

SEQ ID NO: 3514458 - DNA, 14 bp, Homo sapiens
tggaccctgttgct

SEQ ID NO: 3514459 - DNA, 16 bp, Homo sapiens
tggaccttaggccttc

SEQ ID NO: 3514460 - DNA, 13 bp, Homo sapiens
tggacgaaggtct

SEQ ID NO: 3514461 - DNA, 16 bp, Homo sapiens
tggacggtgctccagg

SEQ ID NO: 3514462 - DNA, 21 bp, Homo sapiens
tggactaaaagatataagtgc

SEQ ID NO: 3514463 - DNA, 23 bp, Homo sapiens
tggactaaaagatataagtgctg

SEQ ID NO: 3514464 - DNA, 22 bp, Homo sapiens
tggactatctgtctggtggccc

SEQ ID NO: 3514465 - DNA, 12 bp, Homo sapiens
tggactcagaaa

SEQ ID NO: 3514466 - DNA, 15 bp, Homo sapiens
tggactcagggcagc

SEQ ID NO: 3514467 - DNA, 22 bp, Homo sapiens
tggactccagcctgcctggcag

SEQ ID NO: 3514468 - DNA, 14 bp, Homo sapiens
tggactccggccct

SEQ ID NO: 3514469 - DNA, 21 bp, Homo sapiens
tggactctgaaatatcccggg

SEQ ID NO: 3514470 - DNA, 17 bp, Homo sapiens
tggactgacctggtcca

SEQ ID NO: 3514471 - DNA, 11 bp, Homo sapiens
tggactgaggc

SEQ ID NO: 3514472 - DNA, 14 bp, Homo sapiens
tggactgaggcctg

SEQ ID NO: 3514473 - DNA, 19 bp, Homo sapiens
tggactgcagaagcaaggg

SEQ ID NO: 3514474 - DNA, 19 bp, Homo sapiens
tggagaagccacaggcctg

SEQ ID NO: 3514475 - DNA, 23 bp, Homo sapiens
tggagaagccacaggcctgagat

SEQ ID NO: 3514476 - DNA, 18 bp, Homo sapiens
tggagacaatgtctgcag

SEQ ID NO: 3514477 - DNA, 18 bp, Homo sapiens
tggagactcctaggcagg

SEQ ID NO: 3514478 - DNA, 16 bp, Homo sapiens
tggagacttagggcac

SEQ ID NO: 3514479 - DNA, 12 bp, Homo sapiens
tggagagaaaac

SEQ ID NO: 3514480 - DNA, 17 bp, Homo sapiens
tggagagctggagcctg

SEQ ID NO: 3514481 - DNA, 15 bp, Homo sapiens
tggagagtttcctga

SEQ ID NO: 3514482 - DNA, 17 bp, Homo sapiens
tggagagtttcctgaaa

SEQ ID NO: 3514483 - DNA, 16 bp, Homo sapiens
tggagatagggaaaga

SEQ ID NO: 3514484 - DNA, 18 bp, Homo sapiens
tggagatcctcctgcaga

SEQ ID NO: 3514485 - DNA, 21 bp, Homo sapiens
tggagatcctcctgcagacca

SEQ ID NO: 3514486 - DNA, 18 bp, Homo sapiens
tggagatgctgagggtgt

SEQ ID NO: 3514487 - DNA, 18 bp, Homo sapiens
tggagatggaagcttgtt

SEQ ID NO: 3514488 - DNA, 22 bp, Homo sapiens
tggagattctaatcccaacaag

SEQ ID NO: 3514489 - DNA, 18 bp, Homo sapiens
tggagcaatcacagatga

SEQ ID NO: 3514490 - DNA, 21 bp, Homo sapiens
tggagcactgggctcccgggc

SEQ ID NO: 3514491 - DNA, 21 bp, Homo sapiens
tggagcactgttctgggactc

SEQ ID NO: 3514492 - DNA, 13 bp, Homo sapiens
tggagcagagggg

SEQ ID NO: 3514493 - DNA, 17 bp, Homo sapiens
tggagcagaggggctga

SEQ ID NO: 3514494 - DNA, 13 bp, Homo sapiens
tggagccagctcc

SEQ ID NO: 3514495 - DNA, 15 bp, Homo sapiens
tggagccctccgcct

SEQ ID NO: 3514496 - DNA, 12 bp, Homo sapiens
tggagccgaggc

SEQ ID NO: 3514497 - DNA, 13 bp, Homo sapiens
tggagcctggtgc

SEQ ID NO: 3514498 - DNA, 13 bp, Homo sapiens
tggagctgcctga

SEQ ID NO: 3514499 - DNA, 14 bp, Homo sapiens
tggagcttttttcc

SEQ ID NO: 3514500 - DNA, 16 bp, Homo sapiens
tggaggaaagggagga

SEQ ID NO: 3514501 - DNA, 13 bp, Homo sapiens
tggaggacagtgg

SEQ ID NO: 3514502 - DNA, 15 bp, Homo sapiens
tggaggagagagcct

SEQ ID NO: 3514503 - DNA, 18 bp, Homo sapiens
tggaggagcaaaggctga

SEQ ID NO: 3514504 - DNA, 20 bp, Homo sapiens
tggaggagcagtgcaggcac

SEQ ID NO: 3514505 - DNA, 22 bp, Homo sapiens
tggaggagcagtgcaggcacag

SEQ ID NO: 3514506 - DNA, 16 bp, Homo sapiens
tggaggattgctgcca

SEQ ID NO: 3514507 - DNA, 17 bp, Homo sapiens
tggaggattgctgccag

SEQ ID NO: 3514508 - DNA, 19 bp, Homo sapiens
tggaggattgctgccagag

SEQ ID NO: 3514509 - DNA, 20 bp, Homo sapiens
tggaggattgctgccagaga

SEQ ID NO: 3514510 - DNA, 24 bp, Homo sapiens
tggaggattgctgccagagaagtc

SEQ ID NO: 3514511 - DNA, 20 bp, Homo sapiens
tggaggcaatcctaccttgc

SEQ ID NO: 3514512 - DNA, 13 bp, Homo sapiens
tggaggcacttta

SEQ ID NO: 3514513 - DNA, 12 bp, Homo sapiens
tggaggcccagg

SEQ ID NO: 3514514 - DNA, 18 bp, Homo sapiens
tggaggcccaggctggga

SEQ ID NO: 3514515 - DNA, 15 bp, Homo sapiens
tggaggcccagttca

SEQ ID NO: 3514516 - DNA, 20 bp, Homo sapiens
tggaggcctcaggtgctgtc

SEQ ID NO: 3514517 - DNA, 20 bp, Homo sapiens
tggaggtcagcatttgatct

SEQ ID NO: 3514518 - DNA, 17 bp, Homo sapiens
tggaggttaaggctgag

SEQ ID NO: 3514519 - DNA, 21 bp, Homo sapiens
tggaggttaaggctgaggaaa

SEQ ID NO: 3514520 - DNA, 19 bp, Homo sapiens
tggagtccgccaaaggccc

SEQ ID NO: 3514521 - DNA, 14 bp, Homo sapiens
tggagtgcagtgag

SEQ ID NO: 3514522 - DNA, 13 bp, Homo sapiens
tggagtggccact

SEQ ID NO: 3514523 - DNA, 19 bp, Homo sapiens
tggagtgtatgactgcaca

SEQ ID NO: 3514524 - DNA, 18 bp, Homo sapiens
tggagtgttatgtatttc

SEQ ID NO: 3514525 - DNA, 19 bp, Homo sapiens
tggagtgttccccttccac

SEQ ID NO: 3514526 - DNA, 24 bp, Homo sapiens
tggagtgtttctaataaacttgga

SEQ ID NO: 3514527 - DNA, 17 bp, Homo sapiens
tggagttgatctggaac

SEQ ID NO: 3514528 - DNA, 17 bp, Homo sapiens
tggatacataaagacta

SEQ ID NO: 3514529 - DNA, 17 bp, Homo sapiens
tggatccgtttgaccaa

SEQ ID NO: 3514530 - DNA, 20 bp, Homo sapiens
tggatgatggtcttcagcct

SEQ ID NO: 3514531 - DNA, 17 bp, Homo sapiens
tggatgatgtttcgtga

SEQ ID NO: 3514532 - DNA, 15 bp, Homo sapiens
tggatgcagtgctcg

SEQ ID NO: 3514533 - DNA, 21 bp, Homo sapiens
tggatgccaatattaaatctg

SEQ ID NO: 3514534 - DNA, 21 bp, Homo sapiens
tggatgcctggtggcagctgc

SEQ ID NO: 3514535 - DNA, 23 bp, Homo sapiens
tggatgcctggtggcagctgcgg

SEQ ID NO: 3514536 - DNA, 17 bp, Homo sapiens
tggatgcgcagtgcctt

SEQ ID NO: 3514537 - DNA, 16 bp, Homo sapiens
tggatgcttagaggga

SEQ ID NO: 3514538 - DNA, 14 bp, Homo sapiens
tggatggccccagc

SEQ ID NO: 3514539 - DNA, 17 bp, Homo sapiens
tggatggccccagcaca

SEQ ID NO: 3514540 - DNA, 21 bp, Homo sapiens
tggatggccccagcacagctt

SEQ ID NO: 3514541 - DNA, 16 bp, Homo sapiens
tggatgggcctttgag

SEQ ID NO: 3514542 - DNA, 21 bp, Homo sapiens
tggatgggcctttgagcctga

SEQ ID NO: 3514543 - DNA, 20 bp, Homo sapiens
tggattacttctctataaaa

SEQ ID NO: 3514544 - DNA, 15 bp, Homo sapiens
tggattaggtctctg

SEQ ID NO: 3514545 - DNA, 14 bp, Homo sapiens
tggattctgaatct

SEQ ID NO: 3514546 - DNA, 23 bp, Homo sapiens
tggattggagaagtaatcctagg

SEQ ID NO: 3514547 - DNA, 21 bp, Homo sapiens
tggattggagatagggaaaga

SEQ ID NO: 3514548 - DNA, 20 bp, Homo sapiens
tggatttttgactctggcaa

SEQ ID NO: 3514549 - DNA, 16 bp, Homo sapiens
tggcaaagcttttaga

SEQ ID NO: 3514550 - DNA, 18 bp, Homo sapiens
tggcaacagatctggaac

SEQ ID NO: 3514551 - DNA, 17 bp, Homo sapiens
tggcaagagtgtggagg

SEQ ID NO: 3514552 - DNA, 16 bp, Homo sapiens
tggcaaggaaaaacag

SEQ ID NO: 3514553 - DNA, 19 bp, Homo sapiens
tggcaaggacacagatgaa

SEQ ID NO: 3514554 - DNA, 17 bp, Homo sapiens
tggcaagggttcacctg

SEQ ID NO: 3514555 - DNA, 19 bp, Homo sapiens
tggcaatgccatcatctcc

SEQ ID NO: 3514556 - DNA, 23 bp, Homo sapiens
tggcaccagacacccaggactta

SEQ ID NO: 3514557 - DNA, 23 bp, Homo sapiens
tggcacccaagacctcagggcac

SEQ ID NO: 3514558 - DNA, 15 bp, Homo sapiens
tggcacccggcccct

SEQ ID NO: 3514559 - DNA, 18 bp, Homo sapiens
tggcacccggcccctgct

SEQ ID NO: 3514560 - DNA, 19 bp, Homo sapiens
tggcactgactgggcatag

SEQ ID NO: 3514561 - DNA, 19 bp, Homo sapiens
tggcactgctaaaatagaa

SEQ ID NO: 3514562 - DNA, 13 bp, Homo sapiens
tggcactggatgc

SEQ ID NO: 3514563 - DNA, 18 bp, Homo sapiens
tggcactggatgcagaaa

SEQ ID NO: 3514564 - DNA, 15 bp, Homo sapiens
tggcagagtcctgga

SEQ ID NO: 3514565 - DNA, 16 bp, Homo sapiens
tggcagagttgtaaat

SEQ ID NO: 3514566 - DNA, 17 bp, Homo sapiens
tggcagagttgtaaata

SEQ ID NO: 3514567 - DNA, 23 bp, Homo sapiens
tggcagagttgtaaatatataaa

SEQ ID NO: 3514568 - DNA, 23 bp, Homo sapiens
tggcagatgacaagatggtacaa

SEQ ID NO: 3514569 - DNA, 18 bp, Homo sapiens
tggcagattcccactgcc

SEQ ID NO: 3514570 - DNA, 14 bp, Homo sapiens
tggcagcagagtgt

SEQ ID NO: 3514571 - DNA, 20 bp, Homo sapiens
tggcagcagagtgtggcctt

SEQ ID NO: 3514572 - DNA, 21 bp, Homo sapiens
tggcagcctcccatccagggc

SEQ ID NO: 3514573 - DNA, 22 bp, Homo sapiens
tggcagcctcccatccagggcc

SEQ ID NO: 3514574 - DNA, 17 bp, Homo sapiens
tggcagctgcggtccac

SEQ ID NO: 3514575 - DNA, 23 bp, Homo sapiens
tggcagctgcggtccacccagga

SEQ ID NO: 3514576 - DNA, 15 bp, Homo sapiens
tgcacatctgtgtct

SEQ ID NO: 3514577 - DNA, 19 bp, Homo sapiens
tgcacatctgtgtcttgtt

SEQ ID NO: 3514578 - DNA, 24 bp, Homo sapiens
tgcacatcttggctatgtaattct

SEQ ID NO: 3514579 - DNA, 15 bp, Homo sapiens
tgcacatgtcttaat

SEQ ID NO: 3514580 - DNA, 17 bp, Homo sapiens
tgcacatgtttcctcta

SEQ ID NO: 3514581 - DNA, 11 bp, Homo sapiens
tgcacattgtt

SEQ ID NO: 3514582 - DNA, 22 bp, Homo sapiens
tgcaccaagcaggaaatgaaaa

SEQ ID NO: 3514583 - DNA, 14 bp, Homo sapiens
tgcaccaccaagcc

SEQ ID NO: 3514584 - DNA, 16 bp, Homo sapiens
tgcaccaccaagccaa

SEQ ID NO: 3514585 - DNA, 19 bp, Homo sapiens
tgcaccaccaagccaaggg

SEQ ID NO: 3514586 - DNA, 13 bp, Homo sapiens
tgcaccagccctt

SEQ ID NO: 3514587 - DNA, 18 bp, Homo sapiens
tgcaccaggactggctgt

SEQ ID NO: 3514588 - DNA, 19 bp, Homo sapiens
tgcaccagttttatccata

SEQ ID NO: 3514589 - DNA, 16 bp, Homo sapiens
tgcaccatcccttttt

SEQ ID NO: 3514590 - DNA, 17 bp, Homo sapiens
tgcacccacccaggagt

SEQ ID NO: 3514591 - DNA, 16 bp, Homo sapiens
tgcacccagcccagat

SEQ ID NO: 3514592 - DNA, 17 bp, Homo sapiens
tgcaccctcaggcaggt

SEQ ID NO: 3514593 - DNA, 14 bp, Homo sapiens
tgcaccgggccaca

SEQ ID NO: 3514594 - DNA, 17 bp, Homo sapiens
tgcacctagagcttttt

SEQ ID NO: 3514595 - DNA, 15 bp, Homo sapiens
tgcaccttgccaggg

SEQ ID NO: 3514596 - DNA, 16 bp, Homo sapiens
tgcaccttgccaggga

SEQ ID NO: 3514597 - DNA, 14 bp, Homo sapiens
tgcacggctgctga

SEQ ID NO: 3514598 - DNA, 16 bp, Homo sapiens
tgcacgtacacacaca

SEQ ID NO: 3514599 - DNA, 19 bp, Homo sapiens
tgcacgtacacacacatac

SEQ ID NO: 3514600 - DNA, 15 bp, Homo sapiens
tgcacgtgcctgtgg

SEQ ID NO: 3514601 - DNA, 15 bp, Homo sapiens
tgcacgtgtgtgcac

SEQ ID NO: 3514602 - DNA, 16 bp, Homo sapiens
tgcactaactgctggt

SEQ ID NO: 3514603 - DNA, 17 bp, Homo sapiens
tgcactaaggggcccgg

SEQ ID NO: 3514604 - DNA, 23 bp, Homo sapiens
tgcactaaggggcccggccagcc

SEQ ID NO: 3514605 - DNA, 15 bp, Homo sapiens
tgcactccagcctgg

SEQ ID NO: 3514606 - DNA, 16 bp, Homo sapiens
tgcactccagcctggg

SEQ ID NO: 3514607 - DNA, 21 bp, Homo sapiens
tgcactgacattgttggccaa

SEQ ID NO: 3514608 - DNA, 22 bp, Homo sapiens
tgcactgatgctgcccctcatc

SEQ ID NO: 3514609 - DNA, 20 bp, Homo sapiens
tgcactgtaaattgctggca

SEQ ID NO: 3514610 - DNA, 15 bp, Homo sapiens
tgcactgtgaaggac

SEQ ID NO: 3514611 - DNA, 18 bp, Homo sapiens
tgcactgtgtgctgactg

SEQ ID NO: 3514612 - DNA, 20 bp, Homo sapiens
tgcactgttccccctgtgca

SEQ ID NO: 3514613 - DNA, 19 bp, Homo sapiens
tgcacttatgatttcatgt

SEQ ID NO: 3514614 - DNA, 21 bp, Homo sapiens
tgcacttgcagactctacaga

SEQ ID NO: 3514615 - DNA, 16 bp, Homo sapiens
tgcagaaggaaaaatg

SEQ ID NO: 3514616 - DNA, 19 bp, Homo sapiens
tgcagaaggaaaaatgtgt

SEQ ID NO: 3514617 - DNA, 13 bp, Homo sapiens
tgcagacaggaat

SEQ ID NO: 3514618 - DNA, 21 bp, Homo sapiens
tgcagacaggcaagcacctcc

SEQ ID NO: 3514619 - DNA, 17 bp, Homo sapiens
tgcagacctgtcaccct

SEQ ID NO: 3514620 - DNA, 20 bp, Homo sapiens
tgcagactctacagaggcca

SEQ ID NO: 3514621 - DNA, 16 bp, Homo sapiens
tgcagacttcccagct

SEQ ID NO: 3514622 - DNA, 22 bp, Homo sapiens
tgcagacttcccagctaggaag

SEQ ID NO: 3514623 - DNA, 20 bp, Homo sapiens
tgcagagaaacttaagcaaa

SEQ ID NO: 3514624 - DNA, 14 bp, Homo sapiens
tgcagaggccagag

SEQ ID NO: 3514625 - DNA, 14 bp, Homo sapiens
tgcagaggcctggg

SEQ ID NO: 3514626 - DNA, 15 bp, Homo sapiens
tgcagaggtctccaa

SEQ ID NO: 3514627 - DNA, 16 bp, Homo sapiens
tgcagatttgggctgg

SEQ ID NO: 3514628 - DNA, 21 bp, Homo sapiens
tgcagcaggatctagaggggg

SEQ ID NO: 3514629 - DNA, 16 bp, Homo sapiens
tgcctggtattttcaa

SEQ ID NO: 3514630 - DNA, 18 bp, Homo sapiens
tgcctggtggcagctgcg

SEQ ID NO: 3514631 - DNA, 23 bp, Homo sapiens
tgcctgtagcccactctgctcgc

SEQ ID NO: 3514632 - DNA, 13 bp, Homo sapiens
tgcctgtctgccc

SEQ ID NO: 3514633 - DNA, 23 bp, Homo sapiens
tgcctgtggcgccgtctccaggg

SEQ ID NO: 3514634 - DNA, 17 bp, Homo sapiens
tgccttaccgagagcca

SEQ ID NO: 3514635 - DNA, 14 bp, Homo sapiens
tgccttagcttcag

SEQ ID NO: 3514636 - DNA, 16 bp, Homo sapiens
tgccttagcttcagga

SEQ ID NO: 3514637 - DNA, 12 bp, Homo sapiens
tgccttccagat

SEQ ID NO: 3514638 - DNA, 15 bp, Homo sapiens
tgccttccagatcct

SEQ ID NO: 3514639 - DNA, 20 bp, Homo sapiens
tgccttccagatcctctctg

SEQ ID NO: 3514640 - DNA, 14 bp, Homo sapiens
tgccttcctcctgg

SEQ ID NO: 3514641 - DNA, 20 bp, Homo sapiens
tgccttcctcctgggccctc

SEQ ID NO: 3514642 - DNA, 22 bp, Homo sapiens
tgccttcgcttcttgcctctgt

SEQ ID NO: 3514643 - DNA, 23 bp, Homo sapiens
tgccttcgcttcttgcctctgtg

SEQ ID NO: 3514644 - DNA, 16 bp, Homo sapiens
tgccttctaaaggtgt

SEQ ID NO: 3514645 - DNA, 16 bp, Homo sapiens
tgccttctcaccagct

SEQ ID NO: 3514646 - DNA, 18 bp, Homo sapiens
tgccttctcaccagctgc

SEQ ID NO: 3514647 - DNA, 23 bp, Homo sapiens
tgccttctcaccagctgcaaagt

SEQ ID NO: 3514648 - DNA, 11 bp, Homo sapiens
tgccttctgtg

SEQ ID NO: 3514649 - DNA, 14 bp, Homo sapiens
tgccttctgtgggg

SEQ ID NO: 3514650 - DNA, 22 bp, Homo sapiens
tgccttctgtggggactccggc

SEQ ID NO: 3514651 - DNA, 17 bp, Homo sapiens
tgccttgcctcctcagt

SEQ ID NO: 3514652 - DNA, 13 bp, Homo sapiens
tgccttgccttta

SEQ ID NO: 3514653 - DNA, 19 bp, Homo sapiens
tgccttggctcagacatgt

SEQ ID NO: 3514654 - DNA, 20 bp, Homo sapiens
tgcctttattgtgtttgtca

SEQ ID NO: 3514655 - DNA, 15 bp, Homo sapiens
tgccttttgcagaag

SEQ ID NO: 3514656 - DNA, 16 bp, Homo sapiens
tgccttttgcagaaga

SEQ ID NO: 3514657 - DNA, 17 bp, Homo sapiens
tgccttttgcagaagag

SEQ ID NO: 3514658 - DNA, 19 bp, Homo sapiens
tgcgacactgggaggccag

SEQ ID NO: 3514659 - DNA, 15 bp, Homo sapiens
tgcgactttctgcct

SEQ ID NO: 3514660 - DNA, 16 bp, Homo sapiens
tgcgactttctgcctg

SEQ ID NO: 3514661 - DNA, 20 bp, Homo sapiens
tgcgatctgggttcactgca

SEQ ID NO: 3514662 - DNA, 15 bp, Homo sapiens
tgcgccagtcctgct

SEQ ID NO: 3514663 - DNA, 18 bp, Homo sapiens
tgcgcccagtccttccac

SEQ ID NO: 3514664 - DNA, 23 bp, Homo sapiens
tgcgccccctccgccctgccact

SEQ ID NO: 3514665 - DNA, 12 bp, Homo sapiens
tgcgcctgctgc

SEQ ID NO: 3514666 - DNA, 14 bp, Homo sapiens
tgcgcctgtgacca

SEQ ID NO: 3514667 - DNA, 21 bp, Homo sapiens
tgcgcgcatgtaatcccagct

SEQ ID NO: 3514668 - DNA, 14 bp, Homo sapiens
tgcgctcagggcca

SEQ ID NO: 3514669 - DNA, 22 bp, Homo sapiens
tgcgctcagggccatgctgagg

SEQ ID NO: 3514670 - DNA, 15 bp, Homo sapiens
tgcggaatcagcttc

SEQ ID NO: 3514671 - DNA, 17 bp, Homo sapiens
tgcggacagccacggcc

SEQ ID NO: 3514672 - DNA, 23 bp, Homo sapiens
tgcggacagccacggccaggcca

SEQ ID NO: 3514673 - DNA, 19 bp, Homo sapiens
tgcggcctttggcttcacg

SEQ ID NO: 3514674 - DNA, 21 bp, Homo sapiens
tgcgggtgaacaaagcagcca

SEQ ID NO: 3514675 - DNA, 23 bp, Homo sapiens
tgcgggtgaacaaagcagccacg

SEQ ID NO: 3514676 - DNA, 23 bp, Homo sapiens
tgcgggtggggcttggggctcac

SEQ ID NO: 3514677 - DNA, 17 bp, Homo sapiens
tgcggtagccagcacac

SEQ ID NO: 3514678 - DNA, 14 bp, Homo sapiens
tgcggtccacccag

SEQ ID NO: 3514679 - DNA, 15 bp, Homo sapiens
tgctaagccccagca

SEQ ID NO: 3514680 - DNA, 18 bp, Homo sapiens
tgctaagccccagcaagc

SEQ ID NO: 3514681 - DNA, 15 bp, Homo sapiens
tgctaagtgtaggat

SEQ ID NO: 3514682 - DNA, 17 bp, Homo sapiens
tgctaagtgtgaactgg

SEQ ID NO: 3514683 - DNA, 13 bp, Homo sapiens
tgctacccagcca

SEQ ID NO: 3514684 - DNA, 13 bp, Homo sapiens
tgctacgcctgca

SEQ ID NO: 3514685 - DNA, 14 bp, Homo sapiens
tgctactagctctt

SEQ ID NO: 3514686 - DNA, 18 bp, Homo sapiens
tgctagagacgctgatcc

SEQ ID NO: 3514687 - DNA, 17 bp, Homo sapiens
tgctagatctttattat

SEQ ID NO: 3514688 - DNA, 21 bp, Homo sapiens
tgctatagtatttgattcaaa

SEQ ID NO: 3514689 - DNA, 17 bp, Homo sapiens
tgctatgttctgtcttc

SEQ ID NO: 3514690 - DNA, 22 bp, Homo sapiens
tgctatgttctgtcttcccaaa

SEQ ID NO: 3514691 - DNA, 20 bp, Homo sapiens
tgctattgacaataaaatat

SEQ ID NO: 3514692 - DNA, 17 bp, Homo sapiens
tgctcacatatctgtca

SEQ ID NO: 3514693 - DNA, 13 bp, Homo sapiens
tgctcacctgggg

SEQ ID NO: 3514694 - DNA, 22 bp, Homo sapiens
tgctcacctggggtgtgggagg

SEQ ID NO: 3514695 - DNA, 23 bp, Homo sapiens
tgctcacctggggtgtgggaggc

SEQ ID NO: 3514696 - DNA, 15 bp, Homo sapiens
tgctcactttaaacc

SEQ ID NO: 3514697 - DNA, 17 bp, Homo sapiens
tgctcagaacttgctgc

SEQ ID NO: 3514698 - DNA, 16 bp, Homo sapiens
tgctcagaccagctct

SEQ ID NO: 3514699 - DNA, 21 bp, Homo sapiens
tgctcagctctggtccaggcc

SEQ ID NO: 3514700 - DNA, 12 bp, Homo sapiens
tgctcagcttct

SEQ ID NO: 3514701 - DNA, 12 bp, Homo sapiens
tgctcagggaaa

SEQ ID NO: 3514702 - DNA, 21 bp, Homo sapiens
tgctcagggaaatggccttcc

SEQ ID NO: 3514703 - DNA, 23 bp, Homo sapiens
tgctcagggaaatggccttcccg

SEQ ID NO: 3514704 - DNA, 15 bp, Homo sapiens
tgctcatcattctct

SEQ ID NO: 3514705 - DNA, 21 bp, Homo sapiens
tgctcatcattctctgtctca

SEQ ID NO: 3514706 - DNA, 23 bp, Homo sapiens
tgctcatcattctctgtctcatc

SEQ ID NO: 3514707 - DNA, 13 bp, Homo sapiens
tgctcatctgctg

SEQ ID NO: 3514708 - DNA, 14 bp, Homo sapiens
tgctcatctgctgg

SEQ ID NO: 3514709 - DNA, 22 bp, Homo sapiens
tgctccaagtggtgggaatcag

SEQ ID NO: 3514710 - DNA, 14 bp, Homo sapiens
tgctccagacctga

SEQ ID NO: 3514711 - DNA, 15 bp, Homo sapiens
tgctcccccgccctg

SEQ ID NO: 3514712 - DNA, 20 bp, Homo sapiens
tgctccctaccacctcccca

SEQ ID NO: 3514713 - DNA, 14 bp, Homo sapiens
tgctccctctgtca

SEQ ID NO: 3514714 - DNA, 14 bp, Homo sapiens
tgctcctagaggga

SEQ ID NO: 3514715 - DNA, 24 bp, Homo sapiens
tgctcctagagggaggggcctagg

SEQ ID NO: 3514716 - DNA, 19 bp, Homo sapiens
tgctcctggcccactgcat

SEQ ID NO: 3514717 - DNA, 19 bp, Homo sapiens
tgctccttccaacaggagc

SEQ ID NO: 3514718 - DNA, 12 bp, Homo sapiens
tgctccttgggc

SEQ ID NO: 3514719 - DNA, 15 bp, Homo sapiens
tgctccttgggccct

SEQ ID NO: 3514720 - DNA, 14 bp, Homo sapiens
tgctccttgttcct

SEQ ID NO: 3514721 - DNA, 14 bp, Homo sapiens
tgctcgccctgcgg

SEQ ID NO: 3514722 - DNA, 17 bp, Homo sapiens
tgctcgctgttgctgaa

SEQ ID NO: 3514723 - DNA, 19 bp, Homo sapiens
tgctctaggaagacatttt

SEQ ID NO: 3514724 - DNA, 18 bp, Homo sapiens
tgctctatgctttccaaa

SEQ ID NO: 3514725 - DNA, 21 bp, Homo sapiens
tgctctatgctttccaaacct

SEQ ID NO: 3514726 - DNA, 23 bp, Homo sapiens
tgctctccttcctggagcccaga

SEQ ID NO: 3514727 - DNA, 22 bp, Homo sapiens
tgctctgctgacagacacaggc

SEQ ID NO: 3514728 - DNA, 15 bp, Homo sapiens
tgctctggacaggca

SEQ ID NO: 3514729 - DNA, 23 bp, Homo sapiens
tgattccaggaggagttagccaa

SEQ ID NO: 3514730 - DNA, 15 bp, Homo sapiens
tgattcccaagctct

SEQ ID NO: 3514731 - DNA, 16 bp, Homo sapiens
tgattcccaagctctg

SEQ ID NO: 3514732 - DNA, 21 bp, Homo sapiens
tgattcccaagctctgctcct

SEQ ID NO: 3514733 - DNA, 14 bp, Homo sapiens
tgattccttcctgt

SEQ ID NO: 3514734 - DNA, 19 bp, Homo sapiens
tgattccttcctgttctga

SEQ ID NO: 3514735 - DNA, 20 bp, Homo sapiens
tgattctcagggtctctgct

SEQ ID NO: 3514736 - DNA, 22 bp, Homo sapiens
tgattctcagggtctctgctgc

SEQ ID NO: 3514737 - DNA, 13 bp, Homo sapiens
tgattctcctgcc

SEQ ID NO: 3514738 - DNA, 18 bp, Homo sapiens
tgattctccttcagccct

SEQ ID NO: 3514739 - DNA, 22 bp, Homo sapiens
tgattctgcagtaaatctttta

SEQ ID NO: 3514740 - DNA, 12 bp, Homo sapiens
tgattgatttga

SEQ ID NO: 3514741 - DNA, 17 bp, Homo sapiens
tgattgggacagaggtt

SEQ ID NO: 3514742 - DNA, 14 bp, Homo sapiens
tgattgtggaatgg

SEQ ID NO: 3514743 - DNA, 14 bp, Homo sapiens
tgattgtttacagg

SEQ ID NO: 3514744 - DNA, 22 bp, Homo sapiens
tgattgtttacaggatattcca

SEQ ID NO: 3514745 - DNA, 20 bp, Homo sapiens
tgatttagccatgtgaaact

SEQ ID NO: 3514746 - DNA, 22 bp, Homo sapiens
tgatttaggagaagccaggaat

SEQ ID NO: 3514747 - DNA, 15 bp, Homo sapiens
tgatttataaacaga

SEQ ID NO: 3514748 - DNA, 23 bp, Homo sapiens
tgatttataaacagacaatatgt

SEQ ID NO: 3514749 - DNA, 17 bp, Homo sapiens
tgatttatttgcttctt

SEQ ID NO: 3514750 - DNA, 13 bp, Homo sapiens
tgatttccttgaa

SEQ ID NO: 3514751 - DNA, 17 bp, Homo sapiens
tgatttgaagaacatgt

SEQ ID NO: 3514752 - DNA, 15 bp, Homo sapiens
tgatttgcattgaac

SEQ ID NO: 3514753 - DNA, 18 bp, Homo sapiens
tgatttgcattgaacaca

SEQ ID NO: 3514754 - DNA, 19 bp, Homo sapiens
tgattttacaattgaaatg

SEQ ID NO: 3514755 - DNA, 18 bp, Homo sapiens
tgattttatgatcagtgt

SEQ ID NO: 3514756 - DNA, 13 bp, Homo sapiens
tgattttctggat

SEQ ID NO: 3514757 - DNA, 13 bp, Homo sapiens
tgatttttttcca

SEQ ID NO: 3514758 - DNA, 19 bp, Homo sapiens
tgcaaaaactacaaccaat

SEQ ID NO: 3514759 - DNA, 18 bp, Homo sapiens
tgcaaaaatatttataaa

SEQ ID NO: 3514760 - DNA, 22 bp, Homo sapiens
tgcaaaaatatttataaaactt

SEQ ID NO: 3514761 - DNA, 22 bp, Homo sapiens
tgcaaaaggactctcaggacca

SEQ ID NO: 3514762 - DNA, 16 bp, Homo sapiens
tgcaaacgctgcctgc

SEQ ID NO: 3514763 - DNA, 17 bp, Homo sapiens
tgcaaacgctgcctgcc

SEQ ID NO: 3514764 - DNA, 19 bp, Homo sapiens
tgcaaacgctgcctgccca

SEQ ID NO: 3514765 - DNA, 13 bp, Homo sapiens
tgcaaagaggcaa

SEQ ID NO: 3514766 - DNA, 15 bp, Homo sapiens
tgcaaaggacagatc

SEQ ID NO: 3514767 - DNA, 12 bp, Homo sapiens
tgcaaaggctgg

SEQ ID NO: 3514768 - DNA, 14 bp, Homo sapiens
tgcaaaggctggga

SEQ ID NO: 3514769 - DNA, 13 bp, Homo sapiens
tgcaaagtactgt

SEQ ID NO: 3514770 - DNA, 15 bp, Homo sapiens
tgcaaagtactgtaa

SEQ ID NO: 3514771 - DNA, 17 bp, Homo sapiens
tgcaaagtattgtaaat

SEQ ID NO: 3514772 - DNA, 18 bp, Homo sapiens
tgcaaagtattgtaaatt

SEQ ID NO: 3514773 - DNA, 22 bp, Homo sapiens
tgcaaagtgttttgtaccagtg

SEQ ID NO: 3514774 - DNA, 18 bp, Homo sapiens
tgcaaatcctatgtgatt

SEQ ID NO: 3514775 - DNA, 17 bp, Homo sapiens
tgcaacaaaatgtagaa

SEQ ID NO: 3514776 - DNA, 20 bp, Homo sapiens
tgcaacaggctgggcttcag

SEQ ID NO: 3514777 - DNA, 19 bp, Homo sapiens
tgcaacagggggcaaagat

SEQ ID NO: 3514778 - DNA, 14 bp, Homo sapiens
tgcaacctcgctgg

SEQ ID NO: 3514779 - DNA, 18 bp, Homo sapiens
tgcaacctctgcttccca

SEQ ID NO: 3514780 - DNA, 17 bp, Homo sapiens
tgcaacttctttttatt

SEQ ID NO: 3514781 - DNA, 18 bp, Homo sapiens
tgcaagaactcatcactg

SEQ ID NO: 3514782 - DNA, 22 bp, Homo sapiens
tgcaagaactcatcactgtggc

SEQ ID NO: 3514783 - DNA, 23 bp, Homo sapiens
tgcaagaactcatcactgtggct

SEQ ID NO: 3514784 - DNA, 21 bp, Homo sapiens
tgcaagagaacattttactgt

SEQ ID NO: 3514785 - DNA, 22 bp, Homo sapiens
tgcaagagaacattttactgtt

SEQ ID NO: 3514786 - DNA, 14 bp, Homo sapiens
tgcaagagccaagt

SEQ ID NO: 3514787 - DNA, 11 bp, Homo sapiens
tgcaagggaaa

SEQ ID NO: 3514788 - DNA, 20 bp, Homo sapiens
tgcaagtatactagggagcc

SEQ ID NO: 3514789 - DNA, 18 bp, Homo sapiens
tgcaagtgaaggtttaca

SEQ ID NO: 3514790 - DNA, 15 bp, Homo sapiens
tgcaagtgctcaggg

SEQ ID NO: 3514791 - DNA, 20 bp, Homo sapiens
tgcaataaatctgacccagt

SEQ ID NO: 3514792 - DNA, 21 bp, Homo sapiens
tgcaataaatctgacccagtg

SEQ ID NO: 3514793 - DNA, 16 bp, Homo sapiens
tgcaataatgcagtat

SEQ ID NO: 3514794 - DNA, 16 bp, Homo sapiens
tgcaatataacattct

SEQ ID NO: 3514795 - DNA, 16 bp, Homo sapiens
tgcaatggcagccttg

SEQ ID NO: 3514796 - DNA, 15 bp, Homo sapiens
tgcacacaccagagc

SEQ ID NO: 3514797 - DNA, 21 bp, Homo sapiens
tgcacacaccagagcccacct

SEQ ID NO: 3514798 - DNA, 14 bp, Homo sapiens
tgcacacagtgctt

SEQ ID NO: 3514799 - DNA, 16 bp, Homo sapiens
tgcacacccactcagc

SEQ ID NO: 3514800 - DNA, 14 bp, Homo sapiens
tgcacactttgcca

SEQ ID NO: 3514801 - DNA, 14 bp, Homo sapiens
tgcacagaagtcct

SEQ ID NO: 3514802 - DNA, 22 bp, Homo sapiens
tgcacagaagtcctgtatgtct

SEQ ID NO: 3514803 - DNA, 14 bp, Homo sapiens
tgcacatctctgct

SEQ ID NO: 3514804 - DNA, 17 bp, Homo sapiens
tgactctggcaaagctt

SEQ ID NO: 3514805 - DNA, 15 bp, Homo sapiens
tgactctgggtcctt

SEQ ID NO: 3514806 - DNA, 20 bp, Homo sapiens
tgactctgggtccttcctga

SEQ ID NO: 3514807 - DNA, 21 bp, Homo sapiens
tgactctgggtccttcctgaa

SEQ ID NO: 3514808 - DNA, 14 bp, Homo sapiens
tgactcttctctca

SEQ ID NO: 3514809 - DNA, 16 bp, Homo sapiens
tgactgccttgcctcc

SEQ ID NO: 3514810 - DNA, 16 bp, Homo sapiens
tgactgctcagaactt

SEQ ID NO: 3514811 - DNA, 20 bp, Homo sapiens
tgactgctcagaacttgctg

SEQ ID NO: 3514812 - DNA, 23 bp, Homo sapiens
tgactggtgttatcaccgtgggc

SEQ ID NO: 3514813 - DNA, 19 bp, Homo sapiens
tgacttaagcaaaagaaaa

SEQ ID NO: 3514814 - DNA, 18 bp, Homo sapiens
tgacttcccctgcctcct

SEQ ID NO: 3514815 - DNA, 19 bp, Homo sapiens
tgacttcccctgcctccta

SEQ ID NO: 3514816 - DNA, 23 bp, Homo sapiens
tgacttgcacagggattctcaca

SEQ ID NO: 3514817 - DNA, 18 bp, Homo sapiens
tgactttacgcccatctc

SEQ ID NO: 3514818 - DNA, 21 bp, Homo sapiens
tgactttagaaagctgacatt

SEQ ID NO: 3514819 - DNA, 18 bp, Homo sapiens
tgactttagtctgcaaaa

SEQ ID NO: 3514820 - DNA, 13 bp, Homo sapiens
tgactttcaggta

SEQ ID NO: 3514821 - DNA, 14 bp, Homo sapiens
tgactttttataaa

SEQ ID NO: 3514822 - DNA, 21 bp, Homo sapiens
tgagaaagagcacttaagaga

SEQ ID NO: 3514823 - DNA, 15 bp, Homo sapiens
tgagaaatatggaca

SEQ ID NO: 3514824 - DNA, 14 bp, Homo sapiens
tgagaacactgtga

SEQ ID NO: 3514825 - DNA, 22 bp, Homo sapiens
tgagaacctgggttgcagacag

SEQ ID NO: 3514826 - DNA, 20 bp, Homo sapiens
tgagaactgcatatgtttcg

SEQ ID NO: 3514827 - DNA, 23 bp, Homo sapiens
tgagaagaaaacatctattctct

SEQ ID NO: 3514828 - DNA, 20 bp, Homo sapiens
tgagaagaaaatggaaccag

SEQ ID NO: 3514829 - DNA, 19 bp, Homo sapiens
tgagaagcttttgaataaa

SEQ ID NO: 3514830 - DNA, 13 bp, Homo sapiens
tgagaaggtgcct

SEQ ID NO: 3514831 - DNA, 15 bp, Homo sapiens
tgagaaggtgcctgc

SEQ ID NO: 3514832 - DNA, 19 bp, Homo sapiens
tgagaaggtgcctgccata

SEQ ID NO: 3514833 - DNA, 17 bp, Homo sapiens
tgagaagtagccacagt

SEQ ID NO: 3514834 - DNA, 22 bp, Homo sapiens
tgagaagtgaatgctgggactc

SEQ ID NO: 3514835 - DNA, 17 bp, Homo sapiens
tgagaatcagatcattt

SEQ ID NO: 3514836 - DNA, 21 bp, Homo sapiens
tgagaatctacccccagatcc

SEQ ID NO: 3514837 - DNA, 19 bp, Homo sapiens
tgagaatctttattgagaa

SEQ ID NO: 3514838 - DNA, 20 bp, Homo sapiens
tgagaatgctagcaggctgt

SEQ ID NO: 3514839 - DNA, 19 bp, Homo sapiens
tgagaatgtgccatgtata

SEQ ID NO: 3514840 - DNA, 14 bp, Homo sapiens
tgagacaggcagtt

SEQ ID NO: 3514841 - DNA, 17 bp, Homo sapiens
tgagacaggcagtttca

SEQ ID NO: 3514842 - DNA, 23 bp, Homo sapiens
tgagacaggcagtttcagagatg

SEQ ID NO: 3514843 - DNA, 24 bp, Homo sapiens
tgagacaggcagtttcagagatgg

SEQ ID NO: 3514844 - DNA, 13 bp, Homo sapiens
tgagaccagcctg

SEQ ID NO: 3514845 - DNA, 15 bp, Homo sapiens
tgagacttgccttcc

SEQ ID NO: 3514846 - DNA, 21 bp, Homo sapiens
tgagagacggtgtcttgttct

SEQ ID NO: 3514847 - DNA, 14 bp, Homo sapiens
tgagagctgggtgt

SEQ ID NO: 3514848 - DNA, 18 bp, Homo sapiens
tgagaggcagacttccct

SEQ ID NO: 3514849 - DNA, 24 bp, Homo sapiens
tgagagtgtcttcacggcaggaca

SEQ ID NO: 3514850 - DNA, 15 bp, Homo sapiens
tgagagttttggatg

SEQ ID NO: 3514851 - DNA, 12 bp, Homo sapiens
tgagatgctggc

SEQ ID NO: 3514852 - DNA, 23 bp, Homo sapiens
tgagattcaatattgaatttttc

SEQ ID NO: 3514853 - DNA, 23 bp, Homo sapiens
tgagattgttttctttttctacc

SEQ ID NO: 3514854 - DNA, 21 bp, Homo sapiens
tgagatttcatctgctctcct

SEQ ID NO: 3514855 - DNA, 18 bp, Homo sapiens
tgagcaactcttgattat

SEQ ID NO: 3514856 - DNA, 13 bp, Homo sapiens
tgagcaccagggg

SEQ ID NO: 3514857 - DNA, 15 bp, Homo sapiens
tgagcaccctctgga

SEQ ID NO: 3514858 - DNA, 21 bp, Homo sapiens
tgagcaccgtgtcaagctgct

SEQ ID NO: 3514859 - DNA, 22 bp, Homo sapiens
tgagcacctttggaaacaacat

SEQ ID NO: 3514860 - DNA, 20 bp, Homo sapiens
tgagcactaaggtgtgctct

SEQ ID NO: 3514861 - DNA, 20 bp, Homo sapiens
tgaaagttgccattattcta

SEQ ID NO: 3514862 - DNA, 17 bp, Homo sapiens
tgaaataaaactggctt

SEQ ID NO: 3514863 - DNA, 22 bp, Homo sapiens
tgaaataaattctgattcttct

SEQ ID NO: 3514864 - DNA, 20 bp, Homo sapiens
tgaaatatcccgggggtggg

SEQ ID NO: 3514865 - DNA, 15 bp, Homo sapiens
tgaaatatcctgctt

SEQ ID NO: 3514866 - DNA, 12 bp, Homo sapiens
tgaaatatgcat

SEQ ID NO: 3514867 - DNA, 18 bp, Homo sapiens
tgaaatatgctcttttgt

SEQ ID NO: 3514868 - DNA, 14 bp, Homo sapiens
tgaaatattcttag

SEQ ID NO: 3514869 - DNA, 13 bp, Homo sapiens
tgaaatattgctg

SEQ ID NO: 3514870 - DNA, 19 bp, Homo sapiens
tgaaatcttacagctgggt

SEQ ID NO: 3514871 - DNA, 14 bp, Homo sapiens
tgaaatgaggccta

SEQ ID NO: 3514872 - DNA, 21 bp, Homo sapiens
tgaaatgaggtcagagcctgc

SEQ ID NO: 3514873 - DNA, 22 bp, Homo sapiens
tgaaatgaggtcagagcctgca

SEQ ID NO: 3514874 - DNA, 23 bp, Homo sapiens
tgaaatgaggtcagagcctgcag

SEQ ID NO: 3514875 - DNA, 21 bp, Homo sapiens
tgaaattaagaaggcaaaaat

SEQ ID NO: 3514876 - DNA, 15 bp, Homo sapiens
tgaaattctgaattt

SEQ ID NO: 3514877 - DNA, 15 bp, Homo sapiens
tgaaattgtattaca

SEQ ID NO: 3514878 - DNA, 15 bp, Homo sapiens
tgaaatttttgtaaa

SEQ ID NO: 3514879 - DNA, 18 bp, Homo sapiens
tgaaatttttgtaaatca

SEQ ID NO: 3514880 - DNA, 16 bp, Homo sapiens
tgaacaaagcagccac

SEQ ID NO: 3514881 - DNA, 18 bp, Homo sapiens
tgaacacaaactgtaaat

SEQ ID NO: 3514882 - DNA, 14 bp, Homo sapiens
tgaacacttaaatt

SEQ ID NO: 3514883 - DNA, 21 bp, Homo sapiens
tgaacagaagctcttactctt

SEQ ID NO: 3514884 - DNA, 14 bp, Homo sapiens
tgaacagcttgctg

SEQ ID NO: 3514885 - DNA, 21 bp, Homo sapiens
tgaaccacatcttgctctgct

SEQ ID NO: 3514886 - DNA, 17 bp, Homo sapiens
tgaaccaccacacccag

SEQ ID NO: 3514887 - DNA, 20 bp, Homo sapiens
tgaaccaccacacccagccc

SEQ ID NO: 3514888 - DNA, 16 bp, Homo sapiens
tgaaccacgcgggggc

SEQ ID NO: 3514889 - DNA, 14 bp, Homo sapiens
tgaaccctggggcc

SEQ ID NO: 3514890 - DNA, 21 bp, Homo sapiens
tgaaccctggggcctgactgc

SEQ ID NO: 3514891 - DNA, 22 bp, Homo sapiens
tgaacctaggagtgccccattc

SEQ ID NO: 3514892 - DNA, 17 bp, Homo sapiens
tgaactcctggcctcaa

SEQ ID NO: 3514893 - DNA, 19 bp, Homo sapiens
tgaactggaccctgttgct

SEQ ID NO: 3514894 - DNA, 22 bp, Homo sapiens
tgaactggaccctgttgctaag

SEQ ID NO: 3514895 - DNA, 23 bp, Homo sapiens
tgaactgggtacttgtggacaca

SEQ ID NO: 3514896 - DNA, 16 bp, Homo sapiens
tgaactggtcttcctt

SEQ ID NO: 3514897 - DNA, 17 bp, Homo sapiens
tgaactggtcttccttt

SEQ ID NO: 3514898 - DNA, 21 bp, Homo sapiens
tgaactttcctggatgtctga

SEQ ID NO: 3514899 - DNA, 12 bp, Homo sapiens
tgaacttttcat

SEQ ID NO: 3514900 - DNA, 21 bp, Homo sapiens
tgaagaaatccaatcctagcc

SEQ ID NO: 3514901 - DNA, 20 bp, Homo sapiens
tgaagaacagtaactgccat

SEQ ID NO: 3514902 - DNA, 13 bp, Homo sapiens
tgaagaacatgtg

SEQ ID NO: 3514903 - DNA, 19 bp, Homo sapiens
tgaagaactattttattct

SEQ ID NO: 3514904 - DNA, 14 bp, Homo sapiens
tgaagaactgcagg

SEQ ID NO: 3514905 - DNA, 15 bp, Homo sapiens
tgaagaactgcaggc

SEQ ID NO: 3514906 - DNA, 18 bp, Homo sapiens
tgaagaactgcaggccct

SEQ ID NO: 3514907 - DNA, 13 bp, Homo sapiens
tgaagacttgccc

SEQ ID NO: 3514908 - DNA, 21 bp, Homo sapiens
tgaagataagtgtatttttca

SEQ ID NO: 3514909 - DNA, 23 bp, Homo sapiens
tgaagatataactattgcccagg

SEQ ID NO: 3514910 - DNA, 23 bp, Homo sapiens
tgaagcagatgcaaagaggcaag

SEQ ID NO: 3514911 - DNA, 15 bp, Homo sapiens
tgaagcagcctctcc

SEQ ID NO: 3514912 - DNA, 15 bp, Homo sapiens
tgaagccaaagccaa

SEQ ID NO: 3514913 - DNA, 23 bp, Homo sapiens
tgaagctaatgaccaacctgttt

SEQ ID NO: 3514914 - DNA, 14 bp, Homo sapiens
tgaagctactgtgt

SEQ ID NO: 3514915 - DNA, 22 bp, Homo sapiens
tgaagctactgtgtgtgtgaat

SEQ ID NO: 3514916 - DNA, 20 bp, Homo sapiens
tgaaggaacttgtctcttca

SEQ ID NO: 3514917 - DNA, 14 bp, Homo sapiens
tgaaggaatatatg

SEQ ID NO: 3514918 - DNA, 15 bp, Homo sapiens
tgaaggaatatatgg

SEQ ID NO: 3514919 - DNA, 23 bp, Homo sapiens
tgaaggaatatatggcagagttg

SEQ ID NO: 3514920 - DNA, 12 bp, Homo sapiens
tgaaggaccctt

SEQ ID NO: 3514921 - DNA, 14 bp, Homo sapiens
tgaaggcaatgcca

SEQ ID NO: 3514922 - DNA, 18 bp, Homo sapiens
tgaaggcagagaaaggga

SEQ ID NO: 3514923 - DNA, 18 bp, Homo sapiens
tgaaggctaaaaagcaac

SEQ ID NO: 3514924 - DNA, 13 bp, Homo sapiens
tgaaggcttctct

SEQ ID NO: 3514925 - DNA, 19 bp, Homo sapiens
tgaaggcttctctctgtgg

SEQ ID NO: 3514926 - DNA, 24 bp, Homo sapiens
tgaagggattttagtcacacgtgg

SEQ ID NO: 3514927 - DNA, 15 bp, Homo sapiens
tgaagggccagagcc

SEQ ID NO: 3514928 - DNA, 19 bp, Homo sapiens
tgaagggccagagccaggg

SEQ ID NO: 3514929 - DNA, 23 bp, Homo sapiens
tgaaggggcaaattcttttgaat

SEQ ID NO: 3514930 - DNA, 21 bp, Homo sapiens
tgaaggtttacaatttacaaa

SEQ ID NO: 3514931 - DNA, 15 bp, Homo sapiens
tgaagtaaactgcag

SEQ ID NO: 3514932 - DNA, 16 bp, Homo sapiens
tgaagtcctggcttca

SEQ ID NO: 3514933 - DNA, 17 bp, Homo sapiens
tgaagtgtaggcagaca

SEQ ID NO: 3514934 - DNA, 20 bp, Homo sapiens
tgaagttgttactaactaaa

SEQ ID NO: 3514935 - DNA, 16 bp, Homo sapiens
tgaagtttccttggct

SEQ ID NO: 3514936 - DNA, 11 bp, Homo sapiens
tgaataaagaa

SEQ ID NO: 3514937 - DNA, 17 bp, Homo sapiens
tgaataggcgatcacaa

SEQ ID NO: 3514938 - DNA, 18 bp, Homo sapiens
tgaataggcgatcacaac

SEQ ID NO: 3514939 - DNA, 22 bp, Homo sapiens
tgaatatatttaagcaacatct

SEQ ID NO: 3514940 - DNA, 23 bp, Homo sapiens
tgaatatatttaagcaacatctt

SEQ ID NO: 3514941 - DNA, 14 bp, Homo sapiens
tgaatattgttaca

SEQ ID NO: 3514942 - DNA, 15 bp, Homo sapiens
tgaatctatgctggt

SEQ ID NO: 3514943 - DNA, 14 bp, Homo sapiens
tgaatctatttaag

SEQ ID NO: 3514944 - DNA, 19 bp, Homo sapiens
tgaatcttgtctcaatgct

SEQ ID NO: 3514945 - DNA, 20 bp, Homo sapiens
tgaatcttgtctcaatgctc

SEQ ID NO: 3514946 - DNA, 21 bp, Homo sapiens
tgaatcttgtctcaatgctca

SEQ ID NO: 3514947 - DNA, 11 bp, Homo sapiens
tgaatgaacac

SEQ ID NO: 3514948 - DNA, 12 bp, Homo sapiens
tgaatgaacact

SEQ ID NO: 3514949 - DNA, 15 bp, Homo sapiens
tgaatgaacactctt

SEQ ID NO: 3514950 - DNA, 17 bp, Homo sapiens
tgaatgaacccctggct

SEQ ID NO: 3514951 - DNA, 15 bp, Homo sapiens
tgaatgaaccttctg

SEQ ID NO: 3514952 - DNA, 19 bp, Homo sapiens
tgaatgatttgtgtttctt

SEQ ID NO: 3514953 - DNA, 13 bp, Homo sapiens
tgaatgctgggac

SEQ ID NO: 3514954 - DNA, 14 bp, Homo sapiens
tgaatgctgggact

SEQ ID NO: 3514955 - DNA, 21 bp, Homo sapiens
tgaatgcttataggtggcctc

SEQ ID NO: 3514956 - DNA, 14 bp, Homo sapiens
tgaatgctttgcat

SEQ ID NO: 3514957 - DNA, 20 bp, Homo sapiens
tgaatgggatcatgaaagta

SEQ ID NO: 3514958 - DNA, 16 bp, Homo sapiens
tgaatgtattgaactt

SEQ ID NO: 3514959 - DNA, 18 bp, Homo sapiens
tgaatgtggcttgagaaa

SEQ ID NO: 3514960 - DNA, 20 bp, Homo sapiens
tgaatgttaaataaattgta

SEQ ID NO: 3514961 - DNA, 23 bp, Homo sapiens
tgaattcggaactgtcctttcct

SEQ ID NO: 3514962 - DNA, 20 bp, Homo sapiens
tgaattcttggttgaggaaa

SEQ ID NO: 3514963 - DNA, 12 bp, Homo sapiens
tgaattgtacag

SEQ ID NO: 3514964 - DNA, 13 bp, Homo sapiens
tgaattgtacaga

SEQ ID NO: 3514965 - DNA, 20 bp, Homo sapiens
tgaatttattgcacattgtt

SEQ ID NO: 3514966 - DNA, 12 bp, Homo sapiens
tgaatttgcaaa

SEQ ID NO: 3514967 - DNA, 15 bp, Homo sapiens
tgaatttgcaaagta

SEQ ID NO: 3514968 - DNA, 17 bp, Homo sapiens
tgaattttcaaggcctt

SEQ ID NO: 3514969 - DNA, 19 bp, Homo sapiens
tgaattttcaaggccttca

SEQ ID NO: 3514970 - DNA, 21 bp, Homo sapiens
tgaattttcaaggccttcagt

SEQ ID NO: 3514971 - DNA, 20 bp, Homo sapiens
tgaattttggggattttcaa

SEQ ID NO: 3514972 - DNA, 22 bp, Homo sapiens
tgaattttggggattttcaaaa

SEQ ID NO: 3514973 - DNA, 17 bp, Homo sapiens
tgaattttgttctctgg

SEQ ID NO: 3514974 - DNA, 18 bp, Homo sapiens
tgaattttgttctctggg

SEQ ID NO: 3514975 - DNA, 20 bp, Homo sapiens
tgaattttgttctctgggag

SEQ ID NO: 3514976 - DNA, 22 bp, Homo sapiens
tgaatttttgcaataatgcagt

SEQ ID NO: 3514977 - DNA, 16 bp, Homo sapiens
tgaatttttttctgca

SEQ ID NO: 3514978 - DNA, 17 bp, Homo sapiens
tgaatttttttctgcac

SEQ ID NO: 3514979 - DNA, 12 bp, Homo sapiens
tgacaacatctg

SEQ ID NO: 3514980 - DNA, 21 bp, Homo sapiens
tgacaacgtttcagcgactcc

SEQ ID NO: 3514981 - DNA, 17 bp, Homo sapiens
tgacaactggcaggcag

SEQ ID NO: 3514982 - DNA, 18 bp, Homo sapiens
tgacaactggcaggcagg

SEQ ID NO: 3514983 - DNA, 18 bp, Homo sapiens
tgacaaggattgctactg

SEQ ID NO: 3514984 - DNA, 23 bp, Homo sapiens
tgacaaggattgctactgtccta

SEQ ID NO: 3514985 - DNA, 22 bp, Homo sapiens
tgacaaggccagcacccaaagg

SEQ ID NO: 3514986 - DNA, 23 bp, Homo sapiens
tgacaaggccagcacccaaaggg

SEQ ID NO: 3514987 - DNA, 16 bp, Homo sapiens
tgacaaggtcaaattt

SEQ ID NO: 3514988 - DNA, 15 bp, Homo sapiens
tgacaataaaatatt

SEQ ID NO: 3514989 - DNA, 20 bp, Homo sapiens
tgacaataaaatattattga

SEQ ID NO: 3514990 - DNA, 12 bp, Homo sapiens
tgacaattctgc

SEQ ID NO: 3514991 - DNA, 17 bp, Homo sapiens
tgacaattctgttttta

SEQ ID NO: 3514992 - DNA, 13 bp, Homo sapiens
tgacacaaacaca

SEQ ID NO: 3514993 - DNA, 16 bp, Homo sapiens
tgacacaaacctgcct

SEQ ID NO: 3514994 - DNA, 16 bp, Homo sapiens
tgacacaagtggacct

SEQ ID NO: 3514995 - DNA, 19 bp, Homo sapiens
tgacacaagtggaccttag

SEQ ID NO: 3514996 - DNA, 16 bp, Homo sapiens
tgacacacagctctgt

SEQ ID NO: 3514997 - DNA, 13 bp, Homo sapiens
tcgccaaggccta

SEQ ID NO: 3514998 - DNA, 15 bp, Homo sapiens
tcgccaaggcctagg

SEQ ID NO: 3514999 - DNA, 19 bp, Homo sapiens
tcgcccaggctggaatgca

SEQ ID NO: 3515000 - DNA, 14 bp, Homo sapiens
tcgccctcccaggc

SEQ ID NO: 3515001 - DNA, 22 bp, Homo sapiens
tcgcccttacttcttgccctgg

SEQ ID NO: 3515002 - DNA, 23 bp, Homo sapiens
tcgcccttacttcttgccctggg

SEQ ID NO: 3515003 - DNA, 14 bp, Homo sapiens
tcgcgctctgctca

SEQ ID NO: 3515004 - DNA, 16 bp, Homo sapiens
tcgctcccaaaggaaa

SEQ ID NO: 3515005 - DNA, 17 bp, Homo sapiens
tcgctccctcccaggac

SEQ ID NO: 3515006 - DNA, 12 bp, Homo sapiens
tcgctcctgtgt

SEQ ID NO: 3515007 - DNA, 22 bp, Homo sapiens
tcgctgatatatgtgtttttca

SEQ ID NO: 3515008 - DNA, 22 bp, Homo sapiens
tcgctggactctcagtctctga

SEQ ID NO: 3515009 - DNA, 11 bp, Homo sapiens
tcgctgtcctt

SEQ ID NO: 3515010 - DNA, 15 bp, Homo sapiens
tcgctgttgctgaat

SEQ ID NO: 3515011 - DNA, 14 bp, Homo sapiens
tcgcttcttgcctc

SEQ ID NO: 3515012 - DNA, 15 bp, Homo sapiens
tcgcttcttgcctct

SEQ ID NO: 3515013 - DNA, 16 bp, Homo sapiens
tcgcttcttgcctctg

SEQ ID NO: 3515014 - DNA, 20 bp, Homo sapiens
tcggaacccaagcttagaac

SEQ ID NO: 3515015 - DNA, 18 bp, Homo sapiens
tcggaactgtcctttcct

SEQ ID NO: 3515016 - DNA, 21 bp, Homo sapiens
tcggacaagacccccagcact

SEQ ID NO: 3515017 - DNA, 12 bp, Homo sapiens
tcggaggaagcc

SEQ ID NO: 3515018 - DNA, 20 bp, Homo sapiens
tcggccaaacagacaggtgg

SEQ ID NO: 3515019 - DNA, 15 bp, Homo sapiens
tcggcctagggcccc

SEQ ID NO: 3515020 - DNA, 13 bp, Homo sapiens
tcggctctggagg

SEQ ID NO: 3515021 - DNA, 19 bp, Homo sapiens
tcggcttggatcctgggct

SEQ ID NO: 3515022 - DNA, 10 bp, Homo sapiens
tcgggaccag

SEQ ID NO: 3515023 - DNA, 21 bp, Homo sapiens
tcgggagaggggacgcaggcc

SEQ ID NO: 3515024 - DNA, 19 bp, Homo sapiens
tcgggaggtcgaggcagga

SEQ ID NO: 3515025 - DNA, 16 bp, Homo sapiens
tcgggcaccagccagc

SEQ ID NO: 3515026 - DNA, 14 bp, Homo sapiens
tcgggctccagcca

SEQ ID NO: 3515027 - DNA, 12 bp, Homo sapiens
tcgggctgtgcc

SEQ ID NO: 3515028 - DNA, 13 bp, Homo sapiens
tcggggagaaata

SEQ ID NO: 3515029 - DNA, 22 bp, Homo sapiens
tcggtttgccaaaattcatttc

SEQ ID NO: 3515030 - DNA, 17 bp, Homo sapiens
tcgtccacagcttcctg

SEQ ID NO: 3515031 - DNA, 12 bp, Homo sapiens
tcgtccagggag

SEQ ID NO: 3515032 - DNA, 16 bp, Homo sapiens
tcgtcttaactcacca

SEQ ID NO: 3515033 - DNA, 17 bp, Homo sapiens
tcgtgaagtatactgta

SEQ ID NO: 3515034 - DNA, 15 bp, Homo sapiens
tcgtgagctcttgtg

SEQ ID NO: 3515035 - DNA, 22 bp, Homo sapiens
tcgtgagctcttgtgaggaaag

SEQ ID NO: 3515036 - DNA, 14 bp, Homo sapiens
tcgtgcctgtgtcc

SEQ ID NO: 3515037 - DNA, 12 bp, Homo sapiens
tcgtggggaggt

SEQ ID NO: 3515038 - DNA, 16 bp, Homo sapiens
tcgttaaaaagttgtt

SEQ ID NO: 3515039 - DNA, 22 bp, Homo sapiens
tcgttcgcagagcttttcagat

SEQ ID NO: 3515040 - DNA, 16 bp, Homo sapiens
tcgtttggatctgtga

SEQ ID NO: 3515041 - DNA, 15 bp, Homo sapiens
tctaaaacaataaaa

SEQ ID NO: 3515042 - DNA, 12 bp, Homo sapiens
tctaaaagactt

SEQ ID NO: 3515043 - DNA, 19 bp, Homo sapiens
tctaaacccaatccaaatg

SEQ ID NO: 3515044 - DNA, 18 bp, Homo sapiens
tctaaaccccagattctt

SEQ ID NO: 3515045 - DNA, 21 bp, Homo sapiens
tctaaagagtttattttaaga

SEQ ID NO: 3515046 - DNA, 20 bp, Homo sapiens
tctaaagccattgtagtcct

SEQ ID NO: 3515047 - DNA, 18 bp, Homo sapiens
tctaacacagttgaccct

SEQ ID NO: 3515048 - DNA, 16 bp, Homo sapiens
tctaagcctgaagggg

SEQ ID NO: 3515049 - DNA, 14 bp, Homo sapiens
tctaatatggccac

SEQ ID NO: 3515050 - DNA, 14 bp, Homo sapiens
tctaatatgtaaca

SEQ ID NO: 3515051 - DNA, 24 bp, Homo sapiens
tctaatgaggagagaaaatatatg

SEQ ID NO: 3515052 - DNA, 22 bp, Homo sapiens
tctaatttatcttgtctctggg

SEQ ID NO: 3515053 - DNA, 15 bp, Homo sapiens
tctacaatgtgaact

SEQ ID NO: 3515054 - DNA, 19 bp, Homo sapiens
tctacaattcctctgataa

SEQ ID NO: 3515055 - DNA, 15 bp, Homo sapiens
tctacaccaattaat

SEQ ID NO: 3515056 - DNA, 16 bp, Homo sapiens
tctacaccttgctttt

SEQ ID NO: 3515057 - DNA, 16 bp, Homo sapiens
tctacagagcttccct

SEQ ID NO: 3515058 - DNA, 18 bp, Homo sapiens
tctacagagcttccctga

SEQ ID NO: 3515059 - DNA, 16 bp, Homo sapiens
tctacccagggcctgc

SEQ ID NO: 3515060 - DNA, 19 bp, Homo sapiens
tctactaagtgatgctgtg

SEQ ID NO: 3515061 - DNA, 18 bp, Homo sapiens
tctactaattccacacct

SEQ ID NO: 3515062 - DNA, 21 bp, Homo sapiens
tctacttaatccaatgggttt

SEQ ID NO: 3515063 - DNA, 19 bp, Homo sapiens
tctagaaataggttaaact

SEQ ID NO: 3515064 - DNA, 20 bp, Homo sapiens
tctagaacatccctgccagc

SEQ ID NO: 3515065 - DNA, 23 bp, Homo sapiens
tctagagagggaggcaagccctg

SEQ ID NO: 3515066 - DNA, 14 bp, Homo sapiens
tctagagcactgcc

SEQ ID NO: 3515067 - DNA, 24 bp, Homo sapiens
tctagaggctcatggccctgtagt

SEQ ID NO: 3515068 - DNA, 16 bp, Homo sapiens
tctagatacaataaat

SEQ ID NO: 3515069 - DNA, 19 bp, Homo sapiens
tctagatacctaaaacata

SEQ ID NO: 3515070 - DNA, 22 bp, Homo sapiens
tctagatgaagttttacattgt

SEQ ID NO: 3515071 - DNA, 16 bp, Homo sapiens
tctagatgagctgggc

SEQ ID NO: 3515072 - DNA, 18 bp, Homo sapiens
tctagatggctcctctca

SEQ ID NO: 3515073 - DNA, 20 bp, Homo sapiens
tctagatggctcctctcagt

SEQ ID NO: 3515074 - DNA, 15 bp, Homo sapiens
tctagcaaatgttat

SEQ ID NO: 3515075 - DNA, 21 bp, Homo sapiens
tctagctgggggtgggccagg

SEQ ID NO: 3515076 - DNA, 11 bp, Homo sapiens
tctagctgttg

SEQ ID NO: 3515077 - DNA, 18 bp, Homo sapiens
tctagctgttgagctgtt

SEQ ID NO: 3515078 - DNA, 19 bp, Homo sapiens
tctaggaaattcttgaaaa

SEQ ID NO: 3515079 - DNA, 18 bp, Homo sapiens
tctaggacgccacccagc

SEQ ID NO: 3515080 - DNA, 14 bp, Homo sapiens
tctaggatagctaa

SEQ ID NO: 3515081 - DNA, 23 bp, Homo sapiens
tctaggatagctaactgtaaatc

SEQ ID NO: 3515082 - DNA, 17 bp, Homo sapiens
tctaggctctgccttcg

SEQ ID NO: 3515083 - DNA, 12 bp, Homo sapiens
tctaggctgggg

SEQ ID NO: 3515084 - DNA, 17 bp, Homo sapiens
tctagggaaatgaaaga

SEQ ID NO: 3515085 - DNA, 22 bp, Homo sapiens
tctagggcggagaggctgcact

SEQ ID NO: 3515086 - DNA, 22 bp, Homo sapiens
tctagggtgttctgtacttaga

SEQ ID NO: 3515087 - DNA, 20 bp, Homo sapiens
tctaggtaggggcccacttc

SEQ ID NO: 3515088 - DNA, 16 bp, Homo sapiens
tctagtatttgaacaa

SEQ ID NO: 3515089 - DNA, 15 bp, Homo sapiens
tctagtctgagcttc

SEQ ID NO: 3515090 - DNA, 23 bp, Homo sapiens
tctagtgccttctaaaggtgttg

SEQ ID NO: 3515091 - DNA, 13 bp, Homo sapiens
tctagttctttgt

SEQ ID NO: 3515092 - DNA, 14 bp, Homo sapiens
tctagttttcagtt

SEQ ID NO: 3515093 - DNA, 22 bp, Homo sapiens
tctataaggccataaaacaggt

SEQ ID NO: 3515094 - DNA, 15 bp, Homo sapiens
tctatacatatcttt

SEQ ID NO: 3515095 - DNA, 13 bp, Homo sapiens
tctatagactcta

SEQ ID NO: 3515096 - DNA, 15 bp, Homo sapiens
tctatcatttaataa

SEQ ID NO: 3515097 - DNA, 16 bp, Homo sapiens
tctatcatttaataat

SEQ ID NO: 3515098 - DNA, 18 bp, Homo sapiens
tctatcttttgtttcctt

SEQ ID NO: 3515099 - DNA, 19 bp, Homo sapiens
tctatgataattacaatac

SEQ ID NO: 3515100 - DNA, 20 bp, Homo sapiens
tctatgataattacaataca

SEQ ID NO: 3515101 - DNA, 22 bp, Homo sapiens
tctatgattcgtgtaattactt

SEQ ID NO: 3515102 - DNA, 13 bp, Homo sapiens
tctatgctttcca

SEQ ID NO: 3515103 - DNA, 18 bp, Homo sapiens
tctatgctttccaaacct

SEQ ID NO: 3515104 - DNA, 23 bp, Homo sapiens
tctatgctttccaaaccttatct

SEQ ID NO: 3515105 - DNA, 19 bp, Homo sapiens
tctatggcagtccagccag

SEQ ID NO: 3515106 - DNA, 22 bp, Homo sapiens
tctatggcagtccagccagctc

SEQ ID NO: 3515107 - DNA, 21 bp, Homo sapiens
tctatgggtttagttacttta

SEQ ID NO: 3515108 - DNA, 21 bp, Homo sapiens
tctatgtagtggttttaggat

SEQ ID NO: 3515109 - DNA, 22 bp, Homo sapiens
tctatgtagtggttttaggata

SEQ ID NO: 3515110 - DNA, 13 bp, Homo sapiens
tctatttatatgt

SEQ ID NO: 3515111 - DNA, 15 bp, Homo sapiens
tctatttatttactg

SEQ ID NO: 3515112 - DNA, 15 bp, Homo sapiens
tctatttctcctcca

SEQ ID NO: 3515113 - DNA, 16 bp, Homo sapiens
tctatttctcctccat

SEQ ID NO: 3515114 - DNA, 20 bp, Homo sapiens
tctatttcttcttcacatcc

SEQ ID NO: 3515115 - DNA, 22 bp, Homo sapiens
tctatttcttcttcacatccat

SEQ ID NO: 3515116 - DNA, 16 bp, Homo sapiens
tctcaaaaaaagaaaa

SEQ ID NO: 3515117 - DNA, 13 bp, Homo sapiens
tctcaaaagaact

SEQ ID NO: 3515118 - DNA, 14 bp, Homo sapiens
tctcaaccttggcc

SEQ ID NO: 3515119 - DNA, 22 bp, Homo sapiens
tctcaagatgggggcagggctg

SEQ ID NO: 3515120 - DNA, 14 bp, Homo sapiens
tctcaagtaatata

SEQ ID NO: 3515121 - DNA, 18 bp, Homo sapiens
tctcaatcctgcagtggg

SEQ ID NO: 3515122 - DNA, 13 bp, Homo sapiens
tctcaatgctcat

SEQ ID NO: 3515123 - DNA, 14 bp, Homo sapiens
tctcacaagccagc

SEQ ID NO: 3515124 - DNA, 13 bp, Homo sapiens
tctcaccagctgc

SEQ ID NO: 3515125 - DNA, 22 bp, Homo sapiens
tctcacccataataaaggttgt

SEQ ID NO: 3515126 - DNA, 17 bp, Homo sapiens
gtcaagagtagttatat

SEQ ID NO: 3515127 - DNA, 15 bp, Homo sapiens
gtcaagctcctcctc

SEQ ID NO: 3515128 - DNA, 13 bp, Homo sapiens
gtcaagctgctct

SEQ ID NO: 3515129 - DNA, 14 bp, Homo sapiens
gtcaagctgctctg

SEQ ID NO: 3515130 - DNA, 17 bp, Homo sapiens
gtcaagctgctctgagc

SEQ ID NO: 3515131 - DNA, 18 bp, Homo sapiens
gtcaagctgctctgagcc

SEQ ID NO: 3515132 - DNA, 23 bp, Homo sapiens
gtcaagctgctctgagccacagt

SEQ ID NO: 3515133 - DNA, 18 bp, Homo sapiens
gtcaaggctgcttagaat

SEQ ID NO: 3515134 - DNA, 15 bp, Homo sapiens
gtcaagtgaaaaagg

SEQ ID NO: 3515135 - DNA, 16 bp, Homo sapiens
gtcaagtgaaaaagga

SEQ ID NO: 3515136 - DNA, 20 bp, Homo sapiens
gtcaatacagtacaggcagc

SEQ ID NO: 3515137 - DNA, 21 bp, Homo sapiens
gtcaatacagtacaggcagca

SEQ ID NO: 3515138 - DNA, 22 bp, Homo sapiens
gtcaatccaagagtctgatgat

SEQ ID NO: 3515139 - DNA, 17 bp, Homo sapiens
gtcaatttatgaatata

SEQ ID NO: 3515140 - DNA, 18 bp, Homo sapiens
gtcaatttatgaatataa

SEQ ID NO: 3515141 - DNA, 17 bp, Homo sapiens
gtcaatttctgtgttgc

SEQ ID NO: 3515142 - DNA, 21 bp, Homo sapiens
gtcacacagtattacttctgc

SEQ ID NO: 3515143 - DNA, 16 bp, Homo sapiens
gtcacaggcaggtcca

SEQ ID NO: 3515144 - DNA, 19 bp, Homo sapiens
gtcaccaaaagacactgca

SEQ ID NO: 3515145 - DNA, 15 bp, Homo sapiens
gtcaccaagcccagt

SEQ ID NO: 3515146 - DNA, 16 bp, Homo sapiens
gtcaccacgactggcc

SEQ ID NO: 3515147 - DNA, 19 bp, Homo sapiens
gtcaccacgactggccagg

SEQ ID NO: 3515148 - DNA, 14 bp, Homo sapiens
gtcaccctagccct

SEQ ID NO: 3515149 - DNA, 16 bp, Homo sapiens
gtcacctagcaagctg

SEQ ID NO: 3515150 - DNA, 13 bp, Homo sapiens
gtcacctgtgctt

SEQ ID NO: 3515151 - DNA, 13 bp, Homo sapiens
gtcacgcctgaaa

SEQ ID NO: 3515152 - DNA, 14 bp, Homo sapiens
gtcacgcctgaaac

SEQ ID NO: 3515153 - DNA, 15 bp, Homo sapiens
gtcactcaggctgga

SEQ ID NO: 3515154 - DNA, 23 bp, Homo sapiens
gtcactcattgctgagcctctgc

SEQ ID NO: 3515155 - DNA, 22 bp, Homo sapiens
gtcacttgggaagaggacttcg

SEQ ID NO: 3515156 - DNA, 19 bp, Homo sapiens
gtcagaattagctgcttct

SEQ ID NO: 3515157 - DNA, 23 bp, Homo sapiens
gtcagagccacagggtctgcctc

SEQ ID NO: 3515158 - DNA, 16 bp, Homo sapiens
gtcagagcctgcagtt

SEQ ID NO: 3515159 - DNA, 15 bp, Homo sapiens
gtcagccaggagctg

SEQ ID NO: 3515160 - DNA, 20 bp, Homo sapiens
gtcagccaggagctgtcacc

SEQ ID NO: 3515161 - DNA, 23 bp, Homo sapiens
gtcagccattgcacccagcccag

SEQ ID NO: 3515162 - DNA, 12 bp, Homo sapiens
gtcagctgaggc

SEQ ID NO: 3515163 - DNA, 23 bp, Homo sapiens
gtcagctgaggctgggggagagc

SEQ ID NO: 3515164 - DNA, 13 bp, Homo sapiens
gtcaggcagggtg

SEQ ID NO: 3515165 - DNA, 14 bp, Homo sapiens
gtcagggacccctg

SEQ ID NO: 3515166 - DNA, 18 bp, Homo sapiens
gtcagggacccctgccct

SEQ ID NO: 3515167 - DNA, 13 bp, Homo sapiens
gtcagtcacagcc

SEQ ID NO: 3515168 - DNA, 12 bp, Homo sapiens
gtcagtctttag

SEQ ID NO: 3515169 - DNA, 17 bp, Homo sapiens
gtcagtgtccaaagcag

SEQ ID NO: 3515170 - DNA, 20 bp, Homo sapiens
gtcagtgtccaaagcagggt

SEQ ID NO: 3515171 - DNA, 24 bp, Homo sapiens
gtcagtgtccaaagcagggtctgg

SEQ ID NO: 3515172 - DNA, 15 bp, Homo sapiens
gtcataccaatgaaa

SEQ ID NO: 3515173 - DNA, 22 bp, Homo sapiens
gtcatactatctactctcctca

SEQ ID NO: 3515174 - DNA, 22 bp, Homo sapiens
gtcatatactgccatgtactag

SEQ ID NO: 3515175 - DNA, 16 bp, Homo sapiens
gtcatatgttaagcag

SEQ ID NO: 3515176 - DNA, 22 bp, Homo sapiens
gtcatcgattcaaactgctcca

SEQ ID NO: 3515177 - DNA, 18 bp, Homo sapiens
gtcatcttgaccaagcag

SEQ ID NO: 3515178 - DNA, 17 bp, Homo sapiens
gtcatgccctcctctcc

SEQ ID NO: 3515179 - DNA, 12 bp, Homo sapiens
gtcatgcttcat

SEQ ID NO: 3515180 - DNA, 18 bp, Homo sapiens
gtcatgtgcctctgtcct

SEQ ID NO: 3515181 - DNA, 16 bp, Homo sapiens
gtcattcgttctgtgg

SEQ ID NO: 3515182 - DNA, 18 bp, Homo sapiens
gtcattgcagtttaagag

SEQ ID NO: 3515183 - DNA, 17 bp, Homo sapiens
gtcattggctttatcct

SEQ ID NO: 3515184 - DNA, 21 bp, Homo sapiens
gtcatttatgtgtcagttcat

SEQ ID NO: 3515185 - DNA, 21 bp, Homo sapiens
gtcatttgagcagggctcagc

SEQ ID NO: 3515186 - DNA, 16 bp, Homo sapiens
gtcattttgcactgta

SEQ ID NO: 3515187 - DNA, 21 bp, Homo sapiens
gtccaagcaacagcctttgaa

SEQ ID NO: 3515188 - DNA, 18 bp, Homo sapiens
gtccaattttaatttagt

SEQ ID NO: 3515189 - DNA, 20 bp, Homo sapiens
gtccacaaaataaccaatcc

SEQ ID NO: 3515190 - DNA, 14 bp, Homo sapiens
gtccacagcttcct

SEQ ID NO: 3515191 - DNA, 23 bp, Homo sapiens
gtccacccaggagccccgaggcc

SEQ ID NO: 3515192 - DNA, 16 bp, Homo sapiens
gtccacgactgtctcc

SEQ ID NO: 3515193 - DNA, 11 bp, Homo sapiens
gtccagaagga

SEQ ID NO: 3515194 - DNA, 14 bp, Homo sapiens
gtccagagctggcc

SEQ ID NO: 3515195 - DNA, 13 bp, Homo sapiens
gtccagccagctc

SEQ ID NO: 3515196 - DNA, 14 bp, Homo sapiens
gtccagccagctcc

SEQ ID NO: 3515197 - DNA, 24 bp, Homo sapiens
gtccagctcccgctgtggccgcac

SEQ ID NO: 3515198 - DNA, 13 bp, Homo sapiens
gtccagctctgga

SEQ ID NO: 3515199 - DNA, 15 bp, Homo sapiens
gtccaggcactgaga

SEQ ID NO: 3515200 - DNA, 17 bp, Homo sapiens
gtccaggccctgtggca

SEQ ID NO: 3515201 - DNA, 20 bp, Homo sapiens
gtccaggctgccgtggggcc

SEQ ID NO: 3515202 - DNA, 11 bp, Homo sapiens
gtccaggggat

SEQ ID NO: 3515203 - DNA, 11 bp, Homo sapiens
gtccagtgcct

SEQ ID NO: 3515204 - DNA, 21 bp, Homo sapiens
gtccatatcagaactgtgcca

SEQ ID NO: 3515205 - DNA, 18 bp, Homo sapiens
gtccatgtattcacacac

SEQ ID NO: 3515206 - DNA, 23 bp, Homo sapiens
gtccatgtattcacacacccctc

SEQ ID NO: 3515207 - DNA, 22 bp, Homo sapiens
gtccatttggcaggggtggctg

SEQ ID NO: 3515208 - DNA, 23 bp, Homo sapiens
gtcccaaggtgaaatgaagcaac

SEQ ID NO: 3515209 - DNA, 17 bp, Homo sapiens
gtcccaccttggctgca

SEQ ID NO: 3515210 - DNA, 19 bp, Homo sapiens
gtcccaccttggctgcagg

SEQ ID NO: 3515211 - DNA, 12 bp, Homo sapiens
gtcccactcaag

SEQ ID NO: 3515212 - DNA, 22 bp, Homo sapiens
gtcccactcaagccaagcagcc

SEQ ID NO: 3515213 - DNA, 17 bp, Homo sapiens
gtcccagatacttgggg

SEQ ID NO: 3515214 - DNA, 15 bp, Homo sapiens
gtcccagttttgttg

SEQ ID NO: 3515215 - DNA, 23 bp, Homo sapiens
gtcccagttttgttgccccagaa

SEQ ID NO: 3515216 - DNA, 11 bp, Homo sapiens
gtcccatctct

SEQ ID NO: 3515217 - DNA, 20 bp, Homo sapiens
gtcctctgtcagtcacagcc

SEQ ID NO: 3515218 - DNA, 14 bp, Homo sapiens
gtcctgaaagcggc

SEQ ID NO: 3515219 - DNA, 18 bp, Homo sapiens
gtcctgaaagcggctgcc

SEQ ID NO: 3515220 - DNA, 21 bp, Homo sapiens
gtcctgaaagcggctgcctcc

SEQ ID NO: 3515221 - DNA, 23 bp, Homo sapiens
gtcctgaaagcggctgcctccat

SEQ ID NO: 3515222 - DNA, 20 bp, Homo sapiens
gtcctgccaccaccctgtct

SEQ ID NO: 3515223 - DNA, 15 bp, Homo sapiens
gtcctgcctcagcct

SEQ ID NO: 3515224 - DNA, 12 bp, Homo sapiens
gtcctgcctgtc

SEQ ID NO: 3515225 - DNA, 22 bp, Homo sapiens
gtcctgcctgtggcgccgtctc

SEQ ID NO: 3515226 - DNA, 17 bp, Homo sapiens
gtcctggatgttgtgtg

SEQ ID NO: 3515227 - DNA, 17 bp, Homo sapiens
gtcctggattcactggc

SEQ ID NO: 3515228 - DNA, 15 bp, Homo sapiens
gtcctggcttcaggc

SEQ ID NO: 3515229 - DNA, 15 bp, Homo sapiens
gtcctgggagtgagc

SEQ ID NO: 3515230 - DNA, 17 bp, Homo sapiens
gtcctgggagtgagctg

SEQ ID NO: 3515231 - DNA, 19 bp, Homo sapiens
gtcctgggagtgagctggt

SEQ ID NO: 3515232 - DNA, 15 bp, Homo sapiens
gtcctgtatgtctgt

SEQ ID NO: 3515233 - DNA, 22 bp, Homo sapiens
gtcctgtccacacccagctcag

SEQ ID NO: 3515234 - DNA, 22 bp, Homo sapiens
gtcctgttaacgtcatctcagg

SEQ ID NO: 3515235 - DNA, 22 bp, Homo sapiens
gtccttaatgaagagccagccc

SEQ ID NO: 3515236 - DNA, 15 bp, Homo sapiens
gtcctttgtgaatat

SEQ ID NO: 3515237 - DNA, 19 bp, Homo sapiens
gtccttttactacagctat

SEQ ID NO: 3515238 - DNA, 19 bp, Homo sapiens
gtcctttttttccatcttt

SEQ ID NO: 3515239 - DNA, 16 bp, Homo sapiens
gtcgaggacagggagg

SEQ ID NO: 3515240 - DNA, 20 bp, Homo sapiens
gtcgcccaggctggagtgca

SEQ ID NO: 3515241 - DNA, 17 bp, Homo sapiens
gtcggctgaccatgctc

SEQ ID NO: 3515242 - DNA, 11 bp, Homo sapiens
gtcgggagagg

SEQ ID NO: 3515243 - DNA, 21 bp, Homo sapiens
gtcgggagaggggacgcaggc

SEQ ID NO: 3515244 - DNA, 15 bp, Homo sapiens
gtcgtagaattcctt

SEQ ID NO: 3515245 - DNA, 12 bp, Homo sapiens
gtcgtgcctgtg

SEQ ID NO: 3515246 - DNA, 17 bp, Homo sapiens
gtcgtgcctgtgtccat

SEQ ID NO: 3515247 - DNA, 13 bp, Homo sapiens
gtctaaaacaata

SEQ ID NO: 3515248 - DNA, 10 bp, Homo sapiens
gtctaaactg

SEQ ID NO: 3515249 - DNA, 14 bp, Homo sapiens
gtctagagagggag

SEQ ID NO: 3515250 - DNA, 17 bp, Homo sapiens
gtctagagcctcttggg

SEQ ID NO: 3515251 - DNA, 17 bp, Homo sapiens
gtctatgttcaaagact

SEQ ID NO: 3515252 - DNA, 16 bp, Homo sapiens
gtctattccattccct

SEQ ID NO: 3515253 - DNA, 12 bp, Homo sapiens
gtctcaatgctc

SEQ ID NO: 3515254 - DNA, 17 bp, Homo sapiens
gtctcaatgctcataac

SEQ ID NO: 3515255 - DNA, 23 bp, Homo sapiens
gtctcacagtgttgcccaggctg

SEQ ID NO: 3515256 - DNA, 16 bp, Homo sapiens
gtctcactctgtcgcc

SEQ ID NO: 3515257 - DNA, 19 bp, Homo sapiens
gtctcactctgtcgcccag

SEQ ID NO: 3515258 - DNA, 13 bp, Homo sapiens
gtctcagcctccc

SEQ ID NO: 3515259 - DNA, 16 bp, Homo sapiens
gtctcaggagtctctg

SEQ ID NO: 3515260 - DNA, 17 bp, Homo sapiens
gtctcaggagtctctgg

SEQ ID NO: 3515261 - DNA, 19 bp, Homo sapiens
gtctcataggttgagcaat

SEQ ID NO: 3515262 - DNA, 16 bp, Homo sapiens
gtctcatccatcatca

SEQ ID NO: 3515263 - DNA, 19 bp, Homo sapiens
gtctcattccgttgtctgt

SEQ ID NO: 3515264 - DNA, 22 bp, Homo sapiens
gtctccaaccccccagcactga

SEQ ID NO: 3515265 - DNA, 16 bp, Homo sapiens
gtctccaccaggaacc

SEQ ID NO: 3515266 - DNA, 19 bp, Homo sapiens
gtctccaccaggaacctct

SEQ ID NO: 3515267 - DNA, 20 bp, Homo sapiens
gtctccaggggctgcttcct

SEQ ID NO: 3515268 - DNA, 22 bp, Homo sapiens
gtctccaggggctgcttcctcc

SEQ ID NO: 3515269 - DNA, 15 bp, Homo sapiens
gtctcctctcagccc

SEQ ID NO: 3515270 - DNA, 16 bp, Homo sapiens
gtctccttaacactga

SEQ ID NO: 3515271 - DNA, 20 bp, Homo sapiens
gtctcctttcaccccagggc

SEQ ID NO: 3515272 - DNA, 16 bp, Homo sapiens
gtctcgctttgttgcc

SEQ ID NO: 3515273 - DNA, 13 bp, Homo sapiens
gtctctccactgc

SEQ ID NO: 3515274 - DNA, 14 bp, Homo sapiens
gtctctccactgct

SEQ ID NO: 3515275 - DNA, 19 bp, Homo sapiens
gtctctccactgctctcag

SEQ ID NO: 3515276 - DNA, 23 bp, Homo sapiens
gtctctccactgctctcagcctc

SEQ ID NO: 3515277 - DNA, 21 bp, Homo sapiens
gtctctgcatttttctgcaga

SEQ ID NO: 3515278 - DNA, 15 bp, Homo sapiens
gtctctgctggccca

SEQ ID NO: 3515279 - DNA, 20 bp, Homo sapiens
gtctctgctggcccagccaa

SEQ ID NO: 3515280 - DNA, 19 bp, Homo sapiens
gtctctgggccacttggag

SEQ ID NO: 3515281 - DNA, 20 bp, Homo sapiens
gtctctgggccacttggagt

SEQ ID NO: 3515282 - DNA, 22 bp, Homo sapiens
gtctcttcatgtctattccatt

SEQ ID NO: 3515283 - DNA, 18 bp, Homo sapiens
gtctctttaatgtcacag

SEQ ID NO: 3515284 - DNA, 23 bp, Homo sapiens
gtctctttaatgtcacaggcagg

SEQ ID NO: 3515285 - DNA, 17 bp, Homo sapiens
gtctctttattttacta

SEQ ID NO: 3515286 - DNA, 22 bp, Homo sapiens
gtctctttcatgagtttttccc

SEQ ID NO: 3515287 - DNA, 14 bp, Homo sapiens
gtctgacaggcaat

SEQ ID NO: 3515288 - DNA, 18 bp, Homo sapiens
gtctgacaggcaatgctg

SEQ ID NO: 3515289 - DNA, 23 bp, Homo sapiens
gtctgacaggcaatgctggctgt

SEQ ID NO: 3515290 - DNA, 13 bp, Homo sapiens
gtctgacccactg

SEQ ID NO: 3515291 - DNA, 14 bp, Homo sapiens
gtctgacccactgc

SEQ ID NO: 3515292 - DNA, 15 bp, Homo sapiens
gtctgacccactgct

SEQ ID NO: 3515293 - DNA, 17 bp, Homo sapiens
gtctgagtctatgttca

SEQ ID NO: 3515294 - DNA, 14 bp, Homo sapiens
gtctgagtgaacct

SEQ ID NO: 3515295 - DNA, 18 bp, Homo sapiens
gtctgattcccaagctct

SEQ ID NO: 3515296 - DNA, 21 bp, Homo sapiens
gtctgcaaaatgaggaatgta

SEQ ID NO: 3515297 - DNA, 12 bp, Homo sapiens
gtctgcagccct

SEQ ID NO: 3515298 - DNA, 13 bp, Homo sapiens
gtctgcagccctg

SEQ ID NO: 3515299 - DNA, 15 bp, Homo sapiens
gtctgcagccctgag

SEQ ID NO: 3515300 - DNA, 13 bp, Homo sapiens
gtctgcaggcagg

SEQ ID NO: 3515301 - DNA, 21 bp, Homo sapiens
gtctgcatttcggtggctagt

SEQ ID NO: 3515302 - DNA, 15 bp, Homo sapiens
gtctgccccacatgt

SEQ ID NO: 3515303 - DNA, 17 bp, Homo sapiens
gtctgccccacatgtgg

SEQ ID NO: 3515304 - DNA, 16 bp, Homo sapiens
gtctgctatcattatt

SEQ ID NO: 3515305 - DNA, 17 bp, Homo sapiens
gtctgctcctttcccct

SEQ ID NO: 3515306 - DNA, 21 bp, Homo sapiens
gtctgctctagatgagctggg

SEQ ID NO: 3515307 - DNA, 17 bp, Homo sapiens
gtctgggagtcaggccc

SEQ ID NO: 3515308 - DNA, 18 bp, Homo sapiens
gtctgggagtcaggcccg

SEQ ID NO: 3515309 - DNA, 14 bp, Homo sapiens
gtctggtcagagcc

SEQ ID NO: 3515310 - DNA, 18 bp, Homo sapiens
gtctggtcagagccacag

SEQ ID NO: 3515311 - DNA, 11 bp, Homo sapiens
gtctgtaaaat

SEQ ID NO: 3515312 - DNA, 16 bp, Homo sapiens
gtctgtcgtgatgggg

SEQ ID NO: 3515313 - DNA, 23 bp, Homo sapiens
gtctgttaggtgtacatcctgca

SEQ ID NO: 3515314 - DNA, 11 bp, Homo sapiens
gtctgttgagt

SEQ ID NO: 3515315 - DNA, 16 bp, Homo sapiens
gtctgttggcaggctg

SEQ ID NO: 3515316 - DNA, 18 bp, Homo sapiens
gtctgttggcaggctggc

SEQ ID NO: 3515317 - DNA, 21 bp, Homo sapiens
gtctgttggcaggctggccag

SEQ ID NO: 3515318 - DNA, 22 bp, Homo sapiens
gtctgttggcaggctggccagt

SEQ ID NO: 3515319 - DNA, 11 bp, Homo sapiens
gtctgtttctg

SEQ ID NO: 3515320 - DNA, 14 bp, Homo sapiens
gtcttaatgaagtt

SEQ ID NO: 3515321 - DNA, 16 bp, Homo sapiens
gtcttaatgaagtttg

SEQ ID NO: 3515322 - DNA, 20 bp, Homo sapiens
gtcttaatttctatcttgtt

SEQ ID NO: 3515323 - DNA, 15 bp, Homo sapiens
gtcttatcaagcagc

SEQ ID NO: 3515324 - DNA, 20 bp, Homo sapiens
gtcttcacctgattcaacta

SEQ ID NO: 3515325 - DNA, 15 bp, Homo sapiens
gtcttccacaaagaa

SEQ ID NO: 3515326 - DNA, 21 bp, Homo sapiens
gtcttcctctgcaagtgctca

SEQ ID NO: 3515327 - DNA, 15 bp, Homo sapiens
gtcttgaagtcctgg

SEQ ID NO: 3515328 - DNA, 16 bp, Homo sapiens
gtcttgcaatggcagc

SEQ ID NO: 3515329 - DNA, 20 bp, Homo sapiens
gtcttgcaatggcagccttg

SEQ ID NO: 3515330 - DNA, 20 bp, Homo sapiens
gtcttgggcagagctggctc

SEQ ID NO: 3515331 - DNA, 22 bp, Homo sapiens
gtcttgggcagagctggctctg

SEQ ID NO: 3515332 - DNA, 17 bp, Homo sapiens
gtcttgttcattttgag

SEQ ID NO: 3515333 - DNA, 16 bp, Homo sapiens
gtcttgttctgtcact

SEQ ID NO: 3515334 - DNA, 16 bp, Homo sapiens
gtctttcagtactttt

SEQ ID NO: 3515335 - DNA, 18 bp, Homo sapiens
gtctttccacggagccac

SEQ ID NO: 3515336 - DNA, 14 bp, Homo sapiens
gtcttttgcttttg

SEQ ID NO: 3515337 - DNA, 15 bp, Homo sapiens
gtctttttaaaaata

SEQ ID NO: 3515338 - DNA, 15 bp, Homo sapiens
gtctttttcgccaaa

SEQ ID NO: 3515339 - DNA, 15 bp, Homo sapiens
gtgaaaacggagctg

SEQ ID NO: 3515340 - DNA, 15 bp, Homo sapiens
gtgaaaatggtccag

SEQ ID NO: 3515341 - DNA, 17 bp, Homo sapiens
gtgaaatagttcaaagc

SEQ ID NO: 3515342 - DNA, 14 bp, Homo sapiens
gtgaaatgaagcaa

SEQ ID NO: 3515343 - DNA, 17 bp, Homo sapiens
gtgaacaaagcagccac

SEQ ID NO: 3515344 - DNA, 15 bp, Homo sapiens
gtgaaccatgtcagc

SEQ ID NO: 3515345 - DNA, 14 bp, Homo sapiens
gtgaacgatttaga

SEQ ID NO: 3515346 - DNA, 16 bp, Homo sapiens
gtgaacgatttagaaa

SEQ ID NO: 3515347 - DNA, 17 bp, Homo sapiens
gtgaacttgggccactg

SEQ ID NO: 3515348 - DNA, 19 bp, Homo sapiens
gtgaacttgggccactgtg

SEQ ID NO: 3515349 - DNA, 18 bp, Homo sapiens
gtgaagacacctgcagcc

SEQ ID NO: 3515350 - DNA, 20 bp, Homo sapiens
gttcctgttcagtaataaaa

SEQ ID NO: 3515351 - DNA, 20 bp, Homo sapiens
gttcgagaccagcctggcca

SEQ ID NO: 3515352 - DNA, 13 bp, Homo sapiens
gttcgcagagctt

SEQ ID NO: 3515353 - DNA, 17 bp, Homo sapiens
gttctaagtctttccat

SEQ ID NO: 3515354 - DNA, 21 bp, Homo sapiens
gttctccgttagctcctgtgg

SEQ ID NO: 3515355 - DNA, 23 bp, Homo sapiens
gttctccgttagctcctgtggcc

SEQ ID NO: 3515356 - DNA, 17 bp, Homo sapiens
gttctctatcatttaat

SEQ ID NO: 3515357 - DNA, 18 bp, Homo sapiens
gttctctatcatttaata

SEQ ID NO: 3515358 - DNA, 15 bp, Homo sapiens
gttctctcttctcca

SEQ ID NO: 3515359 - DNA, 16 bp, Homo sapiens
gttctctgaggacact

SEQ ID NO: 3515360 - DNA, 12 bp, Homo sapiens
gttctctgggag

SEQ ID NO: 3515361 - DNA, 13 bp, Homo sapiens
gttctctgggaga

SEQ ID NO: 3515362 - DNA, 15 bp, Homo sapiens
gttctctgggagaaa

SEQ ID NO: 3515363 - DNA, 18 bp, Homo sapiens
gttctgatgatgtgcctg

SEQ ID NO: 3515364 - DNA, 13 bp, Homo sapiens
gttctgcctgcca

SEQ ID NO: 3515365 - DNA, 19 bp, Homo sapiens
gttctgcctgccagctgca

SEQ ID NO: 3515366 - DNA, 18 bp, Homo sapiens
gttctgctcatcattctc

SEQ ID NO: 3515367 - DNA, 15 bp, Homo sapiens
gttctgggacacagt

SEQ ID NO: 3515368 - DNA, 16 bp, Homo sapiens
gttctgggacacagtt

SEQ ID NO: 3515369 - DNA, 15 bp, Homo sapiens
gttctgggactccag

SEQ ID NO: 3515370 - DNA, 22 bp, Homo sapiens
gttctgtagaaatggttgtatt

SEQ ID NO: 3515371 - DNA, 18 bp, Homo sapiens
gttctgtttgttattgtt

SEQ ID NO: 3515372 - DNA, 20 bp, Homo sapiens
gttcttaaccagatggttgt

SEQ ID NO: 3515373 - DNA, 21 bp, Homo sapiens
gttcttaggctccatcctgtt

SEQ ID NO: 3515374 - DNA, 23 bp, Homo sapiens
gttctttaaaatgtaaagccatg

SEQ ID NO: 3515375 - DNA, 17 bp, Homo sapiens
gttctttagatggtggc

SEQ ID NO: 3515376 - DNA, 22 bp, Homo sapiens
gttctttgggccagacatgcca

SEQ ID NO: 3515377 - DNA, 15 bp, Homo sapiens
gttctttttaagtta

SEQ ID NO: 3515378 - DNA, 13 bp, Homo sapiens
gttgaatactttt

SEQ ID NO: 3515379 - DNA, 17 bp, Homo sapiens
gttgacatatttaatgt

SEQ ID NO: 3515380 - DNA, 20 bp, Homo sapiens
gttgacatatttaatgtttt

SEQ ID NO: 3515381 - DNA, 23 bp, Homo sapiens
gttgacatatttaatgttttaaa

SEQ ID NO: 3515382 - DNA, 20 bp, Homo sapiens
gttgaccctattttttgaca

SEQ ID NO: 3515383 - DNA, 15 bp, Homo sapiens
gttgagaaggtgcct

SEQ ID NO: 3515384 - DNA, 17 bp, Homo sapiens
gttgagaaggtgcctgc

SEQ ID NO: 3515385 - DNA, 24 bp, Homo sapiens
gttgagctctcggaactgcatgct

SEQ ID NO: 3515386 - DNA, 21 bp, Homo sapiens
gttgagttcaggtagctgccc

SEQ ID NO: 3515387 - DNA, 16 bp, Homo sapiens
gttgatctggaaccca

SEQ ID NO: 3515388 - DNA, 17 bp, Homo sapiens
gttgatgttggctggga

SEQ ID NO: 3515389 - DNA, 23 bp, Homo sapiens
gttgattcggtatccccccatct

SEQ ID NO: 3515390 - DNA, 15 bp, Homo sapiens
gttgcagacaggaat

SEQ ID NO: 3515391 - DNA, 18 bp, Homo sapiens
gttgccaagctccaagcc

SEQ ID NO: 3515392 - DNA, 14 bp, Homo sapiens
gttgccacaggaca

SEQ ID NO: 3515393 - DNA, 15 bp, Homo sapiens
gttgccattattcta

SEQ ID NO: 3515394 - DNA, 19 bp, Homo sapiens
gttgccattattctatgta

SEQ ID NO: 3515395 - DNA, 14 bp, Homo sapiens
gttgcccaggcagg

SEQ ID NO: 3515396 - DNA, 18 bp, Homo sapiens
gttgcccaggcaggtctt

SEQ ID NO: 3515397 - DNA, 16 bp, Homo sapiens
gttgcccaggctggcg

SEQ ID NO: 3515398 - DNA, 17 bp, Homo sapiens
gttgcccaggctggcgt

SEQ ID NO: 3515399 - DNA, 21 bp, Homo sapiens
gttgcccaggctggcgtgcag

SEQ ID NO: 3515400 - DNA, 20 bp, Homo sapiens
gttgctctaggaagacattt

SEQ ID NO: 3515401 - DNA, 20 bp, Homo sapiens
gttgctgctgtccagtgcct

SEQ ID NO: 3515402 - DNA, 15 bp, Homo sapiens
gttgctgtttcacaa

SEQ ID NO: 3515403 - DNA, 17 bp, Homo sapiens
gttgctgttttcctccc

SEQ ID NO: 3515404 - DNA, 18 bp, Homo sapiens
gttgctgttttcctccct

SEQ ID NO: 3515405 - DNA, 23 bp, Homo sapiens
gttgctgttttcctcccttctgc

SEQ ID NO: 3515406 - DNA, 15 bp, Homo sapiens
gttgctttcactctc

SEQ ID NO: 3515407 - DNA, 18 bp, Homo sapiens
gttggaactatgcagtgt

SEQ ID NO: 3515408 - DNA, 23 bp, Homo sapiens
gttggaggagagagccttgggag

SEQ ID NO: 3515409 - DNA, 21 bp, Homo sapiens
gttggatccgtttgaccaatt

SEQ ID NO: 3515410 - DNA, 22 bp, Homo sapiens
gttggatggatgggtggatggc

SEQ ID NO: 3515411 - DNA, 14 bp, Homo sapiens
gttggcaggctggc

SEQ ID NO: 3515412 - DNA, 20 bp, Homo sapiens
gttggcaggctggccagtcc

SEQ ID NO: 3515413 - DNA, 15 bp, Homo sapiens
gttggccaggctggt

SEQ ID NO: 3515414 - DNA, 17 bp, Homo sapiens
gttggccaggctggtct

SEQ ID NO: 3515415 - DNA, 14 bp, Homo sapiens
gttggccagtgtga

SEQ ID NO: 3515416 - DNA, 13 bp, Homo sapiens
gttggcccctgcc

SEQ ID NO: 3515417 - DNA, 14 bp, Homo sapiens
gttggcccctgccc

SEQ ID NO: 3515418 - DNA, 20 bp, Homo sapiens
gttggcccctgcccggctgc

SEQ ID NO: 3515419 - DNA, 13 bp, Homo sapiens
gttggctggcctt

SEQ ID NO: 3515420 - DNA, 17 bp, Homo sapiens
gttggctgggaactcac

SEQ ID NO: 3515421 - DNA, 18 bp, Homo sapiens
gttgggaacagcatggag

SEQ ID NO: 3515422 - DNA, 15 bp, Homo sapiens
gttgggctggtgtca

SEQ ID NO: 3515423 - DNA, 17 bp, Homo sapiens
gttgggctggtgtcacc

SEQ ID NO: 3515424 - DNA, 18 bp, Homo sapiens
gttgtaaatatataaata

SEQ ID NO: 3515425 - DNA, 15 bp, Homo sapiens
gttgtacaatcatgt

SEQ ID NO: 3515426 - DNA, 19 bp, Homo sapiens
gttgtacaatcatgttctg

SEQ ID NO: 3515427 - DNA, 12 bp, Homo sapiens
gttgtacatgaa

SEQ ID NO: 3515428 - DNA, 14 bp, Homo sapiens
gttgtacatgaaat

SEQ ID NO: 3515429 - DNA, 23 bp, Homo sapiens
gttgtatacttccttatgcttct

SEQ ID NO: 3515430 - DNA, 16 bp, Homo sapiens
gttgtcaaagagaggg

SEQ ID NO: 3515431 - DNA, 16 bp, Homo sapiens
gttgtcactgcttttg

SEQ ID NO: 3515432 - DNA, 14 bp, Homo sapiens
gttgtccaactatt

SEQ ID NO: 3515433 - DNA, 13 bp, Homo sapiens
gttgtgaatgttc

SEQ ID NO: 3515434 - DNA, 20 bp, Homo sapiens
gttgttactaactaaactct

SEQ ID NO: 3515435 - DNA, 14 bp, Homo sapiens
gtttaaaaatacac

SEQ ID NO: 3515436 - DNA, 18 bp, Homo sapiens
gtttaaaaatacacatgg

SEQ ID NO: 3515437 - DNA, 16 bp, Homo sapiens
gtttaaaaatcaactt

SEQ ID NO: 3515438 - DNA, 21 bp, Homo sapiens
gtttaatgcaagagaacattt

SEQ ID NO: 3515439 - DNA, 22 bp, Homo sapiens
gtttaatgcaagagaacatttt

SEQ ID NO: 3515440 - DNA, 20 bp, Homo sapiens
gtttacaaatggacatagga

SEQ ID NO: 3515441 - DNA, 19 bp, Homo sapiens
gtttacaagcccccccttc

SEQ ID NO: 3515442 - DNA, 14 bp, Homo sapiens
gtttacaggatatt

SEQ ID NO: 3515443 - DNA, 15 bp, Homo sapiens
gtttacagtgtctgt

SEQ ID NO: 3515444 - DNA, 16 bp, Homo sapiens
gtttacctgtgaaata

SEQ ID NO: 3515445 - DNA, 22 bp, Homo sapiens
gtttactagggatccctcatct

SEQ ID NO: 3515446 - DNA, 16 bp, Homo sapiens
gtttactatgcctgtg

SEQ ID NO: 3515447 - DNA, 18 bp, Homo sapiens
gtttatcaactcaagaat

SEQ ID NO: 3515448 - DNA, 21 bp, Homo sapiens
gtttatgagatgctggttttc

SEQ ID NO: 3515449 - DNA, 22 bp, Homo sapiens
gtttattaaaattctgaatttt

SEQ ID NO: 3515450 - DNA, 20 bp, Homo sapiens
gtttatttccactattttca

SEQ ID NO: 3515451 - DNA, 20 bp, Homo sapiens
gtttcaaaaccatgcctggt

SEQ ID NO: 3515452 - DNA, 17 bp, Homo sapiens
gtttcaattgcatctcc

SEQ ID NO: 3515453 - DNA, 19 bp, Homo sapiens
gtttcacaaggtctttaaa

SEQ ID NO: 3515454 - DNA, 22 bp, Homo sapiens
gtttcaccatgatggccaggct

SEQ ID NO: 3515455 - DNA, 17 bp, Homo sapiens
gtttcagagatggacag

SEQ ID NO: 3515456 - DNA, 18 bp, Homo sapiens
gtttcagagatggacaga

SEQ ID NO: 3515457 - DNA, 10 bp, Homo sapiens
gtttcagttg

SEQ ID NO: 3515458 - DNA, 18 bp, Homo sapiens
gtttcctctagttctttg

SEQ ID NO: 3515459 - DNA, 22 bp, Homo sapiens
gtttcctctagttctttgttca

SEQ ID NO: 3515460 - DNA, 22 bp, Homo sapiens
gtttcctgaaacaacttggaaa

SEQ ID NO: 3515461 - DNA, 15 bp, Homo sapiens
gtttcctgacattgt

SEQ ID NO: 3515462 - DNA, 19 bp, Homo sapiens
gtttcctggcactggaccc

SEQ ID NO: 3515463 - DNA, 23 bp, Homo sapiens
gtttccttttctgtctctctctt

SEQ ID NO: 3515464 - DNA, 14 bp, Homo sapiens
gtttccttttttcc

SEQ ID NO: 3515465 - DNA, 20 bp, Homo sapiens
gtttctacctatatgcagtc

SEQ ID NO: 3515466 - DNA, 15 bp, Homo sapiens
gtttctagggaaatg

SEQ ID NO: 3515467 - DNA, 19 bp, Homo sapiens
gtttctatgtgtagggcgg

SEQ ID NO: 3515468 - DNA, 19 bp, Homo sapiens
gtttctcagaatccaaaga

SEQ ID NO: 3515469 - DNA, 20 bp, Homo sapiens
gtttctcagaatccaaagat

SEQ ID NO: 3515470 - DNA, 21 bp, Homo sapiens
gtttctggtggtctgttggca

SEQ ID NO: 3515471 - DNA, 17 bp, Homo sapiens
gtttcttttgtatgtaa

SEQ ID NO: 3515472 - DNA, 20 bp, Homo sapiens
gtttcttttgtatgtaaatg

SEQ ID NO: 3515473 - DNA, 11 bp, Homo sapiens
gtttgaaattc

SEQ ID NO: 3515474 - DNA, 15 bp, Homo sapiens
gtttgaagctgctgt

SEQ ID NO: 3515475 - DNA, 15 bp, Homo sapiens
gtttgaatgttaaat

SEQ ID NO: 3515476 - DNA, 19 bp, Homo sapiens
gtttgaccaatttgcacca

SEQ ID NO: 3515477 - DNA, 16 bp, Homo sapiens
gtttgactagatgatg

SEQ ID NO: 3515478 - DNA, 19 bp, Homo sapiens
gtttgactagatgatggat

SEQ ID NO: 3515479 - DNA, 17 bp, Homo sapiens
gtttgagatcagcctgg

SEQ ID NO: 3515480 - DNA, 14 bp, Homo sapiens
gtttgaggaatatt

SEQ ID NO: 3515481 - DNA, 17 bp, Homo sapiens
gtttgcctctgcctctg

SEQ ID NO: 3515482 - DNA, 18 bp, Homo sapiens
gtggttatggagagggtg

SEQ ID NO: 3515483 - DNA, 14 bp, Homo sapiens
gtggttgaagagca

SEQ ID NO: 3515484 - DNA, 20 bp, Homo sapiens
gtggttgctgttttcctccc

SEQ ID NO: 3515485 - DNA, 19 bp, Homo sapiens
gtgtaaatagttactccag

SEQ ID NO: 3515486 - DNA, 14 bp, Homo sapiens
gtgtaatatgaaat

SEQ ID NO: 3515487 - DNA, 23 bp, Homo sapiens
gtgtaattttgttctagttttca

SEQ ID NO: 3515488 - DNA, 21 bp, Homo sapiens
gtgtacctcctctcagtgttt

SEQ ID NO: 3515489 - DNA, 12 bp, Homo sapiens
gtgtaggcagac

SEQ ID NO: 3515490 - DNA, 16 bp, Homo sapiens
gtgtaggcctgcctta

SEQ ID NO: 3515491 - DNA, 19 bp, Homo sapiens
gtgtatgagtgtgaatgat

SEQ ID NO: 3515492 - DNA, 15 bp, Homo sapiens
gtgtatgggtagcac

SEQ ID NO: 3515493 - DNA, 17 bp, Homo sapiens
gtgtatttacgctttga

SEQ ID NO: 3515494 - DNA, 14 bp, Homo sapiens
gtgtcacctgtgct

SEQ ID NO: 3515495 - DNA, 15 bp, Homo sapiens
gtgtcactcaaggcg

SEQ ID NO: 3515496 - DNA, 16 bp, Homo sapiens
gtgtcagcatagaagt

SEQ ID NO: 3515497 - DNA, 12 bp, Homo sapiens
gtgtcagccatt

SEQ ID NO: 3515498 - DNA, 18 bp, Homo sapiens
gtgtcaggtggggcagct

SEQ ID NO: 3515499 - DNA, 20 bp, Homo sapiens
gtgtcaggtggggcagcttg

SEQ ID NO: 3515500 - DNA, 20 bp, Homo sapiens
gtgtcagtggggctctctga

SEQ ID NO: 3515501 - DNA, 20 bp, Homo sapiens
gtgtcatctaattaagggaa

SEQ ID NO: 3515502 - DNA, 13 bp, Homo sapiens
gtgtccaaagcag

SEQ ID NO: 3515503 - DNA, 21 bp, Homo sapiens
gtgtccatgcgctcagggcca

SEQ ID NO: 3515504 - DNA, 14 bp, Homo sapiens
gtgtccccctctgt

SEQ ID NO: 3515505 - DNA, 18 bp, Homo sapiens
gtgtccccctctgtccag

SEQ ID NO: 3515506 - DNA, 16 bp, Homo sapiens
gtgtccctgcacttgc

SEQ ID NO: 3515507 - DNA, 14 bp, Homo sapiens
gtgtccggtccctg

SEQ ID NO: 3515508 - DNA, 16 bp, Homo sapiens
gtgtccttagaacatt

SEQ ID NO: 3515509 - DNA, 21 bp, Homo sapiens
gtgtctcggagggattcccct

SEQ ID NO: 3515510 - DNA, 20 bp, Homo sapiens
gtgtctggatgatgctgtgc

SEQ ID NO: 3515511 - DNA, 20 bp, Homo sapiens
gtgtcttctccaccacgctg

SEQ ID NO: 3515512 - DNA, 17 bp, Homo sapiens
gtgtcttgggcagagct

SEQ ID NO: 3515513 - DNA, 18 bp, Homo sapiens
gtgtgacatttggagagg

SEQ ID NO: 3515514 - DNA, 17 bp, Homo sapiens
gtgtgactactccccca

SEQ ID NO: 3515515 - DNA, 21 bp, Homo sapiens
gtgtgagaagtgaatgctggg

SEQ ID NO: 3515516 - DNA, 18 bp, Homo sapiens
gtgtgagtcaccaagccc

SEQ ID NO: 3515517 - DNA, 23 bp, Homo sapiens
gtgtgattgacagctttgctgct

SEQ ID NO: 3515518 - DNA, 17 bp, Homo sapiens
gtgtgcactaaggggcc

SEQ ID NO: 3515519 - DNA, 20 bp, Homo sapiens
gtgtgcctgactgcccagca

SEQ ID NO: 3515520 - DNA, 23 bp, Homo sapiens
gtgtgccttccagatcctctctg

SEQ ID NO: 3515521 - DNA, 15 bp, Homo sapiens
gtgtgctctgcttca

SEQ ID NO: 3515522 - DNA, 19 bp, Homo sapiens
gtgtgctgggagctccact

SEQ ID NO: 3515523 - DNA, 17 bp, Homo sapiens
gtgtggagagagaggct

SEQ ID NO: 3515524 - DNA, 15 bp, Homo sapiens
gtgtggccacttctg

SEQ ID NO: 3515525 - DNA, 14 bp, Homo sapiens
gtgtgggacaggct

SEQ ID NO: 3515526 - DNA, 17 bp, Homo sapiens
gtgtgggtacctgtatt

SEQ ID NO: 3515527 - DNA, 23 bp, Homo sapiens
gtgtgggtgtcctgcctgtctgc

SEQ ID NO: 3515528 - DNA, 13 bp, Homo sapiens
gtgtggtgcagtg

SEQ ID NO: 3515529 - DNA, 18 bp, Homo sapiens
gtgtggtgcagtgtgaaa

SEQ ID NO: 3515530 - DNA, 16 bp, Homo sapiens
gtgtgtaattgttcct

SEQ ID NO: 3515531 - DNA, 20 bp, Homo sapiens
gtgtgtattaaaaaaaacaa

SEQ ID NO: 3515532 - DNA, 20 bp, Homo sapiens
gtgtgtccacgactgtctcc

SEQ ID NO: 3515533 - DNA, 21 bp, Homo sapiens
gtgtgtgcgcctacaggagtg

SEQ ID NO: 3515534 - DNA, 15 bp, Homo sapiens
gtgtgtgtgtcagct

SEQ ID NO: 3515535 - DNA, 12 bp, Homo sapiens
gtgtgtgtgtga

SEQ ID NO: 3515536 - DNA, 14 bp, Homo sapiens
gtgtgtgtgtgtgt

SEQ ID NO: 3515537 - DNA, 14 bp, Homo sapiens
gtgtgttgtctctt

SEQ ID NO: 3515538 - DNA, 21 bp, Homo sapiens
gtgttaaatgtgatgaatact

SEQ ID NO: 3515539 - DNA, 14 bp, Homo sapiens
gtgttacccactgc

SEQ ID NO: 3515540 - DNA, 16 bp, Homo sapiens
gtgttacctgtgtgct

SEQ ID NO: 3515541 - DNA, 18 bp, Homo sapiens
gtgttccccttccactga

SEQ ID NO: 3515542 - DNA, 23 bp, Homo sapiens
gtgttccccttccactgagggca

SEQ ID NO: 3515543 - DNA, 19 bp, Homo sapiens
gtgttcctggcagtttaaa

SEQ ID NO: 3515544 - DNA, 23 bp, Homo sapiens
gtgttctgtttgttattgttttg

SEQ ID NO: 3515545 - DNA, 12 bp, Homo sapiens
gtgttggacagg

SEQ ID NO: 3515546 - DNA, 19 bp, Homo sapiens
gtgtttattaaaattctga

SEQ ID NO: 3515547 - DNA, 11 bp, Homo sapiens
gtgtttctagg

SEQ ID NO: 3515548 - DNA, 15 bp, Homo sapiens
gtgtttctagggaaa

SEQ ID NO: 3515549 - DNA, 19 bp, Homo sapiens
gtgtttctatgagtggaaa

SEQ ID NO: 3515550 - DNA, 18 bp, Homo sapiens
gtgtttctgtaagaaacc

SEQ ID NO: 3515551 - DNA, 14 bp, Homo sapiens
gtgtttggctttca

SEQ ID NO: 3515552 - DNA, 16 bp, Homo sapiens
gtgttttatttcctat

SEQ ID NO: 3515553 - DNA, 16 bp, Homo sapiens
gtgttttgtttattaa

SEQ ID NO: 3515554 - DNA, 15 bp, Homo sapiens
gttaaactagcatat

SEQ ID NO: 3515555 - DNA, 19 bp, Homo sapiens
gttaaactagcatatctgc

SEQ ID NO: 3515556 - DNA, 21 bp, Homo sapiens
gttaaactagcatatctgcct

SEQ ID NO: 3515557 - DNA, 22 bp, Homo sapiens
gttaaactagcatatctgcctt

SEQ ID NO: 3515558 - DNA, 13 bp, Homo sapiens
gttaaataaattg

SEQ ID NO: 3515559 - DNA, 21 bp, Homo sapiens
gttaaataaattgtatattca

SEQ ID NO: 3515560 - DNA, 21 bp, Homo sapiens
gttaaatagagtatatgcact

SEQ ID NO: 3515561 - DNA, 23 bp, Homo sapiens
gttaacccatttttgagccaagc

SEQ ID NO: 3515562 - DNA, 20 bp, Homo sapiens
gttaacgtattagttgccaa

SEQ ID NO: 3515563 - DNA, 14 bp, Homo sapiens
gttaacgtcatctc

SEQ ID NO: 3515564 - DNA, 22 bp, Homo sapiens
gttaagacatgatttccttgaa

SEQ ID NO: 3515565 - DNA, 14 bp, Homo sapiens
gttaagccctggca

SEQ ID NO: 3515566 - DNA, 17 bp, Homo sapiens
gttaagcttctattttt

SEQ ID NO: 3515567 - DNA, 14 bp, Homo sapiens
gttaaggaatataa

SEQ ID NO: 3515568 - DNA, 11 bp, Homo sapiens
gttaaggcctg

SEQ ID NO: 3515569 - DNA, 17 bp, Homo sapiens
gttaagtcctccctgac

SEQ ID NO: 3515570 - DNA, 18 bp, Homo sapiens
gttaataaagatgattga

SEQ ID NO: 3515571 - DNA, 21 bp, Homo sapiens
gttaatattaaaaagtctgta

SEQ ID NO: 3515572 - DNA, 15 bp, Homo sapiens
gttaatatttaacct

SEQ ID NO: 3515573 - DNA, 13 bp, Homo sapiens
gttaatattttgt

SEQ ID NO: 3515574 - DNA, 15 bp, Homo sapiens
gttaatgttatatca

SEQ ID NO: 3515575 - DNA, 23 bp, Homo sapiens
gttaatgttatatcatatgtata

SEQ ID NO: 3515576 - DNA, 15 bp, Homo sapiens
gttaatttttacatg

SEQ ID NO: 3515577 - DNA, 20 bp, Homo sapiens
gttaattttttggtacaaaa

SEQ ID NO: 3515578 - DNA, 21 bp, Homo sapiens
gttacacactttttaagaaat

SEQ ID NO: 3515579 - DNA, 22 bp, Homo sapiens
gttacacagaaatgctgctggc

SEQ ID NO: 3515580 - DNA, 15 bp, Homo sapiens
gttacagcacaaaat

SEQ ID NO: 3515581 - DNA, 12 bp, Homo sapiens
gttacatcttgt

SEQ ID NO: 3515582 - DNA, 17 bp, Homo sapiens
gttacccactgccatgc

SEQ ID NO: 3515583 - DNA, 14 bp, Homo sapiens
gttacctgtgtgct

SEQ ID NO: 3515584 - DNA, 14 bp, Homo sapiens
gttactgccttaat

SEQ ID NO: 3515585 - DNA, 21 bp, Homo sapiens
gttactgccttaataaaaaat

SEQ ID NO: 3515586 - DNA, 13 bp, Homo sapiens
gttactgtaattc

SEQ ID NO: 3515587 - DNA, 16 bp, Homo sapiens
gttagctcctgtggcc

SEQ ID NO: 3515588 - DNA, 20 bp, Homo sapiens
gttagctcctgtggccccac

SEQ ID NO: 3515589 - DNA, 13 bp, Homo sapiens
gttaggcctggct

SEQ ID NO: 3515590 - DNA, 18 bp, Homo sapiens
gttaggtagagggagttg

SEQ ID NO: 3515591 - DNA, 23 bp, Homo sapiens
gttagtaacatgaggggacattt

SEQ ID NO: 3515592 - DNA, 14 bp, Homo sapiens
gttatatgaatata

SEQ ID NO: 3515593 - DNA, 20 bp, Homo sapiens
gttatcaccgtgggctccct

SEQ ID NO: 3515594 - DNA, 15 bp, Homo sapiens
gttatctaaaagaaa

SEQ ID NO: 3515595 - DNA, 16 bp, Homo sapiens
gttatctaaaagaaat

SEQ ID NO: 3515596 - DNA, 21 bp, Homo sapiens
gttatgtaaaaggccaaacct

SEQ ID NO: 3515597 - DNA, 22 bp, Homo sapiens
gttattagagattacctcctga

SEQ ID NO: 3515598 - DNA, 15 bp, Homo sapiens
gttattatatttgac

SEQ ID NO: 3515599 - DNA, 23 bp, Homo sapiens
gttatttaacagctgaattatct

SEQ ID NO: 3515600 - DNA, 13 bp, Homo sapiens
gttattttccagg

SEQ ID NO: 3515601 - DNA, 13 bp, Homo sapiens
gttcaaagactgt

SEQ ID NO: 3515602 - DNA, 16 bp, Homo sapiens
gttcaaagactgtgaa

SEQ ID NO: 3515603 - DNA, 19 bp, Homo sapiens
gttcaaagactgtgaacag

SEQ ID NO: 3515604 - DNA, 13 bp, Homo sapiens
gttcaaagccagc

SEQ ID NO: 3515605 - DNA, 14 bp, Homo sapiens
gttcaagccttcca

SEQ ID NO: 3515606 - DNA, 19 bp, Homo sapiens
gttcaaggccatccttccc

SEQ ID NO: 3515607 - DNA, 19 bp, Homo sapiens
gttcaagttttcagcttta

SEQ ID NO: 3515608 - DNA, 23 bp, Homo sapiens
gttcaataaagcactgagcaagt

SEQ ID NO: 3515609 - DNA, 13 bp, Homo sapiens
gttcacagacata

SEQ ID NO: 3515610 - DNA, 15 bp, Homo sapiens
gttcacctttgtagc

SEQ ID NO: 3515611 - DNA, 19 bp, Homo sapiens
gttcacgtgcagctcaagg

SEQ ID NO: 3515612 - DNA, 23 bp, Homo sapiens
gttcagatcttaatataaattca

SEQ ID NO: 3515613 - DNA, 18 bp, Homo sapiens
gttcagctccagctcacc

SEQ ID NO: 3515614 - DNA, 17 bp, Homo sapiens
gttcaggtaacaggcag

SEQ ID NO: 3515615 - DNA, 18 bp, Homo sapiens
gttcaggtaacaggcaga

SEQ ID NO: 3515616 - DNA, 23 bp, Homo sapiens
gttcagtactctacaattcctct

SEQ ID NO: 3515617 - DNA, 20 bp, Homo sapiens
gttcatcctggagaattgaa

SEQ ID NO: 3515618 - DNA, 19 bp, Homo sapiens
tacaactagatcaaggagc

SEQ ID NO: 3515619 - DNA, 18 bp, Homo sapiens
tacaactcaaaaaacatt

SEQ ID NO: 3515620 - DNA, 19 bp, Homo sapiens
tacaagatattatgtataa

SEQ ID NO: 3515621 - DNA, 21 bp, Homo sapiens
tacaagccattctaaggaaat

SEQ ID NO: 3515622 - DNA, 15 bp, Homo sapiens
tacaagccccccctt

SEQ ID NO: 3515623 - DNA, 18 bp, Homo sapiens
tacaaggttatgtagaga

SEQ ID NO: 3515624 - DNA, 14 bp, Homo sapiens
tacaataaattgct

SEQ ID NO: 3515625 - DNA, 23 bp, Homo sapiens
tacaataaattgctaatgttgct

SEQ ID NO: 3515626 - DNA, 13 bp, Homo sapiens
tacaataacataa

SEQ ID NO: 3515627 - DNA, 18 bp, Homo sapiens
tacaataatgtaatttag

SEQ ID NO: 3515628 - DNA, 20 bp, Homo sapiens
tacaataatgtaatttagtc

SEQ ID NO: 3515629 - DNA, 22 bp, Homo sapiens
tacaataatgtaatttagtcta

SEQ ID NO: 3515630 - DNA, 12 bp, Homo sapiens
tacaatcatgtt

SEQ ID NO: 3515631 - DNA, 15 bp, Homo sapiens
tacaatgtgaacttt

SEQ ID NO: 3515632 - DNA, 17 bp, Homo sapiens
tacaatgtgaactttat

SEQ ID NO: 3515633 - DNA, 22 bp, Homo sapiens
tacaatgttcatcccatgatgt

SEQ ID NO: 3515634 - DNA, 18 bp, Homo sapiens
tacaattctacattgtca

SEQ ID NO: 3515635 - DNA, 16 bp, Homo sapiens
tacaattgaaatgact

SEQ ID NO: 3515636 - DNA, 12 bp, Homo sapiens
tacaattttatc

SEQ ID NO: 3515637 - DNA, 23 bp, Homo sapiens
tacacaaatgatagcataacata

SEQ ID NO: 3515638 - DNA, 16 bp, Homo sapiens
tacacaagagctggag

SEQ ID NO: 3515639 - DNA, 17 bp, Homo sapiens
tacacagaaatgctgct

SEQ ID NO: 3515640 - DNA, 19 bp, Homo sapiens
tacacagaaatgctgctgg

SEQ ID NO: 3515641 - DNA, 23 bp, Homo sapiens
tacacagaaatgctgctggccaa

SEQ ID NO: 3515642 - DNA, 20 bp, Homo sapiens
tacacagggatgtacaaggc

SEQ ID NO: 3515643 - DNA, 17 bp, Homo sapiens
tacaccagcattccttt

SEQ ID NO: 3515644 - DNA, 20 bp, Homo sapiens
tacactgtatgttatagaac

SEQ ID NO: 3515645 - DNA, 16 bp, Homo sapiens
tacagaactctttcaa

SEQ ID NO: 3515646 - DNA, 19 bp, Homo sapiens
tacagaagattaagacaga

SEQ ID NO: 3515647 - DNA, 23 bp, Homo sapiens
tacagaattactgtaactgatta

SEQ ID NO: 3515648 - DNA, 22 bp, Homo sapiens
tacagacagagaatatgtctgc

SEQ ID NO: 3515649 - DNA, 13 bp, Homo sapiens
tacagacatattt

SEQ ID NO: 3515650 - DNA, 14 bp, Homo sapiens
tacagacatattta

SEQ ID NO: 3515651 - DNA, 18 bp, Homo sapiens
tacagacatatttaactg

SEQ ID NO: 3515652 - DNA, 19 bp, Homo sapiens
tacagacatatttaactgg

SEQ ID NO: 3515653 - DNA, 18 bp, Homo sapiens
tacagatgaatgtattta

SEQ ID NO: 3515654 - DNA, 22 bp, Homo sapiens
tacagatgaatgtatttatttg

SEQ ID NO: 3515655 - DNA, 15 bp, Homo sapiens
tacagattttgatag

SEQ ID NO: 3515656 - DNA, 22 bp, Homo sapiens
tacagattttgatagcaaagcg

SEQ ID NO: 3515657 - DNA, 23 bp, Homo sapiens
tacagattttgatagcaaagcga

SEQ ID NO: 3515658 - DNA, 18 bp, Homo sapiens
tacagcaacaggaatctc

SEQ ID NO: 3515659 - DNA, 21 bp, Homo sapiens
tacagctgggtggcactgcca

SEQ ID NO: 3515660 - DNA, 19 bp, Homo sapiens
tacagctttgatccctgac

SEQ ID NO: 3515661 - DNA, 18 bp, Homo sapiens
tacaggaaaagctgctga

SEQ ID NO: 3515662 - DNA, 19 bp, Homo sapiens
tacaggatattccaaaata

SEQ ID NO: 3515663 - DNA, 12 bp, Homo sapiens
tacaggctggcg

SEQ ID NO: 3515664 - DNA, 17 bp, Homo sapiens
tacaggggttctggaaa

SEQ ID NO: 3515665 - DNA, 16 bp, Homo sapiens
tacaggtgtgagtcac

SEQ ID NO: 3515666 - DNA, 17 bp, Homo sapiens
tacagtagattttccaa

SEQ ID NO: 3515667 - DNA, 14 bp, Homo sapiens
tacagtaggagccc

SEQ ID NO: 3515668 - DNA, 15 bp, Homo sapiens
tacagtatctcaggg

SEQ ID NO: 3515669 - DNA, 18 bp, Homo sapiens
tacagtatctcagggcct

SEQ ID NO: 3515670 - DNA, 15 bp, Homo sapiens
tacagtcttccacaa

SEQ ID NO: 3515671 - DNA, 20 bp, Homo sapiens
tacagtcttccatttgcaag

SEQ ID NO: 3515672 - DNA, 22 bp, Homo sapiens
tacagtcttccatttgcaaggg

SEQ ID NO: 3515673 - DNA, 17 bp, Homo sapiens
tacagtcttgcagcagg

SEQ ID NO: 3515674 - DNA, 17 bp, Homo sapiens
tacagtgtctgtgtgtg

SEQ ID NO: 3515675 - DNA, 19 bp, Homo sapiens
tacagttgaaataactgga

SEQ ID NO: 3515676 - DNA, 17 bp, Homo sapiens
tacagtttgtcacatga

SEQ ID NO: 3515677 - DNA, 14 bp, Homo sapiens
tacatacaccagca

SEQ ID NO: 3515678 - DNA, 16 bp, Homo sapiens
tacatacaccagcatt

SEQ ID NO: 3515679 - DNA, 12 bp, Homo sapiens
tacatacagaat

SEQ ID NO: 3515680 - DNA, 21 bp, Homo sapiens
tacatagtgcattgtttctgt

SEQ ID NO: 3515681 - DNA, 19 bp, Homo sapiens
tacatctattttggattgt

SEQ ID NO: 3515682 - DNA, 20 bp, Homo sapiens
tacatgaaatttttgtaaat

SEQ ID NO: 3515683 - DNA, 16 bp, Homo sapiens
tacatgacatttattt

SEQ ID NO: 3515684 - DNA, 18 bp, Homo sapiens
tacatgagaacaaacaga

SEQ ID NO: 3515685 - DNA, 20 bp, Homo sapiens
tacatgtaactatttcttca

SEQ ID NO: 3515686 - DNA, 20 bp, Homo sapiens
tacatgtataaagtgattga

SEQ ID NO: 3515687 - DNA, 14 bp, Homo sapiens
tacattcaaattct

SEQ ID NO: 3515688 - DNA, 16 bp, Homo sapiens
tacattcaaattcttt

SEQ ID NO: 3515689 - DNA, 18 bp, Homo sapiens
tacattcaaattcttttt

SEQ ID NO: 3515690 - DNA, 14 bp, Homo sapiens
tacattccaactcg

SEQ ID NO: 3515691 - DNA, 21 bp, Homo sapiens
tacattctctaataagaaaac

SEQ ID NO: 3515692 - DNA, 23 bp, Homo sapiens
tacattgttgagctattgctgtt

SEQ ID NO: 3515693 - DNA, 15 bp, Homo sapiens
tacatttctatttca

SEQ ID NO: 3515694 - DNA, 18 bp, Homo sapiens
tacatttctatttcataa

SEQ ID NO: 3515695 - DNA, 20 bp, Homo sapiens
taccaaagtgtcttttgaca

SEQ ID NO: 3515696 - DNA, 15 bp, Homo sapiens
taccacacactgttt

SEQ ID NO: 3515697 - DNA, 22 bp, Homo sapiens
taccagcgtatatataagaaag

SEQ ID NO: 3515698 - DNA, 13 bp, Homo sapiens
taccagtgaattt

SEQ ID NO: 3515699 - DNA, 14 bp, Homo sapiens
taccagtgaatttt

SEQ ID NO: 3515700 - DNA, 18 bp, Homo sapiens
taccagtgaatttttgca

SEQ ID NO: 3515701 - DNA, 19 bp, Homo sapiens
taccagtgaatttttgcaa

SEQ ID NO: 3515702 - DNA, 23 bp, Homo sapiens
taccagtgaatttttgcaataat

SEQ ID NO: 3515703 - DNA, 17 bp, Homo sapiens
taccatcactgagtttt

SEQ ID NO: 3515704 - DNA, 20 bp, Homo sapiens
taccatcactgagttttcca

SEQ ID NO: 3515705 - DNA, 14 bp, Homo sapiens
taccatctgctgcc

SEQ ID NO: 3515706 - DNA, 13 bp, Homo sapiens
taccatcttctgt

SEQ ID NO: 3515707 - DNA, 16 bp, Homo sapiens
taccatgtaaataatc

SEQ ID NO: 3515708 - DNA, 17 bp, Homo sapiens
taccatttatacaaatt

SEQ ID NO: 3515709 - DNA, 21 bp, Homo sapiens
taccatttatacaaattagaa

SEQ ID NO: 3515710 - DNA, 23 bp, Homo sapiens
taccatttcctcagcttatctct

SEQ ID NO: 3515711 - DNA, 15 bp, Homo sapiens
taccatttgcctccc

SEQ ID NO: 3515712 - DNA, 19 bp, Homo sapiens
tacccaaacccatggctct

SEQ ID NO: 3515713 - DNA, 11 bp, Homo sapiens
tacccactgct

SEQ ID NO: 3515714 - DNA, 13 bp, Homo sapiens
tacccactgctct

SEQ ID NO: 3515715 - DNA, 20 bp, Homo sapiens
tacccagggtggagtgcagt

SEQ ID NO: 3515716 - DNA, 22 bp, Homo sapiens
tacccagtccccattttctggt

SEQ ID NO: 3515717 - DNA, 22 bp, Homo sapiens
tacccattttttaaaaaagcaa

SEQ ID NO: 3515718 - DNA, 18 bp, Homo sapiens
taccccctccttcagaca

SEQ ID NO: 3515719 - DNA, 22 bp, Homo sapiens
taccctcttcatggatggggga

SEQ ID NO: 3515720 - DNA, 18 bp, Homo sapiens
taccctgagctgaggcag

SEQ ID NO: 3515721 - DNA, 18 bp, Homo sapiens
taccctgaggtcactgct

SEQ ID NO: 3515722 - DNA, 18 bp, Homo sapiens
taccctgtgctaagcacg

SEQ ID NO: 3515723 - DNA, 15 bp, Homo sapiens
taccgagagccaaac

SEQ ID NO: 3515724 - DNA, 22 bp, Homo sapiens
taccgagagccaaacagagccc

SEQ ID NO: 3515725 - DNA, 16 bp, Homo sapiens
taccgcgttgtaaaat

SEQ ID NO: 3515726 - DNA, 19 bp, Homo sapiens
tacctcaaccatcctggct

SEQ ID NO: 3515727 - DNA, 12 bp, Homo sapiens
tacctccctccc

SEQ ID NO: 3515728 - DNA, 21 bp, Homo sapiens
tacctccctccccgtctcatt

SEQ ID NO: 3515729 - DNA, 13 bp, Homo sapiens
tacctcctctcag

SEQ ID NO: 3515730 - DNA, 17 bp, Homo sapiens
tacctcctctcagtgtt

SEQ ID NO: 3515731 - DNA, 19 bp, Homo sapiens
tacctcctctcagtgtttt

SEQ ID NO: 3515732 - DNA, 12 bp, Homo sapiens
tacctctctgtc

SEQ ID NO: 3515733 - DNA, 17 bp, Homo sapiens
tacctctgatacctcaa

SEQ ID NO: 3515734 - DNA, 10 bp, Homo sapiens
tacctgctgc

SEQ ID NO: 3515735 - DNA, 14 bp, Homo sapiens
tacctggaatgtgt

SEQ ID NO: 3515736 - DNA, 19 bp, Homo sapiens
tacctgtcattttgcactg

SEQ ID NO: 3515737 - DNA, 20 bp, Homo sapiens
tacctgtcattttgcactgt

SEQ ID NO: 3515738 - DNA, 22 bp, Homo sapiens
tacctgttttgtggtcagctgt

SEQ ID NO: 3515739 - DNA, 14 bp, Homo sapiens
taccttctccctca

SEQ ID NO: 3515740 - DNA, 19 bp, Homo sapiens
taccttctctacccatctc

SEQ ID NO: 3515741 - DNA, 18 bp, Homo sapiens
taccttgcttttgcttct

SEQ ID NO: 3515742 - DNA, 21 bp, Homo sapiens
taccttgcttttgcttctaga

SEQ ID NO: 3515743 - DNA, 22 bp, Homo sapiens
taccttggttcccccactgatc

SEQ ID NO: 3515744 - DNA, 22 bp, Homo sapiens
taccttgttatttaacccattt

SEQ ID NO: 3515745 - DNA, 19 bp, Homo sapiens
tacgagagcagaggtctcc

SEQ ID NO: 3515746 - DNA, 17 bp, Homo sapiens
tacgcccatctcaggac

SEQ ID NO: 3515747 - DNA, 18 bp, Homo sapiens
tacgcctcttctgtccct

SEQ ID NO: 3515748 - DNA, 13 bp, Homo sapiens
tacgctggtgctg

SEQ ID NO: 3515749 - DNA, 17 bp, Homo sapiens
tacgcttttaatgaaaa

SEQ ID NO: 3515750 - DNA, 12 bp, Homo sapiens
tacgcttttctt

SEQ ID NO: 3515751 - DNA, 13 bp, Homo sapiens
tacggacaccccc

SEQ ID NO: 3515752 - DNA, 14 bp, Homo sapiens
tacggacaccccct

SEQ ID NO: 3515753 - DNA, 14 bp, Homo sapiens
tactaactaaactc

SEQ ID NO: 3515754 - DNA, 19 bp, Homo sapiens
taagcctcatcatcagagc

SEQ ID NO: 3515755 - DNA, 12 bp, Homo sapiens
taagcctgtggc

SEQ ID NO: 3515756 - DNA, 20 bp, Homo sapiens
taagcctgtggctgtggaga

SEQ ID NO: 3515757 - DNA, 19 bp, Homo sapiens
taagctatccgtgttgcag

SEQ ID NO: 3515758 - DNA, 11 bp, Homo sapiens
taagctgtttc

SEQ ID NO: 3515759 - DNA, 21 bp, Homo sapiens
taagcttctagaggctcatgg

SEQ ID NO: 3515760 - DNA, 23 bp, Homo sapiens
taagcttctagaggctcatggcc

SEQ ID NO: 3515761 - DNA, 19 bp, Homo sapiens
taaggacatgatgctttta

SEQ ID NO: 3515762 - DNA, 20 bp, Homo sapiens
taaggaggggaaaaaaatgt

SEQ ID NO: 3515763 - DNA, 17 bp, Homo sapiens
taaggatgtagcttttc

SEQ ID NO: 3515764 - DNA, 13 bp, Homo sapiens
taagggcagagtc

SEQ ID NO: 3515765 - DNA, 15 bp, Homo sapiens
taaggggaagataag

SEQ ID NO: 3515766 - DNA, 22 bp, Homo sapiens
taagggtttcccccaacatata

SEQ ID NO: 3515767 - DNA, 16 bp, Homo sapiens
taaggtcctgaaagta

SEQ ID NO: 3515768 - DNA, 18 bp, Homo sapiens
taaggtctttcagtactt

SEQ ID NO: 3515769 - DNA, 15 bp, Homo sapiens
taaggtgaggcctgt

SEQ ID NO: 3515770 - DNA, 22 bp, Homo sapiens
taaggtgaggcctgtctgtgac

SEQ ID NO: 3515771 - DNA, 14 bp, Homo sapiens
taagtaagaaaata

SEQ ID NO: 3515772 - DNA, 19 bp, Homo sapiens
taagtaagaaaatattttg

SEQ ID NO: 3515773 - DNA, 20 bp, Homo sapiens
taagtaagaaaatattttgt

SEQ ID NO: 3515774 - DNA, 16 bp, Homo sapiens
taagtacctttcctac

SEQ ID NO: 3515775 - DNA, 21 bp, Homo sapiens
taagtacctttcctacatttt

SEQ ID NO: 3515776 - DNA, 23 bp, Homo sapiens
taagtacctttcctacattttct

SEQ ID NO: 3515777 - DNA, 16 bp, Homo sapiens
taagtataaaatacaa

SEQ ID NO: 3515778 - DNA, 11 bp, Homo sapiens
taagtattgca

SEQ ID NO: 3515779 - DNA, 17 bp, Homo sapiens
taagtattgcatctgta

SEQ ID NO: 3515780 - DNA, 20 bp, Homo sapiens
taagtattgcatctgtataa

SEQ ID NO: 3515781 - DNA, 17 bp, Homo sapiens
taagtcaacctgcctga

SEQ ID NO: 3515782 - DNA, 22 bp, Homo sapiens
taagtcagggaagagcagtgct

SEQ ID NO: 3515783 - DNA, 19 bp, Homo sapiens
taagtgatgtgctgaattt

SEQ ID NO: 3515784 - DNA, 22 bp, Homo sapiens
taagtgatgtgctgaattttat

SEQ ID NO: 3515785 - DNA, 15 bp, Homo sapiens
taagtgctgtataaa

SEQ ID NO: 3515786 - DNA, 17 bp, Homo sapiens
taagtgctgtataaaat

SEQ ID NO: 3515787 - DNA, 18 bp, Homo sapiens
taagtgctgtataaaatc

SEQ ID NO: 3515788 - DNA, 23 bp, Homo sapiens
taagtgctgtataaaatcagcca

SEQ ID NO: 3515789 - DNA, 15 bp, Homo sapiens
taagtggaggcactt

SEQ ID NO: 3515790 - DNA, 19 bp, Homo sapiens
taagtggaggcactttagg

SEQ ID NO: 3515791 - DNA, 16 bp, Homo sapiens
taagtggtagtaattt

SEQ ID NO: 3515792 - DNA, 13 bp, Homo sapiens
taagtgtattttt

SEQ ID NO: 3515793 - DNA, 12 bp, Homo sapiens
taagtgtgaact

SEQ ID NO: 3515794 - DNA, 15 bp, Homo sapiens
taagttacaatgttt

SEQ ID NO: 3515795 - DNA, 22 bp, Homo sapiens
taagttgagaaggtgcctgcca

SEQ ID NO: 3515796 - DNA, 13 bp, Homo sapiens
taataaaaaggca

SEQ ID NO: 3515797 - DNA, 12 bp, Homo sapiens
taataaaccagt

SEQ ID NO: 3515798 - DNA, 20 bp, Homo sapiens
taataaagatgattgaatcc

SEQ ID NO: 3515799 - DNA, 13 bp, Homo sapiens
taataaaggttgt

SEQ ID NO: 3515800 - DNA, 12 bp, Homo sapiens
taataacattta

SEQ ID NO: 3515801 - DNA, 14 bp, Homo sapiens
taataacatttaat

SEQ ID NO: 3515802 - DNA, 20 bp, Homo sapiens
taataacatttaatttagat

SEQ ID NO: 3515803 - DNA, 21 bp, Homo sapiens
taataacatttaatttagata

SEQ ID NO: 3515804 - DNA, 17 bp, Homo sapiens
taataacgtgaaactta

SEQ ID NO: 3515805 - DNA, 17 bp, Homo sapiens
taataagtgatgtgctg

SEQ ID NO: 3515806 - DNA, 14 bp, Homo sapiens
taataatatacttg

SEQ ID NO: 3515807 - DNA, 19 bp, Homo sapiens
taataatatacttgtggac

SEQ ID NO: 3515808 - DNA, 20 bp, Homo sapiens
taataatcttattagggaga

SEQ ID NO: 3515809 - DNA, 22 bp, Homo sapiens
taataatttacaggttcttagg

SEQ ID NO: 3515810 - DNA, 23 bp, Homo sapiens
taatactgctgagatacatacag

SEQ ID NO: 3515811 - DNA, 12 bp, Homo sapiens
taatactgtatt

SEQ ID NO: 3515812 - DNA, 18 bp, Homo sapiens
taatagtaatttgtaaag

SEQ ID NO: 3515813 - DNA, 21 bp, Homo sapiens
taatagttcaggtaacaggca

SEQ ID NO: 3515814 - DNA, 13 bp, Homo sapiens
taatataaattca

SEQ ID NO: 3515815 - DNA, 18 bp, Homo sapiens
taatataaattcactttc

SEQ ID NO: 3515816 - DNA, 16 bp, Homo sapiens
taatatagctgagact

SEQ ID NO: 3515817 - DNA, 22 bp, Homo sapiens
taatatggccacagtagtcttg

SEQ ID NO: 3515818 - DNA, 19 bp, Homo sapiens
taatcatttgtttacattt

SEQ ID NO: 3515819 - DNA, 19 bp, Homo sapiens
taatccaatgggtttttcc

SEQ ID NO: 3515820 - DNA, 18 bp, Homo sapiens
taatccaggcagatccag

SEQ ID NO: 3515821 - DNA, 19 bp, Homo sapiens
taatcccagcactttggga

SEQ ID NO: 3515822 - DNA, 12 bp, Homo sapiens
taatcccagcta

SEQ ID NO: 3515823 - DNA, 19 bp, Homo sapiens
taatcccagctacttggga

SEQ ID NO: 3515824 - DNA, 18 bp, Homo sapiens
taatccccagtaaaattg

SEQ ID NO: 3515825 - DNA, 19 bp, Homo sapiens
taatccgaatctctttttg

SEQ ID NO: 3515826 - DNA, 21 bp, Homo sapiens
taatctgatggcttctccagg

SEQ ID NO: 3515827 - DNA, 13 bp, Homo sapiens
taatcttattagg

SEQ ID NO: 3515828 - DNA, 21 bp, Homo sapiens
taatcttattagggagaaaat

SEQ ID NO: 3515829 - DNA, 15 bp, Homo sapiens
taatcttgctctgct

SEQ ID NO: 3515830 - DNA, 20 bp, Homo sapiens
taatcttgctttctttagaa

SEQ ID NO: 3515831 - DNA, 22 bp, Homo sapiens
taatcttgctttctttagaatt

SEQ ID NO: 3515832 - DNA, 19 bp, Homo sapiens
taatctttcaaaccagctt

SEQ ID NO: 3515833 - DNA, 15 bp, Homo sapiens
taatgaagagccagc

SEQ ID NO: 3515834 - DNA, 14 bp, Homo sapiens
taatgaagtttgaa

SEQ ID NO: 3515835 - DNA, 19 bp, Homo sapiens
taatgaagtttgaatgtta

SEQ ID NO: 3515836 - DNA, 22 bp, Homo sapiens
taatgaagtttgaatgttaaat

SEQ ID NO: 3515837 - DNA, 20 bp, Homo sapiens
taatgaatcgtaatgaagtt

SEQ ID NO: 3515838 - DNA, 23 bp, Homo sapiens
taatgaggagagaaaatatatgt

SEQ ID NO: 3515839 - DNA, 18 bp, Homo sapiens
taatgatggatttaacag

SEQ ID NO: 3515840 - DNA, 22 bp, Homo sapiens
taatgatggatttaacagcatg

SEQ ID NO: 3515841 - DNA, 14 bp, Homo sapiens
taatgcaaagaatc

SEQ ID NO: 3515842 - DNA, 14 bp, Homo sapiens
taatgcaagagaac

SEQ ID NO: 3515843 - DNA, 20 bp, Homo sapiens
taatgcaagagaacatttta

SEQ ID NO: 3515844 - DNA, 21 bp, Homo sapiens
taatgcaagagaacattttac

SEQ ID NO: 3515845 - DNA, 22 bp, Homo sapiens
taatgcaagagaacattttact

SEQ ID NO: 3515846 - DNA, 17 bp, Homo sapiens
taatgcagtatggtaca

SEQ ID NO: 3515847 - DNA, 21 bp, Homo sapiens
taatgcatgttaggaaaattt

SEQ ID NO: 3515848 - DNA, 19 bp, Homo sapiens
taatgctaatttaaagaga

SEQ ID NO: 3515849 - DNA, 13 bp, Homo sapiens
taatgcttaagat

SEQ ID NO: 3515850 - DNA, 15 bp, Homo sapiens
taatgtacatctggc

SEQ ID NO: 3515851 - DNA, 19 bp, Homo sapiens
taatgtctctgtgagactc

SEQ ID NO: 3515852 - DNA, 21 bp, Homo sapiens
taatgtgaaaatggtccagga

SEQ ID NO: 3515853 - DNA, 18 bp, Homo sapiens
taatgttatatcatatgt

SEQ ID NO: 3515854 - DNA, 15 bp, Homo sapiens
taatgttctgtgata

SEQ ID NO: 3515855 - DNA, 16 bp, Homo sapiens
taattaggaaaaaaac

SEQ ID NO: 3515856 - DNA, 16 bp, Homo sapiens
taattagtgctaagtg

SEQ ID NO: 3515857 - DNA, 23 bp, Homo sapiens
taattagttcctcattagcattt

SEQ ID NO: 3515858 - DNA, 19 bp, Homo sapiens
taattcagccatgtacaga

SEQ ID NO: 3515859 - DNA, 19 bp, Homo sapiens
taattcatcccaactgtct

SEQ ID NO: 3515860 - DNA, 15 bp, Homo sapiens
taattccacaccttt

SEQ ID NO: 3515861 - DNA, 19 bp, Homo sapiens
taattcctcaacgtattgt

SEQ ID NO: 3515862 - DNA, 15 bp, Homo sapiens
taattcttctgtcct

SEQ ID NO: 3515863 - DNA, 14 bp, Homo sapiens
taattgaaagtata

SEQ ID NO: 3515864 - DNA, 23 bp, Homo sapiens
taattgcagataactttgacttt

SEQ ID NO: 3515865 - DNA, 12 bp, Homo sapiens
taattgctttga

SEQ ID NO: 3515866 - DNA, 18 bp, Homo sapiens
taattgggtcatagaaat

SEQ ID NO: 3515867 - DNA, 18 bp, Homo sapiens
taattgtactaaagccaa

SEQ ID NO: 3515868 - DNA, 22 bp, Homo sapiens
taattgtactaaagccaaacat

SEQ ID NO: 3515869 - DNA, 17 bp, Homo sapiens
taattgtttgtctttaa

SEQ ID NO: 3515870 - DNA, 13 bp, Homo sapiens
taatttaaagaga

SEQ ID NO: 3515871 - DNA, 16 bp, Homo sapiens
taatttagatattttc

SEQ ID NO: 3515872 - DNA, 15 bp, Homo sapiens
taatttagtaaatgt

SEQ ID NO: 3515873 - DNA, 20 bp, Homo sapiens
taatttagtaaatgttatct

SEQ ID NO: 3515874 - DNA, 18 bp, Homo sapiens
taatttattaattgcttt

SEQ ID NO: 3515875 - DNA, 16 bp, Homo sapiens
taatttcaaaatgctt

SEQ ID NO: 3515876 - DNA, 17 bp, Homo sapiens
taatttctttttttcct

SEQ ID NO: 3515877 - DNA, 12 bp, Homo sapiens
taatttgcatta

SEQ ID NO: 3515878 - DNA, 22 bp, Homo sapiens
taatttgctggaacacaaagac

SEQ ID NO: 3515879 - DNA, 20 bp, Homo sapiens
taatttgtattgaagaagtt

SEQ ID NO: 3515880 - DNA, 17 bp, Homo sapiens
taattttcctaataaag

SEQ ID NO: 3515881 - DNA, 15 bp, Homo sapiens
tacaaaaagcataaa

SEQ ID NO: 3515882 - DNA, 12 bp, Homo sapiens
tacaaaaataaa

SEQ ID NO: 3515883 - DNA, 17 bp, Homo sapiens
tacaaaaataaatttat

SEQ ID NO: 3515884 - DNA, 18 bp, Homo sapiens
tacaaaaattagccggac

SEQ ID NO: 3515885 - DNA, 22 bp, Homo sapiens
tacaaaggttccattcagtgca

SEQ ID NO: 3515886 - DNA, 17 bp, Homo sapiens
tacaaatactcttagga

SEQ ID NO: 3515887 - DNA, 19 bp, Homo sapiens
tacaaatactcttaggaag

SEQ ID NO: 3515888 - DNA, 23 bp, Homo sapiens
tacaaatactcttaggaagagaa

SEQ ID NO: 3515889 - DNA, 16 bp, Homo sapiens
tacaaccaatggaatg

SEQ ID NO: 3515890 - DNA, 15 bp, Homo sapiens
tcctctgaaacagct

SEQ ID NO: 3515891 - DNA, 16 bp, Homo sapiens
tcctctgaaacagctg

SEQ ID NO: 3515892 - DNA, 18 bp, Homo sapiens
tcctctgaaacagctgcc

SEQ ID NO: 3515893 - DNA, 19 bp, Homo sapiens
tcctctgaaacagctgcct

SEQ ID NO: 3515894 - DNA, 16 bp, Homo sapiens
tcctctgactcagggc

SEQ ID NO: 3515895 - DNA, 20 bp, Homo sapiens
tcccagctgtgctctggaca

SEQ ID NO: 3515896 - DNA, 23 bp, Homo sapiens
tcccagctgtgctctggacaggc

SEQ ID NO: 3515897 - DNA, 12 bp, Homo sapiens
tcccaggaccct

SEQ ID NO: 3515898 - DNA, 19 bp, Homo sapiens
tcccaggaccctgaagggg

SEQ ID NO: 3515899 - DNA, 16 bp, Homo sapiens
tcccaggatgagcatc

SEQ ID NO: 3515900 - DNA, 24 bp, Homo sapiens
tcccaggatgagcatcccaggatc

SEQ ID NO: 3515901 - DNA, 16 bp, Homo sapiens
tcccagggacacctgg

SEQ ID NO: 3515902 - DNA, 15 bp, Homo sapiens
tcccagtggctgctg

SEQ ID NO: 3515903 - DNA, 16 bp, Homo sapiens
tcccagtggctgctgc

SEQ ID NO: 3515904 - DNA, 17 bp, Homo sapiens
tcccagtggctgctgcc

SEQ ID NO: 3515905 - DNA, 21 bp, Homo sapiens
tcccagtggctgctgcccagg

SEQ ID NO: 3515906 - DNA, 22 bp, Homo sapiens
tcccagtggctgctgcccaggc

SEQ ID NO: 3515907 - DNA, 14 bp, Homo sapiens
tcccataccaccca

SEQ ID NO: 3515908 - DNA, 15 bp, Homo sapiens
tcccataggcccagt

SEQ ID NO: 3515909 - DNA, 13 bp, Homo sapiens
tcccatccagggc

SEQ ID NO: 3515910 - DNA, 17 bp, Homo sapiens
tcccatctggtcatttg

SEQ ID NO: 3515911 - DNA, 20 bp, Homo sapiens
tcccatctggtcatttggtt

SEQ ID NO: 3515912 - DNA, 14 bp, Homo sapiens
tcccatgacccagg

SEQ ID NO: 3515913 - DNA, 19 bp, Homo sapiens
tcccatgagcctcagcatc

SEQ ID NO: 3515914 - DNA, 20 bp, Homo sapiens
tcccatgagcctcagcatcc

SEQ ID NO: 3515915 - DNA, 16 bp, Homo sapiens
tcccatgcctgcaacc

SEQ ID NO: 3515916 - DNA, 21 bp, Homo sapiens
tcccatgtagccccctggcct

SEQ ID NO: 3515917 - DNA, 22 bp, Homo sapiens
tcccatgtagccccctggcctc

SEQ ID NO: 3515918 - DNA, 13 bp, Homo sapiens
tcccattgtccct

SEQ ID NO: 3515919 - DNA, 17 bp, Homo sapiens
tcccattgtccctctgc

SEQ ID NO: 3515920 - DNA, 14 bp, Homo sapiens
tcccatttgtaatt

SEQ ID NO: 3515921 - DNA, 16 bp, Homo sapiens
tccccaatgagacttg

SEQ ID NO: 3515922 - DNA, 13 bp, Homo sapiens
tccccacagaact

SEQ ID NO: 3515923 - DNA, 15 bp, Homo sapiens
tccccacgagggctg

SEQ ID NO: 3515924 - DNA, 17 bp, Homo sapiens
tccccacgagggctggc

SEQ ID NO: 3515925 - DNA, 19 bp, Homo sapiens
tccccactgacagcctccc

SEQ ID NO: 3515926 - DNA, 17 bp, Homo sapiens
tccccacttctgtgcca

SEQ ID NO: 3515927 - DNA, 18 bp, Homo sapiens
tccccacttctgtgccac

SEQ ID NO: 3515928 - DNA, 17 bp, Homo sapiens
tccccagaatggaggca

SEQ ID NO: 3515929 - DNA, 10 bp, Homo sapiens
tccccagaga

SEQ ID NO: 3515930 - DNA, 19 bp, Homo sapiens
tccccagattgcaacaggc

SEQ ID NO: 3515931 - DNA, 20 bp, Homo sapiens
tccccagattgcaacaggct

SEQ ID NO: 3515932 - DNA, 20 bp, Homo sapiens
tccccagcaagtgagagctg

SEQ ID NO: 3515933 - DNA, 21 bp, Homo sapiens
tccccagcaagtgagagctgg

SEQ ID NO: 3515934 - DNA, 14 bp, Homo sapiens
tccccagcccagag

SEQ ID NO: 3515935 - DNA, 12 bp, Homo sapiens
tccccagcctgc

SEQ ID NO: 3515936 - DNA, 14 bp, Homo sapiens
tccccagcctgcgc

SEQ ID NO: 3515937 - DNA, 19 bp, Homo sapiens
tccccagcctgcgcctgct

SEQ ID NO: 3515938 - DNA, 18 bp, Homo sapiens
tccccagctccccaggac

SEQ ID NO: 3515939 - DNA, 21 bp, Homo sapiens
tccccagctccccaggactca

SEQ ID NO: 3515940 - DNA, 18 bp, Homo sapiens
tccccaggactcaccctc

SEQ ID NO: 3515941 - DNA, 13 bp, Homo sapiens
tccccaggcccca

SEQ ID NO: 3515942 - DNA, 17 bp, Homo sapiens
tccccaggtccagctct

SEQ ID NO: 3515943 - DNA, 23 bp, Homo sapiens
tccccaggtccagctctggaggg

SEQ ID NO: 3515944 - DNA, 16 bp, Homo sapiens
tccccaggtctctcca

SEQ ID NO: 3515945 - DNA, 20 bp, Homo sapiens
tccccaggtctctccactgc

SEQ ID NO: 3515946 - DNA, 14 bp, Homo sapiens
tccccagtaaaatt

SEQ ID NO: 3515947 - DNA, 14 bp, Homo sapiens
tccccatctcaggc

SEQ ID NO: 3515948 - DNA, 15 bp, Homo sapiens
tccccatctgtcggc

SEQ ID NO: 3515949 - DNA, 17 bp, Homo sapiens
tccccatctgtcggcct

SEQ ID NO: 3515950 - DNA, 19 bp, Homo sapiens
tccccattcagacacttca

SEQ ID NO: 3515951 - DNA, 16 bp, Homo sapiens
tcccccaacactgagc

SEQ ID NO: 3515952 - DNA, 19 bp, Homo sapiens
tcccccaccccctccccgc

SEQ ID NO: 3515953 - DNA, 14 bp, Homo sapiens
tcccccactgccac

SEQ ID NO: 3515954 - DNA, 15 bp, Homo sapiens
tcccccactgccaca

SEQ ID NO: 3515955 - DNA, 21 bp, Homo sapiens
tcccccagcagaaccagcctc

SEQ ID NO: 3515956 - DNA, 19 bp, Homo sapiens
tcccccaggcctgagctgc

SEQ ID NO: 3515957 - DNA, 23 bp, Homo sapiens
tcccccaggcctgagctgcttca

SEQ ID NO: 3515958 - DNA, 17 bp, Homo sapiens
tcccccctcctctgaaa

SEQ ID NO: 3515959 - DNA, 19 bp, Homo sapiens
tcccccctcctctgaaaca

SEQ ID NO: 3515960 - DNA, 22 bp, Homo sapiens
tcccccctcctctgaaacagct

SEQ ID NO: 3515961 - DNA, 17 bp, Homo sapiens
tccccctaaaccaactg

SEQ ID NO: 3515962 - DNA, 12 bp, Homo sapiens
tccccctctgtc

SEQ ID NO: 3515963 - DNA, 21 bp, Homo sapiens
tccccgcagtgtgcactaagg

SEQ ID NO: 3515964 - DNA, 13 bp, Homo sapiens
tccccggctcgag

SEQ ID NO: 3515965 - DNA, 15 bp, Homo sapiens
tccccgtctcattcc

SEQ ID NO: 3515966 - DNA, 20 bp, Homo sapiens
tccccgtgagcactgcgtac

SEQ ID NO: 3515967 - DNA, 13 bp, Homo sapiens
tcccctccaacct

SEQ ID NO: 3515968 - DNA, 22 bp, Homo sapiens
tcccctccaacctggggggcag

SEQ ID NO: 3515969 - DNA, 17 bp, Homo sapiens
tcccctccggactggtg

SEQ ID NO: 3515970 - DNA, 14 bp, Homo sapiens
tcccctcctcactc

SEQ ID NO: 3515971 - DNA, 14 bp, Homo sapiens
tcccctcctccact

SEQ ID NO: 3515972 - DNA, 16 bp, Homo sapiens
tcccctcctccactct

SEQ ID NO: 3515973 - DNA, 14 bp, Homo sapiens
tcccctccttctcc

SEQ ID NO: 3515974 - DNA, 18 bp, Homo sapiens
tcccctccttctcccttt

SEQ ID NO: 3515975 - DNA, 16 bp, Homo sapiens
tcccctctccttcctg

SEQ ID NO: 3515976 - DNA, 21 bp, Homo sapiens
tcccctctcttgtcagatgcc

SEQ ID NO: 3515977 - DNA, 12 bp, Homo sapiens
tcccctcttctg

SEQ ID NO: 3515978 - DNA, 15 bp, Homo sapiens
tcccctcttctgagc

SEQ ID NO: 3515979 - DNA, 12 bp, Homo sapiens
tcccctgccagg

SEQ ID NO: 3515980 - DNA, 15 bp, Homo sapiens
tcccctgccagggca

SEQ ID NO: 3515981 - DNA, 13 bp, Homo sapiens
tcccctgccattt

SEQ ID NO: 3515982 - DNA, 13 bp, Homo sapiens
tcccctgccccca

SEQ ID NO: 3515983 - DNA, 14 bp, Homo sapiens
tcccctgcccccag

SEQ ID NO: 3515984 - DNA, 16 bp, Homo sapiens
tcccctgcccccagga

SEQ ID NO: 3515985 - DNA, 17 bp, Homo sapiens
tcccctgcccccaggac

SEQ ID NO: 3515986 - DNA, 19 bp, Homo sapiens
tcccctgcccccaggactg

SEQ ID NO: 3515987 - DNA, 15 bp, Homo sapiens
tcccctgcctcctac

SEQ ID NO: 3515988 - DNA, 15 bp, Homo sapiens
tcccctggggaccca

SEQ ID NO: 3515989 - DNA, 17 bp, Homo sapiens
tccccttacccttagaa

SEQ ID NO: 3515990 - DNA, 18 bp, Homo sapiens
tccccttgaactcttcac

SEQ ID NO: 3515991 - DNA, 20 bp, Homo sapiens
tcccgaatagctgggactac

SEQ ID NO: 3515992 - DNA, 20 bp, Homo sapiens
tcccgccggaggccagctat

SEQ ID NO: 3515993 - DNA, 12 bp, Homo sapiens
tcccgggcctca

SEQ ID NO: 3515994 - DNA, 15 bp, Homo sapiens
tccctaccgacccag

SEQ ID NO: 3515995 - DNA, 18 bp, Homo sapiens
tccctagaaacttccaaa

SEQ ID NO: 3515996 - DNA, 13 bp, Homo sapiens
tccctagacttta

SEQ ID NO: 3515997 - DNA, 14 bp, Homo sapiens
tccctagactttag

SEQ ID NO: 3515998 - DNA, 20 bp, Homo sapiens
tccctcaccttggcaccaga

SEQ ID NO: 3515999 - DNA, 21 bp, Homo sapiens
tccctcaccttggcaccagac

SEQ ID NO: 3516000 - DNA, 16 bp, Homo sapiens
tccctcatctgtccct

SEQ ID NO: 3516001 - DNA, 13 bp, Homo sapiens
tccctccatcccc

SEQ ID NO: 3516002 - DNA, 14 bp, Homo sapiens
tccctcccaggact

SEQ ID NO: 3516003 - DNA, 14 bp, Homo sapiens
tccctcccccccat

SEQ ID NO: 3516004 - DNA, 15 bp, Homo sapiens
tccctccgggacctg

SEQ ID NO: 3516005 - DNA, 21 bp, Homo sapiens
tccctcctggagctctgtggg

SEQ ID NO: 3516006 - DNA, 19 bp, Homo sapiens
tccctcgctgcacaaatac

SEQ ID NO: 3516007 - DNA, 18 bp, Homo sapiens
tccctctaggctctgcct

SEQ ID NO: 3516008 - DNA, 17 bp, Homo sapiens
tccctctcatctcaggt

SEQ ID NO: 3516009 - DNA, 12 bp, Homo sapiens
tccctctccctg

SEQ ID NO: 3516010 - DNA, 13 bp, Homo sapiens
tccctctgaccca

SEQ ID NO: 3516011 - DNA, 20 bp, Homo sapiens
tccagagattcattttctag

SEQ ID NO: 3516012 - DNA, 16 bp, Homo sapiens
tccagagctggccagg

SEQ ID NO: 3516013 - DNA, 17 bp, Homo sapiens
tccagagctggccaggc

SEQ ID NO: 3516014 - DNA, 23 bp, Homo sapiens
tccagatcccaggcccctggagg

SEQ ID NO: 3516015 - DNA, 16 bp, Homo sapiens
tccagatcctctctgg

SEQ ID NO: 3516016 - DNA, 20 bp, Homo sapiens
tccagatcctctctggggct

SEQ ID NO: 3516017 - DNA, 16 bp, Homo sapiens
tccagatcttgcctcc

SEQ ID NO: 3516018 - DNA, 19 bp, Homo sapiens
tccagatcttgcctccaga

SEQ ID NO: 3516019 - DNA, 20 bp, Homo sapiens
tccagatcttgcctccagag

SEQ ID NO: 3516020 - DNA, 18 bp, Homo sapiens
tccagatgcagggcagtc

SEQ ID NO: 3516021 - DNA, 19 bp, Homo sapiens
tccagatgcagggcagtca

SEQ ID NO: 3516022 - DNA, 18 bp, Homo sapiens
tccagatgtttccagact

SEQ ID NO: 3516023 - DNA, 18 bp, Homo sapiens
tccagcagtctctgcctt

SEQ ID NO: 3516024 - DNA, 17 bp, Homo sapiens
tccagccaaacgggagc

SEQ ID NO: 3516025 - DNA, 23 bp, Homo sapiens
tccagccaaagcctcctccagcc

SEQ ID NO: 3516026 - DNA, 21 bp, Homo sapiens
tccagccagctcctgggcagc

SEQ ID NO: 3516027 - DNA, 14 bp, Homo sapiens
tccagccagggctg

SEQ ID NO: 3516028 - DNA, 15 bp, Homo sapiens
tccagccatctcatg

SEQ ID NO: 3516029 - DNA, 23 bp, Homo sapiens
tccagcccctctggtcgctcctg

SEQ ID NO: 3516030 - DNA, 22 bp, Homo sapiens
tccagccccttctcagaatcta

SEQ ID NO: 3516031 - DNA, 11 bp, Homo sapiens
tccagcctcac

SEQ ID NO: 3516032 - DNA, 19 bp, Homo sapiens
tccagcctgcctggcaggc

SEQ ID NO: 3516033 - DNA, 13 bp, Homo sapiens
tccagcctgggtg

SEQ ID NO: 3516034 - DNA, 18 bp, Homo sapiens
tccagctcaccagcccca

SEQ ID NO: 3516035 - DNA, 13 bp, Homo sapiens
tccagctctggag

SEQ ID NO: 3516036 - DNA, 15 bp, Homo sapiens
tccagctctggaggg

SEQ ID NO: 3516037 - DNA, 21 bp, Homo sapiens
tccagctctttcctccttcca

SEQ ID NO: 3516038 - DNA, 12 bp, Homo sapiens
tccagctgcccc

SEQ ID NO: 3516039 - DNA, 14 bp, Homo sapiens
tccagcttcccgag

SEQ ID NO: 3516040 - DNA, 21 bp, Homo sapiens
tccaggaagaaagaatgttac

SEQ ID NO: 3516041 - DNA, 20 bp, Homo sapiens
tccaggactatatttgggcc

SEQ ID NO: 3516042 - DNA, 14 bp, Homo sapiens
tccaggcactgaga

SEQ ID NO: 3516043 - DNA, 20 bp, Homo sapiens
tccaggcagatccaggacta

SEQ ID NO: 3516044 - DNA, 21 bp, Homo sapiens
tccaggcagatccaggactat

SEQ ID NO: 3516045 - DNA, 14 bp, Homo sapiens
tccaggcaggctaa

SEQ ID NO: 3516046 - DNA, 16 bp, Homo sapiens
tccaggctgccgtggg

SEQ ID NO: 3516047 - DNA, 15 bp, Homo sapiens
tccaggctgggcagc

SEQ ID NO: 3516048 - DNA, 14 bp, Homo sapiens
tccaggctgtatcc

SEQ ID NO: 3516049 - DNA, 14 bp, Homo sapiens
tccagggacagagg

SEQ ID NO: 3516050 - DNA, 19 bp, Homo sapiens
tccagggacagaggcccca

SEQ ID NO: 3516051 - DNA, 21 bp, Homo sapiens
tccagggacagaggccccagc

SEQ ID NO: 3516052 - DNA, 18 bp, Homo sapiens
tccagggatgattcaagc

SEQ ID NO: 3516053 - DNA, 14 bp, Homo sapiens
tccagggctggact

SEQ ID NO: 3516054 - DNA, 19 bp, Homo sapiens
tccagggctggactgaggc

SEQ ID NO: 3516055 - DNA, 21 bp, Homo sapiens
tccaggggctgcttcctcctg

SEQ ID NO: 3516056 - DNA, 23 bp, Homo sapiens
tccaggggctgcttcctcctgga

SEQ ID NO: 3516057 - DNA, 18 bp, Homo sapiens
tccaggtaccttgacctt

SEQ ID NO: 3516058 - DNA, 23 bp, Homo sapiens
tccaggttcaacccacagctact

SEQ ID NO: 3516059 - DNA, 15 bp, Homo sapiens
tccaggttcagcttg

SEQ ID NO: 3516060 - DNA, 16 bp, Homo sapiens
tccaggttcagcttgt

SEQ ID NO: 3516061 - DNA, 17 bp, Homo sapiens
tccaggtttaagctgtt

SEQ ID NO: 3516062 - DNA, 18 bp, Homo sapiens
tccaggtttaagctgtta

SEQ ID NO: 3516063 - DNA, 17 bp, Homo sapiens
tccagtactattttaat

SEQ ID NO: 3516064 - DNA, 17 bp, Homo sapiens
tccagtatgacagagga

SEQ ID NO: 3516065 - DNA, 16 bp, Homo sapiens
tccagtccaaggaaac

SEQ ID NO: 3516066 - DNA, 20 bp, Homo sapiens
tccagtccccagaagcagag

SEQ ID NO: 3516067 - DNA, 18 bp, Homo sapiens
tccagtgccaacaatcct

SEQ ID NO: 3516068 - DNA, 13 bp, Homo sapiens
tccagtgcctaca

SEQ ID NO: 3516069 - DNA, 22 bp, Homo sapiens
tccagtggaggtttgtcgggca

SEQ ID NO: 3516070 - DNA, 13 bp, Homo sapiens
tccagtgtgcacc

SEQ ID NO: 3516071 - DNA, 17 bp, Homo sapiens
tccagtgtgcacccctc

SEQ ID NO: 3516072 - DNA, 23 bp, Homo sapiens
tccagtgtgcacccctccccatt

SEQ ID NO: 3516073 - DNA, 21 bp, Homo sapiens
tccagttaaaaaaaattttaa

SEQ ID NO: 3516074 - DNA, 15 bp, Homo sapiens
tccagtttccccatg

SEQ ID NO: 3516075 - DNA, 22 bp, Homo sapiens
tccagtttccccatggggctgc

SEQ ID NO: 3516076 - DNA, 20 bp, Homo sapiens
tccagttttttgttatatag

SEQ ID NO: 3516077 - DNA, 16 bp, Homo sapiens
tccataagtaagaaat

SEQ ID NO: 3516078 - DNA, 20 bp, Homo sapiens
tccatatatccttttcttct

SEQ ID NO: 3516079 - DNA, 17 bp, Homo sapiens
tccatatattggcactg

SEQ ID NO: 3516080 - DNA, 19 bp, Homo sapiens
tccatatttataggtaccc

SEQ ID NO: 3516081 - DNA, 17 bp, Homo sapiens
tccatcagttagagctg

SEQ ID NO: 3516082 - DNA, 13 bp, Homo sapiens
tccatcatcatgt

SEQ ID NO: 3516083 - DNA, 21 bp, Homo sapiens
tccatccaaggccaggttctc

SEQ ID NO: 3516084 - DNA, 16 bp, Homo sapiens
tccatccagcttgcca

SEQ ID NO: 3516085 - DNA, 16 bp, Homo sapiens
tccatctctcatcctc

SEQ ID NO: 3516086 - DNA, 20 bp, Homo sapiens
tccatgatgtaatggaagct

SEQ ID NO: 3516087 - DNA, 18 bp, Homo sapiens
tccatggcaggaaggctt

SEQ ID NO: 3516088 - DNA, 20 bp, Homo sapiens
tccatggccctgcaaaagga

SEQ ID NO: 3516089 - DNA, 18 bp, Homo sapiens
tccatgggagaaaataga

SEQ ID NO: 3516090 - DNA, 22 bp, Homo sapiens
tccatgtattcacacacccctc

SEQ ID NO: 3516091 - DNA, 23 bp, Homo sapiens
tccatgtattcacacacccctca

SEQ ID NO: 3516092 - DNA, 17 bp, Homo sapiens
tccatgtcccctcccag

SEQ ID NO: 3516093 - DNA, 22 bp, Homo sapiens
tccattcacagttctttgggcc

SEQ ID NO: 3516094 - DNA, 15 bp, Homo sapiens
tccattcagtgcagc

SEQ ID NO: 3516095 - DNA, 17 bp, Homo sapiens
tccattcccaagatgcc

SEQ ID NO: 3516096 - DNA, 19 bp, Homo sapiens
tccattcccaagatgcctg

SEQ ID NO: 3516097 - DNA, 22 bp, Homo sapiens
tccattcccaagatgcctgatc

SEQ ID NO: 3516098 - DNA, 22 bp, Homo sapiens
tccatttacaaactacttgatt

SEQ ID NO: 3516099 - DNA, 15 bp, Homo sapiens
tccatttgcaaggga

SEQ ID NO: 3516100 - DNA, 18 bp, Homo sapiens
tcccaaaattagggagct

SEQ ID NO: 3516101 - DNA, 22 bp, Homo sapiens
tcccaaaattagggagctcttg

SEQ ID NO: 3516102 - DNA, 21 bp, Homo sapiens
tcccaaacccagtctcctctc

SEQ ID NO: 3516103 - DNA, 22 bp, Homo sapiens
tcccaaacccagtctcctctcc

SEQ ID NO: 3516104 - DNA, 15 bp, Homo sapiens
tcccaaacgcctccc

SEQ ID NO: 3516105 - DNA, 21 bp, Homo sapiens
tcccaaagtgctgggattaca

SEQ ID NO: 3516106 - DNA, 19 bp, Homo sapiens
tcccaaatttgattgattt

SEQ ID NO: 3516107 - DNA, 20 bp, Homo sapiens
tcccaaatttgattgatttg

SEQ ID NO: 3516108 - DNA, 22 bp, Homo sapiens
tcccaaccccttaagccctggc

SEQ ID NO: 3516109 - DNA, 19 bp, Homo sapiens
tcccaacgtgcaaagccaa

SEQ ID NO: 3516110 - DNA, 13 bp, Homo sapiens
tcccaagatgcct

SEQ ID NO: 3516111 - DNA, 13 bp, Homo sapiens
tcccaagctggct

SEQ ID NO: 3516112 - DNA, 18 bp, Homo sapiens
tcccaagggatggtgccc

SEQ ID NO: 3516113 - DNA, 24 bp, Homo sapiens
tcccaaggtgaaatgaagcaacag

SEQ ID NO: 3516114 - DNA, 17 bp, Homo sapiens
tcccaagtagaatctca

SEQ ID NO: 3516115 - DNA, 19 bp, Homo sapiens
tcccaagtagaatctcagt

SEQ ID NO: 3516116 - DNA, 13 bp, Homo sapiens
tcccaatcttctt

SEQ ID NO: 3516117 - DNA, 19 bp, Homo sapiens
tcaagttttgggtatgttt

SEQ ID NO: 3516118 - DNA, 17 bp, Homo sapiens
tcaataaagtatttaat

SEQ ID NO: 3516119 - DNA, 18 bp, Homo sapiens
tcaataaagtatttaatt

SEQ ID NO: 3516120 - DNA, 20 bp, Homo sapiens
tcaataaagtatttaattag

SEQ ID NO: 3516121 - DNA, 17 bp, Homo sapiens
tcaatacagtacaggca

SEQ ID NO: 3516122 - DNA, 20 bp, Homo sapiens
tcaatacagtacaggcagca

SEQ ID NO: 3516123 - DNA, 18 bp, Homo sapiens
tcaatagtgcaactgttt

SEQ ID NO: 3516124 - DNA, 17 bp, Homo sapiens
tcaatagttcaaggaac

SEQ ID NO: 3516125 - DNA, 15 bp, Homo sapiens
tcaatattgaatttt

SEQ ID NO: 3516126 - DNA, 19 bp, Homo sapiens
tcaatattgaatttttcct

SEQ ID NO: 3516127 - DNA, 11 bp, Homo sapiens
tcaatatttat

SEQ ID NO: 3516128 - DNA, 12 bp, Homo sapiens
tcaatatttatt

SEQ ID NO: 3516129 - DNA, 13 bp, Homo sapiens
tcaatatttatta

SEQ ID NO: 3516130 - DNA, 20 bp, Homo sapiens
tcaatatttattattttcac

SEQ ID NO: 3516131 - DNA, 16 bp, Homo sapiens
tcaatatttttagata

SEQ ID NO: 3516132 - DNA, 15 bp, Homo sapiens
tcaatccagctatgt

SEQ ID NO: 3516133 - DNA, 13 bp, Homo sapiens
tcaattcaacact

SEQ ID NO: 3516134 - DNA, 17 bp, Homo sapiens
tcaattcaacactccct

SEQ ID NO: 3516135 - DNA, 19 bp, Homo sapiens
tcaattccgtagccagctg

SEQ ID NO: 3516136 - DNA, 20 bp, Homo sapiens
tcaattctgtaggttaaaaa

SEQ ID NO: 3516137 - DNA, 23 bp, Homo sapiens
tcaatttctgtgttgccaagctc

SEQ ID NO: 3516138 - DNA, 18 bp, Homo sapiens
tcaattttgacttaatgt

SEQ ID NO: 3516139 - DNA, 22 bp, Homo sapiens
tcacaaaacagcctttgggaaa

SEQ ID NO: 3516140 - DNA, 16 bp, Homo sapiens
tcacaaagcccaaggg

SEQ ID NO: 3516141 - DNA, 12 bp, Homo sapiens
tcacaaataata

SEQ ID NO: 3516142 - DNA, 17 bp, Homo sapiens
tcacaacgtgcattgtg

SEQ ID NO: 3516143 - DNA, 18 bp, Homo sapiens
tcacaacgtgcattgtgc

SEQ ID NO: 3516144 - DNA, 19 bp, Homo sapiens
tcacaacgtgcattgtgct

SEQ ID NO: 3516145 - DNA, 21 bp, Homo sapiens
tcacaatagccgatatcagaa

SEQ ID NO: 3516146 - DNA, 22 bp, Homo sapiens
tcacaatagccgatatcagaat

SEQ ID NO: 3516147 - DNA, 17 bp, Homo sapiens
tcacaattccatttcca

SEQ ID NO: 3516148 - DNA, 10 bp, Homo sapiens
tcacacacac

SEQ ID NO: 3516149 - DNA, 15 bp, Homo sapiens
tcacacactttggct

SEQ ID NO: 3516150 - DNA, 22 bp, Homo sapiens
tcacacagtattacttctgcta

SEQ ID NO: 3516151 - DNA, 13 bp, Homo sapiens
tcacacagtgagt

SEQ ID NO: 3516152 - DNA, 17 bp, Homo sapiens
tcacacctgccctaaac

SEQ ID NO: 3516153 - DNA, 21 bp, Homo sapiens
tcacactgagaatgtaagaac

SEQ ID NO: 3516154 - DNA, 21 bp, Homo sapiens
tcacactgggtggtggcctgg

SEQ ID NO: 3516155 - DNA, 21 bp, Homo sapiens
tcacacttactgtaagacatt

SEQ ID NO: 3516156 - DNA, 23 bp, Homo sapiens
tcacacttactgtaagacattag

SEQ ID NO: 3516157 - DNA, 15 bp, Homo sapiens
tcacagcagcttcta

SEQ ID NO: 3516158 - DNA, 16 bp, Homo sapiens
tcacagccacccctga

SEQ ID NO: 3516159 - DNA, 13 bp, Homo sapiens
tcacagcctctga

SEQ ID NO: 3516160 - DNA, 11 bp, Homo sapiens
tcacaggcagg

SEQ ID NO: 3516161 - DNA, 18 bp, Homo sapiens
tcacaggcaggtccaggg

SEQ ID NO: 3516162 - DNA, 19 bp, Homo sapiens
tcacaggcaggtccagggt

SEQ ID NO: 3516163 - DNA, 19 bp, Homo sapiens
tcacaggccccaggaaagg

SEQ ID NO: 3516164 - DNA, 14 bp, Homo sapiens
tcacagtgctgtgt

SEQ ID NO: 3516165 - DNA, 12 bp, Homo sapiens
tcacatatctgt

SEQ ID NO: 3516166 - DNA, 18 bp, Homo sapiens
tcacatcctgtgtttcta

SEQ ID NO: 3516167 - DNA, 19 bp, Homo sapiens
tcacatcctgtgtttctag

SEQ ID NO: 3516168 - DNA, 18 bp, Homo sapiens
tcacatcttttaagacaa

SEQ ID NO: 3516169 - DNA, 19 bp, Homo sapiens
tcacatcttttaagacaaa

SEQ ID NO: 3516170 - DNA, 22 bp, Homo sapiens
tcacattagaagacaattgaca

SEQ ID NO: 3516171 - DNA, 20 bp, Homo sapiens
tcacattatttatttttcat

SEQ ID NO: 3516172 - DNA, 13 bp, Homo sapiens
tcacattctgctt

SEQ ID NO: 3516173 - DNA, 13 bp, Homo sapiens
tcaccaaggaaac

SEQ ID NO: 3516174 - DNA, 16 bp, Homo sapiens
tcaccacatgtgcaca

SEQ ID NO: 3516175 - DNA, 20 bp, Homo sapiens
tcaccaccccctccttccct

SEQ ID NO: 3516176 - DNA, 20 bp, Homo sapiens
tcaccacgactggccagggc

SEQ ID NO: 3516177 - DNA, 19 bp, Homo sapiens
tcaccagctgcaaagtgtt

SEQ ID NO: 3516178 - DNA, 21 bp, Homo sapiens
tcaccatgatggccaggctga

SEQ ID NO: 3516179 - DNA, 19 bp, Homo sapiens
tcaccatgatggggcccta

SEQ ID NO: 3516180 - DNA, 19 bp, Homo sapiens
tcaccatgtattttgtaaa

SEQ ID NO: 3516181 - DNA, 20 bp, Homo sapiens
tcaccattctgcatttagct

SEQ ID NO: 3516182 - DNA, 17 bp, Homo sapiens
tcaccatttgattatgt

SEQ ID NO: 3516183 - DNA, 17 bp, Homo sapiens
tcacccacaattgcctt

SEQ ID NO: 3516184 - DNA, 14 bp, Homo sapiens
tcacccacccctgc

SEQ ID NO: 3516185 - DNA, 13 bp, Homo sapiens
tcaccccagggcc

SEQ ID NO: 3516186 - DNA, 15 bp, Homo sapiens
tcaccccagggcctg

SEQ ID NO: 3516187 - DNA, 21 bp, Homo sapiens
tcaccccagggcctgagcctg

SEQ ID NO: 3516188 - DNA, 12 bp, Homo sapiens
tcaccccatccc

SEQ ID NO: 3516189 - DNA, 13 bp, Homo sapiens
tcaccccatccca

SEQ ID NO: 3516190 - DNA, 15 bp, Homo sapiens
tcaccccctccttca

SEQ ID NO: 3516191 - DNA, 18 bp, Homo sapiens
tcacccctccctttctcc

SEQ ID NO: 3516192 - DNA, 17 bp, Homo sapiens
tcaccctagccctctcc

SEQ ID NO: 3516193 - DNA, 16 bp, Homo sapiens
tcaccctgcaggactt

SEQ ID NO: 3516194 - DNA, 15 bp, Homo sapiens
tcaccggatcctggg

SEQ ID NO: 3516195 - DNA, 15 bp, Homo sapiens
tcaccgtgggctccc

SEQ ID NO: 3516196 - DNA, 15 bp, Homo sapiens
tcacctagaaattga

SEQ ID NO: 3516197 - DNA, 14 bp, Homo sapiens
tcacctcattctga

SEQ ID NO: 3516198 - DNA, 14 bp, Homo sapiens
tcacctccttcaat

SEQ ID NO: 3516199 - DNA, 13 bp, Homo sapiens
tcacctctcccac

SEQ ID NO: 3516200 - DNA, 17 bp, Homo sapiens
tcacctcttccactcct

SEQ ID NO: 3516201 - DNA, 16 bp, Homo sapiens
tcacctgaagactcat

SEQ ID NO: 3516202 - DNA, 16 bp, Homo sapiens
tcacctgccccaactc

SEQ ID NO: 3516203 - DNA, 16 bp, Homo sapiens
tcacctggggctgctg

SEQ ID NO: 3516204 - DNA, 22 bp, Homo sapiens
tcacctggggctgctggcctga

SEQ ID NO: 3516205 - DNA, 20 bp, Homo sapiens
tcacctgtgcttcgggccct

SEQ ID NO: 3516206 - DNA, 18 bp, Homo sapiens
tcaccttaggcagggaag

SEQ ID NO: 3516207 - DNA, 16 bp, Homo sapiens
tcaccttcagtaaccc

SEQ ID NO: 3516208 - DNA, 23 bp, Homo sapiens
tcaccttggcaccagacacccag

SEQ ID NO: 3516209 - DNA, 14 bp, Homo sapiens
tcacctttcccact

SEQ ID NO: 3516210 - DNA, 19 bp, Homo sapiens
tcacctttcccactttctt

SEQ ID NO: 3516211 - DNA, 21 bp, Homo sapiens
tcacgcctgtaatcccagcac

SEQ ID NO: 3516212 - DNA, 22 bp, Homo sapiens
tcacgcctgtaatcccagcact

SEQ ID NO: 3516213 - DNA, 19 bp, Homo sapiens
tcacgcctgtaatcctagc

SEQ ID NO: 3516214 - DNA, 15 bp, Homo sapiens
tcacgcttcacagtg

SEQ ID NO: 3516215 - DNA, 15 bp, Homo sapiens
tcacggaagttttca

SEQ ID NO: 3516216 - DNA, 23 bp, Homo sapiens
tcacggcaggacaacgaggaagc

SEQ ID NO: 3516217 - DNA, 13 bp, Homo sapiens
tcacggctcactg

SEQ ID NO: 3516218 - DNA, 20 bp, Homo sapiens
tcacgttaccttgacacata

SEQ ID NO: 3516219 - DNA, 23 bp, Homo sapiens
tcacgttttgttttgtgccaacc

SEQ ID NO: 3516220 - DNA, 13 bp, Homo sapiens
tcactacaactga

SEQ ID NO: 3516221 - DNA, 21 bp, Homo sapiens
tcactagggaatcctgcggca

SEQ ID NO: 3516222 - DNA, 21 bp, Homo sapiens
tcactatgttgcccaggcagg

SEQ ID NO: 3516223 - DNA, 17 bp, Homo sapiens
tcactattcctaggagg

SEQ ID NO: 3516224 - DNA, 18 bp, Homo sapiens
tcactattcctaggagga

SEQ ID NO: 3516225 - DNA, 12 bp, Homo sapiens
tcactcaaggcg

SEQ ID NO: 3516226 - DNA, 13 bp, Homo sapiens
tcactcaggctgg

SEQ ID NO: 3516227 - DNA, 21 bp, Homo sapiens
tcactcaggctggagtacagt

SEQ ID NO: 3516228 - DNA, 13 bp, Homo sapiens
tcactcattgctg

SEQ ID NO: 3516229 - DNA, 15 bp, Homo sapiens
tcactcattgctgag

SEQ ID NO: 3516230 - DNA, 19 bp, Homo sapiens
tcactcattgctgagcctc

SEQ ID NO: 3516231 - DNA, 16 bp, Homo sapiens
tcactctgtcgcccag

SEQ ID NO: 3516232 - DNA, 23 bp, Homo sapiens
tcactcttattgcccacgctgga

SEQ ID NO: 3516233 - DNA, 19 bp, Homo sapiens
tcactgacacaaaaagtag

SEQ ID NO: 3516234 - DNA, 17 bp, Homo sapiens
tcactgagttttccatg

SEQ ID NO: 3516235 - DNA, 23 bp, Homo sapiens
tcactgagttttccatggcagga

SEQ ID NO: 3516236 - DNA, 20 bp, Homo sapiens
tcactgatattttttataca

SEQ ID NO: 3516237 - DNA, 16 bp, Homo sapiens
tcactgcttttggcct

SEQ ID NO: 3516238 - DNA, 17 bp, Homo sapiens
tcactgcttttggcctg

SEQ ID NO: 3516239 - DNA, 19 bp, Homo sapiens
tcactggggtcacttggga

SEQ ID NO: 3516240 - DNA, 20 bp, Homo sapiens
tcactggggtcacttgggaa

SEQ ID NO: 3516241 - DNA, 19 bp, Homo sapiens
tcactgtcctccaagccag

SEQ ID NO: 3516242 - DNA, 12 bp, Homo sapiens
tcactgtggctg

SEQ ID NO: 3516243 - DNA, 22 bp, Homo sapiens
tcactgttctattcatctcaag

SEQ ID NO: 3516244 - DNA, 16 bp, Homo sapiens
tcactgtttgttttta

SEQ ID NO: 3516245 - DNA, 20 bp, Homo sapiens
tcacttctagggtatgggaa

SEQ ID NO: 3516246 - DNA, 17 bp, Homo sapiens
tcacttctgagaactca

SEQ ID NO: 3516247 - DNA, 22 bp, Homo sapiens
tcacttgaggtcaggagttcct

SEQ ID NO: 3516248 - DNA, 21 bp, Homo sapiens
tcacttgtgccaacactcaag

SEQ ID NO: 3516249 - DNA, 14 bp, Homo sapiens
tcagaaacaggacc

SEQ ID NO: 3516250 - DNA, 13 bp, Homo sapiens
tcagaaatacaga

SEQ ID NO: 3516251 - DNA, 13 bp, Homo sapiens
tcagaaccctgcc

SEQ ID NO: 3516252 - DNA, 16 bp, Homo sapiens
tcagaaccctgccatg

SEQ ID NO: 3516253 - DNA, 15 bp, Homo sapiens
tcagaacccttggct

SEQ ID NO: 3516254 - DNA, 13 bp, Homo sapiens
tcagaacttgctg

SEQ ID NO: 3516255 - DNA, 16 bp, Homo sapiens
tcagaagcctctgggt

SEQ ID NO: 3516256 - DNA, 23 bp, Homo sapiens
tcagaagggagctagccagagga

SEQ ID NO: 3516257 - DNA, 15 bp, Homo sapiens
tcagaatatcatctt

SEQ ID NO: 3516258 - DNA, 17 bp, Homo sapiens
tcagaatctttgttaag

SEQ ID NO: 3516259 - DNA, 18 bp, Homo sapiens
tcagaattagctgcttct

SEQ ID NO: 3516260 - DNA, 22 bp, Homo sapiens
tcagaatttgtgttgaaggaac

SEQ ID NO: 3516261 - DNA, 13 bp, Homo sapiens
tcagacaaaatgg

SEQ ID NO: 3516262 - DNA, 15 bp, Homo sapiens
tcagacaccctcaac

SEQ ID NO: 3516263 - DNA, 22 bp, Homo sapiens
tcagacaccctcaacctcttct

SEQ ID NO: 3516264 - DNA, 14 bp, Homo sapiens
tcagacatgttttc

SEQ ID NO: 3516265 - DNA, 16 bp, Homo sapiens
tcagacattttctttt

SEQ ID NO: 3516266 - DNA, 20 bp, Homo sapiens
tcagacattttcttttttta

SEQ ID NO: 3516267 - DNA, 14 bp, Homo sapiens
tcagaccacggctc

SEQ ID NO: 3516268 - DNA, 16 bp, Homo sapiens
tcagacgcctgaggaa

SEQ ID NO: 3516269 - DNA, 16 bp, Homo sapiens
tcagactctccttcag

SEQ ID NO: 3516270 - DNA, 17 bp, Homo sapiens
tcagactctccttcagg

SEQ ID NO: 3516271 - DNA, 23 bp, Homo sapiens
tcagacttgccatgtgactctgg

SEQ ID NO: 3516272 - DNA, 13 bp, Homo sapiens
tcagacttgtcaa

SEQ ID NO: 3516273 - DNA, 15 bp, Homo sapiens
tcagacttgtcaagc

SEQ ID NO: 3516274 - DNA, 16 bp, Homo sapiens
tcagactttggaaaat

SEQ ID NO: 3516275 - DNA, 20 bp, Homo sapiens
tcagagacaggtggcctagc

SEQ ID NO: 3516276 - DNA, 21 bp, Homo sapiens
tcagagaccaggccctggcta

SEQ ID NO: 3516277 - DNA, 15 bp, Homo sapiens
tcagagaccattgca

SEQ ID NO: 3516278 - DNA, 17 bp, Homo sapiens
tcagagatggacagaga

SEQ ID NO: 3516279 - DNA, 15 bp, Homo sapiens
tcagagatgggctga

SEQ ID NO: 3516280 - DNA, 14 bp, Homo sapiens
tcagagccacaggg

SEQ ID NO: 3516281 - DNA, 22 bp, Homo sapiens
tcagagccacagggtctgcctc

SEQ ID NO: 3516282 - DNA, 16 bp, Homo sapiens
tcagagccgtggtcct

SEQ ID NO: 3516283 - DNA, 17 bp, Homo sapiens
tcagagcctttcctcaa

SEQ ID NO: 3516284 - DNA, 22 bp, Homo sapiens
tcagagctaaactccttcctgg

SEQ ID NO: 3516285 - DNA, 18 bp, Homo sapiens
tcagagctgacacaggat

SEQ ID NO: 3516286 - DNA, 21 bp, Homo sapiens
tcagaggagagatagcctgtg

SEQ ID NO: 3516287 - DNA, 22 bp, Homo sapiens
tcagaggagagatagcctgtgg

SEQ ID NO: 3516288 - DNA, 23 bp, Homo sapiens
tcagaggagagatagcctgtggc

SEQ ID NO: 3516289 - DNA, 22 bp, Homo sapiens
tcagaggccttatgagggtcct

SEQ ID NO: 3516290 - DNA, 20 bp, Homo sapiens
tcagataaggtaaaatgcca

SEQ ID NO: 3516291 - DNA, 23 bp, Homo sapiens
tcagataaggtaaaatgccatga

SEQ ID NO: 3516292 - DNA, 18 bp, Homo sapiens
tcagatattctgctctat

SEQ ID NO: 3516293 - DNA, 14 bp, Homo sapiens
tcagatccagggac

SEQ ID NO: 3516294 - DNA, 15 bp, Homo sapiens
tcagatccagggaca

SEQ ID NO: 3516295 - DNA, 16 bp, Homo sapiens
tcagatccagggacag

SEQ ID NO: 3516296 - DNA, 21 bp, Homo sapiens
tcagatgatttcccccctccg

SEQ ID NO: 3516297 - DNA, 17 bp, Homo sapiens
tcagatgtaatgttttc

SEQ ID NO: 3516298 - DNA, 15 bp, Homo sapiens
tcagattgcatgtga

SEQ ID NO: 3516299 - DNA, 18 bp, Homo sapiens
tcagattgcatgtgactc

SEQ ID NO: 3516300 - DNA, 18 bp, Homo sapiens
tcagattgtggaatgttg

SEQ ID NO: 3516301 - DNA, 23 bp, Homo sapiens
tcagattgtggaatgttggataa

SEQ ID NO: 3516302 - DNA, 14 bp, Homo sapiens
tcagattttttcct

SEQ ID NO: 3516303 - DNA, 14 bp, Homo sapiens
tcagcaaaaagcaa

SEQ ID NO: 3516304 - DNA, 15 bp, Homo sapiens
tcagcaaaagatgct

SEQ ID NO: 3516305 - DNA, 13 bp, Homo sapiens
tcagcacaaggcc

SEQ ID NO: 3516306 - DNA, 15 bp, Homo sapiens
tcagcattattgaaa

SEQ ID NO: 3516307 - DNA, 19 bp, Homo sapiens
tcagcatttccacaccaag

SEQ ID NO: 3516308 - DNA, 17 bp, Homo sapiens
tcagccaattatgttaa

SEQ ID NO: 3516309 - DNA, 18 bp, Homo sapiens
tcagccaattatgttaaa

SEQ ID NO: 3516310 - DNA, 21 bp, Homo sapiens
tcagccactaagaacccctct

SEQ ID NO: 3516311 - DNA, 14 bp, Homo sapiens
tcagccagcacttg

SEQ ID NO: 3516312 - DNA, 22 bp, Homo sapiens
tcagccccgacttcctgactct

SEQ ID NO: 3516313 - DNA, 14 bp, Homo sapiens
tcagcccctgatcc

SEQ ID NO: 3516314 - DNA, 22 bp, Homo sapiens
tcagcccctgatcctgtgaagt

SEQ ID NO: 3516315 - DNA, 23 bp, Homo sapiens
tcagccctagggtggagagccac

SEQ ID NO: 3516316 - DNA, 13 bp, Homo sapiens
tcagccctgaccc

SEQ ID NO: 3516317 - DNA, 16 bp, Homo sapiens
tcagccctgaccctgt

SEQ ID NO: 3516318 - DNA, 23 bp, Homo sapiens
tcagccgtgtaaccatggaccca

SEQ ID NO: 3516319 - DNA, 14 bp, Homo sapiens
tcagcctcccaaag

SEQ ID NO: 3516320 - DNA, 13 bp, Homo sapiens
tcagcctcccaac

SEQ ID NO: 3516321 - DNA, 12 bp, Homo sapiens
tcagcctcccga

SEQ ID NO: 3516322 - DNA, 18 bp, Homo sapiens
tcagcctcccgagtagct

SEQ ID NO: 3516323 - DNA, 20 bp, Homo sapiens
tcagcctccggagtagctgg

SEQ ID NO: 3516324 - DNA, 12 bp, Homo sapiens
tcagcctggcca

SEQ ID NO: 3516325 - DNA, 11 bp, Homo sapiens
tagcagctgca

SEQ ID NO: 3516326 - DNA, 12 bp, Homo sapiens
tagcaggccatg

SEQ ID NO: 3516327 - DNA, 11 bp, Homo sapiens
tagcagggaaa

SEQ ID NO: 3516328 - DNA, 20 bp, Homo sapiens
tagcagggggggaaatgcat

SEQ ID NO: 3516329 - DNA, 14 bp, Homo sapiens
tagcagtgtaccca

SEQ ID NO: 3516330 - DNA, 17 bp, Homo sapiens
tagcatatctgccttta

SEQ ID NO: 3516331 - DNA, 18 bp, Homo sapiens
tagcatatctgcctttat

SEQ ID NO: 3516332 - DNA, 21 bp, Homo sapiens
tagcatatctgcctttattgt

SEQ ID NO: 3516333 - DNA, 22 bp, Homo sapiens
tagcatatctgcctttattgtg

SEQ ID NO: 3516334 - DNA, 17 bp, Homo sapiens
tagcatctgtacaaagg

SEQ ID NO: 3516335 - DNA, 16 bp, Homo sapiens
tagcatctttcatatg

SEQ ID NO: 3516336 - DNA, 15 bp, Homo sapiens
tagcatgacatttct

SEQ ID NO: 3516337 - DNA, 14 bp, Homo sapiens
tagccaaacaacaa

SEQ ID NO: 3516338 - DNA, 20 bp, Homo sapiens
tagccacaaaattgggaaag

SEQ ID NO: 3516339 - DNA, 15 bp, Homo sapiens
tagccagaggactgt

SEQ ID NO: 3516340 - DNA, 18 bp, Homo sapiens
tagccagcacacagggca

SEQ ID NO: 3516341 - DNA, 20 bp, Homo sapiens
tagccagcacacagggcagt

SEQ ID NO: 3516342 - DNA, 22 bp, Homo sapiens
tagccatgtgaaactcatctca

SEQ ID NO: 3516343 - DNA, 18 bp, Homo sapiens
tagccatttttcaaagca

SEQ ID NO: 3516344 - DNA, 16 bp, Homo sapiens
tagccccctggcctct

SEQ ID NO: 3516345 - DNA, 22 bp, Homo sapiens
tagcccctcccaagctggctgg

SEQ ID NO: 3516346 - DNA, 22 bp, Homo sapiens
tagcccctggggtggccaccag

SEQ ID NO: 3516347 - DNA, 15 bp, Homo sapiens
tagccctctccctct

SEQ ID NO: 3516348 - DNA, 21 bp, Homo sapiens
tagccggttcctgtccctgcg

SEQ ID NO: 3516349 - DNA, 20 bp, Homo sapiens
tagcctgtggccctgtcctg

SEQ ID NO: 3516350 - DNA, 20 bp, Homo sapiens
tagcgactaaactagatttt

SEQ ID NO: 3516351 - DNA, 17 bp, Homo sapiens
tagcgggccgggcgggg

SEQ ID NO: 3516352 - DNA, 19 bp, Homo sapiens
tagcgtgcccgtgtgcatg

SEQ ID NO: 3516353 - DNA, 19 bp, Homo sapiens
tagctaaacggattccaaa

SEQ ID NO: 3516354 - DNA, 15 bp, Homo sapiens
tagctagaggaacca

SEQ ID NO: 3516355 - DNA, 23 bp, Homo sapiens
tagctcaagagaaaagttgacac

SEQ ID NO: 3516356 - DNA, 20 bp, Homo sapiens
tagctcctgtggccccaccc

SEQ ID NO: 3516357 - DNA, 16 bp, Homo sapiens
tagctgcaaaggacag

SEQ ID NO: 3516358 - DNA, 12 bp, Homo sapiens
tagctgggacta

SEQ ID NO: 3516359 - DNA, 19 bp, Homo sapiens
tagctgggactacaggcac

SEQ ID NO: 3516360 - DNA, 18 bp, Homo sapiens
tagctgggactacaggtg

SEQ ID NO: 3516361 - DNA, 15 bp, Homo sapiens
tagctgggattacag

SEQ ID NO: 3516362 - DNA, 16 bp, Homo sapiens
tagctgtacaaatata

SEQ ID NO: 3516363 - DNA, 18 bp, Homo sapiens
tagctgtacaaatataag

SEQ ID NO: 3516364 - DNA, 19 bp, Homo sapiens
tagctgtattcatatattg

SEQ ID NO: 3516365 - DNA, 21 bp, Homo sapiens
tagctgtcccatctggtcatt

SEQ ID NO: 3516366 - DNA, 11 bp, Homo sapiens
tagcttcagga

SEQ ID NO: 3516367 - DNA, 19 bp, Homo sapiens
tagctttactgtttgttat

SEQ ID NO: 3516368 - DNA, 16 bp, Homo sapiens
tagcttttcaccttta

SEQ ID NO: 3516369 - DNA, 20 bp, Homo sapiens
tagctttttcatccccttac

SEQ ID NO: 3516370 - DNA, 22 bp, Homo sapiens
taggaaaaaaactattaaggat

SEQ ID NO: 3516371 - DNA, 22 bp, Homo sapiens
taggaaccgtggtatgtctgcc

SEQ ID NO: 3516372 - DNA, 14 bp, Homo sapiens
taggaagagaaacc

SEQ ID NO: 3516373 - DNA, 18 bp, Homo sapiens
taggaagagcaggactcc

SEQ ID NO: 3516374 - DNA, 15 bp, Homo sapiens
taggaaggcagaatg

SEQ ID NO: 3516375 - DNA, 16 bp, Homo sapiens
taggaagtaaattata

SEQ ID NO: 3516376 - DNA, 22 bp, Homo sapiens
taggaccaagcatcttgggggg

SEQ ID NO: 3516377 - DNA, 16 bp, Homo sapiens
taggaccaggatccag

SEQ ID NO: 3516378 - DNA, 14 bp, Homo sapiens
taggacccaagcag

SEQ ID NO: 3516379 - DNA, 15 bp, Homo sapiens
taggacgccacccag

SEQ ID NO: 3516380 - DNA, 15 bp, Homo sapiens
taggagaagccagga

SEQ ID NO: 3516381 - DNA, 16 bp, Homo sapiens
taggagaagccaggaa

SEQ ID NO: 3516382 - DNA, 18 bp, Homo sapiens
taggagctgccttggctc

SEQ ID NO: 3516383 - DNA, 19 bp, Homo sapiens
taggatagctaactgtaaa

SEQ ID NO: 3516384 - DNA, 13 bp, Homo sapiens
taggatttttaga

SEQ ID NO: 3516385 - DNA, 14 bp, Homo sapiens
taggatttttagaa

SEQ ID NO: 3516386 - DNA, 21 bp, Homo sapiens
taggattttttttaatgttta

SEQ ID NO: 3516387 - DNA, 20 bp, Homo sapiens
taggcaaatgtttaaacatt

SEQ ID NO: 3516388 - DNA, 11 bp, Homo sapiens
taggcagacac

SEQ ID NO: 3516389 - DNA, 14 bp, Homo sapiens
taggcagacacagg

SEQ ID NO: 3516390 - DNA, 22 bp, Homo sapiens
taggcagacacagggacttgaa

SEQ ID NO: 3516391 - DNA, 17 bp, Homo sapiens
taggcaggacatgctga

SEQ ID NO: 3516392 - DNA, 16 bp, Homo sapiens
taggcagtgggaggca

SEQ ID NO: 3516393 - DNA, 20 bp, Homo sapiens
taggcattaacacaaaggag

SEQ ID NO: 3516394 - DNA, 15 bp, Homo sapiens
taggcatttcctgct

SEQ ID NO: 3516395 - DNA, 17 bp, Homo sapiens
taggcatttcctgctga

SEQ ID NO: 3516396 - DNA, 16 bp, Homo sapiens
taggcatttgctgaat

SEQ ID NO: 3516397 - DNA, 21 bp, Homo sapiens
taggcatttttaccatcactg

SEQ ID NO: 3516398 - DNA, 14 bp, Homo sapiens
taggcccccacttg

SEQ ID NO: 3516399 - DNA, 19 bp, Homo sapiens
taggcccggagctgcccct

SEQ ID NO: 3516400 - DNA, 12 bp, Homo sapiens
taggcctatcaa

SEQ ID NO: 3516401 - DNA, 16 bp, Homo sapiens
taggcctcagccagag

SEQ ID NO: 3516402 - DNA, 13 bp, Homo sapiens
taggcgatcacaa

SEQ ID NO: 3516403 - DNA, 23 bp, Homo sapiens
taggcgatcacaacgtgcattgt

SEQ ID NO: 3516404 - DNA, 13 bp, Homo sapiens
taggctctgcctt

SEQ ID NO: 3516405 - DNA, 23 bp, Homo sapiens
taggctgccccgggtccccagct

SEQ ID NO: 3516406 - DNA, 18 bp, Homo sapiens
taggcttagtttgtgtgt

SEQ ID NO: 3516407 - DNA, 12 bp, Homo sapiens
taggcttttgtt

SEQ ID NO: 3516408 - DNA, 19 bp, Homo sapiens
tagggaaaaaccagcgtgt

SEQ ID NO: 3516409 - DNA, 20 bp, Homo sapiens
tagggaaaaaccagcgtgtg

SEQ ID NO: 3516410 - DNA, 13 bp, Homo sapiens
tagggaggaccac

SEQ ID NO: 3516411 - DNA, 23 bp, Homo sapiens
tagggaggaccacaggtgtgagc

SEQ ID NO: 3516412 - DNA, 16 bp, Homo sapiens
tagggggaactctagc

SEQ ID NO: 3516413 - DNA, 13 bp, Homo sapiens
tagggtgttctgt

SEQ ID NO: 3516414 - DNA, 14 bp, Homo sapiens
tagggttctgcctc

SEQ ID NO: 3516415 - DNA, 12 bp, Homo sapiens
tagggtttaatc

SEQ ID NO: 3516416 - DNA, 12 bp, Homo sapiens
taggtaaattct

SEQ ID NO: 3516417 - DNA, 13 bp, Homo sapiens
taggtaacttcat

SEQ ID NO: 3516418 - DNA, 14 bp, Homo sapiens
taggtagggtttaa

SEQ ID NO: 3516419 - DNA, 16 bp, Homo sapiens
taggtatgtttgtaac

SEQ ID NO: 3516420 - DNA, 18 bp, Homo sapiens
taggtatgtttgtaactt

SEQ ID NO: 3516421 - DNA, 16 bp, Homo sapiens
taggtcagtgcaaata

SEQ ID NO: 3516422 - DNA, 16 bp, Homo sapiens
tagttgccaatatgcc

SEQ ID NO: 3516423 - DNA, 16 bp, Homo sapiens
tagttggcagaaatac

SEQ ID NO: 3516424 - DNA, 18 bp, Homo sapiens
tagttggcagaaatacag

SEQ ID NO: 3516425 - DNA, 21 bp, Homo sapiens
tagtttgattattcagtgtca

SEQ ID NO: 3516426 - DNA, 13 bp, Homo sapiens
tagttttcttgtt

SEQ ID NO: 3516427 - DNA, 20 bp, Homo sapiens
tagtttttacagctgtgtta

SEQ ID NO: 3516428 - DNA, 18 bp, Homo sapiens
tataaaaagcttccatga

SEQ ID NO: 3516429 - DNA, 19 bp, Homo sapiens
tataaaactgcgttaaagg

SEQ ID NO: 3516430 - DNA, 12 bp, Homo sapiens
tataaaacttct

SEQ ID NO: 3516431 - DNA, 11 bp, Homo sapiens
tataaaagatg

SEQ ID NO: 3516432 - DNA, 20 bp, Homo sapiens
tataaaagatggggtctgta

SEQ ID NO: 3516433 - DNA, 12 bp, Homo sapiens
tataaaatgtaa

SEQ ID NO: 3516434 - DNA, 15 bp, Homo sapiens
tataaaattaagcaa

SEQ ID NO: 3516435 - DNA, 14 bp, Homo sapiens
tataaacatcacac

SEQ ID NO: 3516436 - DNA, 17 bp, Homo sapiens
tataaacatcacacaca

SEQ ID NO: 3516437 - DNA, 18 bp, Homo sapiens
tataaacatcacacacac

SEQ ID NO: 3516438 - DNA, 15 bp, Homo sapiens
tataaacctaaaaaa

SEQ ID NO: 3516439 - DNA, 12 bp, Homo sapiens
tataaagaattc

SEQ ID NO: 3516440 - DNA, 16 bp, Homo sapiens
tataaagtagtcctgt

SEQ ID NO: 3516441 - DNA, 14 bp, Homo sapiens
tataaagtgattga

SEQ ID NO: 3516442 - DNA, 15 bp, Homo sapiens
tataaagtgattgac

SEQ ID NO: 3516443 - DNA, 23 bp, Homo sapiens
tataaatcaacaccttaatatgc

SEQ ID NO: 3516444 - DNA, 21 bp, Homo sapiens
tataacaacgtctttttgttt

SEQ ID NO: 3516445 - DNA, 12 bp, Homo sapiens
tataagaaaaac

SEQ ID NO: 3516446 - DNA, 13 bp, Homo sapiens
tataagaaagaca

SEQ ID NO: 3516447 - DNA, 21 bp, Homo sapiens
tataagaaagacatctttctc

SEQ ID NO: 3516448 - DNA, 19 bp, Homo sapiens
tataagactaaatgattag

SEQ ID NO: 3516449 - DNA, 15 bp, Homo sapiens
tataagtaagaaaat

SEQ ID NO: 3516450 - DNA, 16 bp, Homo sapiens
tataagtaagaaaata

SEQ ID NO: 3516451 - DNA, 14 bp, Homo sapiens
tataagtgctgtat

SEQ ID NO: 3516452 - DNA, 16 bp, Homo sapiens
tataagtgctgtataa

SEQ ID NO: 3516453 - DNA, 19 bp, Homo sapiens
tataagtggtgcttagaaa

SEQ ID NO: 3516454 - DNA, 19 bp, Homo sapiens
tataagttatttttgtaca

SEQ ID NO: 3516455 - DNA, 15 bp, Homo sapiens
tataatactgtattt

SEQ ID NO: 3516456 - DNA, 15 bp, Homo sapiens
tataatatatttgtg

SEQ ID NO: 3516457 - DNA, 16 bp, Homo sapiens
tataatatatttgtgt

SEQ ID NO: 3516458 - DNA, 15 bp, Homo sapiens
tataatttttttctt

SEQ ID NO: 3516459 - DNA, 17 bp, Homo sapiens
tataatttttttcttgt

SEQ ID NO: 3516460 - DNA, 14 bp, Homo sapiens
tatacaaattagaa

SEQ ID NO: 3516461 - DNA, 17 bp, Homo sapiens
tatacaaattagaaaat

SEQ ID NO: 3516462 - DNA, 22 bp, Homo sapiens
tatacaataatgtaatttagtc

SEQ ID NO: 3516463 - DNA, 22 bp, Homo sapiens
tatacatagcatgacatttctt

SEQ ID NO: 3516464 - DNA, 15 bp, Homo sapiens
tatacatatctttat

SEQ ID NO: 3516465 - DNA, 19 bp, Homo sapiens
tatacccgtacaacgtgtc

SEQ ID NO: 3516466 - DNA, 19 bp, Homo sapiens
tatacctgtgcctcggctt

SEQ ID NO: 3516467 - DNA, 15 bp, Homo sapiens
tatacgcttttcttt

SEQ ID NO: 3516468 - DNA, 22 bp, Homo sapiens
tatactagggagccatttgaga

SEQ ID NO: 3516469 - DNA, 18 bp, Homo sapiens
tatactctagatgaagtt

SEQ ID NO: 3516470 - DNA, 16 bp, Homo sapiens
tatactctttctgtat

SEQ ID NO: 3516471 - DNA, 23 bp, Homo sapiens
tatactgcttggagctgagcaaa

SEQ ID NO: 3516472 - DNA, 13 bp, Homo sapiens
tatactgtacaat

SEQ ID NO: 3516473 - DNA, 15 bp, Homo sapiens
tatactgtacaataa

SEQ ID NO: 3516474 - DNA, 23 bp, Homo sapiens
tatacttgtggactaaaagatat

SEQ ID NO: 3516475 - DNA, 23 bp, Homo sapiens
tatagaaaaataaaaatctcttt

SEQ ID NO: 3516476 - DNA, 13 bp, Homo sapiens
tatagaacttcat

SEQ ID NO: 3516477 - DNA, 21 bp, Homo sapiens
tatagaatatttattacctct

SEQ ID NO: 3516478 - DNA, 16 bp, Homo sapiens
tatagaattagctttt

SEQ ID NO: 3516479 - DNA, 23 bp, Homo sapiens
tatagacagtccttaaaaatcac

SEQ ID NO: 3516480 - DNA, 14 bp, Homo sapiens
tatagcatctttca

SEQ ID NO: 3516481 - DNA, 18 bp, Homo sapiens
tatagcctaggtgacaga

SEQ ID NO: 3516482 - DNA, 20 bp, Homo sapiens
tatagcctaggtgacagagt

SEQ ID NO: 3516483 - DNA, 21 bp, Homo sapiens
tatagctgagactacaagtgt

SEQ ID NO: 3516484 - DNA, 16 bp, Homo sapiens
tatagctgtacaaata

SEQ ID NO: 3516485 - DNA, 18 bp, Homo sapiens
tatagtatttgattcaaa

SEQ ID NO: 3516486 - DNA, 13 bp, Homo sapiens
tatagtgatgtaa

SEQ ID NO: 3516487 - DNA, 16 bp, Homo sapiens
tatagttaatattttg

SEQ ID NO: 3516488 - DNA, 19 bp, Homo sapiens
tatagtttattgacaataa

SEQ ID NO: 3516489 - DNA, 17 bp, Homo sapiens
tatagtttgggcttcag

SEQ ID NO: 3516490 - DNA, 14 bp, Homo sapiens
tatataagaaagac

SEQ ID NO: 3516491 - DNA, 17 bp, Homo sapiens
tatataatatctaaagt

SEQ ID NO: 3516492 - DNA, 22 bp, Homo sapiens
tatatagtttattgacaataat

SEQ ID NO: 3516493 - DNA, 13 bp, Homo sapiens
tatatataaaata

SEQ ID NO: 3516494 - DNA, 14 bp, Homo sapiens
tatatatataaaat

SEQ ID NO: 3516495 - DNA, 14 bp, Homo sapiens
tatatattattctc

SEQ ID NO: 3516496 - DNA, 17 bp, Homo sapiens
tatatatttctattatt

SEQ ID NO: 3516497 - DNA, 14 bp, Homo sapiens
tatatcatatgtat

SEQ ID NO: 3516498 - DNA, 20 bp, Homo sapiens
tatatccttaatattttata

SEQ ID NO: 3516499 - DNA, 21 bp, Homo sapiens
tatatccttttcttctatgta

SEQ ID NO: 3516500 - DNA, 18 bp, Homo sapiens
tatatgcagtctctttat

SEQ ID NO: 3516501 - DNA, 22 bp, Homo sapiens
tatatgcagtctctttatttta

SEQ ID NO: 3516502 - DNA, 15 bp, Homo sapiens
tatatgcttactgtg

SEQ ID NO: 3516503 - DNA, 19 bp, Homo sapiens
tatatggcagagttgtaaa

SEQ ID NO: 3516504 - DNA, 20 bp, Homo sapiens
tatatggcagagttgtaaat

SEQ ID NO: 3516505 - DNA, 12 bp, Homo sapiens
tatatgtacatg

SEQ ID NO: 3516506 - DNA, 12 bp, Homo sapiens
tatatgtatttt

SEQ ID NO: 3516507 - DNA, 12 bp, Homo sapiens
tatatgtgagga

SEQ ID NO: 3516508 - DNA, 19 bp, Homo sapiens
tatattaaaaatataaaac

SEQ ID NO: 3516509 - DNA, 15 bp, Homo sapiens
tatattaatagtaat

SEQ ID NO: 3516510 - DNA, 15 bp, Homo sapiens
tatattaatgtactt

SEQ ID NO: 3516511 - DNA, 19 bp, Homo sapiens
tatgtgtcagttcatttgt

SEQ ID NO: 3516512 - DNA, 17 bp, Homo sapiens
tatgtgtttttcacatt

SEQ ID NO: 3516513 - DNA, 16 bp, Homo sapiens
tatgttaacctaggca

SEQ ID NO: 3516514 - DNA, 22 bp, Homo sapiens
tatgttaagcagctaaattttc

SEQ ID NO: 3516515 - DNA, 17 bp, Homo sapiens
tatgttctgtcttccca

SEQ ID NO: 3516516 - DNA, 18 bp, Homo sapiens
tatgttctgtcttcccaa

SEQ ID NO: 3516517 - DNA, 16 bp, Homo sapiens
tatgttgcccaggcag

SEQ ID NO: 3516518 - DNA, 21 bp, Homo sapiens
tatgttgcccaggcaggtctt

SEQ ID NO: 3516519 - DNA, 13 bp, Homo sapiens
tatgttgtcaaag

SEQ ID NO: 3516520 - DNA, 19 bp, Homo sapiens
tatgttttaagaggcaggg

SEQ ID NO: 3516521 - DNA, 17 bp, Homo sapiens
tatgttttttaaaatat

SEQ ID NO: 3516522 - DNA, 14 bp, Homo sapiens
tattaaaaaaaaca

SEQ ID NO: 3516523 - DNA, 18 bp, Homo sapiens
tattaaaaagtctgtatg

SEQ ID NO: 3516524 - DNA, 18 bp, Homo sapiens
tattaaaaatataaaact

SEQ ID NO: 3516525 - DNA, 21 bp, Homo sapiens
tattaaaaatataaaactgcg

SEQ ID NO: 3516526 - DNA, 19 bp, Homo sapiens
tattaaatacaaaacttcc

SEQ ID NO: 3516527 - DNA, 18 bp, Homo sapiens
tattaaggatgtagcttt

SEQ ID NO: 3516528 - DNA, 17 bp, Homo sapiens
tattaatagtaatttgt

SEQ ID NO: 3516529 - DNA, 18 bp, Homo sapiens
tattaatagtaatttgta

SEQ ID NO: 3516530 - DNA, 12 bp, Homo sapiens
tattacatcttt

SEQ ID NO: 3516531 - DNA, 17 bp, Homo sapiens
tattacatctttcacat

SEQ ID NO: 3516532 - DNA, 13 bp, Homo sapiens
tattaccatgtaa

SEQ ID NO: 3516533 - DNA, 14 bp, Homo sapiens
tattaccatgtaaa

SEQ ID NO: 3516534 - DNA, 15 bp, Homo sapiens
tattaccatgtaaat

SEQ ID NO: 3516535 - DNA, 22 bp, Homo sapiens
tattaccatgtaaataatctgt

SEQ ID NO: 3516536 - DNA, 14 bp, Homo sapiens
tattacttctgcta

SEQ ID NO: 3516537 - DNA, 15 bp, Homo sapiens
tattagagtgtcttt

SEQ ID NO: 3516538 - DNA, 22 bp, Homo sapiens
tattagtggtttatcagcaaaa

SEQ ID NO: 3516539 - DNA, 15 bp, Homo sapiens
tattagttgccaata

SEQ ID NO: 3516540 - DNA, 19 bp, Homo sapiens
tattataacaagtgtgtct

SEQ ID NO: 3516541 - DNA, 19 bp, Homo sapiens
tattataatttttttcaat

SEQ ID NO: 3516542 - DNA, 15 bp, Homo sapiens
tattatataaacttt

SEQ ID NO: 3516543 - DNA, 14 bp, Homo sapiens
tattatatttgaca

SEQ ID NO: 3516544 - DNA, 16 bp, Homo sapiens
tattatcaatgtttac

SEQ ID NO: 3516545 - DNA, 14 bp, Homo sapiens
tattatgagatgct

SEQ ID NO: 3516546 - DNA, 22 bp, Homo sapiens
tattatgtataaaatgtaacac

SEQ ID NO: 3516547 - DNA, 15 bp, Homo sapiens
tattattttcacctg

SEQ ID NO: 3516548 - DNA, 13 bp, Homo sapiens
tattattttccaa

SEQ ID NO: 3516549 - DNA, 14 bp, Homo sapiens
tattattttccaaa

SEQ ID NO: 3516550 - DNA, 13 bp, Homo sapiens
tattcaaattcct

SEQ ID NO: 3516551 - DNA, 14 bp, Homo sapiens
tattcaataaagta

SEQ ID NO: 3516552 - DNA, 17 bp, Homo sapiens
tattcaataaagtattt

SEQ ID NO: 3516553 - DNA, 19 bp, Homo sapiens
tattcaataaagtatttaa

SEQ ID NO: 3516554 - DNA, 21 bp, Homo sapiens
tattcaataaagtatttaatt

SEQ ID NO: 3516555 - DNA, 15 bp, Homo sapiens
tattcaattcctctg

SEQ ID NO: 3516556 - DNA, 18 bp, Homo sapiens
tattcaattcctctggga

SEQ ID NO: 3516557 - DNA, 21 bp, Homo sapiens
tattcagacaaaatggataca

SEQ ID NO: 3516558 - DNA, 14 bp, Homo sapiens
tattcagataatta

SEQ ID NO: 3516559 - DNA, 13 bp, Homo sapiens
tattcatatattg

SEQ ID NO: 3516560 - DNA, 18 bp, Homo sapiens
tattcattatttgtcaaa

SEQ ID NO: 3516561 - DNA, 22 bp, Homo sapiens
tattcattatttgtcaaattgt

SEQ ID NO: 3516562 - DNA, 16 bp, Homo sapiens
tattccagaatgctgt

SEQ ID NO: 3516563 - DNA, 23 bp, Homo sapiens
tattccagaatgctgtacatcta

SEQ ID NO: 3516564 - DNA, 15 bp, Homo sapiens
tattcccccctaagc

SEQ ID NO: 3516565 - DNA, 21 bp, Homo sapiens
tattccctagaaacttccaaa

SEQ ID NO: 3516566 - DNA, 15 bp, Homo sapiens
tattctaaaaccatt

SEQ ID NO: 3516567 - DNA, 11 bp, Homo sapiens
ttttacaaagg

SEQ ID NO: 3516568 - DNA, 16 bp, Homo sapiens
ttttacatactgctgt

SEQ ID NO: 3516569 - DNA, 18 bp, Homo sapiens
ttttacattacagaatat

SEQ ID NO: 3516570 - DNA, 14 bp, Homo sapiens
ttttacattttagt

SEQ ID NO: 3516571 - DNA, 20 bp, Homo sapiens
ttttaccacacactgttttt

SEQ ID NO: 3516572 - DNA, 15 bp, Homo sapiens
ttttactgaagcctt

SEQ ID NO: 3516573 - DNA, 20 bp, Homo sapiens
ttttagaaagcatttgaatg

SEQ ID NO: 3516574 - DNA, 20 bp, Homo sapiens
ttttagcccagtgttttctt

SEQ ID NO: 3516575 - DNA, 20 bp, Homo sapiens
ttttaggatacttaacaaat

SEQ ID NO: 3516576 - DNA, 21 bp, Homo sapiens
ttttaggatacttaacaaata

SEQ ID NO: 3516577 - DNA, 19 bp, Homo sapiens
ttttagtgaacttgaaata

SEQ ID NO: 3516578 - DNA, 23 bp, Homo sapiens
ttttagttactgaagccttacaa

SEQ ID NO: 3516579 - DNA, 14 bp, Homo sapiens
ttttataagaaaaa

SEQ ID NO: 3516580 - DNA, 16 bp, Homo sapiens
ttttataagaaaaact

SEQ ID NO: 3516581 - DNA, 16 bp, Homo sapiens
ttttataatgttgtat

SEQ ID NO: 3516582 - DNA, 19 bp, Homo sapiens
ttttatactctttctgtat

SEQ ID NO: 3516583 - DNA, 22 bp, Homo sapiens
ttttatatgaagataagtgtat

SEQ ID NO: 3516584 - DNA, 12 bp, Homo sapiens
ttttatatttgt

SEQ ID NO: 3516585 - DNA, 14 bp, Homo sapiens
ttttatatttgtag

SEQ ID NO: 3516586 - DNA, 18 bp, Homo sapiens
ttttatccataatgatgg

SEQ ID NO: 3516587 - DNA, 22 bp, Homo sapiens
ttttatccataatgatggattt

SEQ ID NO: 3516588 - DNA, 12 bp, Homo sapiens
ttttatgagatg

SEQ ID NO: 3516589 - DNA, 16 bp, Homo sapiens
ttttattgacacagaa

SEQ ID NO: 3516590 - DNA, 12 bp, Homo sapiens
ttttattgcctt

SEQ ID NO: 3516591 - DNA, 14 bp, Homo sapiens
ttttattgccttct

SEQ ID NO: 3516592 - DNA, 22 bp, Homo sapiens
ttttattgccttctcaccagct

SEQ ID NO: 3516593 - DNA, 19 bp, Homo sapiens
ttttatttaacagtgcaaa

SEQ ID NO: 3516594 - DNA, 14 bp, Homo sapiens
ttttatttcattgg

SEQ ID NO: 3516595 - DNA, 22 bp, Homo sapiens
ttttatttcattggttaatttt

SEQ ID NO: 3516596 - DNA, 15 bp, Homo sapiens
ttttattttggaact

SEQ ID NO: 3516597 - DNA, 19 bp, Homo sapiens
ttttcaaaatagaaaagtt

SEQ ID NO: 3516598 - DNA, 12 bp, Homo sapiens
ttttcaaagcaa

SEQ ID NO: 3516599 - DNA, 22 bp, Homo sapiens
ttttcaacagtgaagacagaag

SEQ ID NO: 3516600 - DNA, 18 bp, Homo sapiens
ttttcaaccataaaagaa

SEQ ID NO: 3516601 - DNA, 22 bp, Homo sapiens
ttttcaaccataaaagaagttt

SEQ ID NO: 3516602 - DNA, 18 bp, Homo sapiens
ttttcaactttgaataaa

SEQ ID NO: 3516603 - DNA, 24 bp, Homo sapiens
ttttcaactttgaataaagaatac

SEQ ID NO: 3516604 - DNA, 12 bp, Homo sapiens
ttttcaaggcct

SEQ ID NO: 3516605 - DNA, 17 bp, Homo sapiens
ttttcaaggccttcagt

SEQ ID NO: 3516606 - DNA, 16 bp, Homo sapiens
ttttcaatatttatta

SEQ ID NO: 3516607 - DNA, 15 bp, Homo sapiens
ttttcacagcaacat

SEQ ID NO: 3516608 - DNA, 18 bp, Homo sapiens
ttttcacggaagttttca

SEQ ID NO: 3516609 - DNA, 16 bp, Homo sapiens
ttttcagacttgtcaa

SEQ ID NO: 3516610 - DNA, 18 bp, Homo sapiens
ttttcaggctcgccaagg

SEQ ID NO: 3516611 - DNA, 21 bp, Homo sapiens
ttttcaggctcgccaaggcct

SEQ ID NO: 3516612 - DNA, 19 bp, Homo sapiens
ttttcatgttttaacaaaa

SEQ ID NO: 3516613 - DNA, 20 bp, Homo sapiens
ttttcatgttttaacaaaaa

SEQ ID NO: 3516614 - DNA, 18 bp, Homo sapiens
ttttcattccctgtagtt

SEQ ID NO: 3516615 - DNA, 15 bp, Homo sapiens
ttttccaaagaaaag

SEQ ID NO: 3516616 - DNA, 19 bp, Homo sapiens
ttttccaaagagtgatagt

SEQ ID NO: 3516617 - DNA, 22 bp, Homo sapiens
ttttccaaatgtaataaacttt

SEQ ID NO: 3516618 - DNA, 15 bp, Homo sapiens
ttttccactactgct

SEQ ID NO: 3516619 - DNA, 18 bp, Homo sapiens
ttttccactccattgtcg

SEQ ID NO: 3516620 - DNA, 13 bp, Homo sapiens
ttttccaggctgg

SEQ ID NO: 3516621 - DNA, 14 bp, Homo sapiens
ttttccatatattg

SEQ ID NO: 3516622 - DNA, 19 bp, Homo sapiens
ttttcccagctacaccttt

SEQ ID NO: 3516623 - DNA, 16 bp, Homo sapiens
ttttcccataagacaa

SEQ ID NO: 3516624 - DNA, 15 bp, Homo sapiens
ttttcccatttgtaa

SEQ ID NO: 3516625 - DNA, 20 bp, Homo sapiens
ttttcctaataaagttctgt

SEQ ID NO: 3516626 - DNA, 19 bp, Homo sapiens
ttttcctatgctattgaca

SEQ ID NO: 3516627 - DNA, 10 bp, Homo sapiens
ttttcctgcc

SEQ ID NO: 3516628 - DNA, 21 bp, Homo sapiens
ttttctcgctgtcctttctag

SEQ ID NO: 3516629 - DNA, 18 bp, Homo sapiens
ttttcttgcctctgtccc

SEQ ID NO: 3516630 - DNA, 21 bp, Homo sapiens
ttttcttgcctctgtcccctt

SEQ ID NO: 3516631 - DNA, 18 bp, Homo sapiens
ttttctttaaagaagttg

SEQ ID NO: 3516632 - DNA, 16 bp, Homo sapiens
ttttgaattgttacat

SEQ ID NO: 3516633 - DNA, 14 bp, Homo sapiens
ttttgacttaatgt

SEQ ID NO: 3516634 - DNA, 15 bp, Homo sapiens
ttttgacttaatgtg

SEQ ID NO: 3516635 - DNA, 19 bp, Homo sapiens
ttttgagaacgtaaagaac

SEQ ID NO: 3516636 - DNA, 19 bp, Homo sapiens
ttttgagtatttttaaaaa

SEQ ID NO: 3516637 - DNA, 12 bp, Homo sapiens
ttttgattatgt

SEQ ID NO: 3516638 - DNA, 21 bp, Homo sapiens
ttttgcaacctcgctggactc

SEQ ID NO: 3516639 - DNA, 22 bp, Homo sapiens
ttttgcaagtgaaggtttacaa

SEQ ID NO: 3516640 - DNA, 14 bp, Homo sapiens
ttttgctgcttctg

SEQ ID NO: 3516641 - DNA, 23 bp, Homo sapiens
ttttgctggaattcctaactttt

SEQ ID NO: 3516642 - DNA, 21 bp, Homo sapiens
ttttgctttcgaactgctagt

SEQ ID NO: 3516643 - DNA, 21 bp, Homo sapiens
ttttgcttttggcaaaactct

SEQ ID NO: 3516644 - DNA, 17 bp, Homo sapiens
ttttggactccatctct

SEQ ID NO: 3516645 - DNA, 16 bp, Homo sapiens
ttttggagtgttatgt

SEQ ID NO: 3516646 - DNA, 16 bp, Homo sapiens
ttttggattgtatatt

SEQ ID NO: 3516647 - DNA, 19 bp, Homo sapiens
ttttggcaaaactctactt

SEQ ID NO: 3516648 - DNA, 23 bp, Homo sapiens
ttttggcctcatctctgcctgac

SEQ ID NO: 3516649 - DNA, 15 bp, Homo sapiens
ttttggcctggagtt

SEQ ID NO: 3516650 - DNA, 16 bp, Homo sapiens
ttttggtacaaaaata

SEQ ID NO: 3516651 - DNA, 19 bp, Homo sapiens
ttttgtagagccagggtct

SEQ ID NO: 3516652 - DNA, 17 bp, Homo sapiens
ttttgtagcaaccattt

SEQ ID NO: 3516653 - DNA, 14 bp, Homo sapiens
ttttgtatgtaaat

SEQ ID NO: 3516654 - DNA, 15 bp, Homo sapiens
ttttgtcaacattgt

SEQ ID NO: 3516655 - DNA, 15 bp, Homo sapiens
ttttgtctaattaaa

SEQ ID NO: 3516656 - DNA, 13 bp, Homo sapiens
ttttgtgtcctcc

SEQ ID NO: 3516657 - DNA, 20 bp, Homo sapiens
ttttgttccaatgtcaatgt

SEQ ID NO: 3516658 - DNA, 19 bp, Homo sapiens
ttttgttcccctcctccac

SEQ ID NO: 3516659 - DNA, 23 bp, Homo sapiens
ttttgttcgcatggtcacacact

SEQ ID NO: 3516660 - DNA, 14 bp, Homo sapiens
ttttgttctctggg

SEQ ID NO: 3516661 - DNA, 17 bp, Homo sapiens
ttttgttctctgggaga

SEQ ID NO: 3516662 - DNA, 16 bp, Homo sapiens
ttttgttgccccagaa

SEQ ID NO: 3516663 - DNA, 14 bp, Homo sapiens
ttttgtttggtatt

SEQ ID NO: 3516664 - DNA, 19 bp, Homo sapiens
ttttgtttggtattgtatt

SEQ ID NO: 3516665 - DNA, 14 bp, Homo sapiens
ttttgtttgtattg

SEQ ID NO: 3516666 - DNA, 16 bp, Homo sapiens
ttttgttttaaaatta

SEQ ID NO: 3516667 - DNA, 13 bp, Homo sapiens
ttttgttttacaa

SEQ ID NO: 3516668 - DNA, 23 bp, Homo sapiens
tttttaaaaaaataaaacagtat

SEQ ID NO: 3516669 - DNA, 18 bp, Homo sapiens
tttttaaaaaatattttc

SEQ ID NO: 3516670 - DNA, 13 bp, Homo sapiens
tttttaatcagtt

SEQ ID NO: 3516671 - DNA, 13 bp, Homo sapiens
tttttaatgctat

SEQ ID NO: 3516672 - DNA, 12 bp, Homo sapiens
tttttaatgctt

SEQ ID NO: 3516673 - DNA, 13 bp, Homo sapiens
tttttacacttta

SEQ ID NO: 3516674 - DNA, 19 bp, Homo sapiens
tttttacagctgtgttatt

SEQ ID NO: 3516675 - DNA, 16 bp, Homo sapiens
tttttactattaacat

SEQ ID NO: 3516676 - DNA, 20 bp, Homo sapiens
tttttagaaagcatttgaat

SEQ ID NO: 3516677 - DNA, 22 bp, Homo sapiens
tttttattattatttatttgat

SEQ ID NO: 3516678 - DNA, 15 bp, Homo sapiens
tttttattcagcaga

SEQ ID NO: 3516679 - DNA, 13 bp, Homo sapiens
tttttattgcctt

SEQ ID NO: 3516680 - DNA, 16 bp, Homo sapiens
tttttcacggaagttt

SEQ ID NO: 3516681 - DNA, 11 bp, Homo sapiens
tttttcatgtt

SEQ ID NO: 3516682 - DNA, 20 bp, Homo sapiens
tttttcatgttttaacaaaa

SEQ ID NO: 3516683 - DNA, 20 bp, Homo sapiens
tttttccaatgcttcttata

SEQ ID NO: 3516684 - DNA, 20 bp, Homo sapiens
tttttccttaatccagctga

SEQ ID NO: 3516685 - DNA, 11 bp, Homo sapiens
tttttgaagtg

SEQ ID NO: 3516686 - DNA, 12 bp, Homo sapiens
tttttgcaataa

SEQ ID NO: 3516687 - DNA, 20 bp, Homo sapiens
tttttgcacatgtttcctct

SEQ ID NO: 3516688 - DNA, 13 bp, Homo sapiens
tttttggtacaaa

SEQ ID NO: 3516689 - DNA, 19 bp, Homo sapiens
tttttgtaataacatttaa

SEQ ID NO: 3516690 - DNA, 12 bp, Homo sapiens
tttttgtacatg

SEQ ID NO: 3516691 - DNA, 20 bp, Homo sapiens
tttttgtagtgacctgttta

SEQ ID NO: 3516692 - DNA, 19 bp, Homo sapiens
tttttgtgaaaagctccat

SEQ ID NO: 3516693 - DNA, 20 bp, Homo sapiens
tttttgttcttgatggagat

SEQ ID NO: 3516694 - DNA, 14 bp, Homo sapiens
tttttgttggagtg

SEQ ID NO: 3516695 - DNA, 17 bp, Homo sapiens
tttttgttttacaatgt

SEQ ID NO: 3516696 - DNA, 13 bp, Homo sapiens
ttttttaaaaact

SEQ ID NO: 3516697 - DNA, 19 bp, Homo sapiens
ttttttaaccaaaggtgaa

SEQ ID NO: 3516698 - DNA, 15 bp, Homo sapiens
ttttttattcagcag

SEQ ID NO: 3516699 - DNA, 13 bp, Homo sapiens
ttttttcatttat

SEQ ID NO: 3516700 - DNA, 12 bp, Homo sapiens
ttttttctgcac

SEQ ID NO: 3516701 - DNA, 12 bp, Homo sapiens
tttttttggatg

SEQ ID NO: 3516702 - DNA, 14 bp, Homo sapiens
ttttttttaaacta

SEQ ID NO: 3516703 - DNA, 11 bp, Homo sapiens
ttttttttcat

SEQ ID NO: 3516704 - DNA, 11 bp, Homo sapiens
ttttttttcca

SEQ ID NO: 3516705 - DNA, 19 bp, Homo sapiens
tttgagcctgatgtttaca

SEQ ID NO: 3516706 - DNA, 20 bp, Homo sapiens
tttgagtggatgatgtttcg

SEQ ID NO: 3516707 - DNA, 13 bp, Homo sapiens
tttgataatgaca

SEQ ID NO: 3516708 - DNA, 17 bp, Homo sapiens
tttgataatgacactgt

SEQ ID NO: 3516709 - DNA, 18 bp, Homo sapiens
tttgataatgacactgtt

SEQ ID NO: 3516710 - DNA, 22 bp, Homo sapiens
tttgatacagtcaacaagcctg

SEQ ID NO: 3516711 - DNA, 20 bp, Homo sapiens
tttgatacataaacttttgc

SEQ ID NO: 3516712 - DNA, 15 bp, Homo sapiens
tttgatccaagctgg

SEQ ID NO: 3516713 - DNA, 17 bp, Homo sapiens
tttgatgcatgtctttt

SEQ ID NO: 3516714 - DNA, 13 bp, Homo sapiens
tttgattctcctt

SEQ ID NO: 3516715 - DNA, 16 bp, Homo sapiens
tttgattgtttacagg

SEQ ID NO: 3516716 - DNA, 11 bp, Homo sapiens
tttgcaaagta

SEQ ID NO: 3516717 - DNA, 14 bp, Homo sapiens
tttgcaaagtactg

SEQ ID NO: 3516718 - DNA, 17 bp, Homo sapiens
tttgcaaagtactgtaa

SEQ ID NO: 3516719 - DNA, 20 bp, Homo sapiens
tttgcaagggaaaagtctct

SEQ ID NO: 3516720 - DNA, 13 bp, Homo sapiens
tttgcaagtgaag

SEQ ID NO: 3516721 - DNA, 21 bp, Homo sapiens
tttgcaagtgaaggtttacaa

SEQ ID NO: 3516722 - DNA, 14 bp, Homo sapiens
tttgcaataatgca

SEQ ID NO: 3516723 - DNA, 15 bp, Homo sapiens
tttgcaataatgcag

SEQ ID NO: 3516724 - DNA, 17 bp, Homo sapiens
tttgcaataatgcagta

SEQ ID NO: 3516725 - DNA, 22 bp, Homo sapiens
tttgcaataatgcagtatggta

SEQ ID NO: 3516726 - DNA, 13 bp, Homo sapiens
tttgcactgtgtg

SEQ ID NO: 3516727 - DNA, 16 bp, Homo sapiens
tttgcactgtgtgctg

SEQ ID NO: 3516728 - DNA, 21 bp, Homo sapiens
tttgcatagcagctgctacta

SEQ ID NO: 3516729 - DNA, 21 bp, Homo sapiens
tttgccagagccaaattttat

SEQ ID NO: 3516730 - DNA, 23 bp, Homo sapiens
tttgccagagccaaattttatct

SEQ ID NO: 3516731 - DNA, 12 bp, Homo sapiens
tttgccctttga

SEQ ID NO: 3516732 - DNA, 19 bp, Homo sapiens
tttgcgtacacagagaagg

SEQ ID NO: 3516733 - DNA, 12 bp, Homo sapiens
tttgctgtaaga

SEQ ID NO: 3516734 - DNA, 19 bp, Homo sapiens
tttgctgtaagatgtctgt

SEQ ID NO: 3516735 - DNA, 23 bp, Homo sapiens
tttgctgtcccatagtccctgcc

SEQ ID NO: 3516736 - DNA, 16 bp, Homo sapiens
tttgcttagaaaagaa

SEQ ID NO: 3516737 - DNA, 20 bp, Homo sapiens
tttgctttgggtttgtggca

SEQ ID NO: 3516738 - DNA, 14 bp, Homo sapiens
tttggaaacaacat

SEQ ID NO: 3516739 - DNA, 12 bp, Homo sapiens
tttggaactatg

SEQ ID NO: 3516740 - DNA, 20 bp, Homo sapiens
tttggaagatcctgtgagga

SEQ ID NO: 3516741 - DNA, 13 bp, Homo sapiens
tttggaatacttt

SEQ ID NO: 3516742 - DNA, 15 bp, Homo sapiens
tttggaatacttttt

SEQ ID NO: 3516743 - DNA, 17 bp, Homo sapiens
tttggaatactttttgt

SEQ ID NO: 3516744 - DNA, 22 bp, Homo sapiens
tttggaatttttgcttgacttc

SEQ ID NO: 3516745 - DNA, 18 bp, Homo sapiens
tttggactccatctctca

SEQ ID NO: 3516746 - DNA, 18 bp, Homo sapiens
tttggagagtttcctgaa

SEQ ID NO: 3516747 - DNA, 22 bp, Homo sapiens
tttggagtgttatgtatttcct

SEQ ID NO: 3516748 - DNA, 22 bp, Homo sapiens
tttggatctgtgacacatcgtt

SEQ ID NO: 3516749 - DNA, 13 bp, Homo sapiens
tttggattcttta

SEQ ID NO: 3516750 - DNA, 20 bp, Homo sapiens
tttggattggggtccctcta

SEQ ID NO: 3516751 - DNA, 20 bp, Homo sapiens
tttggcagagcttcttccag

SEQ ID NO: 3516752 - DNA, 22 bp, Homo sapiens
tttggcaggggcagaaaactct

SEQ ID NO: 3516753 - DNA, 22 bp, Homo sapiens
tttggcctccatcctcatctct

SEQ ID NO: 3516754 - DNA, 13 bp, Homo sapiens
tttggctgtgtct

SEQ ID NO: 3516755 - DNA, 17 bp, Homo sapiens
tttgggaatatttgaat

SEQ ID NO: 3516756 - DNA, 11 bp, Homo sapiens
tttgggcatgt

SEQ ID NO: 3516757 - DNA, 22 bp, Homo sapiens
tttgggtatgtttaatctgtta

SEQ ID NO: 3516758 - DNA, 20 bp, Homo sapiens
tttggttcttctcaaaagaa

SEQ ID NO: 3516759 - DNA, 14 bp, Homo sapiens
tttggttttgttcc

SEQ ID NO: 3516760 - DNA, 15 bp, Homo sapiens
tttggttttgttccc

SEQ ID NO: 3516761 - DNA, 16 bp, Homo sapiens
tttggttttgttcccc

SEQ ID NO: 3516762 - DNA, 21 bp, Homo sapiens
tttggttttgttcccctcctc

SEQ ID NO: 3516763 - DNA, 21 bp, Homo sapiens
tttgtaaagttggttggataa

SEQ ID NO: 3516764 - DNA, 14 bp, Homo sapiens
tttgtaaataggat

SEQ ID NO: 3516765 - DNA, 19 bp, Homo sapiens
tttgtaagaactaaagaag

SEQ ID NO: 3516766 - DNA, 20 bp, Homo sapiens
tttgtaatgaattcctagaa

SEQ ID NO: 3516767 - DNA, 11 bp, Homo sapiens
tttgtacatgt

SEQ ID NO: 3516768 - DNA, 12 bp, Homo sapiens
tttgtaccagtg

SEQ ID NO: 3516769 - DNA, 22 bp, Homo sapiens
tttgtaccagtgaatttttgca

SEQ ID NO: 3516770 - DNA, 13 bp, Homo sapiens
tttgtactgttta

SEQ ID NO: 3516771 - DNA, 13 bp, Homo sapiens
tttgtagagccag

SEQ ID NO: 3516772 - DNA, 15 bp, Homo sapiens
tttgtagcaaccatt

SEQ ID NO: 3516773 - DNA, 21 bp, Homo sapiens
tttgtaggagaaactcccatg

SEQ ID NO: 3516774 - DNA, 16 bp, Homo sapiens
tttgtatagtaaagtg

SEQ ID NO: 3516775 - DNA, 17 bp, Homo sapiens
tttgtatagtaaagtga

SEQ ID NO: 3516776 - DNA, 18 bp, Homo sapiens
tttgtatgaaattataat

SEQ ID NO: 3516777 - DNA, 14 bp, Homo sapiens
tttgtatgtaaatg

SEQ ID NO: 3516778 - DNA, 16 bp, Homo sapiens
tttgtatgtaaatgtg

SEQ ID NO: 3516779 - DNA, 10 bp, Homo sapiens
tttgtatgtt

SEQ ID NO: 3516780 - DNA, 12 bp, Homo sapiens
tttgtatgtttt

SEQ ID NO: 3516781 - DNA, 14 bp, Homo sapiens
tttgtattctctga

SEQ ID NO: 3516782 - DNA, 16 bp, Homo sapiens
tttgtattctctgagc

SEQ ID NO: 3516783 - DNA, 17 bp, Homo sapiens
tttgtcaccagaacaca

SEQ ID NO: 3516784 - DNA, 13 bp, Homo sapiens
tttgtcatatcaa

SEQ ID NO: 3516785 - DNA, 20 bp, Homo sapiens
tttgtcattagcctgagtag

SEQ ID NO: 3516786 - DNA, 23 bp, Homo sapiens
tttgtcattagcctgagtagaaa

SEQ ID NO: 3516787 - DNA, 19 bp, Homo sapiens
tttgtcctgatgcttttgt

SEQ ID NO: 3516788 - DNA, 14 bp, Homo sapiens
tttgtctcatccca

SEQ ID NO: 3516789 - DNA, 17 bp, Homo sapiens
tttgtctgtcttcatag

SEQ ID NO: 3516790 - DNA, 15 bp, Homo sapiens
tttgtgacattcctt

SEQ ID NO: 3516791 - DNA, 18 bp, Homo sapiens
tttgtggccaaggagctg

SEQ ID NO: 3516792 - DNA, 12 bp, Homo sapiens
tttgtgtcctcc

SEQ ID NO: 3516793 - DNA, 16 bp, Homo sapiens
tttgtgtcctccagga

SEQ ID NO: 3516794 - DNA, 14 bp, Homo sapiens
tttgtgttcttctt

SEQ ID NO: 3516795 - DNA, 13 bp, Homo sapiens
tttgttaatatta

SEQ ID NO: 3516796 - DNA, 17 bp, Homo sapiens
tttgttaggattttcac

SEQ ID NO: 3516797 - DNA, 16 bp, Homo sapiens
tttgttattgttttgt

SEQ ID NO: 3516798 - DNA, 16 bp, Homo sapiens
tttgttattttgcaac

SEQ ID NO: 3516799 - DNA, 12 bp, Homo sapiens
tttgttccactt

SEQ ID NO: 3516800 - DNA, 19 bp, Homo sapiens
tttgttcccctcctccact

SEQ ID NO: 3516801 - DNA, 13 bp, Homo sapiens
tttgttcttatga

SEQ ID NO: 3516802 - DNA, 18 bp, Homo sapiens
tttgttcttgatggagat

SEQ ID NO: 3516803 - DNA, 14 bp, Homo sapiens
tttgttgccccaga

SEQ ID NO: 3516804 - DNA, 19 bp, Homo sapiens
tttgttggagtgtttctaa

SEQ ID NO: 3516805 - DNA, 17 bp, Homo sapiens
tttgtttattaaatagt

SEQ ID NO: 3516806 - DNA, 15 bp, Homo sapiens
tttgtttgtattgta

SEQ ID NO: 3516807 - DNA, 18 bp, Homo sapiens
tttgttttacaatgtcat

SEQ ID NO: 3516808 - DNA, 12 bp, Homo sapiens
tttgttttgcac

SEQ ID NO: 3516809 - DNA, 21 bp, Homo sapiens
tttgttttggattctttaaat

SEQ ID NO: 3516810 - DNA, 18 bp, Homo sapiens
tttgtttttatttaaatt

SEQ ID NO: 3516811 - DNA, 19 bp, Homo sapiens
ttttaaaaaaataaaacag

SEQ ID NO: 3516812 - DNA, 20 bp, Homo sapiens
ttttaaaaaaataaaacagt

SEQ ID NO: 3516813 - DNA, 22 bp, Homo sapiens
ttttaaaaaaataaaacagtat

SEQ ID NO: 3516814 - DNA, 21 bp, Homo sapiens
ttttaaaaaactgctgactgt

SEQ ID NO: 3516815 - DNA, 21 bp, Homo sapiens
ttttaaaaaatgttttctggg

SEQ ID NO: 3516816 - DNA, 22 bp, Homo sapiens
ttttaaaaaatgttttctgggg

SEQ ID NO: 3516817 - DNA, 19 bp, Homo sapiens
ttttaaaaacatagaaaaa

SEQ ID NO: 3516818 - DNA, 13 bp, Homo sapiens
ttttaaaacccag

SEQ ID NO: 3516819 - DNA, 14 bp, Homo sapiens
ttttaaaagacaag

SEQ ID NO: 3516820 - DNA, 23 bp, Homo sapiens
ttttaaaagacaagacttcagta

SEQ ID NO: 3516821 - DNA, 16 bp, Homo sapiens
ttttaaaataaactgt

SEQ ID NO: 3516822 - DNA, 19 bp, Homo sapiens
ttttaaaataaactgtaaa

SEQ ID NO: 3516823 - DNA, 22 bp, Homo sapiens
ttttaaaataaactgtaaacta

SEQ ID NO: 3516824 - DNA, 19 bp, Homo sapiens
ttttaaacatgagaataaa

SEQ ID NO: 3516825 - DNA, 23 bp, Homo sapiens
ttttaaagaatatgactttttat

SEQ ID NO: 3516826 - DNA, 21 bp, Homo sapiens
ttttaaagacctgacaccttt

SEQ ID NO: 3516827 - DNA, 15 bp, Homo sapiens
ttttaaatgtacaga

SEQ ID NO: 3516828 - DNA, 12 bp, Homo sapiens
ttttaaccaaag

SEQ ID NO: 3516829 - DNA, 16 bp, Homo sapiens
ttttaaccaaaggtga

SEQ ID NO: 3516830 - DNA, 19 bp, Homo sapiens
ttttaactgccaatcctta

SEQ ID NO: 3516831 - DNA, 20 bp, Homo sapiens
ttttaagaaattttgccttt

SEQ ID NO: 3516832 - DNA, 19 bp, Homo sapiens
ttttaagacgtgtttgtgt

SEQ ID NO: 3516833 - DNA, 22 bp, Homo sapiens
ttttaagataaattataagtta

SEQ ID NO: 3516834 - DNA, 18 bp, Homo sapiens
ttttaaggtctttcagta

SEQ ID NO: 3516835 - DNA, 21 bp, Homo sapiens
ttttaagtgaaagtgaggaaa

SEQ ID NO: 3516836 - DNA, 15 bp, Homo sapiens
ttttaatgatgacaa

SEQ ID NO: 3516837 - DNA, 20 bp, Homo sapiens
ttttaatgctatttgaacaa

SEQ ID NO: 3516838 - DNA, 13 bp, Homo sapiens
ttttaatgcttaa

SEQ ID NO: 3516839 - DNA, 10 bp, Homo sapiens
ttttaattta

SEQ ID NO: 3516840 - DNA, 14 bp, Homo sapiens
ttttaatttagtaa

SEQ ID NO: 3516841 - DNA, 12 bp, Homo sapiens
ttttaattttta

SEQ ID NO: 3516842 - DNA, 15 bp, Homo sapiens
tttcagcagctgcag

SEQ ID NO: 3516843 - DNA, 18 bp, Homo sapiens
tttcagcgactccgttgg

SEQ ID NO: 3516844 - DNA, 20 bp, Homo sapiens
tttcaggctcgccaaggcct

SEQ ID NO: 3516845 - DNA, 18 bp, Homo sapiens
tttcaggttttgtaaaga

SEQ ID NO: 3516846 - DNA, 19 bp, Homo sapiens
tttcaggttttgtaaagat

SEQ ID NO: 3516847 - DNA, 16 bp, Homo sapiens
tttcagtactttttta

SEQ ID NO: 3516848 - DNA, 21 bp, Homo sapiens
tttcagtggggcagtcattat

SEQ ID NO: 3516849 - DNA, 16 bp, Homo sapiens
tttcagtgttacctgt

SEQ ID NO: 3516850 - DNA, 17 bp, Homo sapiens
tttcagtgttacctgtg

SEQ ID NO: 3516851 - DNA, 17 bp, Homo sapiens
tttcataagtatttcaa

SEQ ID NO: 3516852 - DNA, 23 bp, Homo sapiens
tttcataatgaaaaactatgtca

SEQ ID NO: 3516853 - DNA, 20 bp, Homo sapiens
tttcatagttggggtcatag

SEQ ID NO: 3516854 - DNA, 18 bp, Homo sapiens
tttcatattctttcaatt

SEQ ID NO: 3516855 - DNA, 21 bp, Homo sapiens
tttcatccactagtgcaaatc

SEQ ID NO: 3516856 - DNA, 16 bp, Homo sapiens
tttcatctcttgtata

SEQ ID NO: 3516857 - DNA, 11 bp, Homo sapiens
tttcatctgct

SEQ ID NO: 3516858 - DNA, 20 bp, Homo sapiens
tttcatctgctctccttcct

SEQ ID NO: 3516859 - DNA, 22 bp, Homo sapiens
tttcatctgctctccttcctgg

SEQ ID NO: 3516860 - DNA, 16 bp, Homo sapiens
tttcatgttttaacaa

SEQ ID NO: 3516861 - DNA, 22 bp, Homo sapiens
tttcattagaagttaccaaatt

SEQ ID NO: 3516862 - DNA, 14 bp, Homo sapiens
tttcattccctgta

SEQ ID NO: 3516863 - DNA, 23 bp, Homo sapiens
tttcattgaggataaattgccat

SEQ ID NO: 3516864 - DNA, 19 bp, Homo sapiens
tttcatttggttcattaat

SEQ ID NO: 3516865 - DNA, 15 bp, Homo sapiens
tttcatttttttcca

SEQ ID NO: 3516866 - DNA, 19 bp, Homo sapiens
tttccaaaataaaacaaag

SEQ ID NO: 3516867 - DNA, 15 bp, Homo sapiens
tttccaaattcacaa

SEQ ID NO: 3516868 - DNA, 23 bp, Homo sapiens
tttccaaattcacaagttgtgtt

SEQ ID NO: 3516869 - DNA, 21 bp, Homo sapiens
tttccagcagaagacaaaaag

SEQ ID NO: 3516870 - DNA, 19 bp, Homo sapiens
tttccatagtgttaactgt

SEQ ID NO: 3516871 - DNA, 20 bp, Homo sapiens
tttccatggcaggaaggctt

SEQ ID NO: 3516872 - DNA, 17 bp, Homo sapiens
tttcccactttcttcta

SEQ ID NO: 3516873 - DNA, 19 bp, Homo sapiens
tttcccactttcttctacc

SEQ ID NO: 3516874 - DNA, 14 bp, Homo sapiens
tttcccctttcctg

SEQ ID NO: 3516875 - DNA, 16 bp, Homo sapiens
tttccgtggcactgca

SEQ ID NO: 3516876 - DNA, 17 bp, Homo sapiens
tttcctaaggctgcaag

SEQ ID NO: 3516877 - DNA, 24 bp, Homo sapiens
tttcctaataaagttctgtactca

SEQ ID NO: 3516878 - DNA, 15 bp, Homo sapiens
tttcctaatatcaaa

SEQ ID NO: 3516879 - DNA, 21 bp, Homo sapiens
tttcctagttctgtagaaatg

SEQ ID NO: 3516880 - DNA, 12 bp, Homo sapiens
tttcctcccttc

SEQ ID NO: 3516881 - DNA, 13 bp, Homo sapiens
tttcctcccttct

SEQ ID NO: 3516882 - DNA, 14 bp, Homo sapiens
tttcctcccttctg

SEQ ID NO: 3516883 - DNA, 19 bp, Homo sapiens
tttcctcccttctgctact

SEQ ID NO: 3516884 - DNA, 21 bp, Homo sapiens
tttcctggcactggaccccag

SEQ ID NO: 3516885 - DNA, 16 bp, Homo sapiens
tttccttaatccagct

SEQ ID NO: 3516886 - DNA, 16 bp, Homo sapiens
tttccttccagcccag

SEQ ID NO: 3516887 - DNA, 16 bp, Homo sapiens
tttccttggctggtgc

SEQ ID NO: 3516888 - DNA, 18 bp, Homo sapiens
tttccttggggcaggcag

SEQ ID NO: 3516889 - DNA, 23 bp, Homo sapiens
tttcctttaactccctttttaca

SEQ ID NO: 3516890 - DNA, 9 bp, Homo sapiens
tttcctttg

SEQ ID NO: 3516891 - DNA, 13 bp, Homo sapiens
tttcctttgctct

SEQ ID NO: 3516892 - DNA, 16 bp, Homo sapiens
tttccttttttaaaaa

SEQ ID NO: 3516893 - DNA, 21 bp, Homo sapiens
tttccttttttaaaaatgcaa

SEQ ID NO: 3516894 - DNA, 18 bp, Homo sapiens
tttcgccaaactgtctct

SEQ ID NO: 3516895 - DNA, 15 bp, Homo sapiens
tttcgtgagccccat

SEQ ID NO: 3516896 - DNA, 18 bp, Homo sapiens
tttcgtgagccccatctt

SEQ ID NO: 3516897 - DNA, 13 bp, Homo sapiens
tttctaaaagact

SEQ ID NO: 3516898 - DNA, 17 bp, Homo sapiens
tttctacaatgtgaact

SEQ ID NO: 3516899 - DNA, 18 bp, Homo sapiens
tttctacaatgtgaactt

SEQ ID NO: 3516900 - DNA, 21 bp, Homo sapiens
tttctacaatgtgaactttat

SEQ ID NO: 3516901 - DNA, 22 bp, Homo sapiens
tttctacaatgtgaactttatt

SEQ ID NO: 3516902 - DNA, 15 bp, Homo sapiens
tttctacccagcgag

SEQ ID NO: 3516903 - DNA, 17 bp, Homo sapiens
tttctaccttaaaggga

SEQ ID NO: 3516904 - DNA, 16 bp, Homo sapiens
tttctagatacaataa

SEQ ID NO: 3516905 - DNA, 13 bp, Homo sapiens
tttctatttcata

SEQ ID NO: 3516906 - DNA, 15 bp, Homo sapiens
tttctattttaagac

SEQ ID NO: 3516907 - DNA, 15 bp, Homo sapiens
tttctcacttttgga

SEQ ID NO: 3516908 - DNA, 18 bp, Homo sapiens
tttctcagaatccaaaga

SEQ ID NO: 3516909 - DNA, 19 bp, Homo sapiens
tttctcagactttggaaaa

SEQ ID NO: 3516910 - DNA, 18 bp, Homo sapiens
tttctcatgaatctgcaa

SEQ ID NO: 3516911 - DNA, 23 bp, Homo sapiens
tttctccccaatgagacttgcct

SEQ ID NO: 3516912 - DNA, 13 bp, Homo sapiens
tttctcccctgcc

SEQ ID NO: 3516913 - DNA, 14 bp, Homo sapiens
tttctcccctgccc

SEQ ID NO: 3516914 - DNA, 20 bp, Homo sapiens
tttctcccctgcccccagga

SEQ ID NO: 3516915 - DNA, 22 bp, Homo sapiens
tttctcccctgcccccaggact

SEQ ID NO: 3516916 - DNA, 23 bp, Homo sapiens
tttctcccctgcccccaggactg

SEQ ID NO: 3516917 - DNA, 23 bp, Homo sapiens
tttctcctttcaccaccccctcc

SEQ ID NO: 3516918 - DNA, 16 bp, Homo sapiens
tttctcctttgtactt

SEQ ID NO: 3516919 - DNA, 20 bp, Homo sapiens
tttctcttttcccctttcct

SEQ ID NO: 3516920 - DNA, 13 bp, Homo sapiens
tttctgacagttt

SEQ ID NO: 3516921 - DNA, 17 bp, Homo sapiens
tttctgagtgccttctg

SEQ ID NO: 3516922 - DNA, 17 bp, Homo sapiens
tttctgcacagcttttc

SEQ ID NO: 3516923 - DNA, 21 bp, Homo sapiens
tttctgcacagcttttccaaa

SEQ ID NO: 3516924 - DNA, 13 bp, Homo sapiens
tttctgcatatgt

SEQ ID NO: 3516925 - DNA, 14 bp, Homo sapiens
tttctgcctggagt

SEQ ID NO: 3516926 - DNA, 18 bp, Homo sapiens
tttctgctcagcttctcc

SEQ ID NO: 3516927 - DNA, 15 bp, Homo sapiens
tttctggaaatgttc

SEQ ID NO: 3516928 - DNA, 21 bp, Homo sapiens
tttctggcaggtcctcccctc

SEQ ID NO: 3516929 - DNA, 17 bp, Homo sapiens
tttctggggaaagggga

SEQ ID NO: 3516930 - DNA, 15 bp, Homo sapiens
tttctggtggtctgt

SEQ ID NO: 3516931 - DNA, 15 bp, Homo sapiens
tttctgtaaactctg

SEQ ID NO: 3516932 - DNA, 22 bp, Homo sapiens
tttctgtattttttgtttgtat

SEQ ID NO: 3516933 - DNA, 15 bp, Homo sapiens
tttctgtcccttctg

SEQ ID NO: 3516934 - DNA, 18 bp, Homo sapiens
tttcttacacaagagctg

SEQ ID NO: 3516935 - DNA, 13 bp, Homo sapiens
tttcttattgcgc

SEQ ID NO: 3516936 - DNA, 12 bp, Homo sapiens
tttcttctattt

SEQ ID NO: 3516937 - DNA, 14 bp, Homo sapiens
tttcttcttcacat

SEQ ID NO: 3516938 - DNA, 22 bp, Homo sapiens
tttcttgaatttttttctgcac

SEQ ID NO: 3516939 - DNA, 12 bp, Homo sapiens
tttcttgcctct

SEQ ID NO: 3516940 - DNA, 18 bp, Homo sapiens
tttctttcctcctttcct

SEQ ID NO: 3516941 - DNA, 13 bp, Homo sapiens
tttctttcttaga

SEQ ID NO: 3516942 - DNA, 12 bp, Homo sapiens
tttctttgagga

SEQ ID NO: 3516943 - DNA, 14 bp, Homo sapiens
tttctttgcaaagt

SEQ ID NO: 3516944 - DNA, 15 bp, Homo sapiens
tttctttgcaaagta

SEQ ID NO: 3516945 - DNA, 21 bp, Homo sapiens
tttctttgggaatatttgaat

SEQ ID NO: 3516946 - DNA, 15 bp, Homo sapiens
tttctttttttaact

SEQ ID NO: 3516947 - DNA, 22 bp, Homo sapiens
tttctttttttattaaacagat

SEQ ID NO: 3516948 - DNA, 22 bp, Homo sapiens
tttgaaataaagaaccagtccc

SEQ ID NO: 3516949 - DNA, 13 bp, Homo sapiens
tttgaaattctga

SEQ ID NO: 3516950 - DNA, 15 bp, Homo sapiens
tttgaaattctgaat

SEQ ID NO: 3516951 - DNA, 20 bp, Homo sapiens
tttgaaattctgaatttgca

SEQ ID NO: 3516952 - DNA, 21 bp, Homo sapiens
tttgaaattgtattacaaatc

SEQ ID NO: 3516953 - DNA, 17 bp, Homo sapiens
tttgaagaacatgtgag

SEQ ID NO: 3516954 - DNA, 21 bp, Homo sapiens
tttgaagtgtaggcagacaca

SEQ ID NO: 3516955 - DNA, 20 bp, Homo sapiens
tttgaataaagaatacttga

SEQ ID NO: 3516956 - DNA, 21 bp, Homo sapiens
tttgaataaagaatacttgaa

SEQ ID NO: 3516957 - DNA, 18 bp, Homo sapiens
tttgaatcatcaagtctt

SEQ ID NO: 3516958 - DNA, 12 bp, Homo sapiens
tttgaatcttgt

SEQ ID NO: 3516959 - DNA, 13 bp, Homo sapiens
tttgaatgcattt

SEQ ID NO: 3516960 - DNA, 14 bp, Homo sapiens
tttgaatgcatttt

SEQ ID NO: 3516961 - DNA, 16 bp, Homo sapiens
tttgaatgcattttgt

SEQ ID NO: 3516962 - DNA, 12 bp, Homo sapiens
tttgaatgttaa

SEQ ID NO: 3516963 - DNA, 18 bp, Homo sapiens
tttgaatgttaaataaat

SEQ ID NO: 3516964 - DNA, 21 bp, Homo sapiens
tttgaatgttaaataaattgt

SEQ ID NO: 3516965 - DNA, 19 bp, Homo sapiens
tttgaatgttaattttttg

SEQ ID NO: 3516966 - DNA, 15 bp, Homo sapiens
tttgaattgttacat

SEQ ID NO: 3516967 - DNA, 20 bp, Homo sapiens
tttgacattgcgtttgacct

SEQ ID NO: 3516968 - DNA, 21 bp, Homo sapiens
tttgacgtcactgatattttt

SEQ ID NO: 3516969 - DNA, 17 bp, Homo sapiens
tttgactaattttacat

SEQ ID NO: 3516970 - DNA, 16 bp, Homo sapiens
tttgacttaatgtgat

SEQ ID NO: 3516971 - DNA, 13 bp, Homo sapiens
tttgactttaatt

SEQ ID NO: 3516972 - DNA, 14 bp, Homo sapiens
tttgactttaattt

SEQ ID NO: 3516973 - DNA, 15 bp, Homo sapiens
tttgactttcttctg

SEQ ID NO: 3516974 - DNA, 17 bp, Homo sapiens
tttgactttcttctgaa

SEQ ID NO: 3516975 - DNA, 22 bp, Homo sapiens
tttgactttcttctgaatattt

SEQ ID NO: 3516976 - DNA, 18 bp, Homo sapiens
tttgagaacgtaaagaac

SEQ ID NO: 3516977 - DNA, 13 bp, Homo sapiens
tttgagacagagt

SEQ ID NO: 3516978 - DNA, 15 bp, Homo sapiens
tttgagcagggctca

SEQ ID NO: 3516979 - DNA, 18 bp, Homo sapiens
tttaaaatttttttagaa

SEQ ID NO: 3516980 - DNA, 18 bp, Homo sapiens
tttaaagaatatgacttt

SEQ ID NO: 3516981 - DNA, 22 bp, Homo sapiens
tttaaagtgactaatggcatga

SEQ ID NO: 3516982 - DNA, 20 bp, Homo sapiens
tttaaatacagtcttccatt

SEQ ID NO: 3516983 - DNA, 21 bp, Homo sapiens
tttaaatatatattattctca

SEQ ID NO: 3516984 - DNA, 15 bp, Homo sapiens
tttaaatattttcta

SEQ ID NO: 3516985 - DNA, 17 bp, Homo sapiens
tttaaatattttctatt

SEQ ID NO: 3516986 - DNA, 19 bp, Homo sapiens
tttaaatattttctatttt

SEQ ID NO: 3516987 - DNA, 15 bp, Homo sapiens
tttaaattttgtaat

SEQ ID NO: 3516988 - DNA, 19 bp, Homo sapiens
tttaacaaaaagtgcttca

SEQ ID NO: 3516989 - DNA, 14 bp, Homo sapiens
tttaacagtgcaaa

SEQ ID NO: 3516990 - DNA, 15 bp, Homo sapiens
tttaaccaaaggtga

SEQ ID NO: 3516991 - DNA, 21 bp, Homo sapiens
tttaaccaaaggtgaaggaat

SEQ ID NO: 3516992 - DNA, 23 bp, Homo sapiens
tttaaccaaaggtgaaggaatat

SEQ ID NO: 3516993 - DNA, 14 bp, Homo sapiens
tttaacctcttttt

SEQ ID NO: 3516994 - DNA, 22 bp, Homo sapiens
tttaacctctttttaaggacac

SEQ ID NO: 3516995 - DNA, 15 bp, Homo sapiens
tttaactagaattta

SEQ ID NO: 3516996 - DNA, 19 bp, Homo sapiens
tttaactccctttttacac

SEQ ID NO: 3516997 - DNA, 23 bp, Homo sapiens
tttaactccctttttacacttta

SEQ ID NO: 3516998 - DNA, 18 bp, Homo sapiens
tttaactctagaatttgg

SEQ ID NO: 3516999 - DNA, 13 bp, Homo sapiens
tttaactctgtct

SEQ ID NO: 3517000 - DNA, 14 bp, Homo sapiens
tttaactctgtctt

SEQ ID NO: 3517001 - DNA, 13 bp, Homo sapiens
tttaactgagggc

SEQ ID NO: 3517002 - DNA, 21 bp, Homo sapiens
tttaactgccaatccttaaat

SEQ ID NO: 3517003 - DNA, 19 bp, Homo sapiens
tttaactggtgcactttgt

SEQ ID NO: 3517004 - DNA, 22 bp, Homo sapiens
tttaactggtgcactttgtaaa

SEQ ID NO: 3517005 - DNA, 17 bp, Homo sapiens
tttaagacgtgtttgtg

SEQ ID NO: 3517006 - DNA, 17 bp, Homo sapiens
tttaagcctgcattctt

SEQ ID NO: 3517007 - DNA, 21 bp, Homo sapiens
tttaagcctgcattcttaaca

SEQ ID NO: 3517008 - DNA, 11 bp, Homo sapiens
tttaagctgtt

SEQ ID NO: 3517009 - DNA, 12 bp, Homo sapiens
tttaagctgttt

SEQ ID NO: 3517010 - DNA, 13 bp, Homo sapiens
tttaagctgtttc

SEQ ID NO: 3517011 - DNA, 16 bp, Homo sapiens
tttaaggtttttactg

SEQ ID NO: 3517012 - DNA, 16 bp, Homo sapiens
tttaagtccctgtcac

SEQ ID NO: 3517013 - DNA, 14 bp, Homo sapiens
tttaagtgtaactg

SEQ ID NO: 3517014 - DNA, 15 bp, Homo sapiens
tttaatgttctgtga

SEQ ID NO: 3517015 - DNA, 17 bp, Homo sapiens
tttaatgtttaaaacat

SEQ ID NO: 3517016 - DNA, 22 bp, Homo sapiens
tttaattagtgctaagtgtgaa

SEQ ID NO: 3517017 - DNA, 14 bp, Homo sapiens
tttaattcatgttt

SEQ ID NO: 3517018 - DNA, 23 bp, Homo sapiens
tttaatttagatattttccatat

SEQ ID NO: 3517019 - DNA, 20 bp, Homo sapiens
tttaatttatgtaacttgaa

SEQ ID NO: 3517020 - DNA, 16 bp, Homo sapiens
tttaatttgtattgaa

SEQ ID NO: 3517021 - DNA, 16 bp, Homo sapiens
tttacaaagtgtgtat

SEQ ID NO: 3517022 - DNA, 15 bp, Homo sapiens
tttacaattgaaatg

SEQ ID NO: 3517023 - DNA, 18 bp, Homo sapiens
tttacaatttacaaagtg

SEQ ID NO: 3517024 - DNA, 13 bp, Homo sapiens
tttacagaatttt

SEQ ID NO: 3517025 - DNA, 22 bp, Homo sapiens
tttacagccagtgggagatgtt

SEQ ID NO: 3517026 - DNA, 15 bp, Homo sapiens
tttacagctgtgtta

SEQ ID NO: 3517027 - DNA, 18 bp, Homo sapiens
tttacaggatattccaaa

SEQ ID NO: 3517028 - DNA, 19 bp, Homo sapiens
tttacccacacacagataa

SEQ ID NO: 3517029 - DNA, 16 bp, Homo sapiens
tttacctgtgaaatag

SEQ ID NO: 3517030 - DNA, 15 bp, Homo sapiens
tttactagaaatggg

SEQ ID NO: 3517031 - DNA, 16 bp, Homo sapiens
tttactagaaatggga

SEQ ID NO: 3517032 - DNA, 22 bp, Homo sapiens
tttactagaaatgggaatcatg

SEQ ID NO: 3517033 - DNA, 16 bp, Homo sapiens
tttactattaacatga

SEQ ID NO: 3517034 - DNA, 22 bp, Homo sapiens
tttactattaacatgatgtact

SEQ ID NO: 3517035 - DNA, 19 bp, Homo sapiens
tttactggacaaagaattc

SEQ ID NO: 3517036 - DNA, 15 bp, Homo sapiens
tttactgttgtacaa

SEQ ID NO: 3517037 - DNA, 22 bp, Homo sapiens
tttactgttgtacaatcatgtt

SEQ ID NO: 3517038 - DNA, 21 bp, Homo sapiens
tttagaaaaagaacatgcagt

SEQ ID NO: 3517039 - DNA, 11 bp, Homo sapiens
tttagaaaata

SEQ ID NO: 3517040 - DNA, 19 bp, Homo sapiens
tttagaaagcatttgaatg

SEQ ID NO: 3517041 - DNA, 16 bp, Homo sapiens
tttagaaagctgacat

SEQ ID NO: 3517042 - DNA, 19 bp, Homo sapiens
tttagaccctattgctgct

SEQ ID NO: 3517043 - DNA, 22 bp, Homo sapiens
tttagaccctattgctgcttga

SEQ ID NO: 3517044 - DNA, 17 bp, Homo sapiens
tttagagttagactgtt

SEQ ID NO: 3517045 - DNA, 17 bp, Homo sapiens
tttagcccagtgttttc

SEQ ID NO: 3517046 - DNA, 22 bp, Homo sapiens
tttagcccagtgttttctttga

SEQ ID NO: 3517047 - DNA, 21 bp, Homo sapiens
tttaggatacttaacaaatac

SEQ ID NO: 3517048 - DNA, 18 bp, Homo sapiens
tttaggctggtggcccag

SEQ ID NO: 3517049 - DNA, 22 bp, Homo sapiens
tttaggggagttttgttttttg

SEQ ID NO: 3517050 - DNA, 17 bp, Homo sapiens
tttagggttctgcctct

SEQ ID NO: 3517051 - DNA, 12 bp, Homo sapiens
tttagtaaatgt

SEQ ID NO: 3517052 - DNA, 16 bp, Homo sapiens
tttagtaatttcctag

SEQ ID NO: 3517053 - DNA, 21 bp, Homo sapiens
tttagtattgaatacttacat

SEQ ID NO: 3517054 - DNA, 16 bp, Homo sapiens
tttagtctaacacagt

SEQ ID NO: 3517055 - DNA, 18 bp, Homo sapiens
tttagtctgcaaaatgag

SEQ ID NO: 3517056 - DNA, 13 bp, Homo sapiens
tttagttttctct

SEQ ID NO: 3517057 - DNA, 14 bp, Homo sapiens
tttataaaacttct

SEQ ID NO: 3517058 - DNA, 12 bp, Homo sapiens
tttataagaaaa

SEQ ID NO: 3517059 - DNA, 15 bp, Homo sapiens
tttatacaaattaga

SEQ ID NO: 3517060 - DNA, 16 bp, Homo sapiens
tttatactctttctgt

SEQ ID NO: 3517061 - DNA, 20 bp, Homo sapiens
tttatactctttctgtatat

SEQ ID NO: 3517062 - DNA, 16 bp, Homo sapiens
tttataggtgagaaaa

SEQ ID NO: 3517063 - DNA, 14 bp, Homo sapiens
tttatataatatct

SEQ ID NO: 3517064 - DNA, 18 bp, Homo sapiens
tttatatatctaagttca

SEQ ID NO: 3517065 - DNA, 19 bp, Homo sapiens
tttatatgaagataagtgt

SEQ ID NO: 3517066 - DNA, 14 bp, Homo sapiens
tttatattaatgta

SEQ ID NO: 3517067 - DNA, 16 bp, Homo sapiens
tttatattaatgtact

SEQ ID NO: 3517068 - DNA, 17 bp, Homo sapiens
tttatcaactcaagaat

SEQ ID NO: 3517069 - DNA, 13 bp, Homo sapiens
tttatccataatg

SEQ ID NO: 3517070 - DNA, 22 bp, Homo sapiens
tttatccataatgatggattta

SEQ ID NO: 3517071 - DNA, 13 bp, Homo sapiens
tttatctgattaa

SEQ ID NO: 3517072 - DNA, 14 bp, Homo sapiens
tttatgaatataat

SEQ ID NO: 3517073 - DNA, 14 bp, Homo sapiens
tttatgatcagtgt

SEQ ID NO: 3517074 - DNA, 18 bp, Homo sapiens
tttatgccagttgttaaa

SEQ ID NO: 3517075 - DNA, 13 bp, Homo sapiens
tttatgcttgcaa

SEQ ID NO: 3517076 - DNA, 15 bp, Homo sapiens
tttattaaatacaaa

SEQ ID NO: 3517077 - DNA, 17 bp, Homo sapiens
tttattaattgctttga

SEQ ID NO: 3517078 - DNA, 16 bp, Homo sapiens
tttattacatctttca

SEQ ID NO: 3517079 - DNA, 12 bp, Homo sapiens
tttattaccccc

SEQ ID NO: 3517080 - DNA, 13 bp, Homo sapiens
tttattcaataaa

SEQ ID NO: 3517081 - DNA, 22 bp, Homo sapiens
tttattccagaatgctgtacat

SEQ ID NO: 3517082 - DNA, 16 bp, Homo sapiens
tttattgaacttgaaa

SEQ ID NO: 3517083 - DNA, 12 bp, Homo sapiens
tttattgacaca

SEQ ID NO: 3517084 - DNA, 16 bp, Homo sapiens
tttattgagaaagagc

SEQ ID NO: 3517085 - DNA, 12 bp, Homo sapiens
tttattgccttc

SEQ ID NO: 3517086 - DNA, 13 bp, Homo sapiens
tttattgccttct

SEQ ID NO: 3517087 - DNA, 17 bp, Homo sapiens
tttattgtgtttgtcat

SEQ ID NO: 3517088 - DNA, 20 bp, Homo sapiens
tttatttacagatgaatgta

SEQ ID NO: 3517089 - DNA, 19 bp, Homo sapiens
tttatttagttccttgagt

SEQ ID NO: 3517090 - DNA, 17 bp, Homo sapiens
tttatttcattggttaa

SEQ ID NO: 3517091 - DNA, 13 bp, Homo sapiens
tttatttggttcc

SEQ ID NO: 3517092 - DNA, 23 bp, Homo sapiens
tttattttggaactatgaagact

SEQ ID NO: 3517093 - DNA, 15 bp, Homo sapiens
tttattttttacatt

SEQ ID NO: 3517094 - DNA, 17 bp, Homo sapiens
tttattttttcttctgt

SEQ ID NO: 3517095 - DNA, 20 bp, Homo sapiens
tttcaaaataaaaaccaaga

SEQ ID NO: 3517096 - DNA, 21 bp, Homo sapiens
tttcaaagcaattgaaatgca

SEQ ID NO: 3517097 - DNA, 14 bp, Homo sapiens
tttcaaatttagaa

SEQ ID NO: 3517098 - DNA, 18 bp, Homo sapiens
tttcaaatttagaaacta

SEQ ID NO: 3517099 - DNA, 21 bp, Homo sapiens
tttcaagagtctaatagtctt

SEQ ID NO: 3517100 - DNA, 12 bp, Homo sapiens
tttcaaggcctt

SEQ ID NO: 3517101 - DNA, 14 bp, Homo sapiens
tttcaaggccttca

SEQ ID NO: 3517102 - DNA, 23 bp, Homo sapiens
tttcaagtcaaattaataatctt

SEQ ID NO: 3517103 - DNA, 12 bp, Homo sapiens
tttcaagtttac

SEQ ID NO: 3517104 - DNA, 19 bp, Homo sapiens
tttcacattagaagacaat

SEQ ID NO: 3517105 - DNA, 20 bp, Homo sapiens
tttcacccctccctttctcc

SEQ ID NO: 3517106 - DNA, 21 bp, Homo sapiens
tttcacctccttcaattccat

SEQ ID NO: 3517107 - DNA, 23 bp, Homo sapiens
tttcacctgtttttaagctgttt

SEQ ID NO: 3517108 - DNA, 14 bp, Homo sapiens
tttcacctttactt

SEQ ID NO: 3517109 - DNA, 16 bp, Homo sapiens
tttcacctttacttta

SEQ ID NO: 3517110 - DNA, 20 bp, Homo sapiens
tttcactctcctatgccttt

SEQ ID NO: 3517111 - DNA, 17 bp, Homo sapiens
tttcagagaccattgca

SEQ ID NO: 3517112 - DNA, 17 bp, Homo sapiens
tttcagagatggacaga

SEQ ID NO: 3517113 - DNA, 23 bp, Homo sapiens
tttcagagtgacacccaagaggg

SEQ ID NO: 3517114 - DNA, 16 bp, Homo sapiens
tttcagatgtaatgtt

SEQ ID NO: 3517115 - DNA, 21 bp, Homo sapiens
tttcagattgtggaatgttgg

SEQ ID NO: 3517116 - DNA, 16 bp, Homo sapiens
ttgggccaagccagct

SEQ ID NO: 3517117 - DNA, 17 bp, Homo sapiens
ttgggccagacatgcca

SEQ ID NO: 3517118 - DNA, 19 bp, Homo sapiens
ttgggcctgctccagacct

SEQ ID NO: 3517119 - DNA, 17 bp, Homo sapiens
ttggggagttaagacct

SEQ ID NO: 3517120 - DNA, 13 bp, Homo sapiens
ttggggccctgcc

SEQ ID NO: 3517121 - DNA, 13 bp, Homo sapiens
ttgggggggtggc

SEQ ID NO: 3517122 - DNA, 17 bp, Homo sapiens
ttgggggttcaggcccg

SEQ ID NO: 3517123 - DNA, 21 bp, Homo sapiens
ttggggtagctagaggaacca

SEQ ID NO: 3517124 - DNA, 16 bp, Homo sapiens
ttgggtggatgcctgg

SEQ ID NO: 3517125 - DNA, 14 bp, Homo sapiens
ttggtacacaacta

SEQ ID NO: 3517126 - DNA, 13 bp, Homo sapiens
ttggtataggaat

SEQ ID NO: 3517127 - DNA, 14 bp, Homo sapiens
ttggtataggaatg

SEQ ID NO: 3517128 - DNA, 16 bp, Homo sapiens
ttggtataggaatgta

SEQ ID NO: 3517129 - DNA, 12 bp, Homo sapiens
ttggtattgtat

SEQ ID NO: 3517130 - DNA, 13 bp, Homo sapiens
ttggtattgtatt

SEQ ID NO: 3517131 - DNA, 21 bp, Homo sapiens
ttggtattgtatttattcaat

SEQ ID NO: 3517132 - DNA, 19 bp, Homo sapiens
ttggtcctacctattatcc

SEQ ID NO: 3517133 - DNA, 13 bp, Homo sapiens
ttggtctgtgtga

SEQ ID NO: 3517134 - DNA, 17 bp, Homo sapiens
ttggtgaatttcacaag

SEQ ID NO: 3517135 - DNA, 21 bp, Homo sapiens
ttggtgaattttcaaggcctt

SEQ ID NO: 3517136 - DNA, 14 bp, Homo sapiens
ttggtgagaacctg

SEQ ID NO: 3517137 - DNA, 12 bp, Homo sapiens
ttggtgagaagg

SEQ ID NO: 3517138 - DNA, 17 bp, Homo sapiens
ttggtggaatctttagc

SEQ ID NO: 3517139 - DNA, 16 bp, Homo sapiens
ttggtggagataaaga

SEQ ID NO: 3517140 - DNA, 18 bp, Homo sapiens
ttggttcccccactgatc

SEQ ID NO: 3517141 - DNA, 14 bp, Homo sapiens
ttggttgaattttt

SEQ ID NO: 3517142 - DNA, 20 bp, Homo sapiens
ttggtttggccatctctgga

SEQ ID NO: 3517143 - DNA, 17 bp, Homo sapiens
ttggttttgacttcaga

SEQ ID NO: 3517144 - DNA, 14 bp, Homo sapiens
ttggttttgttccc

SEQ ID NO: 3517145 - DNA, 17 bp, Homo sapiens
ttgtaaaaaattcacat

SEQ ID NO: 3517146 - DNA, 16 bp, Homo sapiens
ttgtaaagtgaagaat

SEQ ID NO: 3517147 - DNA, 15 bp, Homo sapiens
ttgtaaatatataaa

SEQ ID NO: 3517148 - DNA, 21 bp, Homo sapiens
ttgtaaatatataaatatata

SEQ ID NO: 3517149 - DNA, 14 bp, Homo sapiens
ttgtaaattatatt

SEQ ID NO: 3517150 - DNA, 15 bp, Homo sapiens
ttgtaaattatattt

SEQ ID NO: 3517151 - DNA, 16 bp, Homo sapiens
ttgtaaattatatttg

SEQ ID NO: 3517152 - DNA, 20 bp, Homo sapiens
ttgtaaattatatttgtgct

SEQ ID NO: 3517153 - DNA, 16 bp, Homo sapiens
ttgtaacccagatttt

SEQ ID NO: 3517154 - DNA, 18 bp, Homo sapiens
ttgtaactttttacatta

SEQ ID NO: 3517155 - DNA, 12 bp, Homo sapiens
ttgtaataacat

SEQ ID NO: 3517156 - DNA, 15 bp, Homo sapiens
ttgtaataacattta

SEQ ID NO: 3517157 - DNA, 14 bp, Homo sapiens
ttgtacaatcatgt

SEQ ID NO: 3517158 - DNA, 18 bp, Homo sapiens
ttgtacaatcatgttctg

SEQ ID NO: 3517159 - DNA, 17 bp, Homo sapiens
ttgtacagaatatttct

SEQ ID NO: 3517160 - DNA, 21 bp, Homo sapiens
ttgtacagaatatttctattg

SEQ ID NO: 3517161 - DNA, 13 bp, Homo sapiens
ttgtacagcccag

SEQ ID NO: 3517162 - DNA, 21 bp, Homo sapiens
ttgtacctgtaggactctcat

SEQ ID NO: 3517163 - DNA, 17 bp, Homo sapiens
ttgtactgtttaatgtt

SEQ ID NO: 3517164 - DNA, 24 bp, Homo sapiens
ttgtactgtttaatgttctgtgat

SEQ ID NO: 3517165 - DNA, 21 bp, Homo sapiens
ttgtagtgaagctctcaccca

SEQ ID NO: 3517166 - DNA, 14 bp, Homo sapiens
ttgtatagtaaagt

SEQ ID NO: 3517167 - DNA, 14 bp, Homo sapiens
ttgtatattcactt

SEQ ID NO: 3517168 - DNA, 13 bp, Homo sapiens
ttgtatattgtgt

SEQ ID NO: 3517169 - DNA, 15 bp, Homo sapiens
ttgtatattgtgttt

SEQ ID NO: 3517170 - DNA, 18 bp, Homo sapiens
ttgtatcgatgttatgta

SEQ ID NO: 3517171 - DNA, 13 bp, Homo sapiens
ttgtatgtaaatg

SEQ ID NO: 3517172 - DNA, 16 bp, Homo sapiens
ttgtatgtaaatgtgc

SEQ ID NO: 3517173 - DNA, 18 bp, Homo sapiens
ttgtatgtaaatgtgcat

SEQ ID NO: 3517174 - DNA, 13 bp, Homo sapiens
ttgtattacagat

SEQ ID NO: 3517175 - DNA, 14 bp, Homo sapiens
ttgtattctctgag

SEQ ID NO: 3517176 - DNA, 16 bp, Homo sapiens
ttgtatttattcaata

SEQ ID NO: 3517177 - DNA, 20 bp, Homo sapiens
ttgtatttttttgcaagtga

SEQ ID NO: 3517178 - DNA, 20 bp, Homo sapiens
ttgtcaagtctctgctggcc

SEQ ID NO: 3517179 - DNA, 17 bp, Homo sapiens
ttgtcacacactttggc

SEQ ID NO: 3517180 - DNA, 18 bp, Homo sapiens
ttgtcacacactttggct

SEQ ID NO: 3517181 - DNA, 15 bp, Homo sapiens
ttgtcactagcagct

SEQ ID NO: 3517182 - DNA, 17 bp, Homo sapiens
ttgtcactgcttttggc

SEQ ID NO: 3517183 - DNA, 23 bp, Homo sapiens
ttgtcatatgtagccttcacaca

SEQ ID NO: 3517184 - DNA, 21 bp, Homo sapiens
ttgtcccagaggctgccccac

SEQ ID NO: 3517185 - DNA, 18 bp, Homo sapiens
ttgtcccatctctacccc

SEQ ID NO: 3517186 - DNA, 19 bp, Homo sapiens
ttgtcctgatgcttttgtc

SEQ ID NO: 3517187 - DNA, 20 bp, Homo sapiens
ttgtcctttaaaaaagaaaa

SEQ ID NO: 3517188 - DNA, 11 bp, Homo sapiens
ttgtctaaaat

SEQ ID NO: 3517189 - DNA, 23 bp, Homo sapiens
ttgtctagggtgttctgtactta

SEQ ID NO: 3517190 - DNA, 14 bp, Homo sapiens
ttgtctatgggact

SEQ ID NO: 3517191 - DNA, 13 bp, Homo sapiens
ttgtgaaccaatg

SEQ ID NO: 3517192 - DNA, 19 bp, Homo sapiens
ttgtgaagaactattttat

SEQ ID NO: 3517193 - DNA, 19 bp, Homo sapiens
ttgtgaagctaatgaccaa

SEQ ID NO: 3517194 - DNA, 17 bp, Homo sapiens
ttgtgaggaaagtcatt

SEQ ID NO: 3517195 - DNA, 16 bp, Homo sapiens
ttgtgatagcactttc

SEQ ID NO: 3517196 - DNA, 17 bp, Homo sapiens
ttgtgcagcttttggtc

SEQ ID NO: 3517197 - DNA, 16 bp, Homo sapiens
ttgtgctagaaatttt

SEQ ID NO: 3517198 - DNA, 23 bp, Homo sapiens
ttgtgcttctttctttgggaata

SEQ ID NO: 3517199 - DNA, 12 bp, Homo sapiens
ttgtgctttgta

SEQ ID NO: 3517200 - DNA, 13 bp, Homo sapiens
ttgtgctttgtat

SEQ ID NO: 3517201 - DNA, 14 bp, Homo sapiens
ttgtgcttttcctg

SEQ ID NO: 3517202 - DNA, 15 bp, Homo sapiens
ttgtgcttttcctga

SEQ ID NO: 3517203 - DNA, 13 bp, Homo sapiens
ttgtggaatgttg

SEQ ID NO: 3517204 - DNA, 19 bp, Homo sapiens
ttgtggaatgttggataag

SEQ ID NO: 3517205 - DNA, 16 bp, Homo sapiens
ttgtggactaaaagat

SEQ ID NO: 3517206 - DNA, 22 bp, Homo sapiens
ttgtggactaaaagatataagt

SEQ ID NO: 3517207 - DNA, 11 bp, Homo sapiens
ttgtggctttc

SEQ ID NO: 3517208 - DNA, 18 bp, Homo sapiens
ttgtggtctaaagtgttt

SEQ ID NO: 3517209 - DNA, 22 bp, Homo sapiens
ttgtgtatttacgctttgattc

SEQ ID NO: 3517210 - DNA, 19 bp, Homo sapiens
ttgtgtgtgctctgcttca

SEQ ID NO: 3517211 - DNA, 14 bp, Homo sapiens
ttgtgtttgtcatt

SEQ ID NO: 3517212 - DNA, 21 bp, Homo sapiens
ttgttaaaaataaatcccatg

SEQ ID NO: 3517213 - DNA, 21 bp, Homo sapiens
ttgttaatattaaaaagtctg

SEQ ID NO: 3517214 - DNA, 12 bp, Homo sapiens
ttgttacccatg

SEQ ID NO: 3517215 - DNA, 22 bp, Homo sapiens
ttgttacctgtcattttgcact

SEQ ID NO: 3517216 - DNA, 14 bp, Homo sapiens
ttgttacttctgag

SEQ ID NO: 3517217 - DNA, 22 bp, Homo sapiens
ttgttatcagtcaatattttta

SEQ ID NO: 3517218 - DNA, 14 bp, Homo sapiens
ttgttatttataac

SEQ ID NO: 3517219 - DNA, 13 bp, Homo sapiens
ttgttcaagtttt

SEQ ID NO: 3517220 - DNA, 15 bp, Homo sapiens
ttgttcaattagaat

SEQ ID NO: 3517221 - DNA, 13 bp, Homo sapiens
ttgttcattttga

SEQ ID NO: 3517222 - DNA, 17 bp, Homo sapiens
ttgttcattttgagtat

SEQ ID NO: 3517223 - DNA, 18 bp, Homo sapiens
ttgttcccctcctccact

SEQ ID NO: 3517224 - DNA, 23 bp, Homo sapiens
ttgttcccctcctccactctccc

SEQ ID NO: 3517225 - DNA, 23 bp, Homo sapiens
ttgttccctatttttctctcctg

SEQ ID NO: 3517226 - DNA, 16 bp, Homo sapiens
ttgttcgggtgtgcaa

SEQ ID NO: 3517227 - DNA, 17 bp, Homo sapiens
ttgttcgggtgtgcaat

SEQ ID NO: 3517228 - DNA, 13 bp, Homo sapiens
ttgttctctggga

SEQ ID NO: 3517229 - DNA, 21 bp, Homo sapiens
ttgttctctgggagaaaatca

SEQ ID NO: 3517230 - DNA, 14 bp, Homo sapiens
ttgttgcggatgga

SEQ ID NO: 3517231 - DNA, 12 bp, Homo sapiens
ttgttgctttgt

SEQ ID NO: 3517232 - DNA, 20 bp, Homo sapiens
ttgttggatccgtttgacca

SEQ ID NO: 3517233 - DNA, 14 bp, Homo sapiens
ttgttgtgctttta

SEQ ID NO: 3517234 - DNA, 19 bp, Homo sapiens
ttgtttaaaaatacacatg

SEQ ID NO: 3517235 - DNA, 18 bp, Homo sapiens
ttgtttacaggatattcc

SEQ ID NO: 3517236 - DNA, 18 bp, Homo sapiens
ttgtttatacctttgcct

SEQ ID NO: 3517237 - DNA, 15 bp, Homo sapiens
ttgtttgcactgtgt

SEQ ID NO: 3517238 - DNA, 19 bp, Homo sapiens
ttgtttgctcacctggggt

SEQ ID NO: 3517239 - DNA, 12 bp, Homo sapiens
ttgtttgctgct

SEQ ID NO: 3517240 - DNA, 16 bp, Homo sapiens
ttgtttggtattgtat

SEQ ID NO: 3517241 - DNA, 19 bp, Homo sapiens
ttgtttggtattgtattta

SEQ ID NO: 3517242 - DNA, 21 bp, Homo sapiens
ttgtttggtattgtatttatt

SEQ ID NO: 3517243 - DNA, 19 bp, Homo sapiens
tttaaaaaaataaaacagt

SEQ ID NO: 3517244 - DNA, 17 bp, Homo sapiens
tttaaaaaatattttct

SEQ ID NO: 3517245 - DNA, 18 bp, Homo sapiens
tttaaaaacatagaaaaa

SEQ ID NO: 3517246 - DNA, 19 bp, Homo sapiens
tttaaaaagcatgttgtga

SEQ ID NO: 3517247 - DNA, 15 bp, Homo sapiens
tttaaaaatacacat

SEQ ID NO: 3517248 - DNA, 14 bp, Homo sapiens
tttaaaaatatttt

SEQ ID NO: 3517249 - DNA, 11 bp, Homo sapiens
tttaaaaatgt

SEQ ID NO: 3517250 - DNA, 14 bp, Homo sapiens
tttaaaagaagctt

SEQ ID NO: 3517251 - DNA, 22 bp, Homo sapiens
tttaaaagagagagagagaaaa

SEQ ID NO: 3517252 - DNA, 16 bp, Homo sapiens
tttaaaatatttatct

SEQ ID NO: 3517253 - DNA, 15 bp, Homo sapiens
tttaaaatctgtcac

SEQ ID NO: 3517254 - DNA, 16 bp, Homo sapiens
ttgatgatctttgcag

SEQ ID NO: 3517255 - DNA, 17 bp, Homo sapiens
ttgatggagattaagat

SEQ ID NO: 3517256 - DNA, 15 bp, Homo sapiens
ttgatgttacagatt

SEQ ID NO: 3517257 - DNA, 16 bp, Homo sapiens
ttgatgttggctggga

SEQ ID NO: 3517258 - DNA, 17 bp, Homo sapiens
ttgattacagtgcagtg

SEQ ID NO: 3517259 - DNA, 16 bp, Homo sapiens
ttgattagttttcttg

SEQ ID NO: 3517260 - DNA, 21 bp, Homo sapiens
ttgattatccatattgagtca

SEQ ID NO: 3517261 - DNA, 17 bp, Homo sapiens
ttgattctccttcagcc

SEQ ID NO: 3517262 - DNA, 13 bp, Homo sapiens
ttgattgtttaca

SEQ ID NO: 3517263 - DNA, 14 bp, Homo sapiens
ttgatttgcattga

SEQ ID NO: 3517264 - DNA, 17 bp, Homo sapiens
ttgatttgcattgaaca

SEQ ID NO: 3517265 - DNA, 23 bp, Homo sapiens
ttgattttacaattgaaatgact

SEQ ID NO: 3517266 - DNA, 19 bp, Homo sapiens
ttgcaaaaactacaaccaa

SEQ ID NO: 3517267 - DNA, 20 bp, Homo sapiens
ttgcaaaaactacaaccaat

SEQ ID NO: 3517268 - DNA, 13 bp, Homo sapiens
ttgcaaagtactg

SEQ ID NO: 3517269 - DNA, 14 bp, Homo sapiens
ttgcaaagtactgt

SEQ ID NO: 3517270 - DNA, 15 bp, Homo sapiens
ttgcaaagtactgta

SEQ ID NO: 3517271 - DNA, 17 bp, Homo sapiens
ttgcaaagtattgtaaa

SEQ ID NO: 3517272 - DNA, 20 bp, Homo sapiens
ttgcaaagtattgtaaatta

SEQ ID NO: 3517273 - DNA, 12 bp, Homo sapiens
ttgcaaatagtc

SEQ ID NO: 3517274 - DNA, 16 bp, Homo sapiens
ttgcaaatcttgaaat

SEQ ID NO: 3517275 - DNA, 14 bp, Homo sapiens
ttgcaacaggctgg

SEQ ID NO: 3517276 - DNA, 14 bp, Homo sapiens
ttgcaagcccctct

SEQ ID NO: 3517277 - DNA, 15 bp, Homo sapiens
ttgcaataatgcagt

SEQ ID NO: 3517278 - DNA, 21 bp, Homo sapiens
ttgcaataatgcagtatggta

SEQ ID NO: 3517279 - DNA, 16 bp, Homo sapiens
ttgcaatggcagcctt

SEQ ID NO: 3517280 - DNA, 17 bp, Homo sapiens
ttgcaatggcagccttg

SEQ ID NO: 3517281 - DNA, 21 bp, Homo sapiens
ttgcacacccactcagctccg

SEQ ID NO: 3517282 - DNA, 22 bp, Homo sapiens
ttgcacatgtcttaatgaagtt

SEQ ID NO: 3517283 - DNA, 13 bp, Homo sapiens
ttgcacattgttc

SEQ ID NO: 3517284 - DNA, 21 bp, Homo sapiens
ttgcaccactgcactccagcc

SEQ ID NO: 3517285 - DNA, 19 bp, Homo sapiens
ttgcaccagttttatccat

SEQ ID NO: 3517286 - DNA, 15 bp, Homo sapiens
ttgcacccagcccag

SEQ ID NO: 3517287 - DNA, 21 bp, Homo sapiens
ttgcagaactaaactcattta

SEQ ID NO: 3517288 - DNA, 16 bp, Homo sapiens
ttgcagaagagggtgt

SEQ ID NO: 3517289 - DNA, 20 bp, Homo sapiens
ttgcagaagagggtgtgttt

SEQ ID NO: 3517290 - DNA, 22 bp, Homo sapiens
ttgcagacaggcaagcacctcc

SEQ ID NO: 3517291 - DNA, 23 bp, Homo sapiens
ttgcagacaggcaagcacctcct

SEQ ID NO: 3517292 - DNA, 19 bp, Homo sapiens
ttgcataacaattcctcta

SEQ ID NO: 3517293 - DNA, 19 bp, Homo sapiens
ttgcatggcatcacctcca

SEQ ID NO: 3517294 - DNA, 13 bp, Homo sapiens
ttgcattaaattc

SEQ ID NO: 3517295 - DNA, 21 bp, Homo sapiens
ttgcattaaattcacaaactt

SEQ ID NO: 3517296 - DNA, 22 bp, Homo sapiens
ttgcattaaattcacaaacttt

SEQ ID NO: 3517297 - DNA, 23 bp, Homo sapiens
ttgcattgaacacaaactgtaaa

SEQ ID NO: 3517298 - DNA, 16 bp, Homo sapiens
ttgcatttctgtattt

SEQ ID NO: 3517299 - DNA, 21 bp, Homo sapiens
ttgcatttggattggggtccc

SEQ ID NO: 3517300 - DNA, 15 bp, Homo sapiens
ttgccaaaaaggata

SEQ ID NO: 3517301 - DNA, 15 bp, Homo sapiens
ttgccaagctcagga

SEQ ID NO: 3517302 - DNA, 12 bp, Homo sapiens
ttgccaatatgc

SEQ ID NO: 3517303 - DNA, 13 bp, Homo sapiens
ttgccaatatgcc

SEQ ID NO: 3517304 - DNA, 15 bp, Homo sapiens
ttgccacccccagtt

SEQ ID NO: 3517305 - DNA, 17 bp, Homo sapiens
ttgccatattgcacatg

SEQ ID NO: 3517306 - DNA, 18 bp, Homo sapiens
ttgccatgttggccaggc

SEQ ID NO: 3517307 - DNA, 17 bp, Homo sapiens
ttgcctaaatccaaaga

SEQ ID NO: 3517308 - DNA, 15 bp, Homo sapiens
ttgcctatcctgctg

SEQ ID NO: 3517309 - DNA, 16 bp, Homo sapiens
ttgcctatcctgctgt

SEQ ID NO: 3517310 - DNA, 13 bp, Homo sapiens
ttgcctcaccttg

SEQ ID NO: 3517311 - DNA, 16 bp, Homo sapiens
ttgcctctgcctctga

SEQ ID NO: 3517312 - DNA, 20 bp, Homo sapiens
ttgcctctgtccccttctct

SEQ ID NO: 3517313 - DNA, 12 bp, Homo sapiens
ttgcctctgtgc

SEQ ID NO: 3517314 - DNA, 15 bp, Homo sapiens
ttgccttcctaagcc

SEQ ID NO: 3517315 - DNA, 23 bp, Homo sapiens
ttgccttctcaccagctgcaaag

SEQ ID NO: 3517316 - DNA, 16 bp, Homo sapiens
ttgcctttgaatgtta

SEQ ID NO: 3517317 - DNA, 22 bp, Homo sapiens
ttgctatcaacaataaaatttt

SEQ ID NO: 3517318 - DNA, 11 bp, Homo sapiens
ttgctgaatag

SEQ ID NO: 3517319 - DNA, 18 bp, Homo sapiens
ttgctgaataggcgatca

SEQ ID NO: 3517320 - DNA, 16 bp, Homo sapiens
ttgctgcctcagagca

SEQ ID NO: 3517321 - DNA, 22 bp, Homo sapiens
ttgctgctgtccagtgcctaca

SEQ ID NO: 3517322 - DNA, 12 bp, Homo sapiens
ttgctgctgtct

SEQ ID NO: 3517323 - DNA, 14 bp, Homo sapiens
ttgctgcttgaggc

SEQ ID NO: 3517324 - DNA, 21 bp, Homo sapiens
ttgctggagtcatgtgcctct

SEQ ID NO: 3517325 - DNA, 19 bp, Homo sapiens
ttgctgtaggatctaaggc

SEQ ID NO: 3517326 - DNA, 21 bp, Homo sapiens
ttgctgttattatatttgaca

SEQ ID NO: 3517327 - DNA, 20 bp, Homo sapiens
ttgctgttgacatatttaat

SEQ ID NO: 3517328 - DNA, 16 bp, Homo sapiens
ttgcttccccttttgc

SEQ ID NO: 3517329 - DNA, 17 bp, Homo sapiens
ttgcttgacttcagtta

SEQ ID NO: 3517330 - DNA, 13 bp, Homo sapiens
ttgcttgttctct

SEQ ID NO: 3517331 - DNA, 11 bp, Homo sapiens
ttgctttcact

SEQ ID NO: 3517332 - DNA, 14 bp, Homo sapiens
ttgcttttttgact

SEQ ID NO: 3517333 - DNA, 15 bp, Homo sapiens
ttggaaaatgcattg

SEQ ID NO: 3517334 - DNA, 18 bp, Homo sapiens
ttggaacactactcttac

SEQ ID NO: 3517335 - DNA, 13 bp, Homo sapiens
ttggaactatgaa

SEQ ID NO: 3517336 - DNA, 19 bp, Homo sapiens
ttggaagctccgctttcta

SEQ ID NO: 3517337 - DNA, 17 bp, Homo sapiens
ttggaatgggcagctca

SEQ ID NO: 3517338 - DNA, 23 bp, Homo sapiens
ttggacaatcatgaaatatgcat

SEQ ID NO: 3517339 - DNA, 22 bp, Homo sapiens
ttggacatcagtgtttgttgga

SEQ ID NO: 3517340 - DNA, 14 bp, Homo sapiens
ttggacatcctcct

SEQ ID NO: 3517341 - DNA, 23 bp, Homo sapiens
ttggacctaaatggcctcatgtg

SEQ ID NO: 3517342 - DNA, 13 bp, Homo sapiens
ttggactattata

SEQ ID NO: 3517343 - DNA, 15 bp, Homo sapiens
ttggactggatgcat

SEQ ID NO: 3517344 - DNA, 20 bp, Homo sapiens
ttggagaagcccgtgtgaga

SEQ ID NO: 3517345 - DNA, 15 bp, Homo sapiens
ttggagagtttcctg

SEQ ID NO: 3517346 - DNA, 13 bp, Homo sapiens
ttggaggacagtg

SEQ ID NO: 3517347 - DNA, 15 bp, Homo sapiens
ttggaggagagagcc

SEQ ID NO: 3517348 - DNA, 17 bp, Homo sapiens
ttggaggagagagcctt

SEQ ID NO: 3517349 - DNA, 19 bp, Homo sapiens
ttggagtgttccccttcca

SEQ ID NO: 3517350 - DNA, 14 bp, Homo sapiens
ttggagtgtttcta

SEQ ID NO: 3517351 - DNA, 23 bp, Homo sapiens
ttggatgcagtgctcgctgttgc

SEQ ID NO: 3517352 - DNA, 14 bp, Homo sapiens
ttggattctttaaa

SEQ ID NO: 3517353 - DNA, 14 bp, Homo sapiens
ttggattggggtcc

SEQ ID NO: 3517354 - DNA, 18 bp, Homo sapiens
ttggattgtatattgtgt

SEQ ID NO: 3517355 - DNA, 22 bp, Homo sapiens
ttggatttgacattgcgtttga

SEQ ID NO: 3517356 - DNA, 17 bp, Homo sapiens
ttggcaaaaaggcagga

SEQ ID NO: 3517357 - DNA, 17 bp, Homo sapiens
ttggcaccagacaccca

SEQ ID NO: 3517358 - DNA, 21 bp, Homo sapiens
ttggcaccagacacccaggac

SEQ ID NO: 3517359 - DNA, 23 bp, Homo sapiens
ttggcaccagacacccaggactt

SEQ ID NO: 3517360 - DNA, 15 bp, Homo sapiens
ttggcagcacctgtc

SEQ ID NO: 3517361 - DNA, 12 bp, Homo sapiens
ttggcaggctgg

SEQ ID NO: 3517362 - DNA, 14 bp, Homo sapiens
ttggcaggctggcc

SEQ ID NO: 3517363 - DNA, 15 bp, Homo sapiens
ttggcatcagctggc

SEQ ID NO: 3517364 - DNA, 20 bp, Homo sapiens
ttggccaccaggtgcctttc

SEQ ID NO: 3517365 - DNA, 21 bp, Homo sapiens
ttggccactccgagaggtggg

SEQ ID NO: 3517366 - DNA, 18 bp, Homo sapiens
ttggcctcatctctgcct

SEQ ID NO: 3517367 - DNA, 20 bp, Homo sapiens
ttggcctcatctctgcctga

SEQ ID NO: 3517368 - DNA, 14 bp, Homo sapiens
ttggcctggagttt

SEQ ID NO: 3517369 - DNA, 22 bp, Homo sapiens
ttggccttctcccctcttctga

SEQ ID NO: 3517370 - DNA, 16 bp, Homo sapiens
ttggctcacactgaga

SEQ ID NO: 3517371 - DNA, 22 bp, Homo sapiens
ttggctcgaatctctgtgcctt

SEQ ID NO: 3517372 - DNA, 20 bp, Homo sapiens
ttggctgaaattctcctgga

SEQ ID NO: 3517373 - DNA, 14 bp, Homo sapiens
ttggctgcagggag

SEQ ID NO: 3517374 - DNA, 17 bp, Homo sapiens
ttggctgcatttgcctg

SEQ ID NO: 3517375 - DNA, 18 bp, Homo sapiens
ttggctgggggcctcagt

SEQ ID NO: 3517376 - DNA, 21 bp, Homo sapiens
ttggctgggggcctcagtgcc

SEQ ID NO: 3517377 - DNA, 15 bp, Homo sapiens
ttggctgtgtctaaa

SEQ ID NO: 3517378 - DNA, 21 bp, Homo sapiens
ttggctgtgtctaaactgcat

SEQ ID NO: 3517379 - DNA, 17 bp, Homo sapiens
ttggcttactgcagcct

SEQ ID NO: 3517380 - DNA, 23 bp, Homo sapiens
ttggcttcacggaagagccttgc

SEQ ID NO: 3517381 - DNA, 20 bp, Homo sapiens
ttggctttatcctctttaga

SEQ ID NO: 3517382 - DNA, 17 bp, Homo sapiens
ttggctttatgcacatt

SEQ ID NO: 3517383 - DNA, 18 bp, Homo sapiens
ttgggaactgaactcact

SEQ ID NO: 3517384 - DNA, 15 bp, Homo sapiens
ttgggaatatttgaa

SEQ ID NO: 3517385 - DNA, 17 bp, Homo sapiens
ttgggaatatttgaatc

SEQ ID NO: 3517386 - DNA, 14 bp, Homo sapiens
ttgggaatgtttgt

SEQ ID NO: 3517387 - DNA, 16 bp, Homo sapiens
ttgggagagcaggaat

SEQ ID NO: 3517388 - DNA, 12 bp, Homo sapiens
ttgggagccact

SEQ ID NO: 3517389 - DNA, 23 bp, Homo sapiens
ttgggatcgtcctggattcactg

SEQ ID NO: 3517390 - DNA, 22 bp, Homo sapiens
ttgggcagagctggctctgagc

SEQ ID NO: 3517391 - DNA, 18 bp, Homo sapiens
ttcttaaccagatggttg

SEQ ID NO: 3517392 - DNA, 18 bp, Homo sapiens
ttcttaagacatgtatca

SEQ ID NO: 3517393 - DNA, 17 bp, Homo sapiens
ttcttaatgttcacata

SEQ ID NO: 3517394 - DNA, 12 bp, Homo sapiens
ttcttacaagga

SEQ ID NO: 3517395 - DNA, 13 bp, Homo sapiens
ttcttacatgttt

SEQ ID NO: 3517396 - DNA, 13 bp, Homo sapiens
ttcttagaaattt

SEQ ID NO: 3517397 - DNA, 20 bp, Homo sapiens
ttcttatacgcttttctttg

SEQ ID NO: 3517398 - DNA, 19 bp, Homo sapiens
ttcttattcccccctaagc

SEQ ID NO: 3517399 - DNA, 15 bp, Homo sapiens
ttcttcatattctaa

SEQ ID NO: 3517400 - DNA, 19 bp, Homo sapiens
ttcttccaggtgcccagct

SEQ ID NO: 3517401 - DNA, 20 bp, Homo sapiens
ttcttccaggtgcccagcta

SEQ ID NO: 3517402 - DNA, 21 bp, Homo sapiens
ttcttcccttttacatactgc

SEQ ID NO: 3517403 - DNA, 18 bp, Homo sapiens
ttcttcgttctttttaag

SEQ ID NO: 3517404 - DNA, 17 bp, Homo sapiens
ttcttctcctatgtgta

SEQ ID NO: 3517405 - DNA, 18 bp, Homo sapiens
ttcttctcctatgtgtaa

SEQ ID NO: 3517406 - DNA, 15 bp, Homo sapiens
ttcttctgcttcagc

SEQ ID NO: 3517407 - DNA, 20 bp, Homo sapiens
ttcttctgcttcagcctccc

SEQ ID NO: 3517408 - DNA, 11 bp, Homo sapiens
ttcttctgggc

SEQ ID NO: 3517409 - DNA, 13 bp, Homo sapiens
ttcttcttcacat

SEQ ID NO: 3517410 - DNA, 13 bp, Homo sapiens
ttcttgaaagctg

SEQ ID NO: 3517411 - DNA, 14 bp, Homo sapiens
ttcttgaaagctgt

SEQ ID NO: 3517412 - DNA, 21 bp, Homo sapiens
ttcttgatcaacatcttttct

SEQ ID NO: 3517413 - DNA, 18 bp, Homo sapiens
ttcttgattaaagtgatt

SEQ ID NO: 3517414 - DNA, 18 bp, Homo sapiens
ttcttgcctctgtcccct

SEQ ID NO: 3517415 - DNA, 22 bp, Homo sapiens
ttcttgcctctgtgctgtgtgt

SEQ ID NO: 3517416 - DNA, 22 bp, Homo sapiens
ttcttggcttaatcattttcat

SEQ ID NO: 3517417 - DNA, 14 bp, Homo sapiens
ttcttgtttccttg

SEQ ID NO: 3517418 - DNA, 23 bp, Homo sapiens
ttctttaaaaaacaactatggat

SEQ ID NO: 3517419 - DNA, 11 bp, Homo sapiens
ttctttagaac

SEQ ID NO: 3517420 - DNA, 20 bp, Homo sapiens
ttctttagaatttttaccca

SEQ ID NO: 3517421 - DNA, 15 bp, Homo sapiens
ttctttcaattctgt

SEQ ID NO: 3517422 - DNA, 12 bp, Homo sapiens
ttctttcccaaa

SEQ ID NO: 3517423 - DNA, 20 bp, Homo sapiens
ttctttcttagaaatttatt

SEQ ID NO: 3517424 - DNA, 16 bp, Homo sapiens
ttctttgcaaagtatt

SEQ ID NO: 3517425 - DNA, 13 bp, Homo sapiens
ttctttgggccag

SEQ ID NO: 3517426 - DNA, 16 bp, Homo sapiens
ttctttttattttctt

SEQ ID NO: 3517427 - DNA, 22 bp, Homo sapiens
ttctttttttattattatttat

SEQ ID NO: 3517428 - DNA, 19 bp, Homo sapiens
ttctttttttcctttttaa

SEQ ID NO: 3517429 - DNA, 18 bp, Homo sapiens
ttcttttttttcattata

SEQ ID NO: 3517430 - DNA, 21 bp, Homo sapiens
ttcttttttttttttttgaga

SEQ ID NO: 3517431 - DNA, 22 bp, Homo sapiens
ttgaaaaaatagagcctgaggg

SEQ ID NO: 3517432 - DNA, 15 bp, Homo sapiens
ttgaaaagtcaaact

SEQ ID NO: 3517433 - DNA, 18 bp, Homo sapiens
ttgaaatgtggttttcct

SEQ ID NO: 3517434 - DNA, 14 bp, Homo sapiens
ttgaaattctgaat

SEQ ID NO: 3517435 - DNA, 22 bp, Homo sapiens
ttgaaattctgaatttgcaaag

SEQ ID NO: 3517436 - DNA, 20 bp, Homo sapiens
ttgaacacaaactgtaaata

SEQ ID NO: 3517437 - DNA, 21 bp, Homo sapiens
ttgaacacaaactgtaaataa

SEQ ID NO: 3517438 - DNA, 17 bp, Homo sapiens
ttgaacccaggagttca

SEQ ID NO: 3517439 - DNA, 16 bp, Homo sapiens
ttgaactctgggctca

SEQ ID NO: 3517440 - DNA, 15 bp, Homo sapiens
ttgaactctggtggc

SEQ ID NO: 3517441 - DNA, 20 bp, Homo sapiens
ttgaactcttcactcttcaa

SEQ ID NO: 3517442 - DNA, 19 bp, Homo sapiens
ttgaagaactgcaggccct

SEQ ID NO: 3517443 - DNA, 21 bp, Homo sapiens
ttgaagaagttcagaaattta

SEQ ID NO: 3517444 - DNA, 18 bp, Homo sapiens
ttgaagagaaaaaagtca

SEQ ID NO: 3517445 - DNA, 14 bp, Homo sapiens
ttgaagctgctgtc

SEQ ID NO: 3517446 - DNA, 15 bp, Homo sapiens
ttgaagggccagagc

SEQ ID NO: 3517447 - DNA, 17 bp, Homo sapiens
ttgaagggccagagcca

SEQ ID NO: 3517448 - DNA, 20 bp, Homo sapiens
ttgaagggccagagccaggg

SEQ ID NO: 3517449 - DNA, 15 bp, Homo sapiens
ttgaagtaaactgca

SEQ ID NO: 3517450 - DNA, 19 bp, Homo sapiens
ttgaagtgtaggcagacac

SEQ ID NO: 3517451 - DNA, 22 bp, Homo sapiens
ttgaagtgtaggcagacacagg

SEQ ID NO: 3517452 - DNA, 15 bp, Homo sapiens
ttgaatacttacatt

SEQ ID NO: 3517453 - DNA, 21 bp, Homo sapiens
ttgaatataatatatttgtgt

SEQ ID NO: 3517454 - DNA, 22 bp, Homo sapiens
ttgaatataatatatttgtgta

SEQ ID NO: 3517455 - DNA, 18 bp, Homo sapiens
ttgaatcagtttccaatt

SEQ ID NO: 3517456 - DNA, 21 bp, Homo sapiens
ttgaatcagtttccaattatt

SEQ ID NO: 3517457 - DNA, 20 bp, Homo sapiens
ttgaatctatttaagtaaaa

SEQ ID NO: 3517458 - DNA, 14 bp, Homo sapiens
ttgaatcttgtctc

SEQ ID NO: 3517459 - DNA, 15 bp, Homo sapiens
ttgaatcttgtctca

SEQ ID NO: 3517460 - DNA, 12 bp, Homo sapiens
ttgaatgcattt

SEQ ID NO: 3517461 - DNA, 15 bp, Homo sapiens
ttgaatgtaaccaat

SEQ ID NO: 3517462 - DNA, 20 bp, Homo sapiens
ttgaatgttaaataaattgt

SEQ ID NO: 3517463 - DNA, 19 bp, Homo sapiens
ttgaattaaatgttcatct

SEQ ID NO: 3517464 - DNA, 21 bp, Homo sapiens
ttgaattcttggttgaggaaa

SEQ ID NO: 3517465 - DNA, 13 bp, Homo sapiens
ttgaattgttaca

SEQ ID NO: 3517466 - DNA, 20 bp, Homo sapiens
ttgaattttgttctctggga

SEQ ID NO: 3517467 - DNA, 13 bp, Homo sapiens
ttgaatttttcct

SEQ ID NO: 3517468 - DNA, 17 bp, Homo sapiens
ttgaatttttcctatgc

SEQ ID NO: 3517469 - DNA, 21 bp, Homo sapiens
ttgaatttttttctgcacagc

SEQ ID NO: 3517470 - DNA, 18 bp, Homo sapiens
ttgacaaaggcaagcact

SEQ ID NO: 3517471 - DNA, 13 bp, Homo sapiens
ttgacaacatctg

SEQ ID NO: 3517472 - DNA, 18 bp, Homo sapiens
ttgacaactggcaggcag

SEQ ID NO: 3517473 - DNA, 18 bp, Homo sapiens
ttgacaaggtcaaattta

SEQ ID NO: 3517474 - DNA, 14 bp, Homo sapiens
ttgacacttccatt

SEQ ID NO: 3517475 - DNA, 18 bp, Homo sapiens
ttgacacttccattgttt

SEQ ID NO: 3517476 - DNA, 15 bp, Homo sapiens
ttgacagaaagcagt

SEQ ID NO: 3517477 - DNA, 17 bp, Homo sapiens
ttgacagctttgctgct

SEQ ID NO: 3517478 - DNA, 18 bp, Homo sapiens
ttgacagctttgctgctg

SEQ ID NO: 3517479 - DNA, 16 bp, Homo sapiens
ttgacatatttaatgt

SEQ ID NO: 3517480 - DNA, 16 bp, Homo sapiens
ttgaccaagcaggaag

SEQ ID NO: 3517481 - DNA, 13 bp, Homo sapiens
ttgaccaatttgc

SEQ ID NO: 3517482 - DNA, 14 bp, Homo sapiens
ttgaccaatttgca

SEQ ID NO: 3517483 - DNA, 14 bp, Homo sapiens
ttgaccctattttt

SEQ ID NO: 3517484 - DNA, 13 bp, Homo sapiens
ttgacctttgtac

SEQ ID NO: 3517485 - DNA, 14 bp, Homo sapiens
ttgacctttgtaca

SEQ ID NO: 3517486 - DNA, 23 bp, Homo sapiens
ttgactagatgatggatgccaat

SEQ ID NO: 3517487 - DNA, 19 bp, Homo sapiens
ttgactctggcaaagcttt

SEQ ID NO: 3517488 - DNA, 12 bp, Homo sapiens
ttgactctgggt

SEQ ID NO: 3517489 - DNA, 23 bp, Homo sapiens
ttgactgggtttctctgtatagt

SEQ ID NO: 3517490 - DNA, 13 bp, Homo sapiens
ttgactttaattt

SEQ ID NO: 3517491 - DNA, 14 bp, Homo sapiens
ttgactttaattta

SEQ ID NO: 3517492 - DNA, 14 bp, Homo sapiens
ttgactttcttaaa

SEQ ID NO: 3517493 - DNA, 15 bp, Homo sapiens
ttgactttcttaaaa

SEQ ID NO: 3517494 - DNA, 18 bp, Homo sapiens
ttgactttcttaaaaata

SEQ ID NO: 3517495 - DNA, 12 bp, Homo sapiens
ttgagaagctct

SEQ ID NO: 3517496 - DNA, 17 bp, Homo sapiens
ttgagaaggtgcctgcc

SEQ ID NO: 3517497 - DNA, 20 bp, Homo sapiens
ttgagaaggtgcctgccata

SEQ ID NO: 3517498 - DNA, 17 bp, Homo sapiens
ttgagaatacaagatat

SEQ ID NO: 3517499 - DNA, 13 bp, Homo sapiens
ttgagaccagcct

SEQ ID NO: 3517500 - DNA, 16 bp, Homo sapiens
ttgagaccagcctggc

SEQ ID NO: 3517501 - DNA, 19 bp, Homo sapiens
ttgagcatgacagcctgca

SEQ ID NO: 3517502 - DNA, 15 bp, Homo sapiens
ttgagctattgctgt

SEQ ID NO: 3517503 - DNA, 18 bp, Homo sapiens
ttgagctgttttccctga

SEQ ID NO: 3517504 - DNA, 13 bp, Homo sapiens
ttgaggaaaacaa

SEQ ID NO: 3517505 - DNA, 18 bp, Homo sapiens
ttgaggaaacaacagctt

SEQ ID NO: 3517506 - DNA, 21 bp, Homo sapiens
ttgaggaatatttcaagctct

SEQ ID NO: 3517507 - DNA, 16 bp, Homo sapiens
ttgaggataaattgcc

SEQ ID NO: 3517508 - DNA, 19 bp, Homo sapiens
ttgaggataaattgccata

SEQ ID NO: 3517509 - DNA, 15 bp, Homo sapiens
ttgaggataactttt

SEQ ID NO: 3517510 - DNA, 18 bp, Homo sapiens
ttgaggataactttttaa

SEQ ID NO: 3517511 - DNA, 13 bp, Homo sapiens
ttgaggcaagtgt

SEQ ID NO: 3517512 - DNA, 19 bp, Homo sapiens
ttgaggggagagggaacgg

SEQ ID NO: 3517513 - DNA, 14 bp, Homo sapiens
ttgagtctgtgcca

SEQ ID NO: 3517514 - DNA, 17 bp, Homo sapiens
ttgagtgttttaagata

SEQ ID NO: 3517515 - DNA, 20 bp, Homo sapiens
ttgagttgattcagctctgc

SEQ ID NO: 3517516 - DNA, 14 bp, Homo sapiens
ttgagttttcagtg

SEQ ID NO: 3517517 - DNA, 21 bp, Homo sapiens
ttgagttttgttttaaaatta

SEQ ID NO: 3517518 - DNA, 16 bp, Homo sapiens
ttgataagagggcaca

SEQ ID NO: 3517519 - DNA, 22 bp, Homo sapiens
ttgataagagggcacacactgt

SEQ ID NO: 3517520 - DNA, 18 bp, Homo sapiens
ttgatagctgtcccatct

SEQ ID NO: 3517521 - DNA, 18 bp, Homo sapiens
ttgatcaacatcttttct

SEQ ID NO: 3517522 - DNA, 15 bp, Homo sapiens
ttgatcatgtacttt

SEQ ID NO: 3517523 - DNA, 16 bp, Homo sapiens
ttgatcatgtactttt

SEQ ID NO: 3517524 - DNA, 18 bp, Homo sapiens
ttgatccatccagcttgc

SEQ ID NO: 3517525 - DNA, 19 bp, Homo sapiens
ttgatcgcctttcccaggt

SEQ ID NO: 3517526 - DNA, 12 bp, Homo sapiens
ttgatgactgcc

SEQ ID NO: 3517527 - DNA, 14 bp, Homo sapiens
ttgatgactgcctt

SEQ ID NO: 3517528 - DNA, 18 bp, Homo sapiens
tgtcccttctgtccctca

SEQ ID NO: 3517529 - DNA, 14 bp, Homo sapiens
tgtcccttgctgta

SEQ ID NO: 3517530 - DNA, 24 bp, Homo sapiens
tgtccggaggatattaaaatgcta

SEQ ID NO: 3517531 - DNA, 18 bp, Homo sapiens
tgtcctaattcttctgtc

SEQ ID NO: 3517532 - DNA, 20 bp, Homo sapiens
tgtcctacccaccctccttt

SEQ ID NO: 3517533 - DNA, 12 bp, Homo sapiens
tgtcctactctg

SEQ ID NO: 3517534 - DNA, 13 bp, Homo sapiens
tgtcctcaccatg

SEQ ID NO: 3517535 - DNA, 20 bp, Homo sapiens
tgtcctcagccttgccagag

SEQ ID NO: 3517536 - DNA, 21 bp, Homo sapiens
tgtcctcagccttgccagaga

SEQ ID NO: 3517537 - DNA, 22 bp, Homo sapiens
tgtcctcagccttgccagagat

SEQ ID NO: 3517538 - DNA, 14 bp, Homo sapiens
tgtcctcaggtggc

SEQ ID NO: 3517539 - DNA, 16 bp, Homo sapiens
tgtcctcatttctcca

SEQ ID NO: 3517540 - DNA, 17 bp, Homo sapiens
tgtcctcatttctccag

SEQ ID NO: 3517541 - DNA, 23 bp, Homo sapiens
tgtcctccaacaccaagcacagc

SEQ ID NO: 3517542 - DNA, 18 bp, Homo sapiens
tgtcctcccagctcctca

SEQ ID NO: 3517543 - DNA, 13 bp, Homo sapiens
tgtcctcttccct

SEQ ID NO: 3517544 - DNA, 17 bp, Homo sapiens
tgtcctgaaagcggctg

SEQ ID NO: 3517545 - DNA, 21 bp, Homo sapiens
tgtcctgaaagcggctgcctc

SEQ ID NO: 3517546 - DNA, 22 bp, Homo sapiens
tgtcctgaaagcggctgcctcc

SEQ ID NO: 3517547 - DNA, 23 bp, Homo sapiens
tgtcctgaaagcggctgcctcca

SEQ ID NO: 3517548 - DNA, 18 bp, Homo sapiens
tgtcctgatgcttttgtc

SEQ ID NO: 3517549 - DNA, 10 bp, Homo sapiens
tgtcctgcct

SEQ ID NO: 3517550 - DNA, 15 bp, Homo sapiens
tgtcctgcctgtctg

SEQ ID NO: 3517551 - DNA, 16 bp, Homo sapiens
tgtcctgcctgtctgc

SEQ ID NO: 3517552 - DNA, 15 bp, Homo sapiens
tgtcctgggcctgca

SEQ ID NO: 3517553 - DNA, 22 bp, Homo sapiens
tgtcctgtgaaatattcttagg

SEQ ID NO: 3517554 - DNA, 20 bp, Homo sapiens
tgtccttacccatctgcacc

SEQ ID NO: 3517555 - DNA, 16 bp, Homo sapiens
tgtcctttaaaaaaga

SEQ ID NO: 3517556 - DNA, 19 bp, Homo sapiens
tgtcctttctagagcactg

SEQ ID NO: 3517557 - DNA, 17 bp, Homo sapiens
tgtcgagagctggccaa

SEQ ID NO: 3517558 - DNA, 15 bp, Homo sapiens
tgtcgctcatgtgtg

SEQ ID NO: 3517559 - DNA, 16 bp, Homo sapiens
tgtcgctcatgtgtgc

SEQ ID NO: 3517560 - DNA, 19 bp, Homo sapiens
tgtcgggcaccagccagcg

SEQ ID NO: 3517561 - DNA, 20 bp, Homo sapiens
tgtcgggctttgtgtgaagg

SEQ ID NO: 3517562 - DNA, 23 bp, Homo sapiens
tgtcgtagaattccttcgaaagg

SEQ ID NO: 3517563 - DNA, 13 bp, Homo sapiens
tgtctaaaacaat

SEQ ID NO: 3517564 - DNA, 16 bp, Homo sapiens
tgtctaaacaatgctg

SEQ ID NO: 3517565 - DNA, 20 bp, Homo sapiens
tgtctaaacaatgctgattt

SEQ ID NO: 3517566 - DNA, 13 bp, Homo sapiens
tgtctaaactgca

SEQ ID NO: 3517567 - DNA, 18 bp, Homo sapiens
tgtctagagcctcttggg

SEQ ID NO: 3517568 - DNA, 21 bp, Homo sapiens
tgtctagggtgttctgtactt

SEQ ID NO: 3517569 - DNA, 22 bp, Homo sapiens
tgtctagggtgttctgtactta

SEQ ID NO: 3517570 - DNA, 18 bp, Homo sapiens
tgtctattccattccctt

SEQ ID NO: 3517571 - DNA, 14 bp, Homo sapiens
tgtctcaatgctca

SEQ ID NO: 3517572 - DNA, 17 bp, Homo sapiens
tgtctcaatgctcataa

SEQ ID NO: 3517573 - DNA, 13 bp, Homo sapiens
tgtctcagcctcc

SEQ ID NO: 3517574 - DNA, 21 bp, Homo sapiens
tgtctcatccatcatcatgtg

SEQ ID NO: 3517575 - DNA, 16 bp, Homo sapiens
tgtctccaacccccca

SEQ ID NO: 3517576 - DNA, 19 bp, Homo sapiens
tgtctccaaccccccagca

SEQ ID NO: 3517577 - DNA, 23 bp, Homo sapiens
tgtctccaaccccccagcactga

SEQ ID NO: 3517578 - DNA, 21 bp, Homo sapiens
tgtctcctttcaccccagggc

SEQ ID NO: 3517579 - DNA, 13 bp, Homo sapiens
tgtctctgcctct

SEQ ID NO: 3517580 - DNA, 16 bp, Homo sapiens
tgtctctgggccactt

SEQ ID NO: 3517581 - DNA, 20 bp, Homo sapiens
tgtctcttcatctaatatga

SEQ ID NO: 3517582 - DNA, 22 bp, Homo sapiens
tgtctctttaatgtcacaggca

SEQ ID NO: 3517583 - DNA, 20 bp, Homo sapiens
tgtctgagtgaacctgtata

SEQ ID NO: 3517584 - DNA, 21 bp, Homo sapiens
tgtctgagtgaacctgtataa

SEQ ID NO: 3517585 - DNA, 18 bp, Homo sapiens
tgtctgcagccctgagaa

SEQ ID NO: 3517586 - DNA, 13 bp, Homo sapiens
tgtctgcatttcg

SEQ ID NO: 3517587 - DNA, 14 bp, Homo sapiens
tgtctgccccagcc

SEQ ID NO: 3517588 - DNA, 15 bp, Homo sapiens
tgtctggccaggcct

SEQ ID NO: 3517589 - DNA, 16 bp, Homo sapiens
tgtctggtggccccgt

SEQ ID NO: 3517590 - DNA, 21 bp, Homo sapiens
tgtctgtggatggtcattgca

SEQ ID NO: 3517591 - DNA, 17 bp, Homo sapiens
tgtcttaatactgtcct

SEQ ID NO: 3517592 - DNA, 15 bp, Homo sapiens
tgtcttaatgaagtt

SEQ ID NO: 3517593 - DNA, 15 bp, Homo sapiens
tgtcttcctctgcaa

SEQ ID NO: 3517594 - DNA, 17 bp, Homo sapiens
tgtcttcctctgcaagt

SEQ ID NO: 3517595 - DNA, 15 bp, Homo sapiens
tgtcttgcaatggca

SEQ ID NO: 3517596 - DNA, 17 bp, Homo sapiens
tgtcttgcaatggcagc

SEQ ID NO: 3517597 - DNA, 14 bp, Homo sapiens
tgtcttgccagcca

SEQ ID NO: 3517598 - DNA, 19 bp, Homo sapiens
tgtcttgctgttgacatat

SEQ ID NO: 3517599 - DNA, 16 bp, Homo sapiens
tgtcttgggcagagct

SEQ ID NO: 3517600 - DNA, 22 bp, Homo sapiens
tgtcttgggcagagctggctct

SEQ ID NO: 3517601 - DNA, 18 bp, Homo sapiens
tgtcttgttcattttgag

SEQ ID NO: 3517602 - DNA, 18 bp, Homo sapiens
tgtcttgttctgtcactc

SEQ ID NO: 3517603 - DNA, 16 bp, Homo sapiens
tgtctttaaaagagag

SEQ ID NO: 3517604 - DNA, 13 bp, Homo sapiens
tgtctttcctaga

SEQ ID NO: 3517605 - DNA, 16 bp, Homo sapiens
tgtcttttaaaatgca

SEQ ID NO: 3517606 - DNA, 17 bp, Homo sapiens
tgtcttttgacatttta

SEQ ID NO: 3517607 - DNA, 14 bp, Homo sapiens
tgtctttttcgcca

SEQ ID NO: 3517608 - DNA, 20 bp, Homo sapiens
tgtctttttcgccaaactgt

SEQ ID NO: 3517609 - DNA, 18 bp, Homo sapiens
tgtctttttgaaataaag

SEQ ID NO: 3517610 - DNA, 15 bp, Homo sapiens
tgtgaaaagaaaaat

SEQ ID NO: 3517611 - DNA, 21 bp, Homo sapiens
tgtgaaaagaaaaatgagcct

SEQ ID NO: 3517612 - DNA, 18 bp, Homo sapiens
tgtgaaaatggtccagga

SEQ ID NO: 3517613 - DNA, 21 bp, Homo sapiens
tgtgaaatagttcaaagccaa

SEQ ID NO: 3517614 - DNA, 16 bp, Homo sapiens
tgtgaacagcttgctg

SEQ ID NO: 3517615 - DNA, 15 bp, Homo sapiens
tgtgaaccaccacac

SEQ ID NO: 3517616 - DNA, 19 bp, Homo sapiens
tgtgaaccaccacacccag

SEQ ID NO: 3517617 - DNA, 20 bp, Homo sapiens
tgtgaaccctggggcctgac

SEQ ID NO: 3517618 - DNA, 23 bp, Homo sapiens
tgtgaaccctggggcctgactgc

SEQ ID NO: 3517619 - DNA, 19 bp, Homo sapiens
tgtgaactggaccctgttg

SEQ ID NO: 3517620 - DNA, 21 bp, Homo sapiens
tgtgaactggaccctgttgct

SEQ ID NO: 3517621 - DNA, 14 bp, Homo sapiens
tgtgaagagaacca

SEQ ID NO: 3517622 - DNA, 10 bp, Homo sapiens
tgtgaagcca

SEQ ID NO: 3517623 - DNA, 21 bp, Homo sapiens
tgtgaagccaattcagacagg

SEQ ID NO: 3517624 - DNA, 13 bp, Homo sapiens
tgtgaaggaccct

SEQ ID NO: 3517625 - DNA, 14 bp, Homo sapiens
tgtgaatctatgct

SEQ ID NO: 3517626 - DNA, 17 bp, Homo sapiens
tgtgaatctatgctggt

SEQ ID NO: 3517627 - DNA, 17 bp, Homo sapiens
tgtgaatgaacactctt

SEQ ID NO: 3517628 - DNA, 23 bp, Homo sapiens
tgtgaatgaacactcttttgctt

SEQ ID NO: 3517629 - DNA, 19 bp, Homo sapiens
tgtgacaattctgttttta

SEQ ID NO: 3517630 - DNA, 13 bp, Homo sapiens
tgtgacattcctt

SEQ ID NO: 3517631 - DNA, 20 bp, Homo sapiens
tgtgacccccagctccggcc

SEQ ID NO: 3517632 - DNA, 16 bp, Homo sapiens
tgtgacgcgcaagtct

SEQ ID NO: 3517633 - DNA, 17 bp, Homo sapiens
tgtgactctggcttggc

SEQ ID NO: 3517634 - DNA, 24 bp, Homo sapiens
tgtgagaagtgaatgctgggactc

SEQ ID NO: 3517635 - DNA, 19 bp, Homo sapiens
tgtgagactcgagaacttt

SEQ ID NO: 3517636 - DNA, 10 bp, Homo sapiens
tgtgagcaca

SEQ ID NO: 3517637 - DNA, 23 bp, Homo sapiens
gtgcctgccatagccaggagcgc

SEQ ID NO: 3517638 - DNA, 22 bp, Homo sapiens
gtgcctgggtggacatggcccc

SEQ ID NO: 3517639 - DNA, 20 bp, Homo sapiens
gtgccttcttcagggcctgg

SEQ ID NO: 3517640 - DNA, 21 bp, Homo sapiens
gtgccttcttcagggcctggt

SEQ ID NO: 3517641 - DNA, 18 bp, Homo sapiens
gtgccttttgcagaagag

SEQ ID NO: 3517642 - DNA, 23 bp, Homo sapiens
gtgccttttgcagaagagggtgt

SEQ ID NO: 3517643 - DNA, 18 bp, Homo sapiens
gtgcgatctcggctcagt

SEQ ID NO: 3517644 - DNA, 12 bp, Homo sapiens
gtgcgtgctcag

SEQ ID NO: 3517645 - DNA, 21 bp, Homo sapiens
gtgctatgacatggaggcact

SEQ ID NO: 3517646 - DNA, 16 bp, Homo sapiens
gtgctatggtgctctg

SEQ ID NO: 3517647 - DNA, 18 bp, Homo sapiens
gtgctcaggactcagaag

SEQ ID NO: 3517648 - DNA, 22 bp, Homo sapiens
gtgctcaggactcagaagcctc

SEQ ID NO: 3517649 - DNA, 15 bp, Homo sapiens
gtgctcagggaaatg

SEQ ID NO: 3517650 - DNA, 21 bp, Homo sapiens
gtgctcagggaaatggccttc

SEQ ID NO: 3517651 - DNA, 23 bp, Homo sapiens
gtgctcagggaaatggccttccc

SEQ ID NO: 3517652 - DNA, 16 bp, Homo sapiens
gtgctcccctctgaaa

SEQ ID NO: 3517653 - DNA, 16 bp, Homo sapiens
gtgctctgatcatcca

SEQ ID NO: 3517654 - DNA, 13 bp, Homo sapiens
gtgctctggacag

SEQ ID NO: 3517655 - DNA, 14 bp, Homo sapiens
gtgctctggacagg

SEQ ID NO: 3517656 - DNA, 14 bp, Homo sapiens
gtgctgactgaaca

SEQ ID NO: 3517657 - DNA, 15 bp, Homo sapiens
gtgctgactgaacat

SEQ ID NO: 3517658 - DNA, 16 bp, Homo sapiens
gtgctgactgaacatt

SEQ ID NO: 3517659 - DNA, 11 bp, Homo sapiens
gtgctgagaag

SEQ ID NO: 3517660 - DNA, 14 bp, Homo sapiens
gtgctgagtagatg

SEQ ID NO: 3517661 - DNA, 19 bp, Homo sapiens
gtgctgcagctccctggct

SEQ ID NO: 3517662 - DNA, 18 bp, Homo sapiens
gtgctgccatccaggttc

SEQ ID NO: 3517663 - DNA, 15 bp, Homo sapiens
aaatattttctctgt

SEQ ID NO: 3517664 - DNA, 21 bp, Homo sapiens
aaatcaactttttattgcctt

SEQ ID NO: 3517665 - DNA, 12 bp, Homo sapiens
aaatcaagtttt

SEQ ID NO: 3517666 - DNA, 14 bp, Homo sapiens
aaatcacatcctta

SEQ ID NO: 3517667 - DNA, 21 bp, Homo sapiens
aaatcagccaattatgttaaa

SEQ ID NO: 3517668 - DNA, 23 bp, Homo sapiens
aaatcagccaattatgttaaact

SEQ ID NO: 3517669 - DNA, 12 bp, Homo sapiens
aaatcagcctgc

SEQ ID NO: 3517670 - DNA, 21 bp, Homo sapiens
aaatcagcctgctccagctgt

SEQ ID NO: 3517671 - DNA, 23 bp, Homo sapiens
aaatcagcctgctccagctgttc

SEQ ID NO: 3517672 - DNA, 12 bp, Homo sapiens
aaatcatcaaga

SEQ ID NO: 3517673 - DNA, 18 bp, Homo sapiens
aaatcatcaagaagggct

SEQ ID NO: 3517674 - DNA, 19 bp, Homo sapiens
aaatcatcaagaagggctg

SEQ ID NO: 3517675 - DNA, 14 bp, Homo sapiens
aaatccaaagaaaa

SEQ ID NO: 3517676 - DNA, 20 bp, Homo sapiens
aaatccagtgtgcacccctc

SEQ ID NO: 3517677 - DNA, 19 bp, Homo sapiens
aaatccgaacctcctctgt

SEQ ID NO: 3517678 - DNA, 14 bp, Homo sapiens
aaatcctatgtgat

SEQ ID NO: 3517679 - DNA, 16 bp, Homo sapiens
aaatcctatgtgattt

SEQ ID NO: 3517680 - DNA, 19 bp, Homo sapiens
aaatccttagatctggcat

SEQ ID NO: 3517681 - DNA, 14 bp, Homo sapiens
aaatctgacccagt

SEQ ID NO: 3517682 - DNA, 11 bp, Homo sapiens
aaatctgcctg

SEQ ID NO: 3517683 - DNA, 15 bp, Homo sapiens
aaatctgcctgggtt

SEQ ID NO: 3517684 - DNA, 22 bp, Homo sapiens
aaatctgctggagtttcatgta

SEQ ID NO: 3517685 - DNA, 12 bp, Homo sapiens
aaatctggaagc

SEQ ID NO: 3517686 - DNA, 16 bp, Homo sapiens
aaatctgtcaagagta

SEQ ID NO: 3517687 - DNA, 22 bp, Homo sapiens
aaatcttgttattgaagtgttc

SEQ ID NO: 3517688 - DNA, 13 bp, Homo sapiens
aaatgagccatga

SEQ ID NO: 3517689 - DNA, 19 bp, Homo sapiens
aaatgagcctggcaagaat

SEQ ID NO: 3517690 - DNA, 14 bp, Homo sapiens
aaatgaggaatgta

SEQ ID NO: 3517691 - DNA, 17 bp, Homo sapiens
aaatgaggaatgtatat

SEQ ID NO: 3517692 - DNA, 18 bp, Homo sapiens
aaatgaggaatgtatatg

SEQ ID NO: 3517693 - DNA, 13 bp, Homo sapiens
aaatgcaaatcct

SEQ ID NO: 3517694 - DNA, 21 bp, Homo sapiens
aaatgcaaatcctatgtgatt

SEQ ID NO: 3517695 - DNA, 14 bp, Homo sapiens
aaatgcacaaacaa

SEQ ID NO: 3517696 - DNA, 14 bp, Homo sapiens
aaatgcagtatatt

SEQ ID NO: 3517697 - DNA, 18 bp, Homo sapiens
aaatgcagtatatttctt

SEQ ID NO: 3517698 - DNA, 14 bp, Homo sapiens
aaatgcatgatttt

SEQ ID NO: 3517699 - DNA, 11 bp, Homo sapiens
aaatgcattta

SEQ ID NO: 3517700 - DNA, 14 bp, Homo sapiens
aaatgcatttctaa

SEQ ID NO: 3517701 - DNA, 22 bp, Homo sapiens
aaatgccatgatgcctctgtct

SEQ ID NO: 3517702 - DNA, 16 bp, Homo sapiens
aaatggatacataaag

SEQ ID NO: 3517703 - DNA, 17 bp, Homo sapiens
aaatggatgccttgaat

SEQ ID NO: 3517704 - DNA, 22 bp, Homo sapiens
aaatggatgccttgaataataa

SEQ ID NO: 3517705 - DNA, 16 bp, Homo sapiens
aaatggcagtgatgaa

SEQ ID NO: 3517706 - DNA, 15 bp, Homo sapiens
aaatggcctcatgtg

SEQ ID NO: 3517707 - DNA, 22 bp, Homo sapiens
aaatggcctcatgtggctggaa

SEQ ID NO: 3517708 - DNA, 13 bp, Homo sapiens
aaatggccttccc

SEQ ID NO: 3517709 - DNA, 14 bp, Homo sapiens
aaatggccttcccg

SEQ ID NO: 3517710 - DNA, 21 bp, Homo sapiens
aaatggcgtctggaagtccaa

SEQ ID NO: 3517711 - DNA, 19 bp, Homo sapiens
aaatggctgtaatcatttg

SEQ ID NO: 3517712 - DNA, 15 bp, Homo sapiens
aaatgggaatcatgg

SEQ ID NO: 3517713 - DNA, 21 bp, Homo sapiens
aaatggggccagatccagcct

SEQ ID NO: 3517714 - DNA, 22 bp, Homo sapiens
aaatggggccagatccagcctg

SEQ ID NO: 3517715 - DNA, 22 bp, Homo sapiens
aaatggtggaggattgctgcca

SEQ ID NO: 3517716 - DNA, 13 bp, Homo sapiens
aaatggttgtatt

SEQ ID NO: 3517717 - DNA, 17 bp, Homo sapiens
aaatggttgtattagat

SEQ ID NO: 3517718 - DNA, 20 bp, Homo sapiens
aaatggttgtattagatgtt

SEQ ID NO: 3517719 - DNA, 23 bp, Homo sapiens
aaatgtaactgtgccagttcttt

SEQ ID NO: 3517720 - DNA, 20 bp, Homo sapiens
aaatgtaatagccaaaccca

SEQ ID NO: 3517721 - DNA, 20 bp, Homo sapiens
aaatgtacagacatatttaa

SEQ ID NO: 3517722 - DNA, 18 bp, Homo sapiens
aaatgtagaatattcaga

SEQ ID NO: 3517723 - DNA, 14 bp, Homo sapiens
aaatgtatcttatt

SEQ ID NO: 3517724 - DNA, 21 bp, Homo sapiens
aaatgtctctttaatgtcaca

SEQ ID NO: 3517725 - DNA, 13 bp, Homo sapiens
aaatgtcttgtgt

SEQ ID NO: 3517726 - DNA, 23 bp, Homo sapiens
aaatgtgcattcttttaaaagac

SEQ ID NO: 3517727 - DNA, 22 bp, Homo sapiens
aaatgtggttttcctgaaatca

SEQ ID NO: 3517728 - DNA, 14 bp, Homo sapiens
aaattaaaatggat

SEQ ID NO: 3517729 - DNA, 18 bp, Homo sapiens
aaattaacagaaaaacag

SEQ ID NO: 3517730 - DNA, 16 bp, Homo sapiens
aaattacaattttatc

SEQ ID NO: 3517731 - DNA, 20 bp, Homo sapiens
aaattagaaaatgttattta

SEQ ID NO: 3517732 - DNA, 23 bp, Homo sapiens
aaattataagagacagacacttg

SEQ ID NO: 3517733 - DNA, 20 bp, Homo sapiens
aaattcaattgtaaattgaa

SEQ ID NO: 3517734 - DNA, 15 bp, Homo sapiens
aaattcacaaacttt

SEQ ID NO: 3517735 - DNA, 17 bp, Homo sapiens
aaattcacaaactttta

SEQ ID NO: 3517736 - DNA, 16 bp, Homo sapiens
aaattcacataataaa

SEQ ID NO: 3517737 - DNA, 14 bp, Homo sapiens
aaattcactttcat

SEQ ID NO: 3517738 - DNA, 17 bp, Homo sapiens
aaattccaagtgattga

SEQ ID NO: 3517739 - DNA, 16 bp, Homo sapiens
aaattccccaccctga

SEQ ID NO: 3517740 - DNA, 14 bp, Homo sapiens
aaattctaaatgta

SEQ ID NO: 3517741 - DNA, 14 bp, Homo sapiens
aaattctcctggag

SEQ ID NO: 3517742 - DNA, 14 bp, Homo sapiens
aaattctgaatttg

SEQ ID NO: 3517743 - DNA, 19 bp, Homo sapiens
aaattctgaatttgcaaag

SEQ ID NO: 3517744 - DNA, 20 bp, Homo sapiens
aaattctgaatttgcaaagt

SEQ ID NO: 3517745 - DNA, 15 bp, Homo sapiens
aaattctgaattttg

SEQ ID NO: 3517746 - DNA, 12 bp, Homo sapiens
aaattctgattc

SEQ ID NO: 3517747 - DNA, 14 bp, Homo sapiens
aaattctgattctt

SEQ ID NO: 3517748 - DNA, 18 bp, Homo sapiens
aaattctttttttattat

SEQ ID NO: 3517749 - DNA, 23 bp, Homo sapiens
aaattgaatcagtataaacaaag

SEQ ID NO: 3517750 - DNA, 19 bp, Homo sapiens
aaattgcacagaagtcctg

SEQ ID NO: 3517751 - DNA, 18 bp, Homo sapiens
aaattgccatattgcaca

SEQ ID NO: 3517752 - DNA, 17 bp, Homo sapiens
aaattgctaatgttgct

SEQ ID NO: 3517753 - DNA, 15 bp, Homo sapiens
aaattgtatattcac

SEQ ID NO: 3517754 - DNA, 21 bp, Homo sapiens
aaattgtgtgtgctctgcttc

SEQ ID NO: 3517755 - DNA, 18 bp, Homo sapiens
aaatttaattcatgtttc

SEQ ID NO: 3517756 - DNA, 17 bp, Homo sapiens
aaatttagaaactaatt

SEQ ID NO: 3517757 - DNA, 13 bp, Homo sapiens
aaatttatttcct

SEQ ID NO: 3517758 - DNA, 22 bp, Homo sapiens
aaatttattttataagaaaaac

SEQ ID NO: 3517759 - DNA, 23 bp, Homo sapiens
aaatttattttataagaaaaact

SEQ ID NO: 3517760 - DNA, 17 bp, Homo sapiens
aaatttcagcagctgca

SEQ ID NO: 3517761 - DNA, 18 bp, Homo sapiens
aaatttcagcagctgcag

SEQ ID NO: 3517762 - DNA, 15 bp, Homo sapiens
aaatttggttctaat

SEQ ID NO: 3517763 - DNA, 16 bp, Homo sapiens
aaatttggttctaata

SEQ ID NO: 3517764 - DNA, 19 bp, Homo sapiens
aaatttgttattttgcaac

SEQ ID NO: 3517765 - DNA, 21 bp, Homo sapiens
aaattttataaaattaagcaa

SEQ ID NO: 3517766 - DNA, 12 bp, Homo sapiens
aaattttattcc

SEQ ID NO: 3517767 - DNA, 13 bp, Homo sapiens
aaattttattcct

SEQ ID NO: 3517768 - DNA, 14 bp, Homo sapiens
aaattttgtaatga

SEQ ID NO: 3517769 - DNA, 13 bp, Homo sapiens
aaatttttgtaaa

SEQ ID NO: 3517770 - DNA, 21 bp, Homo sapiens
aaatttttttagaaagcattt

SEQ ID NO: 3517771 - DNA, 15 bp, Homo sapiens
aaattttttttcatg

SEQ ID NO: 3517772 - DNA, 11 bp, Homo sapiens
aacaaaaagaa

SEQ ID NO: 3517773 - DNA, 13 bp, Homo sapiens
aacaaaaattgtc

SEQ ID NO: 3517774 - DNA, 14 bp, Homo sapiens
aacaaaaccagctg

SEQ ID NO: 3517775 - DNA, 16 bp, Homo sapiens
aacaaaaccagctgct

SEQ ID NO: 3517776 - DNA, 15 bp, Homo sapiens
aacaaaatttctatt

SEQ ID NO: 3517777 - DNA, 14 bp, Homo sapiens
aacaaactcttcag

SEQ ID NO: 3517778 - DNA, 17 bp, Homo sapiens
aacaaagaagacaacat

SEQ ID NO: 3517779 - DNA, 15 bp, Homo sapiens
aacaaagcagccacg

SEQ ID NO: 3517780 - DNA, 23 bp, Homo sapiens
aacaaagttactaggtaacttca

SEQ ID NO: 3517781 - DNA, 18 bp, Homo sapiens
aacaaatacattcaaatt

SEQ ID NO: 3517782 - DNA, 24 bp, Homo sapiens
aacaacatgtgagcatggtcacaa

SEQ ID NO: 3517783 - DNA, 12 bp, Homo sapiens
aacaacattttg

SEQ ID NO: 3517784 - DNA, 14 bp, Homo sapiens
aacaacgtcttttt

SEQ ID NO: 3517785 - DNA, 18 bp, Homo sapiens
aacaacgtctttttgttt

SEQ ID NO: 3517786 - DNA, 15 bp, Homo sapiens
aacaactctttgaga

SEQ ID NO: 3517787 - DNA, 19 bp, Homo sapiens
aacaagagcactacattca

SEQ ID NO: 3517788 - DNA, 14 bp, Homo sapiens
aacaaggaaacttt

SEQ ID NO: 3517789 - DNA, 20 bp, Homo sapiens
aacaaggttatatgaatata

SEQ ID NO: 3517790 - DNA, 12 bp, Homo sapiens
aacaataaaaga

SEQ ID NO: 3517791 - DNA, 23 bp, Homo sapiens
aacaataaaattttttttcatgt

SEQ ID NO: 3517792 - DNA, 17 bp, Homo sapiens
aacaatctggaagaaaa

SEQ ID NO: 3517793 - DNA, 20 bp, Homo sapiens
aacaatctggaagaaaaaaa

SEQ ID NO: 3517794 - DNA, 13 bp, Homo sapiens
aacacaaactgta

SEQ ID NO: 3517795 - DNA, 19 bp, Homo sapiens
aacacaaagaccaaaatga

SEQ ID NO: 3517796 - DNA, 14 bp, Homo sapiens
aagccagaagctga

SEQ ID NO: 3517797 - DNA, 14 bp, Homo sapiens
aagccagaggctgg

SEQ ID NO: 3517798 - DNA, 14 bp, Homo sapiens
aagccagcgtcctc

SEQ ID NO: 3517799 - DNA, 20 bp, Homo sapiens
aagccagcgtcctcctctgt

SEQ ID NO: 3517800 - DNA, 10 bp, Homo sapiens
aagccagctg

SEQ ID NO: 3517801 - DNA, 14 bp, Homo sapiens
aagccagctgccta

SEQ ID NO: 3517802 - DNA, 15 bp, Homo sapiens
aagccagctgcctag

SEQ ID NO: 3517803 - DNA, 21 bp, Homo sapiens
aagccaggaatttcccaggac

SEQ ID NO: 3517804 - DNA, 23 bp, Homo sapiens
aagccaggaatttcccaggaccc

SEQ ID NO: 3517805 - DNA, 23 bp, Homo sapiens
aagccaggtgtggtggtatgtgc

SEQ ID NO: 3517806 - DNA, 13 bp, Homo sapiens
aagccatgctgga

SEQ ID NO: 3517807 - DNA, 20 bp, Homo sapiens
aagcccagcactgcttgagg

SEQ ID NO: 3517808 - DNA, 22 bp, Homo sapiens
aagcccagcccctactgctgtg

SEQ ID NO: 3517809 - DNA, 16 bp, Homo sapiens
aagcccccagctaaga

SEQ ID NO: 3517810 - DNA, 19 bp, Homo sapiens
aagccctgggatcactgtg

SEQ ID NO: 3517811 - DNA, 22 bp, Homo sapiens
aagccctgttgacacaggtctt

SEQ ID NO: 3517812 - DNA, 21 bp, Homo sapiens
aagccgtgattttcattgctg

SEQ ID NO: 3517813 - DNA, 16 bp, Homo sapiens
aagcctcccacgactg

SEQ ID NO: 3517814 - DNA, 21 bp, Homo sapiens
aagcctgaaggggcgtctgtt

SEQ ID NO: 3517815 - DNA, 15 bp, Homo sapiens
aagcctgcattctta

SEQ ID NO: 3517816 - DNA, 15 bp, Homo sapiens
aagcctgtggctgtg

SEQ ID NO: 3517817 - DNA, 14 bp, Homo sapiens
aagcgattctcctg

SEQ ID NO: 3517818 - DNA, 15 bp, Homo sapiens
aagcgattcttctgc

SEQ ID NO: 3517819 - DNA, 23 bp, Homo sapiens
aagcgtgaaggccgagaagcaag

SEQ ID NO: 3517820 - DNA, 22 bp, Homo sapiens
aagctaccattttacatttcta

SEQ ID NO: 3517821 - DNA, 19 bp, Homo sapiens
aagctactgtgtgtgtgaa

SEQ ID NO: 3517822 - DNA, 17 bp, Homo sapiens
aagctaggcctggccag

SEQ ID NO: 3517823 - DNA, 20 bp, Homo sapiens
aagctagtgtacctcctctc

SEQ ID NO: 3517824 - DNA, 21 bp, Homo sapiens
aagctataaattcctctttgc

SEQ ID NO: 3517825 - DNA, 15 bp, Homo sapiens
aagctattgtctgta

SEQ ID NO: 3517826 - DNA, 20 bp, Homo sapiens
aagctcaagatgacagctct

SEQ ID NO: 3517827 - DNA, 19 bp, Homo sapiens
aagctcaagtgttcacaac

SEQ ID NO: 3517828 - DNA, 22 bp, Homo sapiens
aagctcagaggcgcactgtgac

SEQ ID NO: 3517829 - DNA, 23 bp, Homo sapiens
aagctcagaggcgcactgtgacc

SEQ ID NO: 3517830 - DNA, 17 bp, Homo sapiens
aagctcaggaccaggca

SEQ ID NO: 3517831 - DNA, 16 bp, Homo sapiens
aagctcctacttttgc

SEQ ID NO: 3517832 - DNA, 13 bp, Homo sapiens
aagctcctcctcc

SEQ ID NO: 3517833 - DNA, 19 bp, Homo sapiens
aagctcctctccccagccc

SEQ ID NO: 3517834 - DNA, 22 bp, Homo sapiens
aagctcctctccccagcccaga

SEQ ID NO: 3517835 - DNA, 13 bp, Homo sapiens
aagctctgctcct

SEQ ID NO: 3517836 - DNA, 23 bp, Homo sapiens
aagctctggccccaggcttgtca

SEQ ID NO: 3517837 - DNA, 17 bp, Homo sapiens
aagctgacgaacttcca

SEQ ID NO: 3517838 - DNA, 20 bp, Homo sapiens
aagctgacgaacttccatgg

SEQ ID NO: 3517839 - DNA, 19 bp, Homo sapiens
aagctgcaccctcaggcag

SEQ ID NO: 3517840 - DNA, 21 bp, Homo sapiens
aagctgctttaaaaaaataca

SEQ ID NO: 3517841 - DNA, 12 bp, Homo sapiens
aagctggctggg

SEQ ID NO: 3517842 - DNA, 13 bp, Homo sapiens
aagctgggcaggt

SEQ ID NO: 3517843 - DNA, 21 bp, Homo sapiens
aagctggtcccactcagtcca

SEQ ID NO: 3517844 - DNA, 18 bp, Homo sapiens
aagctggtggcctctgca

SEQ ID NO: 3517845 - DNA, 14 bp, Homo sapiens
aagctgtattttga

SEQ ID NO: 3517846 - DNA, 12 bp, Homo sapiens
aagcttcaaccc

SEQ ID NO: 3517847 - DNA, 22 bp, Homo sapiens
aagcttcaaccctcagccttga

SEQ ID NO: 3517848 - DNA, 21 bp, Homo sapiens
aagcttcattctccttgttgt

SEQ ID NO: 3517849 - DNA, 13 bp, Homo sapiens
aagcttccttggc

SEQ ID NO: 3517850 - DNA, 18 bp, Homo sapiens
aagcttctagaggctcat

SEQ ID NO: 3517851 - DNA, 20 bp, Homo sapiens
aagcttctgtctccagcttc

SEQ ID NO: 3517852 - DNA, 22 bp, Homo sapiens
aagcttgttgaaaacccagact

SEQ ID NO: 3517853 - DNA, 17 bp, Homo sapiens
aaggaaaaataaatatt

SEQ ID NO: 3517854 - DNA, 17 bp, Homo sapiens
aaggaaaaatgtgtaat

SEQ ID NO: 3517855 - DNA, 21 bp, Homo sapiens
aaggaaaaatgtgtaattttg

SEQ ID NO: 3517856 - DNA, 16 bp, Homo sapiens
aaggaaaccacagctg

SEQ ID NO: 3517857 - DNA, 16 bp, Homo sapiens
aaggaaacgctacctc

SEQ ID NO: 3517858 - DNA, 14 bp, Homo sapiens
aaggaaaggcctga

SEQ ID NO: 3517859 - DNA, 17 bp, Homo sapiens
aaggaacttgaaaaata

SEQ ID NO: 3517860 - DNA, 13 bp, Homo sapiens
aaggaatatatgg

SEQ ID NO: 3517861 - DNA, 18 bp, Homo sapiens
aaggaatatatggcagag

SEQ ID NO: 3517862 - DNA, 19 bp, Homo sapiens
aaggaatcacgttagagga

SEQ ID NO: 3517863 - DNA, 18 bp, Homo sapiens
aaggacacagatgaaaca

SEQ ID NO: 3517864 - DNA, 15 bp, Homo sapiens
aaggacattcttgta

SEQ ID NO: 3517865 - DNA, 18 bp, Homo sapiens
aaggacattgcggacagc

SEQ ID NO: 3517866 - DNA, 13 bp, Homo sapiens
aaggactctggaa

SEQ ID NO: 3517867 - DNA, 22 bp, Homo sapiens
aaggacttcctgtccagctcca

SEQ ID NO: 3517868 - DNA, 23 bp, Homo sapiens
aaggacttcctgtccagctccaa

SEQ ID NO: 3517869 - DNA, 16 bp, Homo sapiens
aaggagacaggcagag

SEQ ID NO: 3517870 - DNA, 14 bp, Homo sapiens
aaggagaggaggca

SEQ ID NO: 3517871 - DNA, 17 bp, Homo sapiens
aaggagatagggaaaag

SEQ ID NO: 3517872 - DNA, 22 bp, Homo sapiens
aaggagcatttttttattcagc

SEQ ID NO: 3517873 - DNA, 23 bp, Homo sapiens
aaggagcatttttttattcagca

SEQ ID NO: 3517874 - DNA, 15 bp, Homo sapiens
aaggagccagtttgc

SEQ ID NO: 3517875 - DNA, 14 bp, Homo sapiens
aaggagcccagaaa

SEQ ID NO: 3517876 - DNA, 18 bp, Homo sapiens
aaggagctgctatagcct

SEQ ID NO: 3517877 - DNA, 21 bp, Homo sapiens
aaggagctgctatagcctggg

SEQ ID NO: 3517878 - DNA, 17 bp, Homo sapiens
aaggaggggaaaaaaat

SEQ ID NO: 3517879 - DNA, 23 bp, Homo sapiens
aaggatactgtaacactttacaa

SEQ ID NO: 3517880 - DNA, 19 bp, Homo sapiens
aaggatagatgctggccca

SEQ ID NO: 3517881 - DNA, 14 bp, Homo sapiens
aaggatgagcagag

SEQ ID NO: 3517882 - DNA, 15 bp, Homo sapiens
aaggatgagcagagc

SEQ ID NO: 3517883 - DNA, 15 bp, Homo sapiens
aaggatgtacatttc

SEQ ID NO: 3517884 - DNA, 22 bp, Homo sapiens
aaggatgtagcttttcaccttt

SEQ ID NO: 3517885 - DNA, 22 bp, Homo sapiens
aaggattaattgctgcaaggac

SEQ ID NO: 3517886 - DNA, 12 bp, Homo sapiens
aaggcaaaattg

SEQ ID NO: 3517887 - DNA, 15 bp, Homo sapiens
aaggcaaaattgcaa

SEQ ID NO: 3517888 - DNA, 19 bp, Homo sapiens
aaggcaaaattgcaaatct

SEQ ID NO: 3517889 - DNA, 15 bp, Homo sapiens
aaggcaaacccatca

SEQ ID NO: 3517890 - DNA, 21 bp, Homo sapiens
aaggcaaagggtccagaagga

SEQ ID NO: 3517891 - DNA, 14 bp, Homo sapiens
aaggcaagccagca

SEQ ID NO: 3517892 - DNA, 13 bp, Homo sapiens
aaggcactgcctg

SEQ ID NO: 3517893 - DNA, 20 bp, Homo sapiens
aaggcagcgaccccaggacc

SEQ ID NO: 3517894 - DNA, 21 bp, Homo sapiens
aaggcatacgagagcagaggt

SEQ ID NO: 3517895 - DNA, 22 bp, Homo sapiens
aaggcatacgagagcagaggtc

SEQ ID NO: 3517896 - DNA, 21 bp, Homo sapiens
aaggccagcacccaaagggtt

SEQ ID NO: 3517897 - DNA, 14 bp, Homo sapiens
aaggccagctggca

SEQ ID NO: 3517898 - DNA, 17 bp, Homo sapiens
aaggccagctggcagca

SEQ ID NO: 3517899 - DNA, 22 bp, Homo sapiens
aaggccatctgggctcctccag

SEQ ID NO: 3517900 - DNA, 13 bp, Homo sapiens
aaggccctgctga

SEQ ID NO: 3517901 - DNA, 18 bp, Homo sapiens
aaggccgagaagcaagaa

SEQ ID NO: 3517902 - DNA, 11 bp, Homo sapiens
aaggcctttaa

SEQ ID NO: 3517903 - DNA, 16 bp, Homo sapiens
aaggcctttaaaattt

SEQ ID NO: 3517904 - DNA, 17 bp, Homo sapiens
aaggcctttaaaatttt

SEQ ID NO: 3517905 - DNA, 21 bp, Homo sapiens
aaggcggtggacttgaacttt

SEQ ID NO: 3517906 - DNA, 18 bp, Homo sapiens
aaggcgtggagctgcctg

SEQ ID NO: 3517907 - DNA, 16 bp, Homo sapiens
aaggctaaaaagcaac

SEQ ID NO: 3517908 - DNA, 13 bp, Homo sapiens
aaggctaaaaagt

SEQ ID NO: 3517909 - DNA, 15 bp, Homo sapiens
aaggctcgattttgt

SEQ ID NO: 3517910 - DNA, 22 bp, Homo sapiens
aaggctcgattttgtatctgca

SEQ ID NO: 3517911 - DNA, 19 bp, Homo sapiens
aaggctcttctccccagag

SEQ ID NO: 3517912 - DNA, 13 bp, Homo sapiens
aaggctgaaaaga

SEQ ID NO: 3517913 - DNA, 16 bp, Homo sapiens
aaggctgatgtcaatt

SEQ ID NO: 3517914 - DNA, 22 bp, Homo sapiens
aaggctggcgagagtctggccc

SEQ ID NO: 3517915 - DNA, 16 bp, Homo sapiens
aaggctgggggaagaa

SEQ ID NO: 3517916 - DNA, 19 bp, Homo sapiens
aaggctgggggaagaagct

SEQ ID NO: 3517917 - DNA, 22 bp, Homo sapiens
aaggctgggggaagaagctctc

SEQ ID NO: 3517918 - DNA, 18 bp, Homo sapiens
aaggcttctctctgtggg

SEQ ID NO: 3517919 - DNA, 17 bp, Homo sapiens
aaggcttgttgtgcttt

SEQ ID NO: 3517920 - DNA, 19 bp, Homo sapiens
aaggcttgttgtgctttta

SEQ ID NO: 3517921 - DNA, 14 bp, Homo sapiens
aagggaaatatcat

SEQ ID NO: 3517922 - DNA, 15 bp, Homo sapiens
aagggaaatatcatt

SEQ ID NO: 3517923 - DNA, 20 bp, Homo sapiens
aagggaatcacatcttttaa

SEQ ID NO: 3517924 - DNA, 17 bp, Homo sapiens
aagggaatcctcctcca

SEQ ID NO: 3517925 - DNA, 17 bp, Homo sapiens
aagggagctagccagag

SEQ ID NO: 3517926 - DNA, 17 bp, Homo sapiens
aagggattttagtcaca

SEQ ID NO: 3517927 - DNA, 22 bp, Homo sapiens
aagggattttagtcacacgtgg

SEQ ID NO: 3517928 - DNA, 23 bp, Homo sapiens
acacaaggatagatgctggccca

SEQ ID NO: 3517929 - DNA, 13 bp, Homo sapiens
acacacacacaca

SEQ ID NO: 3517930 - DNA, 14 bp, Homo sapiens
acacacacacacac

SEQ ID NO: 3517931 - DNA, 14 bp, Homo sapiens
acacacacatacac

SEQ ID NO: 3517932 - DNA, 19 bp, Homo sapiens
acacacagatacacacaca

SEQ ID NO: 3517933 - DNA, 17 bp, Homo sapiens
acacacagctctgtcct

SEQ ID NO: 3517934 - DNA, 20 bp, Homo sapiens
acacaccagagcccaccttg

SEQ ID NO: 3517935 - DNA, 11 bp, Homo sapiens
acacacctgta

SEQ ID NO: 3517936 - DNA, 16 bp, Homo sapiens
acacactgaggcaggg

SEQ ID NO: 3517937 - DNA, 18 bp, Homo sapiens
acacactgaggcagggaa

SEQ ID NO: 3517938 - DNA, 15 bp, Homo sapiens
acacactgatgctta

SEQ ID NO: 3517939 - DNA, 19 bp, Homo sapiens
acacactttttaagaaata

SEQ ID NO: 3517940 - DNA, 16 bp, Homo sapiens
acacagaaatgctgct

SEQ ID NO: 3517941 - DNA, 23 bp, Homo sapiens
acacagacgttaggcatttcctg

SEQ ID NO: 3517942 - DNA, 10 bp, Homo sapiens
acacagagaa

SEQ ID NO: 3517943 - DNA, 15 bp, Homo sapiens
acacagagaaggcta

SEQ ID NO: 3517944 - DNA, 16 bp, Homo sapiens
acacagatacacacac

SEQ ID NO: 3517945 - DNA, 14 bp, Homo sapiens
acacagatgaaaca

SEQ ID NO: 3517946 - DNA, 21 bp, Homo sapiens
acacagatgaaacacaaacaa

SEQ ID NO: 3517947 - DNA, 18 bp, Homo sapiens
acacagccaggagtgggt

SEQ ID NO: 3517948 - DNA, 21 bp, Homo sapiens
acacagctaacacacagctcc

SEQ ID NO: 3517949 - DNA, 12 bp, Homo sapiens
acacagctctgt

SEQ ID NO: 3517950 - DNA, 11 bp, Homo sapiens
acacagctctt

SEQ ID NO: 3517951 - DNA, 13 bp, Homo sapiens
acacagctcttct

SEQ ID NO: 3517952 - DNA, 19 bp, Homo sapiens
acacagctcttctccaggc

SEQ ID NO: 3517953 - DNA, 20 bp, Homo sapiens
acacagctcttctccaggct

SEQ ID NO: 3517954 - DNA, 18 bp, Homo sapiens
acacaggcccggctccag

SEQ ID NO: 3517955 - DNA, 21 bp, Homo sapiens
acacaggcccggctccaggct

SEQ ID NO: 3517956 - DNA, 16 bp, Homo sapiens
acacaggccctccctg

SEQ ID NO: 3517957 - DNA, 14 bp, Homo sapiens
acacagggacttga

SEQ ID NO: 3517958 - DNA, 15 bp, Homo sapiens
acacagggacttgaa

SEQ ID NO: 3517959 - DNA, 18 bp, Homo sapiens
acacagggacttgaagtt

SEQ ID NO: 3517960 - DNA, 14 bp, Homo sapiens
acacagttatcaaa

SEQ ID NO: 3517961 - DNA, 22 bp, Homo sapiens
acacagttgaccctattttttg

SEQ ID NO: 3517962 - DNA, 15 bp, Homo sapiens
acacataccctcttc

SEQ ID NO: 3517963 - DNA, 17 bp, Homo sapiens
acacatatgagggggaa

SEQ ID NO: 3517964 - DNA, 13 bp, Homo sapiens
acacatctgtgga

SEQ ID NO: 3517965 - DNA, 17 bp, Homo sapiens
acacatgctatgttctg

SEQ ID NO: 3517966 - DNA, 17 bp, Homo sapiens
acacatggtgagcctag

SEQ ID NO: 3517967 - DNA, 16 bp, Homo sapiens
acaccaagcacagcag

SEQ ID NO: 3517968 - DNA, 12 bp, Homo sapiens
acaccagagccc

SEQ ID NO: 3517969 - DNA, 17 bp, Homo sapiens
acaccctcaacctcttc

SEQ ID NO: 3517970 - DNA, 21 bp, Homo sapiens
acacctactctatcagagaaa

SEQ ID NO: 3517971 - DNA, 13 bp, Homo sapiens
acacctagccagc

SEQ ID NO: 3517972 - DNA, 18 bp, Homo sapiens
acacctggccgcctccag

SEQ ID NO: 3517973 - DNA, 19 bp, Homo sapiens
acacctggccgcctccagg

SEQ ID NO: 3517974 - DNA, 20 bp, Homo sapiens
acacctgtagcacttactgg

SEQ ID NO: 3517975 - DNA, 14 bp, Homo sapiens
acaccttgacaggg

SEQ ID NO: 3517976 - DNA, 15 bp, Homo sapiens
acaccttgacagggc

SEQ ID NO: 3517977 - DNA, 22 bp, Homo sapiens
acaccttggacatcctcctccc

SEQ ID NO: 3517978 - DNA, 22 bp, Homo sapiens
acaccttggcttgttattgcct

SEQ ID NO: 3517979 - DNA, 14 bp, Homo sapiens
acacctttctcctt

SEQ ID NO: 3517980 - DNA, 21 bp, Homo sapiens
acaccttttattgacacagaa

SEQ ID NO: 3517981 - DNA, 14 bp, Homo sapiens
acacgcacctgcct

SEQ ID NO: 3517982 - DNA, 15 bp, Homo sapiens
acacgcaggagcaca

SEQ ID NO: 3517983 - DNA, 15 bp, Homo sapiens
acacgcgtgcacaca

SEQ ID NO: 3517984 - DNA, 15 bp, Homo sapiens
acacggatctgagaa

SEQ ID NO: 3517985 - DNA, 17 bp, Homo sapiens
acacggatctgagaatc

SEQ ID NO: 3517986 - DNA, 12 bp, Homo sapiens
acacggccacat

SEQ ID NO: 3517987 - DNA, 15 bp, Homo sapiens
acacggctcccccag

SEQ ID NO: 3517988 - DNA, 18 bp, Homo sapiens
acacggctcccccaggcc

SEQ ID NO: 3517989 - DNA, 19 bp, Homo sapiens
acacggctcccccaggcct

SEQ ID NO: 3517990 - DNA, 16 bp, Homo sapiens
acacgggggcagctga

SEQ ID NO: 3517991 - DNA, 23 bp, Homo sapiens
acacgggggcagctgatacaaat

SEQ ID NO: 3517992 - DNA, 22 bp, Homo sapiens
acacggtttgaagcctggaaca

SEQ ID NO: 3517993 - DNA, 17 bp, Homo sapiens
acacgtgacacaaacac

SEQ ID NO: 3517994 - DNA, 13 bp, Homo sapiens
acactaaagactg

SEQ ID NO: 3517995 - DNA, 15 bp, Homo sapiens
acactaaccacgctg

SEQ ID NO: 3517996 - DNA, 20 bp, Homo sapiens
acactaaccacgctggacct

SEQ ID NO: 3517997 - DNA, 20 bp, Homo sapiens
acactaccttatcaggcaaa

SEQ ID NO: 3517998 - DNA, 17 bp, Homo sapiens
acactatggtatttgag

SEQ ID NO: 3517999 - DNA, 22 bp, Homo sapiens
acactcacatttattctgctca

SEQ ID NO: 3518000 - DNA, 15 bp, Homo sapiens
acactcacttctctt

SEQ ID NO: 3518001 - DNA, 13 bp, Homo sapiens
acactcagcacaa

SEQ ID NO: 3518002 - DNA, 21 bp, Homo sapiens
acactcccaaggttggagccc

SEQ ID NO: 3518003 - DNA, 15 bp, Homo sapiens
acactccccgaagtc

SEQ ID NO: 3518004 - DNA, 21 bp, Homo sapiens
acactcttttgctttattcca

SEQ ID NO: 3518005 - DNA, 19 bp, Homo sapiens
acactgagaatgtaagaac

SEQ ID NO: 3518006 - DNA, 20 bp, Homo sapiens
acactgatgataggttaata

SEQ ID NO: 3518007 - DNA, 16 bp, Homo sapiens
acactgcaggcatcac

SEQ ID NO: 3518008 - DNA, 20 bp, Homo sapiens
acactgcaggcatcacagct

SEQ ID NO: 3518009 - DNA, 15 bp, Homo sapiens
acactgggaggccag

SEQ ID NO: 3518010 - DNA, 23 bp, Homo sapiens
acactgggtggtggcctggtccc

SEQ ID NO: 3518011 - DNA, 19 bp, Homo sapiens
acactggtattcctgcctc

SEQ ID NO: 3518012 - DNA, 18 bp, Homo sapiens
acactgtatgttatagaa

SEQ ID NO: 3518013 - DNA, 21 bp, Homo sapiens
acactgtcatgcttcatcatt

SEQ ID NO: 3518014 - DNA, 22 bp, Homo sapiens
acactgtcccaaggtgaaatga

SEQ ID NO: 3518015 - DNA, 14 bp, Homo sapiens
acactgtttcctga

SEQ ID NO: 3518016 - DNA, 21 bp, Homo sapiens
acacttcagtatagcattggt

SEQ ID NO: 3518017 - DNA, 13 bp, Homo sapiens
acacttgcaacct

SEQ ID NO: 3518018 - DNA, 12 bp, Homo sapiens
acactttacaat

SEQ ID NO: 3518019 - DNA, 13 bp, Homo sapiens
acactttacaatg

SEQ ID NO: 3518020 - DNA, 15 bp, Homo sapiens
acacttttcacctcc

SEQ ID NO: 3518021 - DNA, 14 bp, Homo sapiens
acagaaatgctgct

SEQ ID NO: 3518022 - DNA, 15 bp, Homo sapiens
acagaaatgctgctg

SEQ ID NO: 3518023 - DNA, 17 bp, Homo sapiens
acagaaccttgttattt

SEQ ID NO: 3518024 - DNA, 20 bp, Homo sapiens
acagaactctttcaaaacct

SEQ ID NO: 3518025 - DNA, 20 bp, Homo sapiens
acagaactgcttactagccc

SEQ ID NO: 3518026 - DNA, 17 bp, Homo sapiens
acagaagattaagacag

SEQ ID NO: 3518027 - DNA, 13 bp, Homo sapiens
acagaagcttcca

SEQ ID NO: 3518028 - DNA, 15 bp, Homo sapiens
acagaagtttgcact

SEQ ID NO: 3518029 - DNA, 21 bp, Homo sapiens
acagaatatgaatgagaatgt

SEQ ID NO: 3518030 - DNA, 11 bp, Homo sapiens
acagacacagg

SEQ ID NO: 3518031 - DNA, 15 bp, Homo sapiens
acagacacaggcccg

SEQ ID NO: 3518032 - DNA, 23 bp, Homo sapiens
acagacacaggcccggctccagg

SEQ ID NO: 3518033 - DNA, 20 bp, Homo sapiens
acagacacgagccacctcac

SEQ ID NO: 3518034 - DNA, 16 bp, Homo sapiens
acagacagacacacac

SEQ ID NO: 3518035 - DNA, 19 bp, Homo sapiens
acagacaggtggaaaaact

SEQ ID NO: 3518036 - DNA, 15 bp, Homo sapiens
acagaccttcacaga

SEQ ID NO: 3518037 - DNA, 22 bp, Homo sapiens
acagactcacaacctgaaccta

SEQ ID NO: 3518038 - DNA, 17 bp, Homo sapiens
acagactggaagcacag

SEQ ID NO: 3518039 - DNA, 21 bp, Homo sapiens
acagactggaagcacagcttc

SEQ ID NO: 3518040 - DNA, 13 bp, Homo sapiens
acagagaaggcta

SEQ ID NO: 3518041 - DNA, 17 bp, Homo sapiens
acagagaatatgtctgc

SEQ ID NO: 3518042 - DNA, 20 bp, Homo sapiens
acagagacccagatctcatg

SEQ ID NO: 3518043 - DNA, 22 bp, Homo sapiens
acagagagagagaatggatcct

SEQ ID NO: 3518044 - DNA, 21 bp, Homo sapiens
acagagcaagtgagaccctgt

SEQ ID NO: 3518045 - DNA, 15 bp, Homo sapiens
acagagcccagggag

SEQ ID NO: 3518046 - DNA, 17 bp, Homo sapiens
acagagcctcgctctgt

SEQ ID NO: 3518047 - DNA, 15 bp, Homo sapiens
acagagcttccctga

SEQ ID NO: 3518048 - DNA, 16 bp, Homo sapiens
acagagcttccctgac

SEQ ID NO: 3518049 - DNA, 16 bp, Homo sapiens
acagaggatgagctct

SEQ ID NO: 3518050 - DNA, 13 bp, Homo sapiens
acagaggcagccc

SEQ ID NO: 3518051 - DNA, 14 bp, Homo sapiens
acagaggcagcccc

SEQ ID NO: 3518052 - DNA, 19 bp, Homo sapiens
acagaggcagccccattct

SEQ ID NO: 3518053 - DNA, 17 bp, Homo sapiens
acagaggccatgggcct

SEQ ID NO: 3518054 - DNA, 16 bp, Homo sapiens
acagaggccccagcct

SEQ ID NO: 3518055 - DNA, 17 bp, Homo sapiens
acagaggctattgtccc

SEQ ID NO: 3518056 - DNA, 14 bp, Homo sapiens
acagagtctcactg

SEQ ID NO: 3518057 - DNA, 18 bp, Homo sapiens
acagagttttcactctta

SEQ ID NO: 3518058 - DNA, 23 bp, Homo sapiens
acagatatcttcagtttaatgca

SEQ ID NO: 3518059 - DNA, 23 bp, Homo sapiens
acagatcgaaccgttttgaagct

SEQ ID NO: 3518060 - DNA, 16 bp, Homo sapiens
acagatcgcatttcct

SEQ ID NO: 3518061 - DNA, 16 bp, Homo sapiens
accaccaagccaaggg

SEQ ID NO: 3518062 - DNA, 15 bp, Homo sapiens
accaccacacccagc

SEQ ID NO: 3518063 - DNA, 17 bp, Homo sapiens
accaccagttaacgtat

SEQ ID NO: 3518064 - DNA, 18 bp, Homo sapiens
accaccccaacaaaccat

SEQ ID NO: 3518065 - DNA, 17 bp, Homo sapiens
accaccctgtcttcctc

SEQ ID NO: 3518066 - DNA, 18 bp, Homo sapiens
accaccctgtcttcctct

SEQ ID NO: 3518067 - DNA, 13 bp, Homo sapiens
accacgactggcc

SEQ ID NO: 3518068 - DNA, 24 bp, Homo sapiens
accacgactggccagggccacgct

SEQ ID NO: 3518069 - DNA, 19 bp, Homo sapiens
accacgcccgtcctgcctg

SEQ ID NO: 3518070 - DNA, 16 bp, Homo sapiens
accacgctggaccttg

SEQ ID NO: 3518071 - DNA, 15 bp, Homo sapiens
accactgcaagtcct

SEQ ID NO: 3518072 - DNA, 21 bp, Homo sapiens
accactgcactccagcctggg

SEQ ID NO: 3518073 - DNA, 18 bp, Homo sapiens
accactttttgcagcttt

SEQ ID NO: 3518074 - DNA, 13 bp, Homo sapiens
accagaagggaaa

SEQ ID NO: 3518075 - DNA, 12 bp, Homo sapiens
accagacaatgt

SEQ ID NO: 3518076 - DNA, 14 bp, Homo sapiens
accagacaatgttg

SEQ ID NO: 3518077 - DNA, 14 bp, Homo sapiens
accagacaccttga

SEQ ID NO: 3518078 - DNA, 20 bp, Homo sapiens
accagagagagcaaggaagc

SEQ ID NO: 3518079 - DNA, 16 bp, Homo sapiens
accagagcccaccttg

SEQ ID NO: 3518080 - DNA, 13 bp, Homo sapiens
accagaggaagcc

SEQ ID NO: 3518081 - DNA, 19 bp, Homo sapiens
accagataactgaggaggg

SEQ ID NO: 3518082 - DNA, 15 bp, Homo sapiens
accagatggttgtgt

SEQ ID NO: 3518083 - DNA, 21 bp, Homo sapiens
accagcatccacactgccggc

SEQ ID NO: 3518084 - DNA, 16 bp, Homo sapiens
accagccccagtgccc

SEQ ID NO: 3518085 - DNA, 14 bp, Homo sapiens
accagccgtgagca

SEQ ID NO: 3518086 - DNA, 11 bp, Homo sapiens
accagcctggc

SEQ ID NO: 3518087 - DNA, 23 bp, Homo sapiens
accagcgtatatataagaaagac

SEQ ID NO: 3518088 - DNA, 22 bp, Homo sapiens
accagcgtgtgactactccccc

SEQ ID NO: 3518089 - DNA, 23 bp, Homo sapiens
accagctaagaaaagattttaat

SEQ ID NO: 3518090 - DNA, 11 bp, Homo sapiens
accagctgcaa

SEQ ID NO: 3518091 - DNA, 17 bp, Homo sapiens
accagctgcaaagtgtt

SEQ ID NO: 3518092 - DNA, 19 bp, Homo sapiens
accagctgcaaagtgtttt

SEQ ID NO: 3518093 - DNA, 10 bp, Homo sapiens
accagctgct

SEQ ID NO: 3518094 - DNA, 19 bp, Homo sapiens
accaggcttgcctgcaggc

SEQ ID NO: 3518095 - DNA, 20 bp, Homo sapiens
accagggagcccctttgatg

SEQ ID NO: 3518096 - DNA, 21 bp, Homo sapiens
accagggttgaccccagagga

SEQ ID NO: 3518097 - DNA, 22 bp, Homo sapiens
accaggtgggagcgttttgttg

SEQ ID NO: 3518098 - DNA, 16 bp, Homo sapiens
accagtatttttgctg

SEQ ID NO: 3518099 - DNA, 23 bp, Homo sapiens
accagtatttttgctgcttctga

SEQ ID NO: 3518100 - DNA, 9 bp, Homo sapiens
accagtccc

SEQ ID NO: 3518101 - DNA, 12 bp, Homo sapiens
accagtccctgt

SEQ ID NO: 3518102 - DNA, 17 bp, Homo sapiens
accagtgaatttttgca

SEQ ID NO: 3518103 - DNA, 21 bp, Homo sapiens
accagtgaatttttgcaataa

SEQ ID NO: 3518104 - DNA, 20 bp, Homo sapiens
accagtttaacctgatgcag

SEQ ID NO: 3518105 - DNA, 16 bp, Homo sapiens
accatatgaacatata

SEQ ID NO: 3518106 - DNA, 12 bp, Homo sapiens
accatatgaatt

SEQ ID NO: 3518107 - DNA, 13 bp, Homo sapiens
accatatgaattg

SEQ ID NO: 3518108 - DNA, 12 bp, Homo sapiens
accatcatccta

SEQ ID NO: 3518109 - DNA, 14 bp, Homo sapiens
accatcctggctgc

SEQ ID NO: 3518110 - DNA, 19 bp, Homo sapiens
accatctgtcttgccagcc

SEQ ID NO: 3518111 - DNA, 23 bp, Homo sapiens
accatctgtcttgccagccagaa

SEQ ID NO: 3518112 - DNA, 23 bp, Homo sapiens
accatgattaaccacttcagctg

SEQ ID NO: 3518113 - DNA, 19 bp, Homo sapiens
accatgcctcactaatttt

SEQ ID NO: 3518114 - DNA, 19 bp, Homo sapiens
accatgctcatctgctggt

SEQ ID NO: 3518115 - DNA, 20 bp, Homo sapiens
accatgctcatctgctggtc

SEQ ID NO: 3518116 - DNA, 16 bp, Homo sapiens
accatgtattttgtaa

SEQ ID NO: 3518117 - DNA, 18 bp, Homo sapiens
accatgtcagcaaaaagc

SEQ ID NO: 3518118 - DNA, 21 bp, Homo sapiens
accatgtcagcaaaaagcaaa

SEQ ID NO: 3518119 - DNA, 12 bp, Homo sapiens
accattctgcat

SEQ ID NO: 3518120 - DNA, 15 bp, Homo sapiens
accattctgcattta

SEQ ID NO: 3518121 - DNA, 22 bp, Homo sapiens
accatttatacaaattagaaaa

SEQ ID NO: 3518122 - DNA, 21 bp, Homo sapiens
accattttggggtacccactg

SEQ ID NO: 3518123 - DNA, 22 bp, Homo sapiens
accattttggggtacccactgc

SEQ ID NO: 3518124 - DNA, 23 bp, Homo sapiens
accattttggggtacccactgct

SEQ ID NO: 3518125 - DNA, 12 bp, Homo sapiens
acccaaagggtt

SEQ ID NO: 3518126 - DNA, 18 bp, Homo sapiens
acccaagacctcagggca

SEQ ID NO: 3518127 - DNA, 19 bp, Homo sapiens
acccaagtagctgctacct

SEQ ID NO: 3518128 - DNA, 21 bp, Homo sapiens
acccaatagctgcccatttcg

SEQ ID NO: 3518129 - DNA, 12 bp, Homo sapiens
acccaccagcct

SEQ ID NO: 3518130 - DNA, 14 bp, Homo sapiens
acccacgtggctgc

SEQ ID NO: 3518131 - DNA, 20 bp, Homo sapiens
acccactgcagcccctgaga

SEQ ID NO: 3518132 - DNA, 15 bp, Homo sapiens
acccactgctctggt

SEQ ID NO: 3518133 - DNA, 22 bp, Homo sapiens
acccagacggctccactaggac

SEQ ID NO: 3518134 - DNA, 20 bp, Homo sapiens
acccagactgtctccacggc

SEQ ID NO: 3518135 - DNA, 19 bp, Homo sapiens
acccagattttgctgtata

SEQ ID NO: 3518136 - DNA, 16 bp, Homo sapiens
acccagccctcatccc

SEQ ID NO: 3518137 - DNA, 13 bp, Homo sapiens
acccagcgagccc

SEQ ID NO: 3518138 - DNA, 23 bp, Homo sapiens
acccagcgggcaggttctgcctg

SEQ ID NO: 3518139 - DNA, 13 bp, Homo sapiens
acccaggagcccc

SEQ ID NO: 3518140 - DNA, 17 bp, Homo sapiens
acccaggagtgtggcca

SEQ ID NO: 3518141 - DNA, 12 bp, Homo sapiens
acccaggctggg

SEQ ID NO: 3518142 - DNA, 13 bp, Homo sapiens
acccagggcctgc

SEQ ID NO: 3518143 - DNA, 14 bp, Homo sapiens
acccagggcctgca

SEQ ID NO: 3518144 - DNA, 13 bp, Homo sapiens
acccaggtgggtc

SEQ ID NO: 3518145 - DNA, 16 bp, Homo sapiens
acccaggtgggtcccg

SEQ ID NO: 3518146 - DNA, 18 bp, Homo sapiens
acccaggtgggtcccggc

SEQ ID NO: 3518147 - DNA, 16 bp, Homo sapiens
acccagtccacaaaat

SEQ ID NO: 3518148 - DNA, 13 bp, Homo sapiens
acccagtctcctc

SEQ ID NO: 3518149 - DNA, 15 bp, Homo sapiens
acccagtctcctctc

SEQ ID NO: 3518150 - DNA, 15 bp, Homo sapiens
acccagtcttgtgga

SEQ ID NO: 3518151 - DNA, 13 bp, Homo sapiens
acccatctccccc

SEQ ID NO: 3518152 - DNA, 21 bp, Homo sapiens
acccatctgcacccccctggg

SEQ ID NO: 3518153 - DNA, 22 bp, Homo sapiens
acccatctgcacccccctgggc

SEQ ID NO: 3518154 - DNA, 11 bp, Homo sapiens
acccatgaaaa

SEQ ID NO: 3518155 - DNA, 21 bp, Homo sapiens
acccatgagttggggtctggc

SEQ ID NO: 3518156 - DNA, 19 bp, Homo sapiens
acccattctacacagagca

SEQ ID NO: 3518157 - DNA, 13 bp, Homo sapiens
acccattgctgtt

SEQ ID NO: 3518158 - DNA, 18 bp, Homo sapiens
acccatttttgagccaag

SEQ ID NO: 3518159 - DNA, 21 bp, Homo sapiens
acccattttttaaaaaagcaa

SEQ ID NO: 3518160 - DNA, 20 bp, Homo sapiens
accccaaaggaacactgaca

SEQ ID NO: 3518161 - DNA, 16 bp, Homo sapiens
accccaagaggaagtt

SEQ ID NO: 3518162 - DNA, 13 bp, Homo sapiens
accccacccttcc

SEQ ID NO: 3518163 - DNA, 17 bp, Homo sapiens
accccagattcttcagc

SEQ ID NO: 3518164 - DNA, 22 bp, Homo sapiens
accccagcattctcaggcacca

SEQ ID NO: 3518165 - DNA, 18 bp, Homo sapiens
accccagctactctgatc

SEQ ID NO: 3518166 - DNA, 17 bp, Homo sapiens
accccaggaaaagcaca

SEQ ID NO: 3518167 - DNA, 22 bp, Homo sapiens
accccaggacctcttctggaga

SEQ ID NO: 3518168 - DNA, 12 bp, Homo sapiens
accccaggccct

SEQ ID NO: 3518169 - DNA, 18 bp, Homo sapiens
accccagggcccccacag

SEQ ID NO: 3518170 - DNA, 15 bp, Homo sapiens
accccagggcctgag

SEQ ID NO: 3518171 - DNA, 17 bp, Homo sapiens
accccagggcctgagcc

SEQ ID NO: 3518172 - DNA, 15 bp, Homo sapiens
accccagttttttga

SEQ ID NO: 3518173 - DNA, 17 bp, Homo sapiens
accccatccctgtcttt

SEQ ID NO: 3518174 - DNA, 19 bp, Homo sapiens
accccatggctgcacagtt

SEQ ID NO: 3518175 - DNA, 23 bp, Homo sapiens
accccatgtcaccggatcctggg

SEQ ID NO: 3518176 - DNA, 12 bp, Homo sapiens
acccccagcctg

SEQ ID NO: 3518177 - DNA, 18 bp, Homo sapiens
acccccatttctatttat

SEQ ID NO: 3518178 - DNA, 14 bp, Homo sapiens
accccccagcactg

SEQ ID NO: 3518179 - DNA, 18 bp, Homo sapiens
acccccccaccccaggcc

SEQ ID NO: 3518180 - DNA, 13 bp, Homo sapiens
acccccgccccct

SEQ ID NO: 3518181 - DNA, 21 bp, Homo sapiens
acccccgccccctgccctccc

SEQ ID NO: 3518182 - DNA, 11 bp, Homo sapiens
accccctcctt

SEQ ID NO: 3518183 - DNA, 23 bp, Homo sapiens
accccctccttccctgtgtcttt

SEQ ID NO: 3518184 - DNA, 22 bp, Homo sapiens
accccctcttctgagcacagat

SEQ ID NO: 3518185 - DNA, 18 bp, Homo sapiens
accccgcagacaccttgg

SEQ ID NO: 3518186 - DNA, 20 bp, Homo sapiens
accccggggtgcccacaggc

SEQ ID NO: 3518187 - DNA, 23 bp, Homo sapiens
accccggggtgcccacaggccgc

SEQ ID NO: 3518188 - DNA, 14 bp, Homo sapiens
acccctccctttct

SEQ ID NO: 3518189 - DNA, 18 bp, Homo sapiens
acccctccctttctcccc

SEQ ID NO: 3518190 - DNA, 19 bp, Homo sapiens
acccctccctttctcccct

SEQ ID NO: 3518191 - DNA, 16 bp, Homo sapiens
acccctgactcatcat

SEQ ID NO: 3518192 - DNA, 12 bp, Homo sapiens
acccctggaaga

SEQ ID NO: 3518193 - DNA, 19 bp, Homo sapiens
acccctggaagagcccagt

SEQ ID NO: 3518194 - DNA, 18 bp, Homo sapiens
actccggctgtgctggga

SEQ ID NO: 3518195 - DNA, 18 bp, Homo sapiens
actcctaacctcaagtga

SEQ ID NO: 3518196 - DNA, 18 bp, Homo sapiens
actcctaggcaggacatg

SEQ ID NO: 3518197 - DNA, 20 bp, Homo sapiens
actcctcacacttactgtaa

SEQ ID NO: 3518198 - DNA, 11 bp, Homo sapiens
actcctcccat

SEQ ID NO: 3518199 - DNA, 12 bp, Homo sapiens
actcctccctcc

SEQ ID NO: 3518200 - DNA, 13 bp, Homo sapiens
actcctccctccg

SEQ ID NO: 3518201 - DNA, 20 bp, Homo sapiens
actcctgccaccagcatcca

SEQ ID NO: 3518202 - DNA, 11 bp, Homo sapiens
actcctggcct

SEQ ID NO: 3518203 - DNA, 16 bp, Homo sapiens
actccttcctggcctg

SEQ ID NO: 3518204 - DNA, 17 bp, Homo sapiens
actccttgagagaccag

SEQ ID NO: 3518205 - DNA, 17 bp, Homo sapiens
actcgagaactttcatt

SEQ ID NO: 3518206 - DNA, 20 bp, Homo sapiens
actcggggtgcttccttgta

SEQ ID NO: 3518207 - DNA, 19 bp, Homo sapiens
actcgtatagcatgcatct

SEQ ID NO: 3518208 - DNA, 15 bp, Homo sapiens
actctacagaggcca

SEQ ID NO: 3518209 - DNA, 21 bp, Homo sapiens
actctagatacctaaaacata

SEQ ID NO: 3518210 - DNA, 15 bp, Homo sapiens
actctagggaaaaac

SEQ ID NO: 3518211 - DNA, 15 bp, Homo sapiens
actctatagactcta

SEQ ID NO: 3518212 - DNA, 18 bp, Homo sapiens
actctatagactctagga

SEQ ID NO: 3518213 - DNA, 22 bp, Homo sapiens
actctcacctgtactattgcag

SEQ ID NO: 3518214 - DNA, 22 bp, Homo sapiens
actctcaggaccaaagctttca

SEQ ID NO: 3518215 - DNA, 18 bp, Homo sapiens
actctcagtctctgagca

SEQ ID NO: 3518216 - DNA, 15 bp, Homo sapiens
actctccaggggtcc

SEQ ID NO: 3518217 - DNA, 23 bp, Homo sapiens
actctccaggggtcctaggcctc

SEQ ID NO: 3518218 - DNA, 20 bp, Homo sapiens
actctcccccaccccctccc

SEQ ID NO: 3518219 - DNA, 16 bp, Homo sapiens
actctcctatgccttt

SEQ ID NO: 3518220 - DNA, 14 bp, Homo sapiens
actctcctcatctc

SEQ ID NO: 3518221 - DNA, 18 bp, Homo sapiens
actctcgcatcttcccaa

SEQ ID NO: 3518222 - DNA, 13 bp, Homo sapiens
actctcttcttct

SEQ ID NO: 3518223 - DNA, 12 bp, Homo sapiens
actctgaagctg

SEQ ID NO: 3518224 - DNA, 14 bp, Homo sapiens
actctgagtgtttt

SEQ ID NO: 3518225 - DNA, 15 bp, Homo sapiens
actctgcatccagag

SEQ ID NO: 3518226 - DNA, 20 bp, Homo sapiens
actctgcatccagagattca

SEQ ID NO: 3518227 - DNA, 13 bp, Homo sapiens
actctgccctcta

SEQ ID NO: 3518228 - DNA, 17 bp, Homo sapiens
actctgccctctagagc

SEQ ID NO: 3518229 - DNA, 16 bp, Homo sapiens
actctggcaaagcttt

SEQ ID NO: 3518230 - DNA, 16 bp, Homo sapiens
actctggcttggccta

SEQ ID NO: 3518231 - DNA, 22 bp, Homo sapiens
actctggcttggcctatctcct

SEQ ID NO: 3518232 - DNA, 16 bp, Homo sapiens
actctgtcttcacctg

SEQ ID NO: 3518233 - DNA, 18 bp, Homo sapiens
actctgtcttcacctgat

SEQ ID NO: 3518234 - DNA, 22 bp, Homo sapiens
actctgtcttcacctgattcaa

SEQ ID NO: 3518235 - DNA, 16 bp, Homo sapiens
actctgtgtcaggtgg

SEQ ID NO: 3518236 - DNA, 19 bp, Homo sapiens
actctgtgtcaggtggggc

SEQ ID NO: 3518237 - DNA, 14 bp, Homo sapiens
actctgttccttca

SEQ ID NO: 3518238 - DNA, 20 bp, Homo sapiens
actctgttccttcacatcct

SEQ ID NO: 3518239 - DNA, 19 bp, Homo sapiens
actcttagatggattctcc

SEQ ID NO: 3518240 - DNA, 19 bp, Homo sapiens
actcttattgcccacgctg

SEQ ID NO: 3518241 - DNA, 12 bp, Homo sapiens
actcttcctttc

SEQ ID NO: 3518242 - DNA, 13 bp, Homo sapiens
actcttcctttct

SEQ ID NO: 3518243 - DNA, 22 bp, Homo sapiens
actcttctctcaaccttggcct

SEQ ID NO: 3518244 - DNA, 16 bp, Homo sapiens
actcttgacctcaggt

SEQ ID NO: 3518245 - DNA, 14 bp, Homo sapiens
actctttatgcttg

SEQ ID NO: 3518246 - DNA, 15 bp, Homo sapiens
actctttatgcttgc

SEQ ID NO: 3518247 - DNA, 15 bp, Homo sapiens
actctttctgagtgc

SEQ ID NO: 3518248 - DNA, 18 bp, Homo sapiens
actctttctgagtgcctt

SEQ ID NO: 3518249 - DNA, 20 bp, Homo sapiens
actctttctgagtgccttct

SEQ ID NO: 3518250 - DNA, 22 bp, Homo sapiens
actctttctgagtgccttctgt

SEQ ID NO: 3518251 - DNA, 16 bp, Homo sapiens
actctttgagaaacaa

SEQ ID NO: 3518252 - DNA, 21 bp, Homo sapiens
actcttttgctttattccaga

SEQ ID NO: 3518253 - DNA, 21 bp, Homo sapiens
actcttttggacaaaggaatc

SEQ ID NO: 3518254 - DNA, 21 bp, Homo sapiens
actgaactgtgtgtaattgtt

SEQ ID NO: 3518255 - DNA, 16 bp, Homo sapiens
actgaactttcttatc

SEQ ID NO: 3518256 - DNA, 17 bp, Homo sapiens
actgaagcaacttgatg

SEQ ID NO: 3518257 - DNA, 21 bp, Homo sapiens
actgaagcagcctctccccag

SEQ ID NO: 3518258 - DNA, 21 bp, Homo sapiens
actgaagccttacaaggttat

SEQ ID NO: 3518259 - DNA, 22 bp, Homo sapiens
actgacattgttggccaaagcc

SEQ ID NO: 3518260 - DNA, 14 bp, Homo sapiens
actgaccagaacta

SEQ ID NO: 3518261 - DNA, 17 bp, Homo sapiens
actgaccctggggctgg

SEQ ID NO: 3518262 - DNA, 21 bp, Homo sapiens
actgacctggtccacagggca

SEQ ID NO: 3518263 - DNA, 20 bp, Homo sapiens
actgagaatgtaagaactac

SEQ ID NO: 3518264 - DNA, 14 bp, Homo sapiens
actgagacaggcag

SEQ ID NO: 3518265 - DNA, 15 bp, Homo sapiens
actgagacaggcagt

SEQ ID NO: 3518266 - DNA, 16 bp, Homo sapiens
actgagacaggcagtt

SEQ ID NO: 3518267 - DNA, 20 bp, Homo sapiens
actgagacaggcagtttcag

SEQ ID NO: 3518268 - DNA, 14 bp, Homo sapiens
actgaggcagggaa

SEQ ID NO: 3518269 - DNA, 15 bp, Homo sapiens
actgaggcagggaag

SEQ ID NO: 3518270 - DNA, 13 bp, Homo sapiens
actgagttttcca

SEQ ID NO: 3518271 - DNA, 18 bp, Homo sapiens
actgatcaggacctccaa

SEQ ID NO: 3518272 - DNA, 19 bp, Homo sapiens
actgatgctgcccctcatc

SEQ ID NO: 3518273 - DNA, 23 bp, Homo sapiens
actgatgggcaacccccagcctg

SEQ ID NO: 3518274 - DNA, 19 bp, Homo sapiens
actgattaaatatttgaag

SEQ ID NO: 3518275 - DNA, 14 bp, Homo sapiens
actgcaaagagacg

SEQ ID NO: 3518276 - DNA, 13 bp, Homo sapiens
actgcaacctccg

SEQ ID NO: 3518277 - DNA, 16 bp, Homo sapiens
actgcaacctccgcct

SEQ ID NO: 3518278 - DNA, 14 bp, Homo sapiens
actgcactccagcc

SEQ ID NO: 3518279 - DNA, 12 bp, Homo sapiens
actgcagagcag

SEQ ID NO: 3518280 - DNA, 23 bp, Homo sapiens
actgcagcctcaacctcctgggc

SEQ ID NO: 3518281 - DNA, 19 bp, Homo sapiens
actgcaggccctggcctcc

SEQ ID NO: 3518282 - DNA, 13 bp, Homo sapiens
actgcagggttca

SEQ ID NO: 3518283 - DNA, 16 bp, Homo sapiens
actgcataccaacctg

SEQ ID NO: 3518284 - DNA, 22 bp, Homo sapiens
actgcataccaacctgggcaat

SEQ ID NO: 3518285 - DNA, 23 bp, Homo sapiens
actgccaatatagaaaaataaaa

SEQ ID NO: 3518286 - DNA, 16 bp, Homo sapiens
actgccagtctcactg

SEQ ID NO: 3518287 - DNA, 14 bp, Homo sapiens
actgccataaaaca

SEQ ID NO: 3518288 - DNA, 22 bp, Homo sapiens
actgccataaaacattaagaaa

SEQ ID NO: 3518289 - DNA, 22 bp, Homo sapiens
actgcccggcagggtcctagaa

SEQ ID NO: 3518290 - DNA, 20 bp, Homo sapiens
actgccctccagctctttcc

SEQ ID NO: 3518291 - DNA, 18 bp, Homo sapiens
actgccgtcagtgctgtg

SEQ ID NO: 3518292 - DNA, 11 bp, Homo sapiens
actgccttaat

SEQ ID NO: 3518293 - DNA, 16 bp, Homo sapiens
actgccttcgcttctt

SEQ ID NO: 3518294 - DNA, 23 bp, Homo sapiens
actgccttcgcttcttgcctctg

SEQ ID NO: 3518295 - DNA, 18 bp, Homo sapiens
actgccttgcctcctcag

SEQ ID NO: 3518296 - DNA, 15 bp, Homo sapiens
actgcgactttctgc

SEQ ID NO: 3518297 - DNA, 21 bp, Homo sapiens
actgctaaaatagaatatagc

SEQ ID NO: 3518298 - DNA, 17 bp, Homo sapiens
actgctcagctctggtc

SEQ ID NO: 3518299 - DNA, 14 bp, Homo sapiens
actgctctcagcct

SEQ ID NO: 3518300 - DNA, 16 bp, Homo sapiens
actgctctcagcctcc

SEQ ID NO: 3518301 - DNA, 17 bp, Homo sapiens
actgctctcagcctccc

SEQ ID NO: 3518302 - DNA, 19 bp, Homo sapiens
actgctgagatacatacag

SEQ ID NO: 3518303 - DNA, 22 bp, Homo sapiens
actgctgtgaaccctggggcct

SEQ ID NO: 3518304 - DNA, 14 bp, Homo sapiens
actgcttcattttt

SEQ ID NO: 3518305 - DNA, 18 bp, Homo sapiens
actgcttcatttttgtaa

SEQ ID NO: 3518306 - DNA, 13 bp, Homo sapiens
actgcttggagct

SEQ ID NO: 3518307 - DNA, 16 bp, Homo sapiens
actgcttggagctgag

SEQ ID NO: 3518308 - DNA, 16 bp, Homo sapiens
actgctttgcaaagac

SEQ ID NO: 3518309 - DNA, 15 bp, Homo sapiens
actgcttttggcctg

SEQ ID NO: 3518310 - DNA, 16 bp, Homo sapiens
actgcttttggtctgt

SEQ ID NO: 3518311 - DNA, 14 bp, Homo sapiens
actggaagcacagc

SEQ ID NO: 3518312 - DNA, 17 bp, Homo sapiens
actggaagcacagcttc

SEQ ID NO: 3518313 - DNA, 20 bp, Homo sapiens
actggaagctaatttgcatt

SEQ ID NO: 3518314 - DNA, 17 bp, Homo sapiens
actggaaggctgctttc

SEQ ID NO: 3518315 - DNA, 18 bp, Homo sapiens
actggaaggtggggacag

SEQ ID NO: 3518316 - DNA, 15 bp, Homo sapiens
actggaccagacaat

SEQ ID NO: 3518317 - DNA, 13 bp, Homo sapiens
actggaccccagc

SEQ ID NO: 3518318 - DNA, 19 bp, Homo sapiens
actggaccctgttgctaag

SEQ ID NO: 3518319 - DNA, 17 bp, Homo sapiens
actggatgcagaaacag

SEQ ID NO: 3518320 - DNA, 13 bp, Homo sapiens
actggatgtccag

SEQ ID NO: 3518321 - DNA, 18 bp, Homo sapiens
actggcaacattccaaga

SEQ ID NO: 3518322 - DNA, 16 bp, Homo sapiens
actggctgtgtgacct

SEQ ID NO: 3518323 - DNA, 15 bp, Homo sapiens
actggctttggcttc

SEQ ID NO: 3518324 - DNA, 16 bp, Homo sapiens
actggctttggcttct

SEQ ID NO: 3518325 - DNA, 16 bp, Homo sapiens
actgggacagcccagg

SEQ ID NO: 3518326 - DNA, 17 bp, Homo sapiens
actgggccctgagccag

SEQ ID NO: 3518327 - DNA, 20 bp, Homo sapiens
agacggcacggtcttccctc

SEQ ID NO: 3518328 - DNA, 14 bp, Homo sapiens
agacgtgtttgtgt

SEQ ID NO: 3518329 - DNA, 14 bp, Homo sapiens
agactactaagagg

SEQ ID NO: 3518330 - DNA, 20 bp, Homo sapiens
agactcacaacctgaaccta

SEQ ID NO: 3518331 - DNA, 23 bp, Homo sapiens
agactcaggccaagaaacgtctt

SEQ ID NO: 3518332 - DNA, 19 bp, Homo sapiens
agactcccattcctgaaga

SEQ ID NO: 3518333 - DNA, 16 bp, Homo sapiens
agactccgctgtggga

SEQ ID NO: 3518334 - DNA, 14 bp, Homo sapiens
agactcctaggcag

SEQ ID NO: 3518335 - DNA, 20 bp, Homo sapiens
agactccttgagagaccagg

SEQ ID NO: 3518336 - DNA, 18 bp, Homo sapiens
agactcgagaactttcat

SEQ ID NO: 3518337 - DNA, 23 bp, Homo sapiens
agactcgattcatattgaatata

SEQ ID NO: 3518338 - DNA, 17 bp, Homo sapiens
agactcggggtgcttcc

SEQ ID NO: 3518339 - DNA, 22 bp, Homo sapiens
agactcggggtgcttccttgta

SEQ ID NO: 3518340 - DNA, 17 bp, Homo sapiens
agactctacagaggcca

SEQ ID NO: 3518341 - DNA, 23 bp, Homo sapiens
agactctcgcatcttcccaaccc

SEQ ID NO: 3518342 - DNA, 15 bp, Homo sapiens
agactctttgcatat

SEQ ID NO: 3518343 - DNA, 16 bp, Homo sapiens
agactctttggacact

SEQ ID NO: 3518344 - DNA, 20 bp, Homo sapiens
agactgaactgcagggttca

SEQ ID NO: 3518345 - DNA, 14 bp, Homo sapiens
agactgatcaggac

SEQ ID NO: 3518346 - DNA, 19 bp, Homo sapiens
agactgatcaggacctcca

SEQ ID NO: 3518347 - DNA, 20 bp, Homo sapiens
agactggaagctaatttgca

SEQ ID NO: 3518348 - DNA, 14 bp, Homo sapiens
agactgtgaacagc

SEQ ID NO: 3518349 - DNA, 19 bp, Homo sapiens
agactgtgaacagcttgct

SEQ ID NO: 3518350 - DNA, 22 bp, Homo sapiens
agacttaaaaaatacttgcatg

SEQ ID NO: 3518351 - DNA, 21 bp, Homo sapiens
agacttaaaagagctcagaca

SEQ ID NO: 3518352 - DNA, 22 bp, Homo sapiens
agacttaaaagagctcagacat

SEQ ID NO: 3518353 - DNA, 13 bp, Homo sapiens
agacttcagtatg

SEQ ID NO: 3518354 - DNA, 19 bp, Homo sapiens
agacttcagtatgttgtca

SEQ ID NO: 3518355 - DNA, 15 bp, Homo sapiens
agacttccctgaatg

SEQ ID NO: 3518356 - DNA, 14 bp, Homo sapiens
agacttccttgaga

SEQ ID NO: 3518357 - DNA, 17 bp, Homo sapiens
agacttgccatgtgact

SEQ ID NO: 3518358 - DNA, 22 bp, Homo sapiens
agacttgtcaagcctgtgcaaa

SEQ ID NO: 3518359 - DNA, 18 bp, Homo sapiens
agactttgtttttaaaat

SEQ ID NO: 3518360 - DNA, 18 bp, Homo sapiens
agagaaaaaggctgaaaa

SEQ ID NO: 3518361 - DNA, 19 bp, Homo sapiens
agagaaaatatatgtattt

SEQ ID NO: 3518362 - DNA, 23 bp, Homo sapiens
agagaaaatatatgtatttttat

SEQ ID NO: 3518363 - DNA, 19 bp, Homo sapiens
agagaaaggggagcccact

SEQ ID NO: 3518364 - DNA, 12 bp, Homo sapiens
agagaacatttt

SEQ ID NO: 3518365 - DNA, 15 bp, Homo sapiens
agagaacattttact

SEQ ID NO: 3518366 - DNA, 23 bp, Homo sapiens
agagaacctcacgcacctcccat

SEQ ID NO: 3518367 - DNA, 10 bp, Homo sapiens
agagaagaga

SEQ ID NO: 3518368 - DNA, 22 bp, Homo sapiens
agagaatatgtctgctcctttc

SEQ ID NO: 3518369 - DNA, 22 bp, Homo sapiens
agagaatattagctttactgtt

SEQ ID NO: 3518370 - DNA, 13 bp, Homo sapiens
agagaatatttta

SEQ ID NO: 3518371 - DNA, 18 bp, Homo sapiens
agagaatgaaagggccca

SEQ ID NO: 3518372 - DNA, 14 bp, Homo sapiens
agagaatgagagcg

SEQ ID NO: 3518373 - DNA, 19 bp, Homo sapiens
agagaatgagagcgacaca

SEQ ID NO: 3518374 - DNA, 18 bp, Homo sapiens
agagaatgtgtttcaaaa

SEQ ID NO: 3518375 - DNA, 20 bp, Homo sapiens
agagacagttgggtgagaac

SEQ ID NO: 3518376 - DNA, 22 bp, Homo sapiens
agagacagttgggtgagaacaa

SEQ ID NO: 3518377 - DNA, 23 bp, Homo sapiens
agagacatacttgaagggccaga

SEQ ID NO: 3518378 - DNA, 21 bp, Homo sapiens
agagacggtgtcttgttctgt

SEQ ID NO: 3518379 - DNA, 15 bp, Homo sapiens
agagacggtgttttg

SEQ ID NO: 3518380 - DNA, 21 bp, Homo sapiens
agagactccttgagagaccag

SEQ ID NO: 3518381 - DNA, 13 bp, Homo sapiens
agagagaaaaaaa

SEQ ID NO: 3518382 - DNA, 13 bp, Homo sapiens
agagagacagaga

SEQ ID NO: 3518383 - DNA, 17 bp, Homo sapiens
agagagccttgggagcc

SEQ ID NO: 3518384 - DNA, 21 bp, Homo sapiens
agagagccttgggagccactg

SEQ ID NO: 3518385 - DNA, 18 bp, Homo sapiens
agagagggaggcaagccc

SEQ ID NO: 3518386 - DNA, 15 bp, Homo sapiens
agagatggacagaga

SEQ ID NO: 3518387 - DNA, 19 bp, Homo sapiens
agagatggacagagaactt

SEQ ID NO: 3518388 - DNA, 18 bp, Homo sapiens
agagatggagtcttgcta

SEQ ID NO: 3518389 - DNA, 12 bp, Homo sapiens
agagcaaggaag

SEQ ID NO: 3518390 - DNA, 17 bp, Homo sapiens
agagcaatggttgtatt

SEQ ID NO: 3518391 - DNA, 13 bp, Homo sapiens
agagcactgccac

SEQ ID NO: 3518392 - DNA, 15 bp, Homo sapiens
agagcacttaagaga

SEQ ID NO: 3518393 - DNA, 13 bp, Homo sapiens
agagcaggactcc

SEQ ID NO: 3518394 - DNA, 17 bp, Homo sapiens
agagcaggactccaggc

SEQ ID NO: 3518395 - DNA, 23 bp, Homo sapiens
agagcagggggacctaggctcct

SEQ ID NO: 3518396 - DNA, 20 bp, Homo sapiens
agagcattttttatgatatc

SEQ ID NO: 3518397 - DNA, 16 bp, Homo sapiens
agagccaaacagagcc

SEQ ID NO: 3518398 - DNA, 18 bp, Homo sapiens
agagccaaacagagccca

SEQ ID NO: 3518399 - DNA, 19 bp, Homo sapiens
agagccaaacagagcccag

SEQ ID NO: 3518400 - DNA, 15 bp, Homo sapiens
agagccacagggtct

SEQ ID NO: 3518401 - DNA, 21 bp, Homo sapiens
agagccacagggtctgcctcc

SEQ ID NO: 3518402 - DNA, 22 bp, Homo sapiens
agagccaggggggtgaggagct

SEQ ID NO: 3518403 - DNA, 20 bp, Homo sapiens
agagccatgtagaagctgca

SEQ ID NO: 3518404 - DNA, 13 bp, Homo sapiens
agagcccaccttg

SEQ ID NO: 3518405 - DNA, 14 bp, Homo sapiens
agagcccggagctc

SEQ ID NO: 3518406 - DNA, 13 bp, Homo sapiens
agagcctgaggga

SEQ ID NO: 3518407 - DNA, 16 bp, Homo sapiens
agagccttcagcctta

SEQ ID NO: 3518408 - DNA, 19 bp, Homo sapiens
agagccttgggagccactg

SEQ ID NO: 3518409 - DNA, 21 bp, Homo sapiens
agagccttgggagccactgcc

SEQ ID NO: 3518410 - DNA, 15 bp, Homo sapiens
agagcctttccaaag

SEQ ID NO: 3518411 - DNA, 14 bp, Homo sapiens
agagcgcctgcccc

SEQ ID NO: 3518412 - DNA, 15 bp, Homo sapiens
agagcgcgcccctag

SEQ ID NO: 3518413 - DNA, 20 bp, Homo sapiens
agagcgcgcccctagccggt

SEQ ID NO: 3518414 - DNA, 22 bp, Homo sapiens
agagctctggtgataaggacat

SEQ ID NO: 3518415 - DNA, 21 bp, Homo sapiens
agagctgaagagttgccccgt

SEQ ID NO: 3518416 - DNA, 20 bp, Homo sapiens
agagctgacacaaacctgcc

SEQ ID NO: 3518417 - DNA, 22 bp, Homo sapiens
agagctgacacaaacctgcctg

SEQ ID NO: 3518418 - DNA, 12 bp, Homo sapiens
agagctggagcc

SEQ ID NO: 3518419 - DNA, 17 bp, Homo sapiens
agagctggagcctggtg

SEQ ID NO: 3518420 - DNA, 12 bp, Homo sapiens
agagctggctct

SEQ ID NO: 3518421 - DNA, 13 bp, Homo sapiens
agagctggctctg

SEQ ID NO: 3518422 - DNA, 17 bp, Homo sapiens
agagctgtattaagcca

SEQ ID NO: 3518423 - DNA, 19 bp, Homo sapiens
agagctgtattaagccact

SEQ ID NO: 3518424 - DNA, 23 bp, Homo sapiens
agagcttcttccaggtgcccagc

SEQ ID NO: 3518425 - DNA, 23 bp, Homo sapiens
agagcttggactggatgcatgtt

SEQ ID NO: 3518426 - DNA, 13 bp, Homo sapiens
agagcttttcaga

SEQ ID NO: 3518427 - DNA, 16 bp, Homo sapiens
agaggaagttcagatc

SEQ ID NO: 3518428 - DNA, 22 bp, Homo sapiens
agaggacgagcgattgaggtgt

SEQ ID NO: 3518429 - DNA, 21 bp, Homo sapiens
agaggacttttctttgtggct

SEQ ID NO: 3518430 - DNA, 22 bp, Homo sapiens
agaggacttttctttgtggctt

SEQ ID NO: 3518431 - DNA, 23 bp, Homo sapiens
agaggacttttctttgtggcttc

SEQ ID NO: 3518432 - DNA, 12 bp, Homo sapiens
agaggaggatgt

SEQ ID NO: 3518433 - DNA, 12 bp, Homo sapiens
agaggaggggcc

SEQ ID NO: 3518434 - DNA, 14 bp, Homo sapiens
agaggaggggccgc

SEQ ID NO: 3518435 - DNA, 18 bp, Homo sapiens
agaggaggggccgctgcc

SEQ ID NO: 3518436 - DNA, 22 bp, Homo sapiens
agaggattaggttccatccttt

SEQ ID NO: 3518437 - DNA, 19 bp, Homo sapiens
agaggcagccccattctgc

SEQ ID NO: 3518438 - DNA, 13 bp, Homo sapiens
agaggcagggtct

SEQ ID NO: 3518439 - DNA, 18 bp, Homo sapiens
agaggccaaaggctggtg

SEQ ID NO: 3518440 - DNA, 19 bp, Homo sapiens
agaggccatgggcctcctg

SEQ ID NO: 3518441 - DNA, 14 bp, Homo sapiens
agaggccccagcct

SEQ ID NO: 3518442 - DNA, 16 bp, Homo sapiens
agaggccccagcctcc

SEQ ID NO: 3518443 - DNA, 23 bp, Homo sapiens
agaggccccagcctccctgaagc

SEQ ID NO: 3518444 - DNA, 20 bp, Homo sapiens
agaggcccccagcccagggc

SEQ ID NO: 3518445 - DNA, 21 bp, Homo sapiens
agaggcccccagcccagggct

SEQ ID NO: 3518446 - DNA, 18 bp, Homo sapiens
agaggccctctggagtgg

SEQ ID NO: 3518447 - DNA, 23 bp, Homo sapiens
agaggccctctggagtggccact

SEQ ID NO: 3518448 - DNA, 24 bp, Homo sapiens
agaggccctctggagtggccacta

SEQ ID NO: 3518449 - DNA, 21 bp, Homo sapiens
agaggcctgcctccagggctg

SEQ ID NO: 3518450 - DNA, 15 bp, Homo sapiens
agaggctacagggcc

SEQ ID NO: 3518451 - DNA, 17 bp, Homo sapiens
agaggctcatggccctg

SEQ ID NO: 3518452 - DNA, 20 bp, Homo sapiens
agaggctcatggccctgtag

SEQ ID NO: 3518453 - DNA, 22 bp, Homo sapiens
agaggctcgttgactggctgtg

SEQ ID NO: 3518454 - DNA, 14 bp, Homo sapiens
agaggctgggttca

SEQ ID NO: 3518455 - DNA, 15 bp, Homo sapiens
agagggaagaaaaga

SEQ ID NO: 3518456 - DNA, 14 bp, Homo sapiens
agagggaggggcct

SEQ ID NO: 3518457 - DNA, 18 bp, Homo sapiens
agagggaggggcctaggc

SEQ ID NO: 3518458 - DNA, 16 bp, Homo sapiens
agccccattcctggga

SEQ ID NO: 3518459 - DNA, 12 bp, Homo sapiens
agcccccagcta

SEQ ID NO: 3518460 - DNA, 19 bp, Homo sapiens
agcccccagctaagaacct

SEQ ID NO: 3518461 - DNA, 17 bp, Homo sapiens
agccccctggcctctgt

SEQ ID NO: 3518462 - DNA, 19 bp, Homo sapiens
agccccggtggctgggcag

SEQ ID NO: 3518463 - DNA, 15 bp, Homo sapiens
agcccctactgctgt

SEQ ID NO: 3518464 - DNA, 21 bp, Homo sapiens
agcccctcccaagctggctgg

SEQ ID NO: 3518465 - DNA, 22 bp, Homo sapiens
agcccctcccaagctggctggg

SEQ ID NO: 3518466 - DNA, 20 bp, Homo sapiens
agcccctctggtcgctcctg

SEQ ID NO: 3518467 - DNA, 19 bp, Homo sapiens
agcccctggacatgcctgt

SEQ ID NO: 3518468 - DNA, 22 bp, Homo sapiens
agcccctggacatgcctgtcct

SEQ ID NO: 3518469 - DNA, 22 bp, Homo sapiens
agcccctggggtggccaccagt

SEQ ID NO: 3518470 - DNA, 20 bp, Homo sapiens
agcccctgtctagagaggga

SEQ ID NO: 3518471 - DNA, 22 bp, Homo sapiens
agcccctgtctagagagggagg

SEQ ID NO: 3518472 - DNA, 16 bp, Homo sapiens
agccccttctcagaat

SEQ ID NO: 3518473 - DNA, 18 bp, Homo sapiens
agccccttctcagaatct

SEQ ID NO: 3518474 - DNA, 19 bp, Homo sapiens
agccccttctcagaatcta

SEQ ID NO: 3518475 - DNA, 15 bp, Homo sapiens
agccccttctgctca

SEQ ID NO: 3518476 - DNA, 18 bp, Homo sapiens
agcccggagctccggcct

SEQ ID NO: 3518477 - DNA, 17 bp, Homo sapiens
agccctagggtggagag

SEQ ID NO: 3518478 - DNA, 15 bp, Homo sapiens
agccctcagaaccct

SEQ ID NO: 3518479 - DNA, 19 bp, Homo sapiens
agccctcagaacccttggc

SEQ ID NO: 3518480 - DNA, 16 bp, Homo sapiens
agccctcatcccgagc

SEQ ID NO: 3518481 - DNA, 12 bp, Homo sapiens
agccctccccat

SEQ ID NO: 3518482 - DNA, 20 bp, Homo sapiens
agccctccccatggagccag

SEQ ID NO: 3518483 - DNA, 14 bp, Homo sapiens
agccctcgtctccc

SEQ ID NO: 3518484 - DNA, 13 bp, Homo sapiens
agccctgaccctg

SEQ ID NO: 3518485 - DNA, 17 bp, Homo sapiens
agccctgaccctgtgga

SEQ ID NO: 3518486 - DNA, 18 bp, Homo sapiens
agccctgagaaagccctg

SEQ ID NO: 3518487 - DNA, 11 bp, Homo sapiens
agccctggcag

SEQ ID NO: 3518488 - DNA, 14 bp, Homo sapiens
agccctggtggcag

SEQ ID NO: 3518489 - DNA, 16 bp, Homo sapiens
agccctggtggcagtg

SEQ ID NO: 3518490 - DNA, 23 bp, Homo sapiens
agccctggtggcagtgggagctg

SEQ ID NO: 3518491 - DNA, 18 bp, Homo sapiens
agccctgtggatgagccc

SEQ ID NO: 3518492 - DNA, 22 bp, Homo sapiens
agccctgtggatgagccctcag

SEQ ID NO: 3518493 - DNA, 17 bp, Homo sapiens
agccctgttgacacagg

SEQ ID NO: 3518494 - DNA, 20 bp, Homo sapiens
agccctgttgacacaggtct

SEQ ID NO: 3518495 - DNA, 21 bp, Homo sapiens
agccctgttgacacaggtctt

SEQ ID NO: 3518496 - DNA, 21 bp, Homo sapiens
agcccttagcagggaaacagc

SEQ ID NO: 3518497 - DNA, 21 bp, Homo sapiens
agcccttctccatggccctgc

SEQ ID NO: 3518498 - DNA, 21 bp, Homo sapiens
agccgacaccttttttcaaca

SEQ ID NO: 3518499 - DNA, 18 bp, Homo sapiens
agccgagatcacgccact

SEQ ID NO: 3518500 - DNA, 19 bp, Homo sapiens
agccgagatcacgccactg

SEQ ID NO: 3518501 - DNA, 19 bp, Homo sapiens
agccgagattgcaccactg

SEQ ID NO: 3518502 - DNA, 20 bp, Homo sapiens
agccgagattgcaccactgc

SEQ ID NO: 3518503 - DNA, 19 bp, Homo sapiens
agccgatatcagaatttgt

SEQ ID NO: 3518504 - DNA, 18 bp, Homo sapiens
agccgattcacctgagca

SEQ ID NO: 3518505 - DNA, 15 bp, Homo sapiens
agccgctgagcgagg

SEQ ID NO: 3518506 - DNA, 21 bp, Homo sapiens
agccggttcctgtccctgcgc

SEQ ID NO: 3518507 - DNA, 13 bp, Homo sapiens
agcctagccctgg

SEQ ID NO: 3518508 - DNA, 15 bp, Homo sapiens
agcctaggtgacaga

SEQ ID NO: 3518509 - DNA, 15 bp, Homo sapiens
agcctcaacctcctg

SEQ ID NO: 3518510 - DNA, 18 bp, Homo sapiens
agcctcaacctcctgggc

SEQ ID NO: 3518511 - DNA, 21 bp, Homo sapiens
agcctcacttctagggtatgg

SEQ ID NO: 3518512 - DNA, 19 bp, Homo sapiens
agcctcagcatcctggcac

SEQ ID NO: 3518513 - DNA, 23 bp, Homo sapiens
agcctcagctctcagttgcagcc

SEQ ID NO: 3518514 - DNA, 17 bp, Homo sapiens
agcctcccaaagtgctg

SEQ ID NO: 3518515 - DNA, 20 bp, Homo sapiens
agcctcccaaagtgctggga

SEQ ID NO: 3518516 - DNA, 19 bp, Homo sapiens
agcctcccctgccagggca

SEQ ID NO: 3518517 - DNA, 19 bp, Homo sapiens
agcctcccgaatagctggg

SEQ ID NO: 3518518 - DNA, 22 bp, Homo sapiens
agcctcccgaatagctgggact

SEQ ID NO: 3518519 - DNA, 20 bp, Homo sapiens
agcctcccgagtagctggga

SEQ ID NO: 3518520 - DNA, 16 bp, Homo sapiens
agcctccctgaagcct

SEQ ID NO: 3518521 - DNA, 13 bp, Homo sapiens
agcctcgctctgt

SEQ ID NO: 3518522 - DNA, 23 bp, Homo sapiens
agcctcgctctgttacccagggt

SEQ ID NO: 3518523 - DNA, 22 bp, Homo sapiens
agcctctccccaggtccagctc

SEQ ID NO: 3518524 - DNA, 13 bp, Homo sapiens
agcctctgggtca

SEQ ID NO: 3518525 - DNA, 22 bp, Homo sapiens
agcctctgggtcagtggtccac

SEQ ID NO: 3518526 - DNA, 14 bp, Homo sapiens
agcctcttggggaa

SEQ ID NO: 3518527 - DNA, 23 bp, Homo sapiens
agcctgagtagaaaggcctttaa

SEQ ID NO: 3518528 - DNA, 18 bp, Homo sapiens
agcctgatgagattttta

SEQ ID NO: 3518529 - DNA, 19 bp, Homo sapiens
agcctgatgagatttttaa

SEQ ID NO: 3518530 - DNA, 23 bp, Homo sapiens
agcctgcagttattaacactaac

SEQ ID NO: 3518531 - DNA, 19 bp, Homo sapiens
agcctgcctcttctctact

SEQ ID NO: 3518532 - DNA, 17 bp, Homo sapiens
agcctgcgcctgctgca

SEQ ID NO: 3518533 - DNA, 20 bp, Homo sapiens
agcctgcgggaagctgacct

SEQ ID NO: 3518534 - DNA, 16 bp, Homo sapiens
agcctgctccagctgt

SEQ ID NO: 3518535 - DNA, 19 bp, Homo sapiens
agcctgctggaagcccagc

SEQ ID NO: 3518536 - DNA, 20 bp, Homo sapiens
agcctggaacatcatcaagg

SEQ ID NO: 3518537 - DNA, 20 bp, Homo sapiens
agcctggccaacatggcgaa

SEQ ID NO: 3518538 - DNA, 12 bp, Homo sapiens
agcctggccaga

SEQ ID NO: 3518539 - DNA, 13 bp, Homo sapiens
agcctggccagac

SEQ ID NO: 3518540 - DNA, 21 bp, Homo sapiens
agcctggccagacacaggccc

SEQ ID NO: 3518541 - DNA, 17 bp, Homo sapiens
agcctggccccatggtc

SEQ ID NO: 3518542 - DNA, 12 bp, Homo sapiens
agcctgggaggt

SEQ ID NO: 3518543 - DNA, 20 bp, Homo sapiens
agcctgggaggtcaaggctg

SEQ ID NO: 3518544 - DNA, 18 bp, Homo sapiens
agcctgggcaatgtgata

SEQ ID NO: 3518545 - DNA, 14 bp, Homo sapiens
agcctggggctggc

SEQ ID NO: 3518546 - DNA, 14 bp, Homo sapiens
agcctgggtgacaa

SEQ ID NO: 3518547 - DNA, 21 bp, Homo sapiens
agcctggtaggaaagggcaag

SEQ ID NO: 3518548 - DNA, 11 bp, Homo sapiens
agcctggtgcc

SEQ ID NO: 3518549 - DNA, 15 bp, Homo sapiens
agcctggtgctgctg

SEQ ID NO: 3518550 - DNA, 13 bp, Homo sapiens
agcctgtggccct

SEQ ID NO: 3518551 - DNA, 19 bp, Homo sapiens
agcctgtggccctgtcctg

SEQ ID NO: 3518552 - DNA, 18 bp, Homo sapiens
agcctgtggctgtggaga

SEQ ID NO: 3518553 - DNA, 21 bp, Homo sapiens
agccttacaaggttatgtaga

SEQ ID NO: 3518554 - DNA, 16 bp, Homo sapiens
agccttcagccttaat

SEQ ID NO: 3518555 - DNA, 14 bp, Homo sapiens
agccttgaaaaaca

SEQ ID NO: 3518556 - DNA, 14 bp, Homo sapiens
agccttgaactctg

SEQ ID NO: 3518557 - DNA, 18 bp, Homo sapiens
agccttgaactctgggct

SEQ ID NO: 3518558 - DNA, 13 bp, Homo sapiens
agccttgactatg

SEQ ID NO: 3518559 - DNA, 15 bp, Homo sapiens
agccttgccagagat

SEQ ID NO: 3518560 - DNA, 16 bp, Homo sapiens
agccttgggagccact

SEQ ID NO: 3518561 - DNA, 20 bp, Homo sapiens
agcctttgaatgctaagaat

SEQ ID NO: 3518562 - DNA, 16 bp, Homo sapiens
agcctttgaatgtaac

SEQ ID NO: 3518563 - DNA, 19 bp, Homo sapiens
agcctttgaatgtaaccaa

SEQ ID NO: 3518564 - DNA, 22 bp, Homo sapiens
agcgaccccaggacctcttctg

SEQ ID NO: 3518565 - DNA, 19 bp, Homo sapiens
agcgactccgttggccact

SEQ ID NO: 3518566 - DNA, 21 bp, Homo sapiens
agcgactccgttggccactcc

SEQ ID NO: 3518567 - DNA, 19 bp, Homo sapiens
agcgaggaggctccagagg

SEQ ID NO: 3518568 - DNA, 18 bp, Homo sapiens
agcgatgggcccctggcc

SEQ ID NO: 3518569 - DNA, 19 bp, Homo sapiens
agcgatgggcccctggccc

SEQ ID NO: 3518570 - DNA, 17 bp, Homo sapiens
agcgcctttcccaactc

SEQ ID NO: 3518571 - DNA, 20 bp, Homo sapiens
agcgcctttcccaactctag

SEQ ID NO: 3518572 - DNA, 21 bp, Homo sapiens
agcgctcctgccgcagagctg

SEQ ID NO: 3518573 - DNA, 14 bp, Homo sapiens
agcggaggtgtgga

SEQ ID NO: 3518574 - DNA, 13 bp, Homo sapiens
agcggctgcctcc

SEQ ID NO: 3518575 - DNA, 14 bp, Homo sapiens
agcggctgcctcca

SEQ ID NO: 3518576 - DNA, 23 bp, Homo sapiens
agcggctggcagcccacccctca

SEQ ID NO: 3518577 - DNA, 20 bp, Homo sapiens
agcgggaatggcagctgcca

SEQ ID NO: 3518578 - DNA, 15 bp, Homo sapiens
agcggggacagctcc

SEQ ID NO: 3518579 - DNA, 19 bp, Homo sapiens
agcgtcctcctctgtgacc

SEQ ID NO: 3518580 - DNA, 23 bp, Homo sapiens
agcgtgaaggccgagaagcaaga

SEQ ID NO: 3518581 - DNA, 16 bp, Homo sapiens
agcgtgagccactgca

SEQ ID NO: 3518582 - DNA, 18 bp, Homo sapiens
agcgttttgttgagcatg

SEQ ID NO: 3518583 - DNA, 18 bp, Homo sapiens
agctaaaccaaggactga

SEQ ID NO: 3518584 - DNA, 16 bp, Homo sapiens
agctaacacacagctc

SEQ ID NO: 3518585 - DNA, 17 bp, Homo sapiens
agctaacacacagctcc

SEQ ID NO: 3518586 - DNA, 16 bp, Homo sapiens
agctaagaacctggaa

SEQ ID NO: 3518587 - DNA, 18 bp, Homo sapiens
agctaatacccagagcac

SEQ ID NO: 3518588 - DNA, 22 bp, Homo sapiens
agctaatgaccaacctgtttct

SEQ ID NO: 3518589 - DNA, 13 bp, Homo sapiens
agctggctctgag

SEQ ID NO: 3518590 - DNA, 14 bp, Homo sapiens
agctggctctgagc

SEQ ID NO: 3518591 - DNA, 20 bp, Homo sapiens
agctggctctgagcgcctcc

SEQ ID NO: 3518592 - DNA, 20 bp, Homo sapiens
agctggctggggtggcctgt

SEQ ID NO: 3518593 - DNA, 15 bp, Homo sapiens
agctgggactacagg

SEQ ID NO: 3518594 - DNA, 18 bp, Homo sapiens
agctgggactacaggcac

SEQ ID NO: 3518595 - DNA, 19 bp, Homo sapiens
agctgggactacaggtgtg

SEQ ID NO: 3518596 - DNA, 21 bp, Homo sapiens
agctgggctagaggctgagca

SEQ ID NO: 3518597 - DNA, 18 bp, Homo sapiens
agctgggggtgggccagg

SEQ ID NO: 3518598 - DNA, 20 bp, Homo sapiens
agctgggggtgggccaggct

SEQ ID NO: 3518599 - DNA, 21 bp, Homo sapiens
agctgggggtgggccaggctg

SEQ ID NO: 3518600 - DNA, 15 bp, Homo sapiens
agctgggtcaggcag

SEQ ID NO: 3518601 - DNA, 20 bp, Homo sapiens
agctggtaatcttgctctgc

SEQ ID NO: 3518602 - DNA, 13 bp, Homo sapiens
agctgtacaaata

SEQ ID NO: 3518603 - DNA, 17 bp, Homo sapiens
agctgtacaaatataag

SEQ ID NO: 3518604 - DNA, 22 bp, Homo sapiens
agctgtacaaatataagaataa

SEQ ID NO: 3518605 - DNA, 23 bp, Homo sapiens
agctgtacaaatataagaataaa

SEQ ID NO: 3518606 - DNA, 11 bp, Homo sapiens
agctgtagtgg

SEQ ID NO: 3518607 - DNA, 18 bp, Homo sapiens
agctgtattcatatattg

SEQ ID NO: 3518608 - DNA, 17 bp, Homo sapiens
agctgtcaccaaggaaa

SEQ ID NO: 3518609 - DNA, 18 bp, Homo sapiens
agctgtcaccaaggaaac

SEQ ID NO: 3518610 - DNA, 19 bp, Homo sapiens
agctgtgcaggtggggaga

SEQ ID NO: 3518611 - DNA, 22 bp, Homo sapiens
agctgtgcttatggtaccagat

SEQ ID NO: 3518612 - DNA, 14 bp, Homo sapiens
agctgttactgtct

SEQ ID NO: 3518613 - DNA, 19 bp, Homo sapiens
agctgttcctgttcagtaa

SEQ ID NO: 3518614 - DNA, 17 bp, Homo sapiens
agctgttctcattcctg

SEQ ID NO: 3518615 - DNA, 21 bp, Homo sapiens
agctgttctcattcctgttct

SEQ ID NO: 3518616 - DNA, 22 bp, Homo sapiens
agctgttctcattcctgttctt

SEQ ID NO: 3518617 - DNA, 16 bp, Homo sapiens
agctgttgagctgttt

SEQ ID NO: 3518618 - DNA, 17 bp, Homo sapiens
agctgttgagctgtttt

SEQ ID NO: 3518619 - DNA, 16 bp, Homo sapiens
agctgtttactaggga

SEQ ID NO: 3518620 - DNA, 14 bp, Homo sapiens
agctgtttccatag

SEQ ID NO: 3518621 - DNA, 20 bp, Homo sapiens
agcttacacaaatctattta

SEQ ID NO: 3518622 - DNA, 11 bp, Homo sapiens
agcttatctct

SEQ ID NO: 3518623 - DNA, 13 bp, Homo sapiens
agcttatctcttt

SEQ ID NO: 3518624 - DNA, 22 bp, Homo sapiens
agcttatctcttttatatttgt

SEQ ID NO: 3518625 - DNA, 19 bp, Homo sapiens
agcttatgtacaaaacttt

SEQ ID NO: 3518626 - DNA, 18 bp, Homo sapiens
agcttcaccccaatccca

SEQ ID NO: 3518627 - DNA, 20 bp, Homo sapiens
agcttcaccccaatcccagc

SEQ ID NO: 3518628 - DNA, 16 bp, Homo sapiens
agcttcaggaacctcg

SEQ ID NO: 3518629 - DNA, 19 bp, Homo sapiens
agcttcatttcctgtgtct

SEQ ID NO: 3518630 - DNA, 18 bp, Homo sapiens
agcttccatagctgctgc

SEQ ID NO: 3518631 - DNA, 23 bp, Homo sapiens
agcttccattccaagcctgacca

SEQ ID NO: 3518632 - DNA, 20 bp, Homo sapiens
agcttcctgtccccatctgt

SEQ ID NO: 3518633 - DNA, 14 bp, Homo sapiens
agcttccttggctt

SEQ ID NO: 3518634 - DNA, 13 bp, Homo sapiens
agcttctctgtga

SEQ ID NO: 3518635 - DNA, 20 bp, Homo sapiens
agcttcttccaggtgcccag

SEQ ID NO: 3518636 - DNA, 16 bp, Homo sapiens
agcttcttgtttcctt

SEQ ID NO: 3518637 - DNA, 14 bp, Homo sapiens
agcttgacctgagg

SEQ ID NO: 3518638 - DNA, 18 bp, Homo sapiens
agcttgagggttgggctg

SEQ ID NO: 3518639 - DNA, 22 bp, Homo sapiens
agcttggacatcagtgtttgtt

SEQ ID NO: 3518640 - DNA, 21 bp, Homo sapiens
agcttgtaaatagctcaggtg

SEQ ID NO: 3518641 - DNA, 15 bp, Homo sapiens
agcttgttgaaaacc

SEQ ID NO: 3518642 - DNA, 20 bp, Homo sapiens
agcttgttgaaaacccagac

SEQ ID NO: 3518643 - DNA, 20 bp, Homo sapiens
agctttctgaccttcagctc

SEQ ID NO: 3518644 - DNA, 18 bp, Homo sapiens
agctttgaaaattcagtg

SEQ ID NO: 3518645 - DNA, 14 bp, Homo sapiens
agcttttcaccttt

SEQ ID NO: 3518646 - DNA, 13 bp, Homo sapiens
aggaaaaaaatag

SEQ ID NO: 3518647 - DNA, 18 bp, Homo sapiens
aggaaaaaataacaatga

SEQ ID NO: 3518648 - DNA, 15 bp, Homo sapiens
aggaaaagattcctg

SEQ ID NO: 3518649 - DNA, 21 bp, Homo sapiens
aggaaaaggtgatatccattc

SEQ ID NO: 3518650 - DNA, 14 bp, Homo sapiens
aggaaaataatgta

SEQ ID NO: 3518651 - DNA, 13 bp, Homo sapiens
aggaaaatgaatt

SEQ ID NO: 3518652 - DNA, 20 bp, Homo sapiens
aggaaaccacagctgctgga

SEQ ID NO: 3518653 - DNA, 16 bp, Homo sapiens
aggaaacgctacctct

SEQ ID NO: 3518654 - DNA, 21 bp, Homo sapiens
aggaaactactgcctttagaa

SEQ ID NO: 3518655 - DNA, 20 bp, Homo sapiens
aggaaactttcctttaactc

SEQ ID NO: 3518656 - DNA, 16 bp, Homo sapiens
aggaaaggccagctgg

SEQ ID NO: 3518657 - DNA, 17 bp, Homo sapiens
aggaaaggccagctggc

SEQ ID NO: 3518658 - DNA, 18 bp, Homo sapiens
aggaaaggccagctggca

SEQ ID NO: 3518659 - DNA, 22 bp, Homo sapiens
aggaaaggccagctggcagcag

SEQ ID NO: 3518660 - DNA, 24 bp, Homo sapiens
aggaaaggccagctggcagcagag

SEQ ID NO: 3518661 - DNA, 14 bp, Homo sapiens
aggaaagggaggag

SEQ ID NO: 3518662 - DNA, 19 bp, Homo sapiens
aggaaagtcattggcttta

SEQ ID NO: 3518663 - DNA, 14 bp, Homo sapiens
aggaaatctcaccc

SEQ ID NO: 3518664 - DNA, 18 bp, Homo sapiens
aggaaatggagaagctct

SEQ ID NO: 3518665 - DNA, 13 bp, Homo sapiens
aggaacatttttt

SEQ ID NO: 3518666 - DNA, 19 bp, Homo sapiens
aggaacccttacagtagga

SEQ ID NO: 3518667 - DNA, 23 bp, Homo sapiens
aggaaccgtggtatgtctgccat

SEQ ID NO: 3518668 - DNA, 20 bp, Homo sapiens
aggaacctcgagtactgtgg

SEQ ID NO: 3518669 - DNA, 16 bp, Homo sapiens
aggaacggtaaatttc

SEQ ID NO: 3518670 - DNA, 22 bp, Homo sapiens
aggaagaacggggctcttctca

SEQ ID NO: 3518671 - DNA, 14 bp, Homo sapiens
aggaagagaaacca

SEQ ID NO: 3518672 - DNA, 20 bp, Homo sapiens
aggaagatctctgcagggcc

SEQ ID NO: 3518673 - DNA, 22 bp, Homo sapiens
aggaagcccccaccgtgggcag

SEQ ID NO: 3518674 - DNA, 14 bp, Homo sapiens
aggaagctcagact

SEQ ID NO: 3518675 - DNA, 18 bp, Homo sapiens
aggaaggggccagaggct

SEQ ID NO: 3518676 - DNA, 15 bp, Homo sapiens
aggaaggtggatggc

SEQ ID NO: 3518677 - DNA, 16 bp, Homo sapiens
aggaaggtggatggcc

SEQ ID NO: 3518678 - DNA, 14 bp, Homo sapiens
aggaagttcagatc

SEQ ID NO: 3518679 - DNA, 17 bp, Homo sapiens
aggaatatatgtgtgcc

SEQ ID NO: 3518680 - DNA, 22 bp, Homo sapiens
aggaatatcaatataatgtttt

SEQ ID NO: 3518681 - DNA, 16 bp, Homo sapiens
aggaatattttccaaa

SEQ ID NO: 3518682 - DNA, 17 bp, Homo sapiens
aggaatctcagagacag

SEQ ID NO: 3518683 - DNA, 14 bp, Homo sapiens
aggaatgagaagta

SEQ ID NO: 3518684 - DNA, 15 bp, Homo sapiens
aggaatgtagaagtc

SEQ ID NO: 3518685 - DNA, 17 bp, Homo sapiens
aggaattctattgagtg

SEQ ID NO: 3518686 - DNA, 15 bp, Homo sapiens
aggaatttcccagga

SEQ ID NO: 3518687 - DNA, 17 bp, Homo sapiens
aggaatttcccaggacc

SEQ ID NO: 3518688 - DNA, 18 bp, Homo sapiens
aggaatttcccaggaccc

SEQ ID NO: 3518689 - DNA, 19 bp, Homo sapiens
aggaatttcccaggaccct

SEQ ID NO: 3518690 - DNA, 17 bp, Homo sapiens
aggacaacgaggaagcc

SEQ ID NO: 3518691 - DNA, 18 bp, Homo sapiens
aggacaacgaggaagccc

SEQ ID NO: 3518692 - DNA, 22 bp, Homo sapiens
aggacagggaggtgaccccagg

SEQ ID NO: 3518693 - DNA, 20 bp, Homo sapiens
aggacataaattagaggtct

SEQ ID NO: 3518694 - DNA, 20 bp, Homo sapiens
aggacatgcggtagccagca

SEQ ID NO: 3518695 - DNA, 17 bp, Homo sapiens
aggacattgcggacagc

SEQ ID NO: 3518696 - DNA, 19 bp, Homo sapiens
aggaccaagcatcttgggg

SEQ ID NO: 3518697 - DNA, 12 bp, Homo sapiens
aggaccagctca

SEQ ID NO: 3518698 - DNA, 18 bp, Homo sapiens
aggaccagctcaggacag

SEQ ID NO: 3518699 - DNA, 19 bp, Homo sapiens
aggaccctgaaggggccat

SEQ ID NO: 3518700 - DNA, 18 bp, Homo sapiens
aggaccctgtgccctcct

SEQ ID NO: 3518701 - DNA, 16 bp, Homo sapiens
aggaccggcggctcgg

SEQ ID NO: 3518702 - DNA, 13 bp, Homo sapiens
aggacctcaggtg

SEQ ID NO: 3518703 - DNA, 20 bp, Homo sapiens
aggacctcaggtgagaagca

SEQ ID NO: 3518704 - DNA, 21 bp, Homo sapiens
aggacctccaagccactgagc

SEQ ID NO: 3518705 - DNA, 20 bp, Homo sapiens
aggacgaacatccaaccttc

SEQ ID NO: 3518706 - DNA, 20 bp, Homo sapiens
aggactatatttgggcctgc

SEQ ID NO: 3518707 - DNA, 18 bp, Homo sapiens
aggactcagaagcctctg

SEQ ID NO: 3518708 - DNA, 18 bp, Homo sapiens
aggactcagctccccaga

SEQ ID NO: 3518709 - DNA, 21 bp, Homo sapiens
aggactctggaagattttcat

SEQ ID NO: 3518710 - DNA, 22 bp, Homo sapiens
aggactctggaagattttcatt

SEQ ID NO: 3518711 - DNA, 21 bp, Homo sapiens
aggactgtgatgccctgccct

SEQ ID NO: 3518712 - DNA, 23 bp, Homo sapiens
aggacttcggggtagaggctggg

SEQ ID NO: 3518713 - DNA, 14 bp, Homo sapiens
aggacttctgcctg

SEQ ID NO: 3518714 - DNA, 19 bp, Homo sapiens
aggacttttctttgtggct

SEQ ID NO: 3518715 - DNA, 23 bp, Homo sapiens
aggacttttctttgtggcttcct

SEQ ID NO: 3518716 - DNA, 16 bp, Homo sapiens
aggagaaatttgataa

SEQ ID NO: 3518717 - DNA, 21 bp, Homo sapiens
aggagaaatttgataatgaca

SEQ ID NO: 3518718 - DNA, 19 bp, Homo sapiens
aggagaaccaaatctggaa

SEQ ID NO: 3518719 - DNA, 11 bp, Homo sapiens
aggagaagcca

SEQ ID NO: 3518720 - DNA, 16 bp, Homo sapiens
aggtaaaatgccatga

SEQ ID NO: 3518721 - DNA, 22 bp, Homo sapiens
aggtaaaatgccatgatgcctc

SEQ ID NO: 3518722 - DNA, 19 bp, Homo sapiens
aggtaaaattgaaaggcat

SEQ ID NO: 3518723 - DNA, 13 bp, Homo sapiens
aggtaacaggcag

SEQ ID NO: 3518724 - DNA, 18 bp, Homo sapiens
aggtaatataaaaagctt

SEQ ID NO: 3518725 - DNA, 19 bp, Homo sapiens
aggtaatttcttgtgcctc

SEQ ID NO: 3518726 - DNA, 18 bp, Homo sapiens
aggtacccaatagctgcc

SEQ ID NO: 3518727 - DNA, 21 bp, Homo sapiens
aggtaccttgacctttgtaca

SEQ ID NO: 3518728 - DNA, 14 bp, Homo sapiens
aggtagagtggtca

SEQ ID NO: 3518729 - DNA, 21 bp, Homo sapiens
aggtagagtggtcagttgaac

SEQ ID NO: 3518730 - DNA, 15 bp, Homo sapiens
aggtagggagatatt

SEQ ID NO: 3518731 - DNA, 18 bp, Homo sapiens
aggtatgggctgggggct

SEQ ID NO: 3518732 - DNA, 14 bp, Homo sapiens
aggtatgtttgtaa

SEQ ID NO: 3518733 - DNA, 22 bp, Homo sapiens
aggtatgtttgtaactttttac

SEQ ID NO: 3518734 - DNA, 18 bp, Homo sapiens
aggtcaatacagtacagg

SEQ ID NO: 3518735 - DNA, 18 bp, Homo sapiens
aggtcagagatgggctga

SEQ ID NO: 3518736 - DNA, 20 bp, Homo sapiens
aggtcaggagttcctaacca

SEQ ID NO: 3518737 - DNA, 15 bp, Homo sapiens
aggtcaggagttcga

SEQ ID NO: 3518738 - DNA, 24 bp, Homo sapiens
aggtccaattctcgagcttggggc

SEQ ID NO: 3518739 - DNA, 18 bp, Homo sapiens
aggtccagctctggaggg

SEQ ID NO: 3518740 - DNA, 17 bp, Homo sapiens
aggtcctcccctctctt

SEQ ID NO: 3518741 - DNA, 23 bp, Homo sapiens
aggtcctctgtcagtcacagcca

SEQ ID NO: 3518742 - DNA, 14 bp, Homo sapiens
aggtctctccactg

SEQ ID NO: 3518743 - DNA, 16 bp, Homo sapiens
aggtctctccactgct

SEQ ID NO: 3518744 - DNA, 22 bp, Homo sapiens
aggtctctccactgctctcagc

SEQ ID NO: 3518745 - DNA, 21 bp, Homo sapiens
aggtcttcatcgaatctacta

SEQ ID NO: 3518746 - DNA, 18 bp, Homo sapiens
aggtcttgaactcctggc

SEQ ID NO: 3518747 - DNA, 23 bp, Homo sapiens
aggtgaaggaatatatggcagag

SEQ ID NO: 3518748 - DNA, 14 bp, Homo sapiens
aggtgagaaaaaaa

SEQ ID NO: 3518749 - DNA, 16 bp, Homo sapiens
aggtgagaagcagagg

SEQ ID NO: 3518750 - DNA, 23 bp, Homo sapiens
aggtgagaagcagaggaaggaga

SEQ ID NO: 3518751 - DNA, 14 bp, Homo sapiens
aggtgaggcctgtc

SEQ ID NO: 3518752 - DNA, 20 bp, Homo sapiens
aggtgaggcctgtctgtgac

SEQ ID NO: 3518753 - DNA, 12 bp, Homo sapiens
aggtgagtgggt

SEQ ID NO: 3518754 - DNA, 22 bp, Homo sapiens
aggtgatggtcatcgagatgga

SEQ ID NO: 3518755 - DNA, 13 bp, Homo sapiens
aggtgcagaggaa

SEQ ID NO: 3518756 - DNA, 18 bp, Homo sapiens
aggtgcagccagaggcac

SEQ ID NO: 3518757 - DNA, 16 bp, Homo sapiens
aggtgcagctcctcag

SEQ ID NO: 3518758 - DNA, 17 bp, Homo sapiens
aggtgcagctcctcagc

SEQ ID NO: 3518759 - DNA, 19 bp, Homo sapiens
aggtgcctgccatagccag

SEQ ID NO: 3518760 - DNA, 23 bp, Homo sapiens
aggtgcctgccatagccaggagc

SEQ ID NO: 3518761 - DNA, 22 bp, Homo sapiens
aggtgccttcttcagggcctgg

SEQ ID NO: 3518762 - DNA, 18 bp, Homo sapiens
aggtgcctttcaaattta

SEQ ID NO: 3518763 - DNA, 19 bp, Homo sapiens
aggtgcctttcaaatttag

SEQ ID NO: 3518764 - DNA, 15 bp, Homo sapiens
aggtgctaaatctgc

SEQ ID NO: 3518765 - DNA, 17 bp, Homo sapiens
aggtgctgacggccagg

SEQ ID NO: 3518766 - DNA, 20 bp, Homo sapiens
aggtgctgacggccagggag

SEQ ID NO: 3518767 - DNA, 14 bp, Homo sapiens
aggtgctgtccatg

SEQ ID NO: 3518768 - DNA, 22 bp, Homo sapiens
aggtggaaaaactgagacaggc

SEQ ID NO: 3518769 - DNA, 23 bp, Homo sapiens
aggtggaaggaccctgtgccctc

SEQ ID NO: 3518770 - DNA, 18 bp, Homo sapiens
aggtggccatgcctcagc

SEQ ID NO: 3518771 - DNA, 18 bp, Homo sapiens
aggtggggagactgggct

SEQ ID NO: 3518772 - DNA, 13 bp, Homo sapiens
aggtggggagtca

SEQ ID NO: 3518773 - DNA, 21 bp, Homo sapiens
aggtgtcaacttttgaccaaa

SEQ ID NO: 3518774 - DNA, 23 bp, Homo sapiens
aggtgtccagcattgctggactc

SEQ ID NO: 3518775 - DNA, 17 bp, Homo sapiens
aggtgtgaaccaccaca

SEQ ID NO: 3518776 - DNA, 22 bp, Homo sapiens
aggtgtgaaccaccacacccag

SEQ ID NO: 3518777 - DNA, 13 bp, Homo sapiens
aggtgtgaggagg

SEQ ID NO: 3518778 - DNA, 12 bp, Homo sapiens
aggtgtgctctg

SEQ ID NO: 3518779 - DNA, 20 bp, Homo sapiens
aggtgtgctctgatcatcca

SEQ ID NO: 3518780 - DNA, 16 bp, Homo sapiens
aggtgtgtgagactac

SEQ ID NO: 3518781 - DNA, 15 bp, Homo sapiens
aggtgttactgtaat

SEQ ID NO: 3518782 - DNA, 18 bp, Homo sapiens
aggtgttggtgacaattg

SEQ ID NO: 3518783 - DNA, 15 bp, Homo sapiens
aggtgttgtcccttc

SEQ ID NO: 3518784 - DNA, 17 bp, Homo sapiens
aggtgtttattaaaatt

SEQ ID NO: 3518785 - DNA, 18 bp, Homo sapiens
aggtgtttattaaaattc

SEQ ID NO: 3518786 - DNA, 17 bp, Homo sapiens
aggttatctgtcccagg

SEQ ID NO: 3518787 - DNA, 14 bp, Homo sapiens
aggttcaacttatt

SEQ ID NO: 3518788 - DNA, 22 bp, Homo sapiens
aggttctctcctccccaaggag

SEQ ID NO: 3518789 - DNA, 17 bp, Homo sapiens
aggttctgcctgctttg

SEQ ID NO: 3518790 - DNA, 19 bp, Homo sapiens
aggttcttcccttttacat

SEQ ID NO: 3518791 - DNA, 23 bp, Homo sapiens
aggttcttcccttttacatactg

SEQ ID NO: 3518792 - DNA, 19 bp, Homo sapiens
aggttcttcttgttctgag

SEQ ID NO: 3518793 - DNA, 20 bp, Homo sapiens
aggttgagcaatttccccct

SEQ ID NO: 3518794 - DNA, 16 bp, Homo sapiens
aggttgatcagatctg

SEQ ID NO: 3518795 - DNA, 21 bp, Homo sapiens
aggttggaactatgcagtgtg

SEQ ID NO: 3518796 - DNA, 14 bp, Homo sapiens
aggtttaagctgtt

SEQ ID NO: 3518797 - DNA, 20 bp, Homo sapiens
aggtttaggctggtggccca

SEQ ID NO: 3518798 - DNA, 22 bp, Homo sapiens
aggtttctggtctctaggctgg

SEQ ID NO: 3518799 - DNA, 13 bp, Homo sapiens
aggttttgtaaag

SEQ ID NO: 3518800 - DNA, 21 bp, Homo sapiens
aggttttgttttttttcagcc

SEQ ID NO: 3518801 - DNA, 20 bp, Homo sapiens
aggtttttattagtaccata

SEQ ID NO: 3518802 - DNA, 12 bp, Homo sapiens
agtaaaaataca

SEQ ID NO: 3518803 - DNA, 13 bp, Homo sapiens
agtaaaaatacaa

SEQ ID NO: 3518804 - DNA, 19 bp, Homo sapiens
agtaaaaatacaaaaatta

SEQ ID NO: 3518805 - DNA, 16 bp, Homo sapiens
agtaaaattgccatat

SEQ ID NO: 3518806 - DNA, 18 bp, Homo sapiens
agtaaagtgataatttct

SEQ ID NO: 3518807 - DNA, 10 bp, Homo sapiens
agtaaatgtt

SEQ ID NO: 3518808 - DNA, 23 bp, Homo sapiens
agtaaccatcactggttgcactt

SEQ ID NO: 3518809 - DNA, 18 bp, Homo sapiens
agtaaggagttcatttta

SEQ ID NO: 3518810 - DNA, 14 bp, Homo sapiens
agtaatgagtttaa

SEQ ID NO: 3518811 - DNA, 18 bp, Homo sapiens
agtaattgacatgtgcca

SEQ ID NO: 3518812 - DNA, 14 bp, Homo sapiens
agtaatttcctaga

SEQ ID NO: 3518813 - DNA, 14 bp, Homo sapiens
agtaatttcttttt

SEQ ID NO: 3518814 - DNA, 14 bp, Homo sapiens
agtaatttgtaaag

SEQ ID NO: 3518815 - DNA, 13 bp, Homo sapiens
agtacagtggtgc

SEQ ID NO: 3518816 - DNA, 23 bp, Homo sapiens
agtaccccctcaaaccctgccct

SEQ ID NO: 3518817 - DNA, 12 bp, Homo sapiens
agtaccttgctt

SEQ ID NO: 3518818 - DNA, 22 bp, Homo sapiens
agtacctttcctacattttctt

SEQ ID NO: 3518819 - DNA, 14 bp, Homo sapiens
agtactagaaactg

SEQ ID NO: 3518820 - DNA, 19 bp, Homo sapiens
agtactattttaatttgta

SEQ ID NO: 3518821 - DNA, 23 bp, Homo sapiens
agtactattttaatttgtattga

SEQ ID NO: 3518822 - DNA, 13 bp, Homo sapiens
agtactgtgggca

SEQ ID NO: 3518823 - DNA, 18 bp, Homo sapiens
agtactgtgggcaattta

SEQ ID NO: 3518824 - DNA, 22 bp, Homo sapiens
agtactgtgggcaatttagaaa

SEQ ID NO: 3518825 - DNA, 20 bp, Homo sapiens
agtacttctccaccctgctc

SEQ ID NO: 3518826 - DNA, 21 bp, Homo sapiens
agtacttctccaccctgctct

SEQ ID NO: 3518827 - DNA, 22 bp, Homo sapiens
agtacttctccaccctgctctc

SEQ ID NO: 3518828 - DNA, 19 bp, Homo sapiens
agtactttggaggccccta

SEQ ID NO: 3518829 - DNA, 13 bp, Homo sapiens
agtacttttttaa

SEQ ID NO: 3518830 - DNA, 23 bp, Homo sapiens
agtacttttttaaatattttcta

SEQ ID NO: 3518831 - DNA, 15 bp, Homo sapiens
agtagaaaggccttt

SEQ ID NO: 3518832 - DNA, 19 bp, Homo sapiens
agtagaaataatatgcatt

SEQ ID NO: 3518833 - DNA, 14 bp, Homo sapiens
agtagaatctcagt

SEQ ID NO: 3518834 - DNA, 20 bp, Homo sapiens
agtagaccttgttacttctg

SEQ ID NO: 3518835 - DNA, 20 bp, Homo sapiens
agtagatgcgcagccccatc

SEQ ID NO: 3518836 - DNA, 21 bp, Homo sapiens
agtagatgcgcagccccatct

SEQ ID NO: 3518837 - DNA, 22 bp, Homo sapiens
agtagattctggacagtcagct

SEQ ID NO: 3518838 - DNA, 13 bp, Homo sapiens
agtagctgggact

SEQ ID NO: 3518839 - DNA, 14 bp, Homo sapiens
agtagctgggacta

SEQ ID NO: 3518840 - DNA, 21 bp, Homo sapiens
agtagctgggactacaggcac

SEQ ID NO: 3518841 - DNA, 22 bp, Homo sapiens
agtagctgggactacaggcacc

SEQ ID NO: 3518842 - DNA, 20 bp, Homo sapiens
agtaggaaatacaataaata

SEQ ID NO: 3518843 - DNA, 16 bp, Homo sapiens
agtagtagtatggcac

SEQ ID NO: 3518844 - DNA, 21 bp, Homo sapiens
agtagtttttacagctgtgtt

SEQ ID NO: 3518845 - DNA, 17 bp, Homo sapiens
agtataaaatacaacaa

SEQ ID NO: 3518846 - DNA, 13 bp, Homo sapiens
agtataaacaaag

SEQ ID NO: 3518847 - DNA, 23 bp, Homo sapiens
agtatactagggagccatttgag

SEQ ID NO: 3518848 - DNA, 17 bp, Homo sapiens
agtatcactgtctttcc

SEQ ID NO: 3518849 - DNA, 15 bp, Homo sapiens
agtatcatgccctgt

SEQ ID NO: 3518850 - DNA, 21 bp, Homo sapiens
agtatccatgctcttgacctt

SEQ ID NO: 3518851 - DNA, 14 bp, Homo sapiens
ataaattcactttc

SEQ ID NO: 3518852 - DNA, 23 bp, Homo sapiens
ataaattcactttcatttttgat

SEQ ID NO: 3518853 - DNA, 15 bp, Homo sapiens
ataaattgccataat

SEQ ID NO: 3518854 - DNA, 19 bp, Homo sapiens
ataaattgccataatatga

SEQ ID NO: 3518855 - DNA, 15 bp, Homo sapiens
ataaatttatatgaa

SEQ ID NO: 3518856 - DNA, 20 bp, Homo sapiens
ataaatttggttctaataga

SEQ ID NO: 3518857 - DNA, 15 bp, Homo sapiens
ataacaattcctcta

SEQ ID NO: 3518858 - DNA, 14 bp, Homo sapiens
ataacacacagcta

SEQ ID NO: 3518859 - DNA, 16 bp, Homo sapiens
ataacagtaaatgtgc

SEQ ID NO: 3518860 - DNA, 14 bp, Homo sapiens
ataacatatgcagt

SEQ ID NO: 3518861 - DNA, 19 bp, Homo sapiens
ataacatttaatttagata

SEQ ID NO: 3518862 - DNA, 21 bp, Homo sapiens
ataacggatcagaaatacaga

SEQ ID NO: 3518863 - DNA, 21 bp, Homo sapiens
ataactagatggtgctgagaa

SEQ ID NO: 3518864 - DNA, 22 bp, Homo sapiens
ataagaaaaccaccccttagat

SEQ ID NO: 3518865 - DNA, 16 bp, Homo sapiens
ataagaactttgagct

SEQ ID NO: 3518866 - DNA, 18 bp, Homo sapiens
ataagaataaaatgttga

SEQ ID NO: 3518867 - DNA, 20 bp, Homo sapiens
ataagactaaatgattagaa

SEQ ID NO: 3518868 - DNA, 21 bp, Homo sapiens
ataagattccaaaaagcacat

SEQ ID NO: 3518869 - DNA, 22 bp, Homo sapiens
ataagattccaaaaagcacata

SEQ ID NO: 3518870 - DNA, 20 bp, Homo sapiens
ataagctatccgtgttgcag

SEQ ID NO: 3518871 - DNA, 24 bp, Homo sapiens
ataaggaaatcaacttgcttatca

SEQ ID NO: 3518872 - DNA, 13 bp, Homo sapiens
ataagggcagagt

SEQ ID NO: 3518873 - DNA, 16 bp, Homo sapiens
ataaggtaaaatgcca

SEQ ID NO: 3518874 - DNA, 18 bp, Homo sapiens
ataaggtaaaatgccatg

SEQ ID NO: 3518875 - DNA, 13 bp, Homo sapiens
ataagtaagaaaa

SEQ ID NO: 3518876 - DNA, 17 bp, Homo sapiens
ataagtaagaaaatatt

SEQ ID NO: 3518877 - DNA, 19 bp, Homo sapiens
ataagtaagaaaatatttt

SEQ ID NO: 3518878 - DNA, 16 bp, Homo sapiens
ataagtatttcaaatt

SEQ ID NO: 3518879 - DNA, 16 bp, Homo sapiens
ataagtcattgtatgt

SEQ ID NO: 3518880 - DNA, 14 bp, Homo sapiens
ataagtgaaaatct

SEQ ID NO: 3518881 - DNA, 17 bp, Homo sapiens
ataagtgctgtataaaa

SEQ ID NO: 3518882 - DNA, 18 bp, Homo sapiens
ataagtgctgtataaaat

SEQ ID NO: 3518883 - DNA, 20 bp, Homo sapiens
ataagtgctgtataaaatca

SEQ ID NO: 3518884 - DNA, 19 bp, Homo sapiens
ataagtggaggcactttag

SEQ ID NO: 3518885 - DNA, 18 bp, Homo sapiens
ataagttatttttgtaca

SEQ ID NO: 3518886 - DNA, 16 bp, Homo sapiens
ataagttcctttcctt

SEQ ID NO: 3518887 - DNA, 17 bp, Homo sapiens
ataagttttttttctgg

SEQ ID NO: 3518888 - DNA, 12 bp, Homo sapiens
ataataaaatag

SEQ ID NO: 3518889 - DNA, 17 bp, Homo sapiens
ataataaacgatgttgt

SEQ ID NO: 3518890 - DNA, 20 bp, Homo sapiens
ataataaacgatgttgtgat

SEQ ID NO: 3518891 - DNA, 13 bp, Homo sapiens
ataataaaggaac

SEQ ID NO: 3518892 - DNA, 17 bp, Homo sapiens
ataataaaggttgtgaa

SEQ ID NO: 3518893 - DNA, 13 bp, Homo sapiens
ataataaattaaa

SEQ ID NO: 3518894 - DNA, 17 bp, Homo sapiens
ataataagcaggatgtt

SEQ ID NO: 3518895 - DNA, 19 bp, Homo sapiens
ataatacagtatctcaggg

SEQ ID NO: 3518896 - DNA, 22 bp, Homo sapiens
ataatactatatttatactgta

SEQ ID NO: 3518897 - DNA, 13 bp, Homo sapiens
ataatatacttgt

SEQ ID NO: 3518898 - DNA, 14 bp, Homo sapiens
ataatatatttgtg

SEQ ID NO: 3518899 - DNA, 17 bp, Homo sapiens
ataatatctaaagttat

SEQ ID NO: 3518900 - DNA, 21 bp, Homo sapiens
ataatctgtgagtgaaagttg

SEQ ID NO: 3518901 - DNA, 19 bp, Homo sapiens
ataatgacactgtttcctg

SEQ ID NO: 3518902 - DNA, 20 bp, Homo sapiens
ataatgacactgtttcctga

SEQ ID NO: 3518903 - DNA, 21 bp, Homo sapiens
ataatgacactgtttcctgat

SEQ ID NO: 3518904 - DNA, 11 bp, Homo sapiens
ataatgcagta

SEQ ID NO: 3518905 - DNA, 15 bp, Homo sapiens
ataatgcagtatggt

SEQ ID NO: 3518906 - DNA, 18 bp, Homo sapiens
ataatgcagtatggtaca

SEQ ID NO: 3518907 - DNA, 21 bp, Homo sapiens
ataatgctaatttaaagagac

SEQ ID NO: 3518908 - DNA, 17 bp, Homo sapiens
ataatgctcacttggtc

SEQ ID NO: 3518909 - DNA, 23 bp, Homo sapiens
ataatgggccactgaaatctgtc

SEQ ID NO: 3518910 - DNA, 14 bp, Homo sapiens
ataatgtaattgta

SEQ ID NO: 3518911 - DNA, 16 bp, Homo sapiens
ataatgtaatttagtc

SEQ ID NO: 3518912 - DNA, 19 bp, Homo sapiens
ataatgtctctgtgagact

SEQ ID NO: 3518913 - DNA, 16 bp, Homo sapiens
ataatgtgaaaatggt

SEQ ID NO: 3518914 - DNA, 17 bp, Homo sapiens
ataatgttgtatttaat

SEQ ID NO: 3518915 - DNA, 20 bp, Homo sapiens
ataatgttgtatttaatttt

SEQ ID NO: 3518916 - DNA, 15 bp, Homo sapiens
ataatttaatgcatg

SEQ ID NO: 3518917 - DNA, 19 bp, Homo sapiens
ataatttgtacatatgtaa

SEQ ID NO: 3518918 - DNA, 20 bp, Homo sapiens
ataattttagtaatttccta

SEQ ID NO: 3518919 - DNA, 20 bp, Homo sapiens
ataatttttttcaatattta

SEQ ID NO: 3518920 - DNA, 15 bp, Homo sapiens
atacaaaaatttgcc

SEQ ID NO: 3518921 - DNA, 18 bp, Homo sapiens
atacaaattagaaaatgt

SEQ ID NO: 3518922 - DNA, 19 bp, Homo sapiens
atacaagatattatgtata

SEQ ID NO: 3518923 - DNA, 12 bp, Homo sapiens
atacaataaatt

SEQ ID NO: 3518924 - DNA, 17 bp, Homo sapiens
atacaataaattgctaa

SEQ ID NO: 3518925 - DNA, 14 bp, Homo sapiens
atacaataatgtaa

SEQ ID NO: 3518926 - DNA, 20 bp, Homo sapiens
atacaataatgtaatttagt

SEQ ID NO: 3518927 - DNA, 15 bp, Homo sapiens
atacaattctacatt

SEQ ID NO: 3518928 - DNA, 23 bp, Homo sapiens
atacaccccctcttctgagcaca

SEQ ID NO: 3518929 - DNA, 22 bp, Homo sapiens
atacactatttgtgagcaaagg

SEQ ID NO: 3518930 - DNA, 20 bp, Homo sapiens
atacactgtatgttatagaa

SEQ ID NO: 3518931 - DNA, 19 bp, Homo sapiens
atacagattttgatagcaa

SEQ ID NO: 3518932 - DNA, 13 bp, Homo sapiens
atacagctttctg

SEQ ID NO: 3518933 - DNA, 19 bp, Homo sapiens
atacaggaaaagctgctga

SEQ ID NO: 3518934 - DNA, 23 bp, Homo sapiens
atacaggaaaagctgctgacagt

SEQ ID NO: 3518935 - DNA, 15 bp, Homo sapiens
atacaggaacaacat

SEQ ID NO: 3518936 - DNA, 19 bp, Homo sapiens
atacagtcttccatttgca

SEQ ID NO: 3518937 - DNA, 20 bp, Homo sapiens
atacatatctttattaatca

SEQ ID NO: 3518938 - DNA, 17 bp, Homo sapiens
atacattctgtaataca

SEQ ID NO: 3518939 - DNA, 14 bp, Homo sapiens
ataccatcttctgt

SEQ ID NO: 3518940 - DNA, 14 bp, Homo sapiens
atacccagagcacc

SEQ ID NO: 3518941 - DNA, 16 bp, Homo sapiens
atacctgtgcctcggc

SEQ ID NO: 3518942 - DNA, 19 bp, Homo sapiens
atacgctactataaagaga

SEQ ID NO: 3518943 - DNA, 16 bp, Homo sapiens
atactagggagccatt

SEQ ID NO: 3518944 - DNA, 21 bp, Homo sapiens
atactattaaaaaggtttaca

SEQ ID NO: 3518945 - DNA, 21 bp, Homo sapiens
atactcatgaccattagaata

SEQ ID NO: 3518946 - DNA, 14 bp, Homo sapiens
atactcatttctta

SEQ ID NO: 3518947 - DNA, 14 bp, Homo sapiens
atactccaaagatg

SEQ ID NO: 3518948 - DNA, 21 bp, Homo sapiens
atactcttaggaagagaaacc

SEQ ID NO: 3518949 - DNA, 17 bp, Homo sapiens
atactctttctgtatat

SEQ ID NO: 3518950 - DNA, 23 bp, Homo sapiens
atactctttctgtatatactttt

SEQ ID NO: 3518951 - DNA, 19 bp, Homo sapiens
atactgactgagaatataa

SEQ ID NO: 3518952 - DNA, 16 bp, Homo sapiens
atactgcaagaaaatg

SEQ ID NO: 3518953 - DNA, 15 bp, Homo sapiens
atactgctactgtaa

SEQ ID NO: 3518954 - DNA, 20 bp, Homo sapiens
atactgctactgtaatttta

SEQ ID NO: 3518955 - DNA, 18 bp, Homo sapiens
atactgctgagatacata

SEQ ID NO: 3518956 - DNA, 22 bp, Homo sapiens
atactgctgagatacatacaga

SEQ ID NO: 3518957 - DNA, 15 bp, Homo sapiens
atactggaggaacac

SEQ ID NO: 3518958 - DNA, 13 bp, Homo sapiens
atactgtacaata

SEQ ID NO: 3518959 - DNA, 17 bp, Homo sapiens
atactgtctctttcatg

SEQ ID NO: 3518960 - DNA, 15 bp, Homo sapiens
atacttaacaaatac

SEQ ID NO: 3518961 - DNA, 22 bp, Homo sapiens
atacttaacaaatacattcaaa

SEQ ID NO: 3518962 - DNA, 22 bp, Homo sapiens
atacttagttcatggcttttct

SEQ ID NO: 3518963 - DNA, 21 bp, Homo sapiens
atacttgaacttgcctctttt

SEQ ID NO: 3518964 - DNA, 14 bp, Homo sapiens
atacttgaacttgt

SEQ ID NO: 3518965 - DNA, 18 bp, Homo sapiens
atacttgaagggccagag

SEQ ID NO: 3518966 - DNA, 19 bp, Homo sapiens
atacttgaagggccagagc

SEQ ID NO: 3518967 - DNA, 21 bp, Homo sapiens
atacttgaagggccagagcca

SEQ ID NO: 3518968 - DNA, 20 bp, Homo sapiens
atacttgtggactaaaagat

SEQ ID NO: 3518969 - DNA, 13 bp, Homo sapiens
atacttttcctta

SEQ ID NO: 3518970 - DNA, 20 bp, Homo sapiens
atactttttacaattaaaaa

SEQ ID NO: 3518971 - DNA, 23 bp, Homo sapiens
atagaaaacctaattaaggaagt

SEQ ID NO: 3518972 - DNA, 16 bp, Homo sapiens
atagaaatgccaagca

SEQ ID NO: 3518973 - DNA, 17 bp, Homo sapiens
atagaaatgccaagcac

SEQ ID NO: 3518974 - DNA, 13 bp, Homo sapiens
atagaagtaaaaa

SEQ ID NO: 3518975 - DNA, 12 bp, Homo sapiens
atagaatattta

SEQ ID NO: 3518976 - DNA, 19 bp, Homo sapiens
atagaatatttattacctc

SEQ ID NO: 3518977 - DNA, 12 bp, Homo sapiens
atagagaatgtt

SEQ ID NO: 3518978 - DNA, 17 bp, Homo sapiens
atagagaatgttccaga

SEQ ID NO: 3518979 - DNA, 13 bp, Homo sapiens
atagagcctgagg

SEQ ID NO: 3518980 - DNA, 19 bp, Homo sapiens
atagaggctaaattactca

SEQ ID NO: 3518981 - DNA, 13 bp, Homo sapiens
atagagtccagat

SEQ ID NO: 3518982 - DNA, 13 bp, Homo sapiens
atagatcatttct

SEQ ID NO: 3518983 - DNA, 22 bp, Homo sapiens
atctctcttgggccaagccagc

SEQ ID NO: 3518984 - DNA, 19 bp, Homo sapiens
atctctgcctgacaaggcc

SEQ ID NO: 3518985 - DNA, 14 bp, Homo sapiens
atctctgtgccttc

SEQ ID NO: 3518986 - DNA, 15 bp, Homo sapiens
atctctgtgccttcg

SEQ ID NO: 3518987 - DNA, 16 bp, Homo sapiens
atctcttattttacaa

SEQ ID NO: 3518988 - DNA, 11 bp, Homo sapiens
atctctttaga

SEQ ID NO: 3518989 - DNA, 13 bp, Homo sapiens
atctctttcacat

SEQ ID NO: 3518990 - DNA, 12 bp, Homo sapiens
atctcttttata

SEQ ID NO: 3518991 - DNA, 20 bp, Homo sapiens
atctcttttatatttgtagg

SEQ ID NO: 3518992 - DNA, 10 bp, Homo sapiens
atctcttttc

SEQ ID NO: 3518993 - DNA, 23 bp, Homo sapiens
atctcttttccactccattgtcg

SEQ ID NO: 3518994 - DNA, 22 bp, Homo sapiens
atctgacactaccttatcaggc

SEQ ID NO: 3518995 - DNA, 16 bp, Homo sapiens
atctgaccagcagcgc

SEQ ID NO: 3518996 - DNA, 14 bp, Homo sapiens
atctgacccagtgc

SEQ ID NO: 3518997 - DNA, 18 bp, Homo sapiens
atctgacccagtgccccc

SEQ ID NO: 3518998 - DNA, 13 bp, Homo sapiens
atctgagaatctt

SEQ ID NO: 3518999 - DNA, 14 bp, Homo sapiens
atctgagaatcttt

SEQ ID NO: 3519000 - DNA, 16 bp, Homo sapiens
atctgagaatctttat

SEQ ID NO: 3519001 - DNA, 18 bp, Homo sapiens
atctgatggcttctccag

SEQ ID NO: 3519002 - DNA, 18 bp, Homo sapiens
atctgcaatttctactac

SEQ ID NO: 3519003 - DNA, 17 bp, Homo sapiens
atctgcacccccctggg

SEQ ID NO: 3519004 - DNA, 14 bp, Homo sapiens
atctgcaggcagac

SEQ ID NO: 3519005 - DNA, 15 bp, Homo sapiens
atctgcaggcagaca

SEQ ID NO: 3519006 - DNA, 16 bp, Homo sapiens
atctgcaggcagacac

SEQ ID NO: 3519007 - DNA, 23 bp, Homo sapiens
atctgcaggggtctgggagtcag

SEQ ID NO: 3519008 - DNA, 20 bp, Homo sapiens
atctgcattgcccagtcttt

SEQ ID NO: 3519009 - DNA, 21 bp, Homo sapiens
atctgcccaactgtgtagcat

SEQ ID NO: 3519010 - DNA, 17 bp, Homo sapiens
atctgcctgacaggctg

SEQ ID NO: 3519011 - DNA, 16 bp, Homo sapiens
atctgcctttattgtg

SEQ ID NO: 3519012 - DNA, 21 bp, Homo sapiens
atctgcctttattgtgtttgt

SEQ ID NO: 3519013 - DNA, 22 bp, Homo sapiens
atctgcctttattgtgtttgtc

SEQ ID NO: 3519014 - DNA, 20 bp, Homo sapiens
atctgcgtgcacttcccaga

SEQ ID NO: 3519015 - DNA, 18 bp, Homo sapiens
atctgctcactttaaacc

SEQ ID NO: 3519016 - DNA, 14 bp, Homo sapiens
atctgctctccttc

SEQ ID NO: 3519017 - DNA, 14 bp, Homo sapiens
atctgctggagttt

SEQ ID NO: 3519018 - DNA, 16 bp, Homo sapiens
atctggaacccagact

SEQ ID NO: 3519019 - DNA, 18 bp, Homo sapiens
atctggaacccagactca

SEQ ID NO: 3519020 - DNA, 17 bp, Homo sapiens
atctggaacctcagcct

SEQ ID NO: 3519021 - DNA, 21 bp, Homo sapiens
atctggaagccaaaatgtagg

SEQ ID NO: 3519022 - DNA, 16 bp, Homo sapiens
atctggaatctgaggc

SEQ ID NO: 3519023 - DNA, 21 bp, Homo sapiens
atctggaatctggagaccagg

SEQ ID NO: 3519024 - DNA, 22 bp, Homo sapiens
atctggagaccagggagccttt

SEQ ID NO: 3519025 - DNA, 22 bp, Homo sapiens
atctgtcaagagtagttatata

SEQ ID NO: 3519026 - DNA, 17 bp, Homo sapiens
atctgtcatttgagcag

SEQ ID NO: 3519027 - DNA, 21 bp, Homo sapiens
atctgtcctcagccttgccag

SEQ ID NO: 3519028 - DNA, 17 bp, Homo sapiens
atctgtctaaagataga

SEQ ID NO: 3519029 - DNA, 16 bp, Homo sapiens
atctgtctggtggccc

SEQ ID NO: 3519030 - DNA, 22 bp, Homo sapiens
atctgtcttgccagccagaagc

SEQ ID NO: 3519031 - DNA, 21 bp, Homo sapiens
atctgtgaaatgctggcattt

SEQ ID NO: 3519032 - DNA, 22 bp, Homo sapiens
atctgtgcaaatccttgatact

SEQ ID NO: 3519033 - DNA, 16 bp, Homo sapiens
atctgtgcattctcct

SEQ ID NO: 3519034 - DNA, 19 bp, Homo sapiens
atctgttgcaagcccctct

SEQ ID NO: 3519035 - DNA, 13 bp, Homo sapiens
atctgtttcccag

SEQ ID NO: 3519036 - DNA, 18 bp, Homo sapiens
atcttagatgtttcacac

SEQ ID NO: 3519037 - DNA, 13 bp, Homo sapiens
atcttattcacat

SEQ ID NO: 3519038 - DNA, 17 bp, Homo sapiens
atcttcacccaggccta

SEQ ID NO: 3519039 - DNA, 19 bp, Homo sapiens
atcttcagtttaatgcaag

SEQ ID NO: 3519040 - DNA, 15 bp, Homo sapiens
atcttcctgtgtcct

SEQ ID NO: 3519041 - DNA, 18 bp, Homo sapiens
atcttcgggaccaggatt

SEQ ID NO: 3519042 - DNA, 14 bp, Homo sapiens
atcttcttcaccat

SEQ ID NO: 3519043 - DNA, 22 bp, Homo sapiens
atcttgaaattaagaaggcaaa

SEQ ID NO: 3519044 - DNA, 17 bp, Homo sapiens
atcttgaccaagcagga

SEQ ID NO: 3519045 - DNA, 15 bp, Homo sapiens
atcttgctctgctga

SEQ ID NO: 3519046 - DNA, 14 bp, Homo sapiens
atcttgcttcccta

SEQ ID NO: 3519047 - DNA, 15 bp, Homo sapiens
atcttgcttccctaa

SEQ ID NO: 3519048 - DNA, 19 bp, Homo sapiens
atcttgctttctttagaat

SEQ ID NO: 3519049 - DNA, 16 bp, Homo sapiens
atcttgggggggtggc

SEQ ID NO: 3519050 - DNA, 20 bp, Homo sapiens
atcttgggggggtggccgct

SEQ ID NO: 3519051 - DNA, 14 bp, Homo sapiens
atcttggtttgcct

SEQ ID NO: 3519052 - DNA, 18 bp, Homo sapiens
atcttgtaggatctactt

SEQ ID NO: 3519053 - DNA, 14 bp, Homo sapiens
atcttgtctcaatg

SEQ ID NO: 3519054 - DNA, 20 bp, Homo sapiens
atcttgtctcaatgctcata

SEQ ID NO: 3519055 - DNA, 23 bp, Homo sapiens
atcttgtttttccactactgcta

SEQ ID NO: 3519056 - DNA, 17 bp, Homo sapiens
atctttacaaaactaca

SEQ ID NO: 3519057 - DNA, 16 bp, Homo sapiens
atctttattgagaaag

SEQ ID NO: 3519058 - DNA, 17 bp, Homo sapiens
atctttattgagaaaga

SEQ ID NO: 3519059 - DNA, 15 bp, Homo sapiens
atctttctttcttag

SEQ ID NO: 3519060 - DNA, 20 bp, Homo sapiens
atctttctttcttagaaatt

SEQ ID NO: 3519061 - DNA, 18 bp, Homo sapiens
atctttgattctccttca

SEQ ID NO: 3519062 - DNA, 16 bp, Homo sapiens
atctttgtggccaagg

SEQ ID NO: 3519063 - DNA, 23 bp, Homo sapiens
atctttgtggccaaggagctgct

SEQ ID NO: 3519064 - DNA, 14 bp, Homo sapiens
atcttttaaagaaa

SEQ ID NO: 3519065 - DNA, 22 bp, Homo sapiens
atcttttgtttccttttttccc

SEQ ID NO: 3519066 - DNA, 17 bp, Homo sapiens
atgaaaaactatgtcag

SEQ ID NO: 3519067 - DNA, 12 bp, Homo sapiens
atgaaaacttat

SEQ ID NO: 3519068 - DNA, 14 bp, Homo sapiens
atgaaaatgtcttg

SEQ ID NO: 3519069 - DNA, 22 bp, Homo sapiens
atgaaaatgttacaagctaaga

SEQ ID NO: 3519070 - DNA, 14 bp, Homo sapiens
atgaaagaaaggcc

SEQ ID NO: 3519071 - DNA, 15 bp, Homo sapiens
atgaaagggcccaga

SEQ ID NO: 3519072 - DNA, 13 bp, Homo sapiens
atgaaatatgcat

SEQ ID NO: 3519073 - DNA, 13 bp, Homo sapiens
atgaaatgtatgt

SEQ ID NO: 3519074 - DNA, 17 bp, Homo sapiens
atgaaatttttgtaaat

SEQ ID NO: 3519075 - DNA, 22 bp, Homo sapiens
atgaaccacatcttgctctgct

SEQ ID NO: 3519076 - DNA, 20 bp, Homo sapiens
atgaaccagccggggcctta

SEQ ID NO: 3519077 - DNA, 21 bp, Homo sapiens
atgaaccttctggcctcccac

SEQ ID NO: 3519078 - DNA, 24 bp, Homo sapiens
atgaaccttctggcctcccacaga

SEQ ID NO: 3519079 - DNA, 18 bp, Homo sapiens
atgaacttgtaaaggaat

SEQ ID NO: 3519080 - DNA, 14 bp, Homo sapiens
atgaagaaagtgga

SEQ ID NO: 3519081 - DNA, 14 bp, Homo sapiens
atgaagacttaaaa

SEQ ID NO: 3519082 - DNA, 22 bp, Homo sapiens
atgaagatatttgctttaataa

SEQ ID NO: 3519083 - DNA, 21 bp, Homo sapiens
atgaaggagaggcaacatcca

SEQ ID NO: 3519084 - DNA, 13 bp, Homo sapiens
atgaagtttgaat

SEQ ID NO: 3519085 - DNA, 14 bp, Homo sapiens
atgaagtttgaatg

SEQ ID NO: 3519086 - DNA, 19 bp, Homo sapiens
atgaagtttgaatgttaaa

SEQ ID NO: 3519087 - DNA, 18 bp, Homo sapiens
atgaatgaacccctggct

SEQ ID NO: 3519088 - DNA, 14 bp, Homo sapiens
atgaatgaatgaat

SEQ ID NO: 3519089 - DNA, 14 bp, Homo sapiens
atgaatgagaatgt

SEQ ID NO: 3519090 - DNA, 15 bp, Homo sapiens
atgaatgtatttatt

SEQ ID NO: 3519091 - DNA, 22 bp, Homo sapiens
atgaattgtacagaatatttct

SEQ ID NO: 3519092 - DNA, 15 bp, Homo sapiens
atgaattttaagggt

SEQ ID NO: 3519093 - DNA, 16 bp, Homo sapiens
atgaattttaagggtt

SEQ ID NO: 3519094 - DNA, 21 bp, Homo sapiens
atgaatttttttcatcttctc

SEQ ID NO: 3519095 - DNA, 14 bp, Homo sapiens
atgacaaaaaatgt

SEQ ID NO: 3519096 - DNA, 17 bp, Homo sapiens
atgacaaaaaatgtttt

SEQ ID NO: 3519097 - DNA, 13 bp, Homo sapiens
atgacaagatggt

SEQ ID NO: 3519098 - DNA, 14 bp, Homo sapiens
atgacaagatggta

SEQ ID NO: 3519099 - DNA, 17 bp, Homo sapiens
atgacacagttatcaaa

SEQ ID NO: 3519100 - DNA, 15 bp, Homo sapiens
atgacactgtttcct

SEQ ID NO: 3519101 - DNA, 17 bp, Homo sapiens
atgacagccagagcctg

SEQ ID NO: 3519102 - DNA, 16 bp, Homo sapiens
atgacagcctgcagca

SEQ ID NO: 3519103 - DNA, 17 bp, Homo sapiens
atgacatggaggcactg

SEQ ID NO: 3519104 - DNA, 20 bp, Homo sapiens
atgacattggatagaacatg

SEQ ID NO: 3519105 - DNA, 22 bp, Homo sapiens
atgacatttctttgtgctttgg

SEQ ID NO: 3519106 - DNA, 15 bp, Homo sapiens
atgaccaaagtcctt

SEQ ID NO: 3519107 - DNA, 22 bp, Homo sapiens
atgacccaggctgggcaaggag

SEQ ID NO: 3519108 - DNA, 19 bp, Homo sapiens
atgactcaggacatccccc

SEQ ID NO: 3519109 - DNA, 16 bp, Homo sapiens
atgactcgggggtggg

SEQ ID NO: 3519110 - DNA, 14 bp, Homo sapiens
atgactgccttgcc

SEQ ID NO: 3519111 - DNA, 11 bp, Homo sapiens
atgagaaactg

SEQ ID NO: 3519112 - DNA, 23 bp, Homo sapiens
atgagaagaaaatggaaccaggc

SEQ ID NO: 3519113 - DNA, 16 bp, Homo sapiens
atgagaaggaacttcc

SEQ ID NO: 3519114 - DNA, 23 bp, Homo sapiens
atgagaatctacccccagatcca

SEQ ID NO: 3519115 - DNA, 18 bp, Homo sapiens
attaaaacaatattgttt

SEQ ID NO: 3519116 - DNA, 20 bp, Homo sapiens
attaaaacaatattgtttct

SEQ ID NO: 3519117 - DNA, 12 bp, Homo sapiens
attaaaatggat

SEQ ID NO: 3519118 - DNA, 19 bp, Homo sapiens
attaaaattctgaattttg

SEQ ID NO: 3519119 - DNA, 13 bp, Homo sapiens
attaaagacagag

SEQ ID NO: 3519120 - DNA, 15 bp, Homo sapiens
attaaatataatatg

SEQ ID NO: 3519121 - DNA, 13 bp, Homo sapiens
attaagaaaatca

SEQ ID NO: 3519122 - DNA, 16 bp, Homo sapiens
attaagaaaatcatat

SEQ ID NO: 3519123 - DNA, 18 bp, Homo sapiens
attaagatgccttgaatt

SEQ ID NO: 3519124 - DNA, 11 bp, Homo sapiens
attaaggaagt

SEQ ID NO: 3519125 - DNA, 18 bp, Homo sapiens
attaaggaagtaactttt

SEQ ID NO: 3519126 - DNA, 21 bp, Homo sapiens
attaaggatgtagcttttcac

SEQ ID NO: 3519127 - DNA, 15 bp, Homo sapiens
attaagtccaaatct

SEQ ID NO: 3519128 - DNA, 22 bp, Homo sapiens
attaagtggtagtaatttcctt

SEQ ID NO: 3519129 - DNA, 12 bp, Homo sapiens
attaatatgaaa

SEQ ID NO: 3519130 - DNA, 15 bp, Homo sapiens
attaatatgaaaact

SEQ ID NO: 3519131 - DNA, 13 bp, Homo sapiens
attaatcactatt

SEQ ID NO: 3519132 - DNA, 16 bp, Homo sapiens
attaatcactattgtt

SEQ ID NO: 3519133 - DNA, 14 bp, Homo sapiens
attaattgctgcaa

SEQ ID NO: 3519134 - DNA, 12 bp, Homo sapiens
attaattgcttt

SEQ ID NO: 3519135 - DNA, 14 bp, Homo sapiens
attaattgctttga

SEQ ID NO: 3519136 - DNA, 16 bp, Homo sapiens
attaatttatgcagaa

SEQ ID NO: 3519137 - DNA, 15 bp, Homo sapiens
attacaaaaggctcg

SEQ ID NO: 3519138 - DNA, 13 bp, Homo sapiens
attacaaatggtt

SEQ ID NO: 3519139 - DNA, 19 bp, Homo sapiens
attacacttggtaattgta

SEQ ID NO: 3519140 - DNA, 15 bp, Homo sapiens
attacatctttcaca

SEQ ID NO: 3519141 - DNA, 18 bp, Homo sapiens
attacatctttcacattg

SEQ ID NO: 3519142 - DNA, 12 bp, Homo sapiens
attaccatgtaa

SEQ ID NO: 3519143 - DNA, 14 bp, Homo sapiens
attacccaaaccca

SEQ ID NO: 3519144 - DNA, 13 bp, Homo sapiens
attaccccctcct

SEQ ID NO: 3519145 - DNA, 18 bp, Homo sapiens
attaccccctccttcaga

SEQ ID NO: 3519146 - DNA, 17 bp, Homo sapiens
attaccgcgttgtaaaa

SEQ ID NO: 3519147 - DNA, 21 bp, Homo sapiens
attaccgcgttgtaaaatata

SEQ ID NO: 3519148 - DNA, 12 bp, Homo sapiens
attacctcctga

SEQ ID NO: 3519149 - DNA, 18 bp, Homo sapiens
attactgcttcatttttg

SEQ ID NO: 3519150 - DNA, 22 bp, Homo sapiens
attactgcttcatttttgtaat

SEQ ID NO: 3519151 - DNA, 15 bp, Homo sapiens
attacttatccctgc

SEQ ID NO: 3519152 - DNA, 19 bp, Homo sapiens
attacttatccctgcccat

SEQ ID NO: 3519153 - DNA, 22 bp, Homo sapiens
attacttctctataaaaaatat

SEQ ID NO: 3519154 - DNA, 12 bp, Homo sapiens
attacttctgct

SEQ ID NO: 3519155 - DNA, 13 bp, Homo sapiens
attacttctgcta

SEQ ID NO: 3519156 - DNA, 19 bp, Homo sapiens
attagaaaatgttatttaa

SEQ ID NO: 3519157 - DNA, 21 bp, Homo sapiens
attagaagacaattgacaaca

SEQ ID NO: 3519158 - DNA, 13 bp, Homo sapiens
attagagaagaga

SEQ ID NO: 3519159 - DNA, 16 bp, Homo sapiens
attagagtgtctttcc

SEQ ID NO: 3519160 - DNA, 19 bp, Homo sapiens
attagatgttctctatcat

SEQ ID NO: 3519161 - DNA, 17 bp, Homo sapiens
attagccacaaaattgg

SEQ ID NO: 3519162 - DNA, 17 bp, Homo sapiens
attagcctgagtagaaa

SEQ ID NO: 3519163 - DNA, 16 bp, Homo sapiens
attagggagaaaattc

SEQ ID NO: 3519164 - DNA, 23 bp, Homo sapiens
attagggagaaaattcaattgta

SEQ ID NO: 3519165 - DNA, 12 bp, Homo sapiens
attagggagctc

SEQ ID NO: 3519166 - DNA, 13 bp, Homo sapiens
attagggagctct

SEQ ID NO: 3519167 - DNA, 15 bp, Homo sapiens
attagggagctcttg

SEQ ID NO: 3519168 - DNA, 12 bp, Homo sapiens
attaggtatgtt

SEQ ID NO: 3519169 - DNA, 19 bp, Homo sapiens
attaggtatgtttgtaact

SEQ ID NO: 3519170 - DNA, 19 bp, Homo sapiens
attaggtttcagcagagct

SEQ ID NO: 3519171 - DNA, 23 bp, Homo sapiens
attagtaacataataaattaaaa

SEQ ID NO: 3519172 - DNA, 13 bp, Homo sapiens
attagtgctaagt

SEQ ID NO: 3519173 - DNA, 15 bp, Homo sapiens
attagtgctaagtgt

SEQ ID NO: 3519174 - DNA, 13 bp, Homo sapiens
attagttgcacta

SEQ ID NO: 3519175 - DNA, 14 bp, Homo sapiens
attagttgccaata

SEQ ID NO: 3519176 - DNA, 16 bp, Homo sapiens
attagttgccaatatg

SEQ ID NO: 3519177 - DNA, 14 bp, Homo sapiens
attagttttcttgt

SEQ ID NO: 3519178 - DNA, 15 bp, Homo sapiens
attagttttcttgtt

SEQ ID NO: 3519179 - DNA, 14 bp, Homo sapiens
attatacgctggca

SEQ ID NO: 3519180 - DNA, 19 bp, Homo sapiens
attataggaatatcaatat

SEQ ID NO: 3519181 - DNA, 21 bp, Homo sapiens
attataggaatatcaatataa

SEQ ID NO: 3519182 - DNA, 15 bp, Homo sapiens
attatatttgacatg

SEQ ID NO: 3519183 - DNA, 20 bp, Homo sapiens
attatatttgacatgggtat

SEQ ID NO: 3519184 - DNA, 12 bp, Homo sapiens
attatcattgct

SEQ ID NO: 3519185 - DNA, 17 bp, Homo sapiens
attatccaggtaatcca

SEQ ID NO: 3519186 - DNA, 14 bp, Homo sapiens
attatccatattga

SEQ ID NO: 3519187 - DNA, 21 bp, Homo sapiens
attatccattcccaagatgcc

SEQ ID NO: 3519188 - DNA, 18 bp, Homo sapiens
attatcctcctgttctga

SEQ ID NO: 3519189 - DNA, 13 bp, Homo sapiens
attatgtataaaa

SEQ ID NO: 3519190 - DNA, 14 bp, Homo sapiens
attatgtataaaat

SEQ ID NO: 3519191 - DNA, 24 bp, Homo sapiens
attatgtataaaatgtaacactga

SEQ ID NO: 3519192 - DNA, 14 bp, Homo sapiens
attatgttaaacta

SEQ ID NO: 3519193 - DNA, 13 bp, Homo sapiens
attattctatgta

SEQ ID NO: 3519194 - DNA, 15 bp, Homo sapiens
attattctatgtagt

SEQ ID NO: 3519195 - DNA, 12 bp, Homo sapiens
attattctcatt

SEQ ID NO: 3519196 - DNA, 13 bp, Homo sapiens
attatttatttga

SEQ ID NO: 3519197 - DNA, 14 bp, Homo sapiens
attattttccaaaa

SEQ ID NO: 3519198 - DNA, 12 bp, Homo sapiens
attcaaaatatt

SEQ ID NO: 3519199 - DNA, 22 bp, Homo sapiens
attcaaaatatttaaaaatgtc

SEQ ID NO: 3519200 - DNA, 22 bp, Homo sapiens
attcaaattctttttttattat

SEQ ID NO: 3519201 - DNA, 22 bp, Homo sapiens
attcaacactcccttcccatga

SEQ ID NO: 3519202 - DNA, 13 bp, Homo sapiens
attcaactaaaaa

SEQ ID NO: 3519203 - DNA, 23 bp, Homo sapiens
attcaactaaaaaaaaaaaagta

SEQ ID NO: 3519204 - DNA, 14 bp, Homo sapiens
attcaataaagtat

SEQ ID NO: 3519205 - DNA, 17 bp, Homo sapiens
attcaataaagtattta

SEQ ID NO: 3519206 - DNA, 21 bp, Homo sapiens
attcaataaagtatttaatta

SEQ ID NO: 3519207 - DNA, 16 bp, Homo sapiens
attcaatatcctttgc

SEQ ID NO: 3519208 - DNA, 14 bp, Homo sapiens
attcaatattgaat

SEQ ID NO: 3519209 - DNA, 16 bp, Homo sapiens
attcaattcctctggg

SEQ ID NO: 3519210 - DNA, 18 bp, Homo sapiens
attcaattgtaaattgaa

SEQ ID NO: 3519211 - DNA, 13 bp, Homo sapiens
attcacaaacttt

SEQ ID NO: 3519212 - DNA, 14 bp, Homo sapiens
attcacaaactttt

SEQ ID NO: 3519213 - DNA, 14 bp, Homo sapiens
attcacacacccct

SEQ ID NO: 3519214 - DNA, 20 bp, Homo sapiens
attcacacacccctcaaaaa

SEQ ID NO: 3519215 - DNA, 11 bp, Homo sapiens
attcacactgt

SEQ ID NO: 3519216 - DNA, 13 bp, Homo sapiens
attcacagagcct

SEQ ID NO: 3519217 - DNA, 22 bp, Homo sapiens
attcacagttctttgggccaga

SEQ ID NO: 3519218 - DNA, 13 bp, Homo sapiens
attcacataataa

SEQ ID NO: 3519219 - DNA, 21 bp, Homo sapiens
attcactctgagtgttttatg

SEQ ID NO: 3519220 - DNA, 18 bp, Homo sapiens
attcactttcatttttga

SEQ ID NO: 3519221 - DNA, 13 bp, Homo sapiens
attcagacaaaat

SEQ ID NO: 3519222 - DNA, 12 bp, Homo sapiens
attcagaggaag

SEQ ID NO: 3519223 - DNA, 22 bp, Homo sapiens
attcagaggaagacatctgtag

SEQ ID NO: 3519224 - DNA, 23 bp, Homo sapiens
attcagcagactttctctgtgta

SEQ ID NO: 3519225 - DNA, 14 bp, Homo sapiens
attcagctctgcaa

SEQ ID NO: 3519226 - DNA, 17 bp, Homo sapiens
attcaggtgcagaggaa

SEQ ID NO: 3519227 - DNA, 20 bp, Homo sapiens
attcagtgcagcatatacaa

SEQ ID NO: 3519228 - DNA, 14 bp, Homo sapiens
attcagtgtcactg

SEQ ID NO: 3519229 - DNA, 13 bp, Homo sapiens
attcagttttcat

SEQ ID NO: 3519230 - DNA, 16 bp, Homo sapiens
attcatagtaacttct

SEQ ID NO: 3519231 - DNA, 17 bp, Homo sapiens
attcatagtaacttctt

SEQ ID NO: 3519232 - DNA, 18 bp, Homo sapiens
attcatagtaacttctta

SEQ ID NO: 3519233 - DNA, 19 bp, Homo sapiens
attcatagtaacttcttat

SEQ ID NO: 3519234 - DNA, 16 bp, Homo sapiens
attcatatattgcatt

SEQ ID NO: 3519235 - DNA, 18 bp, Homo sapiens
attcatatattgcatttc

SEQ ID NO: 3519236 - DNA, 20 bp, Homo sapiens
attcatatattgcatttctg

SEQ ID NO: 3519237 - DNA, 17 bp, Homo sapiens
attcatcccaactgtct

SEQ ID NO: 3519238 - DNA, 15 bp, Homo sapiens
attcatgtttcttaa

SEQ ID NO: 3519239 - DNA, 15 bp, Homo sapiens
attcattatttgtca

SEQ ID NO: 3519240 - DNA, 16 bp, Homo sapiens
attcattccccagctc

SEQ ID NO: 3519241 - DNA, 22 bp, Homo sapiens
attcattccccagctccatact

SEQ ID NO: 3519242 - DNA, 16 bp, Homo sapiens
attccaaaaagcacat

SEQ ID NO: 3519243 - DNA, 20 bp, Homo sapiens
attccaaagcaaaaccagaa

SEQ ID NO: 3519244 - DNA, 22 bp, Homo sapiens
attccaagaatagcatctgtac

SEQ ID NO: 3519245 - DNA, 20 bp, Homo sapiens
attccagaatgctgtacatc

SEQ ID NO: 3519246 - DNA, 14 bp, Homo sapiens
attccagcccctct

SEQ ID NO: 3519247 - DNA, 17 bp, Homo sapiens
attccagcccctctggt

SEQ ID NO: 3519248 - DNA, 16 bp, Homo sapiens
attccattctggattt

SEQ ID NO: 3519249 - DNA, 19 bp, Homo sapiens
atttcttcttcacatccat

SEQ ID NO: 3519250 - DNA, 20 bp, Homo sapiens
atttcttgaggtaaaagcat

SEQ ID NO: 3519251 - DNA, 14 bp, Homo sapiens
atttctttgctgta

SEQ ID NO: 3519252 - DNA, 15 bp, Homo sapiens
atttgaatcttgtct

SEQ ID NO: 3519253 - DNA, 18 bp, Homo sapiens
atttgaatcttgtctcaa

SEQ ID NO: 3519254 - DNA, 16 bp, Homo sapiens
atttgaatgcattttg

SEQ ID NO: 3519255 - DNA, 12 bp, Homo sapiens
atttgactaatt

SEQ ID NO: 3519256 - DNA, 13 bp, Homo sapiens
atttgactaattt

SEQ ID NO: 3519257 - DNA, 17 bp, Homo sapiens
atttgactaattttaca

SEQ ID NO: 3519258 - DNA, 21 bp, Homo sapiens
atttgagaatataaaaaactt

SEQ ID NO: 3519259 - DNA, 16 bp, Homo sapiens
atttgagcagggctca

SEQ ID NO: 3519260 - DNA, 14 bp, Homo sapiens
atttgagtgctctg

SEQ ID NO: 3519261 - DNA, 16 bp, Homo sapiens
atttgagtgctctgat

SEQ ID NO: 3519262 - DNA, 12 bp, Homo sapiens
atttgagtgttt

SEQ ID NO: 3519263 - DNA, 17 bp, Homo sapiens
atttgattaacatttgt

SEQ ID NO: 3519264 - DNA, 19 bp, Homo sapiens
atttgattaggtatgtttg

SEQ ID NO: 3519265 - DNA, 21 bp, Homo sapiens
atttgattaggtatgtttgta

SEQ ID NO: 3519266 - DNA, 22 bp, Homo sapiens
atttgattaggtatgtttgtaa

SEQ ID NO: 3519267 - DNA, 15 bp, Homo sapiens
atttgattcaaaata

SEQ ID NO: 3519268 - DNA, 20 bp, Homo sapiens
atttgattcaaaatatttaa

SEQ ID NO: 3519269 - DNA, 15 bp, Homo sapiens
atttgcaaagtactg

SEQ ID NO: 3519270 - DNA, 19 bp, Homo sapiens
atttgcaaagtactgtaag

SEQ ID NO: 3519271 - DNA, 15 bp, Homo sapiens
atttgcaagggaaaa

SEQ ID NO: 3519272 - DNA, 13 bp, Homo sapiens
atttgcaccagtt

SEQ ID NO: 3519273 - DNA, 22 bp, Homo sapiens
atttgcaccagttttatccata

SEQ ID NO: 3519274 - DNA, 18 bp, Homo sapiens
atttgcattaaattcaca

SEQ ID NO: 3519275 - DNA, 19 bp, Homo sapiens
atttgcattaaattcacaa

SEQ ID NO: 3519276 - DNA, 16 bp, Homo sapiens
atttgcattgaacaca

SEQ ID NO: 3519277 - DNA, 21 bp, Homo sapiens
atttgcattgaacacaaactg

SEQ ID NO: 3519278 - DNA, 20 bp, Homo sapiens
atttgccagagccaaatttt

SEQ ID NO: 3519279 - DNA, 14 bp, Homo sapiens
atttgcctcacctt

SEQ ID NO: 3519280 - DNA, 13 bp, Homo sapiens
atttggaatactt

SEQ ID NO: 3519281 - DNA, 15 bp, Homo sapiens
atttggaatactttt

SEQ ID NO: 3519282 - DNA, 19 bp, Homo sapiens
atttgggcctgctccagac

SEQ ID NO: 3519283 - DNA, 21 bp, Homo sapiens
atttgggcctgctccagacct

SEQ ID NO: 3519284 - DNA, 17 bp, Homo sapiens
atttgggttctgcctgc

SEQ ID NO: 3519285 - DNA, 15 bp, Homo sapiens
atttggttctaatag

SEQ ID NO: 3519286 - DNA, 13 bp, Homo sapiens
atttgtaaaacat

SEQ ID NO: 3519287 - DNA, 22 bp, Homo sapiens
atttgtctttttgttgtaaaac

SEQ ID NO: 3519288 - DNA, 23 bp, Homo sapiens
atttgtctttttgttgtaaaaca

SEQ ID NO: 3519289 - DNA, 18 bp, Homo sapiens
atttgtgatagcactttc

SEQ ID NO: 3519290 - DNA, 22 bp, Homo sapiens
atttgtgtatttaacagggagg

SEQ ID NO: 3519291 - DNA, 14 bp, Homo sapiens
atttgttaaaatac

SEQ ID NO: 3519292 - DNA, 17 bp, Homo sapiens
atttgttattttgcaac

SEQ ID NO: 3519293 - DNA, 14 bp, Homo sapiens
atttgttctctgtc

SEQ ID NO: 3519294 - DNA, 16 bp, Homo sapiens
atttgttttaggtaga

SEQ ID NO: 3519295 - DNA, 13 bp, Homo sapiens
attttaactctgt

SEQ ID NO: 3519296 - DNA, 15 bp, Homo sapiens
attttaactctgtct

SEQ ID NO: 3519297 - DNA, 20 bp, Homo sapiens
attttaactgccaatcctta

SEQ ID NO: 3519298 - DNA, 16 bp, Homo sapiens
attttaagactgattt

SEQ ID NO: 3519299 - DNA, 20 bp, Homo sapiens
attttaagtattgcatctgt

SEQ ID NO: 3519300 - DNA, 23 bp, Homo sapiens
attttaagtattgcatctgtata

SEQ ID NO: 3519301 - DNA, 19 bp, Homo sapiens
attttaagtccctgtcacc

SEQ ID NO: 3519302 - DNA, 14 bp, Homo sapiens
attttaatcaagtt

SEQ ID NO: 3519303 - DNA, 19 bp, Homo sapiens
attttaatttagtaaatgt

SEQ ID NO: 3519304 - DNA, 19 bp, Homo sapiens
attttaatttgtattgaag

SEQ ID NO: 3519305 - DNA, 22 bp, Homo sapiens
attttacagttaaggaatataa

SEQ ID NO: 3519306 - DNA, 13 bp, Homo sapiens
attttactagaaa

SEQ ID NO: 3519307 - DNA, 17 bp, Homo sapiens
attttactagaaatggg

SEQ ID NO: 3519308 - DNA, 15 bp, Homo sapiens
attttactgttgtac

SEQ ID NO: 3519309 - DNA, 23 bp, Homo sapiens
attttactgttgtacaatcatgt

SEQ ID NO: 3519310 - DNA, 13 bp, Homo sapiens
attttacttttta

SEQ ID NO: 3519311 - DNA, 17 bp, Homo sapiens
attttagtaatttccta

SEQ ID NO: 3519312 - DNA, 20 bp, Homo sapiens
attttataagaaaaactttt

SEQ ID NO: 3519313 - DNA, 17 bp, Homo sapiens
attttatagctactaat

SEQ ID NO: 3519314 - DNA, 19 bp, Homo sapiens
attttatagctactaattt

SEQ ID NO: 3519315 - DNA, 22 bp, Homo sapiens
attttatctgtttcctgacatt

SEQ ID NO: 3519316 - DNA, 15 bp, Homo sapiens
attttatctttgatt

SEQ ID NO: 3519317 - DNA, 21 bp, Homo sapiens
attttatctttgattctcctt

SEQ ID NO: 3519318 - DNA, 22 bp, Homo sapiens
attttatctttgattctccttc

SEQ ID NO: 3519319 - DNA, 17 bp, Homo sapiens
attttatgatcagtgtt

SEQ ID NO: 3519320 - DNA, 19 bp, Homo sapiens
attttatgccagttgttaa

SEQ ID NO: 3519321 - DNA, 20 bp, Homo sapiens
attttattacatctttcaca

SEQ ID NO: 3519322 - DNA, 13 bp, Homo sapiens
attttcaaaagat

SEQ ID NO: 3519323 - DNA, 22 bp, Homo sapiens
attttcaaccataaaagaagtt

SEQ ID NO: 3519324 - DNA, 17 bp, Homo sapiens
attttcaaggccttcag

SEQ ID NO: 3519325 - DNA, 18 bp, Homo sapiens
attttcaaggccttcagt

SEQ ID NO: 3519326 - DNA, 18 bp, Homo sapiens
attttcaccctctgtacc

SEQ ID NO: 3519327 - DNA, 15 bp, Homo sapiens
attttcagagtgaca

SEQ ID NO: 3519328 - DNA, 20 bp, Homo sapiens
attttcagcattaagctgtt

SEQ ID NO: 3519329 - DNA, 20 bp, Homo sapiens
attttcataagtatttcaaa

SEQ ID NO: 3519330 - DNA, 21 bp, Homo sapiens
attttcataagtatttcaaat

SEQ ID NO: 3519331 - DNA, 14 bp, Homo sapiens
attttccaaatgta

SEQ ID NO: 3519332 - DNA, 14 bp, Homo sapiens
attttccatatatt

SEQ ID NO: 3519333 - DNA, 15 bp, Homo sapiens
attttctataattta

SEQ ID NO: 3519334 - DNA, 17 bp, Homo sapiens
attttctataatttaaa

SEQ ID NO: 3519335 - DNA, 19 bp, Homo sapiens
attttctataatttaaata

SEQ ID NO: 3519336 - DNA, 22 bp, Homo sapiens
attttctggattccccatctca

SEQ ID NO: 3519337 - DNA, 18 bp, Homo sapiens
attttctttaatgctttt

SEQ ID NO: 3519338 - DNA, 16 bp, Homo sapiens
attttcttttgtaaat

SEQ ID NO: 3519339 - DNA, 19 bp, Homo sapiens
attttcttttgtaaatgtt

SEQ ID NO: 3519340 - DNA, 17 bp, Homo sapiens
attttctttttttaact

SEQ ID NO: 3519341 - DNA, 23 bp, Homo sapiens
attttctttttttaactggtgaa

SEQ ID NO: 3519342 - DNA, 15 bp, Homo sapiens
attttgaaatgtggt

SEQ ID NO: 3519343 - DNA, 19 bp, Homo sapiens
attttgacttaatgtgatt

SEQ ID NO: 3519344 - DNA, 19 bp, Homo sapiens
attttgagaacaaagatga

SEQ ID NO: 3519345 - DNA, 12 bp, Homo sapiens
attttgctgtat

SEQ ID NO: 3519346 - DNA, 20 bp, Homo sapiens
attttggaactatgaagact

SEQ ID NO: 3519347 - DNA, 21 bp, Homo sapiens
attttggagagtttcctgaaa

SEQ ID NO: 3519348 - DNA, 14 bp, Homo sapiens
attttgggcatgtg

SEQ ID NO: 3519349 - DNA, 21 bp, Homo sapiens
attttggggtacccactgctc

SEQ ID NO: 3519350 - DNA, 14 bp, Homo sapiens
attttggtgagaaa

SEQ ID NO: 3519351 - DNA, 17 bp, Homo sapiens
attttggttcttctcaa

SEQ ID NO: 3519352 - DNA, 23 bp, Homo sapiens
attttgtaaataataaaatagta

SEQ ID NO: 3519353 - DNA, 13 bp, Homo sapiens
attttgtatctgc

SEQ ID NO: 3519354 - DNA, 19 bp, Homo sapiens
attttgtcatatcaaataa

SEQ ID NO: 3519355 - DNA, 13 bp, Homo sapiens
attttgtctaaaa

SEQ ID NO: 3519356 - DNA, 16 bp, Homo sapiens
attttgtctaaaatgc

SEQ ID NO: 3519357 - DNA, 22 bp, Homo sapiens
attttgttctctgggagaaaat

SEQ ID NO: 3519358 - DNA, 21 bp, Homo sapiens
attttgtttggtattgtattt

SEQ ID NO: 3519359 - DNA, 15 bp, Homo sapiens
atttttaaaaaatat

SEQ ID NO: 3519360 - DNA, 18 bp, Homo sapiens
atttttaaaaaatatttt

SEQ ID NO: 3519361 - DNA, 18 bp, Homo sapiens
atttttaaaataaactgt

SEQ ID NO: 3519362 - DNA, 14 bp, Homo sapiens
atttttaaagtaga

SEQ ID NO: 3519363 - DNA, 19 bp, Homo sapiens
atttttaaagtagaagagg

SEQ ID NO: 3519364 - DNA, 19 bp, Homo sapiens
atttttaaatgtaaaacat

SEQ ID NO: 3519365 - DNA, 15 bp, Homo sapiens
atttttaaatgtgtt

SEQ ID NO: 3519366 - DNA, 20 bp, Homo sapiens
atttttacctttttccttcc

SEQ ID NO: 3519367 - DNA, 21 bp, Homo sapiens
atttttagaattaaaaaagca

SEQ ID NO: 3519368 - DNA, 23 bp, Homo sapiens
atttttatataatatctaaagtt

SEQ ID NO: 3519369 - DNA, 17 bp, Homo sapiens
atttttcaaaaccctaa

SEQ ID NO: 3519370 - DNA, 14 bp, Homo sapiens
atttttcaactttg

SEQ ID NO: 3519371 - DNA, 22 bp, Homo sapiens
atttttcaactttgaataaaga

SEQ ID NO: 3519372 - DNA, 16 bp, Homo sapiens
atttttcaataaagca

SEQ ID NO: 3519373 - DNA, 23 bp, Homo sapiens
atttttcctatgctattgacaat

SEQ ID NO: 3519374 - DNA, 15 bp, Homo sapiens
atttttctctcctgt

SEQ ID NO: 3519375 - DNA, 12 bp, Homo sapiens
atttttgcaata

SEQ ID NO: 3519376 - DNA, 19 bp, Homo sapiens
atttttgcaataatgcagt

SEQ ID NO: 3519377 - DNA, 12 bp, Homo sapiens
atttttgtaaat

SEQ ID NO: 3519378 - DNA, 19 bp, Homo sapiens
attttttgtttgtattgta

SEQ ID NO: 3519379 - DNA, 18 bp, Homo sapiens
atttttttaaaatgttaa

SEQ ID NO: 3519380 - DNA, 16 bp, Homo sapiens
atttttttaaccaaag

SEQ ID NO: 3519381 - DNA, 19 bp, Homo sapiens
caatcttctttttcaggct

SEQ ID NO: 3519382 - DNA, 20 bp, Homo sapiens
caatgaaatatgtgaagccc

SEQ ID NO: 3519383 - DNA, 14 bp, Homo sapiens
caatgaagccagct

SEQ ID NO: 3519384 - DNA, 17 bp, Homo sapiens
caatgagacttgccttc

SEQ ID NO: 3519385 - DNA, 19 bp, Homo sapiens
caatgagacttgccttcct

SEQ ID NO: 3519386 - DNA, 22 bp, Homo sapiens
caatgccaaaaaaagacagggc

SEQ ID NO: 3519387 - DNA, 20 bp, Homo sapiens
caatgccatcctcaaacact

SEQ ID NO: 3519388 - DNA, 13 bp, Homo sapiens
caatgctgatgtc

SEQ ID NO: 3519389 - DNA, 13 bp, Homo sapiens
caatgctggctgt

SEQ ID NO: 3519390 - DNA, 17 bp, Homo sapiens
caatggaaacatcactg

SEQ ID NO: 3519391 - DNA, 15 bp, Homo sapiens
caatggcccgacatt

SEQ ID NO: 3519392 - DNA, 19 bp, Homo sapiens
caatggcccgacatttctt

SEQ ID NO: 3519393 - DNA, 19 bp, Homo sapiens
caatgggagctgaggccac

SEQ ID NO: 3519394 - DNA, 21 bp, Homo sapiens
caatggtgttatttgaaactt

SEQ ID NO: 3519395 - DNA, 18 bp, Homo sapiens
caatggtttttaaatttt

SEQ ID NO: 3519396 - DNA, 15 bp, Homo sapiens
caatgtctgcagccc

SEQ ID NO: 3519397 - DNA, 16 bp, Homo sapiens
caatgtctgcagccct

SEQ ID NO: 3519398 - DNA, 17 bp, Homo sapiens
caatgtctgcagccctg

SEQ ID NO: 3519399 - DNA, 21 bp, Homo sapiens
caatgtcttgatgcatgcact

SEQ ID NO: 3519400 - DNA, 19 bp, Homo sapiens
caatgtgaaaagaaaaatg

SEQ ID NO: 3519401 - DNA, 21 bp, Homo sapiens
caatgtgaactttattaaata

SEQ ID NO: 3519402 - DNA, 20 bp, Homo sapiens
caatgtgtggctgaagactt

SEQ ID NO: 3519403 - DNA, 23 bp, Homo sapiens
caattaaaaaaaaagatctgttt

SEQ ID NO: 3519404 - DNA, 15 bp, Homo sapiens
caattatgttaaact

SEQ ID NO: 3519405 - DNA, 20 bp, Homo sapiens
caattcacatctaacctcat

SEQ ID NO: 3519406 - DNA, 16 bp, Homo sapiens
caattccactctgata

SEQ ID NO: 3519407 - DNA, 20 bp, Homo sapiens
caattccgtagccagctgct

SEQ ID NO: 3519408 - DNA, 14 bp, Homo sapiens
caattcctctgata

SEQ ID NO: 3519409 - DNA, 16 bp, Homo sapiens
caattcctctgataat

SEQ ID NO: 3519410 - DNA, 15 bp, Homo sapiens
caattcctctgggaa

SEQ ID NO: 3519411 - DNA, 14 bp, Homo sapiens
caattcctggccct

SEQ ID NO: 3519412 - DNA, 23 bp, Homo sapiens
caattctatcttttgtttccttt

SEQ ID NO: 3519413 - DNA, 14 bp, Homo sapiens
caattctcctgcct

SEQ ID NO: 3519414 - DNA, 16 bp, Homo sapiens
caattctcctgccttt

SEQ ID NO: 3519415 - DNA, 20 bp, Homo sapiens
caattctcctgcctttgcct

SEQ ID NO: 3519416 - DNA, 15 bp, Homo sapiens
caattcttgccaaat

SEQ ID NO: 3519417 - DNA, 14 bp, Homo sapiens
caattgcatctccc

SEQ ID NO: 3519418 - DNA, 19 bp, Homo sapiens
caattggattggaatgcag

SEQ ID NO: 3519419 - DNA, 21 bp, Homo sapiens
caattgtgagccaccacgtcc

SEQ ID NO: 3519420 - DNA, 14 bp, Homo sapiens
caatttacaaagtg

SEQ ID NO: 3519421 - DNA, 17 bp, Homo sapiens
caatttacaaagtgtgt

SEQ ID NO: 3519422 - DNA, 11 bp, Homo sapiens
caatttagaaa

SEQ ID NO: 3519423 - DNA, 12 bp, Homo sapiens
caatttccccct

SEQ ID NO: 3519424 - DNA, 20 bp, Homo sapiens
caatttctgtgttgccaagc

SEQ ID NO: 3519425 - DNA, 22 bp, Homo sapiens
caatttctgtgttgccaagctc

SEQ ID NO: 3519426 - DNA, 23 bp, Homo sapiens
caatttgcacatcttggctatgt

SEQ ID NO: 3519427 - DNA, 15 bp, Homo sapiens
caatttgcaccagtt

SEQ ID NO: 3519428 - DNA, 22 bp, Homo sapiens
caatttgcaccagttttatcca

SEQ ID NO: 3519429 - DNA, 15 bp, Homo sapiens
caattttatctgttt

SEQ ID NO: 3519430 - DNA, 16 bp, Homo sapiens
cacaaaacccagacct

SEQ ID NO: 3519431 - DNA, 13 bp, Homo sapiens
cacaaacctgcct

SEQ ID NO: 3519432 - DNA, 17 bp, Homo sapiens
cacaaaccttctgcctt

SEQ ID NO: 3519433 - DNA, 13 bp, Homo sapiens
cacaaactcacca

SEQ ID NO: 3519434 - DNA, 13 bp, Homo sapiens
cacaaactgtaaa

SEQ ID NO: 3519435 - DNA, 20 bp, Homo sapiens
cacaaagaaaattcctataa

SEQ ID NO: 3519436 - DNA, 23 bp, Homo sapiens
cacaagacccaagtagctgctac

SEQ ID NO: 3519437 - DNA, 20 bp, Homo sapiens
cacaagatgccccagggatg

SEQ ID NO: 3519438 - DNA, 21 bp, Homo sapiens
cacaagcctcgaggtgccttc

SEQ ID NO: 3519439 - DNA, 17 bp, Homo sapiens
cacaagctgcaccctca

SEQ ID NO: 3519440 - DNA, 18 bp, Homo sapiens
cacaaggatagatgctgg

SEQ ID NO: 3519441 - DNA, 21 bp, Homo sapiens
cacaaggatagatgctggccc

SEQ ID NO: 3519442 - DNA, 13 bp, Homo sapiens
cacaagtggtggt

SEQ ID NO: 3519443 - DNA, 15 bp, Homo sapiens
cacaatccctttcta

SEQ ID NO: 3519444 - DNA, 22 bp, Homo sapiens
cacaatctcattgaggagcatt

SEQ ID NO: 3519445 - DNA, 18 bp, Homo sapiens
cacaatgcagttctgagc

SEQ ID NO: 3519446 - DNA, 22 bp, Homo sapiens
cacaattccatttccagttcat

SEQ ID NO: 3519447 - DNA, 23 bp, Homo sapiens
cacacaaaagggaacccagctct

SEQ ID NO: 3519448 - DNA, 19 bp, Homo sapiens
cacacaaggatagatgctg

SEQ ID NO: 3519449 - DNA, 11 bp, Homo sapiens
cacacacacac

SEQ ID NO: 3519450 - DNA, 14 bp, Homo sapiens
cacacacacacaaa

SEQ ID NO: 3519451 - DNA, 13 bp, Homo sapiens
cacacacacacac

SEQ ID NO: 3519452 - DNA, 15 bp, Homo sapiens
cacacacacagccag

SEQ ID NO: 3519453 - DNA, 14 bp, Homo sapiens
cacacaccagagcc

SEQ ID NO: 3519454 - DNA, 20 bp, Homo sapiens
cacacaccagagcccacctt

SEQ ID NO: 3519455 - DNA, 12 bp, Homo sapiens
cacacactgttt

SEQ ID NO: 3519456 - DNA, 23 bp, Homo sapiens
cacacactgttttttggcttgct

SEQ ID NO: 3519457 - DNA, 19 bp, Homo sapiens
cacacagagctcacctgtt

SEQ ID NO: 3519458 - DNA, 16 bp, Homo sapiens
cacacagatacacaca

SEQ ID NO: 3519459 - DNA, 12 bp, Homo sapiens
cacacagctctg

SEQ ID NO: 3519460 - DNA, 17 bp, Homo sapiens
cacacagctctgtcctg

SEQ ID NO: 3519461 - DNA, 19 bp, Homo sapiens
cacacaggggccacccggg

SEQ ID NO: 3519462 - DNA, 17 bp, Homo sapiens
cacacaggtacagcaac

SEQ ID NO: 3519463 - DNA, 18 bp, Homo sapiens
cacacaggtacagcaaca

SEQ ID NO: 3519464 - DNA, 20 bp, Homo sapiens
cacacagtattacttctgct

SEQ ID NO: 3519465 - DNA, 17 bp, Homo sapiens
cacacatcctgctgggc

SEQ ID NO: 3519466 - DNA, 14 bp, Homo sapiens
cacacccactcagc

SEQ ID NO: 3519467 - DNA, 15 bp, Homo sapiens
cacacccactcagct

SEQ ID NO: 3519468 - DNA, 14 bp, Homo sapiens
cacaccctccccat

SEQ ID NO: 3519469 - DNA, 17 bp, Homo sapiens
cacaccgggcactcaga

SEQ ID NO: 3519470 - DNA, 22 bp, Homo sapiens
cacaccttttattgacacagaa

SEQ ID NO: 3519471 - DNA, 17 bp, Homo sapiens
cacacgcctcccactgg

SEQ ID NO: 3519472 - DNA, 12 bp, Homo sapiens
cacacggctccc

SEQ ID NO: 3519473 - DNA, 21 bp, Homo sapiens
cacacggctcccccaggcctg

SEQ ID NO: 3519474 - DNA, 20 bp, Homo sapiens
cacactggactccggccctc

SEQ ID NO: 3519475 - DNA, 21 bp, Homo sapiens
cacactgtcatgcttcatcat

SEQ ID NO: 3519476 - DNA, 16 bp, Homo sapiens
cacagaaatgctgctg

SEQ ID NO: 3519477 - DNA, 18 bp, Homo sapiens
cacagaaatgctgctggc

SEQ ID NO: 3519478 - DNA, 13 bp, Homo sapiens
cacagaagtcctg

SEQ ID NO: 3519479 - DNA, 21 bp, Homo sapiens
cacagacgttaggcatttcct

SEQ ID NO: 3519480 - DNA, 21 bp, Homo sapiens
cacagagaaagtacttctcca

SEQ ID NO: 3519481 - DNA, 22 bp, Homo sapiens
cacagagacccccggaacaagc

SEQ ID NO: 3519482 - DNA, 13 bp, Homo sapiens
cacagagcgggga

SEQ ID NO: 3519483 - DNA, 14 bp, Homo sapiens
cacagagcggggac

SEQ ID NO: 3519484 - DNA, 21 bp, Homo sapiens
cacagaggcagcccgcacacc

SEQ ID NO: 3519485 - DNA, 20 bp, Homo sapiens
cacagatcgcatttcctaag

SEQ ID NO: 3519486 - DNA, 15 bp, Homo sapiens
cacagatgctccagg

SEQ ID NO: 3519487 - DNA, 14 bp, Homo sapiens
cacagcaaccccag

SEQ ID NO: 3519488 - DNA, 17 bp, Homo sapiens
cacagcaaccccaggct

SEQ ID NO: 3519489 - DNA, 12 bp, Homo sapiens
cacagcacagcc

SEQ ID NO: 3519490 - DNA, 12 bp, Homo sapiens
cacagcagcctg

SEQ ID NO: 3519491 - DNA, 13 bp, Homo sapiens
cacagcatctgta

SEQ ID NO: 3519492 - DNA, 22 bp, Homo sapiens
cacagccaacacgcacctgcct

SEQ ID NO: 3519493 - DNA, 16 bp, Homo sapiens
cacagccagcacctgg

SEQ ID NO: 3519494 - DNA, 17 bp, Homo sapiens
cacagcctcccctgcca

SEQ ID NO: 3519495 - DNA, 21 bp, Homo sapiens
cacagcctcccctgccagggc

SEQ ID NO: 3519496 - DNA, 11 bp, Homo sapiens
cacagcctctg

SEQ ID NO: 3519497 - DNA, 20 bp, Homo sapiens
cacagcggaggtgtggagcc

SEQ ID NO: 3519498 - DNA, 23 bp, Homo sapiens
cacagcggagtctgtcctgtgac

SEQ ID NO: 3519499 - DNA, 16 bp, Homo sapiens
cacagctactctcccc

SEQ ID NO: 3519500 - DNA, 20 bp, Homo sapiens
cacagctacttggtttgtgt

SEQ ID NO: 3519501 - DNA, 20 bp, Homo sapiens
cacagctcttctccaggctg

SEQ ID NO: 3519502 - DNA, 12 bp, Homo sapiens
cacagctgctgg

SEQ ID NO: 3519503 - DNA, 20 bp, Homo sapiens
cacagctgctggagactcct

SEQ ID NO: 3519504 - DNA, 22 bp, Homo sapiens
cacagcttcatttcctgtgtct

SEQ ID NO: 3519505 - DNA, 22 bp, Homo sapiens
cacagcttcccctctctcctcc

SEQ ID NO: 3519506 - DNA, 23 bp, Homo sapiens
cacagcttcccctctctcctcct

SEQ ID NO: 3519507 - DNA, 12 bp, Homo sapiens
cacagcttcctg

SEQ ID NO: 3519508 - DNA, 21 bp, Homo sapiens
cacagcttcctgtccccatct

SEQ ID NO: 3519509 - DNA, 21 bp, Homo sapiens
cacaggacacctggccgcctc

SEQ ID NO: 3519510 - DNA, 15 bp, Homo sapiens
cacaggaccctcgcc

SEQ ID NO: 3519511 - DNA, 16 bp, Homo sapiens
cacaggagtgtcctct

SEQ ID NO: 3519512 - DNA, 16 bp, Homo sapiens
cacaggatgaaggcaa

SEQ ID NO: 3519513 - DNA, 19 bp, Homo sapiens
cagaggcccccagcccagg

SEQ ID NO: 3519514 - DNA, 22 bp, Homo sapiens
cagaggcccccagcccagggct

SEQ ID NO: 3519515 - DNA, 23 bp, Homo sapiens
cagaggcccccagcccagggctc

SEQ ID NO: 3519516 - DNA, 19 bp, Homo sapiens
cagaggccctcgctgccag

SEQ ID NO: 3519517 - DNA, 20 bp, Homo sapiens
cagaggccctcgctgccagc

SEQ ID NO: 3519518 - DNA, 15 bp, Homo sapiens
cagaggcctggggga

SEQ ID NO: 3519519 - DNA, 18 bp, Homo sapiens
cagaggcgcactgtgacc

SEQ ID NO: 3519520 - DNA, 13 bp, Homo sapiens
cagaggctgcagg

SEQ ID NO: 3519521 - DNA, 13 bp, Homo sapiens
cagaggctgggtt

SEQ ID NO: 3519522 - DNA, 17 bp, Homo sapiens
cagagggctggaggccc

SEQ ID NO: 3519523 - DNA, 18 bp, Homo sapiens
cagagggctggaggccca

SEQ ID NO: 3519524 - DNA, 20 bp, Homo sapiens
cagagtatttgaaaaatgta

SEQ ID NO: 3519525 - DNA, 15 bp, Homo sapiens
cagagtcggaacgga

SEQ ID NO: 3519526 - DNA, 20 bp, Homo sapiens
cagagtgagacccagccctc

SEQ ID NO: 3519527 - DNA, 17 bp, Homo sapiens
cagagtgagactctgtc

SEQ ID NO: 3519528 - DNA, 18 bp, Homo sapiens
cagagtgagactctgtct

SEQ ID NO: 3519529 - DNA, 20 bp, Homo sapiens
cagagtgcaagcccctgctc

SEQ ID NO: 3519530 - DNA, 18 bp, Homo sapiens
cagagttccccatgcaga

SEQ ID NO: 3519531 - DNA, 14 bp, Homo sapiens
cagagttgtaaata

SEQ ID NO: 3519532 - DNA, 16 bp, Homo sapiens
cagagttgtaaatata

SEQ ID NO: 3519533 - DNA, 17 bp, Homo sapiens
cagagttgtaaatatat

SEQ ID NO: 3519534 - DNA, 18 bp, Homo sapiens
cagagttgtaaatatata

SEQ ID NO: 3519535 - DNA, 23 bp, Homo sapiens
cagagttgtaaatatataaatat

SEQ ID NO: 3519536 - DNA, 21 bp, Homo sapiens
cagatacaggaaaagctgctg

SEQ ID NO: 3519537 - DNA, 22 bp, Homo sapiens
cagatacaggaaaagctgctga

SEQ ID NO: 3519538 - DNA, 21 bp, Homo sapiens
cagatcagactctccttcagg

SEQ ID NO: 3519539 - DNA, 18 bp, Homo sapiens
cagatccagcctggggtc

SEQ ID NO: 3519540 - DNA, 12 bp, Homo sapiens
cagatccaggac

SEQ ID NO: 3519541 - DNA, 13 bp, Homo sapiens
cagatccaggact

SEQ ID NO: 3519542 - DNA, 15 bp, Homo sapiens
cagatccagggacag

SEQ ID NO: 3519543 - DNA, 15 bp, Homo sapiens
cagatccagggactg

SEQ ID NO: 3519544 - DNA, 21 bp, Homo sapiens
cagatcccaggcccctggagg

SEQ ID NO: 3519545 - DNA, 14 bp, Homo sapiens
cagatcctcttctc

SEQ ID NO: 3519546 - DNA, 23 bp, Homo sapiens
cagatcctcttctcaaagctggg

SEQ ID NO: 3519547 - DNA, 17 bp, Homo sapiens
cagatcgcatttcctaa

SEQ ID NO: 3519548 - DNA, 21 bp, Homo sapiens
cagatctagtcaatcaagtct

SEQ ID NO: 3519549 - DNA, 22 bp, Homo sapiens
cagatctgacatgattccttcc

SEQ ID NO: 3519550 - DNA, 15 bp, Homo sapiens
cagatctggaacctc

SEQ ID NO: 3519551 - DNA, 23 bp, Homo sapiens
cagatctggaacctcagcctggc

SEQ ID NO: 3519552 - DNA, 18 bp, Homo sapiens
cagatcttaatataaatt

SEQ ID NO: 3519553 - DNA, 16 bp, Homo sapiens
cagatgacaagatggt

SEQ ID NO: 3519554 - DNA, 23 bp, Homo sapiens
cagatgactatgcagaggcctgg

SEQ ID NO: 3519555 - DNA, 16 bp, Homo sapiens
cagatgatttcccccc

SEQ ID NO: 3519556 - DNA, 16 bp, Homo sapiens
cagatgcaaagaggca

SEQ ID NO: 3519557 - DNA, 13 bp, Homo sapiens
cagatgcaccagc

SEQ ID NO: 3519558 - DNA, 16 bp, Homo sapiens
cagatgcaccagccct

SEQ ID NO: 3519559 - DNA, 17 bp, Homo sapiens
cagatgcaccagccctt

SEQ ID NO: 3519560 - DNA, 14 bp, Homo sapiens
cagatgcagggcag

SEQ ID NO: 3519561 - DNA, 18 bp, Homo sapiens
cagatgcccgagggaggg

SEQ ID NO: 3519562 - DNA, 18 bp, Homo sapiens
cagatgcctacttttggc

SEQ ID NO: 3519563 - DNA, 19 bp, Homo sapiens
cagatggaaccgcaggaag

SEQ ID NO: 3519564 - DNA, 20 bp, Homo sapiens
cagatggaaccgcaggaagc

SEQ ID NO: 3519565 - DNA, 13 bp, Homo sapiens
cagatgtaatgtt

SEQ ID NO: 3519566 - DNA, 23 bp, Homo sapiens
cagatgtaatgttttctttgcaa

SEQ ID NO: 3519567 - DNA, 14 bp, Homo sapiens
cagatgtgaaccat

SEQ ID NO: 3519568 - DNA, 17 bp, Homo sapiens
cagatgtgaaccattaa

SEQ ID NO: 3519569 - DNA, 18 bp, Homo sapiens
cagatgtttccagacttc

SEQ ID NO: 3519570 - DNA, 14 bp, Homo sapiens
cagatgtttctttt

SEQ ID NO: 3519571 - DNA, 23 bp, Homo sapiens
cagatgttttggtcaagtagttt

SEQ ID NO: 3519572 - DNA, 19 bp, Homo sapiens
cagattcacactgtctggt

SEQ ID NO: 3519573 - DNA, 16 bp, Homo sapiens
cagattcccctgtgtc

SEQ ID NO: 3519574 - DNA, 17 bp, Homo sapiens
cagattcccctgtgtca

SEQ ID NO: 3519575 - DNA, 22 bp, Homo sapiens
cagattgagttttcttctgtga

SEQ ID NO: 3519576 - DNA, 17 bp, Homo sapiens
cagattgcaacaggctg

SEQ ID NO: 3519577 - DNA, 18 bp, Homo sapiens
cagattgcaacaggctgg

SEQ ID NO: 3519578 - DNA, 21 bp, Homo sapiens
cagattgcaacaggctgggct

SEQ ID NO: 3519579 - DNA, 12 bp, Homo sapiens
cagattgcatgt

SEQ ID NO: 3519580 - DNA, 20 bp, Homo sapiens
cagattgcatgtgactctga

SEQ ID NO: 3519581 - DNA, 22 bp, Homo sapiens
cagattggctcacactgagaat

SEQ ID NO: 3519582 - DNA, 17 bp, Homo sapiens
cagattgtggaatgttg

SEQ ID NO: 3519583 - DNA, 21 bp, Homo sapiens
cagattgtggaatgttggata

SEQ ID NO: 3519584 - DNA, 24 bp, Homo sapiens
cagatttccagtctccaccaggaa

SEQ ID NO: 3519585 - DNA, 19 bp, Homo sapiens
cagattttgatagcaaagc

SEQ ID NO: 3519586 - DNA, 16 bp, Homo sapiens
cagattttgctgtata

SEQ ID NO: 3519587 - DNA, 18 bp, Homo sapiens
cagcaaaaaagtccaatt

SEQ ID NO: 3519588 - DNA, 14 bp, Homo sapiens
cagcaaaaagcaaa

SEQ ID NO: 3519589 - DNA, 20 bp, Homo sapiens
cagcaaaaagcaaaatcatt

SEQ ID NO: 3519590 - DNA, 18 bp, Homo sapiens
cagcaaaagatgcttctc

SEQ ID NO: 3519591 - DNA, 21 bp, Homo sapiens
cagcaaaccatttttaaagta

SEQ ID NO: 3519592 - DNA, 14 bp, Homo sapiens
cagcaaattttcag

SEQ ID NO: 3519593 - DNA, 22 bp, Homo sapiens
cagcaagaagatcctaaaacaa

SEQ ID NO: 3519594 - DNA, 16 bp, Homo sapiens
cagcaagtgagagctg

SEQ ID NO: 3519595 - DNA, 16 bp, Homo sapiens
cagcacaaggccatct

SEQ ID NO: 3519596 - DNA, 18 bp, Homo sapiens
cagcacaaggccttgcct

SEQ ID NO: 3519597 - DNA, 14 bp, Homo sapiens
cagcacacagggca

SEQ ID NO: 3519598 - DNA, 17 bp, Homo sapiens
cagcaccctataaatca

SEQ ID NO: 3519599 - DNA, 16 bp, Homo sapiens
cagcaccgttctgtgc

SEQ ID NO: 3519600 - DNA, 11 bp, Homo sapiens
cagcactgagg

SEQ ID NO: 3519601 - DNA, 17 bp, Homo sapiens
cagcactgaggaagaac

SEQ ID NO: 3519602 - DNA, 19 bp, Homo sapiens
cagcactgcttgaggaaaa

SEQ ID NO: 3519603 - DNA, 13 bp, Homo sapiens
cagcacttattta

SEQ ID NO: 3519604 - DNA, 18 bp, Homo sapiens
cagcacttgtccagctga

SEQ ID NO: 3519605 - DNA, 15 bp, Homo sapiens
cagcactttgggagg

SEQ ID NO: 3519606 - DNA, 16 bp, Homo sapiens
cagcactttgggaggc

SEQ ID NO: 3519607 - DNA, 13 bp, Homo sapiens
cagcagcccaagc

SEQ ID NO: 3519608 - DNA, 19 bp, Homo sapiens
cagcagcccaagcttccct

SEQ ID NO: 3519609 - DNA, 14 bp, Homo sapiens
cagcaggaggccag

SEQ ID NO: 3519610 - DNA, 15 bp, Homo sapiens
cagcaggaggccagg

SEQ ID NO: 3519611 - DNA, 22 bp, Homo sapiens
cagcagggaaaatgcagcaggg

SEQ ID NO: 3519612 - DNA, 15 bp, Homo sapiens
cagcagggatgccct

SEQ ID NO: 3519613 - DNA, 18 bp, Homo sapiens
cagcaggtagcctgctgg

SEQ ID NO: 3519614 - DNA, 19 bp, Homo sapiens
cagcaggtagcctgctggt

SEQ ID NO: 3519615 - DNA, 21 bp, Homo sapiens
cagcagtctctgccttgcctt

SEQ ID NO: 3519616 - DNA, 17 bp, Homo sapiens
cagcatatacaataatg

SEQ ID NO: 3519617 - DNA, 13 bp, Homo sapiens
cagcatcagggtt

SEQ ID NO: 3519618 - DNA, 23 bp, Homo sapiens
cagcatcagggttaagaagactt

SEQ ID NO: 3519619 - DNA, 18 bp, Homo sapiens
cagcatcccttgaccagg

SEQ ID NO: 3519620 - DNA, 19 bp, Homo sapiens
cagcatcccttgaccaggc

SEQ ID NO: 3519621 - DNA, 23 bp, Homo sapiens
cagcatcccttgaccaggcctgg

SEQ ID NO: 3519622 - DNA, 16 bp, Homo sapiens
cagcatcctggcaccc

SEQ ID NO: 3519623 - DNA, 19 bp, Homo sapiens
cagcatcctggcacccggc

SEQ ID NO: 3519624 - DNA, 22 bp, Homo sapiens
cagcatcggacaagacccccag

SEQ ID NO: 3519625 - DNA, 20 bp, Homo sapiens
cagcattctcaggcaccagt

SEQ ID NO: 3519626 - DNA, 15 bp, Homo sapiens
cagccaaaccctgtc

SEQ ID NO: 3519627 - DNA, 16 bp, Homo sapiens
cagccaaaccctgtct

SEQ ID NO: 3519628 - DNA, 16 bp, Homo sapiens
cagccaaacgggagct

SEQ ID NO: 3519629 - DNA, 22 bp, Homo sapiens
cagccaacacgcacctgcctca

SEQ ID NO: 3519630 - DNA, 14 bp, Homo sapiens
cagccaactagccc

SEQ ID NO: 3519631 - DNA, 16 bp, Homo sapiens
cagccaactagcccct

SEQ ID NO: 3519632 - DNA, 20 bp, Homo sapiens
cagccaagggatgaaagaga

SEQ ID NO: 3519633 - DNA, 23 bp, Homo sapiens
cagccaaggttttataaggctga

SEQ ID NO: 3519634 - DNA, 23 bp, Homo sapiens
cagccacggccaggccagaggga

SEQ ID NO: 3519635 - DNA, 21 bp, Homo sapiens
cagccactcccctccactctc

SEQ ID NO: 3519636 - DNA, 13 bp, Homo sapiens
cagccagaggcac

SEQ ID NO: 3519637 - DNA, 22 bp, Homo sapiens
cagccagatggactccagcctg

SEQ ID NO: 3519638 - DNA, 12 bp, Homo sapiens
cagccagctcct

SEQ ID NO: 3519639 - DNA, 20 bp, Homo sapiens
cagccagctcctgggcagct

SEQ ID NO: 3519640 - DNA, 17 bp, Homo sapiens
cagccaggccctgccag

SEQ ID NO: 3519641 - DNA, 15 bp, Homo sapiens
cagccagggctgcta

SEQ ID NO: 3519642 - DNA, 16 bp, Homo sapiens
cagccagggctgctag

SEQ ID NO: 3519643 - DNA, 23 bp, Homo sapiens
cagccagggctgctagacggagg

SEQ ID NO: 3519644 - DNA, 23 bp, Homo sapiens
cagtgcccccactgaccagaact

SEQ ID NO: 3519645 - DNA, 16 bp, Homo sapiens
cagtgctcgctgttgc

SEQ ID NO: 3519646 - DNA, 19 bp, Homo sapiens
cagtgctcgctgttgctga

SEQ ID NO: 3519647 - DNA, 15 bp, Homo sapiens
cagtgctggagaaat

SEQ ID NO: 3519648 - DNA, 16 bp, Homo sapiens
cagtgctgtgctgtgc

SEQ ID NO: 3519649 - DNA, 14 bp, Homo sapiens
cagtgcttgccaca

SEQ ID NO: 3519650 - DNA, 15 bp, Homo sapiens
cagtggaggtttgtc

SEQ ID NO: 3519651 - DNA, 20 bp, Homo sapiens
cagtggcgcattctaggctc

SEQ ID NO: 3519652 - DNA, 13 bp, Homo sapiens
cagtggctgctgc

SEQ ID NO: 3519653 - DNA, 18 bp, Homo sapiens
cagtggctgctgcccagg

SEQ ID NO: 3519654 - DNA, 17 bp, Homo sapiens
cagtgggagatgttaga

SEQ ID NO: 3519655 - DNA, 15 bp, Homo sapiens
cagtgggagctgcct

SEQ ID NO: 3519656 - DNA, 17 bp, Homo sapiens
cagtgggagctgcctgt

SEQ ID NO: 3519657 - DNA, 12 bp, Homo sapiens
cagtgggaggca

SEQ ID NO: 3519658 - DNA, 13 bp, Homo sapiens
cagtgggaggcaa

SEQ ID NO: 3519659 - DNA, 21 bp, Homo sapiens
cagtgggatgaaccagccggg

SEQ ID NO: 3519660 - DNA, 18 bp, Homo sapiens
cagtggggctctctgagt

SEQ ID NO: 3519661 - DNA, 21 bp, Homo sapiens
cagtggggtttcgcagcctga

SEQ ID NO: 3519662 - DNA, 22 bp, Homo sapiens
cagtggggtttcgcagcctgag

SEQ ID NO: 3519663 - DNA, 16 bp, Homo sapiens
cagtgggtaaaattag

SEQ ID NO: 3519664 - DNA, 20 bp, Homo sapiens
cagtggtccacatcccggga

SEQ ID NO: 3519665 - DNA, 20 bp, Homo sapiens
cagtggtgcgatctgggttc

SEQ ID NO: 3519666 - DNA, 22 bp, Homo sapiens
cagtgtacccacgctgggtatt

SEQ ID NO: 3519667 - DNA, 15 bp, Homo sapiens
cagtgtatttgtatt

SEQ ID NO: 3519668 - DNA, 16 bp, Homo sapiens
cagtgtccttagaaca

SEQ ID NO: 3519669 - DNA, 20 bp, Homo sapiens
cagtgtccttagaacatttt

SEQ ID NO: 3519670 - DNA, 14 bp, Homo sapiens
cagtgtctcggagg

SEQ ID NO: 3519671 - DNA, 14 bp, Homo sapiens
cagtgtctgtgtgt

SEQ ID NO: 3519672 - DNA, 14 bp, Homo sapiens
cagtgtgacaagga

SEQ ID NO: 3519673 - DNA, 18 bp, Homo sapiens
cagtgtgaggccagggca

SEQ ID NO: 3519674 - DNA, 14 bp, Homo sapiens
cagtgtgcacccct

SEQ ID NO: 3519675 - DNA, 16 bp, Homo sapiens
cagtgtgcacccctcc

SEQ ID NO: 3519676 - DNA, 19 bp, Homo sapiens
cagtgtgcactaaggggcc

SEQ ID NO: 3519677 - DNA, 15 bp, Homo sapiens
cagtgtgggacaggc

SEQ ID NO: 3519678 - DNA, 14 bp, Homo sapiens
cagtgttaaatgtg

SEQ ID NO: 3519679 - DNA, 17 bp, Homo sapiens
cagtgttacctgtgtgc

SEQ ID NO: 3519680 - DNA, 18 bp, Homo sapiens
cagtgttacctgtgtgct

SEQ ID NO: 3519681 - DNA, 15 bp, Homo sapiens
cagttaaaaaaaatt

SEQ ID NO: 3519682 - DNA, 16 bp, Homo sapiens
cagttaaaaaaaattt

SEQ ID NO: 3519683 - DNA, 22 bp, Homo sapiens
cagttattatatttacaaatgg

SEQ ID NO: 3519684 - DNA, 13 bp, Homo sapiens
cagttcaaagaag

SEQ ID NO: 3519685 - DNA, 21 bp, Homo sapiens
cagttcatctatggcagtcca

SEQ ID NO: 3519686 - DNA, 22 bp, Homo sapiens
cagttcatctatggcagtccag

SEQ ID NO: 3519687 - DNA, 17 bp, Homo sapiens
cagttcctatgacacag

SEQ ID NO: 3519688 - DNA, 15 bp, Homo sapiens
cagttctgatgctta

SEQ ID NO: 3519689 - DNA, 22 bp, Homo sapiens
cagttctggatggtgtgccttc

SEQ ID NO: 3519690 - DNA, 17 bp, Homo sapiens
cagttctgggtgctccc

SEQ ID NO: 3519691 - DNA, 20 bp, Homo sapiens
cagttctgggtgctccctac

SEQ ID NO: 3519692 - DNA, 16 bp, Homo sapiens
cagttgattttctgga

SEQ ID NO: 3519693 - DNA, 16 bp, Homo sapiens
cagttgggtggatgcc

SEQ ID NO: 3519694 - DNA, 18 bp, Homo sapiens
cagttgggtggatgcctg

SEQ ID NO: 3519695 - DNA, 21 bp, Homo sapiens
cagttgtagggttacagagac

SEQ ID NO: 3519696 - DNA, 18 bp, Homo sapiens
cagtttaaaaaaattggt

SEQ ID NO: 3519697 - DNA, 19 bp, Homo sapiens
cagtttatttccactattt

SEQ ID NO: 3519698 - DNA, 19 bp, Homo sapiens
cagtttcagagatggacag

SEQ ID NO: 3519699 - DNA, 18 bp, Homo sapiens
cagtttgaaattctgaat

SEQ ID NO: 3519700 - DNA, 19 bp, Homo sapiens
cagtttgaaattctgaatt

SEQ ID NO: 3519701 - DNA, 13 bp, Homo sapiens
cagtttgtatata

SEQ ID NO: 3519702 - DNA, 16 bp, Homo sapiens
cagtttgttgatcttt

SEQ ID NO: 3519703 - DNA, 16 bp, Homo sapiens
cagttttaactagaat

SEQ ID NO: 3519704 - DNA, 21 bp, Homo sapiens
cagttttacgcaacactaaat

SEQ ID NO: 3519705 - DNA, 22 bp, Homo sapiens
cagttttcaagtcaaattaata

SEQ ID NO: 3519706 - DNA, 19 bp, Homo sapiens
cagttttcctatgctttga

SEQ ID NO: 3519707 - DNA, 21 bp, Homo sapiens
cataaaaattagccaagtgtg

SEQ ID NO: 3519708 - DNA, 16 bp, Homo sapiens
cataaaagaagtttca

SEQ ID NO: 3519709 - DNA, 17 bp, Homo sapiens
cataaagacaatcactg

SEQ ID NO: 3519710 - DNA, 20 bp, Homo sapiens
cataaagacaatcactgcca

SEQ ID NO: 3519711 - DNA, 16 bp, Homo sapiens
cataaaggtaaaacaa

SEQ ID NO: 3519712 - DNA, 15 bp, Homo sapiens
cataacaattcctct

SEQ ID NO: 3519713 - DNA, 16 bp, Homo sapiens
cataacaattcctcta

SEQ ID NO: 3519714 - DNA, 22 bp, Homo sapiens
cataacggatcagaaatacaga

SEQ ID NO: 3519715 - DNA, 18 bp, Homo sapiens
cataagttggaccagagg

SEQ ID NO: 3519716 - DNA, 20 bp, Homo sapiens
cataatgatggatttaacag

SEQ ID NO: 3519717 - DNA, 21 bp, Homo sapiens
cataatgatggatttaacagc

SEQ ID NO: 3519718 - DNA, 21 bp, Homo sapiens
cataatgctaatttaaagaga

SEQ ID NO: 3519719 - DNA, 22 bp, Homo sapiens
cataatgctaatttaaagagac

SEQ ID NO: 3519720 - DNA, 21 bp, Homo sapiens
cataattttagtaatttccta

SEQ ID NO: 3519721 - DNA, 20 bp, Homo sapiens
catacaccagcattcctttt

SEQ ID NO: 3519722 - DNA, 21 bp, Homo sapiens
catacaccccctcttctgagc

SEQ ID NO: 3519723 - DNA, 18 bp, Homo sapiens
catacccaaaccaggtgg

SEQ ID NO: 3519724 - DNA, 22 bp, Homo sapiens
catacgcttttaatgaaaagga

SEQ ID NO: 3519725 - DNA, 18 bp, Homo sapiens
catactatctactctcct

SEQ ID NO: 3519726 - DNA, 23 bp, Homo sapiens
catactccatcagttagagctga

SEQ ID NO: 3519727 - DNA, 11 bp, Homo sapiens
catactgctgt

SEQ ID NO: 3519728 - DNA, 23 bp, Homo sapiens
catacttgaagggccagagccag

SEQ ID NO: 3519729 - DNA, 14 bp, Homo sapiens
catactttcctgta

SEQ ID NO: 3519730 - DNA, 22 bp, Homo sapiens
catactttgtaaataggatttt

SEQ ID NO: 3519731 - DNA, 11 bp, Homo sapiens
catagaaaaat

SEQ ID NO: 3519732 - DNA, 20 bp, Homo sapiens
catagaaatggaaattttgc

SEQ ID NO: 3519733 - DNA, 23 bp, Homo sapiens
catagaaatggaaattttgctat

SEQ ID NO: 3519734 - DNA, 14 bp, Homo sapiens
catagagtccagat

SEQ ID NO: 3519735 - DNA, 12 bp, Homo sapiens
catagcagctgc

SEQ ID NO: 3519736 - DNA, 11 bp, Homo sapiens
catagcccagt

SEQ ID NO: 3519737 - DNA, 18 bp, Homo sapiens
cataggacctttccacca

SEQ ID NO: 3519738 - DNA, 22 bp, Homo sapiens
catagtaacttcttatggaatt

SEQ ID NO: 3519739 - DNA, 20 bp, Homo sapiens
catagtaccatttatacaaa

SEQ ID NO: 3519740 - DNA, 16 bp, Homo sapiens
catagtatggtggctg

SEQ ID NO: 3519741 - DNA, 19 bp, Homo sapiens
catagtatggtggctgggt

SEQ ID NO: 3519742 - DNA, 23 bp, Homo sapiens
catagtgaaataaattctgattc

SEQ ID NO: 3519743 - DNA, 19 bp, Homo sapiens
catataaacatcacacaca

SEQ ID NO: 3519744 - DNA, 17 bp, Homo sapiens
catataagttgagaagg

SEQ ID NO: 3519745 - DNA, 23 bp, Homo sapiens
catatatatgttttaagaggcag

SEQ ID NO: 3519746 - DNA, 20 bp, Homo sapiens
catatatccttttcttctat

SEQ ID NO: 3519747 - DNA, 17 bp, Homo sapiens
catatattgcatttctg

SEQ ID NO: 3519748 - DNA, 14 bp, Homo sapiens
catatattggcact

SEQ ID NO: 3519749 - DNA, 17 bp, Homo sapiens
catatattttttagaaa

SEQ ID NO: 3519750 - DNA, 12 bp, Homo sapiens
catatctgcctt

SEQ ID NO: 3519751 - DNA, 20 bp, Homo sapiens
catatctgcctttattgtgt

SEQ ID NO: 3519752 - DNA, 16 bp, Homo sapiens
catatgaaaggtgcca

SEQ ID NO: 3519753 - DNA, 15 bp, Homo sapiens
catatgtacagaaga

SEQ ID NO: 3519754 - DNA, 24 bp, Homo sapiens
catatgtagccttcacacagatag

SEQ ID NO: 3519755 - DNA, 17 bp, Homo sapiens
catatgttgaatacttt

SEQ ID NO: 3519756 - DNA, 17 bp, Homo sapiens
catattctaaaaccatt

SEQ ID NO: 3519757 - DNA, 21 bp, Homo sapiens
catattctagtgtaacactgc

SEQ ID NO: 3519758 - DNA, 14 bp, Homo sapiens
catattgcacatgt

SEQ ID NO: 3519759 - DNA, 15 bp, Homo sapiens
catattgcacatgtc

SEQ ID NO: 3519760 - DNA, 16 bp, Homo sapiens
catattgcacatgtct

SEQ ID NO: 3519761 - DNA, 17 bp, Homo sapiens
catattgctgagagaaa

SEQ ID NO: 3519762 - DNA, 23 bp, Homo sapiens
catattgctgagagaaatatgga

SEQ ID NO: 3519763 - DNA, 13 bp, Homo sapiens
catatttaactgg

SEQ ID NO: 3519764 - DNA, 14 bp, Homo sapiens
catatttaatgttt

SEQ ID NO: 3519765 - DNA, 16 bp, Homo sapiens
catatttaatgtttta

SEQ ID NO: 3519766 - DNA, 12 bp, Homo sapiens
catattttctgt

SEQ ID NO: 3519767 - DNA, 17 bp, Homo sapiens
catattttctgtccagt

SEQ ID NO: 3519768 - DNA, 15 bp, Homo sapiens
catcaaaatgctttt

SEQ ID NO: 3519769 - DNA, 15 bp, Homo sapiens
catcaaatggaagac

SEQ ID NO: 3519770 - DNA, 19 bp, Homo sapiens
catcaaatggaagacacat

SEQ ID NO: 3519771 - DNA, 15 bp, Homo sapiens
catcaacttaaaagt

SEQ ID NO: 3519772 - DNA, 13 bp, Homo sapiens
catcaagaagggc

SEQ ID NO: 3519773 - DNA, 17 bp, Homo sapiens
catcaagaagggctgca

SEQ ID NO: 3519774 - DNA, 20 bp, Homo sapiens
catcaagaagggctgcatga

SEQ ID NO: 3519775 - DNA, 21 bp, Homo sapiens
catcaagaagggctgcatgat

SEQ ID NO: 3519776 - DNA, 12 bp, Homo sapiens
ccaatattataa

SEQ ID NO: 3519777 - DNA, 13 bp, Homo sapiens
ccaatattataat

SEQ ID NO: 3519778 - DNA, 21 bp, Homo sapiens
ccaatcagagaccaggccctg

SEQ ID NO: 3519779 - DNA, 16 bp, Homo sapiens
ccaatcggtgtgtagt

SEQ ID NO: 3519780 - DNA, 19 bp, Homo sapiens
ccaatctgcaatttctact

SEQ ID NO: 3519781 - DNA, 15 bp, Homo sapiens
ccaatgaaaaaatgt

SEQ ID NO: 3519782 - DNA, 18 bp, Homo sapiens
ccaatgagacttgccttc

SEQ ID NO: 3519783 - DNA, 21 bp, Homo sapiens
ccaatgagacttgccttccta

SEQ ID NO: 3519784 - DNA, 13 bp, Homo sapiens
ccaatgcactgag

SEQ ID NO: 3519785 - DNA, 15 bp, Homo sapiens
ccaatgtaggagctg

SEQ ID NO: 3519786 - DNA, 20 bp, Homo sapiens
ccaatgttctctcttctcca

SEQ ID NO: 3519787 - DNA, 15 bp, Homo sapiens
ccaattaatgtagct

SEQ ID NO: 3519788 - DNA, 17 bp, Homo sapiens
ccaattatgttaaacta

SEQ ID NO: 3519789 - DNA, 22 bp, Homo sapiens
ccaattctatcttttgtttcct

SEQ ID NO: 3519790 - DNA, 17 bp, Homo sapiens
ccaattctcgagcttgg

SEQ ID NO: 3519791 - DNA, 18 bp, Homo sapiens
ccaattctcgagcttggg

SEQ ID NO: 3519792 - DNA, 16 bp, Homo sapiens
ccaatttcagactccc

SEQ ID NO: 3519793 - DNA, 14 bp, Homo sapiens
ccacaaactgtaat

SEQ ID NO: 3519794 - DNA, 18 bp, Homo sapiens
ccacaaaggagagctagc

SEQ ID NO: 3519795 - DNA, 20 bp, Homo sapiens
ccacaaaggcaaagggtcca

SEQ ID NO: 3519796 - DNA, 17 bp, Homo sapiens
ccacaaggacttcctgt

SEQ ID NO: 3519797 - DNA, 21 bp, Homo sapiens
ccacaaggacttcctgtccag

SEQ ID NO: 3519798 - DNA, 13 bp, Homo sapiens
ccacaccacatct

SEQ ID NO: 3519799 - DNA, 14 bp, Homo sapiens
ccacactggactcc

SEQ ID NO: 3519800 - DNA, 21 bp, Homo sapiens
ccacactggactccggccctc

SEQ ID NO: 3519801 - DNA, 22 bp, Homo sapiens
ccacactggactccggccctcc

SEQ ID NO: 3519802 - DNA, 18 bp, Homo sapiens
ccacagaactgcttacta

SEQ ID NO: 3519803 - DNA, 22 bp, Homo sapiens
ccacagagaaagtacttctcca

SEQ ID NO: 3519804 - DNA, 19 bp, Homo sapiens
ccacagcaaccccaggctg

SEQ ID NO: 3519805 - DNA, 18 bp, Homo sapiens
ccacagccagcacctggc

SEQ ID NO: 3519806 - DNA, 16 bp, Homo sapiens
ccacagcctcccctgc

SEQ ID NO: 3519807 - DNA, 16 bp, Homo sapiens
ccacagcctgggaagg

SEQ ID NO: 3519808 - DNA, 12 bp, Homo sapiens
ccacagctgctg

SEQ ID NO: 3519809 - DNA, 14 bp, Homo sapiens
ccacagcttcctgt

SEQ ID NO: 3519810 - DNA, 16 bp, Homo sapiens
ccacaggacacagtca

SEQ ID NO: 3519811 - DNA, 20 bp, Homo sapiens
ccacaggccccccgcagcac

SEQ ID NO: 3519812 - DNA, 23 bp, Homo sapiens
ccacaggccccccgcagcaccct

SEQ ID NO: 3519813 - DNA, 11 bp, Homo sapiens
ccacaggcctg

SEQ ID NO: 3519814 - DNA, 19 bp, Homo sapiens
ccacaggcctgagatttca

SEQ ID NO: 3519815 - DNA, 18 bp, Homo sapiens
ccacagggtctgcctcca

SEQ ID NO: 3519816 - DNA, 14 bp, Homo sapiens
ccacaggtgtgagc

SEQ ID NO: 3519817 - DNA, 23 bp, Homo sapiens
ccacatctaagcctgaaggggcg

SEQ ID NO: 3519818 - DNA, 18 bp, Homo sapiens
ccacatcttccatttcca

SEQ ID NO: 3519819 - DNA, 14 bp, Homo sapiens
ccacatcttgctct

SEQ ID NO: 3519820 - DNA, 22 bp, Homo sapiens
ccacatcttgctctgctgacag

SEQ ID NO: 3519821 - DNA, 19 bp, Homo sapiens
ccacatgccaagcactgtg

SEQ ID NO: 3519822 - DNA, 19 bp, Homo sapiens
ccacatttggaatactttt

SEQ ID NO: 3519823 - DNA, 17 bp, Homo sapiens
ccaccaagacttgtttt

SEQ ID NO: 3519824 - DNA, 21 bp, Homo sapiens
ccaccacagccagcacctggc

SEQ ID NO: 3519825 - DNA, 15 bp, Homo sapiens
ccaccaccctgtctt

SEQ ID NO: 3519826 - DNA, 19 bp, Homo sapiens
ccaccaggccacctcccca

SEQ ID NO: 3519827 - DNA, 14 bp, Homo sapiens
ccaccagttaacgt

SEQ ID NO: 3519828 - DNA, 19 bp, Homo sapiens
ccaccatatgaattgtaca

SEQ ID NO: 3519829 - DNA, 18 bp, Homo sapiens
ccaccatcaccagacagg

SEQ ID NO: 3519830 - DNA, 14 bp, Homo sapiens
ccacccaagtatac

SEQ ID NO: 3519831 - DNA, 13 bp, Homo sapiens
ccacccacctcag

SEQ ID NO: 3519832 - DNA, 16 bp, Homo sapiens
ccacccacctcagcct

SEQ ID NO: 3519833 - DNA, 19 bp, Homo sapiens
ccacccacctccctgcctc

SEQ ID NO: 3519834 - DNA, 14 bp, Homo sapiens
ccaccccaggccct

SEQ ID NO: 3519835 - DNA, 15 bp, Homo sapiens
ccaccccatctggct

SEQ ID NO: 3519836 - DNA, 23 bp, Homo sapiens
ccaccccatgtcaccggatcctg

SEQ ID NO: 3519837 - DNA, 13 bp, Homo sapiens
ccacccctccaga

SEQ ID NO: 3519838 - DNA, 14 bp, Homo sapiens
ccacccctggaaga

SEQ ID NO: 3519839 - DNA, 17 bp, Homo sapiens
ccacccctgggggctct

SEQ ID NO: 3519840 - DNA, 13 bp, Homo sapiens
ccaccccttagat

SEQ ID NO: 3519841 - DNA, 12 bp, Homo sapiens
ccaccctgctct

SEQ ID NO: 3519842 - DNA, 21 bp, Homo sapiens
ccaccctggccgagtccaagc

SEQ ID NO: 3519843 - DNA, 22 bp, Homo sapiens
ccaccctggccgagtccaagct

SEQ ID NO: 3519844 - DNA, 15 bp, Homo sapiens
ccaccctgggccctg

SEQ ID NO: 3519845 - DNA, 19 bp, Homo sapiens
ccaccctgtcttcctctgc

SEQ ID NO: 3519846 - DNA, 20 bp, Homo sapiens
ccaccctgtcttcctctgca

SEQ ID NO: 3519847 - DNA, 19 bp, Homo sapiens
ccacctaggcaatgaagaa

SEQ ID NO: 3519848 - DNA, 13 bp, Homo sapiens
ccacctcagcctc

SEQ ID NO: 3519849 - DNA, 14 bp, Homo sapiens
ccacctcagcctcc

SEQ ID NO: 3519850 - DNA, 15 bp, Homo sapiens
ccacctcagcctccc

SEQ ID NO: 3519851 - DNA, 18 bp, Homo sapiens
ccacctgcccttttttct

SEQ ID NO: 3519852 - DNA, 22 bp, Homo sapiens
ccacctgcccttttttctgcct

SEQ ID NO: 3519853 - DNA, 19 bp, Homo sapiens
ccacctgtcaaacaaagcc

SEQ ID NO: 3519854 - DNA, 20 bp, Homo sapiens
ccacctgtcaaacaaagcca

SEQ ID NO: 3519855 - DNA, 15 bp, Homo sapiens
ccacctgtctcagcc

SEQ ID NO: 3519856 - DNA, 23 bp, Homo sapiens
ccacctgtctcagcctcccagag

SEQ ID NO: 3519857 - DNA, 14 bp, Homo sapiens
ccaccttgcgggga

SEQ ID NO: 3519858 - DNA, 15 bp, Homo sapiens
ccaccttggctgcag

SEQ ID NO: 3519859 - DNA, 14 bp, Homo sapiens
ccacgactgtctcc

SEQ ID NO: 3519860 - DNA, 15 bp, Homo sapiens
ccacgagggctggct

SEQ ID NO: 3519861 - DNA, 19 bp, Homo sapiens
ccacgagggctggctggcc

SEQ ID NO: 3519862 - DNA, 17 bp, Homo sapiens
ccacgcccgtcctgcct

SEQ ID NO: 3519863 - DNA, 21 bp, Homo sapiens
ccacgcccgtcctgcctgtgg

SEQ ID NO: 3519864 - DNA, 12 bp, Homo sapiens
ccacgctccagc

SEQ ID NO: 3519865 - DNA, 23 bp, Homo sapiens
ccacgctgggtattaccatgtaa

SEQ ID NO: 3519866 - DNA, 20 bp, Homo sapiens
ccacggagccactcctctga

SEQ ID NO: 3519867 - DNA, 23 bp, Homo sapiens
ccacggccaggccagagggagtg

SEQ ID NO: 3519868 - DNA, 20 bp, Homo sapiens
ccacggcgttgtacctgtag

SEQ ID NO: 3519869 - DNA, 15 bp, Homo sapiens
ccacgtattcccctt

SEQ ID NO: 3519870 - DNA, 23 bp, Homo sapiens
ccacgtggctgcgtgcccctgct

SEQ ID NO: 3519871 - DNA, 12 bp, Homo sapiens
ccacgtgtgtgt

SEQ ID NO: 3519872 - DNA, 21 bp, Homo sapiens
ccacgttggagaagcccgtgt

SEQ ID NO: 3519873 - DNA, 21 bp, Homo sapiens
ccactaagaattcaaactggg

SEQ ID NO: 3519874 - DNA, 14 bp, Homo sapiens
ccactaagcagagg

SEQ ID NO: 3519875 - DNA, 23 bp, Homo sapiens
ccactacggaatagttggctagg

SEQ ID NO: 3519876 - DNA, 12 bp, Homo sapiens
ccactattttca

SEQ ID NO: 3519877 - DNA, 12 bp, Homo sapiens
ccactcaagcca

SEQ ID NO: 3519878 - DNA, 17 bp, Homo sapiens
ccactcaagccaagcag

SEQ ID NO: 3519879 - DNA, 18 bp, Homo sapiens
ccactcactaggccccca

SEQ ID NO: 3519880 - DNA, 22 bp, Homo sapiens
ccactcactaggcccccacttg

SEQ ID NO: 3519881 - DNA, 11 bp, Homo sapiens
ccactcagctc

SEQ ID NO: 3519882 - DNA, 22 bp, Homo sapiens
ccactcccctccactctctacc

SEQ ID NO: 3519883 - DNA, 17 bp, Homo sapiens
ccactccgagaggtggg

SEQ ID NO: 3519884 - DNA, 19 bp, Homo sapiens
ccactccgagaggtgggcc

SEQ ID NO: 3519885 - DNA, 11 bp, Homo sapiens
ccactcctccc

SEQ ID NO: 3519886 - DNA, 14 bp, Homo sapiens
ccactcctccctcc

SEQ ID NO: 3519887 - DNA, 13 bp, Homo sapiens
ccactcctctgac

SEQ ID NO: 3519888 - DNA, 17 bp, Homo sapiens
ccactctctaccagata

SEQ ID NO: 3519889 - DNA, 20 bp, Homo sapiens
ccactctgcttctctgactt

SEQ ID NO: 3519890 - DNA, 16 bp, Homo sapiens
ccactgacagcctccc

SEQ ID NO: 3519891 - DNA, 22 bp, Homo sapiens
ccactgcaagtccttttgtaaa

SEQ ID NO: 3519892 - DNA, 23 bp, Homo sapiens
ccactgcaagtccttttgtaaag

SEQ ID NO: 3519893 - DNA, 19 bp, Homo sapiens
ccactgcactatagcctag

SEQ ID NO: 3519894 - DNA, 18 bp, Homo sapiens
ccactgcataccaacctg

SEQ ID NO: 3519895 - DNA, 19 bp, Homo sapiens
ccactgcataccaacctgg

SEQ ID NO: 3519896 - DNA, 17 bp, Homo sapiens
ccactgccacaccctcc

SEQ ID NO: 3519897 - DNA, 14 bp, Homo sapiens
ccactgccactcca

SEQ ID NO: 3519898 - DNA, 19 bp, Homo sapiens
ccactgccccttcattgat

SEQ ID NO: 3519899 - DNA, 15 bp, Homo sapiens
ccactgccttcgctt

SEQ ID NO: 3519900 - DNA, 16 bp, Homo sapiens
ccactgccttcgcttc

SEQ ID NO: 3519901 - DNA, 20 bp, Homo sapiens
ccactgcttttggtctgtgt

SEQ ID NO: 3519902 - DNA, 18 bp, Homo sapiens
ccactggactgacctggt

SEQ ID NO: 3519903 - DNA, 18 bp, Homo sapiens
ccactggcacatttttct

SEQ ID NO: 3519904 - DNA, 15 bp, Homo sapiens
ccactggctgctaac

SEQ ID NO: 3519905 - DNA, 16 bp, Homo sapiens
ccactggctgctaaca

SEQ ID NO: 3519906 - DNA, 16 bp, Homo sapiens
ccactggtttctcaga

SEQ ID NO: 3519907 - DNA, 19 bp, Homo sapiens
ccactggtttctcagaatc

SEQ ID NO: 3519908 - DNA, 13 bp, Homo sapiens
cccaacactgagc

SEQ ID NO: 3519909 - DNA, 19 bp, Homo sapiens
cccaacatataaaataatg

SEQ ID NO: 3519910 - DNA, 22 bp, Homo sapiens
cccaacggccctgcagccagct

SEQ ID NO: 3519911 - DNA, 23 bp, Homo sapiens
cccaacgtgcaaagccaaggcag

SEQ ID NO: 3519912 - DNA, 23 bp, Homo sapiens
cccaactacccccagctgtgctt

SEQ ID NO: 3519913 - DNA, 21 bp, Homo sapiens
cccaactctagctgggggtgg

SEQ ID NO: 3519914 - DNA, 15 bp, Homo sapiens
cccaactctcccctg

SEQ ID NO: 3519915 - DNA, 15 bp, Homo sapiens
cccaactgtcttttt

SEQ ID NO: 3519916 - DNA, 12 bp, Homo sapiens
cccaactgttat

SEQ ID NO: 3519917 - DNA, 15 bp, Homo sapiens
cccaagaatgggagg

SEQ ID NO: 3519918 - DNA, 18 bp, Homo sapiens
cccaagacctcagggcac

SEQ ID NO: 3519919 - DNA, 12 bp, Homo sapiens
cccaagagggct

SEQ ID NO: 3519920 - DNA, 13 bp, Homo sapiens
cccaagatgcctg

SEQ ID NO: 3519921 - DNA, 16 bp, Homo sapiens
cccaagatgcctgatc

SEQ ID NO: 3519922 - DNA, 20 bp, Homo sapiens
cccaagcatgggggacccct

SEQ ID NO: 3519923 - DNA, 15 bp, Homo sapiens
cccaagccagaggct

SEQ ID NO: 3519924 - DNA, 13 bp, Homo sapiens
cccaagctctgct

SEQ ID NO: 3519925 - DNA, 17 bp, Homo sapiens
cccaagggaaagaaaag

SEQ ID NO: 3519926 - DNA, 23 bp, Homo sapiens
cccaagggatctggtcctaccca

SEQ ID NO: 3519927 - DNA, 23 bp, Homo sapiens
cccaaggtgaaatgaagcaacag

SEQ ID NO: 3519928 - DNA, 15 bp, Homo sapiens
cccaaggttggagcc

SEQ ID NO: 3519929 - DNA, 20 bp, Homo sapiens
cccaagtaagaggctggagt

SEQ ID NO: 3519930 - DNA, 14 bp, Homo sapiens
cccaagtcttctcc

SEQ ID NO: 3519931 - DNA, 11 bp, Homo sapiens
cccaatattat

SEQ ID NO: 3519932 - DNA, 12 bp, Homo sapiens
cccaatattata

SEQ ID NO: 3519933 - DNA, 17 bp, Homo sapiens
cccaatattataatttt

SEQ ID NO: 3519934 - DNA, 19 bp, Homo sapiens
cccaatcccagctacctca

SEQ ID NO: 3519935 - DNA, 17 bp, Homo sapiens
cccaatccctttattac

SEQ ID NO: 3519936 - DNA, 21 bp, Homo sapiens
cccaatccctttattaccccc

SEQ ID NO: 3519937 - DNA, 16 bp, Homo sapiens
cccaatcttctttttc

SEQ ID NO: 3519938 - DNA, 17 bp, Homo sapiens
cccaatgagacttgcct

SEQ ID NO: 3519939 - DNA, 15 bp, Homo sapiens
cccaatgctgatgtc

SEQ ID NO: 3519940 - DNA, 21 bp, Homo sapiens
cccacaaaggagagctagcag

SEQ ID NO: 3519941 - DNA, 22 bp, Homo sapiens
cccacaagtggtggtaaccctg

SEQ ID NO: 3519942 - DNA, 12 bp, Homo sapiens
cccacaccctgg

SEQ ID NO: 3519943 - DNA, 17 bp, Homo sapiens
cccacagaactgcttac

SEQ ID NO: 3519944 - DNA, 19 bp, Homo sapiens
cccacatgtggccatggcc

SEQ ID NO: 3519945 - DNA, 22 bp, Homo sapiens
cccacatgtggccatggcctct

SEQ ID NO: 3519946 - DNA, 18 bp, Homo sapiens
cccaccatcatgtctggc

SEQ ID NO: 3519947 - DNA, 15 bp, Homo sapiens
cccacccctggaaga

SEQ ID NO: 3519948 - DNA, 14 bp, Homo sapiens
cccacctcagcctc

SEQ ID NO: 3519949 - DNA, 15 bp, Homo sapiens
cccacctcagcctcc

SEQ ID NO: 3519950 - DNA, 12 bp, Homo sapiens
cccacctccctg

SEQ ID NO: 3519951 - DNA, 16 bp, Homo sapiens
cccaccttggctgcag

SEQ ID NO: 3519952 - DNA, 17 bp, Homo sapiens
cccaccttggctgcagg

SEQ ID NO: 3519953 - DNA, 19 bp, Homo sapiens
cccaccttggctgcaggga

SEQ ID NO: 3519954 - DNA, 20 bp, Homo sapiens
cccaccttggctgcagggag

SEQ ID NO: 3519955 - DNA, 21 bp, Homo sapiens
cccacgactgcccggcagggt

SEQ ID NO: 3519956 - DNA, 15 bp, Homo sapiens
cccacgagggctggc

SEQ ID NO: 3519957 - DNA, 23 bp, Homo sapiens
cccacgattggtatgatgctgcc

SEQ ID NO: 3519958 - DNA, 14 bp, Homo sapiens
cccacgctggagtg

SEQ ID NO: 3519959 - DNA, 19 bp, Homo sapiens
cccacgctggagtgcagtg

SEQ ID NO: 3519960 - DNA, 16 bp, Homo sapiens
cccactcaagccaagc

SEQ ID NO: 3519961 - DNA, 17 bp, Homo sapiens
cccactcaagccaagca

SEQ ID NO: 3519962 - DNA, 23 bp, Homo sapiens
cccactcaagccaagcagccaag

SEQ ID NO: 3519963 - DNA, 17 bp, Homo sapiens
cccactgccacaccctc

SEQ ID NO: 3519964 - DNA, 18 bp, Homo sapiens
cccactgccacaccctcc

SEQ ID NO: 3519965 - DNA, 17 bp, Homo sapiens
cccactgccataaaaca

SEQ ID NO: 3519966 - DNA, 21 bp, Homo sapiens
cccactggggtccagggagca

SEQ ID NO: 3519967 - DNA, 12 bp, Homo sapiens
cccactgtatga

SEQ ID NO: 3519968 - DNA, 17 bp, Homo sapiens
cccactgtatgatttat

SEQ ID NO: 3519969 - DNA, 15 bp, Homo sapiens
cccactgtcctgggc

SEQ ID NO: 3519970 - DNA, 16 bp, Homo sapiens
cccacttctgtgccac

SEQ ID NO: 3519971 - DNA, 18 bp, Homo sapiens
cccagaaaacctccagta

SEQ ID NO: 3519972 - DNA, 22 bp, Homo sapiens
cccagaacacactccatcagct

SEQ ID NO: 3519973 - DNA, 22 bp, Homo sapiens
cccagacctgttagcagacagg

SEQ ID NO: 3519974 - DNA, 22 bp, Homo sapiens
cccagagaaaggggagcccact

SEQ ID NO: 3519975 - DNA, 22 bp, Homo sapiens
cccagagacatacttgaagggc

SEQ ID NO: 3519976 - DNA, 19 bp, Homo sapiens
cccagagctggtggaccca

SEQ ID NO: 3519977 - DNA, 22 bp, Homo sapiens
cccagaggaaggggccagaggc

SEQ ID NO: 3519978 - DNA, 23 bp, Homo sapiens
cccagaggaaggggccagaggct

SEQ ID NO: 3519979 - DNA, 24 bp, Homo sapiens
cccagaggaaggggccagaggctc

SEQ ID NO: 3519980 - DNA, 21 bp, Homo sapiens
cccagatgggggaaagcacag

SEQ ID NO: 3519981 - DNA, 20 bp, Homo sapiens
cccagattgcaacaggctgg

SEQ ID NO: 3519982 - DNA, 19 bp, Homo sapiens
cccagattttgctgtatat

SEQ ID NO: 3519983 - DNA, 22 bp, Homo sapiens
cccagcaagtgagagctgggtg

SEQ ID NO: 3519984 - DNA, 22 bp, Homo sapiens
cccagcaagtggtcctagaggc

SEQ ID NO: 3519985 - DNA, 18 bp, Homo sapiens
cccagcacagcttgacct

SEQ ID NO: 3519986 - DNA, 13 bp, Homo sapiens
cccagcactgagg

SEQ ID NO: 3519987 - DNA, 24 bp, Homo sapiens
cccagcactgaggaagaacggggc

SEQ ID NO: 3519988 - DNA, 13 bp, Homo sapiens
cccagcatctctg

SEQ ID NO: 3519989 - DNA, 13 bp, Homo sapiens
cccagcattctca

SEQ ID NO: 3519990 - DNA, 16 bp, Homo sapiens
cccagcattctcaggc

SEQ ID NO: 3519991 - DNA, 17 bp, Homo sapiens
cccagcccacttctgcc

SEQ ID NO: 3519992 - DNA, 13 bp, Homo sapiens
cccagcccagaga

SEQ ID NO: 3519993 - DNA, 14 bp, Homo sapiens
cccagcccagagac

SEQ ID NO: 3519994 - DNA, 11 bp, Homo sapiens
cccagcccagg

SEQ ID NO: 3519995 - DNA, 14 bp, Homo sapiens
cccagccctcatcc

SEQ ID NO: 3519996 - DNA, 19 bp, Homo sapiens
cccagccctcatcccgagc

SEQ ID NO: 3519997 - DNA, 14 bp, Homo sapiens
cccagcctcagcgc

SEQ ID NO: 3519998 - DNA, 18 bp, Homo sapiens
cccagcctccctgaagcc

SEQ ID NO: 3519999 - DNA, 14 bp, Homo sapiens
cccagcctgctagc

SEQ ID NO: 3520000 - DNA, 17 bp, Homo sapiens
cccagcgagccctggtg

SEQ ID NO: 3520001 - DNA, 23 bp, Homo sapiens
cccagcgagccctggtggcagtg

SEQ ID NO: 3520002 - DNA, 16 bp, Homo sapiens
cccagctaagaacctg

SEQ ID NO: 3520003 - DNA, 15 bp, Homo sapiens
cccagctacttggga

SEQ ID NO: 3520004 - DNA, 18 bp, Homo sapiens
cccagctaggaagagcag

SEQ ID NO: 3520005 - DNA, 22 bp, Homo sapiens
cccagctaggaagagcaggact

SEQ ID NO: 3520006 - DNA, 9 bp, Homo sapiens
cccagctcc

SEQ ID NO: 3520007 - DNA, 18 bp, Homo sapiens
cccagctccccaggactc

SEQ ID NO: 3520008 - DNA, 22 bp, Homo sapiens
cccagcttaaaggggctagagt

SEQ ID NO: 3520009 - DNA, 15 bp, Homo sapiens
cccaggaccagctca

SEQ ID NO: 3520010 - DNA, 17 bp, Homo sapiens
cccaggaccagctcagg

SEQ ID NO: 3520011 - DNA, 21 bp, Homo sapiens
cccaggaccagctcaggacag

SEQ ID NO: 3520012 - DNA, 22 bp, Homo sapiens
cccaggaccagctcaggacaga

SEQ ID NO: 3520013 - DNA, 11 bp, Homo sapiens
cccaggaccct

SEQ ID NO: 3520014 - DNA, 16 bp, Homo sapiens
cccaggactcaccctc

SEQ ID NO: 3520015 - DNA, 17 bp, Homo sapiens
cccaggactcaccctca

SEQ ID NO: 3520016 - DNA, 12 bp, Homo sapiens
cccaggactggg

SEQ ID NO: 3520017 - DNA, 14 bp, Homo sapiens
cccaggactgggcc

SEQ ID NO: 3520018 - DNA, 13 bp, Homo sapiens
cccaggagccccg

SEQ ID NO: 3520019 - DNA, 14 bp, Homo sapiens
cccaggagccccga

SEQ ID NO: 3520020 - DNA, 18 bp, Homo sapiens
cccaggagccccgaggcc

SEQ ID NO: 3520021 - DNA, 11 bp, Homo sapiens
cccaggcaggt

SEQ ID NO: 3520022 - DNA, 21 bp, Homo sapiens
cccaggcattgccaagggctt

SEQ ID NO: 3520023 - DNA, 13 bp, Homo sapiens
cccaggccccagg

SEQ ID NO: 3520024 - DNA, 18 bp, Homo sapiens
cccaggccccaggaagcc

SEQ ID NO: 3520025 - DNA, 23 bp, Homo sapiens
cccaggcccctggaggctgcctc

SEQ ID NO: 3520026 - DNA, 18 bp, Homo sapiens
cccaggccctgccagagc

SEQ ID NO: 3520027 - DNA, 20 bp, Homo sapiens
cccaggccctgccagagcag

SEQ ID NO: 3520028 - DNA, 16 bp, Homo sapiens
cccaggcctgagctgc

SEQ ID NO: 3520029 - DNA, 20 bp, Homo sapiens
cccaggcctgagctgcttca

SEQ ID NO: 3520030 - DNA, 13 bp, Homo sapiens
cccaggctggcgt

SEQ ID NO: 3520031 - DNA, 17 bp, Homo sapiens
cccaggctggcgtgcag

SEQ ID NO: 3520032 - DNA, 18 bp, Homo sapiens
cccaggctggcgtgcagt

SEQ ID NO: 3520033 - DNA, 20 bp, Homo sapiens
cccaggctggcgtgcagtgg

SEQ ID NO: 3520034 - DNA, 21 bp, Homo sapiens
cccaggctggcgtgcagtggt

SEQ ID NO: 3520035 - DNA, 12 bp, Homo sapiens
cccaggctggga

SEQ ID NO: 3520036 - DNA, 14 bp, Homo sapiens
cccaggctgggaac

SEQ ID NO: 3520037 - DNA, 12 bp, Homo sapiens
cccaggctgggc

SEQ ID NO: 3520038 - DNA, 16 bp, Homo sapiens
cccaggctggtctcaa

SEQ ID NO: 3520039 - DNA, 23 bp, Homo sapiens
cccaggctggtcttgaagtcctg

SEQ ID NO: 3520040 - DNA, 16 bp, Homo sapiens
cctattttttgacact

SEQ ID NO: 3520041 - DNA, 17 bp, Homo sapiens
cctattttttgacactt

SEQ ID NO: 3520042 - DNA, 17 bp, Homo sapiens
cctcaaaactggagtcc

SEQ ID NO: 3520043 - DNA, 16 bp, Homo sapiens
cctcaagaaataaaag

SEQ ID NO: 3520044 - DNA, 19 bp, Homo sapiens
cctcaagtgatcctcccac

SEQ ID NO: 3520045 - DNA, 16 bp, Homo sapiens
cctcacccacccctgc

SEQ ID NO: 3520046 - DNA, 17 bp, Homo sapiens
cctcaccccctccttca

SEQ ID NO: 3520047 - DNA, 22 bp, Homo sapiens
cctcacccctggttctcatctt

SEQ ID NO: 3520048 - DNA, 16 bp, Homo sapiens
cctcaccttggggcct

SEQ ID NO: 3520049 - DNA, 20 bp, Homo sapiens
cctcaccttggggccttgat

SEQ ID NO: 3520050 - DNA, 16 bp, Homo sapiens
cctcactgttgaattt

SEQ ID NO: 3520051 - DNA, 21 bp, Homo sapiens
cctcagaacaaagtgagacag

SEQ ID NO: 3520052 - DNA, 14 bp, Homo sapiens
cctcagcatcctgg

SEQ ID NO: 3520053 - DNA, 12 bp, Homo sapiens
cctcagcattta

SEQ ID NO: 3520054 - DNA, 11 bp, Homo sapiens
cctcagcctgg

SEQ ID NO: 3520055 - DNA, 13 bp, Homo sapiens
cctcagcctggcc

SEQ ID NO: 3520056 - DNA, 14 bp, Homo sapiens
cctcagcctggcca

SEQ ID NO: 3520057 - DNA, 15 bp, Homo sapiens
cctcagcctggccag

SEQ ID NO: 3520058 - DNA, 18 bp, Homo sapiens
cctcagcctggccagaca

SEQ ID NO: 3520059 - DNA, 20 bp, Homo sapiens
cctcagccttgaaaaacaag

SEQ ID NO: 3520060 - DNA, 23 bp, Homo sapiens
cctcagccttgaaaaacaagtct

SEQ ID NO: 3520061 - DNA, 17 bp, Homo sapiens
cctcagccttgactatg

SEQ ID NO: 3520062 - DNA, 17 bp, Homo sapiens
cctcagctctcagttgc

SEQ ID NO: 3520063 - DNA, 18 bp, Homo sapiens
cctcaggcaggtgggatg

SEQ ID NO: 3520064 - DNA, 11 bp, Homo sapiens
cctcaggtggc

SEQ ID NO: 3520065 - DNA, 21 bp, Homo sapiens
cctcaggtggccatgcctcag

SEQ ID NO: 3520066 - DNA, 15 bp, Homo sapiens
cctcagtaagacgac

SEQ ID NO: 3520067 - DNA, 22 bp, Homo sapiens
cctcagtatgtgggggcttcat

SEQ ID NO: 3520068 - DNA, 17 bp, Homo sapiens
cctcagttgtgcagctt

SEQ ID NO: 3520069 - DNA, 22 bp, Homo sapiens
cctcatagtatggtggctgggt

SEQ ID NO: 3520070 - DNA, 23 bp, Homo sapiens
cctcatccagggctctgaccagt

SEQ ID NO: 3520071 - DNA, 15 bp, Homo sapiens
cctcatctctcttgg

SEQ ID NO: 3520072 - DNA, 15 bp, Homo sapiens
cctcatcttcttcac

SEQ ID NO: 3520073 - DNA, 15 bp, Homo sapiens
cctcattaatgacac

SEQ ID NO: 3520074 - DNA, 17 bp, Homo sapiens
cctcattaatgacactt

SEQ ID NO: 3520075 - DNA, 18 bp, Homo sapiens
cctcattagcattttgct

SEQ ID NO: 3520076 - DNA, 19 bp, Homo sapiens
cctccaacctggggggcag

SEQ ID NO: 3520077 - DNA, 14 bp, Homo sapiens
cctccacatcctcc

SEQ ID NO: 3520078 - DNA, 16 bp, Homo sapiens
cctccacatcctccac

SEQ ID NO: 3520079 - DNA, 20 bp, Homo sapiens
cctccacatcctccacgttc

SEQ ID NO: 3520080 - DNA, 18 bp, Homo sapiens
cctccacgttctgctcat

SEQ ID NO: 3520081 - DNA, 21 bp, Homo sapiens
cctccacgttctgctcatcat

SEQ ID NO: 3520082 - DNA, 19 bp, Homo sapiens
cctccagaagcactgggat

SEQ ID NO: 3520083 - DNA, 16 bp, Homo sapiens
cctccagctctttcct

SEQ ID NO: 3520084 - DNA, 19 bp, Homo sapiens
cctccagctctttcctcct

SEQ ID NO: 3520085 - DNA, 15 bp, Homo sapiens
cctccaggaaccaca

SEQ ID NO: 3520086 - DNA, 13 bp, Homo sapiens
cctccaggagcct

SEQ ID NO: 3520087 - DNA, 15 bp, Homo sapiens
cctccaggagcctac

SEQ ID NO: 3520088 - DNA, 16 bp, Homo sapiens
cctccagggctggact

SEQ ID NO: 3520089 - DNA, 18 bp, Homo sapiens
cctccagggctggactga

SEQ ID NO: 3520090 - DNA, 17 bp, Homo sapiens
cctccagtaccttgctt

SEQ ID NO: 3520091 - DNA, 20 bp, Homo sapiens
cctccagtagtggacaacag

SEQ ID NO: 3520092 - DNA, 12 bp, Homo sapiens
cctccatcctca

SEQ ID NO: 3520093 - DNA, 14 bp, Homo sapiens
cctccatcctcatc

SEQ ID NO: 3520094 - DNA, 15 bp, Homo sapiens
cctccatcctcatct

SEQ ID NO: 3520095 - DNA, 20 bp, Homo sapiens
cctccattatccattcccaa

SEQ ID NO: 3520096 - DNA, 15 bp, Homo sapiens
cctcccaaagtgctg

SEQ ID NO: 3520097 - DNA, 17 bp, Homo sapiens
cctcccaaagtgctggg

SEQ ID NO: 3520098 - DNA, 20 bp, Homo sapiens
cctcccaagctggctggggt

SEQ ID NO: 3520099 - DNA, 20 bp, Homo sapiens
cctcccaatttcagactccc

SEQ ID NO: 3520100 - DNA, 13 bp, Homo sapiens
cctcccaccccca

SEQ ID NO: 3520101 - DNA, 17 bp, Homo sapiens
cctcccacctcagcctc

SEQ ID NO: 3520102 - DNA, 23 bp, Homo sapiens
cctcccagagctggtggacccag

SEQ ID NO: 3520103 - DNA, 15 bp, Homo sapiens
cctcccagcccataa

SEQ ID NO: 3520104 - DNA, 17 bp, Homo sapiens
cctcccaggactctgac

SEQ ID NO: 3520105 - DNA, 20 bp, Homo sapiens
cctcccatagatactctctt

SEQ ID NO: 3520106 - DNA, 22 bp, Homo sapiens
cctccccagcattccagcccct

SEQ ID NO: 3520107 - DNA, 22 bp, Homo sapiens
cctccccagcctgcgcctgctg

SEQ ID NO: 3520108 - DNA, 16 bp, Homo sapiens
cctcccccccatgcac

SEQ ID NO: 3520109 - DNA, 17 bp, Homo sapiens
cctcccccccatgcact

SEQ ID NO: 3520110 - DNA, 19 bp, Homo sapiens
cctcccccccatgcactgt

SEQ ID NO: 3520111 - DNA, 17 bp, Homo sapiens
cctcccctctccttcct

SEQ ID NO: 3520112 - DNA, 16 bp, Homo sapiens
cctcccctctctgcac

SEQ ID NO: 3520113 - DNA, 13 bp, Homo sapiens
cctcccctgccag

SEQ ID NO: 3520114 - DNA, 16 bp, Homo sapiens
cctcccctgccagggc

SEQ ID NO: 3520115 - DNA, 14 bp, Homo sapiens
cctcccctggggac

SEQ ID NO: 3520116 - DNA, 23 bp, Homo sapiens
cctcccctggggacagcaagggc

SEQ ID NO: 3520117 - DNA, 18 bp, Homo sapiens
cctcccgaatagctggga

SEQ ID NO: 3520118 - DNA, 21 bp, Homo sapiens
cctcccgaatagctgggacta

SEQ ID NO: 3520119 - DNA, 19 bp, Homo sapiens
cctccctgaagcctttgca

SEQ ID NO: 3520120 - DNA, 15 bp, Homo sapiens
cctcccttctgctac

SEQ ID NO: 3520121 - DNA, 13 bp, Homo sapiens
cctcccttgcctt

SEQ ID NO: 3520122 - DNA, 12 bp, Homo sapiens
cctccgccctgc

SEQ ID NO: 3520123 - DNA, 16 bp, Homo sapiens
cctccgccctgccact

SEQ ID NO: 3520124 - DNA, 14 bp, Homo sapiens
cctccgcctccagg

SEQ ID NO: 3520125 - DNA, 14 bp, Homo sapiens
cctccgcctcttgg

SEQ ID NO: 3520126 - DNA, 13 bp, Homo sapiens
cctccgtggcaca

SEQ ID NO: 3520127 - DNA, 14 bp, Homo sapiens
cctccgtggcacat

SEQ ID NO: 3520128 - DNA, 21 bp, Homo sapiens
cctcctcaggcacacagctac

SEQ ID NO: 3520129 - DNA, 16 bp, Homo sapiens
cctcctccactctccc

SEQ ID NO: 3520130 - DNA, 12 bp, Homo sapiens
cctcctccaggg

SEQ ID NO: 3520131 - DNA, 10 bp, Homo sapiens
cctcctctga

SEQ ID NO: 3520132 - DNA, 12 bp, Homo sapiens
cctcctctgaaa

SEQ ID NO: 3520133 - DNA, 17 bp, Homo sapiens
cctcctctgaaacagct

SEQ ID NO: 3520134 - DNA, 23 bp, Homo sapiens
cctcctctgaaacagctgcctta

SEQ ID NO: 3520135 - DNA, 21 bp, Homo sapiens
cctcctgacccattgctgttg

SEQ ID NO: 3520136 - DNA, 19 bp, Homo sapiens
cctcctgcagaccacgccc

SEQ ID NO: 3520137 - DNA, 23 bp, Homo sapiens
cctcctgcctcgaactggctgca

SEQ ID NO: 3520138 - DNA, 20 bp, Homo sapiens
cctcctggagctctgtgggt

SEQ ID NO: 3520139 - DNA, 13 bp, Homo sapiens
cctcctgtgtgtg

SEQ ID NO: 3520140 - DNA, 16 bp, Homo sapiens
cctccttctccctttt

SEQ ID NO: 3520141 - DNA, 17 bp, Homo sapiens
cctccttctcccttttt

SEQ ID NO: 3520142 - DNA, 19 bp, Homo sapiens
cctcctttagtaaaactcc

SEQ ID NO: 3520143 - DNA, 16 bp, Homo sapiens
cctcgaactggctgca

SEQ ID NO: 3520144 - DNA, 15 bp, Homo sapiens
cctcgacatcactgt

SEQ ID NO: 3520145 - DNA, 20 bp, Homo sapiens
cctcgagaccatacagccag

SEQ ID NO: 3520146 - DNA, 12 bp, Homo sapiens
cctcgctctgtt

SEQ ID NO: 3520147 - DNA, 13 bp, Homo sapiens
cctcgctgccagc

SEQ ID NO: 3520148 - DNA, 20 bp, Homo sapiens
cctcgctgccagctctgtat

SEQ ID NO: 3520149 - DNA, 17 bp, Homo sapiens
cctcgctggactctcag

SEQ ID NO: 3520150 - DNA, 18 bp, Homo sapiens
cctcgctggactctcagt

SEQ ID NO: 3520151 - DNA, 12 bp, Homo sapiens
cctcgcttggac

SEQ ID NO: 3520152 - DNA, 20 bp, Homo sapiens
cctcggcttttctcagctgg

SEQ ID NO: 3520153 - DNA, 14 bp, Homo sapiens
cctcggtgtggaga

SEQ ID NO: 3520154 - DNA, 18 bp, Homo sapiens
cctcggtgtggagaagcg

SEQ ID NO: 3520155 - DNA, 21 bp, Homo sapiens
cctctacagagcttccctgac

SEQ ID NO: 3520156 - DNA, 24 bp, Homo sapiens
cctctacagagcttccctgactca

SEQ ID NO: 3520157 - DNA, 18 bp, Homo sapiens
cctctactttgattctga

SEQ ID NO: 3520158 - DNA, 21 bp, Homo sapiens
cctctagagccttcagcctta

SEQ ID NO: 3520159 - DNA, 22 bp, Homo sapiens
cctctagagccttcagccttaa

SEQ ID NO: 3520160 - DNA, 13 bp, Homo sapiens
cctctaggctctg

SEQ ID NO: 3520161 - DNA, 17 bp, Homo sapiens
cctctatttatgtttgc

SEQ ID NO: 3520162 - DNA, 13 bp, Homo sapiens
cctctcacctcag

SEQ ID NO: 3520163 - DNA, 14 bp, Homo sapiens
cctctcacctcagc

SEQ ID NO: 3520164 - DNA, 16 bp, Homo sapiens
cctctcacctcagcct

SEQ ID NO: 3520165 - DNA, 19 bp, Homo sapiens
cctctcccattgtccctct

SEQ ID NO: 3520166 - DNA, 14 bp, Homo sapiens
cctctccccagccc

SEQ ID NO: 3520167 - DNA, 17 bp, Homo sapiens
cctctccccagcccaga

SEQ ID NO: 3520168 - DNA, 21 bp, Homo sapiens
cctctccccaggtccagctct

SEQ ID NO: 3520169 - DNA, 19 bp, Homo sapiens
cctctccccattcggtgtg

SEQ ID NO: 3520170 - DNA, 21 bp, Homo sapiens
cctctccctgaccctgtatat

SEQ ID NO: 3520171 - DNA, 13 bp, Homo sapiens
cctctcctccgtg

SEQ ID NO: 3520172 - DNA, 15 bp, Homo sapiens
cctctccttccttgt

SEQ ID NO: 3520173 - DNA, 14 bp, Homo sapiens
cgatcccacacagg

SEQ ID NO: 3520174 - DNA, 20 bp, Homo sapiens
cgatgattcaggtgcagagg

SEQ ID NO: 3520175 - DNA, 15 bp, Homo sapiens
cgattcatattgaat

SEQ ID NO: 3520176 - DNA, 13 bp, Homo sapiens
cgattcttctgct

SEQ ID NO: 3520177 - DNA, 19 bp, Homo sapiens
cgattcttctgcttcagcc

SEQ ID NO: 3520178 - DNA, 21 bp, Homo sapiens
cgattcttctgcttcagcctc

SEQ ID NO: 3520179 - DNA, 14 bp, Homo sapiens
cgattgggagaaag

SEQ ID NO: 3520180 - DNA, 20 bp, Homo sapiens
cgattggtatgatgctgccg

SEQ ID NO: 3520181 - DNA, 17 bp, Homo sapiens
cgattttgtatctgcag

SEQ ID NO: 3520182 - DNA, 23 bp, Homo sapiens
cgattttgtatctgcaggcagac

SEQ ID NO: 3520183 - DNA, 15 bp, Homo sapiens
cgcaaaccacactgg

SEQ ID NO: 3520184 - DNA, 23 bp, Homo sapiens
cgcaaagggcatgggtcgggaga

SEQ ID NO: 3520185 - DNA, 22 bp, Homo sapiens
cgcacaatagtaacctgggtaa

SEQ ID NO: 3520186 - DNA, 12 bp, Homo sapiens
cgcacctcccat

SEQ ID NO: 3520187 - DNA, 13 bp, Homo sapiens
cgcacgcctctcc

SEQ ID NO: 3520188 - DNA, 22 bp, Homo sapiens
cgcactgtgacccccagctccg

SEQ ID NO: 3520189 - DNA, 23 bp, Homo sapiens
cgcacttcgggaggtcgaggcag

SEQ ID NO: 3520190 - DNA, 20 bp, Homo sapiens
cgcagaacgaaccttggcct

SEQ ID NO: 3520191 - DNA, 23 bp, Homo sapiens
cgcagaacgaaccttggcctggg

SEQ ID NO: 3520192 - DNA, 13 bp, Homo sapiens
cgcagacctctgg

SEQ ID NO: 3520193 - DNA, 13 bp, Homo sapiens
cgcagagcgcgcc

SEQ ID NO: 3520194 - DNA, 18 bp, Homo sapiens
cgcagcaccctgcagagc

SEQ ID NO: 3520195 - DNA, 16 bp, Homo sapiens
cgcagcaggaggccag

SEQ ID NO: 3520196 - DNA, 18 bp, Homo sapiens
cgcagcaggaggccaggc

SEQ ID NO: 3520197 - DNA, 13 bp, Homo sapiens
cgcagccccatct

SEQ ID NO: 3520198 - DNA, 11 bp, Homo sapiens
cgcagcctgag

SEQ ID NO: 3520199 - DNA, 23 bp, Homo sapiens
cgcaggagcacacccagccccca

SEQ ID NO: 3520200 - DNA, 16 bp, Homo sapiens
cgcatggtcacacact

SEQ ID NO: 3520201 - DNA, 19 bp, Homo sapiens
cgcatggtcacacactgat

SEQ ID NO: 3520202 - DNA, 12 bp, Homo sapiens
cgccaaggccta

SEQ ID NO: 3520203 - DNA, 18 bp, Homo sapiens
cgccaaggcctaggacct

SEQ ID NO: 3520204 - DNA, 12 bp, Homo sapiens
cgccaaggctgg

SEQ ID NO: 3520205 - DNA, 21 bp, Homo sapiens
cgccacagcctgggaaggagc

SEQ ID NO: 3520206 - DNA, 12 bp, Homo sapiens
cgccacaggacc

SEQ ID NO: 3520207 - DNA, 13 bp, Homo sapiens
cgccacaggaccc

SEQ ID NO: 3520208 - DNA, 18 bp, Homo sapiens
cgccaccgccacccgcag

SEQ ID NO: 3520209 - DNA, 23 bp, Homo sapiens
cgccaggatggaacacggccaca

SEQ ID NO: 3520210 - DNA, 20 bp, Homo sapiens
cgccaggctgaccacagcac

SEQ ID NO: 3520211 - DNA, 16 bp, Homo sapiens
cgccagggagacctgg

SEQ ID NO: 3520212 - DNA, 18 bp, Homo sapiens
cgccagggagacctggac

SEQ ID NO: 3520213 - DNA, 22 bp, Homo sapiens
cgccaggggaaaatcagcctgc

SEQ ID NO: 3520214 - DNA, 14 bp, Homo sapiens
cgccagtacttgtc

SEQ ID NO: 3520215 - DNA, 17 bp, Homo sapiens
cgccatgctcctggccc

SEQ ID NO: 3520216 - DNA, 15 bp, Homo sapiens
cgcccagtccttcca

SEQ ID NO: 3520217 - DNA, 12 bp, Homo sapiens
cgcccagtctgg

SEQ ID NO: 3520218 - DNA, 22 bp, Homo sapiens
cgcccagttgggtggatgcctg

SEQ ID NO: 3520219 - DNA, 14 bp, Homo sapiens
cgcccatctcagga

SEQ ID NO: 3520220 - DNA, 22 bp, Homo sapiens
cgcccccctttggtttggcctc

SEQ ID NO: 3520221 - DNA, 17 bp, Homo sapiens
cgccccctccgccctgc

SEQ ID NO: 3520222 - DNA, 19 bp, Homo sapiens
cgccccctccgccctgcca

SEQ ID NO: 3520223 - DNA, 12 bp, Homo sapiens
cgccccctgccc

SEQ ID NO: 3520224 - DNA, 17 bp, Homo sapiens
cgcccgtcctgcctgtg

SEQ ID NO: 3520225 - DNA, 12 bp, Homo sapiens
cgccggaggcca

SEQ ID NO: 3520226 - DNA, 13 bp, Homo sapiens
cgccggaggccag

SEQ ID NO: 3520227 - DNA, 21 bp, Homo sapiens
cgccggaggccagctatctgc

SEQ ID NO: 3520228 - DNA, 14 bp, Homo sapiens
cgcctacaggagtg

SEQ ID NO: 3520229 - DNA, 11 bp, Homo sapiens
cgcctccagga

SEQ ID NO: 3520230 - DNA, 13 bp, Homo sapiens
cgcctccaggagc

SEQ ID NO: 3520231 - DNA, 14 bp, Homo sapiens
cgcctccaggagcc

SEQ ID NO: 3520232 - DNA, 15 bp, Homo sapiens
cgcctcccactgggg

SEQ ID NO: 3520233 - DNA, 21 bp, Homo sapiens
cgcctgaaactttgaggataa

SEQ ID NO: 3520234 - DNA, 20 bp, Homo sapiens
cgcctgaggaacccttacag

SEQ ID NO: 3520235 - DNA, 17 bp, Homo sapiens
cgcctgcatgtaaacac

SEQ ID NO: 3520236 - DNA, 22 bp, Homo sapiens
cgcctgcatgtaaacacgcctg

SEQ ID NO: 3520237 - DNA, 15 bp, Homo sapiens
cgcctgcccctccca

SEQ ID NO: 3520238 - DNA, 14 bp, Homo sapiens
cgcctgcctgccac

SEQ ID NO: 3520239 - DNA, 12 bp, Homo sapiens
cgcctggagccc

SEQ ID NO: 3520240 - DNA, 16 bp, Homo sapiens
cgcctggccggctcca

SEQ ID NO: 3520241 - DNA, 18 bp, Homo sapiens
cgcctgtaatcccagcac

SEQ ID NO: 3520242 - DNA, 16 bp, Homo sapiens
cgcctgtgatgctggg

SEQ ID NO: 3520243 - DNA, 17 bp, Homo sapiens
cgcctgtgatgctgggc

SEQ ID NO: 3520244 - DNA, 19 bp, Homo sapiens
cgcctttcctctctatatt

SEQ ID NO: 3520245 - DNA, 22 bp, Homo sapiens
cgcgactaatttcaaaatgctt

SEQ ID NO: 3520246 - DNA, 14 bp, Homo sapiens
cgcgatcccacaca

SEQ ID NO: 3520247 - DNA, 16 bp, Homo sapiens
cgcgatcccacacagg

SEQ ID NO: 3520248 - DNA, 14 bp, Homo sapiens
cgcgatgggtcagg

SEQ ID NO: 3520249 - DNA, 18 bp, Homo sapiens
cgcgcatgtaatcccagc

SEQ ID NO: 3520250 - DNA, 22 bp, Homo sapiens
cgcgcatgtaatcccagctact

SEQ ID NO: 3520251 - DNA, 14 bp, Homo sapiens
cgcgccacaggacc

SEQ ID NO: 3520252 - DNA, 16 bp, Homo sapiens
cgcgccacaggaccct

SEQ ID NO: 3520253 - DNA, 13 bp, Homo sapiens
cgcgcccctagcc

SEQ ID NO: 3520254 - DNA, 18 bp, Homo sapiens
cgcggcggagctggcccc

SEQ ID NO: 3520255 - DNA, 22 bp, Homo sapiens
cgcggcggagctggccccgccg

SEQ ID NO: 3520256 - DNA, 23 bp, Homo sapiens
cgcggcggagctggccccgccgc

SEQ ID NO: 3520257 - DNA, 19 bp, Homo sapiens
cgcggtggctcacgcctgt

SEQ ID NO: 3520258 - DNA, 21 bp, Homo sapiens
cgcgtcgccctcccaggctct

SEQ ID NO: 3520259 - DNA, 19 bp, Homo sapiens
cgcgtgcacacaccagagc

SEQ ID NO: 3520260 - DNA, 20 bp, Homo sapiens
cgcgtgcacacaccagagcc

SEQ ID NO: 3520261 - DNA, 15 bp, Homo sapiens
cgctacctctctgtc

SEQ ID NO: 3520262 - DNA, 16 bp, Homo sapiens
cgctactataaagaga

SEQ ID NO: 3520263 - DNA, 17 bp, Homo sapiens
cgctactataaagagaa

SEQ ID NO: 3520264 - DNA, 19 bp, Homo sapiens
cgctcagggccatgctgag

SEQ ID NO: 3520265 - DNA, 20 bp, Homo sapiens
cgctcagggccatgctgagg

SEQ ID NO: 3520266 - DNA, 21 bp, Homo sapiens
cgctcagggccatgctgaggc

SEQ ID NO: 3520267 - DNA, 22 bp, Homo sapiens
cgctcagggccatgctgaggcc

SEQ ID NO: 3520268 - DNA, 10 bp, Homo sapiens
cgctccaggt

SEQ ID NO: 3520269 - DNA, 20 bp, Homo sapiens
cgctccctcccaggactctg

SEQ ID NO: 3520270 - DNA, 13 bp, Homo sapiens
cgctcctgtgtct

SEQ ID NO: 3520271 - DNA, 16 bp, Homo sapiens
cgctgagccacctgcc

SEQ ID NO: 3520272 - DNA, 21 bp, Homo sapiens
cgctgagccacctgccctttt

SEQ ID NO: 3520273 - DNA, 14 bp, Homo sapiens
cgctgagtggcagg

SEQ ID NO: 3520274 - DNA, 16 bp, Homo sapiens
cgctgccacccacctc

SEQ ID NO: 3520275 - DNA, 14 bp, Homo sapiens
cgctgccccatctc

SEQ ID NO: 3520276 - DNA, 13 bp, Homo sapiens
cgctgctctcata

SEQ ID NO: 3520277 - DNA, 12 bp, Homo sapiens
cgctggtgctga

SEQ ID NO: 3520278 - DNA, 14 bp, Homo sapiens
cgctgtcccccaac

SEQ ID NO: 3520279 - DNA, 23 bp, Homo sapiens
cgctgtcccccaacactgagcaa

SEQ ID NO: 3520280 - DNA, 23 bp, Homo sapiens
cgctgtccctagtaaaaatacaa

SEQ ID NO: 3520281 - DNA, 17 bp, Homo sapiens
cgctgtcctttctagag

SEQ ID NO: 3520282 - DNA, 14 bp, Homo sapiens
cgctgttgctgaat

SEQ ID NO: 3520283 - DNA, 17 bp, Homo sapiens
cgctgttgctgaatagg

SEQ ID NO: 3520284 - DNA, 16 bp, Homo sapiens
cgcttccccacagaac

SEQ ID NO: 3520285 - DNA, 20 bp, Homo sapiens
cgcttctgtgtatctctttc

SEQ ID NO: 3520286 - DNA, 19 bp, Homo sapiens
cgcttcttgcctctgtgct

SEQ ID NO: 3520287 - DNA, 14 bp, Homo sapiens
cgcttggagcagag

SEQ ID NO: 3520288 - DNA, 16 bp, Homo sapiens
cgctttgattcatagt

SEQ ID NO: 3520289 - DNA, 14 bp, Homo sapiens
cgcttttccttggc

SEQ ID NO: 3520290 - DNA, 22 bp, Homo sapiens
cgcttttccttggcattccgca

SEQ ID NO: 3520291 - DNA, 20 bp, Homo sapiens
cggaaagcagctcaaaggca

SEQ ID NO: 3520292 - DNA, 19 bp, Homo sapiens
cggaacccaagcttagaac

SEQ ID NO: 3520293 - DNA, 20 bp, Homo sapiens
cggaaccgcccaggatcaga

SEQ ID NO: 3520294 - DNA, 14 bp, Homo sapiens
cggaatagttggct

SEQ ID NO: 3520295 - DNA, 14 bp, Homo sapiens
cggaatttttaaaa

SEQ ID NO: 3520296 - DNA, 23 bp, Homo sapiens
cggaatttttaaaataaactgta

SEQ ID NO: 3520297 - DNA, 20 bp, Homo sapiens
cggacaagacccccagcact

SEQ ID NO: 3520298 - DNA, 21 bp, Homo sapiens
cggacagccacggccaggcca

SEQ ID NO: 3520299 - DNA, 16 bp, Homo sapiens
cggacttttctgcaaa

SEQ ID NO: 3520300 - DNA, 17 bp, Homo sapiens
cggagaaggccgctgcc

SEQ ID NO: 3520301 - DNA, 12 bp, Homo sapiens
cggagacagggt

SEQ ID NO: 3520302 - DNA, 17 bp, Homo sapiens
cggagacggagtcccac

SEQ ID NO: 3520303 - DNA, 17 bp, Homo sapiens
cggagccactcctctga

SEQ ID NO: 3520304 - DNA, 22 bp, Homo sapiens
cggagctgcccctctctgggcc

SEQ ID NO: 3520305 - DNA, 16 bp, Homo sapiens
cggaggccagctatct

SEQ ID NO: 3520306 - DNA, 13 bp, Homo sapiens
ctatgttcaaaga

SEQ ID NO: 3520307 - DNA, 19 bp, Homo sapiens
ctatgttctgtcttcccaa

SEQ ID NO: 3520308 - DNA, 12 bp, Homo sapiens
ctatgttgtaat

SEQ ID NO: 3520309 - DNA, 20 bp, Homo sapiens
ctatgtttttgttcaaagcc

SEQ ID NO: 3520310 - DNA, 13 bp, Homo sapiens
ctattaacatgat

SEQ ID NO: 3520311 - DNA, 16 bp, Homo sapiens
ctattaacatgatgta

SEQ ID NO: 3520312 - DNA, 21 bp, Homo sapiens
ctattaacatgatgtactaaa

SEQ ID NO: 3520313 - DNA, 23 bp, Homo sapiens
ctattaaggtgatatatttaaaa

SEQ ID NO: 3520314 - DNA, 16 bp, Homo sapiens
ctattataatttaatg

SEQ ID NO: 3520315 - DNA, 17 bp, Homo sapiens
ctattataatttaatgc

SEQ ID NO: 3520316 - DNA, 21 bp, Homo sapiens
ctattcttgatttatttgctt

SEQ ID NO: 3520317 - DNA, 16 bp, Homo sapiens
ctattgctgcttgagg

SEQ ID NO: 3520318 - DNA, 21 bp, Homo sapiens
ctattggaggatcagtttttt

SEQ ID NO: 3520319 - DNA, 19 bp, Homo sapiens
ctatttcagtgttacctgt

SEQ ID NO: 3520320 - DNA, 15 bp, Homo sapiens
ctatttctcctccat

SEQ ID NO: 3520321 - DNA, 18 bp, Homo sapiens
ctattttcagatgtgaac

SEQ ID NO: 3520322 - DNA, 22 bp, Homo sapiens
ctattttcagatgtgaaccatt

SEQ ID NO: 3520323 - DNA, 17 bp, Homo sapiens
ctatttttaaataattt

SEQ ID NO: 3520324 - DNA, 14 bp, Homo sapiens
ctatttttctctcc

SEQ ID NO: 3520325 - DNA, 16 bp, Homo sapiens
ctatttttctctcctg

SEQ ID NO: 3520326 - DNA, 12 bp, Homo sapiens
ctatttttgtac

SEQ ID NO: 3520327 - DNA, 20 bp, Homo sapiens
ctattttttgacacttccat

SEQ ID NO: 3520328 - DNA, 17 bp, Homo sapiens
ctcaaaaaaagccttta

SEQ ID NO: 3520329 - DNA, 17 bp, Homo sapiens
ctcaaaaacgccctcaa

SEQ ID NO: 3520330 - DNA, 22 bp, Homo sapiens
ctcaaaacccatctgggctcct

SEQ ID NO: 3520331 - DNA, 18 bp, Homo sapiens
ctcaaaagctgggcaggt

SEQ ID NO: 3520332 - DNA, 12 bp, Homo sapiens
ctcaaacactgc

SEQ ID NO: 3520333 - DNA, 13 bp, Homo sapiens
ctcaaacactgca

SEQ ID NO: 3520334 - DNA, 18 bp, Homo sapiens
ctcaaacactgcaggcat

SEQ ID NO: 3520335 - DNA, 14 bp, Homo sapiens
ctcaaacttctggc

SEQ ID NO: 3520336 - DNA, 14 bp, Homo sapiens
ctcaaatccctctc

SEQ ID NO: 3520337 - DNA, 22 bp, Homo sapiens
ctcaaatgctcagaccagctct

SEQ ID NO: 3520338 - DNA, 19 bp, Homo sapiens
ctcaaatggggccagatcc

SEQ ID NO: 3520339 - DNA, 20 bp, Homo sapiens
ctcaaccatcccctccgtgg

SEQ ID NO: 3520340 - DNA, 12 bp, Homo sapiens
ctcaacctcttc

SEQ ID NO: 3520341 - DNA, 20 bp, Homo sapiens
ctcaacctcttctggctcaa

SEQ ID NO: 3520342 - DNA, 14 bp, Homo sapiens
ctcaactcctccca

SEQ ID NO: 3520343 - DNA, 19 bp, Homo sapiens
ctcaagaacatgatgggcc

SEQ ID NO: 3520344 - DNA, 23 bp, Homo sapiens
ctcaagaacatgatgggcctgaa

SEQ ID NO: 3520345 - DNA, 19 bp, Homo sapiens
ctcaagaagaagaggggca

SEQ ID NO: 3520346 - DNA, 13 bp, Homo sapiens
ctcaagaagcagg

SEQ ID NO: 3520347 - DNA, 15 bp, Homo sapiens
ctcaagaagcaggct

SEQ ID NO: 3520348 - DNA, 23 bp, Homo sapiens
ctcaagaagcaggctacactgac

SEQ ID NO: 3520349 - DNA, 19 bp, Homo sapiens
ctcaagagatcccaagtag

SEQ ID NO: 3520350 - DNA, 16 bp, Homo sapiens
ctcaagatgacagctc

SEQ ID NO: 3520351 - DNA, 15 bp, Homo sapiens
ctcaagatgggggca

SEQ ID NO: 3520352 - DNA, 16 bp, Homo sapiens
ctcaagccaagcagcc

SEQ ID NO: 3520353 - DNA, 17 bp, Homo sapiens
ctcaagcccgcggggac

SEQ ID NO: 3520354 - DNA, 16 bp, Homo sapiens
ctcaagcgattctcct

SEQ ID NO: 3520355 - DNA, 17 bp, Homo sapiens
ctcaaggaaaggcctga

SEQ ID NO: 3520356 - DNA, 17 bp, Homo sapiens
ctcaagtgattctcctg

SEQ ID NO: 3520357 - DNA, 15 bp, Homo sapiens
ctcaatcaagaaaat

SEQ ID NO: 3520358 - DNA, 12 bp, Homo sapiens
ctcaatgctcat

SEQ ID NO: 3520359 - DNA, 19 bp, Homo sapiens
ctcacaacatggtgtctgg

SEQ ID NO: 3520360 - DNA, 17 bp, Homo sapiens
ctcacaacctgaaccta

SEQ ID NO: 3520361 - DNA, 23 bp, Homo sapiens
ctcacagaagggtgtggcatttg

SEQ ID NO: 3520362 - DNA, 17 bp, Homo sapiens
ctcacagtgttgcccag

SEQ ID NO: 3520363 - DNA, 16 bp, Homo sapiens
ctcacattagatctag

SEQ ID NO: 3520364 - DNA, 13 bp, Homo sapiens
ctcacatttatat

SEQ ID NO: 3520365 - DNA, 15 bp, Homo sapiens
ctcacatttattctg

SEQ ID NO: 3520366 - DNA, 19 bp, Homo sapiens
ctcacatttattctgctca

SEQ ID NO: 3520367 - DNA, 13 bp, Homo sapiens
ctcaccagcccca

SEQ ID NO: 3520368 - DNA, 15 bp, Homo sapiens
ctcaccagccccagt

SEQ ID NO: 3520369 - DNA, 21 bp, Homo sapiens
ctcaccagccccagtgcccac

SEQ ID NO: 3520370 - DNA, 15 bp, Homo sapiens
ctcaccagctgcaaa

SEQ ID NO: 3520371 - DNA, 16 bp, Homo sapiens
ctcaccagctgcaaag

SEQ ID NO: 3520372 - DNA, 19 bp, Homo sapiens
ctcaccccatcccacaccc

SEQ ID NO: 3520373 - DNA, 15 bp, Homo sapiens
ctcacccccttctcc

SEQ ID NO: 3520374 - DNA, 14 bp, Homo sapiens
ctcacccctggttc

SEQ ID NO: 3520375 - DNA, 19 bp, Homo sapiens
ctcacccctggttctcatc

SEQ ID NO: 3520376 - DNA, 20 bp, Homo sapiens
ctcacccctggttctcatct

SEQ ID NO: 3520377 - DNA, 15 bp, Homo sapiens
ctcaccctcatacca

SEQ ID NO: 3520378 - DNA, 21 bp, Homo sapiens
ctcaccctcataccatctgct

SEQ ID NO: 3520379 - DNA, 17 bp, Homo sapiens
ctcacctggggctgctg

SEQ ID NO: 3520380 - DNA, 21 bp, Homo sapiens
ctcacctggggctgctggcct

SEQ ID NO: 3520381 - DNA, 21 bp, Homo sapiens
ctcacctggggtgtgggaggc

SEQ ID NO: 3520382 - DNA, 17 bp, Homo sapiens
ctcaccttggcaccaga

SEQ ID NO: 3520383 - DNA, 15 bp, Homo sapiens
ctcaccttggggcct

SEQ ID NO: 3520384 - DNA, 15 bp, Homo sapiens
ctcacgcacctccca

SEQ ID NO: 3520385 - DNA, 20 bp, Homo sapiens
ctcacgcctgtaatcccagc

SEQ ID NO: 3520386 - DNA, 22 bp, Homo sapiens
ctcacgcctgtaatcccagcac

SEQ ID NO: 3520387 - DNA, 17 bp, Homo sapiens
ctcactaatttttgtat

SEQ ID NO: 3520388 - DNA, 18 bp, Homo sapiens
ctcactaggcccccactt

SEQ ID NO: 3520389 - DNA, 20 bp, Homo sapiens
ctcactatgttgcccaggca

SEQ ID NO: 3520390 - DNA, 21 bp, Homo sapiens
ctcactatgttgcccaggcag

SEQ ID NO: 3520391 - DNA, 14 bp, Homo sapiens
ctcactcccacctg

SEQ ID NO: 3520392 - DNA, 19 bp, Homo sapiens
ctcactgaactccttcccc

SEQ ID NO: 3520393 - DNA, 22 bp, Homo sapiens
ctcactgaactccttccccact

SEQ ID NO: 3520394 - DNA, 13 bp, Homo sapiens
ctcactggggcct

SEQ ID NO: 3520395 - DNA, 24 bp, Homo sapiens
ctcactgtgggaaggccagctgcc

SEQ ID NO: 3520396 - DNA, 23 bp, Homo sapiens
ctcactgtgttactgctttgcaa

SEQ ID NO: 3520397 - DNA, 15 bp, Homo sapiens
ctcactgttgaattt

SEQ ID NO: 3520398 - DNA, 15 bp, Homo sapiens
ctcactgttgcccag

SEQ ID NO: 3520399 - DNA, 17 bp, Homo sapiens
ctcactgttgcccaggc

SEQ ID NO: 3520400 - DNA, 19 bp, Homo sapiens
ctcactgttgcccaggctg

SEQ ID NO: 3520401 - DNA, 20 bp, Homo sapiens
ctcactgttgcccaggctgg

SEQ ID NO: 3520402 - DNA, 17 bp, Homo sapiens
ctcagaaagccaacatg

SEQ ID NO: 3520403 - DNA, 19 bp, Homo sapiens
ctcagaacttgctgctgtc

SEQ ID NO: 3520404 - DNA, 20 bp, Homo sapiens
ctcagaacttgctgctgtct

SEQ ID NO: 3520405 - DNA, 20 bp, Homo sapiens
ctcagaagacactgatgggc

SEQ ID NO: 3520406 - DNA, 23 bp, Homo sapiens
ctcagaagacactgatgggcaac

SEQ ID NO: 3520407 - DNA, 21 bp, Homo sapiens
ctcagaagggagctagccaga

SEQ ID NO: 3520408 - DNA, 18 bp, Homo sapiens
ctcagaatccaaagatca

SEQ ID NO: 3520409 - DNA, 17 bp, Homo sapiens
ctcagacattggcacct

SEQ ID NO: 3520410 - DNA, 22 bp, Homo sapiens
ctcagacattttctttttttaa

SEQ ID NO: 3520411 - DNA, 17 bp, Homo sapiens
ctcagactttggaaaat

SEQ ID NO: 3520412 - DNA, 22 bp, Homo sapiens
ctcagactttggaaaatgcatt

SEQ ID NO: 3520413 - DNA, 23 bp, Homo sapiens
ctcagagagggcaggcatgaagt

SEQ ID NO: 3520414 - DNA, 19 bp, Homo sapiens
ctcagaggcgcactgtgac

SEQ ID NO: 3520415 - DNA, 23 bp, Homo sapiens
ctcagaggtttacctagagaaca

SEQ ID NO: 3520416 - DNA, 17 bp, Homo sapiens
ctcagagtatggagctc

SEQ ID NO: 3520417 - DNA, 18 bp, Homo sapiens
ctcagagtcggaacggag

SEQ ID NO: 3520418 - DNA, 17 bp, Homo sapiens
ctcagatcagtgtacca

SEQ ID NO: 3520419 - DNA, 13 bp, Homo sapiens
ctcagatccaggg

SEQ ID NO: 3520420 - DNA, 17 bp, Homo sapiens
ctcagatccagggacag

SEQ ID NO: 3520421 - DNA, 16 bp, Homo sapiens
ctcagatggaaccgca

SEQ ID NO: 3520422 - DNA, 21 bp, Homo sapiens
ctcagcaaaagatgcttctca

SEQ ID NO: 3520423 - DNA, 16 bp, Homo sapiens
ctcagcatcctggcac

SEQ ID NO: 3520424 - DNA, 18 bp, Homo sapiens
ctcagcatcctggcaccc

SEQ ID NO: 3520425 - DNA, 14 bp, Homo sapiens
ctcagcatttgatt

SEQ ID NO: 3520426 - DNA, 20 bp, Homo sapiens
ctcagcatttgattaacatt

SEQ ID NO: 3520427 - DNA, 22 bp, Homo sapiens
ctcagcccctgatcctgtgaag

SEQ ID NO: 3520428 - DNA, 23 bp, Homo sapiens
ctcagcccctgatcctgtgaagt

SEQ ID NO: 3520429 - DNA, 17 bp, Homo sapiens
ctcagccctgaccctgt

SEQ ID NO: 3520430 - DNA, 21 bp, Homo sapiens
ctcagcctcccaaagtgctgg

SEQ ID NO: 3520431 - DNA, 13 bp, Homo sapiens
ctcagcctcccga

SEQ ID NO: 3520432 - DNA, 23 bp, Homo sapiens
ctcagcctcccgaatagctggga

SEQ ID NO: 3520433 - DNA, 13 bp, Homo sapiens
ctcagcctggcca

SEQ ID NO: 3520434 - DNA, 19 bp, Homo sapiens
ctcagccttcagacagaga

SEQ ID NO: 3520435 - DNA, 21 bp, Homo sapiens
ctcagccttgaaaaacaagtc

SEQ ID NO: 3520436 - DNA, 16 bp, Homo sapiens
ctcagccttgccagag

SEQ ID NO: 3520437 - DNA, 11 bp, Homo sapiens
ctccaggcagg

SEQ ID NO: 3520438 - DNA, 15 bp, Homo sapiens
ctccaggcaggctaa

SEQ ID NO: 3520439 - DNA, 22 bp, Homo sapiens
ctccaggcatttagccctcaca

SEQ ID NO: 3520440 - DNA, 16 bp, Homo sapiens
ctccaggcccaaggct

SEQ ID NO: 3520441 - DNA, 15 bp, Homo sapiens
ctccagggctggact

SEQ ID NO: 3520442 - DNA, 21 bp, Homo sapiens
ctccaggggctgcttcctcct

SEQ ID NO: 3520443 - DNA, 20 bp, Homo sapiens
ctccaggggtcctaggcctc

SEQ ID NO: 3520444 - DNA, 21 bp, Homo sapiens
ctccagggtcagaaacaggac

SEQ ID NO: 3520445 - DNA, 15 bp, Homo sapiens
ctccagggtgatttt

SEQ ID NO: 3520446 - DNA, 16 bp, Homo sapiens
ctccagggtgtgtgct

SEQ ID NO: 3520447 - DNA, 14 bp, Homo sapiens
ctccagtatgacag

SEQ ID NO: 3520448 - DNA, 16 bp, Homo sapiens
ctccagtccaaggaaa

SEQ ID NO: 3520449 - DNA, 13 bp, Homo sapiens
ctccagtcctgcc

SEQ ID NO: 3520450 - DNA, 14 bp, Homo sapiens
ctccagtcctgcca

SEQ ID NO: 3520451 - DNA, 15 bp, Homo sapiens
ctccagtcctgccac

SEQ ID NO: 3520452 - DNA, 17 bp, Homo sapiens
ctccagtcctgccacca

SEQ ID NO: 3520453 - DNA, 21 bp, Homo sapiens
ctccagtcctgccaccaccct

SEQ ID NO: 3520454 - DNA, 13 bp, Homo sapiens
ctccagtgaaact

SEQ ID NO: 3520455 - DNA, 18 bp, Homo sapiens
ctccatcagttagagctg

SEQ ID NO: 3520456 - DNA, 17 bp, Homo sapiens
ctccatcctcatctctc

SEQ ID NO: 3520457 - DNA, 13 bp, Homo sapiens
ctccatgtgggct

SEQ ID NO: 3520458 - DNA, 21 bp, Homo sapiens
ctccattcaatttcaggctcc

SEQ ID NO: 3520459 - DNA, 14 bp, Homo sapiens
ctcccaaaggaaag

SEQ ID NO: 3520460 - DNA, 17 bp, Homo sapiens
ctcccaaagtgctggga

SEQ ID NO: 3520461 - DNA, 22 bp, Homo sapiens
ctcccaaagtgctgggattaca

SEQ ID NO: 3520462 - DNA, 23 bp, Homo sapiens
ctcccaaagtgctgggattacag

SEQ ID NO: 3520463 - DNA, 15 bp, Homo sapiens
ctcccaaatgagcca

SEQ ID NO: 3520464 - DNA, 21 bp, Homo sapiens
ctcccaaggttggagcccagg

SEQ ID NO: 3520465 - DNA, 15 bp, Homo sapiens
ctcccacccccatct

SEQ ID NO: 3520466 - DNA, 20 bp, Homo sapiens
ctcccacccccatctctccc

SEQ ID NO: 3520467 - DNA, 14 bp, Homo sapiens
ctcccacctcagcc

SEQ ID NO: 3520468 - DNA, 13 bp, Homo sapiens
ctcccacgggacc

SEQ ID NO: 3520469 - DNA, 13 bp, Homo sapiens
ctcccaggctctc

SEQ ID NO: 3520470 - DNA, 23 bp, Homo sapiens
ctcccatagatactctcttcttc

SEQ ID NO: 3520471 - DNA, 14 bp, Homo sapiens
ctcccatgtatgga

SEQ ID NO: 3520472 - DNA, 22 bp, Homo sapiens
ctcccattgtccctctgcccca

SEQ ID NO: 3520473 - DNA, 18 bp, Homo sapiens
ctccccaatgagacttgc

SEQ ID NO: 3520474 - DNA, 20 bp, Homo sapiens
ctccccagagttccccatgc

SEQ ID NO: 3520475 - DNA, 23 bp, Homo sapiens
ctccccagcattccagcccctct

SEQ ID NO: 3520476 - DNA, 18 bp, Homo sapiens
ctccccagcccagagaca

SEQ ID NO: 3520477 - DNA, 12 bp, Homo sapiens
ctccccagcctg

SEQ ID NO: 3520478 - DNA, 21 bp, Homo sapiens
ctccccagcctgcgcctgctg

SEQ ID NO: 3520479 - DNA, 18 bp, Homo sapiens
ctccccaggtccagctct

SEQ ID NO: 3520480 - DNA, 21 bp, Homo sapiens
ctccccaggtccagctctgga

SEQ ID NO: 3520481 - DNA, 23 bp, Homo sapiens
ctccccaggtccagctctggagg

SEQ ID NO: 3520482 - DNA, 15 bp, Homo sapiens
ctccccattcacaga

SEQ ID NO: 3520483 - DNA, 17 bp, Homo sapiens
ctccccattcacagagc

SEQ ID NO: 3520484 - DNA, 15 bp, Homo sapiens
ctcccccccatgcac

SEQ ID NO: 3520485 - DNA, 14 bp, Homo sapiens
ctccccgcttctgc

SEQ ID NO: 3520486 - DNA, 14 bp, Homo sapiens
ctccccggctcgag

SEQ ID NO: 3520487 - DNA, 16 bp, Homo sapiens
ctcccctcagagtgca

SEQ ID NO: 3520488 - DNA, 22 bp, Homo sapiens
ctcccctctgaaagttgtacat

SEQ ID NO: 3520489 - DNA, 13 bp, Homo sapiens
ctcccctcttctg

SEQ ID NO: 3520490 - DNA, 18 bp, Homo sapiens
ctcccctcttctgagcta

SEQ ID NO: 3520491 - DNA, 21 bp, Homo sapiens
ctcccctgatagaagattgtt

SEQ ID NO: 3520492 - DNA, 23 bp, Homo sapiens
ctcccctgccaccaggccacctc

SEQ ID NO: 3520493 - DNA, 15 bp, Homo sapiens
ctcccctgccagggc

SEQ ID NO: 3520494 - DNA, 21 bp, Homo sapiens
ctcccctgccagggcagggcc

SEQ ID NO: 3520495 - DNA, 14 bp, Homo sapiens
ctcccctgccattt

SEQ ID NO: 3520496 - DNA, 17 bp, Homo sapiens
ctcccctgcccccagga

SEQ ID NO: 3520497 - DNA, 18 bp, Homo sapiens
ctcccctgcccccaggac

SEQ ID NO: 3520498 - DNA, 19 bp, Homo sapiens
ctcccctgcccccaggact

SEQ ID NO: 3520499 - DNA, 23 bp, Homo sapiens
ctcccctggggacagcaagggct

SEQ ID NO: 3520500 - DNA, 16 bp, Homo sapiens
ctcccgaatagctggg

SEQ ID NO: 3520501 - DNA, 19 bp, Homo sapiens
ctcccgaatagctgggact

SEQ ID NO: 3520502 - DNA, 20 bp, Homo sapiens
ctcccgaatagctgggacta

SEQ ID NO: 3520503 - DNA, 18 bp, Homo sapiens
ctcccgagtagctgggac

SEQ ID NO: 3520504 - DNA, 19 bp, Homo sapiens
ctcccgagtagctgggact

SEQ ID NO: 3520505 - DNA, 18 bp, Homo sapiens
ctcccgggccccacagac

SEQ ID NO: 3520506 - DNA, 13 bp, Homo sapiens
ctccctaccacct

SEQ ID NO: 3520507 - DNA, 19 bp, Homo sapiens
ctccctcaccccctccttc

SEQ ID NO: 3520508 - DNA, 22 bp, Homo sapiens
ctccctcatttcaggagcagcc

SEQ ID NO: 3520509 - DNA, 17 bp, Homo sapiens
ctccctcccaggactct

SEQ ID NO: 3520510 - DNA, 14 bp, Homo sapiens
ctccctcccctgcc

SEQ ID NO: 3520511 - DNA, 15 bp, Homo sapiens
ctccctcccctgcca

SEQ ID NO: 3520512 - DNA, 17 bp, Homo sapiens
ctccctccggcttgacc

SEQ ID NO: 3520513 - DNA, 21 bp, Homo sapiens
ctccctctaggctctgccttc

SEQ ID NO: 3520514 - DNA, 22 bp, Homo sapiens
ctccctctaggctctgccttcg

SEQ ID NO: 3520515 - DNA, 23 bp, Homo sapiens
ctccctgaccctgtatatagccc

SEQ ID NO: 3520516 - DNA, 23 bp, Homo sapiens
ctccctgcatctgaccagcagcg

SEQ ID NO: 3520517 - DNA, 15 bp, Homo sapiens
ctccctgcttaaaaa

SEQ ID NO: 3520518 - DNA, 15 bp, Homo sapiens
ctccctggcttctgt

SEQ ID NO: 3520519 - DNA, 19 bp, Homo sapiens
ctccctggcttctgtgggg

SEQ ID NO: 3520520 - DNA, 11 bp, Homo sapiens
ctccctgggcc

SEQ ID NO: 3520521 - DNA, 16 bp, Homo sapiens
ctccctgttccccaga

SEQ ID NO: 3520522 - DNA, 17 bp, Homo sapiens
ctccctgttccccagag

SEQ ID NO: 3520523 - DNA, 15 bp, Homo sapiens
ctcccttctgctact

SEQ ID NO: 3520524 - DNA, 16 bp, Homo sapiens
ctcccttctgctactg

SEQ ID NO: 3520525 - DNA, 23 bp, Homo sapiens
ctcccttgactttgctcctcaca

SEQ ID NO: 3520526 - DNA, 23 bp, Homo sapiens
ctcccttgcctttcgaggcctga

SEQ ID NO: 3520527 - DNA, 20 bp, Homo sapiens
ctccgacgctgcctctcatt

SEQ ID NO: 3520528 - DNA, 19 bp, Homo sapiens
ctccgagtgaactggtctt

SEQ ID NO: 3520529 - DNA, 23 bp, Homo sapiens
ctccgagtgaactggtcttcctt

SEQ ID NO: 3520530 - DNA, 13 bp, Homo sapiens
ctccgccctgcca

SEQ ID NO: 3520531 - DNA, 15 bp, Homo sapiens
ctccgccctgccact

SEQ ID NO: 3520532 - DNA, 16 bp, Homo sapiens
ctccgccctgccactc

SEQ ID NO: 3520533 - DNA, 15 bp, Homo sapiens
ctccgcctgaggcca

SEQ ID NO: 3520534 - DNA, 19 bp, Homo sapiens
ctccgcctgaggccagcct

SEQ ID NO: 3520535 - DNA, 12 bp, Homo sapiens
ctccgccttcac

SEQ ID NO: 3520536 - DNA, 19 bp, Homo sapiens
ctccgctttctacccagcg

SEQ ID NO: 3520537 - DNA, 20 bp, Homo sapiens
ctccgctttctacccagcga

SEQ ID NO: 3520538 - DNA, 21 bp, Homo sapiens
ctccgctttctacccagcgag

SEQ ID NO: 3520539 - DNA, 14 bp, Homo sapiens
ctccggactggtgc

SEQ ID NO: 3520540 - DNA, 16 bp, Homo sapiens
ctccggctcccagcct

SEQ ID NO: 3520541 - DNA, 15 bp, Homo sapiens
ctccgggacctggtg

SEQ ID NO: 3520542 - DNA, 15 bp, Homo sapiens
ctccgttagctcctg

SEQ ID NO: 3520543 - DNA, 18 bp, Homo sapiens
ctcctaccctgcgcccag

SEQ ID NO: 3520544 - DNA, 19 bp, Homo sapiens
ctcctagagggaggggcct

SEQ ID NO: 3520545 - DNA, 23 bp, Homo sapiens
ctcctagagggaggggcctaggc

SEQ ID NO: 3520546 - DNA, 14 bp, Homo sapiens
ctcctatatatttc

SEQ ID NO: 3520547 - DNA, 21 bp, Homo sapiens
ctcctcaggcacacagctact

SEQ ID NO: 3520548 - DNA, 16 bp, Homo sapiens
ctcctcatccagggct

SEQ ID NO: 3520549 - DNA, 13 bp, Homo sapiens
ctcctccagggtg

SEQ ID NO: 3520550 - DNA, 20 bp, Homo sapiens
ctcctcccacccggctgcag

SEQ ID NO: 3520551 - DNA, 21 bp, Homo sapiens
ctcctcccccctcctctgaaa

SEQ ID NO: 3520552 - DNA, 16 bp, Homo sapiens
ctcctccctgcatctg

SEQ ID NO: 3520553 - DNA, 16 bp, Homo sapiens
ctcctccgtggcacat

SEQ ID NO: 3520554 - DNA, 13 bp, Homo sapiens
ctcctcctccctg

SEQ ID NO: 3520555 - DNA, 14 bp, Homo sapiens
ctcctcgcaagctg

SEQ ID NO: 3520556 - DNA, 13 bp, Homo sapiens
ctcctctcagccc

SEQ ID NO: 3520557 - DNA, 20 bp, Homo sapiens
ctcctctccattttagccca

SEQ ID NO: 3520558 - DNA, 15 bp, Homo sapiens
ctcctctccccagcc

SEQ ID NO: 3520559 - DNA, 19 bp, Homo sapiens
ctcctctccccagcccaga

SEQ ID NO: 3520560 - DNA, 22 bp, Homo sapiens
ctcctctccccagcccagagac

SEQ ID NO: 3520561 - DNA, 14 bp, Homo sapiens
ctcctctgaaacag

SEQ ID NO: 3520562 - DNA, 13 bp, Homo sapiens
ctcctctgactca

SEQ ID NO: 3520563 - DNA, 20 bp, Homo sapiens
ctcctctgactcagggctcc

SEQ ID NO: 3520564 - DNA, 12 bp, Homo sapiens
ctcctctgtgaa

SEQ ID NO: 3520565 - DNA, 18 bp, Homo sapiens
ctcctctgtgaagcattc

SEQ ID NO: 3520566 - DNA, 13 bp, Homo sapiens
ctcctctgtgacc

SEQ ID NO: 3520567 - DNA, 23 bp, Homo sapiens
ctcctcttcttttttttcattat

SEQ ID NO: 3520568 - DNA, 14 bp, Homo sapiens
ctcctcttgtaaat

SEQ ID NO: 3520569 - DNA, 20 bp, Homo sapiens
ctgagcaccctctggattct

SEQ ID NO: 3520570 - DNA, 23 bp, Homo sapiens
ctgagcaccgtgtcaagctgctc

SEQ ID NO: 3520571 - DNA, 16 bp, Homo sapiens
ctgagcaggacctctg

SEQ ID NO: 3520572 - DNA, 16 bp, Homo sapiens
ctgagccagtgtcagg

SEQ ID NO: 3520573 - DNA, 12 bp, Homo sapiens
ctgagcctctgc

SEQ ID NO: 3520574 - DNA, 14 bp, Homo sapiens
ctgagcctctgctc

SEQ ID NO: 3520575 - DNA, 15 bp, Homo sapiens
ctgagcctctgctcc

SEQ ID NO: 3520576 - DNA, 18 bp, Homo sapiens
ctgagcctctgctcccca

SEQ ID NO: 3520577 - DNA, 14 bp, Homo sapiens
ctgagcctggccag

SEQ ID NO: 3520578 - DNA, 17 bp, Homo sapiens
ctgagcctggccagcct

SEQ ID NO: 3520579 - DNA, 14 bp, Homo sapiens
ctgagcgctcctgc

SEQ ID NO: 3520580 - DNA, 22 bp, Homo sapiens
ctgagcggtgggggaggagggt

SEQ ID NO: 3520581 - DNA, 15 bp, Homo sapiens
ctgagctgaccagcc

SEQ ID NO: 3520582 - DNA, 12 bp, Homo sapiens
ctgagctgaggc

SEQ ID NO: 3520583 - DNA, 16 bp, Homo sapiens
ctgagcttctctgtga

SEQ ID NO: 3520584 - DNA, 14 bp, Homo sapiens
ctgagctttctgct

SEQ ID NO: 3520585 - DNA, 15 bp, Homo sapiens
ctgaggaaaggccag

SEQ ID NO: 3520586 - DNA, 16 bp, Homo sapiens
ctgaggaaaggccagc

SEQ ID NO: 3520587 - DNA, 19 bp, Homo sapiens
ctgaggaaaggccagctgg

SEQ ID NO: 3520588 - DNA, 14 bp, Homo sapiens
ctgaggaatccaga

SEQ ID NO: 3520589 - DNA, 17 bp, Homo sapiens
ctgaggaatccagaccc

SEQ ID NO: 3520590 - DNA, 21 bp, Homo sapiens
ctgaggaatccagacccggct

SEQ ID NO: 3520591 - DNA, 23 bp, Homo sapiens
ctgaggaatccagacccggctgc

SEQ ID NO: 3520592 - DNA, 13 bp, Homo sapiens
ctgaggaggggag

SEQ ID NO: 3520593 - DNA, 19 bp, Homo sapiens
ctgaggatgggtcagagct

SEQ ID NO: 3520594 - DNA, 22 bp, Homo sapiens
ctgaggcagcagtgtgaggcca

SEQ ID NO: 3520595 - DNA, 24 bp, Homo sapiens
ctgaggcagcagtgtgaggccagg

SEQ ID NO: 3520596 - DNA, 17 bp, Homo sapiens
ctgaggcatcctctgac

SEQ ID NO: 3520597 - DNA, 21 bp, Homo sapiens
ctgaggccccttctaggtggc

SEQ ID NO: 3520598 - DNA, 19 bp, Homo sapiens
ctgaggcctgggccgctgc

SEQ ID NO: 3520599 - DNA, 13 bp, Homo sapiens
ctgaggctggcac

SEQ ID NO: 3520600 - DNA, 20 bp, Homo sapiens
ctgaggctgggggagagccg

SEQ ID NO: 3520601 - DNA, 17 bp, Homo sapiens
ctgaggctgtggtcaca

SEQ ID NO: 3520602 - DNA, 17 bp, Homo sapiens
ctgaggctttggatttg

SEQ ID NO: 3520603 - DNA, 21 bp, Homo sapiens
ctgaggctttggatttgacat

SEQ ID NO: 3520604 - DNA, 19 bp, Homo sapiens
ctgagggcctgctggaggc

SEQ ID NO: 3520605 - DNA, 19 bp, Homo sapiens
ctgagggctgatctttaac

SEQ ID NO: 3520606 - DNA, 16 bp, Homo sapiens
ctgaggtcactgctag

SEQ ID NO: 3520607 - DNA, 22 bp, Homo sapiens
ctgaggtgggaggatctcttga

SEQ ID NO: 3520608 - DNA, 18 bp, Homo sapiens
ctgagtagatgcgcagcc

SEQ ID NO: 3520609 - DNA, 17 bp, Homo sapiens
ctgagtcatctgttagg

SEQ ID NO: 3520610 - DNA, 21 bp, Homo sapiens
ctgagtcatctgttagggcct

SEQ ID NO: 3520611 - DNA, 13 bp, Homo sapiens
ctgagtctatgtt

SEQ ID NO: 3520612 - DNA, 20 bp, Homo sapiens
ctgagtctatgttcaaagac

SEQ ID NO: 3520613 - DNA, 13 bp, Homo sapiens
ctgagtgaacctg

SEQ ID NO: 3520614 - DNA, 15 bp, Homo sapiens
ctgagtgaacctgta

SEQ ID NO: 3520615 - DNA, 18 bp, Homo sapiens
ctgagtgaacctgtataa

SEQ ID NO: 3520616 - DNA, 19 bp, Homo sapiens
ctgagtgcagccgtttgag

SEQ ID NO: 3520617 - DNA, 14 bp, Homo sapiens
ctgagtgcctggcc

SEQ ID NO: 3520618 - DNA, 16 bp, Homo sapiens
ctgagtgcctggccaa

SEQ ID NO: 3520619 - DNA, 19 bp, Homo sapiens
ctgagtgcctggccaaagg

SEQ ID NO: 3520620 - DNA, 20 bp, Homo sapiens
ctgagttttccatggcagga

SEQ ID NO: 3520621 - DNA, 23 bp, Homo sapiens
ctgataaaaccatgtagaaaatt

SEQ ID NO: 3520622 - DNA, 18 bp, Homo sapiens
ctgataaagcacagctgt

SEQ ID NO: 3520623 - DNA, 17 bp, Homo sapiens
ctgataataaaggaact

SEQ ID NO: 3520624 - DNA, 18 bp, Homo sapiens
ctgatagaattatttcac

SEQ ID NO: 3520625 - DNA, 14 bp, Homo sapiens
ctgatcagagccgt

SEQ ID NO: 3520626 - DNA, 18 bp, Homo sapiens
ctgatcaggacctccaag

SEQ ID NO: 3520627 - DNA, 18 bp, Homo sapiens
ctgatcatcgccagaggt

SEQ ID NO: 3520628 - DNA, 13 bp, Homo sapiens
ctgatccctctac

SEQ ID NO: 3520629 - DNA, 21 bp, Homo sapiens
ctgatccctctgggggctctg

SEQ ID NO: 3520630 - DNA, 12 bp, Homo sapiens
ctgatcctggag

SEQ ID NO: 3520631 - DNA, 18 bp, Homo sapiens
ctgatcctggaggcccag

SEQ ID NO: 3520632 - DNA, 20 bp, Homo sapiens
ctgatcctgtgaagtaagga

SEQ ID NO: 3520633 - DNA, 23 bp, Homo sapiens
ctgatcctgtgaagtaaggatgt

SEQ ID NO: 3520634 - DNA, 17 bp, Homo sapiens
ctgatgagatttttaaa

SEQ ID NO: 3520635 - DNA, 21 bp, Homo sapiens
ctgatgataggttaataaaga

SEQ ID NO: 3520636 - DNA, 17 bp, Homo sapiens
ctgatgatgtgcctggg

SEQ ID NO: 3520637 - DNA, 12 bp, Homo sapiens
ctgatgctgaca

SEQ ID NO: 3520638 - DNA, 15 bp, Homo sapiens
ctgatggacctgtca

SEQ ID NO: 3520639 - DNA, 22 bp, Homo sapiens
ctgatggcaggatggcctggcc

SEQ ID NO: 3520640 - DNA, 12 bp, Homo sapiens
ctgatggcttct

SEQ ID NO: 3520641 - DNA, 18 bp, Homo sapiens
ctgatggcttctccaggg

SEQ ID NO: 3520642 - DNA, 21 bp, Homo sapiens
ctgatgggcaacccccagcct

SEQ ID NO: 3520643 - DNA, 21 bp, Homo sapiens
ctgatgggcgtacgctggtgc

SEQ ID NO: 3520644 - DNA, 23 bp, Homo sapiens
ctgatgggcgtacgctggtgctg

SEQ ID NO: 3520645 - DNA, 19 bp, Homo sapiens
ctgatgtcaatttctgtgt

SEQ ID NO: 3520646 - DNA, 20 bp, Homo sapiens
ctgatgtcaatttctgtgtt

SEQ ID NO: 3520647 - DNA, 22 bp, Homo sapiens
ctgattcccaagctctgctcct

SEQ ID NO: 3520648 - DNA, 17 bp, Homo sapiens
ctgattctcagggtctc

SEQ ID NO: 3520649 - DNA, 17 bp, Homo sapiens
ctgattgttgtcaggcc

SEQ ID NO: 3520650 - DNA, 22 bp, Homo sapiens
ctgatttagccatgtgaaactc

SEQ ID NO: 3520651 - DNA, 18 bp, Homo sapiens
ctgatttaggagaagcca

SEQ ID NO: 3520652 - DNA, 19 bp, Homo sapiens
ctgcaaaatgaggaatgta

SEQ ID NO: 3520653 - DNA, 16 bp, Homo sapiens
ctgcaaacgctgcctg

SEQ ID NO: 3520654 - DNA, 18 bp, Homo sapiens
ctgcaaacgctgcctgcc

SEQ ID NO: 3520655 - DNA, 19 bp, Homo sapiens
ctgcaaacgctgcctgccg

SEQ ID NO: 3520656 - DNA, 21 bp, Homo sapiens
ctgcaaagggtatcaggtgct

SEQ ID NO: 3520657 - DNA, 15 bp, Homo sapiens
ctgcaacaaaatgta

SEQ ID NO: 3520658 - DNA, 20 bp, Homo sapiens
ctgcaacctccgcctcttgg

SEQ ID NO: 3520659 - DNA, 15 bp, Homo sapiens
ctgcaacctgttgat

SEQ ID NO: 3520660 - DNA, 17 bp, Homo sapiens
ctgcaaccttgcatcca

SEQ ID NO: 3520661 - DNA, 21 bp, Homo sapiens
ctgcaactgctcagctctggt

SEQ ID NO: 3520662 - DNA, 20 bp, Homo sapiens
ctgcaagcacatctgcattt

SEQ ID NO: 3520663 - DNA, 14 bp, Homo sapiens
ctgcaaggacattc

SEQ ID NO: 3520664 - DNA, 19 bp, Homo sapiens
ctgcaaggacattcttgta

SEQ ID NO: 3520665 - DNA, 18 bp, Homo sapiens
ctgcaaggtttaggctgg

SEQ ID NO: 3520666 - DNA, 23 bp, Homo sapiens
ctgcaaggtttaggctggtggcc

SEQ ID NO: 3520667 - DNA, 15 bp, Homo sapiens
ctgcaagtccttttg

SEQ ID NO: 3520668 - DNA, 21 bp, Homo sapiens
ctgcaagtccttttgtaaagt

SEQ ID NO: 3520669 - DNA, 16 bp, Homo sapiens
ctgcacaaactcacca

SEQ ID NO: 3520670 - DNA, 16 bp, Homo sapiens
ctgcacagcttttcca

SEQ ID NO: 3520671 - DNA, 21 bp, Homo sapiens
ctgcacagcttttccaaaata

SEQ ID NO: 3520672 - DNA, 15 bp, Homo sapiens
ctgcacccccctggg

SEQ ID NO: 3520673 - DNA, 12 bp, Homo sapiens
ctgcaccgggcc

SEQ ID NO: 3520674 - DNA, 16 bp, Homo sapiens
ctgcactatagcctag

SEQ ID NO: 3520675 - DNA, 17 bp, Homo sapiens
ctgcactatagcctagg

SEQ ID NO: 3520676 - DNA, 23 bp, Homo sapiens
ctgcactatagcctaggtgacag

SEQ ID NO: 3520677 - DNA, 13 bp, Homo sapiens
ctgcactccagcc

SEQ ID NO: 3520678 - DNA, 18 bp, Homo sapiens
ctgcactccagcctgggt

SEQ ID NO: 3520679 - DNA, 21 bp, Homo sapiens
ctgcactccctcctggagctc

SEQ ID NO: 3520680 - DNA, 15 bp, Homo sapiens
ctgcactgatgctgc

SEQ ID NO: 3520681 - DNA, 16 bp, Homo sapiens
ctgcacttacttgctt

SEQ ID NO: 3520682 - DNA, 14 bp, Homo sapiens
ctgcacttgcagac

SEQ ID NO: 3520683 - DNA, 17 bp, Homo sapiens
ctgcacttgcagactct

SEQ ID NO: 3520684 - DNA, 18 bp, Homo sapiens
ctgcacttgcagactcta

SEQ ID NO: 3520685 - DNA, 15 bp, Homo sapiens
ctgcagaagcaaggg

SEQ ID NO: 3520686 - DNA, 14 bp, Homo sapiens
ctgcagaaggaaaa

SEQ ID NO: 3520687 - DNA, 19 bp, Homo sapiens
ctgcagaaggaaaaatgtg

SEQ ID NO: 3520688 - DNA, 16 bp, Homo sapiens
ctgcagacttcccagc

SEQ ID NO: 3520689 - DNA, 23 bp, Homo sapiens
ctgcagagaaacttaagcaaagg

SEQ ID NO: 3520690 - DNA, 19 bp, Homo sapiens
ctgcagatttgggctggaa

SEQ ID NO: 3520691 - DNA, 17 bp, Homo sapiens
ctgcagccttgaactct

SEQ ID NO: 3520692 - DNA, 21 bp, Homo sapiens
ctgcagccttgaactctgggc

SEQ ID NO: 3520693 - DNA, 18 bp, Homo sapiens
ctgcagcctttgcctccc

SEQ ID NO: 3520694 - DNA, 15 bp, Homo sapiens
ctgcagctccctggc

SEQ ID NO: 3520695 - DNA, 21 bp, Homo sapiens
ctgcaggacctgcctgtagcc

SEQ ID NO: 3520696 - DNA, 22 bp, Homo sapiens
ctgcaggacctgcctgtagccc

SEQ ID NO: 3520697 - DNA, 16 bp, Homo sapiens
ctgcaggacttctgcc

SEQ ID NO: 3520698 - DNA, 19 bp, Homo sapiens
ctgcaggacttctgcctga

SEQ ID NO: 3520699 - DNA, 13 bp, Homo sapiens
ctgcaggcagaca

SEQ ID NO: 3520700 - DNA, 17 bp, Homo sapiens
ctgcaggcatcacagct

SEQ ID NO: 3520701 - DNA, 14 bp, Homo sapiens
ctggaaatgttctt

SEQ ID NO: 3520702 - DNA, 20 bp, Homo sapiens
ctggaacactagacaagcca

SEQ ID NO: 3520703 - DNA, 21 bp, Homo sapiens
ctggaacagattcacactgtc

SEQ ID NO: 3520704 - DNA, 18 bp, Homo sapiens
ctggaacctcagcctggc

SEQ ID NO: 3520705 - DNA, 21 bp, Homo sapiens
ctggaacctgcaaaaaatact

SEQ ID NO: 3520706 - DNA, 12 bp, Homo sapiens
ctggaagaaaaa

SEQ ID NO: 3520707 - DNA, 11 bp, Homo sapiens
ctggaagagcc

SEQ ID NO: 3520708 - DNA, 14 bp, Homo sapiens
ctggaagatcctgc

SEQ ID NO: 3520709 - DNA, 18 bp, Homo sapiens
ctggaagatcctgcgggt

SEQ ID NO: 3520710 - DNA, 14 bp, Homo sapiens
ctggaagcacagct

SEQ ID NO: 3520711 - DNA, 15 bp, Homo sapiens
ctggaagcacagctt

SEQ ID NO: 3520712 - DNA, 19 bp, Homo sapiens
ctggaaggggcccgtggga

SEQ ID NO: 3520713 - DNA, 23 bp, Homo sapiens
ctggaataatcctaaacatatga

SEQ ID NO: 3520714 - DNA, 14 bp, Homo sapiens
ctggaatctgaggc

SEQ ID NO: 3520715 - DNA, 14 bp, Homo sapiens
ctggaatgcagtgg

SEQ ID NO: 3520716 - DNA, 15 bp, Homo sapiens
ctggaatgcagtggt

SEQ ID NO: 3520717 - DNA, 15 bp, Homo sapiens
ctggacaaagaattc

SEQ ID NO: 3520718 - DNA, 14 bp, Homo sapiens
ctggacagccccac

SEQ ID NO: 3520719 - DNA, 15 bp, Homo sapiens
ctggacagccccacc

SEQ ID NO: 3520720 - DNA, 16 bp, Homo sapiens
ctggacagccccaccc

SEQ ID NO: 3520721 - DNA, 18 bp, Homo sapiens
ctggacagccccaccctg

SEQ ID NO: 3520722 - DNA, 14 bp, Homo sapiens
ctggacaggcatgt

SEQ ID NO: 3520723 - DNA, 17 bp, Homo sapiens
ctggacaggcatgttct

SEQ ID NO: 3520724 - DNA, 23 bp, Homo sapiens
ctggacaggcatgttctctgagg

SEQ ID NO: 3520725 - DNA, 16 bp, Homo sapiens
ctggacatgcctgtcc

SEQ ID NO: 3520726 - DNA, 17 bp, Homo sapiens
ctggacatgcctgtcct

SEQ ID NO: 3520727 - DNA, 18 bp, Homo sapiens
ctggacatgcctgtcctg

SEQ ID NO: 3520728 - DNA, 18 bp, Homo sapiens
ctggaccgtcccctgccc

SEQ ID NO: 3520729 - DNA, 16 bp, Homo sapiens
ctggaccttgaactgg

SEQ ID NO: 3520730 - DNA, 20 bp, Homo sapiens
ctggactagagggacctctc

SEQ ID NO: 3520731 - DNA, 21 bp, Homo sapiens
ctggactagagggacctctcc

SEQ ID NO: 3520732 - DNA, 23 bp, Homo sapiens
ctggactagagggacctctccca

SEQ ID NO: 3520733 - DNA, 24 bp, Homo sapiens
ctggactcctgccaccagcatcca

SEQ ID NO: 3520734 - DNA, 14 bp, Homo sapiens
ctggactctcagtc

SEQ ID NO: 3520735 - DNA, 17 bp, Homo sapiens
ctggactctcagtctct

SEQ ID NO: 3520736 - DNA, 18 bp, Homo sapiens
ctggactctcagtctctg

SEQ ID NO: 3520737 - DNA, 14 bp, Homo sapiens
ctggactgacctgg

SEQ ID NO: 3520738 - DNA, 21 bp, Homo sapiens
ctggactgacctggtccacag

SEQ ID NO: 3520739 - DNA, 13 bp, Homo sapiens
ctggactgaggcc

SEQ ID NO: 3520740 - DNA, 16 bp, Homo sapiens
ctggactgaggcctga

SEQ ID NO: 3520741 - DNA, 18 bp, Homo sapiens
ctggactgaggcctgagc

SEQ ID NO: 3520742 - DNA, 18 bp, Homo sapiens
ctggacttggcccctgcc

SEQ ID NO: 3520743 - DNA, 20 bp, Homo sapiens
ctggagactcctaggcagga

SEQ ID NO: 3520744 - DNA, 15 bp, Homo sapiens
ctggagacttagggc

SEQ ID NO: 3520745 - DNA, 21 bp, Homo sapiens
ctggagacttagggcaccagg

SEQ ID NO: 3520746 - DNA, 15 bp, Homo sapiens
ctggagatcctcctg

SEQ ID NO: 3520747 - DNA, 17 bp, Homo sapiens
ctggagatcctcctgca

SEQ ID NO: 3520748 - DNA, 21 bp, Homo sapiens
ctggagcactgggctcccggg

SEQ ID NO: 3520749 - DNA, 21 bp, Homo sapiens
ctggagcccagaggagggcag

SEQ ID NO: 3520750 - DNA, 13 bp, Homo sapiens
ctggagcccaggg

SEQ ID NO: 3520751 - DNA, 24 bp, Homo sapiens
ctggagcctccgacgctgcctctc

SEQ ID NO: 3520752 - DNA, 15 bp, Homo sapiens
ctggagctctgtggg

SEQ ID NO: 3520753 - DNA, 16 bp, Homo sapiens
ctggagctctgtgggt

SEQ ID NO: 3520754 - DNA, 17 bp, Homo sapiens
ctggaggaaagggagga

SEQ ID NO: 3520755 - DNA, 15 bp, Homo sapiens
ctggaggcccaggct

SEQ ID NO: 3520756 - DNA, 19 bp, Homo sapiens
ctggaggcccaggctggga

SEQ ID NO: 3520757 - DNA, 13 bp, Homo sapiens
ctggaggcctcag

SEQ ID NO: 3520758 - DNA, 18 bp, Homo sapiens
ctggaggctgcctcccaa

SEQ ID NO: 3520759 - DNA, 21 bp, Homo sapiens
ctggaggctgcctcccaacag

SEQ ID NO: 3520760 - DNA, 14 bp, Homo sapiens
ctggagtgcagtga

SEQ ID NO: 3520761 - DNA, 15 bp, Homo sapiens
ctggagtgcagtgag

SEQ ID NO: 3520762 - DNA, 16 bp, Homo sapiens
ctggagtgcagtgagc

SEQ ID NO: 3520763 - DNA, 17 bp, Homo sapiens
ctggagtgcagtgagcc

SEQ ID NO: 3520764 - DNA, 20 bp, Homo sapiens
ctggagtgcagtgagccgag

SEQ ID NO: 3520765 - DNA, 14 bp, Homo sapiens
ctggagtggccact

SEQ ID NO: 3520766 - DNA, 18 bp, Homo sapiens
ctggagttgatctggaac

SEQ ID NO: 3520767 - DNA, 15 bp, Homo sapiens
ctggagttgcattga

SEQ ID NO: 3520768 - DNA, 13 bp, Homo sapiens
ctggagttgtcac

SEQ ID NO: 3520769 - DNA, 15 bp, Homo sapiens
ctggatcctgaaata

SEQ ID NO: 3520770 - DNA, 20 bp, Homo sapiens
ctggatgatggtcttcagcc

SEQ ID NO: 3520771 - DNA, 18 bp, Homo sapiens
ctggatggtgtgccttcc

SEQ ID NO: 3520772 - DNA, 18 bp, Homo sapiens
ctggatgtccagagctgg

SEQ ID NO: 3520773 - DNA, 16 bp, Homo sapiens
ctggatgtctgaactt

SEQ ID NO: 3520774 - DNA, 15 bp, Homo sapiens
ctggatgtttggaaa

SEQ ID NO: 3520775 - DNA, 20 bp, Homo sapiens
ctggattccccatctcaggc

SEQ ID NO: 3520776 - DNA, 20 bp, Homo sapiens
ctggcaaaaggatctttgtg

SEQ ID NO: 3520777 - DNA, 16 bp, Homo sapiens
ctggcaacacagaggc

SEQ ID NO: 3520778 - DNA, 19 bp, Homo sapiens
ctggcactggaccccagca

SEQ ID NO: 3520779 - DNA, 12 bp, Homo sapiens
ctggcagcctcc

SEQ ID NO: 3520780 - DNA, 15 bp, Homo sapiens
ctggcagcctcccat

SEQ ID NO: 3520781 - DNA, 17 bp, Homo sapiens
ctggcagctctggacag

SEQ ID NO: 3520782 - DNA, 18 bp, Homo sapiens
ctggcaggcaggctccca

SEQ ID NO: 3520783 - DNA, 24 bp, Homo sapiens
ctggcaggcaggctcccagggaca

SEQ ID NO: 3520784 - DNA, 18 bp, Homo sapiens
ctggcatcgcaccattct

SEQ ID NO: 3520785 - DNA, 19 bp, Homo sapiens
ctggcatcgcaccattctg

SEQ ID NO: 3520786 - DNA, 22 bp, Homo sapiens
ctggcatcgcaccattctgact

SEQ ID NO: 3520787 - DNA, 23 bp, Homo sapiens
ctggcatcgcaccattctgactc

SEQ ID NO: 3520788 - DNA, 20 bp, Homo sapiens
ctggccaaagagcctttcca

SEQ ID NO: 3520789 - DNA, 18 bp, Homo sapiens
ctggccaagggccagaca

SEQ ID NO: 3520790 - DNA, 21 bp, Homo sapiens
ctggccagacacaggccctcc

SEQ ID NO: 3520791 - DNA, 14 bp, Homo sapiens
ctggccagatgcac

SEQ ID NO: 3520792 - DNA, 18 bp, Homo sapiens
ctggccagatgcaccagc

SEQ ID NO: 3520793 - DNA, 21 bp, Homo sapiens
ctggccagatgcaccagccct

SEQ ID NO: 3520794 - DNA, 22 bp, Homo sapiens
ctggccagatgcaccagccctt

SEQ ID NO: 3520795 - DNA, 17 bp, Homo sapiens
ctggccagggccacgct

SEQ ID NO: 3520796 - DNA, 13 bp, Homo sapiens
ctggccaggggtc

SEQ ID NO: 3520797 - DNA, 18 bp, Homo sapiens
ctggccagtccaggctgc

SEQ ID NO: 3520798 - DNA, 22 bp, Homo sapiens
ctggccagtccaggctgccgtg

SEQ ID NO: 3520799 - DNA, 18 bp, Homo sapiens
ctggccatcccacaagtg

SEQ ID NO: 3520800 - DNA, 22 bp, Homo sapiens
ctggccatctggttaggatggc

SEQ ID NO: 3520801 - DNA, 12 bp, Homo sapiens
ctggcccagggc

SEQ ID NO: 3520802 - DNA, 16 bp, Homo sapiens
ctggcccagggcccag

SEQ ID NO: 3520803 - DNA, 21 bp, Homo sapiens
ctggcccagggcccagagccc

SEQ ID NO: 3520804 - DNA, 22 bp, Homo sapiens
ctggcccagggcccagagccca

SEQ ID NO: 3520805 - DNA, 23 bp, Homo sapiens
ctggcccagggcccagagcccag

SEQ ID NO: 3520806 - DNA, 21 bp, Homo sapiens
ctggccccaggacctggctgc

SEQ ID NO: 3520807 - DNA, 12 bp, Homo sapiens
ctggccccgccg

SEQ ID NO: 3520808 - DNA, 17 bp, Homo sapiens
ctggccccgcctgcctg

SEQ ID NO: 3520809 - DNA, 15 bp, Homo sapiens
ctggccctgttctcc

SEQ ID NO: 3520810 - DNA, 18 bp, Homo sapiens
ctggccgagtccaagctg

SEQ ID NO: 3520811 - DNA, 20 bp, Homo sapiens
ctggccgagtccaagctggg

SEQ ID NO: 3520812 - DNA, 23 bp, Homo sapiens
ctggccgagtccaagctgggaga

SEQ ID NO: 3520813 - DNA, 13 bp, Homo sapiens
ctggccgcctcca

SEQ ID NO: 3520814 - DNA, 19 bp, Homo sapiens
ctggccgcctccaggagcc

SEQ ID NO: 3520815 - DNA, 18 bp, Homo sapiens
ctggccgcgccaaataat

SEQ ID NO: 3520816 - DNA, 15 bp, Homo sapiens
ctggccggctccagt

SEQ ID NO: 3520817 - DNA, 13 bp, Homo sapiens
ctggccgtacttg

SEQ ID NO: 3520818 - DNA, 23 bp, Homo sapiens
ctggcctcaagtgattctcctgc

SEQ ID NO: 3520819 - DNA, 16 bp, Homo sapiens
ctggcctcccaaatga

SEQ ID NO: 3520820 - DNA, 16 bp, Homo sapiens
ctggcctcccctgcca

SEQ ID NO: 3520821 - DNA, 18 bp, Homo sapiens
ctggcctcccctgccacc

SEQ ID NO: 3520822 - DNA, 17 bp, Homo sapiens
ctggccttccacttggc

SEQ ID NO: 3520823 - DNA, 18 bp, Homo sapiens
ctggcggggaaccctggg

SEQ ID NO: 3520824 - DNA, 15 bp, Homo sapiens
ctggcgtgcagtggt

SEQ ID NO: 3520825 - DNA, 22 bp, Homo sapiens
ctggctcattctgcaccttgcc

SEQ ID NO: 3520826 - DNA, 20 bp, Homo sapiens
ctggctctgagcgcctccat

SEQ ID NO: 3520827 - DNA, 13 bp, Homo sapiens
ctggctggcctca

SEQ ID NO: 3520828 - DNA, 17 bp, Homo sapiens
ctggctggcctcaccca

SEQ ID NO: 3520829 - DNA, 21 bp, Homo sapiens
ctggctggggtggcctgtgtg

SEQ ID NO: 3520830 - DNA, 16 bp, Homo sapiens
ctggctggttccatct

SEQ ID NO: 3520831 - DNA, 18 bp, Homo sapiens
ctggctgttggctggggg

SEQ ID NO: 3520832 - DNA, 19 bp, Homo sapiens
ctggctgttggctgggggc

SEQ ID NO: 3520833 - DNA, 14 bp, Homo sapiens
ctggttccagggtc

SEQ ID NO: 3520834 - DNA, 23 bp, Homo sapiens
ctggttcggatttggggtggatt

SEQ ID NO: 3520835 - DNA, 11 bp, Homo sapiens
ctgtaaatcat

SEQ ID NO: 3520836 - DNA, 15 bp, Homo sapiens
ctgtaacctcttcag

SEQ ID NO: 3520837 - DNA, 23 bp, Homo sapiens
ctgtaacctcttcagaggccctc

SEQ ID NO: 3520838 - DNA, 13 bp, Homo sapiens
ctgtaagaaacct

SEQ ID NO: 3520839 - DNA, 19 bp, Homo sapiens
ctgtaagaataatttatag

SEQ ID NO: 3520840 - DNA, 20 bp, Homo sapiens
ctgtaagaataatttatagt

SEQ ID NO: 3520841 - DNA, 12 bp, Homo sapiens
ctgtaagacatt

SEQ ID NO: 3520842 - DNA, 16 bp, Homo sapiens
ctgtaagacattagta

SEQ ID NO: 3520843 - DNA, 21 bp, Homo sapiens
ctgtaatgtgaatctatgctg

SEQ ID NO: 3520844 - DNA, 16 bp, Homo sapiens
ctgtacaaatataaga

SEQ ID NO: 3520845 - DNA, 14 bp, Homo sapiens
ctgtacgtctgaca

SEQ ID NO: 3520846 - DNA, 16 bp, Homo sapiens
ctgtacgtctgacagg

SEQ ID NO: 3520847 - DNA, 20 bp, Homo sapiens
ctgtacgtctgacaggcaat

SEQ ID NO: 3520848 - DNA, 13 bp, Homo sapiens
ctgtagaaatggt

SEQ ID NO: 3520849 - DNA, 19 bp, Homo sapiens
ctgtagaaatggttgtatt

SEQ ID NO: 3520850 - DNA, 18 bp, Homo sapiens
ctgtagatggaaaaactt

SEQ ID NO: 3520851 - DNA, 21 bp, Homo sapiens
ctgtagcccactctgctcgcc

SEQ ID NO: 3520852 - DNA, 22 bp, Homo sapiens
ctgtaggatattggaatgcaca

SEQ ID NO: 3520853 - DNA, 15 bp, Homo sapiens
ctgtaggcagaggct

SEQ ID NO: 3520854 - DNA, 17 bp, Homo sapiens
ctgtaggcagaggctgc

SEQ ID NO: 3520855 - DNA, 24 bp, Homo sapiens
ctgtagggtaattagtaacatgtg

SEQ ID NO: 3520856 - DNA, 18 bp, Homo sapiens
ctgtagtaggcattttta

SEQ ID NO: 3520857 - DNA, 17 bp, Homo sapiens
ctgtagtttggagacaa

SEQ ID NO: 3520858 - DNA, 19 bp, Homo sapiens
ctgtataaaatcagccaat

SEQ ID NO: 3520859 - DNA, 14 bp, Homo sapiens
ctgtataagtaaga

SEQ ID NO: 3520860 - DNA, 15 bp, Homo sapiens
ctgtataagtaagaa

SEQ ID NO: 3520861 - DNA, 16 bp, Homo sapiens
ctgtataagtaagaaa

SEQ ID NO: 3520862 - DNA, 22 bp, Homo sapiens
ctgtataagttatttttgtaca

SEQ ID NO: 3520863 - DNA, 23 bp, Homo sapiens
ctgtataagttatttttgtacat

SEQ ID NO: 3520864 - DNA, 14 bp, Homo sapiens
ctgtatcccatgag

SEQ ID NO: 3520865 - DNA, 21 bp, Homo sapiens
ctgtatcccatgagcctcagc

SEQ ID NO: 3520866 - DNA, 23 bp, Homo sapiens
ctgtatcccatgagcctcagcat

SEQ ID NO: 3520867 - DNA, 16 bp, Homo sapiens
ctgtatggcatgacaa

SEQ ID NO: 3520868 - DNA, 18 bp, Homo sapiens
ctgtatgttatagaactt

SEQ ID NO: 3520869 - DNA, 19 bp, Homo sapiens
ctgtatgttatagaacttc

SEQ ID NO: 3520870 - DNA, 15 bp, Homo sapiens
ctgtattcagacaga

SEQ ID NO: 3520871 - DNA, 20 bp, Homo sapiens
ctgtattttgaaaatgcttt

SEQ ID NO: 3520872 - DNA, 20 bp, Homo sapiens
ctgtattttgtattgtttca

SEQ ID NO: 3520873 - DNA, 22 bp, Homo sapiens
ctgtcaaacaaagccagaagct

SEQ ID NO: 3520874 - DNA, 20 bp, Homo sapiens
ctgtcaaggctgcttagaat

SEQ ID NO: 3520875 - DNA, 17 bp, Homo sapiens
ctgtcacctctcccacg

SEQ ID NO: 3520876 - DNA, 17 bp, Homo sapiens
ctgtcactcaggctgga

SEQ ID NO: 3520877 - DNA, 14 bp, Homo sapiens
ctgtcactcattgc

SEQ ID NO: 3520878 - DNA, 23 bp, Homo sapiens
ctgtcactcattgctgagcctct

SEQ ID NO: 3520879 - DNA, 17 bp, Homo sapiens
ctgtcacttcttcacct

SEQ ID NO: 3520880 - DNA, 14 bp, Homo sapiens
ctgtcagtcacagc

SEQ ID NO: 3520881 - DNA, 18 bp, Homo sapiens
ctgtcagtcacagccacc

SEQ ID NO: 3520882 - DNA, 20 bp, Homo sapiens
ctgtcatttgagcagggctc

SEQ ID NO: 3520883 - DNA, 12 bp, Homo sapiens
ctgtcattttgc

SEQ ID NO: 3520884 - DNA, 20 bp, Homo sapiens
ctgtccacacccagctcagc

SEQ ID NO: 3520885 - DNA, 18 bp, Homo sapiens
ctgtccagctccaacctg

SEQ ID NO: 3520886 - DNA, 16 bp, Homo sapiens
ctgtccaggcactgag

SEQ ID NO: 3520887 - DNA, 12 bp, Homo sapiens
ctgtccatgatg

SEQ ID NO: 3520888 - DNA, 19 bp, Homo sapiens
ctgtcccatagtccctgcc

SEQ ID NO: 3520889 - DNA, 16 bp, Homo sapiens
ctgtccccccagctaa

SEQ ID NO: 3520890 - DNA, 16 bp, Homo sapiens
ctgtccccttctctca

SEQ ID NO: 3520891 - DNA, 19 bp, Homo sapiens
ctgtccccttctctcatct

SEQ ID NO: 3520892 - DNA, 21 bp, Homo sapiens
ctgtccctagtaaaaatacaa

SEQ ID NO: 3520893 - DNA, 12 bp, Homo sapiens
ctgtccctccgg

SEQ ID NO: 3520894 - DNA, 13 bp, Homo sapiens
ctgtccctgcgcc

SEQ ID NO: 3520895 - DNA, 18 bp, Homo sapiens
ctgtcccttgctgtatgc

SEQ ID NO: 3520896 - DNA, 20 bp, Homo sapiens
ctgtcctactctgtgtcagg

SEQ ID NO: 3520897 - DNA, 16 bp, Homo sapiens
ctgtcctatgaatgct

SEQ ID NO: 3520898 - DNA, 21 bp, Homo sapiens
ctgtcctcagccttgccagag

SEQ ID NO: 3520899 - DNA, 16 bp, Homo sapiens
ctgtcctcaggtggcc

SEQ ID NO: 3520900 - DNA, 17 bp, Homo sapiens
ctgtcctcaggtggcca

SEQ ID NO: 3520901 - DNA, 16 bp, Homo sapiens
ctgtcctgaaagcggc

SEQ ID NO: 3520902 - DNA, 17 bp, Homo sapiens
ctgtcctgaaagcggct

SEQ ID NO: 3520903 - DNA, 21 bp, Homo sapiens
ctgtcctgaaagcggctgcct

SEQ ID NO: 3520904 - DNA, 20 bp, Homo sapiens
ctgtcctgccatgcaagaac

SEQ ID NO: 3520905 - DNA, 21 bp, Homo sapiens
ctgtcctgggagtgagctggt

SEQ ID NO: 3520906 - DNA, 12 bp, Homo sapiens
ctgtcctgtgac

SEQ ID NO: 3520907 - DNA, 12 bp, Homo sapiens
ctgtccttaccc

SEQ ID NO: 3520908 - DNA, 13 bp, Homo sapiens
ctgtcctttcctt

SEQ ID NO: 3520909 - DNA, 13 bp, Homo sapiens
ctgtcctttctag

SEQ ID NO: 3520910 - DNA, 20 bp, Homo sapiens
ctgtcctttctagagcactg

SEQ ID NO: 3520911 - DNA, 23 bp, Homo sapiens
ctgtcggcgctgccccatctccc

SEQ ID NO: 3520912 - DNA, 15 bp, Homo sapiens
ctgtcgggctttgtg

SEQ ID NO: 3520913 - DNA, 19 bp, Homo sapiens
ctgtcgggctttgtgtgaa

SEQ ID NO: 3520914 - DNA, 15 bp, Homo sapiens
ctgtcgtgatggggc

SEQ ID NO: 3520915 - DNA, 16 bp, Homo sapiens
ctgtctagagagggag

SEQ ID NO: 3520916 - DNA, 18 bp, Homo sapiens
ctgtctagagagggaggc

SEQ ID NO: 3520917 - DNA, 23 bp, Homo sapiens
ctgtctcaaaaaaacacaaaagt

SEQ ID NO: 3520918 - DNA, 18 bp, Homo sapiens
ctgtctcaaaaaaagaaa

SEQ ID NO: 3520919 - DNA, 22 bp, Homo sapiens
ctgtctcaaaaaaagaaaaaga

SEQ ID NO: 3520920 - DNA, 22 bp, Homo sapiens
ctgtctcctttcaccccagggc

SEQ ID NO: 3520921 - DNA, 16 bp, Homo sapiens
ctgtctctctgggctg

SEQ ID NO: 3520922 - DNA, 14 bp, Homo sapiens
ctgtctgccagggc

SEQ ID NO: 3520923 - DNA, 19 bp, Homo sapiens
ctgtctgccccagcccaga

SEQ ID NO: 3520924 - DNA, 13 bp, Homo sapiens
ctgtctgtgacct

SEQ ID NO: 3520925 - DNA, 14 bp, Homo sapiens
ctgtctgtgttttt

SEQ ID NO: 3520926 - DNA, 22 bp, Homo sapiens
ctgtcttcacctgattcaacta

SEQ ID NO: 3520927 - DNA, 19 bp, Homo sapiens
ctgtcttcatagcagattt

SEQ ID NO: 3520928 - DNA, 11 bp, Homo sapiens
ctgtcttcctc

SEQ ID NO: 3520929 - DNA, 12 bp, Homo sapiens
ctgtcttcctct

SEQ ID NO: 3520930 - DNA, 13 bp, Homo sapiens
ctgtcttcctctg

SEQ ID NO: 3520931 - DNA, 15 bp, Homo sapiens
ctgtcttcctctgca

SEQ ID NO: 3520932 - DNA, 17 bp, Homo sapiens
ctgtcttcctctgcaag

SEQ ID NO: 3520933 - DNA, 13 bp, Homo sapiens
ctgtcttctggac

SEQ ID NO: 3520934 - DNA, 17 bp, Homo sapiens
ctgtcttgttcattttg

SEQ ID NO: 3520935 - DNA, 16 bp, Homo sapiens
ctgtctttaaaagaga

SEQ ID NO: 3520936 - DNA, 15 bp, Homo sapiens
ctgtctttcagcatt

SEQ ID NO: 3520937 - DNA, 11 bp, Homo sapiens
ctgtctttcct

SEQ ID NO: 3520938 - DNA, 19 bp, Homo sapiens
ctgtctttcctaagacctg

SEQ ID NO: 3520939 - DNA, 20 bp, Homo sapiens
ctgtctttcctagatggcag

SEQ ID NO: 3520940 - DNA, 15 bp, Homo sapiens
ctgtgaaatattctt

SEQ ID NO: 3520941 - DNA, 16 bp, Homo sapiens
ctgtgaaatgctggca

SEQ ID NO: 3520942 - DNA, 17 bp, Homo sapiens
ctgtgaacagcttgctg

SEQ ID NO: 3520943 - DNA, 15 bp, Homo sapiens
ctgtgaactgaaatt

SEQ ID NO: 3520944 - DNA, 15 bp, Homo sapiens
ctgtgaagagaacca

SEQ ID NO: 3520945 - DNA, 20 bp, Homo sapiens
ctgtgaagatctcactctgc

SEQ ID NO: 3520946 - DNA, 21 bp, Homo sapiens
ctgtgaagatctcactctgcc

SEQ ID NO: 3520947 - DNA, 21 bp, Homo sapiens
ctgtgaagcattcgagacaga

SEQ ID NO: 3520948 - DNA, 15 bp, Homo sapiens
ctgtgaatgccactg

SEQ ID NO: 3520949 - DNA, 16 bp, Homo sapiens
ctgtgaatgccactgc

SEQ ID NO: 3520950 - DNA, 16 bp, Homo sapiens
ctgtgacagcctctgc

SEQ ID NO: 3520951 - DNA, 17 bp, Homo sapiens
ctgtgaccaatgtcttg

SEQ ID NO: 3520952 - DNA, 16 bp, Homo sapiens
ctgtgacccccagctc

SEQ ID NO: 3520953 - DNA, 14 bp, Homo sapiens
ctgtgacctgcatc

SEQ ID NO: 3520954 - DNA, 15 bp, Homo sapiens
ctgtgacctgcatct

SEQ ID NO: 3520955 - DNA, 16 bp, Homo sapiens
ctgtgactcttctctc

SEQ ID NO: 3520956 - DNA, 18 bp, Homo sapiens
ctgtgagactcgagaact

SEQ ID NO: 3520957 - DNA, 19 bp, Homo sapiens
ctgtgaggagccccatctg

SEQ ID NO: 3520958 - DNA, 21 bp, Homo sapiens
ctgtgagtgaaagttgccatt

SEQ ID NO: 3520959 - DNA, 16 bp, Homo sapiens
ctgtgatacatttctg

SEQ ID NO: 3520960 - DNA, 21 bp, Homo sapiens
ctgtgcaacctcttggcctga

SEQ ID NO: 3520961 - DNA, 12 bp, Homo sapiens
ctgtgcacgcag

SEQ ID NO: 3520962 - DNA, 14 bp, Homo sapiens
ctgtgcattctcct

SEQ ID NO: 3520963 - DNA, 20 bp, Homo sapiens
ctgtgcattctcctggatgc

SEQ ID NO: 3520964 - DNA, 14 bp, Homo sapiens
ctgtgccatgtgcc

SEQ ID NO: 3520965 - DNA, 17 bp, Homo sapiens
ctgtgccctccttccca

SEQ ID NO: 3520966 - DNA, 13 bp, Homo sapiens
cttgagaaacctt

SEQ ID NO: 3520967 - DNA, 23 bp, Homo sapiens
cttgagaagacctcacctagaaa

SEQ ID NO: 3520968 - DNA, 17 bp, Homo sapiens
cttgagacacggagccc

SEQ ID NO: 3520969 - DNA, 20 bp, Homo sapiens
cttgaggaaacaacagcttt

SEQ ID NO: 3520970 - DNA, 15 bp, Homo sapiens
cttgagggttgggct

SEQ ID NO: 3520971 - DNA, 19 bp, Homo sapiens
cttgagggttgggctggtg

SEQ ID NO: 3520972 - DNA, 21 bp, Homo sapiens
cttgagggttgggctggtgtc

SEQ ID NO: 3520973 - DNA, 20 bp, Homo sapiens
cttgagttgattcagctctg

SEQ ID NO: 3520974 - DNA, 22 bp, Homo sapiens
cttgatctgtatatacaataac

SEQ ID NO: 3520975 - DNA, 13 bp, Homo sapiens
cttgatgactgcc

SEQ ID NO: 3520976 - DNA, 21 bp, Homo sapiens
cttgatgactgccttgcctcc

SEQ ID NO: 3520977 - DNA, 17 bp, Homo sapiens
cttgatgggattctgga

SEQ ID NO: 3520978 - DNA, 16 bp, Homo sapiens
cttgatgtgtcatcta

SEQ ID NO: 3520979 - DNA, 13 bp, Homo sapiens
cttgatgtttaga

SEQ ID NO: 3520980 - DNA, 20 bp, Homo sapiens
cttgatgtttagaaaagtat

SEQ ID NO: 3520981 - DNA, 17 bp, Homo sapiens
cttgattctgcagtaaa

SEQ ID NO: 3520982 - DNA, 20 bp, Homo sapiens
cttgattctgcagtaaatct

SEQ ID NO: 3520983 - DNA, 18 bp, Homo sapiens
cttgcagactctacagag

SEQ ID NO: 3520984 - DNA, 20 bp, Homo sapiens
cttgcagactctacagaggc

SEQ ID NO: 3520985 - DNA, 23 bp, Homo sapiens
cttgcagcaggatctagaggggg

SEQ ID NO: 3520986 - DNA, 19 bp, Homo sapiens
cttgccaagggtccctgtg

SEQ ID NO: 3520987 - DNA, 20 bp, Homo sapiens
cttgccaagggtccctgtgt

SEQ ID NO: 3520988 - DNA, 21 bp, Homo sapiens
cttgccaagggtccctgtgtg

SEQ ID NO: 3520989 - DNA, 19 bp, Homo sapiens
cttgccagaaccaaattaa

SEQ ID NO: 3520990 - DNA, 17 bp, Homo sapiens
cttgccagatgctgcag

SEQ ID NO: 3520991 - DNA, 15 bp, Homo sapiens
cttgccattctcttg

SEQ ID NO: 3520992 - DNA, 17 bp, Homo sapiens
cttgccccactctgcct

SEQ ID NO: 3520993 - DNA, 21 bp, Homo sapiens
cttgccccactctgcctgcct

SEQ ID NO: 3520994 - DNA, 23 bp, Homo sapiens
cttgcccccatttcacccatggg

SEQ ID NO: 3520995 - DNA, 18 bp, Homo sapiens
cttgccgcgtcgccctcc

SEQ ID NO: 3520996 - DNA, 21 bp, Homo sapiens
cttgccgcgtcgccctcccag

SEQ ID NO: 3520997 - DNA, 23 bp, Homo sapiens
cttgccgcgtcgccctcccaggc

SEQ ID NO: 3520998 - DNA, 14 bp, Homo sapiens
cttgcctcctcagt

SEQ ID NO: 3520999 - DNA, 23 bp, Homo sapiens
cttgcctctgtccccttctctca

SEQ ID NO: 3521000 - DNA, 13 bp, Homo sapiens
cttgcctctgtgc

SEQ ID NO: 3521001 - DNA, 21 bp, Homo sapiens
cttgcctcttttacctgctgc

SEQ ID NO: 3521002 - DNA, 12 bp, Homo sapiens
cttgcctgcagg

SEQ ID NO: 3521003 - DNA, 18 bp, Homo sapiens
cttgccttattagagtgt

SEQ ID NO: 3521004 - DNA, 21 bp, Homo sapiens
cttgccttattagagtgtctt

SEQ ID NO: 3521005 - DNA, 22 bp, Homo sapiens
cttgccttcctaagcctgtggc

SEQ ID NO: 3521006 - DNA, 23 bp, Homo sapiens
cttgccttcctaagcctgtggct

SEQ ID NO: 3521007 - DNA, 23 bp, Homo sapiens
cttgcctttagcccctcccaagc

SEQ ID NO: 3521008 - DNA, 22 bp, Homo sapiens
cttgctatattgcccaggctgg

SEQ ID NO: 3521009 - DNA, 17 bp, Homo sapiens
cttgctctgctgacaga

SEQ ID NO: 3521010 - DNA, 23 bp, Homo sapiens
cttgctctgcttgacaacatctg

SEQ ID NO: 3521011 - DNA, 18 bp, Homo sapiens
cttgctctgtttgtgggg

SEQ ID NO: 3521012 - DNA, 12 bp, Homo sapiens
cttgctgctgtc

SEQ ID NO: 3521013 - DNA, 13 bp, Homo sapiens
cttgctgctgtct

SEQ ID NO: 3521014 - DNA, 13 bp, Homo sapiens
cttgcttatgtgt

SEQ ID NO: 3521015 - DNA, 20 bp, Homo sapiens
cttgcttgattgtatggtgg

SEQ ID NO: 3521016 - DNA, 13 bp, Homo sapiens
cttggaagctccg

SEQ ID NO: 3521017 - DNA, 18 bp, Homo sapiens
cttggaagttgcatggca

SEQ ID NO: 3521018 - DNA, 21 bp, Homo sapiens
cttggacatcagtgtttgttg

SEQ ID NO: 3521019 - DNA, 14 bp, Homo sapiens
cttggactattata

SEQ ID NO: 3521020 - DNA, 11 bp, Homo sapiens
cttggactcat

SEQ ID NO: 3521021 - DNA, 15 bp, Homo sapiens
cttggaggacagtgg

SEQ ID NO: 3521022 - DNA, 16 bp, Homo sapiens
cttggatcctgggctg

SEQ ID NO: 3521023 - DNA, 15 bp, Homo sapiens
cttggattctctaac

SEQ ID NO: 3521024 - DNA, 21 bp, Homo sapiens
cttggcaccagacacccagga

SEQ ID NO: 3521025 - DNA, 20 bp, Homo sapiens
cttggcagcacctgtctcct

SEQ ID NO: 3521026 - DNA, 17 bp, Homo sapiens
cttggcatcagctggcg

SEQ ID NO: 3521027 - DNA, 19 bp, Homo sapiens
cttggcctaaacctcagtt

SEQ ID NO: 3521028 - DNA, 13 bp, Homo sapiens
cttggcctatctc

SEQ ID NO: 3521029 - DNA, 11 bp, Homo sapiens
cttggccttct

SEQ ID NO: 3521030 - DNA, 12 bp, Homo sapiens
cttggccttctc

SEQ ID NO: 3521031 - DNA, 23 bp, Homo sapiens
cttggccttctcccctcttctga

SEQ ID NO: 3521032 - DNA, 23 bp, Homo sapiens
cttggctcaagtcctcttttctg

SEQ ID NO: 3521033 - DNA, 14 bp, Homo sapiens
cttggctcagacat

SEQ ID NO: 3521034 - DNA, 13 bp, Homo sapiens
cttggctgcagga

SEQ ID NO: 3521035 - DNA, 16 bp, Homo sapiens
cttggctgcagggagt

SEQ ID NO: 3521036 - DNA, 17 bp, Homo sapiens
cttggctgcagggagtc

SEQ ID NO: 3521037 - DNA, 13 bp, Homo sapiens
cttggctggtgca

SEQ ID NO: 3521038 - DNA, 14 bp, Homo sapiens
cttggcttaatcat

SEQ ID NO: 3521039 - DNA, 14 bp, Homo sapiens
cttggcttgcccac

SEQ ID NO: 3521040 - DNA, 20 bp, Homo sapiens
cttggcttttactgaagcct

SEQ ID NO: 3521041 - DNA, 22 bp, Homo sapiens
cttggctttttactattaacat

SEQ ID NO: 3521042 - DNA, 16 bp, Homo sapiens
cttgggagccactgcc

SEQ ID NO: 3521043 - DNA, 17 bp, Homo sapiens
cttgggagccactgcca

SEQ ID NO: 3521044 - DNA, 22 bp, Homo sapiens
cttgggagccactgccactcca

SEQ ID NO: 3521045 - DNA, 19 bp, Homo sapiens
cttgggaggccccactggg

SEQ ID NO: 3521046 - DNA, 15 bp, Homo sapiens
cttgggcagagctgg

SEQ ID NO: 3521047 - DNA, 19 bp, Homo sapiens
cttgggcagagctggctct

SEQ ID NO: 3521048 - DNA, 14 bp, Homo sapiens
cttgggcagcatcc

SEQ ID NO: 3521049 - DNA, 18 bp, Homo sapiens
cttgggccaagccagctg

SEQ ID NO: 3521050 - DNA, 14 bp, Homo sapiens
cttgggccactgtg

SEQ ID NO: 3521051 - DNA, 20 bp, Homo sapiens
cttgggccactgtgaagaga

SEQ ID NO: 3521052 - DNA, 13 bp, Homo sapiens
cttgggctccctg

SEQ ID NO: 3521053 - DNA, 21 bp, Homo sapiens
cttggggagttaagacctggc

SEQ ID NO: 3521054 - DNA, 22 bp, Homo sapiens
cttggggagttaagacctggca

SEQ ID NO: 3521055 - DNA, 23 bp, Homo sapiens
cttggggagttaagacctggcag

SEQ ID NO: 3521056 - DNA, 16 bp, Homo sapiens
cttggggccactgcct

SEQ ID NO: 3521057 - DNA, 22 bp, Homo sapiens
cttggggccttgatgactgcct

SEQ ID NO: 3521058 - DNA, 22 bp, Homo sapiens
cttggggggctgaggtgggagg

SEQ ID NO: 3521059 - DNA, 14 bp, Homo sapiens
cttgggggggtggc

SEQ ID NO: 3521060 - DNA, 18 bp, Homo sapiens
cttgggggttcaggcccg

SEQ ID NO: 3521061 - DNA, 16 bp, Homo sapiens
cttgggtctctctcca

SEQ ID NO: 3521062 - DNA, 17 bp, Homo sapiens
cttgggtctctctccat

SEQ ID NO: 3521063 - DNA, 14 bp, Homo sapiens
cttggtcacataca

SEQ ID NO: 3521064 - DNA, 13 bp, Homo sapiens
cttggttccccca

SEQ ID NO: 3521065 - DNA, 15 bp, Homo sapiens
cttggttgaggaaac

SEQ ID NO: 3521066 - DNA, 17 bp, Homo sapiens
cttgtaaacagaagcaa

SEQ ID NO: 3521067 - DNA, 18 bp, Homo sapiens
cttgtaaaggaatttaaa

SEQ ID NO: 3521068 - DNA, 19 bp, Homo sapiens
cttgtaaaggaatttaaaa

SEQ ID NO: 3521069 - DNA, 23 bp, Homo sapiens
cttgtaaattattaatttatgca

SEQ ID NO: 3521070 - DNA, 16 bp, Homo sapiens
cttgtaatttttattt

SEQ ID NO: 3521071 - DNA, 17 bp, Homo sapiens
cttgtactttattttct

SEQ ID NO: 3521072 - DNA, 13 bp, Homo sapiens
cttgtattaaact

SEQ ID NO: 3521073 - DNA, 20 bp, Homo sapiens
cttgtcactagcagctgcag

SEQ ID NO: 3521074 - DNA, 20 bp, Homo sapiens
cttgtcatatgtagccttca

SEQ ID NO: 3521075 - DNA, 15 bp, Homo sapiens
cttgtcccagaggct

SEQ ID NO: 3521076 - DNA, 18 bp, Homo sapiens
cttgtctcaatgctcata

SEQ ID NO: 3521077 - DNA, 23 bp, Homo sapiens
cttgtctcaatgctcataacgga

SEQ ID NO: 3521078 - DNA, 14 bp, Homo sapiens
cttgtctctgggct

SEQ ID NO: 3521079 - DNA, 23 bp, Homo sapiens
cttgtgaggaaagtcattggctt

SEQ ID NO: 3521080 - DNA, 15 bp, Homo sapiens
cttgtgattatttat

SEQ ID NO: 3521081 - DNA, 17 bp, Homo sapiens
cttgtgattatttatta

SEQ ID NO: 3521082 - DNA, 13 bp, Homo sapiens
cttgtggacacag

SEQ ID NO: 3521083 - DNA, 14 bp, Homo sapiens
cttgtggacacagc

SEQ ID NO: 3521084 - DNA, 17 bp, Homo sapiens
cttgtggacacagctct

SEQ ID NO: 3521085 - DNA, 15 bp, Homo sapiens
cttgtggactaaaag

SEQ ID NO: 3521086 - DNA, 16 bp, Homo sapiens
cttgtggactaaaaga

SEQ ID NO: 3521087 - DNA, 17 bp, Homo sapiens
cttgtggactaaaagat

SEQ ID NO: 3521088 - DNA, 19 bp, Homo sapiens
cttgtggactaaaagatat

SEQ ID NO: 3521089 - DNA, 17 bp, Homo sapiens
cttgtggatggaaatgt

SEQ ID NO: 3521090 - DNA, 17 bp, Homo sapiens
cttgttacccatgaaaa

SEQ ID NO: 3521091 - DNA, 14 bp, Homo sapiens
cttgttacttctga

SEQ ID NO: 3521092 - DNA, 15 bp, Homo sapiens
cttgttacttctgag

SEQ ID NO: 3521093 - DNA, 12 bp, Homo sapiens
cttgttcatttt

SEQ ID NO: 3521094 - DNA, 17 bp, Homo sapiens
cttgttccaaggccagg

SEQ ID NO: 3521095 - DNA, 19 bp, Homo sapiens
cttgttctgagattcaata

SEQ ID NO: 3521096 - DNA, 21 bp, Homo sapiens
cttgttgaaaacccagactgt

SEQ ID NO: 3521097 - DNA, 15 bp, Homo sapiens
cttgttgctttgttg

SEQ ID NO: 3521098 - DNA, 16 bp, Homo sapiens
ctttgctttgcccagc

SEQ ID NO: 3521099 - DNA, 17 bp, Homo sapiens
ctttgctttgctttctg

SEQ ID NO: 3521100 - DNA, 20 bp, Homo sapiens
ctttggaaaatgcattgtat

SEQ ID NO: 3521101 - DNA, 17 bp, Homo sapiens
ctttggaaacaacattt

SEQ ID NO: 3521102 - DNA, 16 bp, Homo sapiens
ctttggatttgacatt

SEQ ID NO: 3521103 - DNA, 15 bp, Homo sapiens
ctttgggaaaggaga

SEQ ID NO: 3521104 - DNA, 22 bp, Homo sapiens
ctttgggaaaggagaagttaag

SEQ ID NO: 3521105 - DNA, 23 bp, Homo sapiens
ctttgggagagcaggaatgaaaa

SEQ ID NO: 3521106 - DNA, 23 bp, Homo sapiens
ctttgggaggccaaggtgggagg

SEQ ID NO: 3521107 - DNA, 21 bp, Homo sapiens
ctttgggccagacatgccaca

SEQ ID NO: 3521108 - DNA, 19 bp, Homo sapiens
ctttggttctggccagaat

SEQ ID NO: 3521109 - DNA, 14 bp, Homo sapiens
ctttggtttggcct

SEQ ID NO: 3521110 - DNA, 20 bp, Homo sapiens
ctttggtttggcctccatcc

SEQ ID NO: 3521111 - DNA, 22 bp, Homo sapiens
ctttggtttggcctccatcctc

SEQ ID NO: 3521112 - DNA, 15 bp, Homo sapiens
ctttgtcccggggct

SEQ ID NO: 3521113 - DNA, 12 bp, Homo sapiens
ctttgtgaatat

SEQ ID NO: 3521114 - DNA, 12 bp, Homo sapiens
ctttgtggccaa

SEQ ID NO: 3521115 - DNA, 13 bp, Homo sapiens
ctttgtggccaag

SEQ ID NO: 3521116 - DNA, 14 bp, Homo sapiens
ctttgtggccaagg

SEQ ID NO: 3521117 - DNA, 20 bp, Homo sapiens
ctttgtgtgtgtgtcagctg

SEQ ID NO: 3521118 - DNA, 15 bp, Homo sapiens
ctttgttgcactgaa

SEQ ID NO: 3521119 - DNA, 17 bp, Homo sapiens
ctttgtttcaaccaagt

SEQ ID NO: 3521120 - DNA, 18 bp, Homo sapiens
ctttgtttcgtggggagg

SEQ ID NO: 3521121 - DNA, 21 bp, Homo sapiens
ctttgtttgttgtcagctgaa

SEQ ID NO: 3521122 - DNA, 13 bp, Homo sapiens
cttttaaacacat

SEQ ID NO: 3521123 - DNA, 16 bp, Homo sapiens
cttttaatgaaaagga

SEQ ID NO: 3521124 - DNA, 17 bp, Homo sapiens
cttttacatactgctgt

SEQ ID NO: 3521125 - DNA, 20 bp, Homo sapiens
cttttacctgctgcttctcc

SEQ ID NO: 3521126 - DNA, 23 bp, Homo sapiens
cttttactacagctatgaagaaa

SEQ ID NO: 3521127 - DNA, 23 bp, Homo sapiens
cttttagaaatactgcaagaaaa

SEQ ID NO: 3521128 - DNA, 12 bp, Homo sapiens
cttttatactct

SEQ ID NO: 3521129 - DNA, 19 bp, Homo sapiens
cttttatactctttctgta

SEQ ID NO: 3521130 - DNA, 22 bp, Homo sapiens
cttttataggtgagaaaaaaac

SEQ ID NO: 3521131 - DNA, 18 bp, Homo sapiens
cttttatgtagtaattga

SEQ ID NO: 3521132 - DNA, 17 bp, Homo sapiens
cttttatgtggtctctt

SEQ ID NO: 3521133 - DNA, 19 bp, Homo sapiens
cttttatgtggtctctttg

SEQ ID NO: 3521134 - DNA, 17 bp, Homo sapiens
cttttattgacacagaa

SEQ ID NO: 3521135 - DNA, 15 bp, Homo sapiens
cttttcacagcaaca

SEQ ID NO: 3521136 - DNA, 17 bp, Homo sapiens
cttttcacagcaacatt

SEQ ID NO: 3521137 - DNA, 16 bp, Homo sapiens
cttttcagattgtgga

SEQ ID NO: 3521138 - DNA, 20 bp, Homo sapiens
cttttcataacctagcctta

SEQ ID NO: 3521139 - DNA, 16 bp, Homo sapiens
cttttcccctttcctg

SEQ ID NO: 3521140 - DNA, 15 bp, Homo sapiens
cttttcccttgcttc

SEQ ID NO: 3521141 - DNA, 13 bp, Homo sapiens
cttttccttgggg

SEQ ID NO: 3521142 - DNA, 20 bp, Homo sapiens
cttttccttggggcaggcag

SEQ ID NO: 3521143 - DNA, 15 bp, Homo sapiens
cttttcgcctttcct

SEQ ID NO: 3521144 - DNA, 20 bp, Homo sapiens
cttttctgggtttgaagctg

SEQ ID NO: 3521145 - DNA, 19 bp, Homo sapiens
cttttctgtttcctgtacc

SEQ ID NO: 3521146 - DNA, 18 bp, Homo sapiens
cttttctttaaagaagtt

SEQ ID NO: 3521147 - DNA, 20 bp, Homo sapiens
cttttgaacccaggagttca

SEQ ID NO: 3521148 - DNA, 14 bp, Homo sapiens
cttttgaattgtta

SEQ ID NO: 3521149 - DNA, 11 bp, Homo sapiens
cttttgacatt

SEQ ID NO: 3521150 - DNA, 23 bp, Homo sapiens
cttttgcagaagagggtgtgttt

SEQ ID NO: 3521151 - DNA, 11 bp, Homo sapiens
cttttgctttt

SEQ ID NO: 3521152 - DNA, 19 bp, Homo sapiens
cttttggaaccatgccttc

SEQ ID NO: 3521153 - DNA, 14 bp, Homo sapiens
cttttgggggaggg

SEQ ID NO: 3521154 - DNA, 18 bp, Homo sapiens
cttttgggggtcaacagt

SEQ ID NO: 3521155 - DNA, 15 bp, Homo sapiens
cttttggtctgtgtg

SEQ ID NO: 3521156 - DNA, 12 bp, Homo sapiens
cttttgtaaagt

SEQ ID NO: 3521157 - DNA, 13 bp, Homo sapiens
cttttgtaaatgt

SEQ ID NO: 3521158 - DNA, 12 bp, Homo sapiens
cttttgtaataa

SEQ ID NO: 3521159 - DNA, 12 bp, Homo sapiens
cttttgtaattt

SEQ ID NO: 3521160 - DNA, 17 bp, Homo sapiens
cttttgtatgtaaatgt

SEQ ID NO: 3521161 - DNA, 18 bp, Homo sapiens
cttttgtatgtaaatgtg

SEQ ID NO: 3521162 - DNA, 13 bp, Homo sapiens
cttttgttcgcat

SEQ ID NO: 3521163 - DNA, 15 bp, Homo sapiens
cttttgtttcctttt

SEQ ID NO: 3521164 - DNA, 19 bp, Homo sapiens
cttttgtttccttttttcc

SEQ ID NO: 3521165 - DNA, 20 bp, Homo sapiens
ctttttaaaaaaataaaaca

SEQ ID NO: 3521166 - DNA, 21 bp, Homo sapiens
ctttttaaaaaaataaaacag

SEQ ID NO: 3521167 - DNA, 22 bp, Homo sapiens
ctttttaaaaaaataaaacagt

SEQ ID NO: 3521168 - DNA, 19 bp, Homo sapiens
ctttttaaaaatagacact

SEQ ID NO: 3521169 - DNA, 20 bp, Homo sapiens
ctttttaaggtctttcagta

SEQ ID NO: 3521170 - DNA, 17 bp, Homo sapiens
ctttttactattaacat

SEQ ID NO: 3521171 - DNA, 16 bp, Homo sapiens
ctttttattgccttct

SEQ ID NO: 3521172 - DNA, 14 bp, Homo sapiens
ctttttcaggctcg

SEQ ID NO: 3521173 - DNA, 23 bp, Homo sapiens
ctttttcaggctcgccaaggcct

SEQ ID NO: 3521174 - DNA, 22 bp, Homo sapiens
ctttttccagacacttttttga

SEQ ID NO: 3521175 - DNA, 13 bp, Homo sapiens
ctttttcgccaaa

SEQ ID NO: 3521176 - DNA, 13 bp, Homo sapiens
ctttttgaagtgt

SEQ ID NO: 3521177 - DNA, 12 bp, Homo sapiens
ctttttgcagct

SEQ ID NO: 3521178 - DNA, 14 bp, Homo sapiens
ctttttgcagcttt

SEQ ID NO: 3521179 - DNA, 13 bp, Homo sapiens
ctttttgctttcg

SEQ ID NO: 3521180 - DNA, 21 bp, Homo sapiens
ctttttgtttgtttgttttgg

SEQ ID NO: 3521181 - DNA, 23 bp, Homo sapiens
ctttttgtttgtttgttttggat

SEQ ID NO: 3521182 - DNA, 21 bp, Homo sapiens
cttttttacttagtagattaa

SEQ ID NO: 3521183 - DNA, 22 bp, Homo sapiens
cttttttcccataagacaatga

SEQ ID NO: 3521184 - DNA, 18 bp, Homo sapiens
cttttttccttaatccag

SEQ ID NO: 3521185 - DNA, 21 bp, Homo sapiens
cttttttgttttttcaaaata

SEQ ID NO: 3521186 - DNA, 15 bp, Homo sapiens
ctttttttaactggt

SEQ ID NO: 3521187 - DNA, 15 bp, Homo sapiens
cttttttttttttcc

SEQ ID NO: 3521188 - DNA, 16 bp, Homo sapiens
cttttttttttttcca

SEQ ID NO: 3521189 - DNA, 16 bp, Homo sapiens
gaaaaaaaccacacaa

SEQ ID NO: 3521190 - DNA, 19 bp, Homo sapiens
gaaaaaaatcgtccaggga

SEQ ID NO: 3521191 - DNA, 21 bp, Homo sapiens
gaaaaaaatgttgtttcctaa

SEQ ID NO: 3521192 - DNA, 19 bp, Homo sapiens
gaaaaaatattttcctgcc

SEQ ID NO: 3521193 - DNA, 11 bp, Homo sapiens
gaaaaagaaaa

SEQ ID NO: 3521194 - DNA, 19 bp, Homo sapiens
gaaaaagaacatgcagttt

SEQ ID NO: 3521195 - DNA, 23 bp, Homo sapiens
gaaaaagaacatgcagtttgaaa

SEQ ID NO: 3521196 - DNA, 15 bp, Homo sapiens
gaaaaaggaggaaga

SEQ ID NO: 3521197 - DNA, 18 bp, Homo sapiens
gaaaaaggctgaaaagaa

SEQ ID NO: 3521198 - DNA, 19 bp, Homo sapiens
gaaaaataacttcaagcaa

SEQ ID NO: 3521199 - DNA, 16 bp, Homo sapiens
gaaaaatagcaacttg

SEQ ID NO: 3521200 - DNA, 17 bp, Homo sapiens
gaaaaatagcaacttgt

SEQ ID NO: 3521201 - DNA, 14 bp, Homo sapiens
gaaaaatgtgtaat

SEQ ID NO: 3521202 - DNA, 14 bp, Homo sapiens
gaaaacaaggaagt

SEQ ID NO: 3521203 - DNA, 18 bp, Homo sapiens
gaaaacatttcaagttta

SEQ ID NO: 3521204 - DNA, 18 bp, Homo sapiens
gaaaaccaccccttagat

SEQ ID NO: 3521205 - DNA, 20 bp, Homo sapiens
gaaaacctaattaaggaagt

SEQ ID NO: 3521206 - DNA, 13 bp, Homo sapiens
gaaaagattttaa

SEQ ID NO: 3521207 - DNA, 14 bp, Homo sapiens
gaaaagcagctctc

SEQ ID NO: 3521208 - DNA, 17 bp, Homo sapiens
gaaaagcagctctcccc

SEQ ID NO: 3521209 - DNA, 19 bp, Homo sapiens
gaaaagctgctgacagtgt

SEQ ID NO: 3521210 - DNA, 14 bp, Homo sapiens
gaaaagtcaaactg

SEQ ID NO: 3521211 - DNA, 19 bp, Homo sapiens
gaaaataatgtaattgtaa

SEQ ID NO: 3521212 - DNA, 17 bp, Homo sapiens
gaaaatatatgtatttt

SEQ ID NO: 3521213 - DNA, 17 bp, Homo sapiens
gaaaatattttgtctaa

SEQ ID NO: 3521214 - DNA, 19 bp, Homo sapiens
gaaaatattttgtctaaaa

SEQ ID NO: 3521215 - DNA, 20 bp, Homo sapiens
gaaaatattttgtctaaaat

SEQ ID NO: 3521216 - DNA, 22 bp, Homo sapiens
gaaaatcagcctgctccagctg

SEQ ID NO: 3521217 - DNA, 21 bp, Homo sapiens
gaaaatcatcaagaagggctg

SEQ ID NO: 3521218 - DNA, 14 bp, Homo sapiens
gaaaatgtcttgtg

SEQ ID NO: 3521219 - DNA, 21 bp, Homo sapiens
gaaaatgttgagaatcccaaa

SEQ ID NO: 3521220 - DNA, 15 bp, Homo sapiens
gaaaattatttgcat

SEQ ID NO: 3521221 - DNA, 16 bp, Homo sapiens
gaaaattatttgcata

SEQ ID NO: 3521222 - DNA, 21 bp, Homo sapiens
gaaacaacagctttaaaagaa

SEQ ID NO: 3521223 - DNA, 21 bp, Homo sapiens
gaaacacactgaggcagggaa

SEQ ID NO: 3521224 - DNA, 13 bp, Homo sapiens
gaaacacagaaac

SEQ ID NO: 3521225 - DNA, 14 bp, Homo sapiens
gaaacacagaaacc

SEQ ID NO: 3521226 - DNA, 12 bp, Homo sapiens
gaaacagaggct

SEQ ID NO: 3521227 - DNA, 19 bp, Homo sapiens
gaaacagctgccttagctt

SEQ ID NO: 3521228 - DNA, 20 bp, Homo sapiens
gaaacagctgccttagcttc

SEQ ID NO: 3521229 - DNA, 16 bp, Homo sapiens
gaaacattttttaaaa

SEQ ID NO: 3521230 - DNA, 14 bp, Homo sapiens
gaaaccacagctgc

SEQ ID NO: 3521231 - DNA, 12 bp, Homo sapiens
gacacaggcccg

SEQ ID NO: 3521232 - DNA, 12 bp, Homo sapiens
gacacaggcctg

SEQ ID NO: 3521233 - DNA, 22 bp, Homo sapiens
gacacaggtctttcctaaggct

SEQ ID NO: 3521234 - DNA, 13 bp, Homo sapiens
gacacatcgtttt

SEQ ID NO: 3521235 - DNA, 17 bp, Homo sapiens
gacacatcgttttgggg

SEQ ID NO: 3521236 - DNA, 15 bp, Homo sapiens
gacacatgctatgtt

SEQ ID NO: 3521237 - DNA, 19 bp, Homo sapiens
gacacatgctatgttctgt

SEQ ID NO: 3521238 - DNA, 14 bp, Homo sapiens
gacacctgcagcct

SEQ ID NO: 3521239 - DNA, 15 bp, Homo sapiens
gacaccttgacaggg

SEQ ID NO: 3521240 - DNA, 17 bp, Homo sapiens
gacactaaccacgctgg

SEQ ID NO: 3521241 - DNA, 21 bp, Homo sapiens
gacactccccgaagtcttttg

SEQ ID NO: 3521242 - DNA, 16 bp, Homo sapiens
gacactgggaggccag

SEQ ID NO: 3521243 - DNA, 23 bp, Homo sapiens
gacactgggaggccagtgagcca

SEQ ID NO: 3521244 - DNA, 18 bp, Homo sapiens
gacagaaagagacacaca

SEQ ID NO: 3521245 - DNA, 20 bp, Homo sapiens
gacagaagtttgcactatct

SEQ ID NO: 3521246 - DNA, 22 bp, Homo sapiens
gacagaagtttgcactatcttt

SEQ ID NO: 3521247 - DNA, 16 bp, Homo sapiens
gacagacacaggcccg

SEQ ID NO: 3521248 - DNA, 14 bp, Homo sapiens
gacagaccctctgc

SEQ ID NO: 3521249 - DNA, 16 bp, Homo sapiens
gacagaccttcacaga

SEQ ID NO: 3521250 - DNA, 22 bp, Homo sapiens
gacagagaatatgtctgctcct

SEQ ID NO: 3521251 - DNA, 16 bp, Homo sapiens
gacagagacctcctgc

SEQ ID NO: 3521252 - DNA, 18 bp, Homo sapiens
gacagaggaccattacaa

SEQ ID NO: 3521253 - DNA, 16 bp, Homo sapiens
gacagaggaggatgta

SEQ ID NO: 3521254 - DNA, 22 bp, Homo sapiens
gacagaggaggatgtaaggcct

SEQ ID NO: 3521255 - DNA, 23 bp, Homo sapiens
gacagaggaggatgtaaggcctt

SEQ ID NO: 3521256 - DNA, 18 bp, Homo sapiens
gacagaggccccagcctc

SEQ ID NO: 3521257 - DNA, 19 bp, Homo sapiens
gacagagggaagaaaagag

SEQ ID NO: 3521258 - DNA, 14 bp, Homo sapiens
gacagagtctcact

SEQ ID NO: 3521259 - DNA, 15 bp, Homo sapiens
gacagatgaggcttt

SEQ ID NO: 3521260 - DNA, 20 bp, Homo sapiens
gacagatgaggctttccatg

SEQ ID NO: 3521261 - DNA, 16 bp, Homo sapiens
gacagccaaaggctgg

SEQ ID NO: 3521262 - DNA, 17 bp, Homo sapiens
gacagccacggccaggc

SEQ ID NO: 3521263 - DNA, 21 bp, Homo sapiens
gacagccacggccaggccaga

SEQ ID NO: 3521264 - DNA, 12 bp, Homo sapiens
gacagccagagc

SEQ ID NO: 3521265 - DNA, 13 bp, Homo sapiens
gacagccagagcc

SEQ ID NO: 3521266 - DNA, 11 bp, Homo sapiens
gacagcctccc

SEQ ID NO: 3521267 - DNA, 16 bp, Homo sapiens
gacagcctcccacccc

SEQ ID NO: 3521268 - DNA, 13 bp, Homo sapiens
gacagctccttct

SEQ ID NO: 3521269 - DNA, 16 bp, Homo sapiens
gacagctccttctgtc

SEQ ID NO: 3521270 - DNA, 18 bp, Homo sapiens
gacagctccttctgtcct

SEQ ID NO: 3521271 - DNA, 19 bp, Homo sapiens
gacagctccttctgtccta

SEQ ID NO: 3521272 - DNA, 21 bp, Homo sapiens
gacagctgctcctagagggag

SEQ ID NO: 3521273 - DNA, 15 bp, Homo sapiens
gacagctttgctgct

SEQ ID NO: 3521274 - DNA, 16 bp, Homo sapiens
gacagctttgctgctg

SEQ ID NO: 3521275 - DNA, 17 bp, Homo sapiens
gacaggagaagagagga

SEQ ID NO: 3521276 - DNA, 21 bp, Homo sapiens
gacaggagacctggcactgga

SEQ ID NO: 3521277 - DNA, 18 bp, Homo sapiens
gacaggcaagcacctcct

SEQ ID NO: 3521278 - DNA, 16 bp, Homo sapiens
gacaggcaatgctggc

SEQ ID NO: 3521279 - DNA, 17 bp, Homo sapiens
gacaggcaatgctggct

SEQ ID NO: 3521280 - DNA, 18 bp, Homo sapiens
gacaggcatgttctctga

SEQ ID NO: 3521281 - DNA, 19 bp, Homo sapiens
gacaggcatgttctctgag

SEQ ID NO: 3521282 - DNA, 21 bp, Homo sapiens
gacaggcatgttctctgagga

SEQ ID NO: 3521283 - DNA, 23 bp, Homo sapiens
gacagggcacaccgggcactcag

SEQ ID NO: 3521284 - DNA, 24 bp, Homo sapiens
gacagggcacaccgggcactcaga

SEQ ID NO: 3521285 - DNA, 23 bp, Homo sapiens
gacaggtggaaaaactgagacag

SEQ ID NO: 3521286 - DNA, 16 bp, Homo sapiens
gacagtcaccccagga

SEQ ID NO: 3521287 - DNA, 16 bp, Homo sapiens
gacagtccagcctgga

SEQ ID NO: 3521288 - DNA, 13 bp, Homo sapiens
gacagtctcactt

SEQ ID NO: 3521289 - DNA, 17 bp, Homo sapiens
gacagtgtgggacaggc

SEQ ID NO: 3521290 - DNA, 19 bp, Homo sapiens
gacagtgtgggacaggctc

SEQ ID NO: 3521291 - DNA, 14 bp, Homo sapiens
gacagtttttctgt

SEQ ID NO: 3521292 - DNA, 23 bp, Homo sapiens
gacataatatattctatttttat

SEQ ID NO: 3521293 - DNA, 19 bp, Homo sapiens
gacatagaagagccaagag

SEQ ID NO: 3521294 - DNA, 14 bp, Homo sapiens
gacatatttaactg

SEQ ID NO: 3521295 - DNA, 20 bp, Homo sapiens
gacatatttaatgttttaaa

SEQ ID NO: 3521296 - DNA, 23 bp, Homo sapiens
gacatatttaatgttttaaatgt

SEQ ID NO: 3521297 - DNA, 13 bp, Homo sapiens
gacatcagctggt

SEQ ID NO: 3521298 - DNA, 16 bp, Homo sapiens
gacatcagtgtttgtt

SEQ ID NO: 3521299 - DNA, 18 bp, Homo sapiens
gacatcagtgtttgttgg

SEQ ID NO: 3521300 - DNA, 15 bp, Homo sapiens
gacatctgtagggaa

SEQ ID NO: 3521301 - DNA, 13 bp, Homo sapiens
gacatctttctct

SEQ ID NO: 3521302 - DNA, 20 bp, Homo sapiens
gacatgaagattctttccca

SEQ ID NO: 3521303 - DNA, 13 bp, Homo sapiens
gacatgatgcttt

SEQ ID NO: 3521304 - DNA, 19 bp, Homo sapiens
gacatgatgcttttactga

SEQ ID NO: 3521305 - DNA, 16 bp, Homo sapiens
gacatgatttccttga

SEQ ID NO: 3521306 - DNA, 17 bp, Homo sapiens
gacatgatttccttgaa

SEQ ID NO: 3521307 - DNA, 20 bp, Homo sapiens
gacatgatttccttgaatgt

SEQ ID NO: 3521308 - DNA, 12 bp, Homo sapiens
gacatgcctgtc

SEQ ID NO: 3521309 - DNA, 13 bp, Homo sapiens
gacatgcctgtcc

SEQ ID NO: 3521310 - DNA, 18 bp, Homo sapiens
gacatgcggtagccagca

SEQ ID NO: 3521311 - DNA, 15 bp, Homo sapiens
gacatgctgaagcca

SEQ ID NO: 3521312 - DNA, 18 bp, Homo sapiens
gacatgctgaagccaaag

SEQ ID NO: 3521313 - DNA, 19 bp, Homo sapiens
gacatgctgaagccaaagc

SEQ ID NO: 3521314 - DNA, 17 bp, Homo sapiens
gacatgggtattttata

SEQ ID NO: 3521315 - DNA, 21 bp, Homo sapiens
gacatgtcagagcttggccct

SEQ ID NO: 3521316 - DNA, 17 bp, Homo sapiens
gacatgttttccgtgaa

SEQ ID NO: 3521317 - DNA, 14 bp, Homo sapiens
gacattcacctgcc

SEQ ID NO: 3521318 - DNA, 18 bp, Homo sapiens
gacattcacctgccccaa

SEQ ID NO: 3521319 - DNA, 24 bp, Homo sapiens
gacattcttgtaaggctttgatta

SEQ ID NO: 3521320 - DNA, 23 bp, Homo sapiens
gacattgcggacagccacggcca

SEQ ID NO: 3521321 - DNA, 15 bp, Homo sapiens
gacattttagggaca

SEQ ID NO: 3521322 - DNA, 23 bp, Homo sapiens
gacatttttccgtttgcttttgt

SEQ ID NO: 3521323 - DNA, 13 bp, Homo sapiens
gaccaatttgcac

SEQ ID NO: 3521324 - DNA, 18 bp, Homo sapiens
gaccacaaaacttttcta

SEQ ID NO: 3521325 - DNA, 12 bp, Homo sapiens
gaccacagcaca

SEQ ID NO: 3521326 - DNA, 22 bp, Homo sapiens
gaccagacaccttgacagggca

SEQ ID NO: 3521327 - DNA, 17 bp, Homo sapiens
gaccagaggaagcccct

SEQ ID NO: 3521328 - DNA, 14 bp, Homo sapiens
gaccagcagcgcct

SEQ ID NO: 3521329 - DNA, 23 bp, Homo sapiens
gaccagcagcgcctttcccaact

SEQ ID NO: 3521330 - DNA, 16 bp, Homo sapiens
gaccagccagcagcag

SEQ ID NO: 3521331 - DNA, 18 bp, Homo sapiens
gaccagccagcagcagcc

SEQ ID NO: 3521332 - DNA, 12 bp, Homo sapiens
gaccagcctggc

SEQ ID NO: 3521333 - DNA, 18 bp, Homo sapiens
gaccagcctggccaacat

SEQ ID NO: 3521334 - DNA, 17 bp, Homo sapiens
gaccaggatccagcctc

SEQ ID NO: 3521335 - DNA, 14 bp, Homo sapiens
gaccagggagcctt

SEQ ID NO: 3521336 - DNA, 22 bp, Homo sapiens
gaccagggagcctttggttctg

SEQ ID NO: 3521337 - DNA, 14 bp, Homo sapiens
gaccagtggtctca

SEQ ID NO: 3521338 - DNA, 24 bp, Homo sapiens
gaccatgcgacactgggaggccag

SEQ ID NO: 3521339 - DNA, 17 bp, Homo sapiens
gacccaagtagctgcta

SEQ ID NO: 3521340 - DNA, 19 bp, Homo sapiens
gacccaatgtaggagctgc

SEQ ID NO: 3521341 - DNA, 13 bp, Homo sapiens
gacccagactccg

SEQ ID NO: 3521342 - DNA, 17 bp, Homo sapiens
gacccagggaacagcca

SEQ ID NO: 3521343 - DNA, 19 bp, Homo sapiens
gacccagggaacagccact

SEQ ID NO: 3521344 - DNA, 20 bp, Homo sapiens
gacccagggaacagccactc

SEQ ID NO: 3521345 - DNA, 16 bp, Homo sapiens
gacccagggttcccgc

SEQ ID NO: 3521346 - DNA, 13 bp, Homo sapiens
gaccccaggacct

SEQ ID NO: 3521347 - DNA, 14 bp, Homo sapiens
gacccctccatgtg

SEQ ID NO: 3521348 - DNA, 16 bp, Homo sapiens
gacccctggctctggg

SEQ ID NO: 3521349 - DNA, 12 bp, Homo sapiens
gaccccttccca

SEQ ID NO: 3521350 - DNA, 14 bp, Homo sapiens
gacccgtccatttg

SEQ ID NO: 3521351 - DNA, 16 bp, Homo sapiens
gaccctaaatcttgac

SEQ ID NO: 3521352 - DNA, 16 bp, Homo sapiens
gaccctattgctgctt

SEQ ID NO: 3521353 - DNA, 18 bp, Homo sapiens
gaccctctaacctcgccc

SEQ ID NO: 3521354 - DNA, 11 bp, Homo sapiens
gaccctctgct

SEQ ID NO: 3521355 - DNA, 17 bp, Homo sapiens
gaccctctgctgaagac

SEQ ID NO: 3521356 - DNA, 20 bp, Homo sapiens
gaccctgagctgaccagccg

SEQ ID NO: 3521357 - DNA, 14 bp, Homo sapiens
gaccctggggctgg

SEQ ID NO: 3521358 - DNA, 11 bp, Homo sapiens
gaccctgtata

SEQ ID NO: 3521359 - DNA, 14 bp, Homo sapiens
gaccctgtggaagc

SEQ ID NO: 3521360 - DNA, 15 bp, Homo sapiens
gaccctgttgctaag

SEQ ID NO: 3521361 - DNA, 16 bp, Homo sapiens
gaccctgttgctaagc

SEQ ID NO: 3521362 - DNA, 21 bp, Homo sapiens
gaccctgttgctaagccccag

SEQ ID NO: 3521363 - DNA, 14 bp, Homo sapiens
gacctaatgctcct

SEQ ID NO: 3521364 - DNA, 15 bp, Homo sapiens
gaggcctcaggtgct

SEQ ID NO: 3521365 - DNA, 16 bp, Homo sapiens
gaggcctcaggtgctg

SEQ ID NO: 3521366 - DNA, 13 bp, Homo sapiens
gaggcctgaagcc

SEQ ID NO: 3521367 - DNA, 20 bp, Homo sapiens
gaggcctgagcgctcctgcc

SEQ ID NO: 3521368 - DNA, 20 bp, Homo sapiens
gaggcctgggccgctgccac

SEQ ID NO: 3521369 - DNA, 10 bp, Homo sapiens
gaggctcagg

SEQ ID NO: 3521370 - DNA, 15 bp, Homo sapiens
gaggctcatggccct

SEQ ID NO: 3521371 - DNA, 21 bp, Homo sapiens
gaggctcatggccctgtagtt

SEQ ID NO: 3521372 - DNA, 22 bp, Homo sapiens
gaggctcatggccctgtagtta

SEQ ID NO: 3521373 - DNA, 19 bp, Homo sapiens
gaggctgacgtgtgaggga

SEQ ID NO: 3521374 - DNA, 16 bp, Homo sapiens
gaggctgaggctggca

SEQ ID NO: 3521375 - DNA, 15 bp, Homo sapiens
gaggctgcactgcag

SEQ ID NO: 3521376 - DNA, 23 bp, Homo sapiens
gaggctgccgagacagaccctct

SEQ ID NO: 3521377 - DNA, 18 bp, Homo sapiens
gaggctggcctctacatc

SEQ ID NO: 3521378 - DNA, 12 bp, Homo sapiens
gaggctgggagg

SEQ ID NO: 3521379 - DNA, 16 bp, Homo sapiens
gaggctgggaggagcc

SEQ ID NO: 3521380 - DNA, 18 bp, Homo sapiens
gaggctgggaggagcccc

SEQ ID NO: 3521381 - DNA, 23 bp, Homo sapiens
gaggctgtggtcacagcggaggt

SEQ ID NO: 3521382 - DNA, 19 bp, Homo sapiens
gagggacccttcgagatca

SEQ ID NO: 3521383 - DNA, 17 bp, Homo sapiens
gagggacctctcccagg

SEQ ID NO: 3521384 - DNA, 15 bp, Homo sapiens
gagggacgcctgggg

SEQ ID NO: 3521385 - DNA, 12 bp, Homo sapiens
gagggagatgga

SEQ ID NO: 3521386 - DNA, 12 bp, Homo sapiens
gagggaggggcc

SEQ ID NO: 3521387 - DNA, 21 bp, Homo sapiens
gagggagtgacagaggcagcc

SEQ ID NO: 3521388 - DNA, 21 bp, Homo sapiens
gagggcagcagaagggggtgg

SEQ ID NO: 3521389 - DNA, 17 bp, Homo sapiens
gagggccttcttaagat

SEQ ID NO: 3521390 - DNA, 10 bp, Homo sapiens
gagggctgga

SEQ ID NO: 3521391 - DNA, 16 bp, Homo sapiens
gagggctggaggccca

SEQ ID NO: 3521392 - DNA, 10 bp, Homo sapiens
gagggctggc

SEQ ID NO: 3521393 - DNA, 16 bp, Homo sapiens
gagggctggctggcct

SEQ ID NO: 3521394 - DNA, 16 bp, Homo sapiens
gaggggaagcttctgt

SEQ ID NO: 3521395 - DNA, 19 bp, Homo sapiens
gaggggacgcaggcccctc

SEQ ID NO: 3521396 - DNA, 11 bp, Homo sapiens
gaggggagggg

SEQ ID NO: 3521397 - DNA, 23 bp, Homo sapiens
gaggggcctaggcctcagccaga

SEQ ID NO: 3521398 - DNA, 13 bp, Homo sapiens
gagggtctgagga

SEQ ID NO: 3521399 - DNA, 20 bp, Homo sapiens
gagggtgagaggaagggtgg

SEQ ID NO: 3521400 - DNA, 14 bp, Homo sapiens
gagggtggtgacct

SEQ ID NO: 3521401 - DNA, 21 bp, Homo sapiens
gagggtggtgacctctgcctg

SEQ ID NO: 3521402 - DNA, 22 bp, Homo sapiens
gagggtgtcccaaaaagaaagg

SEQ ID NO: 3521403 - DNA, 21 bp, Homo sapiens
gagggttttaggtagaaaaac

SEQ ID NO: 3521404 - DNA, 16 bp, Homo sapiens
gaggtatgggctgggg

SEQ ID NO: 3521405 - DNA, 13 bp, Homo sapiens
gaggtcactgcta

SEQ ID NO: 3521406 - DNA, 21 bp, Homo sapiens
gaggtcggtaggttcagccaa

SEQ ID NO: 3521407 - DNA, 13 bp, Homo sapiens
gaggtctaatcta

SEQ ID NO: 3521408 - DNA, 23 bp, Homo sapiens
gaggtgaccccaggtttctatgt

SEQ ID NO: 3521409 - DNA, 17 bp, Homo sapiens
gaggtgagcggatcaca

SEQ ID NO: 3521410 - DNA, 22 bp, Homo sapiens
gaggtgccttcttcagggcctg

SEQ ID NO: 3521411 - DNA, 12 bp, Homo sapiens
gaggtgcttcac

SEQ ID NO: 3521412 - DNA, 11 bp, Homo sapiens
gaggtgggagg

SEQ ID NO: 3521413 - DNA, 20 bp, Homo sapiens
gaggtgggaggatcttttga

SEQ ID NO: 3521414 - DNA, 20 bp, Homo sapiens
gaggtgtatggagagaaaac

SEQ ID NO: 3521415 - DNA, 22 bp, Homo sapiens
gaggttggtttaatgcaataga

SEQ ID NO: 3521416 - DNA, 23 bp, Homo sapiens
gaggtttgtcgggcaccagccag

SEQ ID NO: 3521417 - DNA, 23 bp, Homo sapiens
gaggtttttttgtcaacattgtg

SEQ ID NO: 3521418 - DNA, 23 bp, Homo sapiens
gagtactgtgggcaatttagaaa

SEQ ID NO: 3521419 - DNA, 14 bp, Homo sapiens
gagtagaattgcat

SEQ ID NO: 3521420 - DNA, 23 bp, Homo sapiens
gagtagttatataattgttgaac

SEQ ID NO: 3521421 - DNA, 21 bp, Homo sapiens
gagtatttttaaaaaatatgt

SEQ ID NO: 3521422 - DNA, 15 bp, Homo sapiens
gagtcacaagcctcg

SEQ ID NO: 3521423 - DNA, 12 bp, Homo sapiens
gagtcacacagt

SEQ ID NO: 3521424 - DNA, 15 bp, Homo sapiens
gagtcacattctgct

SEQ ID NO: 3521425 - DNA, 16 bp, Homo sapiens
gagtcaccaagcccag

SEQ ID NO: 3521426 - DNA, 17 bp, Homo sapiens
gagtcagctctctgccc

SEQ ID NO: 3521427 - DNA, 17 bp, Homo sapiens
gagtcagggacccctgc

SEQ ID NO: 3521428 - DNA, 19 bp, Homo sapiens
gagtccgaaagggacttgg

SEQ ID NO: 3521429 - DNA, 14 bp, Homo sapiens
gagtcgaggacagg

SEQ ID NO: 3521430 - DNA, 16 bp, Homo sapiens
gagtcgaggacaggga

SEQ ID NO: 3521431 - DNA, 17 bp, Homo sapiens
gagtcgtggggtgtgct

SEQ ID NO: 3521432 - DNA, 20 bp, Homo sapiens
gagtcgtggggtgtgctggg

SEQ ID NO: 3521433 - DNA, 21 bp, Homo sapiens
gagtcgtggggtgtgctggga

SEQ ID NO: 3521434 - DNA, 19 bp, Homo sapiens
gagtctatgttcaaagact

SEQ ID NO: 3521435 - DNA, 21 bp, Homo sapiens
gagtctcactgttgcccaggc

SEQ ID NO: 3521436 - DNA, 23 bp, Homo sapiens
gagtctgaagcagatgcaaagag

SEQ ID NO: 3521437 - DNA, 12 bp, Homo sapiens
gagtctgatgat

SEQ ID NO: 3521438 - DNA, 23 bp, Homo sapiens
gagtctgccccacatgtggccat

SEQ ID NO: 3521439 - DNA, 20 bp, Homo sapiens
gagtcttgctatattgccca

SEQ ID NO: 3521440 - DNA, 17 bp, Homo sapiens
gagtgaatgccagtgtg

SEQ ID NO: 3521441 - DNA, 17 bp, Homo sapiens
gagtgacagaggcagcc

SEQ ID NO: 3521442 - DNA, 20 bp, Homo sapiens
gagtgacagaggcagcccca

SEQ ID NO: 3521443 - DNA, 16 bp, Homo sapiens
gagtgcagccgtttga

SEQ ID NO: 3521444 - DNA, 14 bp, Homo sapiens
gagtgccttctgtg

SEQ ID NO: 3521445 - DNA, 15 bp, Homo sapiens
gagtgccttctgtgg

SEQ ID NO: 3521446 - DNA, 14 bp, Homo sapiens
gagtggcaggggac

SEQ ID NO: 3521447 - DNA, 23 bp, Homo sapiens
gagtggcaggggacaggagtcca

SEQ ID NO: 3521448 - DNA, 19 bp, Homo sapiens
gagtgtcctcttccctctc

SEQ ID NO: 3521449 - DNA, 21 bp, Homo sapiens
gagtgtctttccacggagcca

SEQ ID NO: 3521450 - DNA, 18 bp, Homo sapiens
gagtgtttctaataaact

SEQ ID NO: 3521451 - DNA, 22 bp, Homo sapiens
gagtgtttctaataaacttgga

SEQ ID NO: 3521452 - DNA, 12 bp, Homo sapiens
gagttagactgt

SEQ ID NO: 3521453 - DNA, 13 bp, Homo sapiens
gagttagccaaac

SEQ ID NO: 3521454 - DNA, 19 bp, Homo sapiens
gagttagccaaacaacaac

SEQ ID NO: 3521455 - DNA, 21 bp, Homo sapiens
gagttcaggtagctgcccctg

SEQ ID NO: 3521456 - DNA, 19 bp, Homo sapiens
gagttgatctggaacccag

SEQ ID NO: 3521457 - DNA, 14 bp, Homo sapiens
gagtttaaaaatca

SEQ ID NO: 3521458 - DNA, 14 bp, Homo sapiens
gagtttacaaagat

SEQ ID NO: 3521459 - DNA, 14 bp, Homo sapiens
gagtttccttttct

SEQ ID NO: 3521460 - DNA, 20 bp, Homo sapiens
gagtttgagaccagcctggc

SEQ ID NO: 3521461 - DNA, 18 bp, Homo sapiens
gagtttgtcgctcatgtg

SEQ ID NO: 3521462 - DNA, 16 bp, Homo sapiens
gagttttggatgcagt

SEQ ID NO: 3521463 - DNA, 17 bp, Homo sapiens
gagttttttattccagt

SEQ ID NO: 3521464 - DNA, 16 bp, Homo sapiens
gagttttttgtaccaa

SEQ ID NO: 3521465 - DNA, 19 bp, Homo sapiens
gataaaacacgccacagcc

SEQ ID NO: 3521466 - DNA, 22 bp, Homo sapiens
gataaaactgggcctgtagctc

SEQ ID NO: 3521467 - DNA, 15 bp, Homo sapiens
gataaagcacagctg

SEQ ID NO: 3521468 - DNA, 12 bp, Homo sapiens
gataaattataa

SEQ ID NO: 3521469 - DNA, 13 bp, Homo sapiens
gataactagatgg

SEQ ID NO: 3521470 - DNA, 13 bp, Homo sapiens
gataattacaata

SEQ ID NO: 3521471 - DNA, 19 bp, Homo sapiens
gataattagatgattatat

SEQ ID NO: 3521472 - DNA, 12 bp, Homo sapiens
gatacaataaat

SEQ ID NO: 3521473 - DNA, 20 bp, Homo sapiens
gatacaggaaaagctgctga

SEQ ID NO: 3521474 - DNA, 21 bp, Homo sapiens
gatacaggaaaagctgctgac

SEQ ID NO: 3521475 - DNA, 14 bp, Homo sapiens
gatacatacagaat

SEQ ID NO: 3521476 - DNA, 13 bp, Homo sapiens
gatacatttctga

SEQ ID NO: 3521477 - DNA, 14 bp, Homo sapiens
gatactcatttctt

SEQ ID NO: 3521478 - DNA, 17 bp, Homo sapiens
gatactgaatattgaca

SEQ ID NO: 3521479 - DNA, 17 bp, Homo sapiens
gatactgcgactttctg

SEQ ID NO: 3521480 - DNA, 19 bp, Homo sapiens
gatactgcgactttctgcc

SEQ ID NO: 3521481 - DNA, 16 bp, Homo sapiens
gatactgtaacacttt

SEQ ID NO: 3521482 - DNA, 17 bp, Homo sapiens
gatacttaacaaataca

SEQ ID NO: 3521483 - DNA, 20 bp, Homo sapiens
gatagacacatatgaggggg

SEQ ID NO: 3521484 - DNA, 21 bp, Homo sapiens
gatagacacatatgaggggga

SEQ ID NO: 3521485 - DNA, 12 bp, Homo sapiens
gatagatgctgg

SEQ ID NO: 3521486 - DNA, 23 bp, Homo sapiens
gatagcaaagcgacgttagtcgt

SEQ ID NO: 3521487 - DNA, 12 bp, Homo sapiens
gatagcactttc

SEQ ID NO: 3521488 - DNA, 14 bp, Homo sapiens
gatagcactttcta

SEQ ID NO: 3521489 - DNA, 14 bp, Homo sapiens
gatagcctgtggcc

SEQ ID NO: 3521490 - DNA, 22 bp, Homo sapiens
gatagtcatgctgctagatctt

SEQ ID NO: 3521491 - DNA, 23 bp, Homo sapiens
gatagtggggagacttcttggct

SEQ ID NO: 3521492 - DNA, 19 bp, Homo sapiens
gatataactattgcccagg

SEQ ID NO: 3521493 - DNA, 14 bp, Homo sapiens
gatataagtgctgt

SEQ ID NO: 3521494 - DNA, 21 bp, Homo sapiens
gatataagtgctgtataaaat

SEQ ID NO: 3521495 - DNA, 22 bp, Homo sapiens
gatataagtgctgtataaaatc

SEQ ID NO: 3521496 - DNA, 20 bp, Homo sapiens
gcagacatagaagagccaag

SEQ ID NO: 3521497 - DNA, 23 bp, Homo sapiens
gcagaccacgcccgtcctgcctg

SEQ ID NO: 3521498 - DNA, 17 bp, Homo sapiens
gcagactctacagaggc

SEQ ID NO: 3521499 - DNA, 19 bp, Homo sapiens
gcagactggtttgcagtga

SEQ ID NO: 3521500 - DNA, 17 bp, Homo sapiens
gcagagaagctctcggg

SEQ ID NO: 3521501 - DNA, 23 bp, Homo sapiens
gcagagaatgaaagggcccagag

SEQ ID NO: 3521502 - DNA, 15 bp, Homo sapiens
gcagagagcacagcc

SEQ ID NO: 3521503 - DNA, 16 bp, Homo sapiens
gcagagcccaagggaa

SEQ ID NO: 3521504 - DNA, 20 bp, Homo sapiens
gcagagcccggagctccggc

SEQ ID NO: 3521505 - DNA, 19 bp, Homo sapiens
gcagagcgcgcccctagcc

SEQ ID NO: 3521506 - DNA, 13 bp, Homo sapiens
gcagagctggctc

SEQ ID NO: 3521507 - DNA, 15 bp, Homo sapiens
gcagagcttttcaga

SEQ ID NO: 3521508 - DNA, 16 bp, Homo sapiens
gcagaggatgttcata

SEQ ID NO: 3521509 - DNA, 12 bp, Homo sapiens
gcagaggccaga

SEQ ID NO: 3521510 - DNA, 16 bp, Homo sapiens
gcagagggctggaggc

SEQ ID NO: 3521511 - DNA, 18 bp, Homo sapiens
gcagagggctggaggccc

SEQ ID NO: 3521512 - DNA, 19 bp, Homo sapiens
gcagagggctggaggccca

SEQ ID NO: 3521513 - DNA, 21 bp, Homo sapiens
gcagagggctggaggcccagg

SEQ ID NO: 3521514 - DNA, 13 bp, Homo sapiens
gcagagtcacacg

SEQ ID NO: 3521515 - DNA, 14 bp, Homo sapiens
gcagagtcctggag

SEQ ID NO: 3521516 - DNA, 15 bp, Homo sapiens
gcagatccaggacta

SEQ ID NO: 3521517 - DNA, 16 bp, Homo sapiens
gcagatcttggactca

SEQ ID NO: 3521518 - DNA, 21 bp, Homo sapiens
gcagatgacaagatggtacaa

SEQ ID NO: 3521519 - DNA, 14 bp, Homo sapiens
gcagatgaggttgc

SEQ ID NO: 3521520 - DNA, 15 bp, Homo sapiens
gcagatgcaaagagg

SEQ ID NO: 3521521 - DNA, 19 bp, Homo sapiens
gcagatgcaaagaggcaag

SEQ ID NO: 3521522 - DNA, 22 bp, Homo sapiens
gcagatgcaaagaggcaagagg

SEQ ID NO: 3521523 - DNA, 13 bp, Homo sapiens
gcagatgcacatg

SEQ ID NO: 3521524 - DNA, 16 bp, Homo sapiens
gcagatggcagatgca

SEQ ID NO: 3521525 - DNA, 16 bp, Homo sapiens
gcagatttgggctgga

SEQ ID NO: 3521526 - DNA, 19 bp, Homo sapiens
gcagcaccctataaatcaa

SEQ ID NO: 3521527 - DNA, 12 bp, Homo sapiens
gcagcagaaggg

SEQ ID NO: 3521528 - DNA, 22 bp, Homo sapiens
gcagcagaagggggtggtgtct

SEQ ID NO: 3521529 - DNA, 15 bp, Homo sapiens
gcagcagggatgccc

SEQ ID NO: 3521530 - DNA, 17 bp, Homo sapiens
gcagcagggatgccctg

SEQ ID NO: 3521531 - DNA, 19 bp, Homo sapiens
gcagcagggatgccctgga

SEQ ID NO: 3521532 - DNA, 18 bp, Homo sapiens
gcagcaggtagcctgctg

SEQ ID NO: 3521533 - DNA, 19 bp, Homo sapiens
gcagcaggtagcctgctgg

SEQ ID NO: 3521534 - DNA, 15 bp, Homo sapiens
gcagcagtgtgaggc

SEQ ID NO: 3521535 - DNA, 17 bp, Homo sapiens
gcagcatatacaataat

SEQ ID NO: 3521536 - DNA, 19 bp, Homo sapiens
gcagcatatacaataatgt

SEQ ID NO: 3521537 - DNA, 23 bp, Homo sapiens
gcagcatcggacaagacccccag

SEQ ID NO: 3521538 - DNA, 12 bp, Homo sapiens
gcagccaaggga

SEQ ID NO: 3521539 - DNA, 17 bp, Homo sapiens
gcagcccaagcttccct

SEQ ID NO: 3521540 - DNA, 21 bp, Homo sapiens
gcagcccaagcttccctccat

SEQ ID NO: 3521541 - DNA, 15 bp, Homo sapiens
gcagccccagcctgc

SEQ ID NO: 3521542 - DNA, 16 bp, Homo sapiens
gcagccccagcctgct

SEQ ID NO: 3521543 - DNA, 18 bp, Homo sapiens
gcagccccattctgcctg

SEQ ID NO: 3521544 - DNA, 24 bp, Homo sapiens
gcagccccattctgcctgcccagg

SEQ ID NO: 3521545 - DNA, 20 bp, Homo sapiens
gcagccctgctgctgcctgc

SEQ ID NO: 3521546 - DNA, 16 bp, Homo sapiens
gcagccgctgagcgag

SEQ ID NO: 3521547 - DNA, 21 bp, Homo sapiens
gcagcctcaacctcctgggct

SEQ ID NO: 3521548 - DNA, 22 bp, Homo sapiens
gcagcctcaacctcctgggcta

SEQ ID NO: 3521549 - DNA, 18 bp, Homo sapiens
gcagcctcccatccaggg

SEQ ID NO: 3521550 - DNA, 14 bp, Homo sapiens
gcagcctggaccct

SEQ ID NO: 3521551 - DNA, 13 bp, Homo sapiens
gcagcgagggcgg

SEQ ID NO: 3521552 - DNA, 14 bp, Homo sapiens
gcagcgagggcgga

SEQ ID NO: 3521553 - DNA, 14 bp, Homo sapiens
gcagcgccaggctg

SEQ ID NO: 3521554 - DNA, 17 bp, Homo sapiens
gcagctcaaaggcacag

SEQ ID NO: 3521555 - DNA, 14 bp, Homo sapiens
gcagctcatctctg

SEQ ID NO: 3521556 - DNA, 17 bp, Homo sapiens
gcagctccctggcttct

SEQ ID NO: 3521557 - DNA, 12 bp, Homo sapiens
gcagctcctcag

SEQ ID NO: 3521558 - DNA, 14 bp, Homo sapiens
gcagctcctcagcg

SEQ ID NO: 3521559 - DNA, 12 bp, Homo sapiens
gcagctctcccc

SEQ ID NO: 3521560 - DNA, 22 bp, Homo sapiens
gcagctgcggtccacccaggag

SEQ ID NO: 3521561 - DNA, 23 bp, Homo sapiens
gcagctgcggtccacccaggagc

SEQ ID NO: 3521562 - DNA, 15 bp, Homo sapiens
gcagcttgagagggc

SEQ ID NO: 3521563 - DNA, 19 bp, Homo sapiens
gcagcttgagggttgggct

SEQ ID NO: 3521564 - DNA, 17 bp, Homo sapiens
gcaggaagctcagactg

SEQ ID NO: 3521565 - DNA, 18 bp, Homo sapiens
gcaggaagctcagactgg

SEQ ID NO: 3521566 - DNA, 13 bp, Homo sapiens
gcaggaagctgct

SEQ ID NO: 3521567 - DNA, 17 bp, Homo sapiens
gcaggacaacgaggaag

SEQ ID NO: 3521568 - DNA, 19 bp, Homo sapiens
gcaggacaacgaggaagcc

SEQ ID NO: 3521569 - DNA, 20 bp, Homo sapiens
gcaggacctctgaaaccctg

SEQ ID NO: 3521570 - DNA, 14 bp, Homo sapiens
gcaggacctgcctg

SEQ ID NO: 3521571 - DNA, 21 bp, Homo sapiens
gcaggaccttcgggctgtgcc

SEQ ID NO: 3521572 - DNA, 19 bp, Homo sapiens
gcaggactcagctccccag

SEQ ID NO: 3521573 - DNA, 23 bp, Homo sapiens
gcaggactccaggcccaaggctc

SEQ ID NO: 3521574 - DNA, 15 bp, Homo sapiens
gcaggactgcagagc

SEQ ID NO: 3521575 - DNA, 18 bp, Homo sapiens
gcaggactgcagagcaga

SEQ ID NO: 3521576 - DNA, 19 bp, Homo sapiens
gcaggactttgaggcaagt

SEQ ID NO: 3521577 - DNA, 22 bp, Homo sapiens
gcaggatttgttctctgtccag

SEQ ID NO: 3521578 - DNA, 14 bp, Homo sapiens
gcaggcacaggaca

SEQ ID NO: 3521579 - DNA, 13 bp, Homo sapiens
gcaggcagacacg

SEQ ID NO: 3521580 - DNA, 17 bp, Homo sapiens
gcaggcaggctcccagg

SEQ ID NO: 3521581 - DNA, 13 bp, Homo sapiens
gcaggcagggctg

SEQ ID NO: 3521582 - DNA, 20 bp, Homo sapiens
gcaggcaggtgtttattaaa

SEQ ID NO: 3521583 - DNA, 9 bp, Homo sapiens
gcaggcagt

SEQ ID NO: 3521584 - DNA, 17 bp, Homo sapiens
gcaggccaggccagctg

SEQ ID NO: 3521585 - DNA, 14 bp, Homo sapiens
gcaggcggtgggca

SEQ ID NO: 3521586 - DNA, 15 bp, Homo sapiens
gcaggcggtgggcac

SEQ ID NO: 3521587 - DNA, 16 bp, Homo sapiens
gcaggcggtgggcacc

SEQ ID NO: 3521588 - DNA, 16 bp, Homo sapiens
gcaggctacactgaca

SEQ ID NO: 3521589 - DNA, 20 bp, Homo sapiens
gcaggctacactgacactgg

SEQ ID NO: 3521590 - DNA, 21 bp, Homo sapiens
gcagggaagtgtaagaaacac

SEQ ID NO: 3521591 - DNA, 19 bp, Homo sapiens
gcagggagcggccggccag

SEQ ID NO: 3521592 - DNA, 13 bp, Homo sapiens
gcagggatgccct

SEQ ID NO: 3521593 - DNA, 13 bp, Homo sapiens
gcagggcagtcat

SEQ ID NO: 3521594 - DNA, 16 bp, Homo sapiens
gcagggcctcacacgg

SEQ ID NO: 3521595 - DNA, 18 bp, Homo sapiens
gcagggcgggcagagggc

SEQ ID NO: 3521596 - DNA, 21 bp, Homo sapiens
gcagggctaccctgagctgag

SEQ ID NO: 3521597 - DNA, 22 bp, Homo sapiens
gcagggctaccctgagctgagg

SEQ ID NO: 3521598 - DNA, 23 bp, Homo sapiens
gcagggctaccctgagctgaggc

SEQ ID NO: 3521599 - DNA, 15 bp, Homo sapiens
gcagggctgtgcttg

SEQ ID NO: 3521600 - DNA, 16 bp, Homo sapiens
gcaggggcctggagat

SEQ ID NO: 3521601 - DNA, 20 bp, Homo sapiens
gcaggggcctggagatcctc

SEQ ID NO: 3521602 - DNA, 21 bp, Homo sapiens
gcagggggacctaggctcctc

SEQ ID NO: 3521603 - DNA, 19 bp, Homo sapiens
gcagggtcctagaaattcc

SEQ ID NO: 3521604 - DNA, 18 bp, Homo sapiens
gcagggtctcactctgtc

SEQ ID NO: 3521605 - DNA, 17 bp, Homo sapiens
gcagggtctgggcagga

SEQ ID NO: 3521606 - DNA, 19 bp, Homo sapiens
gcagggtctgtttggactg

SEQ ID NO: 3521607 - DNA, 22 bp, Homo sapiens
gcagggtgcagtatcatgccct

SEQ ID NO: 3521608 - DNA, 17 bp, Homo sapiens
gcaggtgaaacccagtc

SEQ ID NO: 3521609 - DNA, 20 bp, Homo sapiens
gcaggtgaaacccagtcact

SEQ ID NO: 3521610 - DNA, 19 bp, Homo sapiens
gcaggtgctggagcactgg

SEQ ID NO: 3521611 - DNA, 14 bp, Homo sapiens
gcaggttcatggat

SEQ ID NO: 3521612 - DNA, 19 bp, Homo sapiens
gcaggttcccaagctcaga

SEQ ID NO: 3521613 - DNA, 22 bp, Homo sapiens
gcaggttggaactatgcagtgt

SEQ ID NO: 3521614 - DNA, 21 bp, Homo sapiens
gcagtatcatgccctgtgcaa

SEQ ID NO: 3521615 - DNA, 17 bp, Homo sapiens
gcagtatggtacatttt

SEQ ID NO: 3521616 - DNA, 22 bp, Homo sapiens
gcagtcatcttgaccaagcagg

SEQ ID NO: 3521617 - DNA, 15 bp, Homo sapiens
gcagtccagccagct

SEQ ID NO: 3521618 - DNA, 17 bp, Homo sapiens
gcagtcctgcctcagcc

SEQ ID NO: 3521619 - DNA, 23 bp, Homo sapiens
gcagtccttttactacagctatg

SEQ ID NO: 3521620 - DNA, 13 bp, Homo sapiens
gcagtcgtgcctg

SEQ ID NO: 3521621 - DNA, 19 bp, Homo sapiens
gcagtcgtgcctgtgtcca

SEQ ID NO: 3521622 - DNA, 13 bp, Homo sapiens
gcagtctctgcct

SEQ ID NO: 3521623 - DNA, 18 bp, Homo sapiens
gcagtgctcgctgttgct

SEQ ID NO: 3521624 - DNA, 21 bp, Homo sapiens
gcagtgctcgctgttgctgaa

SEQ ID NO: 3521625 - DNA, 16 bp, Homo sapiens
gcagtgggagctgcct

SEQ ID NO: 3521626 - DNA, 18 bp, Homo sapiens
gcagtgggagctgcctgt

SEQ ID NO: 3521627 - DNA, 18 bp, Homo sapiens
gcagtggtgcgatctggg

SEQ ID NO: 3521628 - DNA, 14 bp, Homo sapiens
gccctcctctccca

SEQ ID NO: 3521629 - DNA, 12 bp, Homo sapiens
gccctccttccc

SEQ ID NO: 3521630 - DNA, 22 bp, Homo sapiens
gccctccttcccaatcttcttt

SEQ ID NO: 3521631 - DNA, 17 bp, Homo sapiens
gccctcgctgccagctc

SEQ ID NO: 3521632 - DNA, 17 bp, Homo sapiens
gccctctccctctaggc

SEQ ID NO: 3521633 - DNA, 22 bp, Homo sapiens
gccctctccctctaggctctgc

SEQ ID NO: 3521634 - DNA, 16 bp, Homo sapiens
gccctctcctttgttc

SEQ ID NO: 3521635 - DNA, 22 bp, Homo sapiens
gccctctcctttgttcccggct

SEQ ID NO: 3521636 - DNA, 16 bp, Homo sapiens
gccctctggagtggcc

SEQ ID NO: 3521637 - DNA, 19 bp, Homo sapiens
gccctctggagtggccact

SEQ ID NO: 3521638 - DNA, 19 bp, Homo sapiens
gccctgagaaagccctgtc

SEQ ID NO: 3521639 - DNA, 11 bp, Homo sapiens
gccctgccact

SEQ ID NO: 3521640 - DNA, 13 bp, Homo sapiens
gccctgccactca

SEQ ID NO: 3521641 - DNA, 15 bp, Homo sapiens
gccctgccagagcag

SEQ ID NO: 3521642 - DNA, 13 bp, Homo sapiens
gccctgccctcac

SEQ ID NO: 3521643 - DNA, 18 bp, Homo sapiens
gccctgcggtagatggga

SEQ ID NO: 3521644 - DNA, 13 bp, Homo sapiens
gccctggaggtgg

SEQ ID NO: 3521645 - DNA, 15 bp, Homo sapiens
gccctggaggtggct

SEQ ID NO: 3521646 - DNA, 14 bp, Homo sapiens
gccctggcctcccc

SEQ ID NO: 3521647 - DNA, 16 bp, Homo sapiens
gccctggcctcccctg

SEQ ID NO: 3521648 - DNA, 24 bp, Homo sapiens
gccctggcctcccctgccaccagg

SEQ ID NO: 3521649 - DNA, 11 bp, Homo sapiens
gccctgggctg

SEQ ID NO: 3521650 - DNA, 13 bp, Homo sapiens
gccctgggctgga

SEQ ID NO: 3521651 - DNA, 16 bp, Homo sapiens
gccctgggctggaatc

SEQ ID NO: 3521652 - DNA, 19 bp, Homo sapiens
gccctggtcctggcctcct

SEQ ID NO: 3521653 - DNA, 14 bp, Homo sapiens
gccctggtggcagt

SEQ ID NO: 3521654 - DNA, 21 bp, Homo sapiens
gccctggtggcagtgggagct

SEQ ID NO: 3521655 - DNA, 21 bp, Homo sapiens
gccctgtgcaacctcttggcc

SEQ ID NO: 3521656 - DNA, 19 bp, Homo sapiens
gccctgttgacacaggtct

SEQ ID NO: 3521657 - DNA, 20 bp, Homo sapiens
gccctgttgacacaggtctt

SEQ ID NO: 3521658 - DNA, 21 bp, Homo sapiens
gcccttacacccatgactgag

SEQ ID NO: 3521659 - DNA, 19 bp, Homo sapiens
gcccttagcagggaaacag

SEQ ID NO: 3521660 - DNA, 20 bp, Homo sapiens
gcccttagcagggaaacagc

SEQ ID NO: 3521661 - DNA, 15 bp, Homo sapiens
gcccttatctgtgct

SEQ ID NO: 3521662 - DNA, 15 bp, Homo sapiens
gcccttcctctttgg

SEQ ID NO: 3521663 - DNA, 16 bp, Homo sapiens
gcccttggaggccagc

SEQ ID NO: 3521664 - DNA, 16 bp, Homo sapiens
gccctttcctcctcag

SEQ ID NO: 3521665 - DNA, 16 bp, Homo sapiens
gcccttttccagcctc

SEQ ID NO: 3521666 - DNA, 19 bp, Homo sapiens
gcccttttttctgcctcct

SEQ ID NO: 3521667 - DNA, 19 bp, Homo sapiens
gccgagatcacgccactgc

SEQ ID NO: 3521668 - DNA, 17 bp, Homo sapiens
gccgagattgcaccact

SEQ ID NO: 3521669 - DNA, 14 bp, Homo sapiens
gccgagtccaagct

SEQ ID NO: 3521670 - DNA, 15 bp, Homo sapiens
gccgagtccaagctg

SEQ ID NO: 3521671 - DNA, 18 bp, Homo sapiens
gccgagtccaagctggga

SEQ ID NO: 3521672 - DNA, 22 bp, Homo sapiens
gccgcaaaccacactggactcc

SEQ ID NO: 3521673 - DNA, 22 bp, Homo sapiens
gccgcaaattgtaccttttttg

SEQ ID NO: 3521674 - DNA, 14 bp, Homo sapiens
gccgcacgcctctc

SEQ ID NO: 3521675 - DNA, 15 bp, Homo sapiens
gccgcacgcctctcc

SEQ ID NO: 3521676 - DNA, 20 bp, Homo sapiens
gccgccagtacttgtcatat

SEQ ID NO: 3521677 - DNA, 16 bp, Homo sapiens
gccgcctccaggagcc

SEQ ID NO: 3521678 - DNA, 13 bp, Homo sapiens
gccgcctggtact

SEQ ID NO: 3521679 - DNA, 11 bp, Homo sapiens
gccgctacctc

SEQ ID NO: 3521680 - DNA, 16 bp, Homo sapiens
gccgctacctccctcc

SEQ ID NO: 3521681 - DNA, 12 bp, Homo sapiens
gccgctgccacc

SEQ ID NO: 3521682 - DNA, 16 bp, Homo sapiens
gccgctgccccagccc

SEQ ID NO: 3521683 - DNA, 13 bp, Homo sapiens
gccggagaggaag

SEQ ID NO: 3521684 - DNA, 12 bp, Homo sapiens
gccggaggccag

SEQ ID NO: 3521685 - DNA, 14 bp, Homo sapiens
gccggaggccagct

SEQ ID NO: 3521686 - DNA, 15 bp, Homo sapiens
gccggaggccagcta

SEQ ID NO: 3521687 - DNA, 18 bp, Homo sapiens
gccggcacagctgggata

SEQ ID NO: 3521688 - DNA, 20 bp, Homo sapiens
gccggcacctacatccccag

SEQ ID NO: 3521689 - DNA, 16 bp, Homo sapiens
gccggcagccccagcc

SEQ ID NO: 3521690 - DNA, 12 bp, Homo sapiens
gccggccagccc

SEQ ID NO: 3521691 - DNA, 14 bp, Homo sapiens
gccggccagcccct

SEQ ID NO: 3521692 - DNA, 22 bp, Homo sapiens
gccggctatgaaagggagcgag

SEQ ID NO: 3521693 - DNA, 21 bp, Homo sapiens
gccgggcgcggtggctcacgc

SEQ ID NO: 3521694 - DNA, 14 bp, Homo sapiens
gccgggtctgcctc

SEQ ID NO: 3521695 - DNA, 20 bp, Homo sapiens
gccgtatctccggctcccag

SEQ ID NO: 3521696 - DNA, 23 bp, Homo sapiens
gccgtatctccggctcccagcct

SEQ ID NO: 3521697 - DNA, 17 bp, Homo sapiens
gccgtcagtgctgtgct

SEQ ID NO: 3521698 - DNA, 16 bp, Homo sapiens
gccgtctccaggggct

SEQ ID NO: 3521699 - DNA, 13 bp, Homo sapiens
gccgtggatggcc

SEQ ID NO: 3521700 - DNA, 23 bp, Homo sapiens
gccgtttgagaagaaaacatcta

SEQ ID NO: 3521701 - DNA, 15 bp, Homo sapiens
gcctaaacctcagtt

SEQ ID NO: 3521702 - DNA, 15 bp, Homo sapiens
gcctaaatccaaaga

SEQ ID NO: 3521703 - DNA, 16 bp, Homo sapiens
gcctaaatccaaagaa

SEQ ID NO: 3521704 - DNA, 14 bp, Homo sapiens
gcctaagaagctct

SEQ ID NO: 3521705 - DNA, 16 bp, Homo sapiens
gcctaagaagctctgg

SEQ ID NO: 3521706 - DNA, 17 bp, Homo sapiens
gcctacaggagtgagca

SEQ ID NO: 3521707 - DNA, 21 bp, Homo sapiens
gcctacatcccgggcctcagt

SEQ ID NO: 3521708 - DNA, 18 bp, Homo sapiens
gcctagcaggcacaggac

SEQ ID NO: 3521709 - DNA, 20 bp, Homo sapiens
gcctaggacctatgttgtaa

SEQ ID NO: 3521710 - DNA, 18 bp, Homo sapiens
gcctaggtcccccaagca

SEQ ID NO: 3521711 - DNA, 22 bp, Homo sapiens
gcctaggtcccccaagcatggg

SEQ ID NO: 3521712 - DNA, 15 bp, Homo sapiens
gcctaggtgacagag

SEQ ID NO: 3521713 - DNA, 20 bp, Homo sapiens
gcctaggtgacagagtgaga

SEQ ID NO: 3521714 - DNA, 23 bp, Homo sapiens
gcctagtgaaggcttctctctgt

SEQ ID NO: 3521715 - DNA, 14 bp, Homo sapiens
gcctagtggcttgt

SEQ ID NO: 3521716 - DNA, 21 bp, Homo sapiens
gcctatctcctagggctatgg

SEQ ID NO: 3521717 - DNA, 18 bp, Homo sapiens
gcctattgcttgggtctc

SEQ ID NO: 3521718 - DNA, 22 bp, Homo sapiens
gcctcaaaaacgccctcaagaa

SEQ ID NO: 3521719 - DNA, 16 bp, Homo sapiens
gcctcaacctcctggg

SEQ ID NO: 3521720 - DNA, 17 bp, Homo sapiens
gcctcaacctcctgggc

SEQ ID NO: 3521721 - DNA, 19 bp, Homo sapiens
gcctcaacctcctgggcta

SEQ ID NO: 3521722 - DNA, 15 bp, Homo sapiens
gcctcaactcctccc

SEQ ID NO: 3521723 - DNA, 18 bp, Homo sapiens
gcctcaactcctcccata

SEQ ID NO: 3521724 - DNA, 21 bp, Homo sapiens
gcctcaagtgattctcctgcc

SEQ ID NO: 3521725 - DNA, 15 bp, Homo sapiens
gcctcagcatcctgg

SEQ ID NO: 3521726 - DNA, 16 bp, Homo sapiens
gcctcagcatcctggc

SEQ ID NO: 3521727 - DNA, 17 bp, Homo sapiens
gcctcagcatcctggca

SEQ ID NO: 3521728 - DNA, 15 bp, Homo sapiens
gcctcagccagagaa

SEQ ID NO: 3521729 - DNA, 15 bp, Homo sapiens
gcctcagcctactcc

SEQ ID NO: 3521730 - DNA, 22 bp, Homo sapiens
gcctcagcctcccaaagtgctg

SEQ ID NO: 3521731 - DNA, 16 bp, Homo sapiens
gcctcagcgcggccct

SEQ ID NO: 3521732 - DNA, 15 bp, Homo sapiens
gcctcagtgccacta

SEQ ID NO: 3521733 - DNA, 13 bp, Homo sapiens
gcctcagtgcccc

SEQ ID NO: 3521734 - DNA, 14 bp, Homo sapiens
gcctcagtgtattt

SEQ ID NO: 3521735 - DNA, 16 bp, Homo sapiens
gcctcagtgtgcccat

SEQ ID NO: 3521736 - DNA, 23 bp, Homo sapiens
gcctcatctctgcctgacaaggc

SEQ ID NO: 3521737 - DNA, 13 bp, Homo sapiens
gcctccaggagcc

SEQ ID NO: 3521738 - DNA, 13 bp, Homo sapiens
gcctccagggctg

SEQ ID NO: 3521739 - DNA, 17 bp, Homo sapiens
gcctccagggctggact

SEQ ID NO: 3521740 - DNA, 22 bp, Homo sapiens
gcctccagggctggactgaggc

SEQ ID NO: 3521741 - DNA, 16 bp, Homo sapiens
gcctccatccaaggcc

SEQ ID NO: 3521742 - DNA, 19 bp, Homo sapiens
gcctcccaaagtgctggga

SEQ ID NO: 3521743 - DNA, 13 bp, Homo sapiens
gcctcccacagac

SEQ ID NO: 3521744 - DNA, 17 bp, Homo sapiens
gcctcccacccccatct

SEQ ID NO: 3521745 - DNA, 22 bp, Homo sapiens
gcctcccatccagggcccccat

SEQ ID NO: 3521746 - DNA, 21 bp, Homo sapiens
gcctcccctctccttcctgtg

SEQ ID NO: 3521747 - DNA, 14 bp, Homo sapiens
gcctcccctgccac

SEQ ID NO: 3521748 - DNA, 19 bp, Homo sapiens
gcctcccctgccaccaggc

SEQ ID NO: 3521749 - DNA, 15 bp, Homo sapiens
gcctcccctgccagg

SEQ ID NO: 3521750 - DNA, 18 bp, Homo sapiens
gcctcccgaatagctggg

SEQ ID NO: 3521751 - DNA, 19 bp, Homo sapiens
gcctcccgaatagctggga

SEQ ID NO: 3521752 - DNA, 17 bp, Homo sapiens
gcctcccgagtagctgg

SEQ ID NO: 3521753 - DNA, 20 bp, Homo sapiens
gcctcccgagtagctgggac

SEQ ID NO: 3521754 - DNA, 21 bp, Homo sapiens
gcctcccgagtagctgggact

SEQ ID NO: 3521755 - DNA, 23 bp, Homo sapiens
gcctcccgagtagctgggactac

SEQ ID NO: 3521756 - DNA, 13 bp, Homo sapiens
gcctcccttgact

SEQ ID NO: 3521757 - DNA, 21 bp, Homo sapiens
gcctccgacgctgcctctcat

SEQ ID NO: 3521758 - DNA, 13 bp, Homo sapiens
gcctcctccagcc

SEQ ID NO: 3521759 - DNA, 15 bp, Homo sapiens
gcctcctggcccagg

SEQ ID NO: 3521760 - DNA, 19 bp, Homo sapiens
gcctcctggcccaggtgag

SEQ ID NO: 3521761 - DNA, 16 bp, Homo sapiens
gctcttgacagaaagc

SEQ ID NO: 3521762 - DNA, 18 bp, Homo sapiens
gctcttgacagaaagcag

SEQ ID NO: 3521763 - DNA, 17 bp, Homo sapiens
gctcttgtgaggaaagt

SEQ ID NO: 3521764 - DNA, 14 bp, Homo sapiens
gctctttggagatc

SEQ ID NO: 3521765 - DNA, 16 bp, Homo sapiens
gctgaaattctcctgg

SEQ ID NO: 3521766 - DNA, 16 bp, Homo sapiens
gctgaaccctcagcct

SEQ ID NO: 3521767 - DNA, 20 bp, Homo sapiens
gctgaaccctcagccttgac

SEQ ID NO: 3521768 - DNA, 15 bp, Homo sapiens
gctgaactcatgaga

SEQ ID NO: 3521769 - DNA, 17 bp, Homo sapiens
gctgaactgagcctagc

SEQ ID NO: 3521770 - DNA, 22 bp, Homo sapiens
gctgaactgagcctagctacct

SEQ ID NO: 3521771 - DNA, 21 bp, Homo sapiens
gctgacacaaacctgcctggg

SEQ ID NO: 3521772 - DNA, 16 bp, Homo sapiens
gctgacagacacaggc

SEQ ID NO: 3521773 - DNA, 17 bp, Homo sapiens
gctgacagacacaggcc

SEQ ID NO: 3521774 - DNA, 19 bp, Homo sapiens
gctgacagacacaggcccg

SEQ ID NO: 3521775 - DNA, 17 bp, Homo sapiens
gctgacagctgctccta

SEQ ID NO: 3521776 - DNA, 17 bp, Homo sapiens
gctgacattcacctgcc

SEQ ID NO: 3521777 - DNA, 21 bp, Homo sapiens
gctgaccagccgtgagcatgt

SEQ ID NO: 3521778 - DNA, 15 bp, Homo sapiens
gctgacctccacagc

SEQ ID NO: 3521779 - DNA, 15 bp, Homo sapiens
gctgacgtgtgaggg

SEQ ID NO: 3521780 - DNA, 19 bp, Homo sapiens
gctgacttcatctcccacc

SEQ ID NO: 3521781 - DNA, 15 bp, Homo sapiens
gctgagcaaacatgt

SEQ ID NO: 3521782 - DNA, 17 bp, Homo sapiens
gctgagcaccaggggat

SEQ ID NO: 3521783 - DNA, 20 bp, Homo sapiens
gctgagccacctgccctttt

SEQ ID NO: 3521784 - DNA, 13 bp, Homo sapiens
gctgagcccctgt

SEQ ID NO: 3521785 - DNA, 19 bp, Homo sapiens
gctgagcctctgctcccca

SEQ ID NO: 3521786 - DNA, 22 bp, Homo sapiens
gctgaggaaaggccagctggca

SEQ ID NO: 3521787 - DNA, 21 bp, Homo sapiens
gctgaggccacactcagcaca

SEQ ID NO: 3521788 - DNA, 13 bp, Homo sapiens
gctgaggcctggg

SEQ ID NO: 3521789 - DNA, 15 bp, Homo sapiens
gctgaggcctgggcc

SEQ ID NO: 3521790 - DNA, 20 bp, Homo sapiens
gctgaggcctgggccgctgc

SEQ ID NO: 3521791 - DNA, 13 bp, Homo sapiens
gctgaggctggca

SEQ ID NO: 3521792 - DNA, 16 bp, Homo sapiens
gctgaggctggcacag

SEQ ID NO: 3521793 - DNA, 22 bp, Homo sapiens
gctgagggcctgctggaggcct

SEQ ID NO: 3521794 - DNA, 18 bp, Homo sapiens
gctgagggtgagtgggtg

SEQ ID NO: 3521795 - DNA, 23 bp, Homo sapiens
gctgagggtgagtgggtgaataa

SEQ ID NO: 3521796 - DNA, 23 bp, Homo sapiens
gctgagtcatctgttagggcctt

SEQ ID NO: 3521797 - DNA, 13 bp, Homo sapiens
gctgatggtctgg

SEQ ID NO: 3521798 - DNA, 20 bp, Homo sapiens
gctgatgtcaatttctgtgt

SEQ ID NO: 3521799 - DNA, 20 bp, Homo sapiens
gctgattctcagggtctctg

SEQ ID NO: 3521800 - DNA, 12 bp, Homo sapiens
gctgcaaagtgt

SEQ ID NO: 3521801 - DNA, 12 bp, Homo sapiens
gctgcaaggttt

SEQ ID NO: 3521802 - DNA, 15 bp, Homo sapiens
gctgcagaggccaga

SEQ ID NO: 3521803 - DNA, 22 bp, Homo sapiens
gctgcagaggccagaggccccc

SEQ ID NO: 3521804 - DNA, 18 bp, Homo sapiens
gctgcagatttgggctgg

SEQ ID NO: 3521805 - DNA, 23 bp, Homo sapiens
gctgcagctccctggcttctgtg

SEQ ID NO: 3521806 - DNA, 17 bp, Homo sapiens
gctgcaggaatctttaa

SEQ ID NO: 3521807 - DNA, 22 bp, Homo sapiens
gctgcaggaatctttaaaagat

SEQ ID NO: 3521808 - DNA, 19 bp, Homo sapiens
gctgcagtcaacagttcaa

SEQ ID NO: 3521809 - DNA, 22 bp, Homo sapiens
gctgcagtcaacagttcaaaga

SEQ ID NO: 3521810 - DNA, 17 bp, Homo sapiens
gctgcatgccctctcag

SEQ ID NO: 3521811 - DNA, 22 bp, Homo sapiens
gctgcatgccctctcaggccgg

SEQ ID NO: 3521812 - DNA, 13 bp, Homo sapiens
gctgccaaatgcg

SEQ ID NO: 3521813 - DNA, 16 bp, Homo sapiens
gctgccagagaagtct

SEQ ID NO: 3521814 - DNA, 17 bp, Homo sapiens
gctgccagagaagtctg

SEQ ID NO: 3521815 - DNA, 14 bp, Homo sapiens
gctgccagggcttc

SEQ ID NO: 3521816 - DNA, 16 bp, Homo sapiens
gctgccagggcttcct

SEQ ID NO: 3521817 - DNA, 16 bp, Homo sapiens
gctgccccagccagat

SEQ ID NO: 3521818 - DNA, 13 bp, Homo sapiens
gctgccccggccc

SEQ ID NO: 3521819 - DNA, 22 bp, Homo sapiens
gctgcccctaatctctgtagga

SEQ ID NO: 3521820 - DNA, 15 bp, Homo sapiens
gctgcccctctctgg

SEQ ID NO: 3521821 - DNA, 18 bp, Homo sapiens
gctgccctatgggcctgc

SEQ ID NO: 3521822 - DNA, 21 bp, Homo sapiens
gctgccgagacagaccctctg

SEQ ID NO: 3521823 - DNA, 18 bp, Homo sapiens
gctgccggcacagctggg

SEQ ID NO: 3521824 - DNA, 21 bp, Homo sapiens
gctgccggcacagctgggata

SEQ ID NO: 3521825 - DNA, 21 bp, Homo sapiens
gctgcctccattatccattcc

SEQ ID NO: 3521826 - DNA, 13 bp, Homo sapiens
gctgcctgcccac

SEQ ID NO: 3521827 - DNA, 22 bp, Homo sapiens
gctgcctgcccgtaaacacgcc

SEQ ID NO: 3521828 - DNA, 13 bp, Homo sapiens
gctgcctgttcag

SEQ ID NO: 3521829 - DNA, 18 bp, Homo sapiens
gctgcctgttcagctcca

SEQ ID NO: 3521830 - DNA, 14 bp, Homo sapiens
gctgccttagcttc

SEQ ID NO: 3521831 - DNA, 20 bp, Homo sapiens
gctgccttagcttcaggaac

SEQ ID NO: 3521832 - DNA, 18 bp, Homo sapiens
gctgcggtccacccagga

SEQ ID NO: 3521833 - DNA, 21 bp, Homo sapiens
gctgcggtccacccaggagcc

SEQ ID NO: 3521834 - DNA, 22 bp, Homo sapiens
gctgctaccgttgacttccagg

SEQ ID NO: 3521835 - DNA, 16 bp, Homo sapiens
gctgctactagctctt

SEQ ID NO: 3521836 - DNA, 16 bp, Homo sapiens
gctgctatagcctggg

SEQ ID NO: 3521837 - DNA, 18 bp, Homo sapiens
gctgctcctagagggagg

SEQ ID NO: 3521838 - DNA, 17 bp, Homo sapiens
gctgctcctccctctga

SEQ ID NO: 3521839 - DNA, 19 bp, Homo sapiens
gctgctcctccctctgacc

SEQ ID NO: 3521840 - DNA, 12 bp, Homo sapiens
gctgctgacagt

SEQ ID NO: 3521841 - DNA, 15 bp, Homo sapiens
gctgctgccagggct

SEQ ID NO: 3521842 - DNA, 17 bp, Homo sapiens
gctgctgccagggcttc

SEQ ID NO: 3521843 - DNA, 12 bp, Homo sapiens
gctgctgctgct

SEQ ID NO: 3521844 - DNA, 21 bp, Homo sapiens
gctgctggacagtatcactgt

SEQ ID NO: 3521845 - DNA, 14 bp, Homo sapiens
gctgctggagactc

SEQ ID NO: 3521846 - DNA, 15 bp, Homo sapiens
gctgctgtccagtgc

SEQ ID NO: 3521847 - DNA, 14 bp, Homo sapiens
gctgctgtcttgtt

SEQ ID NO: 3521848 - DNA, 15 bp, Homo sapiens
gctgcttccaggctg

SEQ ID NO: 3521849 - DNA, 22 bp, Homo sapiens
gctgcttcccatgcctgcaacc

SEQ ID NO: 3521850 - DNA, 17 bp, Homo sapiens
gctgcttcctcctggaa

SEQ ID NO: 3521851 - DNA, 23 bp, Homo sapiens
gctgctttctcctttcaccaccc

SEQ ID NO: 3521852 - DNA, 12 bp, Homo sapiens
gctgcttttcct

SEQ ID NO: 3521853 - DNA, 22 bp, Homo sapiens
gctgcttttccttggggcaggc

SEQ ID NO: 3521854 - DNA, 15 bp, Homo sapiens
gctggaagatcctgc

SEQ ID NO: 3521855 - DNA, 13 bp, Homo sapiens
gctggaagggtca

SEQ ID NO: 3521856 - DNA, 15 bp, Homo sapiens
gctggaatgcagtgg

SEQ ID NO: 3521857 - DNA, 15 bp, Homo sapiens
gctggaccttgaact

SEQ ID NO: 3521858 - DNA, 16 bp, Homo sapiens
gctggaccttgaactg

SEQ ID NO: 3521859 - DNA, 21 bp, Homo sapiens
gctggaccttgaactgggtac

SEQ ID NO: 3521860 - DNA, 11 bp, Homo sapiens
gctggagaaat

SEQ ID NO: 3521861 - DNA, 15 bp, Homo sapiens
gctggagcactgggc

SEQ ID NO: 3521862 - DNA, 16 bp, Homo sapiens
gctggagcccagggag

SEQ ID NO: 3521863 - DNA, 13 bp, Homo sapiens
gctggaggcccag

SEQ ID NO: 3521864 - DNA, 12 bp, Homo sapiens
gctggagtgcag

SEQ ID NO: 3521865 - DNA, 15 bp, Homo sapiens
gctggagtgcagtga

SEQ ID NO: 3521866 - DNA, 17 bp, Homo sapiens
gctggagtgcagtgagc

SEQ ID NO: 3521867 - DNA, 18 bp, Homo sapiens
gctggagtgcagtgagcc

SEQ ID NO: 3521868 - DNA, 21 bp, Homo sapiens
gctggcaacacagaggcagcc

SEQ ID NO: 3521869 - DNA, 16 bp, Homo sapiens
gctggcatttgcacct

SEQ ID NO: 3521870 - DNA, 20 bp, Homo sapiens
gctggccaaagagcctttcc

SEQ ID NO: 3521871 - DNA, 19 bp, Homo sapiens
gctggccaaatagcaaaga

SEQ ID NO: 3521872 - DNA, 16 bp, Homo sapiens
gctggcccagggccca

SEQ ID NO: 3521873 - DNA, 18 bp, Homo sapiens
gctggcccagggcccaga

SEQ ID NO: 3521874 - DNA, 18 bp, Homo sapiens
gctggccgtgggcctggg

SEQ ID NO: 3521875 - DNA, 17 bp, Homo sapiens
gctggcgagagtctggc

SEQ ID NO: 3521876 - DNA, 20 bp, Homo sapiens
gctggcgtgcagtggtgcga

SEQ ID NO: 3521877 - DNA, 20 bp, Homo sapiens
gctggctgttggctgggggc

SEQ ID NO: 3521878 - DNA, 22 bp, Homo sapiens
gctgggacgtggctcagccagc

SEQ ID NO: 3521879 - DNA, 13 bp, Homo sapiens
gctgggactacag

SEQ ID NO: 3521880 - DNA, 12 bp, Homo sapiens
gctgggactcag

SEQ ID NO: 3521881 - DNA, 14 bp, Homo sapiens
gctgggactcagcc

SEQ ID NO: 3521882 - DNA, 23 bp, Homo sapiens
gctgggactcagccttcagacag

SEQ ID NO: 3521883 - DNA, 13 bp, Homo sapiens
gctgggaggagcc

SEQ ID NO: 3521884 - DNA, 21 bp, Homo sapiens
gctgggaggagcccctggaca

SEQ ID NO: 3521885 - DNA, 20 bp, Homo sapiens
gctgggatggtgggcttcag

SEQ ID NO: 3521886 - DNA, 23 bp, Homo sapiens
gctgggatggtgggcttcagggc

SEQ ID NO: 3521887 - DNA, 18 bp, Homo sapiens
gctgggattacaggtgtg

SEQ ID NO: 3521888 - DNA, 19 bp, Homo sapiens
gctgggattacaggtgtga

SEQ ID NO: 3521889 - DNA, 22 bp, Homo sapiens
gctgggcacacgcctcccactg

SEQ ID NO: 3521890 - DNA, 21 bp, Homo sapiens
gctgggcagcacaaggccttg

SEQ ID NO: 3521891 - DNA, 14 bp, Homo sapiens
gctgggcaggttgg

SEQ ID NO: 3521892 - DNA, 22 bp, Homo sapiens
gctgggctagaggctgagcacc

SEQ ID NO: 3521893 - DNA, 14 bp, Homo sapiens
ggcaggggcctgga

SEQ ID NO: 3521894 - DNA, 17 bp, Homo sapiens
ggcaggggcctggagat

SEQ ID NO: 3521895 - DNA, 12 bp, Homo sapiens
ggcagggtccta

SEQ ID NO: 3521896 - DNA, 17 bp, Homo sapiens
ggcagggtctcactctg

SEQ ID NO: 3521897 - DNA, 18 bp, Homo sapiens
ggcagggtctcactctgt

SEQ ID NO: 3521898 - DNA, 20 bp, Homo sapiens
ggcaggtgctggagcactgg

SEQ ID NO: 3521899 - DNA, 16 bp, Homo sapiens
ggcagtgagggagggc

SEQ ID NO: 3521900 - DNA, 18 bp, Homo sapiens
ggcagtgatgctggatgc

SEQ ID NO: 3521901 - DNA, 13 bp, Homo sapiens
ggcagtgggagct

SEQ ID NO: 3521902 - DNA, 16 bp, Homo sapiens
ggcagtgggagctgcc

SEQ ID NO: 3521903 - DNA, 16 bp, Homo sapiens
ggcagtgtcattgagc

SEQ ID NO: 3521904 - DNA, 20 bp, Homo sapiens
ggcatcaccttaggcaggga

SEQ ID NO: 3521905 - DNA, 15 bp, Homo sapiens
ggcatcctctgactc

SEQ ID NO: 3521906 - DNA, 18 bp, Homo sapiens
ggcatcgcaccattctga

SEQ ID NO: 3521907 - DNA, 17 bp, Homo sapiens
ggcatcttgctggctac

SEQ ID NO: 3521908 - DNA, 23 bp, Homo sapiens
ggcatgaagtttccttggctggt

SEQ ID NO: 3521909 - DNA, 16 bp, Homo sapiens
ggcatgatccaagcaa

SEQ ID NO: 3521910 - DNA, 15 bp, Homo sapiens
ggcatggaaggggct

SEQ ID NO: 3521911 - DNA, 19 bp, Homo sapiens
ggcatgggtcgggagaggg

SEQ ID NO: 3521912 - DNA, 12 bp, Homo sapiens
ggcattctctga

SEQ ID NO: 3521913 - DNA, 13 bp, Homo sapiens
ggcatttcacaaa

SEQ ID NO: 3521914 - DNA, 11 bp, Homo sapiens
ggcatttccta

SEQ ID NO: 3521915 - DNA, 14 bp, Homo sapiens
ggcatttgctgaat

SEQ ID NO: 3521916 - DNA, 12 bp, Homo sapiens
ggccaaacctct

SEQ ID NO: 3521917 - DNA, 13 bp, Homo sapiens
ggccaacatggta

SEQ ID NO: 3521918 - DNA, 19 bp, Homo sapiens
ggccaagcagtgcctgcct

SEQ ID NO: 3521919 - DNA, 12 bp, Homo sapiens
ggccaagccagc

SEQ ID NO: 3521920 - DNA, 14 bp, Homo sapiens
ggccaagccagctg

SEQ ID NO: 3521921 - DNA, 15 bp, Homo sapiens
ggccaagccagctgc

SEQ ID NO: 3521922 - DNA, 17 bp, Homo sapiens
ggccaagccagctgcct

SEQ ID NO: 3521923 - DNA, 13 bp, Homo sapiens
ggccaaggagctg

SEQ ID NO: 3521924 - DNA, 13 bp, Homo sapiens
ggccaagggccag

SEQ ID NO: 3521925 - DNA, 14 bp, Homo sapiens
ggccaagggccaga

SEQ ID NO: 3521926 - DNA, 17 bp, Homo sapiens
ggccaagggccagacag

SEQ ID NO: 3521927 - DNA, 16 bp, Homo sapiens
ggccacactcagcaca

SEQ ID NO: 3521928 - DNA, 16 bp, Homo sapiens
ggccacctccccagca

SEQ ID NO: 3521929 - DNA, 20 bp, Homo sapiens
ggccactgggccctgagcca

SEQ ID NO: 3521930 - DNA, 16 bp, Homo sapiens
ggccactgtgaagaga

SEQ ID NO: 3521931 - DNA, 15 bp, Homo sapiens
ggccacttctgtcca

SEQ ID NO: 3521932 - DNA, 18 bp, Homo sapiens
ggccagagagcctggtgc

SEQ ID NO: 3521933 - DNA, 22 bp, Homo sapiens
ggccagagagcctggtgctgct

SEQ ID NO: 3521934 - DNA, 13 bp, Homo sapiens
ggccagagccagg

SEQ ID NO: 3521935 - DNA, 14 bp, Homo sapiens
ggccagagccgagg

SEQ ID NO: 3521936 - DNA, 18 bp, Homo sapiens
ggccagaggcccccagcc

SEQ ID NO: 3521937 - DNA, 13 bp, Homo sapiens
ggccagatccagc

SEQ ID NO: 3521938 - DNA, 18 bp, Homo sapiens
ggccagatccagcctggg

SEQ ID NO: 3521939 - DNA, 15 bp, Homo sapiens
ggccagatgcaccag

SEQ ID NO: 3521940 - DNA, 17 bp, Homo sapiens
ggccagatgcaccagcc

SEQ ID NO: 3521941 - DNA, 16 bp, Homo sapiens
ggccagctatctgcct

SEQ ID NO: 3521942 - DNA, 17 bp, Homo sapiens
ggccagctatctgcctg

SEQ ID NO: 3521943 - DNA, 22 bp, Homo sapiens
ggccagctatctgcctgacagg

SEQ ID NO: 3521944 - DNA, 23 bp, Homo sapiens
ggccagctatctgcctgacaggc

SEQ ID NO: 3521945 - DNA, 15 bp, Homo sapiens
ggccaggccagctgc

SEQ ID NO: 3521946 - DNA, 17 bp, Homo sapiens
ggccaggccagctgcct

SEQ ID NO: 3521947 - DNA, 20 bp, Homo sapiens
ggccaggcgcggtggctcac

SEQ ID NO: 3521948 - DNA, 21 bp, Homo sapiens
ggccaggctgatgggacagaa

SEQ ID NO: 3521949 - DNA, 21 bp, Homo sapiens
ggccagggccacgctccagct

SEQ ID NO: 3521950 - DNA, 19 bp, Homo sapiens
ggccagggcctggaagaca

SEQ ID NO: 3521951 - DNA, 23 bp, Homo sapiens
ggccagggcctggaagacagaga

SEQ ID NO: 3521952 - DNA, 14 bp, Homo sapiens
ggccagtctgtgga

SEQ ID NO: 3521953 - DNA, 15 bp, Homo sapiens
ggccagtctgtggat

SEQ ID NO: 3521954 - DNA, 18 bp, Homo sapiens
ggccagtctgtggatcag

SEQ ID NO: 3521955 - DNA, 22 bp, Homo sapiens
ggccatctgggctcctccaggg

SEQ ID NO: 3521956 - DNA, 22 bp, Homo sapiens
ggccatctggttaggatggcag

SEQ ID NO: 3521957 - DNA, 22 bp, Homo sapiens
ggccatgatggcaacagatctg

SEQ ID NO: 3521958 - DNA, 14 bp, Homo sapiens
ggccatgctgaggc

SEQ ID NO: 3521959 - DNA, 16 bp, Homo sapiens
ggccatggagagctgg

SEQ ID NO: 3521960 - DNA, 13 bp, Homo sapiens
ggccatggcctct

SEQ ID NO: 3521961 - DNA, 15 bp, Homo sapiens
ggccatggcctctgc

SEQ ID NO: 3521962 - DNA, 16 bp, Homo sapiens
ggccatggcctctgca

SEQ ID NO: 3521963 - DNA, 20 bp, Homo sapiens
ggccattctccacagcaacc

SEQ ID NO: 3521964 - DNA, 19 bp, Homo sapiens
ggcccaaaggtgatggtca

SEQ ID NO: 3521965 - DNA, 14 bp, Homo sapiens
ggcccagagcccag

SEQ ID NO: 3521966 - DNA, 15 bp, Homo sapiens
ggcccagagcccagc

SEQ ID NO: 3521967 - DNA, 18 bp, Homo sapiens
ggcccagagcccagctcc

SEQ ID NO: 3521968 - DNA, 19 bp, Homo sapiens
ggcccagggcaagctccgc

SEQ ID NO: 3521969 - DNA, 22 bp, Homo sapiens
ggcccagggcaagctccgcagg

SEQ ID NO: 3521970 - DNA, 18 bp, Homo sapiens
ggcccagggcccagagcc

SEQ ID NO: 3521971 - DNA, 19 bp, Homo sapiens
ggcccagggcccagagccc

SEQ ID NO: 3521972 - DNA, 18 bp, Homo sapiens
ggccccaggaaaggccca

SEQ ID NO: 3521973 - DNA, 16 bp, Homo sapiens
ggccccaggacctggc

SEQ ID NO: 3521974 - DNA, 14 bp, Homo sapiens
ggcccccatctcat

SEQ ID NO: 3521975 - DNA, 21 bp, Homo sapiens
ggcccccatctcatgcccctg

SEQ ID NO: 3521976 - DNA, 16 bp, Homo sapiens
ggccccccgcagcacc

SEQ ID NO: 3521977 - DNA, 14 bp, Homo sapiens
ggccccgccgcctg

SEQ ID NO: 3521978 - DNA, 18 bp, Homo sapiens
ggccccgtttctggtggt

SEQ ID NO: 3521979 - DNA, 18 bp, Homo sapiens
ggcccctgccaccctggg

SEQ ID NO: 3521980 - DNA, 13 bp, Homo sapiens
ggcccctgctggt

SEQ ID NO: 3521981 - DNA, 21 bp, Homo sapiens
ggcccctgctgtctctctggg

SEQ ID NO: 3521982 - DNA, 20 bp, Homo sapiens
ggccctcattaatgacactt

SEQ ID NO: 3521983 - DNA, 20 bp, Homo sapiens
ggccctccctgttccccaga

SEQ ID NO: 3521984 - DNA, 21 bp, Homo sapiens
ggccctccctgttccccagag

SEQ ID NO: 3521985 - DNA, 16 bp, Homo sapiens
ggccctcctaccctgc

SEQ ID NO: 3521986 - DNA, 17 bp, Homo sapiens
ggccctcctaccctgcg

SEQ ID NO: 3521987 - DNA, 19 bp, Homo sapiens
ggccctcctaccctgcgcc

SEQ ID NO: 3521988 - DNA, 21 bp, Homo sapiens
ggccctcctaccctgcgccca

SEQ ID NO: 3521989 - DNA, 16 bp, Homo sapiens
ggccctcgctgccagc

SEQ ID NO: 3521990 - DNA, 23 bp, Homo sapiens
ggccctcgctgccagctctgtat

SEQ ID NO: 3521991 - DNA, 14 bp, Homo sapiens
ggccctctggagtg

SEQ ID NO: 3521992 - DNA, 14 bp, Homo sapiens
ggccctgagccaga

SEQ ID NO: 3521993 - DNA, 16 bp, Homo sapiens
ggccctgagccagaga

SEQ ID NO: 3521994 - DNA, 19 bp, Homo sapiens
ggccctgcaaaaggactct

SEQ ID NO: 3521995 - DNA, 17 bp, Homo sapiens
ggccctgccctggcagg

SEQ ID NO: 3521996 - DNA, 14 bp, Homo sapiens
ggccctggcctccc

SEQ ID NO: 3521997 - DNA, 17 bp, Homo sapiens
ggccctggcctcccctg

SEQ ID NO: 3521998 - DNA, 11 bp, Homo sapiens
ggccctggggc

SEQ ID NO: 3521999 - DNA, 18 bp, Homo sapiens
ggccctgtagttaggcct

SEQ ID NO: 3522000 - DNA, 19 bp, Homo sapiens
ggccctgtagttaggcctg

SEQ ID NO: 3522001 - DNA, 14 bp, Homo sapiens
ggccctgttctcct

SEQ ID NO: 3522002 - DNA, 14 bp, Homo sapiens
ggccctttgctgtc

SEQ ID NO: 3522003 - DNA, 12 bp, Homo sapiens
ggccgagaagca

SEQ ID NO: 3522004 - DNA, 15 bp, Homo sapiens
ggccgagaagcaaga

SEQ ID NO: 3522005 - DNA, 13 bp, Homo sapiens
ggccgagtccaag

SEQ ID NO: 3522006 - DNA, 16 bp, Homo sapiens
ggccgcacgcctctcc

SEQ ID NO: 3522007 - DNA, 17 bp, Homo sapiens
ggccgcacgcctctccc

SEQ ID NO: 3522008 - DNA, 14 bp, Homo sapiens
ggccgccgcctctt

SEQ ID NO: 3522009 - DNA, 13 bp, Homo sapiens
ggccgcctccagg

SEQ ID NO: 3522010 - DNA, 17 bp, Homo sapiens
ggccgctgagtggcagg

SEQ ID NO: 3522011 - DNA, 21 bp, Homo sapiens
ggccgctgccacccacctccc

SEQ ID NO: 3522012 - DNA, 18 bp, Homo sapiens
ggccgctgccccagcccc

SEQ ID NO: 3522013 - DNA, 15 bp, Homo sapiens
ggccggccagcccct

SEQ ID NO: 3522014 - DNA, 14 bp, Homo sapiens
ggccgtgggcctgg

SEQ ID NO: 3522015 - DNA, 17 bp, Homo sapiens
ggccgtgggcctggggt

SEQ ID NO: 3522016 - DNA, 21 bp, Homo sapiens
ggccgttgatgttggctggga

SEQ ID NO: 3522017 - DNA, 19 bp, Homo sapiens
ggcctaagagttgagctct

SEQ ID NO: 3522018 - DNA, 20 bp, Homo sapiens
ggcctaccccgcagacacct

SEQ ID NO: 3522019 - DNA, 23 bp, Homo sapiens
ggcctaccccgcagacaccttgg

SEQ ID NO: 3522020 - DNA, 19 bp, Homo sapiens
ggcctagcaggcacaggac

SEQ ID NO: 3522021 - DNA, 14 bp, Homo sapiens
ggcctaggcctcag

SEQ ID NO: 3522022 - DNA, 18 bp, Homo sapiens
ggcctaggtgcagctcct

SEQ ID NO: 3522023 - DNA, 22 bp, Homo sapiens
ggcctaggtgcagctcctcagc

SEQ ID NO: 3522024 - DNA, 13 bp, Homo sapiens
ggcctatctccta

SEQ ID NO: 3522025 - DNA, 18 bp, Homo sapiens
ggcctattgcttgggtct

SEQ ID NO: 3522026 - DNA, 19 bp, Homo sapiens
ggggtttcctggcactgga

SEQ ID NO: 3522027 - DNA, 19 bp, Homo sapiens
ggggtttcgcagcctgagt

SEQ ID NO: 3522028 - DNA, 14 bp, Homo sapiens
gggtagcactacta

SEQ ID NO: 3522029 - DNA, 15 bp, Homo sapiens
gggtagctagaggaa

SEQ ID NO: 3522030 - DNA, 15 bp, Homo sapiens
gggtatgttaaccta

SEQ ID NO: 3522031 - DNA, 22 bp, Homo sapiens
gggtatgtttaatctgttatgt

SEQ ID NO: 3522032 - DNA, 14 bp, Homo sapiens
gggtcatagaaatt

SEQ ID NO: 3522033 - DNA, 18 bp, Homo sapiens
gggtcatagatgtttcct

SEQ ID NO: 3522034 - DNA, 16 bp, Homo sapiens
gggtcatgccctcctc

SEQ ID NO: 3522035 - DNA, 17 bp, Homo sapiens
gggtccagggagcaggc

SEQ ID NO: 3522036 - DNA, 13 bp, Homo sapiens
gggtccccagctc

SEQ ID NO: 3522037 - DNA, 13 bp, Homo sapiens
gggtcctcttctg

SEQ ID NO: 3522038 - DNA, 20 bp, Homo sapiens
gggtcggctgaccatgctca

SEQ ID NO: 3522039 - DNA, 22 bp, Homo sapiens
gggtctcactatgttgcccagg

SEQ ID NO: 3522040 - DNA, 18 bp, Homo sapiens
gggtctctgctgccgccc

SEQ ID NO: 3522041 - DNA, 12 bp, Homo sapiens
gggtctgaggaa

SEQ ID NO: 3522042 - DNA, 18 bp, Homo sapiens
gggtctgcaggtgagcag

SEQ ID NO: 3522043 - DNA, 17 bp, Homo sapiens
gggtctgcctccagcca

SEQ ID NO: 3522044 - DNA, 20 bp, Homo sapiens
gggtctgggagtcaggcccg

SEQ ID NO: 3522045 - DNA, 16 bp, Homo sapiens
gggtctgtaaaatctt

SEQ ID NO: 3522046 - DNA, 21 bp, Homo sapiens
gggtctgtaaaatctttcttt

SEQ ID NO: 3522047 - DNA, 22 bp, Homo sapiens
gggtgacgggactcaggcggga

SEQ ID NO: 3522048 - DNA, 17 bp, Homo sapiens
gggtgagaggaagggtg

SEQ ID NO: 3522049 - DNA, 15 bp, Homo sapiens
gggtgaggagctggg

SEQ ID NO: 3522050 - DNA, 16 bp, Homo sapiens
gggtgagggccttctt

SEQ ID NO: 3522051 - DNA, 14 bp, Homo sapiens
gggtggcactgcca

SEQ ID NO: 3522052 - DNA, 16 bp, Homo sapiens
gggtgggggtgggtca

SEQ ID NO: 3522053 - DNA, 16 bp, Homo sapiens
gggtggtctgcaggca

SEQ ID NO: 3522054 - DNA, 14 bp, Homo sapiens
gggttaaggcctga

SEQ ID NO: 3522055 - DNA, 20 bp, Homo sapiens
gggttcacctgggctgaggc

SEQ ID NO: 3522056 - DNA, 22 bp, Homo sapiens
gggttctaggcatctctgtact

SEQ ID NO: 3522057 - DNA, 20 bp, Homo sapiens
gggttctgcctgccagctgc

SEQ ID NO: 3522058 - DNA, 14 bp, Homo sapiens
gggtttgaagctgc

SEQ ID NO: 3522059 - DNA, 20 bp, Homo sapiens
gggttttgccatgttggcca

SEQ ID NO: 3522060 - DNA, 18 bp, Homo sapiens
gggtttttagagaatgtg

SEQ ID NO: 3522061 - DNA, 14 bp, Homo sapiens
ggtaaaacaaaaca

SEQ ID NO: 3522062 - DNA, 16 bp, Homo sapiens
ggtaaaattagatgca

SEQ ID NO: 3522063 - DNA, 13 bp, Homo sapiens
ggtaacaggcaga

SEQ ID NO: 3522064 - DNA, 18 bp, Homo sapiens
ggtaactagggaagataa

SEQ ID NO: 3522065 - DNA, 13 bp, Homo sapiens
ggtacaaaaataa

SEQ ID NO: 3522066 - DNA, 14 bp, Homo sapiens
ggtacaaaaataaa

SEQ ID NO: 3522067 - DNA, 16 bp, Homo sapiens
ggtacatttttcaact

SEQ ID NO: 3522068 - DNA, 17 bp, Homo sapiens
ggtacatttttcaactt

SEQ ID NO: 3522069 - DNA, 22 bp, Homo sapiens
ggtaccagatgcagctcaagag

SEQ ID NO: 3522070 - DNA, 16 bp, Homo sapiens
ggtacccactgctctg

SEQ ID NO: 3522071 - DNA, 17 bp, Homo sapiens
ggtacccggggcccagg

SEQ ID NO: 3522072 - DNA, 16 bp, Homo sapiens
ggtacttgtcatttcg

SEQ ID NO: 3522073 - DNA, 16 bp, Homo sapiens
ggtacttgtggacaca

SEQ ID NO: 3522074 - DNA, 17 bp, Homo sapiens
ggtacttgtggacacag

SEQ ID NO: 3522075 - DNA, 17 bp, Homo sapiens
ggtactttttgtgaaga

SEQ ID NO: 3522076 - DNA, 15 bp, Homo sapiens
ggtagaggctgggag

SEQ ID NO: 3522077 - DNA, 16 bp, Homo sapiens
ggtagaggctgggagg

SEQ ID NO: 3522078 - DNA, 13 bp, Homo sapiens
ggtagccagcaca

SEQ ID NO: 3522079 - DNA, 16 bp, Homo sapiens
ggtagccagcacacag

SEQ ID NO: 3522080 - DNA, 18 bp, Homo sapiens
ggtagctgcccctggctc

SEQ ID NO: 3522081 - DNA, 23 bp, Homo sapiens
ggtaggggggaaacaggttggga

SEQ ID NO: 3522082 - DNA, 19 bp, Homo sapiens
ggtaggttcagccaaggtt

SEQ ID NO: 3522083 - DNA, 13 bp, Homo sapiens
ggtataaaagatg

SEQ ID NO: 3522084 - DNA, 16 bp, Homo sapiens
ggtataaaagatgggg

SEQ ID NO: 3522085 - DNA, 17 bp, Homo sapiens
ggtataatggttgactg

SEQ ID NO: 3522086 - DNA, 18 bp, Homo sapiens
ggtatatatccgcctggc

SEQ ID NO: 3522087 - DNA, 14 bp, Homo sapiens
ggtatcaggtgctg

SEQ ID NO: 3522088 - DNA, 12 bp, Homo sapiens
ggtatgtctgcc

SEQ ID NO: 3522089 - DNA, 13 bp, Homo sapiens
ggtatgtctgcca

SEQ ID NO: 3522090 - DNA, 14 bp, Homo sapiens
ggtatgtctgccat

SEQ ID NO: 3522091 - DNA, 20 bp, Homo sapiens
ggtatgtttgtaacttttta

SEQ ID NO: 3522092 - DNA, 15 bp, Homo sapiens
ggtattaccatgtaa

SEQ ID NO: 3522093 - DNA, 22 bp, Homo sapiens
ggtattaccatgtaaataatct

SEQ ID NO: 3522094 - DNA, 17 bp, Homo sapiens
ggtattgtatttattca

SEQ ID NO: 3522095 - DNA, 19 bp, Homo sapiens
ggtattgtatttattcaat

SEQ ID NO: 3522096 - DNA, 16 bp, Homo sapiens
ggtattttttcctttt

SEQ ID NO: 3522097 - DNA, 19 bp, Homo sapiens
ggtcaacatggtgaaaccc

SEQ ID NO: 3522098 - DNA, 20 bp, Homo sapiens
ggtcaatacagtacaggcag

SEQ ID NO: 3522099 - DNA, 20 bp, Homo sapiens
ggtcacttgggaagaggact

SEQ ID NO: 3522100 - DNA, 12 bp, Homo sapiens
ggtcagagcctg

SEQ ID NO: 3522101 - DNA, 21 bp, Homo sapiens
ggtcaggagttcctaaccagc

SEQ ID NO: 3522102 - DNA, 21 bp, Homo sapiens
ggtcatactatctactctcct

SEQ ID NO: 3522103 - DNA, 17 bp, Homo sapiens
ggtcatcgattcaaact

SEQ ID NO: 3522104 - DNA, 22 bp, Homo sapiens
ggtcatcgattcaaactgctcc

SEQ ID NO: 3522105 - DNA, 20 bp, Homo sapiens
ggtcatgccctcctctccca

SEQ ID NO: 3522106 - DNA, 20 bp, Homo sapiens
ggtccacaggaagtgaagaa

SEQ ID NO: 3522107 - DNA, 14 bp, Homo sapiens
ggtccacagggcac

SEQ ID NO: 3522108 - DNA, 15 bp, Homo sapiens
ggtccacccaggagc

SEQ ID NO: 3522109 - DNA, 16 bp, Homo sapiens
ggtccacccaggagcc

SEQ ID NO: 3522110 - DNA, 22 bp, Homo sapiens
ggtccacccaggagccccgagg

SEQ ID NO: 3522111 - DNA, 14 bp, Homo sapiens
ggtccagctctgga

SEQ ID NO: 3522112 - DNA, 16 bp, Homo sapiens
ggtccagctctggagg

SEQ ID NO: 3522113 - DNA, 12 bp, Homo sapiens
ggtccagggagc

SEQ ID NO: 3522114 - DNA, 14 bp, Homo sapiens
ggtccatgggcaga

SEQ ID NO: 3522115 - DNA, 14 bp, Homo sapiens
ggtcccactcagtc

SEQ ID NO: 3522116 - DNA, 23 bp, Homo sapiens
ggtcccagttttgttgccccaga

SEQ ID NO: 3522117 - DNA, 13 bp, Homo sapiens
ggtccccagctcc

SEQ ID NO: 3522118 - DNA, 12 bp, Homo sapiens
ggtcctggccat

SEQ ID NO: 3522119 - DNA, 15 bp, Homo sapiens
ggtcctttggggtga

SEQ ID NO: 3522120 - DNA, 19 bp, Homo sapiens
ggtctatgtcgagagctgg

SEQ ID NO: 3522121 - DNA, 20 bp, Homo sapiens
ggtctatgtcgagagctggc

SEQ ID NO: 3522122 - DNA, 23 bp, Homo sapiens
ggtctatgtcgagagctggccaa

SEQ ID NO: 3522123 - DNA, 20 bp, Homo sapiens
ggtctcacagtgttgcccag

SEQ ID NO: 3522124 - DNA, 21 bp, Homo sapiens
ggtctcacagtgttgcccagg

SEQ ID NO: 3522125 - DNA, 16 bp, Homo sapiens
ggtctcactctgtcgc

SEQ ID NO: 3522126 - DNA, 22 bp, Homo sapiens
ggtctcactctgtcgcccagtc

SEQ ID NO: 3522127 - DNA, 20 bp, Homo sapiens
ggtctcgctttgttgcccag

SEQ ID NO: 3522128 - DNA, 17 bp, Homo sapiens
ggtctctaggctgggga

SEQ ID NO: 3522129 - DNA, 14 bp, Homo sapiens
ggtctctccactgc

SEQ ID NO: 3522130 - DNA, 12 bp, Homo sapiens
ggtctctgctgc

SEQ ID NO: 3522131 - DNA, 13 bp, Homo sapiens
ggtctctgctgcc

SEQ ID NO: 3522132 - DNA, 14 bp, Homo sapiens
ggtctgacccactg

SEQ ID NO: 3522133 - DNA, 16 bp, Homo sapiens
ggtctgacccactgct

SEQ ID NO: 3522134 - DNA, 20 bp, Homo sapiens
ggtctgagtctatgttcaaa

SEQ ID NO: 3522135 - DNA, 17 bp, Homo sapiens
ggtctgcaggtgagcag

SEQ ID NO: 3522136 - DNA, 16 bp, Homo sapiens
ggtctgcctccagcca

SEQ ID NO: 3522137 - DNA, 19 bp, Homo sapiens
ggtctgggagtcacacagt

SEQ ID NO: 3522138 - DNA, 17 bp, Homo sapiens
ggtctgggagtcaggcc

SEQ ID NO: 3522139 - DNA, 20 bp, Homo sapiens
ggtctgggagtcaggcccgg

SEQ ID NO: 3522140 - DNA, 12 bp, Homo sapiens
ggtctgtaaaat

SEQ ID NO: 3522141 - DNA, 12 bp, Homo sapiens
ggtctgtttctg

SEQ ID NO: 3522142 - DNA, 12 bp, Homo sapiens
ggtctttgtaag

SEQ ID NO: 3522143 - DNA, 18 bp, Homo sapiens
ggtgaacaaagcagccac

SEQ ID NO: 3522144 - DNA, 22 bp, Homo sapiens
ggtgaacagtcacgcctgaaac

SEQ ID NO: 3522145 - DNA, 21 bp, Homo sapiens
ggtgacagagtgagactctgt

SEQ ID NO: 3522146 - DNA, 12 bp, Homo sapiens
ggtgacagtggc

SEQ ID NO: 3522147 - DNA, 21 bp, Homo sapiens
ggtgacgggactcaggcggga

SEQ ID NO: 3522148 - DNA, 16 bp, Homo sapiens
ggtgagaggggaacag

SEQ ID NO: 3522149 - DNA, 19 bp, Homo sapiens
ggtgagcccatggccctcc

SEQ ID NO: 3522150 - DNA, 21 bp, Homo sapiens
ggtgagcctagccctgggaca

SEQ ID NO: 3522151 - DNA, 12 bp, Homo sapiens
ggtgaggcctgt

SEQ ID NO: 3522152 - DNA, 17 bp, Homo sapiens
ggtgaggcctgtctgtg

SEQ ID NO: 3522153 - DNA, 14 bp, Homo sapiens
ggtgagggccttct

SEQ ID NO: 3522154 - DNA, 15 bp, Homo sapiens
ggtgatatccattct

SEQ ID NO: 3522155 - DNA, 24 bp, Homo sapiens
ggtgatccacccacctcagcctcc

SEQ ID NO: 3522156 - DNA, 15 bp, Homo sapiens
ggtgcactttgtaaa

SEQ ID NO: 3522157 - DNA, 16 bp, Homo sapiens
ggtgcactttgtaaat

SEQ ID NO: 3522158 - DNA, 16 bp, Homo sapiens
ggtgcagtgtgaaaag

SEQ ID NO: 3522159 - DNA, 16 bp, Homo sapiens
gtcccatagtccctgc

SEQ ID NO: 3522160 - DNA, 17 bp, Homo sapiens
gtcccatagtccctgcc

SEQ ID NO: 3522161 - DNA, 14 bp, Homo sapiens
gtccccagaagcag

SEQ ID NO: 3522162 - DNA, 12 bp, Homo sapiens
gtccccagctcc

SEQ ID NO: 3522163 - DNA, 13 bp, Homo sapiens
gtccccagctccc

SEQ ID NO: 3522164 - DNA, 16 bp, Homo sapiens
gtccccagctccccag

SEQ ID NO: 3522165 - DNA, 19 bp, Homo sapiens
gtccccaggccccaggaag

SEQ ID NO: 3522166 - DNA, 20 bp, Homo sapiens
gtccccaggccccaggaagc

SEQ ID NO: 3522167 - DNA, 14 bp, Homo sapiens
gtccccatctgtcg

SEQ ID NO: 3522168 - DNA, 22 bp, Homo sapiens
gtcccccagcagaaccagcctc

SEQ ID NO: 3522169 - DNA, 12 bp, Homo sapiens
gtccccccaccc

SEQ ID NO: 3522170 - DNA, 15 bp, Homo sapiens
gtcccggctctgtgg

SEQ ID NO: 3522171 - DNA, 11 bp, Homo sapiens
gtccctctgtg

SEQ ID NO: 3522172 - DNA, 22 bp, Homo sapiens
gtccctctgtgtatttgctttt

SEQ ID NO: 3522173 - DNA, 12 bp, Homo sapiens
gtccctgaggat

SEQ ID NO: 3522174 - DNA, 15 bp, Homo sapiens
gtccctgtcacctct

SEQ ID NO: 3522175 - DNA, 17 bp, Homo sapiens
gtccctgtcacctcttc

SEQ ID NO: 3522176 - DNA, 11 bp, Homo sapiens
gtcccttgctg

SEQ ID NO: 3522177 - DNA, 16 bp, Homo sapiens
gtcccttgctgtatgc

SEQ ID NO: 3522178 - DNA, 21 bp, Homo sapiens
gtccgaaagggacttggaagc

SEQ ID NO: 3522179 - DNA, 20 bp, Homo sapiens
gtccgtgctgacagctgctc

SEQ ID NO: 3522180 - DNA, 21 bp, Homo sapiens
gtccgtgctgacagctgctcc

SEQ ID NO: 3522181 - DNA, 14 bp, Homo sapiens
gtccgtgggctggc

SEQ ID NO: 3522182 - DNA, 13 bp, Homo sapiens
gtcctaaaacacc

SEQ ID NO: 3522183 - DNA, 22 bp, Homo sapiens
gtcctagaggccctttgctgtc

SEQ ID NO: 3522184 - DNA, 12 bp, Homo sapiens
gtcctaggagta

SEQ ID NO: 3522185 - DNA, 19 bp, Homo sapiens
gtcctatgaatgctttgca

SEQ ID NO: 3522186 - DNA, 18 bp, Homo sapiens
gtcctcacggtgcctttt

SEQ ID NO: 3522187 - DNA, 20 bp, Homo sapiens
gtcctcagccttgccagaga

SEQ ID NO: 3522188 - DNA, 23 bp, Homo sapiens
gtcctcaggtggccatgcctcag

SEQ ID NO: 3522189 - DNA, 15 bp, Homo sapiens
gtcctcatttctcca

SEQ ID NO: 3522190 - DNA, 17 bp, Homo sapiens
gtcctcccctctcttgt

SEQ ID NO: 3522191 - DNA, 14 bp, Homo sapiens
gtcctccctcaccc

SEQ ID NO: 3522192 - DNA, 12 bp, Homo sapiens
gtcctccctgac

SEQ ID NO: 3522193 - DNA, 12 bp, Homo sapiens
gtcctcctctgt

SEQ ID NO: 3522194 - DNA, 13 bp, Homo sapiens
gtcctcctctgtg

SEQ ID NO: 3522195 - DNA, 12 bp, Homo sapiens
gtcctctctctg

SEQ ID NO: 3522196 - DNA, 21 bp, Homo sapiens
gtcctctctctgtggggctga

SEQ ID NO: 3522197 - DNA, 23 bp, Homo sapiens
gtcctctgtcagtcacagccacc

SEQ ID NO: 3522198 - DNA, 20 bp, Homo sapiens
gtcctcttccctctctgcag

SEQ ID NO: 3522199 - DNA, 15 bp, Homo sapiens
gtcctctttcaaagg

SEQ ID NO: 3522200 - DNA, 14 bp, Homo sapiens
gtcctcttttctga

SEQ ID NO: 3522201 - DNA, 17 bp, Homo sapiens
gtcctgatcagagccgt

SEQ ID NO: 3522202 - DNA, 16 bp, Homo sapiens
gtcctgccggagagga

SEQ ID NO: 3522203 - DNA, 18 bp, Homo sapiens
gtcctgccggagaggaag

SEQ ID NO: 3522204 - DNA, 17 bp, Homo sapiens
gtcctgcctcagcctcc

SEQ ID NO: 3522205 - DNA, 14 bp, Homo sapiens
gtcctgcctgtctg

SEQ ID NO: 3522206 - DNA, 15 bp, Homo sapiens
gtcctgcctgtctgc

SEQ ID NO: 3522207 - DNA, 15 bp, Homo sapiens
gtcctgcctgtggcg

SEQ ID NO: 3522208 - DNA, 22 bp, Homo sapiens
gtcctggactcctgccaccagc

SEQ ID NO: 3522209 - DNA, 15 bp, Homo sapiens
gtcctggccatccca

SEQ ID NO: 3522210 - DNA, 16 bp, Homo sapiens
gtcctggccatcccac

SEQ ID NO: 3522211 - DNA, 17 bp, Homo sapiens
gtcctggccatcccaca

SEQ ID NO: 3522212 - DNA, 18 bp, Homo sapiens
gtcctgggagtgagctgg

SEQ ID NO: 3522213 - DNA, 13 bp, Homo sapiens
gtcctgggcctgc

SEQ ID NO: 3522214 - DNA, 17 bp, Homo sapiens
gtcctgggcctgcagaa

SEQ ID NO: 3522215 - DNA, 21 bp, Homo sapiens
gtcctgttaacgtcatctcag

SEQ ID NO: 3522216 - DNA, 22 bp, Homo sapiens
gtccttaaaaatcacactgtaa

SEQ ID NO: 3522217 - DNA, 21 bp, Homo sapiens
gtccttaatgaagagccagcc

SEQ ID NO: 3522218 - DNA, 22 bp, Homo sapiens
gtccttatgttaagccctggca

SEQ ID NO: 3522219 - DNA, 17 bp, Homo sapiens
gtccttcacctttccca

SEQ ID NO: 3522220 - DNA, 22 bp, Homo sapiens
gtcctttctagagcactgccac

SEQ ID NO: 3522221 - DNA, 16 bp, Homo sapiens
gtcctttttttccatc

SEQ ID NO: 3522222 - DNA, 18 bp, Homo sapiens
gtcgaccccaaaggaaca

SEQ ID NO: 3522223 - DNA, 13 bp, Homo sapiens
gtcgagagctggc

SEQ ID NO: 3522224 - DNA, 14 bp, Homo sapiens
gtcgagagctggcc

SEQ ID NO: 3522225 - DNA, 16 bp, Homo sapiens
gtcgagagctggccaa

SEQ ID NO: 3522226 - DNA, 12 bp, Homo sapiens
gtcgaggcagga

SEQ ID NO: 3522227 - DNA, 14 bp, Homo sapiens
gtcgatagagctgt

SEQ ID NO: 3522228 - DNA, 13 bp, Homo sapiens
gtcgcccagtctg

SEQ ID NO: 3522229 - DNA, 14 bp, Homo sapiens
gtcgcccagtctgg

SEQ ID NO: 3522230 - DNA, 23 bp, Homo sapiens
gtcgcccagtctggaatgcagtg

SEQ ID NO: 3522231 - DNA, 21 bp, Homo sapiens
gtcgctcatgtgtgcaacagg

SEQ ID NO: 3522232 - DNA, 18 bp, Homo sapiens
gtcggctgaccatgctca

SEQ ID NO: 3522233 - DNA, 18 bp, Homo sapiens
gtcgggcaccagccagcg

SEQ ID NO: 3522234 - DNA, 16 bp, Homo sapiens
gtcgggctttgtgtga

SEQ ID NO: 3522235 - DNA, 15 bp, Homo sapiens
gtcgtctggcatctc

SEQ ID NO: 3522236 - DNA, 17 bp, Homo sapiens
gtcgtgagctcttgtga

SEQ ID NO: 3522237 - DNA, 13 bp, Homo sapiens
gtcgtgcctgtgt

SEQ ID NO: 3522238 - DNA, 15 bp, Homo sapiens
gtcgtgcctgtgtcc

SEQ ID NO: 3522239 - DNA, 18 bp, Homo sapiens
gtcgtgcctgtgtccatg

SEQ ID NO: 3522240 - DNA, 22 bp, Homo sapiens
gtctaattaaaacactttcaaa

SEQ ID NO: 3522241 - DNA, 12 bp, Homo sapiens
gtctactgcaag

SEQ ID NO: 3522242 - DNA, 18 bp, Homo sapiens
gtctactgcaagagccaa

SEQ ID NO: 3522243 - DNA, 15 bp, Homo sapiens
gtctacttgctcagg

SEQ ID NO: 3522244 - DNA, 21 bp, Homo sapiens
gtctagagagggaggcaagcc

SEQ ID NO: 3522245 - DNA, 17 bp, Homo sapiens
gtctagatggctcctct

SEQ ID NO: 3522246 - DNA, 18 bp, Homo sapiens
gtctatgtcgagagctgg

SEQ ID NO: 3522247 - DNA, 14 bp, Homo sapiens
gtctattccattcc

SEQ ID NO: 3522248 - DNA, 23 bp, Homo sapiens
gtctattccattcccttcggcca

SEQ ID NO: 3522249 - DNA, 17 bp, Homo sapiens
gtctcaaaaaaagaaaa

SEQ ID NO: 3522250 - DNA, 19 bp, Homo sapiens
gtctcaaaaaaagaaaaag

SEQ ID NO: 3522251 - DNA, 20 bp, Homo sapiens
gtctcaaactcctgggctca

SEQ ID NO: 3522252 - DNA, 22 bp, Homo sapiens
gtctcaaactcttgacctcagg

SEQ ID NO: 3522253 - DNA, 19 bp, Homo sapiens
gtctcacagtgttgcccag

SEQ ID NO: 3522254 - DNA, 21 bp, Homo sapiens
gtctcactatgttgcccaggc

SEQ ID NO: 3522255 - DNA, 15 bp, Homo sapiens
gtctcactctgtcgc

SEQ ID NO: 3522256 - DNA, 18 bp, Homo sapiens
gtctcactctgtcgccca

SEQ ID NO: 3522257 - DNA, 16 bp, Homo sapiens
gtctcactgttgccca

SEQ ID NO: 3522258 - DNA, 17 bp, Homo sapiens
gtctcactgttgcccag

SEQ ID NO: 3522259 - DNA, 20 bp, Homo sapiens
gtctcactgttgcccaggct

SEQ ID NO: 3522260 - DNA, 11 bp, Homo sapiens
gtctcatccca

SEQ ID NO: 3522261 - DNA, 19 bp, Homo sapiens
gtctcatggtatgtaactc

SEQ ID NO: 3522262 - DNA, 20 bp, Homo sapiens
gtctccaaccccccagcact

SEQ ID NO: 3522263 - DNA, 21 bp, Homo sapiens
gtctccaaccccccagcactg

SEQ ID NO: 3522264 - DNA, 17 bp, Homo sapiens
gtctccaccaggaacct

SEQ ID NO: 3522265 - DNA, 20 bp, Homo sapiens
gtctccaccaggaacctctt

SEQ ID NO: 3522266 - DNA, 21 bp, Homo sapiens
gtctccaccaggaacctcttc

SEQ ID NO: 3522267 - DNA, 23 bp, Homo sapiens
gtctccaggggctgcttcctcct

SEQ ID NO: 3522268 - DNA, 14 bp, Homo sapiens
gtctccatggccct

SEQ ID NO: 3522269 - DNA, 22 bp, Homo sapiens
gtctcctatatatttctattat

SEQ ID NO: 3522270 - DNA, 16 bp, Homo sapiens
gtctcctctccatttt

SEQ ID NO: 3522271 - DNA, 23 bp, Homo sapiens
gtctcgctttgttgcccaggctg

SEQ ID NO: 3522272 - DNA, 22 bp, Homo sapiens
gtctctagaagtgccatctcaa

SEQ ID NO: 3522273 - DNA, 20 bp, Homo sapiens
gtctctccactgctctcagc

SEQ ID NO: 3522274 - DNA, 15 bp, Homo sapiens
gtctctctgggctgc

SEQ ID NO: 3522275 - DNA, 15 bp, Homo sapiens
gtctctgcctcttcc

SEQ ID NO: 3522276 - DNA, 13 bp, Homo sapiens
gtctctgctgccg

SEQ ID NO: 3522277 - DNA, 14 bp, Homo sapiens
gtctctgctgccgc

SEQ ID NO: 3522278 - DNA, 13 bp, Homo sapiens
gtctctgctggcc

SEQ ID NO: 3522279 - DNA, 12 bp, Homo sapiens
gtctctggcctg

SEQ ID NO: 3522280 - DNA, 13 bp, Homo sapiens
gtctctggcctgt

SEQ ID NO: 3522281 - DNA, 17 bp, Homo sapiens
gtctctggtagcctgca

SEQ ID NO: 3522282 - DNA, 20 bp, Homo sapiens
gtctctgttgactggctgtg

SEQ ID NO: 3522283 - DNA, 19 bp, Homo sapiens
gtctcttgtattaaactct

SEQ ID NO: 3522284 - DNA, 20 bp, Homo sapiens
gtctctttaatgtcacaggc

SEQ ID NO: 3522285 - DNA, 11 bp, Homo sapiens
gtctgaacttt

SEQ ID NO: 3522286 - DNA, 14 bp, Homo sapiens
gtctgaagcagatg

SEQ ID NO: 3522287 - DNA, 12 bp, Homo sapiens
gtctgacaggca

SEQ ID NO: 3522288 - DNA, 21 bp, Homo sapiens
gtctgattcccaagctctgct

SEQ ID NO: 3522289 - DNA, 23 bp, Homo sapiens
gtctgcaaaatgaggaatgtata

SEQ ID NO: 3522290 - DNA, 11 bp, Homo sapiens
gtctgcagccc

SEQ ID NO: 3522291 - DNA, 13 bp, Homo sapiens
gtctgccagggcc

SEQ ID NO: 3522292 - DNA, 20 bp, Homo sapiens
gttacctgtcattttgcact

SEQ ID NO: 3522293 - DNA, 16 bp, Homo sapiens
gttactaactaaactc

SEQ ID NO: 3522294 - DNA, 14 bp, Homo sapiens
gttactgctttgca

SEQ ID NO: 3522295 - DNA, 12 bp, Homo sapiens
gttagctcctgt

SEQ ID NO: 3522296 - DNA, 15 bp, Homo sapiens
gttaggaatgagaag

SEQ ID NO: 3522297 - DNA, 15 bp, Homo sapiens
gttaggatggcagga

SEQ ID NO: 3522298 - DNA, 19 bp, Homo sapiens
gttatattgaaaaaataga

SEQ ID NO: 3522299 - DNA, 21 bp, Homo sapiens
gttatatttcagatgtaatgt

SEQ ID NO: 3522300 - DNA, 23 bp, Homo sapiens
gttatatttcagatgtaatgttt

SEQ ID NO: 3522301 - DNA, 19 bp, Homo sapiens
gttatccatttaaaaatgg

SEQ ID NO: 3522302 - DNA, 20 bp, Homo sapiens
gttatcttatactgtacaat

SEQ ID NO: 3522303 - DNA, 22 bp, Homo sapiens
gttatcttatactgtacaataa

SEQ ID NO: 3522304 - DNA, 23 bp, Homo sapiens
gttatcttatactgtacaataaa

SEQ ID NO: 3522305 - DNA, 22 bp, Homo sapiens
gttatgcaagggactgtgtgtt

SEQ ID NO: 3522306 - DNA, 23 bp, Homo sapiens
gttatggcagatgacaagatggt

SEQ ID NO: 3522307 - DNA, 17 bp, Homo sapiens
gttatgtactagtgttc

SEQ ID NO: 3522308 - DNA, 13 bp, Homo sapiens
gttatgtatttcc

SEQ ID NO: 3522309 - DNA, 23 bp, Homo sapiens
gttatgtatttcctggatgtttg

SEQ ID NO: 3522310 - DNA, 21 bp, Homo sapiens
gttattagggtggtatttagt

SEQ ID NO: 3522311 - DNA, 20 bp, Homo sapiens
gttattatatttacaaatgg

SEQ ID NO: 3522312 - DNA, 13 bp, Homo sapiens
gttattttgcaac

SEQ ID NO: 3522313 - DNA, 12 bp, Homo sapiens
gttcaaagccag

SEQ ID NO: 3522314 - DNA, 16 bp, Homo sapiens
gttcaacccacagcta

SEQ ID NO: 3522315 - DNA, 20 bp, Homo sapiens
gttcaagcgattctcctgcc

SEQ ID NO: 3522316 - DNA, 18 bp, Homo sapiens
gttcaagcgattcttctg

SEQ ID NO: 3522317 - DNA, 20 bp, Homo sapiens
gttcaagcgattcttctgct

SEQ ID NO: 3522318 - DNA, 23 bp, Homo sapiens
gttcaattctcatttgtcacaca

SEQ ID NO: 3522319 - DNA, 23 bp, Homo sapiens
gttcacctttgtagcactcaggc

SEQ ID NO: 3522320 - DNA, 15 bp, Homo sapiens
gttcagaaatttaaa

SEQ ID NO: 3522321 - DNA, 14 bp, Homo sapiens
gttcagcagactgg

SEQ ID NO: 3522322 - DNA, 15 bp, Homo sapiens
gttcagctccagctc

SEQ ID NO: 3522323 - DNA, 22 bp, Homo sapiens
gttcagggttggcccctgcccg

SEQ ID NO: 3522324 - DNA, 24 bp, Homo sapiens
gttcagtactctacaattcctctg

SEQ ID NO: 3522325 - DNA, 13 bp, Homo sapiens
gttcatagcccag

SEQ ID NO: 3522326 - DNA, 14 bp, Homo sapiens
gttcatagcccagt

SEQ ID NO: 3522327 - DNA, 19 bp, Homo sapiens
gttcatccgcactgtaaat

SEQ ID NO: 3522328 - DNA, 20 bp, Homo sapiens
gttcatcctattctttcgaa

SEQ ID NO: 3522329 - DNA, 20 bp, Homo sapiens
gttcatctatggcagtccag

SEQ ID NO: 3522330 - DNA, 13 bp, Homo sapiens
gttcattttgagt

SEQ ID NO: 3522331 - DNA, 13 bp, Homo sapiens
gttccaaggccag

SEQ ID NO: 3522332 - DNA, 20 bp, Homo sapiens
gttccacttgtttgcactgt

SEQ ID NO: 3522333 - DNA, 14 bp, Homo sapiens
gttccccagagaaa

SEQ ID NO: 3522334 - DNA, 20 bp, Homo sapiens
gttccccgctttttcactcc

SEQ ID NO: 3522335 - DNA, 13 bp, Homo sapiens
gttccccttccac

SEQ ID NO: 3522336 - DNA, 19 bp, Homo sapiens
gttccctatttttctctcc

SEQ ID NO: 3522337 - DNA, 16 bp, Homo sapiens
gttcctgtccctgcgc

SEQ ID NO: 3522338 - DNA, 17 bp, Homo sapiens
gttcctgtccctgcgcc

SEQ ID NO: 3522339 - DNA, 23 bp, Homo sapiens
gttcctttccttttctttaaaga

SEQ ID NO: 3522340 - DNA, 14 bp, Homo sapiens
gttcgcatggtcac

SEQ ID NO: 3522341 - DNA, 16 bp, Homo sapiens
gttctaagtctttcca

SEQ ID NO: 3522342 - DNA, 20 bp, Homo sapiens
gttctaggaaattcttgaaa

SEQ ID NO: 3522343 - DNA, 13 bp, Homo sapiens
gttctagttttca

SEQ ID NO: 3522344 - DNA, 14 bp, Homo sapiens
gttctagttttcag

SEQ ID NO: 3522345 - DNA, 21 bp, Homo sapiens
gttctcattcctgttctttct

SEQ ID NO: 3522346 - DNA, 18 bp, Homo sapiens
gttctccgttagctcctg

SEQ ID NO: 3522347 - DNA, 22 bp, Homo sapiens
gttctccgttagctcctgtggc

SEQ ID NO: 3522348 - DNA, 22 bp, Homo sapiens
gttctctatcatttaataatat

SEQ ID NO: 3522349 - DNA, 14 bp, Homo sapiens
gttctctgggagaa

SEQ ID NO: 3522350 - DNA, 16 bp, Homo sapiens
gttctctgggagaaaa

SEQ ID NO: 3522351 - DNA, 19 bp, Homo sapiens
gttctctgggagaaaatca

SEQ ID NO: 3522352 - DNA, 21 bp, Homo sapiens
gttctctgggagaaaatcatc

SEQ ID NO: 3522353 - DNA, 22 bp, Homo sapiens
gttctgcctgccagctgcactg

SEQ ID NO: 3522354 - DNA, 14 bp, Homo sapiens
gttctgctttctcc

SEQ ID NO: 3522355 - DNA, 23 bp, Homo sapiens
gttctgggacacagttcaattct

SEQ ID NO: 3522356 - DNA, 17 bp, Homo sapiens
gttctgggactccaggt

SEQ ID NO: 3522357 - DNA, 16 bp, Homo sapiens
gttctgggttttctga

SEQ ID NO: 3522358 - DNA, 17 bp, Homo sapiens
gttctggtggtttgatt

SEQ ID NO: 3522359 - DNA, 14 bp, Homo sapiens
gttctgtagaaatg

SEQ ID NO: 3522360 - DNA, 15 bp, Homo sapiens
gttctgtgtctgtgt

SEQ ID NO: 3522361 - DNA, 15 bp, Homo sapiens
gttcttaaccagatg

SEQ ID NO: 3522362 - DNA, 14 bp, Homo sapiens
gttcttatttgcca

SEQ ID NO: 3522363 - DNA, 16 bp, Homo sapiens
gttcttctcaaaagaa

SEQ ID NO: 3522364 - DNA, 17 bp, Homo sapiens
gttctttgggccagaca

SEQ ID NO: 3522365 - DNA, 16 bp, Homo sapiens
gttgaagactttgttt

SEQ ID NO: 3522366 - DNA, 17 bp, Homo sapiens
gttgaatactttttaca

SEQ ID NO: 3522367 - DNA, 20 bp, Homo sapiens
gttgaattttgttctctggg

SEQ ID NO: 3522368 - DNA, 22 bp, Homo sapiens
gttgaattttttttaatgctta

SEQ ID NO: 3522369 - DNA, 17 bp, Homo sapiens
gttgacaattctgcatg

SEQ ID NO: 3522370 - DNA, 21 bp, Homo sapiens
gttgacaattctgcatgtact

SEQ ID NO: 3522371 - DNA, 15 bp, Homo sapiens
gttgacacaggtctt

SEQ ID NO: 3522372 - DNA, 14 bp, Homo sapiens
gttgacatatttaa

SEQ ID NO: 3522373 - DNA, 16 bp, Homo sapiens
gttgaccatgtctatg

SEQ ID NO: 3522374 - DNA, 14 bp, Homo sapiens
gttgaccccagagg

SEQ ID NO: 3522375 - DNA, 14 bp, Homo sapiens
gttgagaaggtgcc

SEQ ID NO: 3522376 - DNA, 19 bp, Homo sapiens
gttgagaatcccaaatttg

SEQ ID NO: 3522377 - DNA, 19 bp, Homo sapiens
gttgatctggaacccagac

SEQ ID NO: 3522378 - DNA, 22 bp, Homo sapiens
gttgatctggaacccagactca

SEQ ID NO: 3522379 - DNA, 22 bp, Homo sapiens
gttgatgatctttgcagacagg

SEQ ID NO: 3522380 - DNA, 23 bp, Homo sapiens
gttgatgatctttgcagacaggc

SEQ ID NO: 3522381 - DNA, 16 bp, Homo sapiens
gttgattacagtgcag

SEQ ID NO: 3522382 - DNA, 14 bp, Homo sapiens
gttgcaagcccctc

SEQ ID NO: 3522383 - DNA, 22 bp, Homo sapiens
gttgcaatagaacagagaaaga

SEQ ID NO: 3522384 - DNA, 20 bp, Homo sapiens
gttgcacacccactcagctc

SEQ ID NO: 3522385 - DNA, 16 bp, Homo sapiens
gttgcagacaggaatc

SEQ ID NO: 3522386 - DNA, 23 bp, Homo sapiens
gttgcagccctgctgctgcctgc

SEQ ID NO: 3522387 - DNA, 15 bp, Homo sapiens
gttgccaagctccaa

SEQ ID NO: 3522388 - DNA, 12 bp, Homo sapiens
gttgcccaggca

SEQ ID NO: 3522389 - DNA, 15 bp, Homo sapiens
gttgcccaggcaggt

SEQ ID NO: 3522390 - DNA, 19 bp, Homo sapiens
gttgcccaggcaggtcttg

SEQ ID NO: 3522391 - DNA, 12 bp, Homo sapiens
gttgcccaggct

SEQ ID NO: 3522392 - DNA, 11 bp, Homo sapiens
gttgccccaga

SEQ ID NO: 3522393 - DNA, 18 bp, Homo sapiens
gttgctgctgtccagtgc

SEQ ID NO: 3522394 - DNA, 21 bp, Homo sapiens
gttgctgttttcctcccttct

SEQ ID NO: 3522395 - DNA, 16 bp, Homo sapiens
gttgctttgttgcact

SEQ ID NO: 3522396 - DNA, 15 bp, Homo sapiens
gttgcttttttgact

SEQ ID NO: 3522397 - DNA, 21 bp, Homo sapiens
gttggaccagaggaagcccct

SEQ ID NO: 3522398 - DNA, 18 bp, Homo sapiens
gttggaggagagagcctt

SEQ ID NO: 3522399 - DNA, 20 bp, Homo sapiens
gttggaggagagagccttgg

SEQ ID NO: 3522400 - DNA, 14 bp, Homo sapiens
gttggccaggctgg

SEQ ID NO: 3522401 - DNA, 23 bp, Homo sapiens
gttggctgggggcctcagtgcca

SEQ ID NO: 3522402 - DNA, 16 bp, Homo sapiens
gttggtcctctctctg

SEQ ID NO: 3522403 - DNA, 13 bp, Homo sapiens
gttggttgattgg

SEQ ID NO: 3522404 - DNA, 13 bp, Homo sapiens
gttgtaaaatata

SEQ ID NO: 3522405 - DNA, 14 bp, Homo sapiens
gttgtaaaatatag

SEQ ID NO: 3522406 - DNA, 22 bp, Homo sapiens
gttgtaaaatatagctgtacaa

SEQ ID NO: 3522407 - DNA, 14 bp, Homo sapiens
gttgtaaatatata

SEQ ID NO: 3522408 - DNA, 15 bp, Homo sapiens
gttgtaaatatataa

SEQ ID NO: 3522409 - DNA, 16 bp, Homo sapiens
gttgtaaatatataaa

SEQ ID NO: 3522410 - DNA, 16 bp, Homo sapiens
gttgtacaatcatgtt

SEQ ID NO: 3522411 - DNA, 16 bp, Homo sapiens
gttgtactgtatgtga

SEQ ID NO: 3522412 - DNA, 17 bp, Homo sapiens
gttgtcaagtctctgct

SEQ ID NO: 3522413 - DNA, 22 bp, Homo sapiens
gttgtcactgcttttggcctgg

SEQ ID NO: 3522414 - DNA, 12 bp, Homo sapiens
gttgtcagctga

SEQ ID NO: 3522415 - DNA, 10 bp, Homo sapiens
gttgtgcagc

SEQ ID NO: 3522416 - DNA, 18 bp, Homo sapiens
gttgtgcagcttttggtc

SEQ ID NO: 3522417 - DNA, 19 bp, Homo sapiens
gttgttactaactaaactc

SEQ ID NO: 3522418 - DNA, 20 bp, Homo sapiens
gttgttttttcctttgctct

SEQ ID NO: 3522419 - DNA, 19 bp, Homo sapiens
gtttaaaaatcaacttttt

SEQ ID NO: 3522420 - DNA, 23 bp, Homo sapiens
gtttaatgcaagagaacatttta

SEQ ID NO: 3522421 - DNA, 20 bp, Homo sapiens
gtttaatgttctgtgataca

SEQ ID NO: 3522422 - DNA, 19 bp, Homo sapiens
gtttaattttataaacaaa

SEQ ID NO: 3522423 - DNA, 11 bp, Homo sapiens
gtttacagaat

SEQ ID NO: 3522424 - DNA, 16 bp, Homo sapiens
taatctttcaaaccag

SEQ ID NO: 3522425 - DNA, 22 bp, Homo sapiens
taatgaagagccagcccaagta

SEQ ID NO: 3522426 - DNA, 15 bp, Homo sapiens
taatgaagtttgaat

SEQ ID NO: 3522427 - DNA, 16 bp, Homo sapiens
taatgaagtttgaatg

SEQ ID NO: 3522428 - DNA, 17 bp, Homo sapiens
taatgaagtttgaatgt

SEQ ID NO: 3522429 - DNA, 18 bp, Homo sapiens
taatgaagtttgaatgtt

SEQ ID NO: 3522430 - DNA, 19 bp, Homo sapiens
taatgaccaacctgtttct

SEQ ID NO: 3522431 - DNA, 17 bp, Homo sapiens
taatgatggatttaaca

SEQ ID NO: 3522432 - DNA, 23 bp, Homo sapiens
taatgcaagagaacattttactg

SEQ ID NO: 3522433 - DNA, 20 bp, Homo sapiens
taatgcagtatggtacattt

SEQ ID NO: 3522434 - DNA, 21 bp, Homo sapiens
taatgcagtatggtacatttt

SEQ ID NO: 3522435 - DNA, 16 bp, Homo sapiens
taatgcatgttaggaa

SEQ ID NO: 3522436 - DNA, 17 bp, Homo sapiens
taatgcatgttaggaaa

SEQ ID NO: 3522437 - DNA, 18 bp, Homo sapiens
taatgctccttgttccta

SEQ ID NO: 3522438 - DNA, 16 bp, Homo sapiens
taatgcttaagaggga

SEQ ID NO: 3522439 - DNA, 16 bp, Homo sapiens
taatgcttaagatttg

SEQ ID NO: 3522440 - DNA, 13 bp, Homo sapiens
taatggacacttt

SEQ ID NO: 3522441 - DNA, 17 bp, Homo sapiens
taatggacagattaata

SEQ ID NO: 3522442 - DNA, 11 bp, Homo sapiens
taatgtctctg

SEQ ID NO: 3522443 - DNA, 18 bp, Homo sapiens
taatgttaaacaccattt

SEQ ID NO: 3522444 - DNA, 15 bp, Homo sapiens
taatgtttaaaacat

SEQ ID NO: 3522445 - DNA, 15 bp, Homo sapiens
taatgttttaactct

SEQ ID NO: 3522446 - DNA, 22 bp, Homo sapiens
taatgttttctttgcaaagtat

SEQ ID NO: 3522447 - DNA, 15 bp, Homo sapiens
taattaaaacacttt

SEQ ID NO: 3522448 - DNA, 12 bp, Homo sapiens
taattagtgcta

SEQ ID NO: 3522449 - DNA, 14 bp, Homo sapiens
taattagtgctaag

SEQ ID NO: 3522450 - DNA, 13 bp, Homo sapiens
taattcaacattt

SEQ ID NO: 3522451 - DNA, 14 bp, Homo sapiens
taattcatgtttct

SEQ ID NO: 3522452 - DNA, 17 bp, Homo sapiens
taattccacacctttta

SEQ ID NO: 3522453 - DNA, 22 bp, Homo sapiens
taattgctttcctgcctccttg

SEQ ID NO: 3522454 - DNA, 23 bp, Homo sapiens
taattgtactaaagccaaacata

SEQ ID NO: 3522455 - DNA, 21 bp, Homo sapiens
taatttaatgcatgttaggaa

SEQ ID NO: 3522456 - DNA, 16 bp, Homo sapiens
taatttagtaaatgtt

SEQ ID NO: 3522457 - DNA, 12 bp, Homo sapiens
taatttatagta

SEQ ID NO: 3522458 - DNA, 23 bp, Homo sapiens
taatttatcttgtctctgggctt

SEQ ID NO: 3522459 - DNA, 14 bp, Homo sapiens
taatttatgcagaa

SEQ ID NO: 3522460 - DNA, 20 bp, Homo sapiens
taatttattaattgctttga

SEQ ID NO: 3522461 - DNA, 17 bp, Homo sapiens
taatttgatgaggtatt

SEQ ID NO: 3522462 - DNA, 20 bp, Homo sapiens
taatttgcattaaattcaca

SEQ ID NO: 3522463 - DNA, 12 bp, Homo sapiens
taatttgtattg

SEQ ID NO: 3522464 - DNA, 21 bp, Homo sapiens
taattttacatgtttataaat

SEQ ID NO: 3522465 - DNA, 19 bp, Homo sapiens
taattttagtaatttccta

SEQ ID NO: 3522466 - DNA, 20 bp, Homo sapiens
taattttctgtggatcattt

SEQ ID NO: 3522467 - DNA, 14 bp, Homo sapiens
taatttttgtaatt

SEQ ID NO: 3522468 - DNA, 17 bp, Homo sapiens
taatttttgtattattt

SEQ ID NO: 3522469 - DNA, 18 bp, Homo sapiens
taattttttggtacaaaa

SEQ ID NO: 3522470 - DNA, 17 bp, Homo sapiens
taatttttttaaccaaa

SEQ ID NO: 3522471 - DNA, 20 bp, Homo sapiens
taatttttttaaccaaaggt

SEQ ID NO: 3522472 - DNA, 16 bp, Homo sapiens
taatttttttcaatat

SEQ ID NO: 3522473 - DNA, 19 bp, Homo sapiens
taatttttttcttgtagta

SEQ ID NO: 3522474 - DNA, 23 bp, Homo sapiens
tacaaaaacacttcgttcgcaga

SEQ ID NO: 3522475 - DNA, 22 bp, Homo sapiens
tacaaaaatttgccaggcgtgg

SEQ ID NO: 3522476 - DNA, 12 bp, Homo sapiens
tacaaaacttcc

SEQ ID NO: 3522477 - DNA, 18 bp, Homo sapiens
tacaaacaaaatttctat

SEQ ID NO: 3522478 - DNA, 18 bp, Homo sapiens
tacaaaggggaaagaaca

SEQ ID NO: 3522479 - DNA, 23 bp, Homo sapiens
tacaaaggggaaagaacataaag

SEQ ID NO: 3522480 - DNA, 19 bp, Homo sapiens
tacaaaggttccattcagt

SEQ ID NO: 3522481 - DNA, 18 bp, Homo sapiens
tacaaagtgtgtattaaa

SEQ ID NO: 3522482 - DNA, 19 bp, Homo sapiens
tacaaagtgtgtattaaaa

SEQ ID NO: 3522483 - DNA, 17 bp, Homo sapiens
tacaaatataagaataa

SEQ ID NO: 3522484 - DNA, 18 bp, Homo sapiens
tacaaatataagaataaa

SEQ ID NO: 3522485 - DNA, 16 bp, Homo sapiens
tacaaatcaagtattt

SEQ ID NO: 3522486 - DNA, 14 bp, Homo sapiens
tacaaattagaaaa

SEQ ID NO: 3522487 - DNA, 20 bp, Homo sapiens
tacaactcattccagatccc

SEQ ID NO: 3522488 - DNA, 24 bp, Homo sapiens
tacaagatgaaggagaggcaacat

SEQ ID NO: 3522489 - DNA, 14 bp, Homo sapiens
tacaagccccccct

SEQ ID NO: 3522490 - DNA, 16 bp, Homo sapiens
tacaagcgtgagccac

SEQ ID NO: 3522491 - DNA, 18 bp, Homo sapiens
tacaagcgtgagccactg

SEQ ID NO: 3522492 - DNA, 19 bp, Homo sapiens
tacaagcgtgagccactgc

SEQ ID NO: 3522493 - DNA, 16 bp, Homo sapiens
tacaataaattgctaa

SEQ ID NO: 3522494 - DNA, 21 bp, Homo sapiens
tacaataatgtaatttagtct

SEQ ID NO: 3522495 - DNA, 18 bp, Homo sapiens
tacaattaaaaaaaaaga

SEQ ID NO: 3522496 - DNA, 15 bp, Homo sapiens
tacaattatatcagt

SEQ ID NO: 3522497 - DNA, 18 bp, Homo sapiens
tacaattatttttacagt

SEQ ID NO: 3522498 - DNA, 17 bp, Homo sapiens
tacaatttacaaagtgt

SEQ ID NO: 3522499 - DNA, 23 bp, Homo sapiens
tacacaaatctatttaattagga

SEQ ID NO: 3522500 - DNA, 20 bp, Homo sapiens
tacacaatggtttttaaatt

SEQ ID NO: 3522501 - DNA, 22 bp, Homo sapiens
tacacacggctcccccaggcct

SEQ ID NO: 3522502 - DNA, 22 bp, Homo sapiens
tacacagaaatgctgctggcca

SEQ ID NO: 3522503 - DNA, 12 bp, Homo sapiens
tacacagagaag

SEQ ID NO: 3522504 - DNA, 13 bp, Homo sapiens
tacacagagaagg

SEQ ID NO: 3522505 - DNA, 17 bp, Homo sapiens
tacacagagaaggctat

SEQ ID NO: 3522506 - DNA, 16 bp, Homo sapiens
tacacccttttccagc

SEQ ID NO: 3522507 - DNA, 14 bp, Homo sapiens
tacaccttgctttt

SEQ ID NO: 3522508 - DNA, 15 bp, Homo sapiens
tacactttatggtaa

SEQ ID NO: 3522509 - DNA, 17 bp, Homo sapiens
tacagaactctttcaaa

SEQ ID NO: 3522510 - DNA, 21 bp, Homo sapiens
tacagaatatttctattgaat

SEQ ID NO: 3522511 - DNA, 13 bp, Homo sapiens
tacagaattttat

SEQ ID NO: 3522512 - DNA, 18 bp, Homo sapiens
tacagattttgatagcaa

SEQ ID NO: 3522513 - DNA, 23 bp, Homo sapiens
tacagcaacaggaatctcagaga

SEQ ID NO: 3522514 - DNA, 16 bp, Homo sapiens
tacagctatgaagaaa

SEQ ID NO: 3522515 - DNA, 20 bp, Homo sapiens
tacagctgggtggcactgcc

SEQ ID NO: 3522516 - DNA, 12 bp, Homo sapiens
tacagctgtgtt

SEQ ID NO: 3522517 - DNA, 17 bp, Homo sapiens
tacagctgtgttattct

SEQ ID NO: 3522518 - DNA, 12 bp, Homo sapiens
tacagctttctg

SEQ ID NO: 3522519 - DNA, 14 bp, Homo sapiens
tacaggatttgaaa

SEQ ID NO: 3522520 - DNA, 21 bp, Homo sapiens
tacaggctggcgcagaacgaa

SEQ ID NO: 3522521 - DNA, 16 bp, Homo sapiens
tacagggaatgcctga

SEQ ID NO: 3522522 - DNA, 22 bp, Homo sapiens
tacagggccaaacgctgagcca

SEQ ID NO: 3522523 - DNA, 16 bp, Homo sapiens
tacaggtgtgagcata

SEQ ID NO: 3522524 - DNA, 22 bp, Homo sapiens
tacaggtgtgagcatagtgaga

SEQ ID NO: 3522525 - DNA, 15 bp, Homo sapiens
tacagtacaggcagc

SEQ ID NO: 3522526 - DNA, 15 bp, Homo sapiens
tacagtaggagccca

SEQ ID NO: 3522527 - DNA, 20 bp, Homo sapiens
tacagtaggagcccagctct

SEQ ID NO: 3522528 - DNA, 22 bp, Homo sapiens
tacagtaggagcccagctctga

SEQ ID NO: 3522529 - DNA, 14 bp, Homo sapiens
tacagtcttccaca

SEQ ID NO: 3522530 - DNA, 19 bp, Homo sapiens
tacagtcttccatttgcaa

SEQ ID NO: 3522531 - DNA, 22 bp, Homo sapiens
tacagtggtgccatcattgctg

SEQ ID NO: 3522532 - DNA, 18 bp, Homo sapiens
tacagttaaggaatataa

SEQ ID NO: 3522533 - DNA, 23 bp, Homo sapiens
tacagttcggtgagctacaaatg

SEQ ID NO: 3522534 - DNA, 17 bp, Homo sapiens
tacagttgaaaaacagc

SEQ ID NO: 3522535 - DNA, 23 bp, Homo sapiens
tacagtttatttttaaagataga

SEQ ID NO: 3522536 - DNA, 14 bp, Homo sapiens
tacataaagactaa

SEQ ID NO: 3522537 - DNA, 16 bp, Homo sapiens
tacataaataagaaaa

SEQ ID NO: 3522538 - DNA, 15 bp, Homo sapiens
tacataattcactct

SEQ ID NO: 3522539 - DNA, 16 bp, Homo sapiens
tacataattcactctg

SEQ ID NO: 3522540 - DNA, 13 bp, Homo sapiens
tacatacactgta

SEQ ID NO: 3522541 - DNA, 13 bp, Homo sapiens
tacatactgctgt

SEQ ID NO: 3522542 - DNA, 23 bp, Homo sapiens
tacatagcatgacatttctttgt

SEQ ID NO: 3522543 - DNA, 12 bp, Homo sapiens
tacatatcttta

SEQ ID NO: 3522544 - DNA, 20 bp, Homo sapiens
tacatatgtaaaataaaatt

SEQ ID NO: 3522545 - DNA, 13 bp, Homo sapiens
tacatattgtctg

SEQ ID NO: 3522546 - DNA, 22 bp, Homo sapiens
tacatcatgctggaacctgcaa

SEQ ID NO: 3522547 - DNA, 18 bp, Homo sapiens
tacatctattttggattg

SEQ ID NO: 3522548 - DNA, 21 bp, Homo sapiens
tacatgacatttatttttcat

SEQ ID NO: 3522549 - DNA, 16 bp, Homo sapiens
tacatgagaaggaact

SEQ ID NO: 3522550 - DNA, 16 bp, Homo sapiens
tacatgtataaagtga

SEQ ID NO: 3522551 - DNA, 17 bp, Homo sapiens
tacatgtataaagtgat

SEQ ID NO: 3522552 - DNA, 18 bp, Homo sapiens
tacatgtataaagtgatt

SEQ ID NO: 3522553 - DNA, 13 bp, Homo sapiens
tacatgtttataa

SEQ ID NO: 3522554 - DNA, 15 bp, Homo sapiens
tacatgtttataaat

SEQ ID NO: 3522555 - DNA, 17 bp, Homo sapiens
tacatgtttataaatct

SEQ ID NO: 3522556 - DNA, 11 bp, Homo sapiens
tatagactcta

SEQ ID NO: 3522557 - DNA, 15 bp, Homo sapiens
tatagatcatttcta

SEQ ID NO: 3522558 - DNA, 16 bp, Homo sapiens
tatagcatctttcata

SEQ ID NO: 3522559 - DNA, 17 bp, Homo sapiens
tatagcatctttcatat

SEQ ID NO: 3522560 - DNA, 20 bp, Homo sapiens
tatagcatctttcatatggt

SEQ ID NO: 3522561 - DNA, 18 bp, Homo sapiens
tatagctgtacaaatata

SEQ ID NO: 3522562 - DNA, 22 bp, Homo sapiens
tatagctgtacaaatataagaa

SEQ ID NO: 3522563 - DNA, 16 bp, Homo sapiens
tatataaaataaatat

SEQ ID NO: 3522564 - DNA, 18 bp, Homo sapiens
tatataaaataaatatat

SEQ ID NO: 3522565 - DNA, 17 bp, Homo sapiens
tatataaacctaaaaaa

SEQ ID NO: 3522566 - DNA, 21 bp, Homo sapiens
tatataaacctaaaaaagata

SEQ ID NO: 3522567 - DNA, 22 bp, Homo sapiens
tatataaacctaaaaaagatat

SEQ ID NO: 3522568 - DNA, 18 bp, Homo sapiens
tatataaagcacagattt

SEQ ID NO: 3522569 - DNA, 13 bp, Homo sapiens
tatataagaaaga

SEQ ID NO: 3522570 - DNA, 16 bp, Homo sapiens
tatataagaaagacat

SEQ ID NO: 3522571 - DNA, 17 bp, Homo sapiens
tatataagaaagacatc

SEQ ID NO: 3522572 - DNA, 19 bp, Homo sapiens
tatataatatctaaagtta

SEQ ID NO: 3522573 - DNA, 17 bp, Homo sapiens
tatatacaataacataa

SEQ ID NO: 3522574 - DNA, 22 bp, Homo sapiens
tatatacaataacataatttgt

SEQ ID NO: 3522575 - DNA, 20 bp, Homo sapiens
tatatacccgtacaacgtgt

SEQ ID NO: 3522576 - DNA, 10 bp, Homo sapiens
tatatataaa

SEQ ID NO: 3522577 - DNA, 12 bp, Homo sapiens
tatatataaaat

SEQ ID NO: 3522578 - DNA, 12 bp, Homo sapiens
tatatataaacc

SEQ ID NO: 3522579 - DNA, 13 bp, Homo sapiens
tatatataaacct

SEQ ID NO: 3522580 - DNA, 13 bp, Homo sapiens
tatatatatatat

SEQ ID NO: 3522581 - DNA, 13 bp, Homo sapiens
tatatattattct

SEQ ID NO: 3522582 - DNA, 16 bp, Homo sapiens
tatatattattctcat

SEQ ID NO: 3522583 - DNA, 19 bp, Homo sapiens
tatatattattctcattta

SEQ ID NO: 3522584 - DNA, 20 bp, Homo sapiens
tatatccttttcttctatgt

SEQ ID NO: 3522585 - DNA, 14 bp, Homo sapiens
tatatctctatttg

SEQ ID NO: 3522586 - DNA, 20 bp, Homo sapiens
tatatgcagtctctttattt

SEQ ID NO: 3522587 - DNA, 22 bp, Homo sapiens
tatatggcagagttgtaaatat

SEQ ID NO: 3522588 - DNA, 23 bp, Homo sapiens
tatatggcagagttgtaaatata

SEQ ID NO: 3522589 - DNA, 14 bp, Homo sapiens
tatatgtgtgccta

SEQ ID NO: 3522590 - DNA, 19 bp, Homo sapiens
tatatgttttaagaggcag

SEQ ID NO: 3522591 - DNA, 18 bp, Homo sapiens
tatattaaaaatataaaa

SEQ ID NO: 3522592 - DNA, 22 bp, Homo sapiens
tatattaatagtaatttgtaaa

SEQ ID NO: 3522593 - DNA, 22 bp, Homo sapiens
tatattatcatgcaaatgctgt

SEQ ID NO: 3522594 - DNA, 14 bp, Homo sapiens
tatattattctcat

SEQ ID NO: 3522595 - DNA, 13 bp, Homo sapiens
tatattgcatttc

SEQ ID NO: 3522596 - DNA, 18 bp, Homo sapiens
tatattgtgtttgtgtat

SEQ ID NO: 3522597 - DNA, 12 bp, Homo sapiens
tatatttacaaa

SEQ ID NO: 3522598 - DNA, 19 bp, Homo sapiens
tatatttcagatgtaatgt

SEQ ID NO: 3522599 - DNA, 22 bp, Homo sapiens
tatatttgtgatagcactttct

SEQ ID NO: 3522600 - DNA, 16 bp, Homo sapiens
tatatttgtgctatag

SEQ ID NO: 3522601 - DNA, 22 bp, Homo sapiens
tatatttgtgctatagtatttg

SEQ ID NO: 3522602 - DNA, 11 bp, Homo sapiens
tatattttgac

SEQ ID NO: 3522603 - DNA, 14 bp, Homo sapiens
tatattttgctagc

SEQ ID NO: 3522604 - DNA, 20 bp, Homo sapiens
tatatttttagcctaaatgt

SEQ ID NO: 3522605 - DNA, 23 bp, Homo sapiens
tatcaaaaagtattatcattgct

SEQ ID NO: 3522606 - DNA, 19 bp, Homo sapiens
tatcaacttcctaaatatt

SEQ ID NO: 3522607 - DNA, 23 bp, Homo sapiens
tatcaccgtgggctccctgactg

SEQ ID NO: 3522608 - DNA, 15 bp, Homo sapiens
tatcacctcattctg

SEQ ID NO: 3522609 - DNA, 20 bp, Homo sapiens
tatcagtcaatatttttaga

SEQ ID NO: 3522610 - DNA, 13 bp, Homo sapiens
tatcataattacc

SEQ ID NO: 3522611 - DNA, 14 bp, Homo sapiens
tatcatattattat

SEQ ID NO: 3522612 - DNA, 14 bp, Homo sapiens
tatcatgccctgtg

SEQ ID NO: 3522613 - DNA, 12 bp, Homo sapiens
tatcatggtctc

SEQ ID NO: 3522614 - DNA, 17 bp, Homo sapiens
tatcatggtctcagtca

SEQ ID NO: 3522615 - DNA, 22 bp, Homo sapiens
tatcattgttggtgttaattga

SEQ ID NO: 3522616 - DNA, 16 bp, Homo sapiens
tatcatttaataatat

SEQ ID NO: 3522617 - DNA, 20 bp, Homo sapiens
tatcatttaataatatactt

SEQ ID NO: 3522618 - DNA, 23 bp, Homo sapiens
tatccaaaatgtgtatttcttat

SEQ ID NO: 3522619 - DNA, 18 bp, Homo sapiens
tatccaggtaatccaaga

SEQ ID NO: 3522620 - DNA, 15 bp, Homo sapiens
tatccatgtacttgt

SEQ ID NO: 3522621 - DNA, 14 bp, Homo sapiens
tatccattcccaag

SEQ ID NO: 3522622 - DNA, 22 bp, Homo sapiens
tatccattcccaagatgcctga

SEQ ID NO: 3522623 - DNA, 14 bp, Homo sapiens
tatcctctttagag

SEQ ID NO: 3522624 - DNA, 22 bp, Homo sapiens
tatcctctttagagttagactg

SEQ ID NO: 3522625 - DNA, 17 bp, Homo sapiens
tatccttcctctccttc

SEQ ID NO: 3522626 - DNA, 12 bp, Homo sapiens
tatctaaagtta

SEQ ID NO: 3522627 - DNA, 18 bp, Homo sapiens
tatctaaagttatatttc

SEQ ID NO: 3522628 - DNA, 15 bp, Homo sapiens
tatctaagttcacag

SEQ ID NO: 3522629 - DNA, 16 bp, Homo sapiens
tatctaagttcacagt

SEQ ID NO: 3522630 - DNA, 14 bp, Homo sapiens
tatctactctcctc

SEQ ID NO: 3522631 - DNA, 20 bp, Homo sapiens
tatctactctcctcatctct

SEQ ID NO: 3522632 - DNA, 11 bp, Homo sapiens
tatctagctct

SEQ ID NO: 3522633 - DNA, 20 bp, Homo sapiens
tatctatacatatctttatt

SEQ ID NO: 3522634 - DNA, 15 bp, Homo sapiens
tatctccaagaccag

SEQ ID NO: 3522635 - DNA, 18 bp, Homo sapiens
tatctccggctcccagcc

SEQ ID NO: 3522636 - DNA, 16 bp, Homo sapiens
tatctctatttgagaa

SEQ ID NO: 3522637 - DNA, 21 bp, Homo sapiens
tatctcttttatatttgtagg

SEQ ID NO: 3522638 - DNA, 21 bp, Homo sapiens
tatctgcaggcagacacggat

SEQ ID NO: 3522639 - DNA, 11 bp, Homo sapiens
tatctgcctga

SEQ ID NO: 3522640 - DNA, 13 bp, Homo sapiens
tatctgcctttat

SEQ ID NO: 3522641 - DNA, 14 bp, Homo sapiens
tatctgcctttatt

SEQ ID NO: 3522642 - DNA, 20 bp, Homo sapiens
tatctgcctttattgtgttt

SEQ ID NO: 3522643 - DNA, 19 bp, Homo sapiens
tatctgtgaaatgctggca

SEQ ID NO: 3522644 - DNA, 22 bp, Homo sapiens
tatctgtgctcaggactcagaa

SEQ ID NO: 3522645 - DNA, 20 bp, Homo sapiens
tatcttgatgtttagaaaag

SEQ ID NO: 3522646 - DNA, 16 bp, Homo sapiens
tatctttgattctcct

SEQ ID NO: 3522647 - DNA, 18 bp, Homo sapiens
tatgaagaaacgcaacaa

SEQ ID NO: 3522648 - DNA, 21 bp, Homo sapiens
tatgaagacttaaaagagctc

SEQ ID NO: 3522649 - DNA, 14 bp, Homo sapiens
tatgaattgtacag

SEQ ID NO: 3522650 - DNA, 22 bp, Homo sapiens
tatgaattgtacagaatatttc

SEQ ID NO: 3522651 - DNA, 14 bp, Homo sapiens
tatgacagaggagg

SEQ ID NO: 3522652 - DNA, 14 bp, Homo sapiens
tatgacattcatgc

SEQ ID NO: 3522653 - DNA, 19 bp, Homo sapiens
tatgacattcatgcctggc

SEQ ID NO: 3522654 - DNA, 13 bp, Homo sapiens
tatgactttttat

SEQ ID NO: 3522655 - DNA, 20 bp, Homo sapiens
tatgatttataaacagacaa

SEQ ID NO: 3522656 - DNA, 20 bp, Homo sapiens
tatgcacttataattttcct

SEQ ID NO: 3522657 - DNA, 20 bp, Homo sapiens
tatgcagtctctttatttta

SEQ ID NO: 3522658 - DNA, 22 bp, Homo sapiens
tatgcagtctctttattttact

SEQ ID NO: 3522659 - DNA, 15 bp, Homo sapiens
tatgcataaagtcag

SEQ ID NO: 3522660 - DNA, 18 bp, Homo sapiens
tatgcatggtgccccagg

SEQ ID NO: 3522661 - DNA, 14 bp, Homo sapiens
tatgcatgtgtgtg

SEQ ID NO: 3522662 - DNA, 22 bp, Homo sapiens
tatgcatttaaatacagtcttc

SEQ ID NO: 3522663 - DNA, 23 bp, Homo sapiens
tatgccagcttggacatcagtgt

SEQ ID NO: 3522664 - DNA, 10 bp, Homo sapiens
tatgcctgtg

SEQ ID NO: 3522665 - DNA, 17 bp, Homo sapiens
tatgctaaaatacattt

SEQ ID NO: 3522666 - DNA, 15 bp, Homo sapiens
tatgctattgacaat

SEQ ID NO: 3522667 - DNA, 17 bp, Homo sapiens
tatgctattgacaataa

SEQ ID NO: 3522668 - DNA, 18 bp, Homo sapiens
tatgctctcactgtttgt

SEQ ID NO: 3522669 - DNA, 15 bp, Homo sapiens
tatgctgacagctct

SEQ ID NO: 3522670 - DNA, 22 bp, Homo sapiens
tatgctgatcatcgccagaggt

SEQ ID NO: 3522671 - DNA, 19 bp, Homo sapiens
tatgctgcaacaaaatgta

SEQ ID NO: 3522672 - DNA, 22 bp, Homo sapiens
tatgctgtggagtcccaacccc

SEQ ID NO: 3522673 - DNA, 16 bp, Homo sapiens
tatgcttgcaaaaact

SEQ ID NO: 3522674 - DNA, 22 bp, Homo sapiens
tatggaattacatgtaaaacat

SEQ ID NO: 3522675 - DNA, 18 bp, Homo sapiens
tatggagctcagagaggg

SEQ ID NO: 3522676 - DNA, 17 bp, Homo sapiens
tatggcagagttgtaaa

SEQ ID NO: 3522677 - DNA, 21 bp, Homo sapiens
tatggcagagttgtaaatata

SEQ ID NO: 3522678 - DNA, 21 bp, Homo sapiens
tatggcagtccagccagctcc

SEQ ID NO: 3522679 - DNA, 22 bp, Homo sapiens
tatgtaaaaggccaaacctctg

SEQ ID NO: 3522680 - DNA, 22 bp, Homo sapiens
tatgtaaacaaaccacagcagg

SEQ ID NO: 3522681 - DNA, 23 bp, Homo sapiens
tatgtataaaatgtaacactgat

SEQ ID NO: 3522682 - DNA, 22 bp, Homo sapiens
tatgtatttaccaaaaattttg

SEQ ID NO: 3522683 - DNA, 19 bp, Homo sapiens
tatgtcgtagaattccttc

SEQ ID NO: 3522684 - DNA, 16 bp, Homo sapiens
tatgtctgtcattgta

SEQ ID NO: 3522685 - DNA, 23 bp, Homo sapiens
tatgtgagctaggagaagggctg

SEQ ID NO: 3522686 - DNA, 23 bp, Homo sapiens
tatgtgagtgccttttgcagaag

SEQ ID NO: 3522687 - DNA, 16 bp, Homo sapiens
tatgtgattttaactc

SEQ ID NO: 3522688 - DNA, 23 bp, Homo sapiens
tcagagtgcaagcccctgctcca

SEQ ID NO: 3522689 - DNA, 15 bp, Homo sapiens
tcagatattctgctc

SEQ ID NO: 3522690 - DNA, 23 bp, Homo sapiens
tcagatcagtgtaccatttgcct

SEQ ID NO: 3522691 - DNA, 23 bp, Homo sapiens
tcagatgactatgcagaggcctg

SEQ ID NO: 3522692 - DNA, 23 bp, Homo sapiens
tcagatggaaccgcaggaagctg

SEQ ID NO: 3522693 - DNA, 14 bp, Homo sapiens
tcagatgtaatgtt

SEQ ID NO: 3522694 - DNA, 15 bp, Homo sapiens
tcagatgtaatgttt

SEQ ID NO: 3522695 - DNA, 19 bp, Homo sapiens
tcagattgcatgtgactct

SEQ ID NO: 3522696 - DNA, 21 bp, Homo sapiens
tcagattgcatgtgactctga

SEQ ID NO: 3522697 - DNA, 16 bp, Homo sapiens
tcagcaaaaagcaaaa

SEQ ID NO: 3522698 - DNA, 20 bp, Homo sapiens
tcagcaaaaagcaaaatcat

SEQ ID NO: 3522699 - DNA, 21 bp, Homo sapiens
tcagcaaaaagcaaaatcatt

SEQ ID NO: 3522700 - DNA, 22 bp, Homo sapiens
tcagcaaaccatttttaaagta

SEQ ID NO: 3522701 - DNA, 19 bp, Homo sapiens
tcagcacaaggccatctgg

SEQ ID NO: 3522702 - DNA, 15 bp, Homo sapiens
tcagcatcctggcac

SEQ ID NO: 3522703 - DNA, 21 bp, Homo sapiens
tcagcattcagtccgcctggc

SEQ ID NO: 3522704 - DNA, 14 bp, Homo sapiens
tcagccagagaagc

SEQ ID NO: 3522705 - DNA, 12 bp, Homo sapiens
tcagccagcact

SEQ ID NO: 3522706 - DNA, 18 bp, Homo sapiens
tcagccaggagctgtcac

SEQ ID NO: 3522707 - DNA, 19 bp, Homo sapiens
tcagccaggagctgtcacc

SEQ ID NO: 3522708 - DNA, 15 bp, Homo sapiens
tcagccatgtacaga

SEQ ID NO: 3522709 - DNA, 11 bp, Homo sapiens
tcagcccagct

SEQ ID NO: 3522710 - DNA, 21 bp, Homo sapiens
tcagccccgacttcctgactc

SEQ ID NO: 3522711 - DNA, 19 bp, Homo sapiens
tcagccctagggtggagag

SEQ ID NO: 3522712 - DNA, 12 bp, Homo sapiens
tcagcctcccaa

SEQ ID NO: 3522713 - DNA, 19 bp, Homo sapiens
tcagcctcccaaagtgctg

SEQ ID NO: 3522714 - DNA, 22 bp, Homo sapiens
tcagcctcccaaagtgctggga

SEQ ID NO: 3522715 - DNA, 19 bp, Homo sapiens
tcagcctcccaaccccagg

SEQ ID NO: 3522716 - DNA, 20 bp, Homo sapiens
tcagcctcccaagtagctgg

SEQ ID NO: 3522717 - DNA, 21 bp, Homo sapiens
tcagcctcccgaatagctggg

SEQ ID NO: 3522718 - DNA, 20 bp, Homo sapiens
tcagcctcccgagtagctgg

SEQ ID NO: 3522719 - DNA, 22 bp, Homo sapiens
tcagcctcccgagtagctggga

SEQ ID NO: 3522720 - DNA, 18 bp, Homo sapiens
tcagcctgctccagctgt

SEQ ID NO: 3522721 - DNA, 12 bp, Homo sapiens
tcagcctgggca

SEQ ID NO: 3522722 - DNA, 15 bp, Homo sapiens
tcagccttgaaaaac

SEQ ID NO: 3522723 - DNA, 15 bp, Homo sapiens
tcagccttgccagag

SEQ ID NO: 3522724 - DNA, 17 bp, Homo sapiens
tcagccttgccagagat

SEQ ID NO: 3522725 - DNA, 19 bp, Homo sapiens
tcagcgactccgttggcca

SEQ ID NO: 3522726 - DNA, 16 bp, Homo sapiens
tcagcggggacagctc

SEQ ID NO: 3522727 - DNA, 20 bp, Homo sapiens
tcagctatttactgccaaag

SEQ ID NO: 3522728 - DNA, 13 bp, Homo sapiens
tcagctcacgctt

SEQ ID NO: 3522729 - DNA, 14 bp, Homo sapiens
tcagctccagctca

SEQ ID NO: 3522730 - DNA, 22 bp, Homo sapiens
tcagctccagctcaccagcccc

SEQ ID NO: 3522731 - DNA, 13 bp, Homo sapiens
tcagctccccaga

SEQ ID NO: 3522732 - DNA, 15 bp, Homo sapiens
tcagctccttcctgg

SEQ ID NO: 3522733 - DNA, 19 bp, Homo sapiens
tcagctctctgccctgtgt

SEQ ID NO: 3522734 - DNA, 21 bp, Homo sapiens
tcagctctctgccctgtgtac

SEQ ID NO: 3522735 - DNA, 19 bp, Homo sapiens
tcagctcttggctccactg

SEQ ID NO: 3522736 - DNA, 16 bp, Homo sapiens
tcagctgaacctgggt

SEQ ID NO: 3522737 - DNA, 20 bp, Homo sapiens
tcagcttatctcttttatat

SEQ ID NO: 3522738 - DNA, 15 bp, Homo sapiens
tcaggaaaggaatca

SEQ ID NO: 3522739 - DNA, 20 bp, Homo sapiens
tcaggaacctcgagtactgt

SEQ ID NO: 3522740 - DNA, 21 bp, Homo sapiens
tcaggaacctcgagtactgtg

SEQ ID NO: 3522741 - DNA, 22 bp, Homo sapiens
tcaggaacctcgagtactgtgg

SEQ ID NO: 3522742 - DNA, 16 bp, Homo sapiens
tcaggacccagaggaa

SEQ ID NO: 3522743 - DNA, 18 bp, Homo sapiens
tcaggacctccaagccac

SEQ ID NO: 3522744 - DNA, 20 bp, Homo sapiens
tcaggacctccaagccactg

SEQ ID NO: 3522745 - DNA, 19 bp, Homo sapiens
tcaggacgagaatgagggt

SEQ ID NO: 3522746 - DNA, 14 bp, Homo sapiens
tcaggactcagaag

SEQ ID NO: 3522747 - DNA, 19 bp, Homo sapiens
tcaggagactgggctctgg

SEQ ID NO: 3522748 - DNA, 22 bp, Homo sapiens
tcaggagcagcctcagaacaaa

SEQ ID NO: 3522749 - DNA, 21 bp, Homo sapiens
tcaggagcttgcaagaagcag

SEQ ID NO: 3522750 - DNA, 17 bp, Homo sapiens
tcaggaggcaggacctt

SEQ ID NO: 3522751 - DNA, 22 bp, Homo sapiens
tcaggagtctctggtagcctgc

SEQ ID NO: 3522752 - DNA, 23 bp, Homo sapiens
tcaggatctcttagcattttaat

SEQ ID NO: 3522753 - DNA, 17 bp, Homo sapiens
tcaggcaaattggggag

SEQ ID NO: 3522754 - DNA, 13 bp, Homo sapiens
tcaggcacacagc

SEQ ID NO: 3522755 - DNA, 14 bp, Homo sapiens
tcaggcacacagct

SEQ ID NO: 3522756 - DNA, 19 bp, Homo sapiens
tcaggcaccagtccctgtc

SEQ ID NO: 3522757 - DNA, 17 bp, Homo sapiens
tcaggccagagccaagg

SEQ ID NO: 3522758 - DNA, 21 bp, Homo sapiens
tcaggccggcagccccagcct

SEQ ID NO: 3522759 - DNA, 20 bp, Homo sapiens
tcaggcgatccacctgtctc

SEQ ID NO: 3522760 - DNA, 16 bp, Homo sapiens
tcaggctcgccaaggc

SEQ ID NO: 3522761 - DNA, 19 bp, Homo sapiens
tcagggaaaagcagctctc

SEQ ID NO: 3522762 - DNA, 14 bp, Homo sapiens
tcagggaaatggcc

SEQ ID NO: 3522763 - DNA, 17 bp, Homo sapiens
tcagggaaatggccttc

SEQ ID NO: 3522764 - DNA, 20 bp, Homo sapiens
tcagggaaatggccttcccg

SEQ ID NO: 3522765 - DNA, 19 bp, Homo sapiens
tcagggaggccctgtgccc

SEQ ID NO: 3522766 - DNA, 14 bp, Homo sapiens
tcagggcaggtggg

SEQ ID NO: 3522767 - DNA, 18 bp, Homo sapiens
tcagggcattgcctgtga

SEQ ID NO: 3522768 - DNA, 19 bp, Homo sapiens
tcagggcattgcctgtgac

SEQ ID NO: 3522769 - DNA, 19 bp, Homo sapiens
tcagggccatgctgaggcc

SEQ ID NO: 3522770 - DNA, 12 bp, Homo sapiens
tcaggggtgtgc

SEQ ID NO: 3522771 - DNA, 17 bp, Homo sapiens
tcagggtctctgctgcc

SEQ ID NO: 3522772 - DNA, 18 bp, Homo sapiens
tcagggttggcccctgcc

SEQ ID NO: 3522773 - DNA, 23 bp, Homo sapiens
tcaggtaacaggcagatacagga

SEQ ID NO: 3522774 - DNA, 14 bp, Homo sapiens
tcaggtacttgtaa

SEQ ID NO: 3522775 - DNA, 16 bp, Homo sapiens
tcaggtaggggggaaa

SEQ ID NO: 3522776 - DNA, 15 bp, Homo sapiens
tcaggtgagaagcag

SEQ ID NO: 3522777 - DNA, 16 bp, Homo sapiens
tcaggtgatccaccca

SEQ ID NO: 3522778 - DNA, 15 bp, Homo sapiens
tcaggtgctgccatc

SEQ ID NO: 3522779 - DNA, 17 bp, Homo sapiens
tcaggtggggcagcttg

SEQ ID NO: 3522780 - DNA, 18 bp, Homo sapiens
tcaggtggggcagcttga

SEQ ID NO: 3522781 - DNA, 20 bp, Homo sapiens
tcaggtggggcagcttgagg

SEQ ID NO: 3522782 - DNA, 17 bp, Homo sapiens
tcagtataaacaaagtt

SEQ ID NO: 3522783 - DNA, 16 bp, Homo sapiens
tcagtcaatattttta

SEQ ID NO: 3522784 - DNA, 21 bp, Homo sapiens
tcagtctgattcccaagctct

SEQ ID NO: 3522785 - DNA, 24 bp, Homo sapiens
tcagtctgattcccaagctctgct

SEQ ID NO: 3522786 - DNA, 13 bp, Homo sapiens
tcagtgctccctc

SEQ ID NO: 3522787 - DNA, 14 bp, Homo sapiens
tcagtggcagctgc

SEQ ID NO: 3522788 - DNA, 17 bp, Homo sapiens
tcagtggggctctctga

SEQ ID NO: 3522789 - DNA, 14 bp, Homo sapiens
tcagtgtatttgta

SEQ ID NO: 3522790 - DNA, 15 bp, Homo sapiens
tcagtgtatttgtat

SEQ ID NO: 3522791 - DNA, 18 bp, Homo sapiens
tcagtgttgttgctctag

SEQ ID NO: 3522792 - DNA, 23 bp, Homo sapiens
tcagtgttttggactccatctct

SEQ ID NO: 3522793 - DNA, 17 bp, Homo sapiens
tcagttaattcttagat

SEQ ID NO: 3522794 - DNA, 18 bp, Homo sapiens
tcagttacccactcggtc

SEQ ID NO: 3522795 - DNA, 15 bp, Homo sapiens
tcagttattggtgga

SEQ ID NO: 3522796 - DNA, 20 bp, Homo sapiens
tcagttcagaatcacttctg

SEQ ID NO: 3522797 - DNA, 15 bp, Homo sapiens
tcagttctgccttat

SEQ ID NO: 3522798 - DNA, 12 bp, Homo sapiens
tcagttgcagcc

SEQ ID NO: 3522799 - DNA, 20 bp, Homo sapiens
tcagttgtccttaaatttgt

SEQ ID NO: 3522800 - DNA, 23 bp, Homo sapiens
tcagtttaatgcaagagaacatt

SEQ ID NO: 3522801 - DNA, 17 bp, Homo sapiens
tcagtttttgtgaaaag

SEQ ID NO: 3522802 - DNA, 20 bp, Homo sapiens
tcataaaaagcaaaacaaaa

SEQ ID NO: 3522803 - DNA, 24 bp, Homo sapiens
tcataaagaggcgttgctttcact

SEQ ID NO: 3522804 - DNA, 15 bp, Homo sapiens
tcataagtatttcaa

SEQ ID NO: 3522805 - DNA, 22 bp, Homo sapiens
tcataattttagtaatttccta

SEQ ID NO: 3522806 - DNA, 13 bp, Homo sapiens
tcatagaaattct

SEQ ID NO: 3522807 - DNA, 18 bp, Homo sapiens
tcatagcagattttaatt

SEQ ID NO: 3522808 - DNA, 18 bp, Homo sapiens
tcatagtaacttcttatg

SEQ ID NO: 3522809 - DNA, 22 bp, Homo sapiens
tcatagtagtttttacagctgt

SEQ ID NO: 3522810 - DNA, 20 bp, Homo sapiens
tcatatgacattcatgcctg

SEQ ID NO: 3522811 - DNA, 15 bp, Homo sapiens
tcatatggtaggaac

SEQ ID NO: 3522812 - DNA, 18 bp, Homo sapiens
tcatattctaaaaccatt

SEQ ID NO: 3522813 - DNA, 12 bp, Homo sapiens
tcatattgaata

SEQ ID NO: 3522814 - DNA, 14 bp, Homo sapiens
tcatattgaatata

SEQ ID NO: 3522815 - DNA, 15 bp, Homo sapiens
tcatcaaggcactgc

SEQ ID NO: 3522816 - DNA, 16 bp, Homo sapiens
tcatcaaggcactgcc

SEQ ID NO: 3522817 - DNA, 18 bp, Homo sapiens
tcatcatgagttctgctg

SEQ ID NO: 3522818 - DNA, 15 bp, Homo sapiens
tcatcattccctctc

SEQ ID NO: 3522819 - DNA, 14 bp, Homo sapiens
tccctctaatttat

SEQ ID NO: 3522820 - DNA, 20 bp, Homo sapiens
tccctctaggctctgccttc

SEQ ID NO: 3522821 - DNA, 13 bp, Homo sapiens
tccctctatttat

SEQ ID NO: 3522822 - DNA, 12 bp, Homo sapiens
tccctctgaccc

SEQ ID NO: 3522823 - DNA, 20 bp, Homo sapiens
tccctctgggggctctggcc

SEQ ID NO: 3522824 - DNA, 22 bp, Homo sapiens
tccctctgggggctctggccaa

SEQ ID NO: 3522825 - DNA, 16 bp, Homo sapiens
tccctcttctttcaga

SEQ ID NO: 3522826 - DNA, 17 bp, Homo sapiens
tccctgaccctgtatat

SEQ ID NO: 3522827 - DNA, 21 bp, Homo sapiens
tccctgacctccctctaattt

SEQ ID NO: 3522828 - DNA, 16 bp, Homo sapiens
tccctgactcattctg

SEQ ID NO: 3522829 - DNA, 19 bp, Homo sapiens
tccctgactcattctgaag

SEQ ID NO: 3522830 - DNA, 14 bp, Homo sapiens
tccctgactgggag

SEQ ID NO: 3522831 - DNA, 22 bp, Homo sapiens
tccctgagaaacccaccagcct

SEQ ID NO: 3522832 - DNA, 20 bp, Homo sapiens
tccctgcactccctcctgga

SEQ ID NO: 3522833 - DNA, 14 bp, Homo sapiens
tccctgcacttgca

SEQ ID NO: 3522834 - DNA, 20 bp, Homo sapiens
tccctgcacttgcagactct

SEQ ID NO: 3522835 - DNA, 21 bp, Homo sapiens
tccctgcatctgaccagcagc

SEQ ID NO: 3522836 - DNA, 16 bp, Homo sapiens
tccctgcgcctgtgat

SEQ ID NO: 3522837 - DNA, 15 bp, Homo sapiens
tccctggcttctgtg

SEQ ID NO: 3522838 - DNA, 16 bp, Homo sapiens
tccctggttctgatga

SEQ ID NO: 3522839 - DNA, 17 bp, Homo sapiens
tccctgtctttcctaag

SEQ ID NO: 3522840 - DNA, 18 bp, Homo sapiens
tccctgttccccagagaa

SEQ ID NO: 3522841 - DNA, 19 bp, Homo sapiens
tccctgttttcccacgagg

SEQ ID NO: 3522842 - DNA, 14 bp, Homo sapiens
tcccttcggccaaa

SEQ ID NO: 3522843 - DNA, 15 bp, Homo sapiens
tcccttctgctactg

SEQ ID NO: 3522844 - DNA, 17 bp, Homo sapiens
tcccttctgtccctcac

SEQ ID NO: 3522845 - DNA, 22 bp, Homo sapiens
tcccttctgtccctcacagcac

SEQ ID NO: 3522846 - DNA, 14 bp, Homo sapiens
tcccttgggctccc

SEQ ID NO: 3522847 - DNA, 15 bp, Homo sapiens
tccctttctcccctg

SEQ ID NO: 3522848 - DNA, 16 bp, Homo sapiens
tccctttctcccctgc

SEQ ID NO: 3522849 - DNA, 17 bp, Homo sapiens
tccctttctcccctgcc

SEQ ID NO: 3522850 - DNA, 23 bp, Homo sapiens
tccctttctcccctgcccccagg

SEQ ID NO: 3522851 - DNA, 13 bp, Homo sapiens
tcccttttacata

SEQ ID NO: 3522852 - DNA, 15 bp, Homo sapiens
tccctttttgaagtg

SEQ ID NO: 3522853 - DNA, 22 bp, Homo sapiens
tccgaaagggacttggaagctc

SEQ ID NO: 3522854 - DNA, 15 bp, Homo sapiens
tccgaacctcctctg

SEQ ID NO: 3522855 - DNA, 23 bp, Homo sapiens
tccgacgctgcctctcattggca

SEQ ID NO: 3522856 - DNA, 15 bp, Homo sapiens
tccgatgaattctta

SEQ ID NO: 3522857 - DNA, 14 bp, Homo sapiens
tccgcatccctacc

SEQ ID NO: 3522858 - DNA, 14 bp, Homo sapiens
tccgccctgccact

SEQ ID NO: 3522859 - DNA, 15 bp, Homo sapiens
tccgccctgccactc

SEQ ID NO: 3522860 - DNA, 16 bp, Homo sapiens
tccgccctgccactca

SEQ ID NO: 3522861 - DNA, 18 bp, Homo sapiens
tccggaatgccacccaca

SEQ ID NO: 3522862 - DNA, 15 bp, Homo sapiens
tccggagtagctggg

SEQ ID NO: 3522863 - DNA, 12 bp, Homo sapiens
tccggctcccag

SEQ ID NO: 3522864 - DNA, 16 bp, Homo sapiens
tccggctcccagcctc

SEQ ID NO: 3522865 - DNA, 19 bp, Homo sapiens
tccggctgtgctgggagaa

SEQ ID NO: 3522866 - DNA, 17 bp, Homo sapiens
tccggtccctgtcccag

SEQ ID NO: 3522867 - DNA, 20 bp, Homo sapiens
tccgtagccagctgctcccc

SEQ ID NO: 3522868 - DNA, 22 bp, Homo sapiens
tccgtaggtagatgtgtaacct

SEQ ID NO: 3522869 - DNA, 17 bp, Homo sapiens
tccgtgctgacagctgc

SEQ ID NO: 3522870 - DNA, 16 bp, Homo sapiens
tccgtgggacggtgcc

SEQ ID NO: 3522871 - DNA, 13 bp, Homo sapiens
tccgttggccact

SEQ ID NO: 3522872 - DNA, 15 bp, Homo sapiens
tccgttggccactcc

SEQ ID NO: 3522873 - DNA, 14 bp, Homo sapiens
tccgtttgaccaat

SEQ ID NO: 3522874 - DNA, 22 bp, Homo sapiens
tcctaaaacaaaagctcatcca

SEQ ID NO: 3522875 - DNA, 17 bp, Homo sapiens
tcctaaaataagggcag

SEQ ID NO: 3522876 - DNA, 14 bp, Homo sapiens
tcctaagcctgtgg

SEQ ID NO: 3522877 - DNA, 20 bp, Homo sapiens
tcctaagcctgtggctgtgg

SEQ ID NO: 3522878 - DNA, 14 bp, Homo sapiens
tcctaatcatccaa

SEQ ID NO: 3522879 - DNA, 12 bp, Homo sapiens
tcctacattttc

SEQ ID NO: 3522880 - DNA, 15 bp, Homo sapiens
tcctacccatccccg

SEQ ID NO: 3522881 - DNA, 15 bp, Homo sapiens
tcctaccctgcgccc

SEQ ID NO: 3522882 - DNA, 20 bp, Homo sapiens
tcctaccctgcgcccagtcc

SEQ ID NO: 3522883 - DNA, 11 bp, Homo sapiens
tcctactccag

SEQ ID NO: 3522884 - DNA, 18 bp, Homo sapiens
tcctagaggccctttgct

SEQ ID NO: 3522885 - DNA, 21 bp, Homo sapiens
tcctagagggaggggcctagg

SEQ ID NO: 3522886 - DNA, 21 bp, Homo sapiens
tcctagatggcagtcactgaa

SEQ ID NO: 3522887 - DNA, 22 bp, Homo sapiens
tcctagatggcagtcactgaat

SEQ ID NO: 3522888 - DNA, 17 bp, Homo sapiens
tcctagcacatgcttca

SEQ ID NO: 3522889 - DNA, 18 bp, Homo sapiens
tcctaggagtatcctcat

SEQ ID NO: 3522890 - DNA, 19 bp, Homo sapiens
tcctaggcaggacatgctg

SEQ ID NO: 3522891 - DNA, 13 bp, Homo sapiens
tcctaggcatttg

SEQ ID NO: 3522892 - DNA, 19 bp, Homo sapiens
tcctaggcatttgctgaat

SEQ ID NO: 3522893 - DNA, 21 bp, Homo sapiens
tcctagttaatcatcattttt

SEQ ID NO: 3522894 - DNA, 17 bp, Homo sapiens
tcctagttctgtagaaa

SEQ ID NO: 3522895 - DNA, 19 bp, Homo sapiens
tcctagttctgtagaaatg

SEQ ID NO: 3522896 - DNA, 16 bp, Homo sapiens
tcctagttttcctact

SEQ ID NO: 3522897 - DNA, 18 bp, Homo sapiens
tcctatacgcagcgtgct

SEQ ID NO: 3522898 - DNA, 15 bp, Homo sapiens
tcctatatagtttat

SEQ ID NO: 3522899 - DNA, 16 bp, Homo sapiens
tcctatatatttctat

SEQ ID NO: 3522900 - DNA, 14 bp, Homo sapiens
tcctatgctttgaa

SEQ ID NO: 3522901 - DNA, 20 bp, Homo sapiens
tcctatgctttgaaacagaa

SEQ ID NO: 3522902 - DNA, 12 bp, Homo sapiens
tcctatgtgtaa

SEQ ID NO: 3522903 - DNA, 19 bp, Homo sapiens
tcctatgtttttgttcaaa

SEQ ID NO: 3522904 - DNA, 14 bp, Homo sapiens
tcctcaaacactgc

SEQ ID NO: 3522905 - DNA, 16 bp, Homo sapiens
tcctcaaacactgcag

SEQ ID NO: 3522906 - DNA, 12 bp, Homo sapiens
tcctcaatccag

SEQ ID NO: 3522907 - DNA, 23 bp, Homo sapiens
tcctcacacttactgtaagacat

SEQ ID NO: 3522908 - DNA, 17 bp, Homo sapiens
tcctcactcccttccca

SEQ ID NO: 3522909 - DNA, 14 bp, Homo sapiens
tcctcagcttatct

SEQ ID NO: 3522910 - DNA, 16 bp, Homo sapiens
tcctcaggcacacagc

SEQ ID NO: 3522911 - DNA, 16 bp, Homo sapiens
tcctcaggtggccatg

SEQ ID NO: 3522912 - DNA, 22 bp, Homo sapiens
tcctcaggtggccatgcctcag

SEQ ID NO: 3522913 - DNA, 23 bp, Homo sapiens
tcctcaggtggccatgcctcagc

SEQ ID NO: 3522914 - DNA, 19 bp, Homo sapiens
tcctcagtgcatttgtgct

SEQ ID NO: 3522915 - DNA, 16 bp, Homo sapiens
tcctcataaaaagcaa

SEQ ID NO: 3522916 - DNA, 22 bp, Homo sapiens
tcctcatagtatggtggctggg

SEQ ID NO: 3522917 - DNA, 18 bp, Homo sapiens
tcctcatccagggctctg

SEQ ID NO: 3522918 - DNA, 12 bp, Homo sapiens
tcctcatctcta

SEQ ID NO: 3522919 - DNA, 20 bp, Homo sapiens
tcctcatgtcttctcacaag

SEQ ID NO: 3522920 - DNA, 17 bp, Homo sapiens
tcctcattagcattttg

SEQ ID NO: 3522921 - DNA, 15 bp, Homo sapiens
tcctcatttctccag

SEQ ID NO: 3522922 - DNA, 19 bp, Homo sapiens
tcctcatttggggtagcta

SEQ ID NO: 3522923 - DNA, 14 bp, Homo sapiens
tcctccaagccagc

SEQ ID NO: 3522924 - DNA, 22 bp, Homo sapiens
tcctccacgttctgctcatcat

SEQ ID NO: 3522925 - DNA, 19 bp, Homo sapiens
tcctccactctcccccacc

SEQ ID NO: 3522926 - DNA, 20 bp, Homo sapiens
tcctccagcagggaaaatgc

SEQ ID NO: 3522927 - DNA, 21 bp, Homo sapiens
tcctccagggatgatcaacag

SEQ ID NO: 3522928 - DNA, 22 bp, Homo sapiens
tcctccagggtgattttatgat

SEQ ID NO: 3522929 - DNA, 17 bp, Homo sapiens
tcctccagtaccttgct

SEQ ID NO: 3522930 - DNA, 18 bp, Homo sapiens
tcctccagtaccttgctt

SEQ ID NO: 3522931 - DNA, 17 bp, Homo sapiens
tcctccatcgcagtgtt

SEQ ID NO: 3522932 - DNA, 18 bp, Homo sapiens
tcctcccacctcagcctc

SEQ ID NO: 3522933 - DNA, 21 bp, Homo sapiens
tcctcccatagatactctctt

SEQ ID NO: 3522934 - DNA, 19 bp, Homo sapiens
tcctccccaaggagacaca

SEQ ID NO: 3522935 - DNA, 17 bp, Homo sapiens
tcctcccctctcttgtc

SEQ ID NO: 3522936 - DNA, 16 bp, Homo sapiens
tcctccctctgaccca

SEQ ID NO: 3522937 - DNA, 20 bp, Homo sapiens
tcctccctgacttttctgtg

SEQ ID NO: 3522938 - DNA, 15 bp, Homo sapiens
tcctcccttctgcta

SEQ ID NO: 3522939 - DNA, 11 bp, Homo sapiens
tcctcctctgt

SEQ ID NO: 3522940 - DNA, 15 bp, Homo sapiens
tcctcctgcagacca

SEQ ID NO: 3522941 - DNA, 17 bp, Homo sapiens
tcctcctgcccacctgt

SEQ ID NO: 3522942 - DNA, 22 bp, Homo sapiens
tcctcctgggccctctctgctc

SEQ ID NO: 3522943 - DNA, 13 bp, Homo sapiens
tcctccttccatg

SEQ ID NO: 3522944 - DNA, 17 bp, Homo sapiens
tcctcgacatcactgtt

SEQ ID NO: 3522945 - DNA, 14 bp, Homo sapiens
tcctcgcaagctgg

SEQ ID NO: 3522946 - DNA, 16 bp, Homo sapiens
tcctcgcaagctgggt

SEQ ID NO: 3522947 - DNA, 18 bp, Homo sapiens
tcctctacaccaattaat

SEQ ID NO: 3522948 - DNA, 17 bp, Homo sapiens
tcctctcacctcagcct

SEQ ID NO: 3522949 - DNA, 21 bp, Homo sapiens
tcctctccccagcccagagac

SEQ ID NO: 3522950 - DNA, 13 bp, Homo sapiens
tcctctctatatt

SEQ ID NO: 3522951 - DNA, 19 bp, Homo sapiens
tcctctctccagatgtttc

SEQ ID NO: 3522952 - DNA, 22 bp, Homo sapiens
tctgctgccgccccacccagat

SEQ ID NO: 3522953 - DNA, 19 bp, Homo sapiens
tctgctggagtttcatgta

SEQ ID NO: 3522954 - DNA, 12 bp, Homo sapiens
tctgctggccca

SEQ ID NO: 3522955 - DNA, 14 bp, Homo sapiens
tctgctggcccagc

SEQ ID NO: 3522956 - DNA, 19 bp, Homo sapiens
tctgcttaaagttgtaaca

SEQ ID NO: 3522957 - DNA, 13 bp, Homo sapiens
tctgcttcagcct

SEQ ID NO: 3522958 - DNA, 13 bp, Homo sapiens
tctgcttcccagg

SEQ ID NO: 3522959 - DNA, 14 bp, Homo sapiens
tctgcttctctgac

SEQ ID NO: 3522960 - DNA, 19 bp, Homo sapiens
tctgcttctctgacttctg

SEQ ID NO: 3522961 - DNA, 20 bp, Homo sapiens
tctgcttgagtcaggtttga

SEQ ID NO: 3522962 - DNA, 19 bp, Homo sapiens
tctgcttgttattagagat

SEQ ID NO: 3522963 - DNA, 13 bp, Homo sapiens
tctggaaatgttc

SEQ ID NO: 3522964 - DNA, 15 bp, Homo sapiens
tctggaaatgttctt

SEQ ID NO: 3522965 - DNA, 22 bp, Homo sapiens
tctggaacccagactcagacat

SEQ ID NO: 3522966 - DNA, 19 bp, Homo sapiens
tctggaacctcagcctggc

SEQ ID NO: 3522967 - DNA, 20 bp, Homo sapiens
tctggaacctcagcctggcc

SEQ ID NO: 3522968 - DNA, 14 bp, Homo sapiens
tctggaagaaaaaa

SEQ ID NO: 3522969 - DNA, 19 bp, Homo sapiens
tctggaatctgaggcatcc

SEQ ID NO: 3522970 - DNA, 20 bp, Homo sapiens
tctggagcttaattttctgt

SEQ ID NO: 3522971 - DNA, 21 bp, Homo sapiens
tctggaggggagggggatccg

SEQ ID NO: 3522972 - DNA, 16 bp, Homo sapiens
tctggcatctcccaca

SEQ ID NO: 3522973 - DNA, 15 bp, Homo sapiens
tctggccaagggcca

SEQ ID NO: 3522974 - DNA, 18 bp, Homo sapiens
tctggccaagggccagac

SEQ ID NO: 3522975 - DNA, 13 bp, Homo sapiens
tctggcctcccac

SEQ ID NO: 3522976 - DNA, 14 bp, Homo sapiens
tctggcctcccaca

SEQ ID NO: 3522977 - DNA, 18 bp, Homo sapiens
tctggcgacagttttcct

SEQ ID NO: 3522978 - DNA, 20 bp, Homo sapiens
tctggctccctcttctttca

SEQ ID NO: 3522979 - DNA, 15 bp, Homo sapiens
tctggcttctggcca

SEQ ID NO: 3522980 - DNA, 12 bp, Homo sapiens
tctgggacacag

SEQ ID NO: 3522981 - DNA, 14 bp, Homo sapiens
tctgggacacagtt

SEQ ID NO: 3522982 - DNA, 20 bp, Homo sapiens
tctgggagaaaatcatcaag

SEQ ID NO: 3522983 - DNA, 23 bp, Homo sapiens
tctgggaggaatggacagacaga

SEQ ID NO: 3522984 - DNA, 15 bp, Homo sapiens
tctgggagtcacaca

SEQ ID NO: 3522985 - DNA, 18 bp, Homo sapiens
tctgggagtcaggcccgg

SEQ ID NO: 3522986 - DNA, 20 bp, Homo sapiens
tctgggcaggactcagctcc

SEQ ID NO: 3522987 - DNA, 18 bp, Homo sapiens
tctgggctaccccaccca

SEQ ID NO: 3522988 - DNA, 19 bp, Homo sapiens
tctgggcttggggcttcct

SEQ ID NO: 3522989 - DNA, 21 bp, Homo sapiens
tctgggcttggggcttcctaa

SEQ ID NO: 3522990 - DNA, 15 bp, Homo sapiens
tctggggctctggga

SEQ ID NO: 3522991 - DNA, 13 bp, Homo sapiens
tctgggggctctg

SEQ ID NO: 3522992 - DNA, 16 bp, Homo sapiens
tctgggggctctggcc

SEQ ID NO: 3522993 - DNA, 18 bp, Homo sapiens
tctgggggctctggccaa

SEQ ID NO: 3522994 - DNA, 19 bp, Homo sapiens
tctgggggctctggccaag

SEQ ID NO: 3522995 - DNA, 20 bp, Homo sapiens
tctgggggctctggccaagg

SEQ ID NO: 3522996 - DNA, 15 bp, Homo sapiens
tctgggtcagtggtc

SEQ ID NO: 3522997 - DNA, 16 bp, Homo sapiens
tctgggtccttcctga

SEQ ID NO: 3522998 - DNA, 16 bp, Homo sapiens
tctgggttttctgaaa

SEQ ID NO: 3522999 - DNA, 13 bp, Homo sapiens
tctggtcagagcc

SEQ ID NO: 3523000 - DNA, 20 bp, Homo sapiens
tctggtcagagccacagggt

SEQ ID NO: 3523001 - DNA, 15 bp, Homo sapiens
tctggtcgctcctgc

SEQ ID NO: 3523002 - DNA, 16 bp, Homo sapiens
tctggtctctaggctg

SEQ ID NO: 3523003 - DNA, 17 bp, Homo sapiens
tctggtctctaggctgg

SEQ ID NO: 3523004 - DNA, 14 bp, Homo sapiens
tctggtggccccgt

SEQ ID NO: 3523005 - DNA, 16 bp, Homo sapiens
tctggtggtttgattg

SEQ ID NO: 3523006 - DNA, 17 bp, Homo sapiens
tctggtggtttgattgt

SEQ ID NO: 3523007 - DNA, 17 bp, Homo sapiens
tctggttaggatggcag

SEQ ID NO: 3523008 - DNA, 14 bp, Homo sapiens
tctgtaaaatcttt

SEQ ID NO: 3523009 - DNA, 22 bp, Homo sapiens
tctgtaaaatctttctttctta

SEQ ID NO: 3523010 - DNA, 14 bp, Homo sapiens
tctgtaagaaacct

SEQ ID NO: 3523011 - DNA, 12 bp, Homo sapiens
tctgtacaaagg

SEQ ID NO: 3523012 - DNA, 18 bp, Homo sapiens
tctgtacgtctgacaggc

SEQ ID NO: 3523013 - DNA, 20 bp, Homo sapiens
tctgtacttttcattctctt

SEQ ID NO: 3523014 - DNA, 21 bp, Homo sapiens
tctgtagggaattcttctgtt

SEQ ID NO: 3523015 - DNA, 17 bp, Homo sapiens
tctgtataagtaagaaa

SEQ ID NO: 3523016 - DNA, 15 bp, Homo sapiens
tctgtatatactttt

SEQ ID NO: 3523017 - DNA, 14 bp, Homo sapiens
tctgtatcttttct

SEQ ID NO: 3523018 - DNA, 20 bp, Homo sapiens
tctgtattttttgtttgtat

SEQ ID NO: 3523019 - DNA, 22 bp, Homo sapiens
tctgtcaagagtagttatataa

SEQ ID NO: 3523020 - DNA, 14 bp, Homo sapiens
tctgtcactcaggc

SEQ ID NO: 3523021 - DNA, 20 bp, Homo sapiens
tctgtcatttgagcagggct

SEQ ID NO: 3523022 - DNA, 21 bp, Homo sapiens
tctgtccagctcccgctgtgg

SEQ ID NO: 3523023 - DNA, 13 bp, Homo sapiens
tctgtcccaggtt

SEQ ID NO: 3523024 - DNA, 15 bp, Homo sapiens
tctgtccccccagct

SEQ ID NO: 3523025 - DNA, 21 bp, Homo sapiens
tctgtccccttctctcatctc

SEQ ID NO: 3523026 - DNA, 23 bp, Homo sapiens
tctgtcccttctgtccctcacag

SEQ ID NO: 3523027 - DNA, 15 bp, Homo sapiens
tctgtcctcagcctt

SEQ ID NO: 3523028 - DNA, 16 bp, Homo sapiens
tctgtcctgagaagca

SEQ ID NO: 3523029 - DNA, 12 bp, Homo sapiens
tctgtcctgctg

SEQ ID NO: 3523030 - DNA, 17 bp, Homo sapiens
tctgtcgcccagtctgg

SEQ ID NO: 3523031 - DNA, 21 bp, Homo sapiens
tctgtctcaaaaaataaaaat

SEQ ID NO: 3523032 - DNA, 17 bp, Homo sapiens
tctgtctggtggccccg

SEQ ID NO: 3523033 - DNA, 14 bp, Homo sapiens
tctgtcttcccaaa

SEQ ID NO: 3523034 - DNA, 14 bp, Homo sapiens
tctgtcttgccagc

SEQ ID NO: 3523035 - DNA, 16 bp, Homo sapiens
tctgtcttgccagcca

SEQ ID NO: 3523036 - DNA, 21 bp, Homo sapiens
tctgtcttgccagccagaagc

SEQ ID NO: 3523037 - DNA, 20 bp, Homo sapiens
tctgtgaaatgctggcattt

SEQ ID NO: 3523038 - DNA, 22 bp, Homo sapiens
tctgtgacacatcgttttgggg

SEQ ID NO: 3523039 - DNA, 16 bp, Homo sapiens
tctgtgaccaatgtct

SEQ ID NO: 3523040 - DNA, 18 bp, Homo sapiens
tctgtgaccaatgtcttg

SEQ ID NO: 3523041 - DNA, 16 bp, Homo sapiens
tctgtgagtgaaagtt

SEQ ID NO: 3523042 - DNA, 18 bp, Homo sapiens
tctgtgccttcttttgat

SEQ ID NO: 3523043 - DNA, 19 bp, Homo sapiens
tctgtgggcgggcccagca

SEQ ID NO: 3523044 - DNA, 20 bp, Homo sapiens
tctgtgggcgggcccagcac

SEQ ID NO: 3523045 - DNA, 14 bp, Homo sapiens
tctgtggggactcc

SEQ ID NO: 3523046 - DNA, 22 bp, Homo sapiens
tctgtgtcaggtggggcagctt

SEQ ID NO: 3523047 - DNA, 12 bp, Homo sapiens
tctgtgtctgtg

SEQ ID NO: 3523048 - DNA, 14 bp, Homo sapiens
tctgtgttgccaag

SEQ ID NO: 3523049 - DNA, 16 bp, Homo sapiens
tctgtgttgccaagct

SEQ ID NO: 3523050 - DNA, 23 bp, Homo sapiens
tctgttaggtgtacatcctgcag

SEQ ID NO: 3523051 - DNA, 17 bp, Homo sapiens
tctgttcagtgtaaata

SEQ ID NO: 3523052 - DNA, 13 bp, Homo sapiens
tctgttccttcac

SEQ ID NO: 3523053 - DNA, 16 bp, Homo sapiens
tctgttgcaagtgcaa

SEQ ID NO: 3523054 - DNA, 12 bp, Homo sapiens
tctgttggccag

SEQ ID NO: 3523055 - DNA, 18 bp, Homo sapiens
tctgttggccagtgtgac

SEQ ID NO: 3523056 - DNA, 19 bp, Homo sapiens
tctgttggccagtgtgaca

SEQ ID NO: 3523057 - DNA, 20 bp, Homo sapiens
tctgttggccagtgtgacaa

SEQ ID NO: 3523058 - DNA, 15 bp, Homo sapiens
tctgttgtaagaata

SEQ ID NO: 3523059 - DNA, 12 bp, Homo sapiens
tctgtttcctgt

SEQ ID NO: 3523060 - DNA, 21 bp, Homo sapiens
tctgtttctggaaatgttctt

SEQ ID NO: 3523061 - DNA, 17 bp, Homo sapiens
tctgttttgaaggcaaa

SEQ ID NO: 3523062 - DNA, 18 bp, Homo sapiens
tctgttttgagttttgta

SEQ ID NO: 3523063 - DNA, 20 bp, Homo sapiens
tctgttttgagttttgtagc

SEQ ID NO: 3523064 - DNA, 23 bp, Homo sapiens
tctgttttgtttggcaaggaaag

SEQ ID NO: 3523065 - DNA, 18 bp, Homo sapiens
tcttaaaaagtggaaaaa

SEQ ID NO: 3523066 - DNA, 16 bp, Homo sapiens
tcttaaacacttgcaa

SEQ ID NO: 3523067 - DNA, 14 bp, Homo sapiens
tcttaaagcaaata

SEQ ID NO: 3523068 - DNA, 22 bp, Homo sapiens
tcttaaccagatggttgtgtat

SEQ ID NO: 3523069 - DNA, 18 bp, Homo sapiens
tcttaaggtgaggcctgt

SEQ ID NO: 3523070 - DNA, 14 bp, Homo sapiens
tcttaatataaatt

SEQ ID NO: 3523071 - DNA, 20 bp, Homo sapiens
tcttaatataaattcacttt

SEQ ID NO: 3523072 - DNA, 21 bp, Homo sapiens
tcttaatataaattcactttc

SEQ ID NO: 3523073 - DNA, 22 bp, Homo sapiens
tcttaatgaagtttgaatgtta

SEQ ID NO: 3523074 - DNA, 19 bp, Homo sapiens
tcttacacaagagctggag

SEQ ID NO: 3523075 - DNA, 19 bp, Homo sapiens
tcttaggaagagaaaccag

SEQ ID NO: 3523076 - DNA, 14 bp, Homo sapiens
tcttataatttaaa

SEQ ID NO: 3523077 - DNA, 16 bp, Homo sapiens
tcttatacgcttttct

SEQ ID NO: 3523078 - DNA, 19 bp, Homo sapiens
tcttatacgcttttctttg

SEQ ID NO: 3523079 - DNA, 15 bp, Homo sapiens
tcttatactgtacaa

SEQ ID NO: 3523080 - DNA, 18 bp, Homo sapiens
tcttatactgtacaataa

SEQ ID NO: 3523081 - DNA, 13 bp, Homo sapiens
tcttatcaagcag

SEQ ID NO: 3523082 - DNA, 21 bp, Homo sapiens
tcttatgctctcactgtttgt

SEQ ID NO: 3523083 - DNA, 15 bp, Homo sapiens
tcttatggaattgat

SEQ ID NO: 3523084 - DNA, 17 bp, Homo sapiens
tcttatggaattgattt

SEQ ID NO: 3523085 - DNA, 22 bp, Homo sapiens
tctttgcaaagtattgtaaatt

SEQ ID NO: 3523086 - DNA, 14 bp, Homo sapiens
tctttgcagacagg

SEQ ID NO: 3523087 - DNA, 13 bp, Homo sapiens
tctttgctgcaga

SEQ ID NO: 3523088 - DNA, 12 bp, Homo sapiens
tctttgctttgc

SEQ ID NO: 3523089 - DNA, 17 bp, Homo sapiens
tctttgctttgcccagc

SEQ ID NO: 3523090 - DNA, 13 bp, Homo sapiens
tctttgctttgct

SEQ ID NO: 3523091 - DNA, 23 bp, Homo sapiens
tctttgctttgctttctgctcag

SEQ ID NO: 3523092 - DNA, 15 bp, Homo sapiens
tctttgggaatattt

SEQ ID NO: 3523093 - DNA, 18 bp, Homo sapiens
tctttgggaatatttgaa

SEQ ID NO: 3523094 - DNA, 18 bp, Homo sapiens
tctttgggaatgtttgtc

SEQ ID NO: 3523095 - DNA, 15 bp, Homo sapiens
tctttgggccagaca

SEQ ID NO: 3523096 - DNA, 17 bp, Homo sapiens
tctttgtaccatctgtc

SEQ ID NO: 3523097 - DNA, 13 bp, Homo sapiens
tctttgtggccaa

SEQ ID NO: 3523098 - DNA, 23 bp, Homo sapiens
tctttgtggccaaggagctgcta

SEQ ID NO: 3523099 - DNA, 20 bp, Homo sapiens
tctttgtgggtttttcatct

SEQ ID NO: 3523100 - DNA, 15 bp, Homo sapiens
tctttgttataccat

SEQ ID NO: 3523101 - DNA, 13 bp, Homo sapiens
tcttttaaaagac

SEQ ID NO: 3523102 - DNA, 21 bp, Homo sapiens
tcttttaatgaggaccaatgt

SEQ ID NO: 3523103 - DNA, 15 bp, Homo sapiens
tcttttacctgctgc

SEQ ID NO: 3523104 - DNA, 22 bp, Homo sapiens
tcttttccaaaataaaacaaag

SEQ ID NO: 3523105 - DNA, 18 bp, Homo sapiens
tcttttctagtctgagct

SEQ ID NO: 3523106 - DNA, 17 bp, Homo sapiens
tcttttgaattgttaca

SEQ ID NO: 3523107 - DNA, 13 bp, Homo sapiens
tcttttgcttttg

SEQ ID NO: 3523108 - DNA, 19 bp, Homo sapiens
tcttttgtaataaactatt

SEQ ID NO: 3523109 - DNA, 10 bp, Homo sapiens
tcttttgtat

SEQ ID NO: 3523110 - DNA, 11 bp, Homo sapiens
tcttttgtatg

SEQ ID NO: 3523111 - DNA, 15 bp, Homo sapiens
tcttttgtatgtaaa

SEQ ID NO: 3523112 - DNA, 14 bp, Homo sapiens
tctttttaaggaca

SEQ ID NO: 3523113 - DNA, 22 bp, Homo sapiens
tctttttcaggctcgccaaggc

SEQ ID NO: 3523114 - DNA, 20 bp, Homo sapiens
tctttttcgccaaactgtct

SEQ ID NO: 3523115 - DNA, 11 bp, Homo sapiens
tctttttgggg

SEQ ID NO: 3523116 - DNA, 12 bp, Homo sapiens
tctttttgggga

SEQ ID NO: 3523117 - DNA, 17 bp, Homo sapiens
tctttttgtttgtttgt

SEQ ID NO: 3523118 - DNA, 18 bp, Homo sapiens
tctttttttaactggtga

SEQ ID NO: 3523119 - DNA, 18 bp, Homo sapiens
tctttttttattaaacag

SEQ ID NO: 3523120 - DNA, 22 bp, Homo sapiens
tgaaaaaatagagcctgaggga

SEQ ID NO: 3523121 - DNA, 11 bp, Homo sapiens
tgaaaaacaag

SEQ ID NO: 3523122 - DNA, 19 bp, Homo sapiens
tgaaaaagttaatgcttaa

SEQ ID NO: 3523123 - DNA, 18 bp, Homo sapiens
tgaaaacactgtgcacat

SEQ ID NO: 3523124 - DNA, 16 bp, Homo sapiens
tgaaaacccagactgt

SEQ ID NO: 3523125 - DNA, 12 bp, Homo sapiens
tgaaaaggaatc

SEQ ID NO: 3523126 - DNA, 12 bp, Homo sapiens
tgaaaagtcaaa

SEQ ID NO: 3523127 - DNA, 16 bp, Homo sapiens
tgaaaatcgtgacaac

SEQ ID NO: 3523128 - DNA, 14 bp, Homo sapiens
tgaaaatgtcttgt

SEQ ID NO: 3523129 - DNA, 9 bp, Homo sapiens
tgaaacagc

SEQ ID NO: 3523130 - DNA, 13 bp, Homo sapiens
tgaaacagctgcc

SEQ ID NO: 3523131 - DNA, 14 bp, Homo sapiens
tgaaacagctgcct

SEQ ID NO: 3523132 - DNA, 20 bp, Homo sapiens
tgaaacccagtcactgtgag

SEQ ID NO: 3523133 - DNA, 20 bp, Homo sapiens
tgaaacctacacactgtcat

SEQ ID NO: 3523134 - DNA, 20 bp, Homo sapiens
tgaaacgctcctttgtgtgt

SEQ ID NO: 3523135 - DNA, 13 bp, Homo sapiens
tgaaactatattt

SEQ ID NO: 3523136 - DNA, 19 bp, Homo sapiens
tgaaactatattttgtcat

SEQ ID NO: 3523137 - DNA, 13 bp, Homo sapiens
tgaaactccacct

SEQ ID NO: 3523138 - DNA, 22 bp, Homo sapiens
tgaaactttgaggataactttt

SEQ ID NO: 3523139 - DNA, 16 bp, Homo sapiens
tgaaagactgaagaaa

SEQ ID NO: 3523140 - DNA, 15 bp, Homo sapiens
tgaaaggaacatttt

SEQ ID NO: 3523141 - DNA, 13 bp, Homo sapiens
tgaaagggcccag

SEQ ID NO: 3523142 - DNA, 18 bp, Homo sapiens
tgaaagggcccagagagg

SEQ ID NO: 3523143 - DNA, 12 bp, Homo sapiens
tgaaagtataat

SEQ ID NO: 3523144 - DNA, 19 bp, Homo sapiens
tgaaagtgaggaaataaag

SEQ ID NO: 3523145 - DNA, 15 bp, Homo sapiens
tgaaagttgtacatg

SEQ ID NO: 3523146 - DNA, 18 bp, Homo sapiens
tgaaagttgtacatgaaa

SEQ ID NO: 3523147 - DNA, 19 bp, Homo sapiens
tgaaataaaactggctttg

SEQ ID NO: 3523148 - DNA, 20 bp, Homo sapiens
tgaaataaagaaccagtccc

SEQ ID NO: 3523149 - DNA, 20 bp, Homo sapiens
tgaaataactggaacaaatt

SEQ ID NO: 3523150 - DNA, 15 bp, Homo sapiens
tgaaatatgctcttt

SEQ ID NO: 3523151 - DNA, 17 bp, Homo sapiens
tgaaatctaatatttct

SEQ ID NO: 3523152 - DNA, 15 bp, Homo sapiens
tgaaatctgtcaaga

SEQ ID NO: 3523153 - DNA, 19 bp, Homo sapiens
tgaaatgaggtcagagcct

SEQ ID NO: 3523154 - DNA, 16 bp, Homo sapiens
tgaaatgctggcattt

SEQ ID NO: 3523155 - DNA, 17 bp, Homo sapiens
tgaaatgtggttttcct

SEQ ID NO: 3523156 - DNA, 14 bp, Homo sapiens
tgaaattctcctgg

SEQ ID NO: 3523157 - DNA, 16 bp, Homo sapiens
tgaaattctcctggag

SEQ ID NO: 3523158 - DNA, 18 bp, Homo sapiens
tgaaattctgaatttgca

SEQ ID NO: 3523159 - DNA, 21 bp, Homo sapiens
tgaaattctgaatttgcaaag

SEQ ID NO: 3523160 - DNA, 17 bp, Homo sapiens
tgaacaaagcagccacg

SEQ ID NO: 3523161 - DNA, 17 bp, Homo sapiens
tgaacacttaaattatg

SEQ ID NO: 3523162 - DNA, 16 bp, Homo sapiens
tgaacagaagctctta

SEQ ID NO: 3523163 - DNA, 22 bp, Homo sapiens
tgaacattagttgcactaactg

SEQ ID NO: 3523164 - DNA, 14 bp, Homo sapiens
tgaaccaatgcaag

SEQ ID NO: 3523165 - DNA, 19 bp, Homo sapiens
tgaaccacatcttgctctg

SEQ ID NO: 3523166 - DNA, 20 bp, Homo sapiens
tgaaccacatcttgctctgc

SEQ ID NO: 3523167 - DNA, 21 bp, Homo sapiens
tgaaccaccacacccagccca

SEQ ID NO: 3523168 - DNA, 14 bp, Homo sapiens
tgaacccctggctc

SEQ ID NO: 3523169 - DNA, 17 bp, Homo sapiens
tgaacccctggctcctt

SEQ ID NO: 3523170 - DNA, 13 bp, Homo sapiens
tgaaccctcagcc

SEQ ID NO: 3523171 - DNA, 14 bp, Homo sapiens
tgaaccctcagcct

SEQ ID NO: 3523172 - DNA, 15 bp, Homo sapiens
tgaaccctggggcct

SEQ ID NO: 3523173 - DNA, 15 bp, Homo sapiens
tgaacccttgcttgc

SEQ ID NO: 3523174 - DNA, 17 bp, Homo sapiens
tgaacctatgaagcaat

SEQ ID NO: 3523175 - DNA, 16 bp, Homo sapiens
tgaacgtccacatgaa

SEQ ID NO: 3523176 - DNA, 20 bp, Homo sapiens
tgaactaccttggttccccc

SEQ ID NO: 3523177 - DNA, 11 bp, Homo sapiens
tgaactcctgg

SEQ ID NO: 3523178 - DNA, 14 bp, Homo sapiens
tgaactcctggcct

SEQ ID NO: 3523179 - DNA, 18 bp, Homo sapiens
tgaactggaccctgttgc

SEQ ID NO: 3523180 - DNA, 20 bp, Homo sapiens
tgaactggaccctgttgcta

SEQ ID NO: 3523181 - DNA, 23 bp, Homo sapiens
tgaactggaccctgttgctaagc

SEQ ID NO: 3523182 - DNA, 15 bp, Homo sapiens
tgaactggtcttcct

SEQ ID NO: 3523183 - DNA, 20 bp, Homo sapiens
tgaacttactgtagcctcag

SEQ ID NO: 3523184 - DNA, 13 bp, Homo sapiens
tgaactttcctgg

SEQ ID NO: 3523185 - DNA, 15 bp, Homo sapiens
tgaagaacagtaact

SEQ ID NO: 3523186 - DNA, 20 bp, Homo sapiens
tgaagaactgcaggccctgg

SEQ ID NO: 3523187 - DNA, 22 bp, Homo sapiens
tgaagaagttcagaaatttaaa

SEQ ID NO: 3523188 - DNA, 16 bp, Homo sapiens
tgaagaatccttttgt

SEQ ID NO: 3523189 - DNA, 17 bp, Homo sapiens
tgaagactggaagctaa

SEQ ID NO: 3523190 - DNA, 21 bp, Homo sapiens
tgaagagaaaaaagtcaccat

SEQ ID NO: 3523191 - DNA, 17 bp, Homo sapiens
tgaagagaaaaaggctg

SEQ ID NO: 3523192 - DNA, 19 bp, Homo sapiens
tgaagagtgggtttcacaa

SEQ ID NO: 3523193 - DNA, 23 bp, Homo sapiens
tgaagataagtgtatttttcaat

SEQ ID NO: 3523194 - DNA, 12 bp, Homo sapiens
tgaagatgaaca

SEQ ID NO: 3523195 - DNA, 20 bp, Homo sapiens
tgaagcaaggcggtggactt

SEQ ID NO: 3523196 - DNA, 18 bp, Homo sapiens
tgaagcaatggatatttg

SEQ ID NO: 3523197 - DNA, 13 bp, Homo sapiens
tgaagcagcctct

SEQ ID NO: 3523198 - DNA, 11 bp, Homo sapiens
tgaagccagct

SEQ ID NO: 3523199 - DNA, 13 bp, Homo sapiens
tgaagcctttctt

SEQ ID NO: 3523200 - DNA, 18 bp, Homo sapiens
tgaagcctttcttttgga

SEQ ID NO: 3523201 - DNA, 17 bp, Homo sapiens
tgaagctaatgaccaac

SEQ ID NO: 3523202 - DNA, 16 bp, Homo sapiens
tgaagctgctgtctct

SEQ ID NO: 3523203 - DNA, 17 bp, Homo sapiens
tgaagctgctgtctcta

SEQ ID NO: 3523204 - DNA, 15 bp, Homo sapiens
tgaaggaacttgtct

SEQ ID NO: 3523205 - DNA, 20 bp, Homo sapiens
tgaaggaatatatggcagag

SEQ ID NO: 3523206 - DNA, 11 bp, Homo sapiens
tgaaggagccc

SEQ ID NO: 3523207 - DNA, 14 bp, Homo sapiens
tgaaggcaaaattg

SEQ ID NO: 3523208 - DNA, 15 bp, Homo sapiens
tgaaggccctgctga

SEQ ID NO: 3523209 - DNA, 19 bp, Homo sapiens
tgaaggccgagaagcaaga

SEQ ID NO: 3523210 - DNA, 12 bp, Homo sapiens
tgaaggctggca

SEQ ID NO: 3523211 - DNA, 14 bp, Homo sapiens
tgaagggccagagc

SEQ ID NO: 3523212 - DNA, 21 bp, Homo sapiens
tgaaggtaaaattgaaaggca

SEQ ID NO: 3523213 - DNA, 22 bp, Homo sapiens
tgaaggtttacaatttacaaag

SEQ ID NO: 3523214 - DNA, 13 bp, Homo sapiens
tgaagtcacacag

SEQ ID NO: 3523215 - DNA, 14 bp, Homo sapiens
tgaagtcctggctt

SEQ ID NO: 3523216 - DNA, 16 bp, Homo sapiens
tgaagtgtaggcagac

SEQ ID NO: 3523217 - DNA, 18 bp, Homo sapiens
tgaagtgtaggcagacac

SEQ ID NO: 3523218 - DNA, 19 bp, Homo sapiens
tgaagtgtaggcagacaca

SEQ ID NO: 3523219 - DNA, 18 bp, Homo sapiens
tgattccttcctgttctg

SEQ ID NO: 3523220 - DNA, 11 bp, Homo sapiens
tgattctcagg

SEQ ID NO: 3523221 - DNA, 12 bp, Homo sapiens
tgattctcaggg

SEQ ID NO: 3523222 - DNA, 21 bp, Homo sapiens
tgattctcagggtctctgctg

SEQ ID NO: 3523223 - DNA, 15 bp, Homo sapiens
tgattctcctgcctc

SEQ ID NO: 3523224 - DNA, 12 bp, Homo sapiens
tgattctccttc

SEQ ID NO: 3523225 - DNA, 21 bp, Homo sapiens
tgattgacagctttgctgctg

SEQ ID NO: 3523226 - DNA, 14 bp, Homo sapiens
tgattgatttgaag

SEQ ID NO: 3523227 - DNA, 22 bp, Homo sapiens
tgattggacaggcatgggtgca

SEQ ID NO: 3523228 - DNA, 15 bp, Homo sapiens
tgattgggacagagg

SEQ ID NO: 3523229 - DNA, 21 bp, Homo sapiens
tgattgtcctttaaaaaagaa

SEQ ID NO: 3523230 - DNA, 10 bp, Homo sapiens
tgattgttta

SEQ ID NO: 3523231 - DNA, 12 bp, Homo sapiens
tgatttagccat

SEQ ID NO: 3523232 - DNA, 16 bp, Homo sapiens
tgatttaggagaagcc

SEQ ID NO: 3523233 - DNA, 20 bp, Homo sapiens
tgatttaggagaagccagga

SEQ ID NO: 3523234 - DNA, 14 bp, Homo sapiens
tgatttcctgtgtc

SEQ ID NO: 3523235 - DNA, 15 bp, Homo sapiens
tgatttcctgtgtca

SEQ ID NO: 3523236 - DNA, 19 bp, Homo sapiens
tgatttcctgtgtcaatcc

SEQ ID NO: 3523237 - DNA, 14 bp, Homo sapiens
tgatttccttgaat

SEQ ID NO: 3523238 - DNA, 19 bp, Homo sapiens
tgatttccttgaatgtggc

SEQ ID NO: 3523239 - DNA, 23 bp, Homo sapiens
tgatttccttgaatgtggcttga

SEQ ID NO: 3523240 - DNA, 13 bp, Homo sapiens
tgatttggtgacc

SEQ ID NO: 3523241 - DNA, 20 bp, Homo sapiens
tgatttggtgaccaactgtc

SEQ ID NO: 3523242 - DNA, 20 bp, Homo sapiens
tgatttgtcagagaacctgt

SEQ ID NO: 3523243 - DNA, 12 bp, Homo sapiens
tgattttatgat

SEQ ID NO: 3523244 - DNA, 15 bp, Homo sapiens
tgattttcattgctg

SEQ ID NO: 3523245 - DNA, 18 bp, Homo sapiens
tgcaaaaaaattaaaatg

SEQ ID NO: 3523246 - DNA, 22 bp, Homo sapiens
tgcaaaaaatactttttctaat

SEQ ID NO: 3523247 - DNA, 21 bp, Homo sapiens
tgcaaacgctgcctgcccgta

SEQ ID NO: 3523248 - DNA, 12 bp, Homo sapiens
tgcaaagaaaat

SEQ ID NO: 3523249 - DNA, 19 bp, Homo sapiens
tgcaaagaggcaagaggct

SEQ ID NO: 3523250 - DNA, 13 bp, Homo sapiens
tgcaaagccaagg

SEQ ID NO: 3523251 - DNA, 15 bp, Homo sapiens
tgcaaagccaaggca

SEQ ID NO: 3523252 - DNA, 16 bp, Homo sapiens
tgcaaagccaaggcag

SEQ ID NO: 3523253 - DNA, 17 bp, Homo sapiens
tgcaaagccaaggcagc

SEQ ID NO: 3523254 - DNA, 13 bp, Homo sapiens
tgcaaaggacaga

SEQ ID NO: 3523255 - DNA, 21 bp, Homo sapiens
tgcaaagggtatcaggtgctg

SEQ ID NO: 3523256 - DNA, 12 bp, Homo sapiens
tgcaaagtattg

SEQ ID NO: 3523257 - DNA, 21 bp, Homo sapiens
tgcaaagtcatgcaaaggctg

SEQ ID NO: 3523258 - DNA, 23 bp, Homo sapiens
tgcaaagtcatgcaaaggctggg

SEQ ID NO: 3523259 - DNA, 10 bp, Homo sapiens
tgcaaagtgt

SEQ ID NO: 3523260 - DNA, 10 bp, Homo sapiens
tgcaaatcct

SEQ ID NO: 3523261 - DNA, 14 bp, Homo sapiens
tgcaaatcctatgt

SEQ ID NO: 3523262 - DNA, 20 bp, Homo sapiens
tgcaacaaaatgtagaatat

SEQ ID NO: 3523263 - DNA, 13 bp, Homo sapiens
tgcaacaggctgg

SEQ ID NO: 3523264 - DNA, 17 bp, Homo sapiens
tgcaacaggctgggctt

SEQ ID NO: 3523265 - DNA, 24 bp, Homo sapiens
tgcaacagggtatggactatctgt

SEQ ID NO: 3523266 - DNA, 13 bp, Homo sapiens
tgcaacctccgcc

SEQ ID NO: 3523267 - DNA, 20 bp, Homo sapiens
tgcaacctcgctggactctc

SEQ ID NO: 3523268 - DNA, 19 bp, Homo sapiens
tgcaacctctgcttcccag

SEQ ID NO: 3523269 - DNA, 20 bp, Homo sapiens
tgcaacctctgcttcccagg

SEQ ID NO: 3523270 - DNA, 21 bp, Homo sapiens
tgcaacctctgcttcccaggt

SEQ ID NO: 3523271 - DNA, 20 bp, Homo sapiens
tgcaacctctgtctcccggg

SEQ ID NO: 3523272 - DNA, 14 bp, Homo sapiens
tgcaacctgttgat

SEQ ID NO: 3523273 - DNA, 20 bp, Homo sapiens
tgcaactgctcagctctggt

SEQ ID NO: 3523274 - DNA, 20 bp, Homo sapiens
tgcaagaaaatgatgtgtac

SEQ ID NO: 3523275 - DNA, 21 bp, Homo sapiens
tgcaagaactcatcactgtgg

SEQ ID NO: 3523276 - DNA, 15 bp, Homo sapiens
tgcaagaagtcttga

SEQ ID NO: 3523277 - DNA, 16 bp, Homo sapiens
tgcaagagaacatttt

SEQ ID NO: 3523278 - DNA, 19 bp, Homo sapiens
tgcaagagaacattttact

SEQ ID NO: 3523279 - DNA, 19 bp, Homo sapiens
tgcaagcaggactttgagg

SEQ ID NO: 3523280 - DNA, 19 bp, Homo sapiens
tgcaagcccctctttctgt

SEQ ID NO: 3523281 - DNA, 16 bp, Homo sapiens
tgcaagggactgtgtg

SEQ ID NO: 3523282 - DNA, 21 bp, Homo sapiens
tgcaagggactgtgtgttgcc

SEQ ID NO: 3523283 - DNA, 13 bp, Homo sapiens
tgcaagtgaaggt

SEQ ID NO: 3523284 - DNA, 17 bp, Homo sapiens
tgcaagtgctcagggaa

SEQ ID NO: 3523285 - DNA, 14 bp, Homo sapiens
tgcaataatgcagt

SEQ ID NO: 3523286 - DNA, 18 bp, Homo sapiens
tgcaataatgcagtatgg

SEQ ID NO: 3523287 - DNA, 20 bp, Homo sapiens
tgcaatagaacagagaaaga

SEQ ID NO: 3523288 - DNA, 21 bp, Homo sapiens
tgcaatagaagtgctcccctc

SEQ ID NO: 3523289 - DNA, 14 bp, Homo sapiens
tgcaatggcagcct

SEQ ID NO: 3523290 - DNA, 19 bp, Homo sapiens
tgcaatgtctgagtgaacc

SEQ ID NO: 3523291 - DNA, 18 bp, Homo sapiens
tgcacaaaacccagacct

SEQ ID NO: 3523292 - DNA, 15 bp, Homo sapiens
tgcacaaactcacca

SEQ ID NO: 3523293 - DNA, 21 bp, Homo sapiens
tgcacaagatgccccagggat

SEQ ID NO: 3523294 - DNA, 18 bp, Homo sapiens
tgcacacaccagagccca

SEQ ID NO: 3523295 - DNA, 14 bp, Homo sapiens
tgcacacccactca

SEQ ID NO: 3523296 - DNA, 17 bp, Homo sapiens
tgcacacccactcagct

SEQ ID NO: 3523297 - DNA, 22 bp, Homo sapiens
tgcacactttgccatattttca

SEQ ID NO: 3523298 - DNA, 15 bp, Homo sapiens
tgcacagaagtcctg

SEQ ID NO: 3523299 - DNA, 15 bp, Homo sapiens
tgcacagcttttcca

SEQ ID NO: 3523300 - DNA, 19 bp, Homo sapiens
tgcacagggattctcacaa

SEQ ID NO: 3523301 - DNA, 16 bp, Homo sapiens
tgcacagggcaattga

SEQ ID NO: 3523302 - DNA, 13 bp, Homo sapiens
tgcacatgtttcc

SEQ ID NO: 3523303 - DNA, 15 bp, Homo sapiens
tgcacattcacttag

SEQ ID NO: 3523304 - DNA, 23 bp, Homo sapiens
tgcacattcacttagcagaacct

SEQ ID NO: 3523305 - DNA, 12 bp, Homo sapiens
tgcaccaccaag

SEQ ID NO: 3523306 - DNA, 15 bp, Homo sapiens
tgcaccaccaagcca

SEQ ID NO: 3523307 - DNA, 15 bp, Homo sapiens
tgcaccactgcactc

SEQ ID NO: 3523308 - DNA, 15 bp, Homo sapiens
tgcaccatccctttt

SEQ ID NO: 3523309 - DNA, 23 bp, Homo sapiens
tgcaccatccctttttgaagtgt

SEQ ID NO: 3523310 - DNA, 14 bp, Homo sapiens
tgcacccagcccag

SEQ ID NO: 3523311 - DNA, 15 bp, Homo sapiens
tgcacccccctgggc

SEQ ID NO: 3523312 - DNA, 16 bp, Homo sapiens
tgcacccccctgggct

SEQ ID NO: 3523313 - DNA, 23 bp, Homo sapiens
tgcacctacccatacaccccctc

SEQ ID NO: 3523314 - DNA, 22 bp, Homo sapiens
tgcacctagagcttttttataa

SEQ ID NO: 3523315 - DNA, 22 bp, Homo sapiens
tgcactaaggggcccggccagc

SEQ ID NO: 3523316 - DNA, 23 bp, Homo sapiens
tgcactatagcctaggtgacaga

SEQ ID NO: 3523317 - DNA, 14 bp, Homo sapiens
tgcactcagctctt

SEQ ID NO: 3523318 - DNA, 17 bp, Homo sapiens
tgcactgtaaattgctg

SEQ ID NO: 3523319 - DNA, 13 bp, Homo sapiens
tgcactgttcccc

SEQ ID NO: 3523320 - DNA, 21 bp, Homo sapiens
tgcactgttccccctgtgcag

SEQ ID NO: 3523321 - DNA, 15 bp, Homo sapiens
tgcacttacttgctt

SEQ ID NO: 3523322 - DNA, 20 bp, Homo sapiens
tgcacttatgatttcatgtg

SEQ ID NO: 3523323 - DNA, 21 bp, Homo sapiens
tgcacttgtgattatttatta

SEQ ID NO: 3523324 - DNA, 16 bp, Homo sapiens
tgcactttgtaaattc

SEQ ID NO: 3523325 - DNA, 15 bp, Homo sapiens
tgcagaagagggtgt

SEQ ID NO: 3523326 - DNA, 12 bp, Homo sapiens
tgcagacaggca

SEQ ID NO: 3523327 - DNA, 23 bp, Homo sapiens
tgcagaccacgcccgtcctgcct

SEQ ID NO: 3523328 - DNA, 19 bp, Homo sapiens
tgcagactctacagaggcc

SEQ ID NO: 3523329 - DNA, 15 bp, Homo sapiens
tgcagacttcccagc

SEQ ID NO: 3523330 - DNA, 19 bp, Homo sapiens
tgcagagaaacttaagcaa

SEQ ID NO: 3523331 - DNA, 18 bp, Homo sapiens
tgcagagcacacaggtac

SEQ ID NO: 3523332 - DNA, 17 bp, Homo sapiens
tgcagaggccagaggcc

SEQ ID NO: 3523333 - DNA, 17 bp, Homo sapiens
tgcagataactttgact

SEQ ID NO: 3523334 - DNA, 18 bp, Homo sapiens
tgcagcagggatgccctg

SEQ ID NO: 3523335 - DNA, 19 bp, Homo sapiens
tgcagcagggatgccctgg

SEQ ID NO: 3523336 - DNA, 22 bp, Homo sapiens
tgcagcagggatgccctggagg

SEQ ID NO: 3523337 - DNA, 16 bp, Homo sapiens
tgcagcatatacaata

SEQ ID NO: 3523338 - DNA, 11 bp, Homo sapiens
tgcagccagct

SEQ ID NO: 3523339 - DNA, 21 bp, Homo sapiens
tgcagccctgagaaagccctg

SEQ ID NO: 3523340 - DNA, 14 bp, Homo sapiens
tgcagccctgctgc

SEQ ID NO: 3523341 - DNA, 22 bp, Homo sapiens
tgcagccctgctgctgcctgcc

SEQ ID NO: 3523342 - DNA, 20 bp, Homo sapiens
tgcagcctcaacctcctggg

SEQ ID NO: 3523343 - DNA, 23 bp, Homo sapiens
tgcagcctttgcctccccggctc

SEQ ID NO: 3523344 - DNA, 20 bp, Homo sapiens
tgcagctccctggcttctgt

SEQ ID NO: 3523345 - DNA, 13 bp, Homo sapiens
tgcagctcctcag

SEQ ID NO: 3523346 - DNA, 14 bp, Homo sapiens
tgcagctcctcagc

SEQ ID NO: 3523347 - DNA, 13 bp, Homo sapiens
tgcagctctcttt

SEQ ID NO: 3523348 - DNA, 14 bp, Homo sapiens
tgcagcttttggtc

SEQ ID NO: 3523349 - DNA, 15 bp, Homo sapiens
tgcaggacttgagaa

SEQ ID NO: 3523350 - DNA, 18 bp, Homo sapiens
tgcaggacttgagaagac

SEQ ID NO: 3523351 - DNA, 14 bp, Homo sapiens
tgcaggatggtgtc

SEQ ID NO: 3523352 - DNA, 17 bp, Homo sapiens
tgctgccggcacagctg

SEQ ID NO: 3523353 - DNA, 14 bp, Homo sapiens
tgctgctagatctt

SEQ ID NO: 3523354 - DNA, 15 bp, Homo sapiens
tgctgctagatcttt

SEQ ID NO: 3523355 - DNA, 15 bp, Homo sapiens
tgctgctcctccctc

SEQ ID NO: 3523356 - DNA, 16 bp, Homo sapiens
tgctgctgctcctccc

SEQ ID NO: 3523357 - DNA, 21 bp, Homo sapiens
tgctgctggccaaatagcaaa

SEQ ID NO: 3523358 - DNA, 13 bp, Homo sapiens
tgctgctgtcacc

SEQ ID NO: 3523359 - DNA, 21 bp, Homo sapiens
tgctgctgtccagtgcctaca

SEQ ID NO: 3523360 - DNA, 12 bp, Homo sapiens
tgctgctgtctt

SEQ ID NO: 3523361 - DNA, 12 bp, Homo sapiens
tgctgcttgagg

SEQ ID NO: 3523362 - DNA, 18 bp, Homo sapiens
tgctggaaaataatactg

SEQ ID NO: 3523363 - DNA, 17 bp, Homo sapiens
tgctggaacctgcaaaa

SEQ ID NO: 3523364 - DNA, 18 bp, Homo sapiens
tgctggccaaatagcaaa

SEQ ID NO: 3523365 - DNA, 20 bp, Homo sapiens
tgctggccaaatagcaaaga

SEQ ID NO: 3523366 - DNA, 12 bp, Homo sapiens
tgctggcccagg

SEQ ID NO: 3523367 - DNA, 19 bp, Homo sapiens
tgctggcccagggcccaga

SEQ ID NO: 3523368 - DNA, 23 bp, Homo sapiens
tgctggcgagtgaatgccagtgt

SEQ ID NO: 3523369 - DNA, 19 bp, Homo sapiens
tgctggctgcctctctgct

SEQ ID NO: 3523370 - DNA, 16 bp, Homo sapiens
tgctgggactcagcct

SEQ ID NO: 3523371 - DNA, 22 bp, Homo sapiens
tgctgggactcagccttcagac

SEQ ID NO: 3523372 - DNA, 23 bp, Homo sapiens
tgctgggactcagccttcagaca

SEQ ID NO: 3523373 - DNA, 20 bp, Homo sapiens
tgctgggagctccactctgc

SEQ ID NO: 3523374 - DNA, 21 bp, Homo sapiens
tgctgggagctccactctgct

SEQ ID NO: 3523375 - DNA, 19 bp, Homo sapiens
tgctgggatggtgggcttc

SEQ ID NO: 3523376 - DNA, 19 bp, Homo sapiens
tgctgggattacaagcgtg

SEQ ID NO: 3523377 - DNA, 16 bp, Homo sapiens
tgctggtccgtgggac

SEQ ID NO: 3523378 - DNA, 15 bp, Homo sapiens
tgctgtacatctatt

SEQ ID NO: 3523379 - DNA, 16 bp, Homo sapiens
tgctgtacatctattt

SEQ ID NO: 3523380 - DNA, 18 bp, Homo sapiens
tgctgtaggatctaaggc

SEQ ID NO: 3523381 - DNA, 15 bp, Homo sapiens
tgctgtataaaatca

SEQ ID NO: 3523382 - DNA, 18 bp, Homo sapiens
tgctgtcaagtcccccag

SEQ ID NO: 3523383 - DNA, 15 bp, Homo sapiens
tgctgtcacctctcc

SEQ ID NO: 3523384 - DNA, 14 bp, Homo sapiens
tgctgtccagtgcc

SEQ ID NO: 3523385 - DNA, 21 bp, Homo sapiens
tgctgtcctcaggtggccatg

SEQ ID NO: 3523386 - DNA, 14 bp, Homo sapiens
tgctgtctatgtgg

SEQ ID NO: 3523387 - DNA, 16 bp, Homo sapiens
tgctgtctctctgggc

SEQ ID NO: 3523388 - DNA, 14 bp, Homo sapiens
tgctgtctgcagcc

SEQ ID NO: 3523389 - DNA, 18 bp, Homo sapiens
tgctgtgctgtgctatgg

SEQ ID NO: 3523390 - DNA, 15 bp, Homo sapiens
tgctgtggtgtgtcc

SEQ ID NO: 3523391 - DNA, 11 bp, Homo sapiens
tgctgtgtgcc

SEQ ID NO: 3523392 - DNA, 22 bp, Homo sapiens
tgctgttctcttgggaactgaa

SEQ ID NO: 3523393 - DNA, 20 bp, Homo sapiens
tgctgttggtcctctctctg

SEQ ID NO: 3523394 - DNA, 18 bp, Homo sapiens
tgctgtttcacaatacct

SEQ ID NO: 3523395 - DNA, 16 bp, Homo sapiens
tgctgttttcctccct

SEQ ID NO: 3523396 - DNA, 21 bp, Homo sapiens
tgctgttttcctcccttctgc

SEQ ID NO: 3523397 - DNA, 15 bp, Homo sapiens
tgcttaaagttgtaa

SEQ ID NO: 3523398 - DNA, 17 bp, Homo sapiens
tgcttaaagttgtaaca

SEQ ID NO: 3523399 - DNA, 20 bp, Homo sapiens
tgcttaaagttgtaacaaat

SEQ ID NO: 3523400 - DNA, 15 bp, Homo sapiens
tgcttatgtgtaggt

SEQ ID NO: 3523401 - DNA, 14 bp, Homo sapiens
tgcttcactaggga

SEQ ID NO: 3523402 - DNA, 14 bp, Homo sapiens
tgcttcagcctccc

SEQ ID NO: 3523403 - DNA, 21 bp, Homo sapiens
tgcttcatttttgtaataaca

SEQ ID NO: 3523404 - DNA, 15 bp, Homo sapiens
tgcttccccttttgc

SEQ ID NO: 3523405 - DNA, 13 bp, Homo sapiens
tgcttcctcctgg

SEQ ID NO: 3523406 - DNA, 12 bp, Homo sapiens
tgcttctcactg

SEQ ID NO: 3523407 - DNA, 13 bp, Homo sapiens
tgcttctctgact

SEQ ID NO: 3523408 - DNA, 14 bp, Homo sapiens
tgcttctctgactt

SEQ ID NO: 3523409 - DNA, 20 bp, Homo sapiens
tgcttctctgacttctgcct

SEQ ID NO: 3523410 - DNA, 23 bp, Homo sapiens
tgcttctctgacttctgcctgga

SEQ ID NO: 3523411 - DNA, 17 bp, Homo sapiens
tgcttgaacccaggaga

SEQ ID NO: 3523412 - DNA, 16 bp, Homo sapiens
tgcttgaggaaaacaa

SEQ ID NO: 3523413 - DNA, 23 bp, Homo sapiens
tgcttgagtcaggtttgagtaga

SEQ ID NO: 3523414 - DNA, 17 bp, Homo sapiens
tgcttggagctgagcaa

SEQ ID NO: 3523415 - DNA, 21 bp, Homo sapiens
tgcttgtcatctgcatgtcta

SEQ ID NO: 3523416 - DNA, 19 bp, Homo sapiens
tgctttacagtcaatagtg

SEQ ID NO: 3523417 - DNA, 14 bp, Homo sapiens
tgctttatgctgaa

SEQ ID NO: 3523418 - DNA, 17 bp, Homo sapiens
tgctttatgctgaaaca

SEQ ID NO: 3523419 - DNA, 17 bp, Homo sapiens
tgctttcactctttaga

SEQ ID NO: 3523420 - DNA, 14 bp, Homo sapiens
tgctttccaaacct

SEQ ID NO: 3523421 - DNA, 23 bp, Homo sapiens
tgctttctcctttcaccaccccc

SEQ ID NO: 3523422 - DNA, 22 bp, Homo sapiens
tgctttgaaaaagttaatgctt

SEQ ID NO: 3523423 - DNA, 21 bp, Homo sapiens
tgctttgaaacagaaaaatat

SEQ ID NO: 3523424 - DNA, 13 bp, Homo sapiens
tgctttgctttct

SEQ ID NO: 3523425 - DNA, 22 bp, Homo sapiens
tgctttggacctaaatggcctc

SEQ ID NO: 3523426 - DNA, 17 bp, Homo sapiens
tgctttggcttacttgt

SEQ ID NO: 3523427 - DNA, 15 bp, Homo sapiens
tgctttgggtttgtg

SEQ ID NO: 3523428 - DNA, 16 bp, Homo sapiens
tgcttttaactctaga

SEQ ID NO: 3523429 - DNA, 17 bp, Homo sapiens
tgcttttaactctagaa

SEQ ID NO: 3523430 - DNA, 24 bp, Homo sapiens
tgcttttagtattttagtgaactt

SEQ ID NO: 3523431 - DNA, 14 bp, Homo sapiens
tgcttttgcttcta

SEQ ID NO: 3523432 - DNA, 15 bp, Homo sapiens
tgctttttatttctg

SEQ ID NO: 3523433 - DNA, 19 bp, Homo sapiens
tgctttttatttctgcata

SEQ ID NO: 3523434 - DNA, 17 bp, Homo sapiens
tgctttttgagtttcat

SEQ ID NO: 3523435 - DNA, 17 bp, Homo sapiens
tgcttttttgttttggc

SEQ ID NO: 3523436 - DNA, 17 bp, Homo sapiens
tggaaaaaaaaaagaca

SEQ ID NO: 3523437 - DNA, 17 bp, Homo sapiens
tggaaacctgtcattgt

SEQ ID NO: 3523438 - DNA, 23 bp, Homo sapiens
tggaaagacagcttctcatcctg

SEQ ID NO: 3523439 - DNA, 16 bp, Homo sapiens
tggaaattgacgaggg

SEQ ID NO: 3523440 - DNA, 20 bp, Homo sapiens
tggaacagattcacactgtc

SEQ ID NO: 3523441 - DNA, 15 bp, Homo sapiens
tggaaccaggcttgg

SEQ ID NO: 3523442 - DNA, 16 bp, Homo sapiens
tggaacccagactcag

SEQ ID NO: 3523443 - DNA, 17 bp, Homo sapiens
tggaacccagactcaga

SEQ ID NO: 3523444 - DNA, 19 bp, Homo sapiens
tggaaccgcaggaagctgc

SEQ ID NO: 3523445 - DNA, 20 bp, Homo sapiens
tggaaccgcaggaagctgct

SEQ ID NO: 3523446 - DNA, 23 bp, Homo sapiens
tggaaccgcaggaagctgctccg

SEQ ID NO: 3523447 - DNA, 17 bp, Homo sapiens
tggaacctcagcctggc

SEQ ID NO: 3523448 - DNA, 23 bp, Homo sapiens
tggaacctcagcctggccagaca

SEQ ID NO: 3523449 - DNA, 13 bp, Homo sapiens
tggaactgtttcc

SEQ ID NO: 3523450 - DNA, 21 bp, Homo sapiens
tggaacttagccatttttcaa

SEQ ID NO: 3523451 - DNA, 11 bp, Homo sapiens
tggaagacaca

SEQ ID NO: 3523452 - DNA, 21 bp, Homo sapiens
tggaagagcccagtctgttga

SEQ ID NO: 3523453 - DNA, 14 bp, Homo sapiens
tggaagatcctgtg

SEQ ID NO: 3523454 - DNA, 18 bp, Homo sapiens
tggaagatcctgtgagga

SEQ ID NO: 3523455 - DNA, 17 bp, Homo sapiens
tggaagattttcattga

SEQ ID NO: 3523456 - DNA, 16 bp, Homo sapiens
tggaagctaatttgca

SEQ ID NO: 3523457 - DNA, 13 bp, Homo sapiens
tggaagctccgct

SEQ ID NO: 3523458 - DNA, 19 bp, Homo sapiens
tggaagggatggggtgcca

SEQ ID NO: 3523459 - DNA, 17 bp, Homo sapiens
tggaagtccaatgtggc

SEQ ID NO: 3523460 - DNA, 17 bp, Homo sapiens
tggaagtgcatctactt

SEQ ID NO: 3523461 - DNA, 16 bp, Homo sapiens
tggaagttgagactta

SEQ ID NO: 3523462 - DNA, 11 bp, Homo sapiens
tggaagttgca

SEQ ID NO: 3523463 - DNA, 16 bp, Homo sapiens
tggaagttgcatggca

SEQ ID NO: 3523464 - DNA, 12 bp, Homo sapiens
tggaatactttt

SEQ ID NO: 3523465 - DNA, 18 bp, Homo sapiens
tggaatactttttgttat

SEQ ID NO: 3523466 - DNA, 15 bp, Homo sapiens
tggaatattgtccat

SEQ ID NO: 3523467 - DNA, 20 bp, Homo sapiens
tggaatattgtccattgtcc

SEQ ID NO: 3523468 - DNA, 23 bp, Homo sapiens
tggaatcaggaatattttccaaa

SEQ ID NO: 3523469 - DNA, 18 bp, Homo sapiens
tggaatctggagaccagg

SEQ ID NO: 3523470 - DNA, 15 bp, Homo sapiens
tggaatgcagaggtc

SEQ ID NO: 3523471 - DNA, 17 bp, Homo sapiens
tggaatgggcagctcat

SEQ ID NO: 3523472 - DNA, 18 bp, Homo sapiens
tggaattgatttgcattg

SEQ ID NO: 3523473 - DNA, 15 bp, Homo sapiens
tggacacagctcttc

SEQ ID NO: 3523474 - DNA, 23 bp, Homo sapiens
tggacacagctcttctccaggct

SEQ ID NO: 3523475 - DNA, 15 bp, Homo sapiens
tggacacaggcctgc

SEQ ID NO: 3523476 - DNA, 16 bp, Homo sapiens
tggacacttttcacct

SEQ ID NO: 3523477 - DNA, 16 bp, Homo sapiens
tggacagattaatatt

SEQ ID NO: 3523478 - DNA, 17 bp, Homo sapiens
tggacaggcatgttctc

SEQ ID NO: 3523479 - DNA, 14 bp, Homo sapiens
tggacaggctggct

SEQ ID NO: 3523480 - DNA, 19 bp, Homo sapiens
tggacaggggattggcgcc

SEQ ID NO: 3523481 - DNA, 21 bp, Homo sapiens
tggacagtatcactgtctttc

SEQ ID NO: 3523482 - DNA, 17 bp, Homo sapiens
tggacagtctgctctag

SEQ ID NO: 3523483 - DNA, 18 bp, Homo sapiens
tggacatcctcctcccac

SEQ ID NO: 3523484 - DNA, 20 bp, Homo sapiens
tggacatcctcctcccaccc

SEQ ID NO: 3523485 - DNA, 18 bp, Homo sapiens
tggtattgtatttattca

SEQ ID NO: 3523486 - DNA, 23 bp, Homo sapiens
tggtattgtatttattcaataaa

SEQ ID NO: 3523487 - DNA, 16 bp, Homo sapiens
tggtcaaacaaactct

SEQ ID NO: 3523488 - DNA, 15 bp, Homo sapiens
tggtcacagcggagg

SEQ ID NO: 3523489 - DNA, 15 bp, Homo sapiens
tggtcagccctaggg

SEQ ID NO: 3523490 - DNA, 19 bp, Homo sapiens
tggtcatcgagatggagct

SEQ ID NO: 3523491 - DNA, 16 bp, Homo sapiens
tggtccaggccctgtg

SEQ ID NO: 3523492 - DNA, 22 bp, Homo sapiens
tggtcctagaggccctttgctg

SEQ ID NO: 3523493 - DNA, 22 bp, Homo sapiens
tggtcctctctctgtggggctg

SEQ ID NO: 3523494 - DNA, 23 bp, Homo sapiens
tggtcctctctctgtggggctga

SEQ ID NO: 3523495 - DNA, 15 bp, Homo sapiens
tggtcgctcctgccc

SEQ ID NO: 3523496 - DNA, 21 bp, Homo sapiens
tggtctaaagtgtttagctgt

SEQ ID NO: 3523497 - DNA, 14 bp, Homo sapiens
tggtctatgttccg

SEQ ID NO: 3523498 - DNA, 16 bp, Homo sapiens
tggtctcaaactcttg

SEQ ID NO: 3523499 - DNA, 14 bp, Homo sapiens
tggtctctaggctg

SEQ ID NO: 3523500 - DNA, 17 bp, Homo sapiens
tggtctgacccactgct

SEQ ID NO: 3523501 - DNA, 14 bp, Homo sapiens
tggtctgcaggcag

SEQ ID NO: 3523502 - DNA, 20 bp, Homo sapiens
tggtcttaaggaacatctct

SEQ ID NO: 3523503 - DNA, 15 bp, Homo sapiens
tggtcttcagcctct

SEQ ID NO: 3523504 - DNA, 19 bp, Homo sapiens
tggtcttgaagtcctggct

SEQ ID NO: 3523505 - DNA, 13 bp, Homo sapiens
tggtgacctctgc

SEQ ID NO: 3523506 - DNA, 19 bp, Homo sapiens
tggtgagcctagccctggg

SEQ ID NO: 3523507 - DNA, 15 bp, Homo sapiens
tggtgataaggacat

SEQ ID NO: 3523508 - DNA, 18 bp, Homo sapiens
tggtgccacaaataaaat

SEQ ID NO: 3523509 - DNA, 22 bp, Homo sapiens
tggtgccatcattgctgtctgc

SEQ ID NO: 3523510 - DNA, 13 bp, Homo sapiens
tggtgccccagga

SEQ ID NO: 3523511 - DNA, 21 bp, Homo sapiens
tggtgccccaggaccagctca

SEQ ID NO: 3523512 - DNA, 17 bp, Homo sapiens
tggtgcgatctgggttc

SEQ ID NO: 3523513 - DNA, 13 bp, Homo sapiens
tggtgcttagaaa

SEQ ID NO: 3523514 - DNA, 21 bp, Homo sapiens
tggtggaggattgctgccaga

SEQ ID NO: 3523515 - DNA, 11 bp, Homo sapiens
tggtggcacat

SEQ ID NO: 3523516 - DNA, 21 bp, Homo sapiens
tggtggcacattcctttgggt

SEQ ID NO: 3523517 - DNA, 15 bp, Homo sapiens
tggtggcagctgcgg

SEQ ID NO: 3523518 - DNA, 10 bp, Homo sapiens
tggtggcatg

SEQ ID NO: 3523519 - DNA, 15 bp, Homo sapiens
tggtggcatggaagg

SEQ ID NO: 3523520 - DNA, 19 bp, Homo sapiens
tggtgggatgtggttttct

SEQ ID NO: 3523521 - DNA, 20 bp, Homo sapiens
tggtgggccaacaaagaaca

SEQ ID NO: 3523522 - DNA, 19 bp, Homo sapiens
tggtgtctccaacccccca

SEQ ID NO: 3523523 - DNA, 17 bp, Homo sapiens
tggtgtctcttctttag

SEQ ID NO: 3523524 - DNA, 23 bp, Homo sapiens
tggtgtctcttctttagaacagg

SEQ ID NO: 3523525 - DNA, 19 bp, Homo sapiens
tggtgttatttgaaacttt

SEQ ID NO: 3523526 - DNA, 12 bp, Homo sapiens
tggttaggatgg

SEQ ID NO: 3523527 - DNA, 12 bp, Homo sapiens
tggttatgaact

SEQ ID NO: 3523528 - DNA, 22 bp, Homo sapiens
tggttatttagggaactgcttg

SEQ ID NO: 3523529 - DNA, 20 bp, Homo sapiens
tggttcagggttggcccctg

SEQ ID NO: 3523530 - DNA, 23 bp, Homo sapiens
tggttcagggttggcccctgccc

SEQ ID NO: 3523531 - DNA, 16 bp, Homo sapiens
tggttcattaattcta

SEQ ID NO: 3523532 - DNA, 22 bp, Homo sapiens
tggttccagggtccctctgtgt

SEQ ID NO: 3523533 - DNA, 19 bp, Homo sapiens
tggttcttctcaaaagaac

SEQ ID NO: 3523534 - DNA, 23 bp, Homo sapiens
tggttgaactctggtggcacagg

SEQ ID NO: 3523535 - DNA, 22 bp, Homo sapiens
tggttgagttcaggtagctgcc

SEQ ID NO: 3523536 - DNA, 19 bp, Homo sapiens
tggttgctgttttcctccc

SEQ ID NO: 3523537 - DNA, 16 bp, Homo sapiens
tggttggagaatttag

SEQ ID NO: 3523538 - DNA, 19 bp, Homo sapiens
tggttggggccctgccctg

SEQ ID NO: 3523539 - DNA, 18 bp, Homo sapiens
tggttgtattagatgttc

SEQ ID NO: 3523540 - DNA, 18 bp, Homo sapiens
tggtttaacttctgcctg

SEQ ID NO: 3523541 - DNA, 19 bp, Homo sapiens
tggtttatcagcaaaaaag

SEQ ID NO: 3523542 - DNA, 14 bp, Homo sapiens
tggtttattttcac

SEQ ID NO: 3523543 - DNA, 22 bp, Homo sapiens
tggtttcataacttcctgtact

SEQ ID NO: 3523544 - DNA, 17 bp, Homo sapiens
tggtttggcctccatcc

SEQ ID NO: 3523545 - DNA, 17 bp, Homo sapiens
tggttttaatacttgat

SEQ ID NO: 3523546 - DNA, 20 bp, Homo sapiens
tggttttaggatacttaaca

SEQ ID NO: 3523547 - DNA, 15 bp, Homo sapiens
tggtttttaaatttt

SEQ ID NO: 3523548 - DNA, 20 bp, Homo sapiens
tggtttttaaattttgtaat

SEQ ID NO: 3523549 - DNA, 16 bp, Homo sapiens
tggtttttacttaact

SEQ ID NO: 3523550 - DNA, 17 bp, Homo sapiens
tgtaaaaaattcacata

SEQ ID NO: 3523551 - DNA, 23 bp, Homo sapiens
tgtaaaagcacatgagaatgcta

SEQ ID NO: 3523552 - DNA, 21 bp, Homo sapiens
tgtaaaatctttctttcttag

SEQ ID NO: 3523553 - DNA, 14 bp, Homo sapiens
tgtaaactgtgcac

SEQ ID NO: 3523554 - DNA, 16 bp, Homo sapiens
tgtaaaggagtcaaaa

SEQ ID NO: 3523555 - DNA, 21 bp, Homo sapiens
tgtaaaggagtcaaaactaca

SEQ ID NO: 3523556 - DNA, 22 bp, Homo sapiens
tgtaaaggcaagccagcatgtg

SEQ ID NO: 3523557 - DNA, 17 bp, Homo sapiens
tgtaaaggggcagctga

SEQ ID NO: 3523558 - DNA, 13 bp, Homo sapiens
tgtaaagtgaaga

SEQ ID NO: 3523559 - DNA, 20 bp, Homo sapiens
tgtaaagttggttggataag

SEQ ID NO: 3523560 - DNA, 14 bp, Homo sapiens
tgtaaataaagccc

SEQ ID NO: 3523561 - DNA, 15 bp, Homo sapiens
tgtaaatagctcagg

SEQ ID NO: 3523562 - DNA, 13 bp, Homo sapiens
tgtaaatatataa

SEQ ID NO: 3523563 - DNA, 16 bp, Homo sapiens
tgtaaatatataaata

SEQ ID NO: 3523564 - DNA, 22 bp, Homo sapiens
tgtaaatgtttgttaaaaataa

SEQ ID NO: 3523565 - DNA, 13 bp, Homo sapiens
tgtaaattatatt

SEQ ID NO: 3523566 - DNA, 17 bp, Homo sapiens
tgtaacactgcaagaag

SEQ ID NO: 3523567 - DNA, 20 bp, Homo sapiens
tgtaacactgcaagaagtct

SEQ ID NO: 3523568 - DNA, 18 bp, Homo sapiens
tgtaacactttacaatgt

SEQ ID NO: 3523569 - DNA, 15 bp, Homo sapiens
tgtaacatgatgtta

SEQ ID NO: 3523570 - DNA, 19 bp, Homo sapiens
tgtaactatttcttcagag

SEQ ID NO: 3523571 - DNA, 23 bp, Homo sapiens
tgtaactgcattgagaactgcat

SEQ ID NO: 3523572 - DNA, 15 bp, Homo sapiens
tgtaactttttacat

SEQ ID NO: 3523573 - DNA, 12 bp, Homo sapiens
tgtaagaaacct

SEQ ID NO: 3523574 - DNA, 19 bp, Homo sapiens
tgtaagaactacaaacaaa

SEQ ID NO: 3523575 - DNA, 16 bp, Homo sapiens
tgtaagaataatttat

SEQ ID NO: 3523576 - DNA, 13 bp, Homo sapiens
tgtaagatgtctg

SEQ ID NO: 3523577 - DNA, 13 bp, Homo sapiens
tgtaaggccttag

SEQ ID NO: 3523578 - DNA, 15 bp, Homo sapiens
tgtaaggccttagcc

SEQ ID NO: 3523579 - DNA, 15 bp, Homo sapiens
tgtaataaactttaa

SEQ ID NO: 3523580 - DNA, 14 bp, Homo sapiens
tgtaataacattta

SEQ ID NO: 3523581 - DNA, 15 bp, Homo sapiens
tgtaataacatttaa

SEQ ID NO: 3523582 - DNA, 11 bp, Homo sapiens
tgtaatacaat

SEQ ID NO: 3523583 - DNA, 20 bp, Homo sapiens
tgtaatcccagctactcggg

SEQ ID NO: 3523584 - DNA, 19 bp, Homo sapiens
tgtaatgaattcctagaat

SEQ ID NO: 3523585 - DNA, 22 bp, Homo sapiens
tgtaatggagcatcaagccact

SEQ ID NO: 3523586 - DNA, 13 bp, Homo sapiens
tgtaatgttttct

SEQ ID NO: 3523587 - DNA, 19 bp, Homo sapiens
tgtaatgttttctttgcaa

SEQ ID NO: 3523588 - DNA, 18 bp, Homo sapiens
tgtaattgtaattttgaa

SEQ ID NO: 3523589 - DNA, 19 bp, Homo sapiens
tgtaattgttccttttatt

SEQ ID NO: 3523590 - DNA, 14 bp, Homo sapiens
tgtaatttagtcta

SEQ ID NO: 3523591 - DNA, 16 bp, Homo sapiens
tgtaattttacttttt

SEQ ID NO: 3523592 - DNA, 15 bp, Homo sapiens
tgtacaaatataaga

SEQ ID NO: 3523593 - DNA, 18 bp, Homo sapiens
tgtacaaatataagaata

SEQ ID NO: 3523594 - DNA, 21 bp, Homo sapiens
tgtacaaatataagaataaaa

SEQ ID NO: 3523595 - DNA, 12 bp, Homo sapiens
tgtacaataaaa

SEQ ID NO: 3523596 - DNA, 16 bp, Homo sapiens
tgtacaataaaaacat

SEQ ID NO: 3523597 - DNA, 15 bp, Homo sapiens
tgtacagacagagaa

SEQ ID NO: 3523598 - DNA, 19 bp, Homo sapiens
tgtacagacatatttaact

SEQ ID NO: 3523599 - DNA, 20 bp, Homo sapiens
tgtacagacatatttaactg

SEQ ID NO: 3523600 - DNA, 12 bp, Homo sapiens
tgtacagcccag

SEQ ID NO: 3523601 - DNA, 18 bp, Homo sapiens
tgtacagtagattttcca

SEQ ID NO: 3523602 - DNA, 20 bp, Homo sapiens
tgtacagtagattttccaaa

SEQ ID NO: 3523603 - DNA, 21 bp, Homo sapiens
tgtacatatgtaaaataaaat

SEQ ID NO: 3523604 - DNA, 14 bp, Homo sapiens
tgtacatctggcct

SEQ ID NO: 3523605 - DNA, 12 bp, Homo sapiens
tgtacatgaaat

SEQ ID NO: 3523606 - DNA, 20 bp, Homo sapiens
tgtacatgaaatttttgtaa

SEQ ID NO: 3523607 - DNA, 16 bp, Homo sapiens
tgtacatgagaaggaa

SEQ ID NO: 3523608 - DNA, 22 bp, Homo sapiens
tgtacatttccaaattcacaag

SEQ ID NO: 3523609 - DNA, 15 bp, Homo sapiens
tgtaccaagaatctt

SEQ ID NO: 3523610 - DNA, 20 bp, Homo sapiens
tgtaccagtgaatttttgca

SEQ ID NO: 3523611 - DNA, 21 bp, Homo sapiens
tgtaccatgaaacaaagctgc

SEQ ID NO: 3523612 - DNA, 14 bp, Homo sapiens
tgtaccatttgcct

SEQ ID NO: 3523613 - DNA, 18 bp, Homo sapiens
tgtacccacgctgggtat

SEQ ID NO: 3523614 - DNA, 20 bp, Homo sapiens
tgtacccacgctgggtatta

SEQ ID NO: 3523615 - DNA, 21 bp, Homo sapiens
tgtaccttttttgttttttca

SEQ ID NO: 3523616 - DNA, 15 bp, Homo sapiens
tgtacgtctgacagg

SEQ ID NO: 3523617 - DNA, 12 bp, Homo sapiens
tgttgctaagcc

SEQ ID NO: 3523618 - DNA, 22 bp, Homo sapiens
tgttgctaagccccagcaagca

SEQ ID NO: 3523619 - DNA, 16 bp, Homo sapiens
tgttgctataataaag

SEQ ID NO: 3523620 - DNA, 20 bp, Homo sapiens
tgttgctctaggaagacatt

SEQ ID NO: 3523621 - DNA, 11 bp, Homo sapiens
tgttgctgaat

SEQ ID NO: 3523622 - DNA, 17 bp, Homo sapiens
tgttggaggagagagcc

SEQ ID NO: 3523623 - DNA, 19 bp, Homo sapiens
tgttggaggagagagcctt

SEQ ID NO: 3523624 - DNA, 16 bp, Homo sapiens
tgttggagtgtttcta

SEQ ID NO: 3523625 - DNA, 15 bp, Homo sapiens
tgttggccaaagcca

SEQ ID NO: 3523626 - DNA, 16 bp, Homo sapiens
tgttggccaggctggt

SEQ ID NO: 3523627 - DNA, 16 bp, Homo sapiens
tgttggttgttttttc

SEQ ID NO: 3523628 - DNA, 19 bp, Homo sapiens
tgttggttgttttttcctt

SEQ ID NO: 3523629 - DNA, 20 bp, Homo sapiens
tgttggttgttttttccttt

SEQ ID NO: 3523630 - DNA, 20 bp, Homo sapiens
tgttgtacaatcatgttctg

SEQ ID NO: 3523631 - DNA, 13 bp, Homo sapiens
tgttgtcaaagag

SEQ ID NO: 3523632 - DNA, 13 bp, Homo sapiens
tgttgtcagctga

SEQ ID NO: 3523633 - DNA, 13 bp, Homo sapiens
tgttgtgctttta

SEQ ID NO: 3523634 - DNA, 12 bp, Homo sapiens
tgttgtgtgtgc

SEQ ID NO: 3523635 - DNA, 13 bp, Homo sapiens
tgttgtgtgtgca

SEQ ID NO: 3523636 - DNA, 22 bp, Homo sapiens
tgtttaaaaatacacatggaaa

SEQ ID NO: 3523637 - DNA, 22 bp, Homo sapiens
tgtttacatttgatgcatgtct

SEQ ID NO: 3523638 - DNA, 15 bp, Homo sapiens
tgtttactgcaaggt

SEQ ID NO: 3523639 - DNA, 19 bp, Homo sapiens
tgtttcaaaaccatgcctg

SEQ ID NO: 3523640 - DNA, 16 bp, Homo sapiens
tgtttcaattgcatct

SEQ ID NO: 3523641 - DNA, 18 bp, Homo sapiens
tgtttcacgaagtttgtt

SEQ ID NO: 3523642 - DNA, 14 bp, Homo sapiens
tgtttcctctagtt

SEQ ID NO: 3523643 - DNA, 13 bp, Homo sapiens
tgtttcctttttt

SEQ ID NO: 3523644 - DNA, 21 bp, Homo sapiens
tgtttcgctgatatatgtgtt

SEQ ID NO: 3523645 - DNA, 15 bp, Homo sapiens
tgtttcgtgaagtat

SEQ ID NO: 3523646 - DNA, 19 bp, Homo sapiens
tgtttcgtgaagtatactg

SEQ ID NO: 3523647 - DNA, 20 bp, Homo sapiens
tgtttcgtgaagtatactgt

SEQ ID NO: 3523648 - DNA, 15 bp, Homo sapiens
tgtttcgtggggagg

SEQ ID NO: 3523649 - DNA, 19 bp, Homo sapiens
tgtttctggaaatgttctt

SEQ ID NO: 3523650 - DNA, 12 bp, Homo sapiens
tgtttgcactgt

SEQ ID NO: 3523651 - DNA, 13 bp, Homo sapiens
tgtttgcactgtg

SEQ ID NO: 3523652 - DNA, 24 bp, Homo sapiens
tgtttgcactgtgtgctgactgaa

SEQ ID NO: 3523653 - DNA, 16 bp, Homo sapiens
tgtttgcttcaccgtg

SEQ ID NO: 3523654 - DNA, 15 bp, Homo sapiens
tgtttggcaaggaaa

SEQ ID NO: 3523655 - DNA, 14 bp, Homo sapiens
tgtttggctttcag

SEQ ID NO: 3523656 - DNA, 15 bp, Homo sapiens
tgtttggggatgaga

SEQ ID NO: 3523657 - DNA, 16 bp, Homo sapiens
tgtttggttttacatt

SEQ ID NO: 3523658 - DNA, 20 bp, Homo sapiens
tgtttgtaactttttacatt

SEQ ID NO: 3523659 - DNA, 14 bp, Homo sapiens
tgtttgtatgaaat

SEQ ID NO: 3523660 - DNA, 15 bp, Homo sapiens
tgtttgtatgaaatt

SEQ ID NO: 3523661 - DNA, 16 bp, Homo sapiens
tgtttgtattgtaaaa

SEQ ID NO: 3523662 - DNA, 20 bp, Homo sapiens
tgtttgtattgtaaaaaatt

SEQ ID NO: 3523663 - DNA, 17 bp, Homo sapiens
tgtttgtctgtcttcat

SEQ ID NO: 3523664 - DNA, 19 bp, Homo sapiens
tgtttgtctgtcttcatag

SEQ ID NO: 3523665 - DNA, 14 bp, Homo sapiens
tgtttgtgctgtgg

SEQ ID NO: 3523666 - DNA, 12 bp, Homo sapiens
tgtttgtgtatt

SEQ ID NO: 3523667 - DNA, 17 bp, Homo sapiens
tgtttgttgtcagctga

SEQ ID NO: 3523668 - DNA, 14 bp, Homo sapiens
tgtttgttttggat

SEQ ID NO: 3523669 - DNA, 23 bp, Homo sapiens
tgttttaaatgtacagacatatt

SEQ ID NO: 3523670 - DNA, 13 bp, Homo sapiens
tgttttaacaaaa

SEQ ID NO: 3523671 - DNA, 14 bp, Homo sapiens
tgttttaacaaaaa

SEQ ID NO: 3523672 - DNA, 17 bp, Homo sapiens
tgttttaagaggcaggg

SEQ ID NO: 3523673 - DNA, 15 bp, Homo sapiens
tgttttatgagaaag

SEQ ID NO: 3523674 - DNA, 18 bp, Homo sapiens
tgttttatttcattggtt

SEQ ID NO: 3523675 - DNA, 15 bp, Homo sapiens
tgttttccagctcct

SEQ ID NO: 3523676 - DNA, 12 bp, Homo sapiens
tgttttccctga

SEQ ID NO: 3523677 - DNA, 16 bp, Homo sapiens
tgttttccctgacctc

SEQ ID NO: 3523678 - DNA, 17 bp, Homo sapiens
tgttttgaaggcaaaat

SEQ ID NO: 3523679 - DNA, 14 bp, Homo sapiens
tgttttggattctt

SEQ ID NO: 3523680 - DNA, 17 bp, Homo sapiens
tgttttggattctttaa

SEQ ID NO: 3523681 - DNA, 21 bp, Homo sapiens
tgttttggggttttgttttgt

SEQ ID NO: 3523682 - DNA, 14 bp, Homo sapiens
tgttttgtaccagt

SEQ ID NO: 3523683 - DNA, 22 bp, Homo sapiens
tgtttttctcttttcacagcaa

SEQ ID NO: 3523684 - DNA, 15 bp, Homo sapiens
tgtttttgttgtgtg

SEQ ID NO: 3523685 - DNA, 13 bp, Homo sapiens
tgttttttcaaaa

SEQ ID NO: 3523686 - DNA, 14 bp, Homo sapiens
tgttttttcaaaat

SEQ ID NO: 3523687 - DNA, 23 bp, Homo sapiens
tgttttttcaaaatagaaaagtt

SEQ ID NO: 3523688 - DNA, 13 bp, Homo sapiens
tgttttttcatgt

SEQ ID NO: 3523689 - DNA, 17 bp, Homo sapiens
tgttttttggcttgctt

SEQ ID NO: 3523690 - DNA, 17 bp, Homo sapiens
tgttttttttcagccac

SEQ ID NO: 3523691 - DNA, 21 bp, Homo sapiens
ttaaaaaaaacaaaaagaaca

SEQ ID NO: 3523692 - DNA, 13 bp, Homo sapiens
ttaaaaaaaagaa

SEQ ID NO: 3523693 - DNA, 23 bp, Homo sapiens
ttaaaaaaataaaacagtatctc

SEQ ID NO: 3523694 - DNA, 20 bp, Homo sapiens
ttaaaaaaattggttggaga

SEQ ID NO: 3523695 - DNA, 18 bp, Homo sapiens
ttaaaaagcatgttgtga

SEQ ID NO: 3523696 - DNA, 16 bp, Homo sapiens
ttaaaaaggtttacag

SEQ ID NO: 3523697 - DNA, 16 bp, Homo sapiens
ttaaaaataaatccca

SEQ ID NO: 3523698 - DNA, 13 bp, Homo sapiens
ttaaaaatacaca

SEQ ID NO: 3523699 - DNA, 16 bp, Homo sapiens
ttaaaaatacacatgg

SEQ ID NO: 3523700 - DNA, 16 bp, Homo sapiens
ttaaaaatataaaact

SEQ ID NO: 3523701 - DNA, 15 bp, Homo sapiens
ttaaaaatgcaaatc

SEQ ID NO: 3523702 - DNA, 17 bp, Homo sapiens
ttaaaagacaagacttc

SEQ ID NO: 3523703 - DNA, 23 bp, Homo sapiens
ttaaaagagagagagagaaaaaa

SEQ ID NO: 3523704 - DNA, 15 bp, Homo sapiens
ttaaaagagctcaga

SEQ ID NO: 3523705 - DNA, 20 bp, Homo sapiens
ttaaaagatgcttttaacag

SEQ ID NO: 3523706 - DNA, 15 bp, Homo sapiens
ttaaaagcagagcat

SEQ ID NO: 3523707 - DNA, 16 bp, Homo sapiens
ttaaaataaactgtaa

SEQ ID NO: 3523708 - DNA, 21 bp, Homo sapiens
ttaaaataaactgtaaactaa

SEQ ID NO: 3523709 - DNA, 13 bp, Homo sapiens
ttaaaatcctcaa

SEQ ID NO: 3523710 - DNA, 21 bp, Homo sapiens
ttaaaatggtttgtcctgatg

SEQ ID NO: 3523711 - DNA, 14 bp, Homo sapiens
ttaaaattctgaat

SEQ ID NO: 3523712 - DNA, 15 bp, Homo sapiens
ttaaaattctgaatt

SEQ ID NO: 3523713 - DNA, 18 bp, Homo sapiens
ttaaaattctgaattttg

SEQ ID NO: 3523714 - DNA, 18 bp, Homo sapiens
ttaaaatttttttagaaa

SEQ ID NO: 3523715 - DNA, 23 bp, Homo sapiens
ttaaacacacagatacacacaca

SEQ ID NO: 3523716 - DNA, 19 bp, Homo sapiens
ttaaacagcctattcctga

SEQ ID NO: 3523717 - DNA, 17 bp, Homo sapiens
ttaaactagcatatctg

SEQ ID NO: 3523718 - DNA, 19 bp, Homo sapiens
ttaaactagcatatctgcc

SEQ ID NO: 3523719 - DNA, 22 bp, Homo sapiens
ttaaactctgttgcaagtgcaa

SEQ ID NO: 3523720 - DNA, 21 bp, Homo sapiens
ttaaagacaaagacaaattct

SEQ ID NO: 3523721 - DNA, 12 bp, Homo sapiens
ttaaagacagag

SEQ ID NO: 3523722 - DNA, 12 bp, Homo sapiens
ttaaaggaaaaa

SEQ ID NO: 3523723 - DNA, 21 bp, Homo sapiens
ttaaaggcagtattttgtgtc

SEQ ID NO: 3523724 - DNA, 21 bp, Homo sapiens
ttaaagtgactaatggcatga

SEQ ID NO: 3523725 - DNA, 18 bp, Homo sapiens
ttaaatacaaaacttcca

SEQ ID NO: 3523726 - DNA, 13 bp, Homo sapiens
ttaaatacagtct

SEQ ID NO: 3523727 - DNA, 14 bp, Homo sapiens
ttaaatatatatta

SEQ ID NO: 3523728 - DNA, 16 bp, Homo sapiens
ttaaatatatattatt

SEQ ID NO: 3523729 - DNA, 22 bp, Homo sapiens
ttaaatatatattattctcatt

SEQ ID NO: 3523730 - DNA, 23 bp, Homo sapiens
ttaaatatatattattctcattt

SEQ ID NO: 3523731 - DNA, 15 bp, Homo sapiens
ttaaatatttgaaga

SEQ ID NO: 3523732 - DNA, 18 bp, Homo sapiens
ttaaatattttctatttt

SEQ ID NO: 3523733 - DNA, 16 bp, Homo sapiens
ttaaatgtaaataatc

SEQ ID NO: 3523734 - DNA, 21 bp, Homo sapiens
ttaaatgtacagacatattta

SEQ ID NO: 3523735 - DNA, 16 bp, Homo sapiens
ttaaattacaatttta

SEQ ID NO: 3523736 - DNA, 17 bp, Homo sapiens
ttaaattacaattttat

SEQ ID NO: 3523737 - DNA, 18 bp, Homo sapiens
ttaaattacaattttatc

SEQ ID NO: 3523738 - DNA, 11 bp, Homo sapiens
ttaaattacct

SEQ ID NO: 3523739 - DNA, 18 bp, Homo sapiens
ttaacaaactcttcagtt

SEQ ID NO: 3523740 - DNA, 12 bp, Homo sapiens
ttaacagcatga

SEQ ID NO: 3523741 - DNA, 14 bp, Homo sapiens
ttaacagcatgaca

SEQ ID NO: 3523742 - DNA, 16 bp, Homo sapiens
ttaacagcatgacaaa

SEQ ID NO: 3523743 - DNA, 17 bp, Homo sapiens
ttaacagcatgacaaaa

SEQ ID NO: 3523744 - DNA, 14 bp, Homo sapiens
ttaacatcatgaat

SEQ ID NO: 3523745 - DNA, 15 bp, Homo sapiens
ttaacatgatgtact

SEQ ID NO: 3523746 - DNA, 17 bp, Homo sapiens
ttaacatgatgtactaa

SEQ ID NO: 3523747 - DNA, 13 bp, Homo sapiens
ttaaccaaaggtg

SEQ ID NO: 3523748 - DNA, 13 bp, Homo sapiens
ttaaccagatcta

SEQ ID NO: 3523749 - DNA, 20 bp, Homo sapiens
ttaaccagatggttgtgtat

SEQ ID NO: 3523750 - DNA, 15 bp, Homo sapiens
ttaacccttcatctt

SEQ ID NO: 3523751 - DNA, 13 bp, Homo sapiens
ttttcaaagcaat

SEQ ID NO: 3523752 - DNA, 13 bp, Homo sapiens
ttttcaactttga

SEQ ID NO: 3523753 - DNA, 21 bp, Homo sapiens
ttttcaactttgaataaagaa

SEQ ID NO: 3523754 - DNA, 18 bp, Homo sapiens
ttttcacagcaacatttt

SEQ ID NO: 3523755 - DNA, 13 bp, Homo sapiens
ttttcaccccacc

SEQ ID NO: 3523756 - DNA, 20 bp, Homo sapiens
ttttcaccccacccttcccc

SEQ ID NO: 3523757 - DNA, 17 bp, Homo sapiens
ttttcacctccttcaat

SEQ ID NO: 3523758 - DNA, 23 bp, Homo sapiens
ttttcacctgtttttaagctgtt

SEQ ID NO: 3523759 - DNA, 20 bp, Homo sapiens
ttttcacggaagttttcaat

SEQ ID NO: 3523760 - DNA, 14 bp, Homo sapiens
ttttcacttatgaa

SEQ ID NO: 3523761 - DNA, 11 bp, Homo sapiens
ttttcagatgt

SEQ ID NO: 3523762 - DNA, 17 bp, Homo sapiens
ttttcagatgtgaacca

SEQ ID NO: 3523763 - DNA, 19 bp, Homo sapiens
ttttcaggctcgccaaggc

SEQ ID NO: 3523764 - DNA, 22 bp, Homo sapiens
ttttcaggctcgccaaggccta

SEQ ID NO: 3523765 - DNA, 18 bp, Homo sapiens
ttttcatacttttacctt

SEQ ID NO: 3523766 - DNA, 16 bp, Homo sapiens
ttttcatgttttaaca

SEQ ID NO: 3523767 - DNA, 20 bp, Homo sapiens
ttttccaaaagtggcctctt

SEQ ID NO: 3523768 - DNA, 23 bp, Homo sapiens
ttttccaaaagtggcctctttgt

SEQ ID NO: 3523769 - DNA, 11 bp, Homo sapiens
ttttccaaatg

SEQ ID NO: 3523770 - DNA, 13 bp, Homo sapiens
ttttccactactg

SEQ ID NO: 3523771 - DNA, 13 bp, Homo sapiens
ttttccagctcct

SEQ ID NO: 3523772 - DNA, 20 bp, Homo sapiens
ttttccagctggatgagaat

SEQ ID NO: 3523773 - DNA, 12 bp, Homo sapiens
ttttccatatat

SEQ ID NO: 3523774 - DNA, 18 bp, Homo sapiens
ttttccattatgctgtag

SEQ ID NO: 3523775 - DNA, 15 bp, Homo sapiens
ttttcccctttcctg

SEQ ID NO: 3523776 - DNA, 16 bp, Homo sapiens
ttttcccctttcctgt

SEQ ID NO: 3523777 - DNA, 18 bp, Homo sapiens
ttttccctattagagaag

SEQ ID NO: 3523778 - DNA, 22 bp, Homo sapiens
ttttccctattagagaagagat

SEQ ID NO: 3523779 - DNA, 15 bp, Homo sapiens
ttttcctatgctatt

SEQ ID NO: 3523780 - DNA, 20 bp, Homo sapiens
ttttcctccctgcttaaaaa

SEQ ID NO: 3523781 - DNA, 14 bp, Homo sapiens
ttttcctcccttct

SEQ ID NO: 3523782 - DNA, 18 bp, Homo sapiens
ttttctagatacaataaa

SEQ ID NO: 3523783 - DNA, 12 bp, Homo sapiens
ttttctcagctg

SEQ ID NO: 3523784 - DNA, 18 bp, Homo sapiens
ttttctctcctgtcctcc

SEQ ID NO: 3523785 - DNA, 13 bp, Homo sapiens
ttttctgcacagc

SEQ ID NO: 3523786 - DNA, 14 bp, Homo sapiens
ttttctgcacagct

SEQ ID NO: 3523787 - DNA, 19 bp, Homo sapiens
ttttcttgcctctgtcccc

SEQ ID NO: 3523788 - DNA, 12 bp, Homo sapiens
ttttctttgcaa

SEQ ID NO: 3523789 - DNA, 15 bp, Homo sapiens
ttttctttgcaaagt

SEQ ID NO: 3523790 - DNA, 21 bp, Homo sapiens
ttttctttttttaactggtga

SEQ ID NO: 3523791 - DNA, 14 bp, Homo sapiens
ttttgaaggcaaaa

SEQ ID NO: 3523792 - DNA, 14 bp, Homo sapiens
ttttgaattgttac

SEQ ID NO: 3523793 - DNA, 22 bp, Homo sapiens
ttttgacacttccattgtttaa

SEQ ID NO: 3523794 - DNA, 17 bp, Homo sapiens
ttttgagaacgtaaaga

SEQ ID NO: 3523795 - DNA, 20 bp, Homo sapiens
ttttgatagctgtcccatct

SEQ ID NO: 3523796 - DNA, 23 bp, Homo sapiens
ttttgcaagtgaaggtttacaat

SEQ ID NO: 3523797 - DNA, 17 bp, Homo sapiens
ttttgcaataatgcagt

SEQ ID NO: 3523798 - DNA, 18 bp, Homo sapiens
ttttgcaataatgcagta

SEQ ID NO: 3523799 - DNA, 20 bp, Homo sapiens
ttttgcacatgtttcctcta

SEQ ID NO: 3523800 - DNA, 23 bp, Homo sapiens
ttttgccatgttggccaggctgg

SEQ ID NO: 3523801 - DNA, 13 bp, Homo sapiens
ttttgccctttga

SEQ ID NO: 3523802 - DNA, 17 bp, Homo sapiens
ttttgcgtacacagaga

SEQ ID NO: 3523803 - DNA, 13 bp, Homo sapiens
ttttgctgtatat

SEQ ID NO: 3523804 - DNA, 18 bp, Homo sapiens
ttttggaactatgaagac

SEQ ID NO: 3523805 - DNA, 23 bp, Homo sapiens
ttttggggattttcaaaagataa

SEQ ID NO: 3523806 - DNA, 20 bp, Homo sapiens
ttttggttttgttcccctcc

SEQ ID NO: 3523807 - DNA, 13 bp, Homo sapiens
ttttgtaatgaat

SEQ ID NO: 3523808 - DNA, 14 bp, Homo sapiens
ttttgtaatttaaa

SEQ ID NO: 3523809 - DNA, 11 bp, Homo sapiens
ttttgtaccag

SEQ ID NO: 3523810 - DNA, 16 bp, Homo sapiens
ttttgttaatattaaa

SEQ ID NO: 3523811 - DNA, 13 bp, Homo sapiens
ttttgttctctgg

SEQ ID NO: 3523812 - DNA, 16 bp, Homo sapiens
ttttgttttacaatgt

SEQ ID NO: 3523813 - DNA, 15 bp, Homo sapiens
ttttgttttggctga

SEQ ID NO: 3523814 - DNA, 19 bp, Homo sapiens
tttttaaaaaatattttct

SEQ ID NO: 3523815 - DNA, 14 bp, Homo sapiens
tttttaaaataaac

SEQ ID NO: 3523816 - DNA, 19 bp, Homo sapiens
tttttaaaataaactgtaa

SEQ ID NO: 3523817 - DNA, 22 bp, Homo sapiens
tttttaaaataaactgtaaact

SEQ ID NO: 3523818 - DNA, 23 bp, Homo sapiens
tttttaaaataaactgtaaacta

SEQ ID NO: 3523819 - DNA, 16 bp, Homo sapiens
tttttaaaatatttat

SEQ ID NO: 3523820 - DNA, 18 bp, Homo sapiens
tttttaagttaatagatt

SEQ ID NO: 3523821 - DNA, 18 bp, Homo sapiens
tttttaataaaaaggcac

SEQ ID NO: 3523822 - DNA, 17 bp, Homo sapiens
tttttacactttatggt

SEQ ID NO: 3523823 - DNA, 20 bp, Homo sapiens
tttttaccaaagtgtctttt

SEQ ID NO: 3523824 - DNA, 12 bp, Homo sapiens
tttttatgtgat

SEQ ID NO: 3523825 - DNA, 16 bp, Homo sapiens
tttttatgtgatcaat

SEQ ID NO: 3523826 - DNA, 20 bp, Homo sapiens
tttttcaaaatagaaaagtt

SEQ ID NO: 3523827 - DNA, 16 bp, Homo sapiens
tttttcaactttgaat

SEQ ID NO: 3523828 - DNA, 16 bp, Homo sapiens
tttttcaatatttatt

SEQ ID NO: 3523829 - DNA, 10 bp, Homo sapiens
tttttcatgt

SEQ ID NO: 3523830 - DNA, 22 bp, Homo sapiens
tttttcattagaagttaccaaa

SEQ ID NO: 3523831 - DNA, 22 bp, Homo sapiens
tttttcatttattgtttatgta

SEQ ID NO: 3523832 - DNA, 12 bp, Homo sapiens
tttttccaggct

SEQ ID NO: 3523833 - DNA, 17 bp, Homo sapiens
tttttcctatgctattg

SEQ ID NO: 3523834 - DNA, 19 bp, Homo sapiens
tttttctcatgaatctgca

SEQ ID NO: 3523835 - DNA, 21 bp, Homo sapiens
tttttctcgctgtcctttcta

SEQ ID NO: 3523836 - DNA, 16 bp, Homo sapiens
tttttctcttttcaca

SEQ ID NO: 3523837 - DNA, 13 bp, Homo sapiens
tttttctgcctcc

SEQ ID NO: 3523838 - DNA, 19 bp, Homo sapiens
tttttcttgtattcatgaa

SEQ ID NO: 3523839 - DNA, 16 bp, Homo sapiens
tttttgaacttttcat

SEQ ID NO: 3523840 - DNA, 12 bp, Homo sapiens
tttttgaagtgt

SEQ ID NO: 3523841 - DNA, 17 bp, Homo sapiens
tttttgacacttccatt

SEQ ID NO: 3523842 - DNA, 15 bp, Homo sapiens
tttttgcaagtgaag

SEQ ID NO: 3523843 - DNA, 22 bp, Homo sapiens
tttttgcaataatgcagtatgg

SEQ ID NO: 3523844 - DNA, 22 bp, Homo sapiens
tttttgcctaaatccaaagaaa

SEQ ID NO: 3523845 - DNA, 14 bp, Homo sapiens
tttttggagtgtta

SEQ ID NO: 3523846 - DNA, 19 bp, Homo sapiens
tttttggagtgttatgtat

SEQ ID NO: 3523847 - DNA, 20 bp, Homo sapiens
tttttggagtgttatgtatt

SEQ ID NO: 3523848 - DNA, 17 bp, Homo sapiens
tttttgtaataacattt

SEQ ID NO: 3523849 - DNA, 18 bp, Homo sapiens
tttttgtaataacattta

SEQ ID NO: 3523850 - DNA, 12 bp, Homo sapiens
tttttgtaccaa

SEQ ID NO: 3523851 - DNA, 16 bp, Homo sapiens
tttttgtcaacattgt

SEQ ID NO: 3523852 - DNA, 21 bp, Homo sapiens
tttttgtgaagacggcacggt

SEQ ID NO: 3523853 - DNA, 15 bp, Homo sapiens
tttttgttgttttgt

SEQ ID NO: 3523854 - DNA, 14 bp, Homo sapiens
tttttgtttctaac

SEQ ID NO: 3523855 - DNA, 23 bp, Homo sapiens
ttttttagaaagcatttgaatgc

SEQ ID NO: 3523856 - DNA, 12 bp, Homo sapiens
ttttttcatctt

SEQ ID NO: 3523857 - DNA, 13 bp, Homo sapiens
ttttttccatctt

SEQ ID NO: 3523858 - DNA, 15 bp, Homo sapiens
ttttttgcaagtgaa

SEQ ID NO: 3523859 - DNA, 16 bp, Homo sapiens
ttttttggtacaaaaa

SEQ ID NO: 3523860 - DNA, 13 bp, Homo sapiens
ttttttgtaccaa

SEQ ID NO: 3523861 - DNA, 12 bp, Homo sapiens
ttttttgtcaac

SEQ ID NO: 3523862 - DNA, 18 bp, Homo sapiens
ttttttgttttacaatgt

SEQ ID NO: 3523863 - DNA, 12 bp, Homo sapiens
tttttttattaa

SEQ ID NO: 3523864 - DNA, 13 bp, Homo sapiens
tttttttccaatt

SEQ ID NO: 3523865 - DNA, 11 bp, Homo sapiens
tttttttggat

SEQ ID NO: 3523866 - DNA, 16 bp, Homo sapiens
gagaatgtgccatgta

SEQ ID NO: 3523867 - DNA, 15 bp, Homo sapiens
gagacaagagggaat

SEQ ID NO: 3523868 - DNA, 19 bp, Homo sapiens
gagacaatgtctgcagccc

SEQ ID NO: 3523869 - DNA, 22 bp, Homo sapiens
gagacaatgtctgcagccctga

SEQ ID NO: 3523870 - DNA, 15 bp, Homo sapiens
gagacacacacacag

SEQ ID NO: 3523871 - DNA, 20 bp, Homo sapiens
gagacagagcctcgctctgt

SEQ ID NO: 3523872 - DNA, 19 bp, Homo sapiens
gagacagagttttcactct

SEQ ID NO: 3523873 - DNA, 14 bp, Homo sapiens
gagacaggcagagc

SEQ ID NO: 3523874 - DNA, 16 bp, Homo sapiens
gagacaggcagagctg

SEQ ID NO: 3523875 - DNA, 13 bp, Homo sapiens
gagacaggcagtt

SEQ ID NO: 3523876 - DNA, 19 bp, Homo sapiens
gagacagggtttcaccatg

SEQ ID NO: 3523877 - DNA, 22 bp, Homo sapiens
gagacagggtttggctgtgtct

SEQ ID NO: 3523878 - DNA, 22 bp, Homo sapiens
gagacagggttttgccatgttg

SEQ ID NO: 3523879 - DNA, 17 bp, Homo sapiens
gagacaggtggcctagc

SEQ ID NO: 3523880 - DNA, 19 bp, Homo sapiens
gagacaggtggcctagcag

SEQ ID NO: 3523881 - DNA, 22 bp, Homo sapiens
gagacaggtggcctagcaggca

SEQ ID NO: 3523882 - DNA, 14 bp, Homo sapiens
gagaccaggccctg

SEQ ID NO: 3523883 - DNA, 15 bp, Homo sapiens
gagaccaggccctgg

SEQ ID NO: 3523884 - DNA, 13 bp, Homo sapiens
gagacccagatct

SEQ ID NO: 3523885 - DNA, 19 bp, Homo sapiens
gagacccagatctcatgga

SEQ ID NO: 3523886 - DNA, 13 bp, Homo sapiens
gagacctcctgcc

SEQ ID NO: 3523887 - DNA, 19 bp, Homo sapiens
gagacctggcactggatgc

SEQ ID NO: 3523888 - DNA, 17 bp, Homo sapiens
gagactcgagaactttc

SEQ ID NO: 3523889 - DNA, 20 bp, Homo sapiens
gagactcgagaactttcatt

SEQ ID NO: 3523890 - DNA, 13 bp, Homo sapiens
gagactctgtctc

SEQ ID NO: 3523891 - DNA, 19 bp, Homo sapiens
gagactgggctctggctct

SEQ ID NO: 3523892 - DNA, 13 bp, Homo sapiens
gagactgggctga

SEQ ID NO: 3523893 - DNA, 14 bp, Homo sapiens
gagactgggctgag

SEQ ID NO: 3523894 - DNA, 15 bp, Homo sapiens
gagactgggctgagg

SEQ ID NO: 3523895 - DNA, 17 bp, Homo sapiens
gagactgggctgaggga

SEQ ID NO: 3523896 - DNA, 14 bp, Homo sapiens
gagagaaaaacaaa

SEQ ID NO: 3523897 - DNA, 21 bp, Homo sapiens
gagagaaaatatatgtatttt

SEQ ID NO: 3523898 - DNA, 14 bp, Homo sapiens
gagagaccaggcaa

SEQ ID NO: 3523899 - DNA, 13 bp, Homo sapiens
gagagagaaaaaa

SEQ ID NO: 3523900 - DNA, 16 bp, Homo sapiens
gagagatagcctgtgg

SEQ ID NO: 3523901 - DNA, 20 bp, Homo sapiens
gagagatagcctgtggccct

SEQ ID NO: 3523902 - DNA, 13 bp, Homo sapiens
gagagcaaggaag

SEQ ID NO: 3523903 - DNA, 14 bp, Homo sapiens
gagagcaaggaagc

SEQ ID NO: 3523904 - DNA, 16 bp, Homo sapiens
gagagcagaggtctcc

SEQ ID NO: 3523905 - DNA, 15 bp, Homo sapiens
gagagcatcggccta

SEQ ID NO: 3523906 - DNA, 11 bp, Homo sapiens
gagagccaaac

SEQ ID NO: 3523907 - DNA, 21 bp, Homo sapiens
gagagccaaacagagcccagg

SEQ ID NO: 3523908 - DNA, 20 bp, Homo sapiens
gagagccgtggtccctgagg

SEQ ID NO: 3523909 - DNA, 21 bp, Homo sapiens
gagagccgtggtccctgagga

SEQ ID NO: 3523910 - DNA, 19 bp, Homo sapiens
gagagcctggtgctgctgc

SEQ ID NO: 3523911 - DNA, 14 bp, Homo sapiens
gagagccttgggag

SEQ ID NO: 3523912 - DNA, 19 bp, Homo sapiens
gagagccttgggagccact

SEQ ID NO: 3523913 - DNA, 21 bp, Homo sapiens
gagagctagcagcagggaggg

SEQ ID NO: 3523914 - DNA, 16 bp, Homo sapiens
gagagctggagcctgg

SEQ ID NO: 3523915 - DNA, 20 bp, Homo sapiens
gagaggactgtagggagggc

SEQ ID NO: 3523916 - DNA, 22 bp, Homo sapiens
gagaggcagacttccctgaatg

SEQ ID NO: 3523917 - DNA, 18 bp, Homo sapiens
gagagggaggcaagccct

SEQ ID NO: 3523918 - DNA, 16 bp, Homo sapiens
gagaggggacgcaggc

SEQ ID NO: 3523919 - DNA, 17 bp, Homo sapiens
gagaggggacgcaggcc

SEQ ID NO: 3523920 - DNA, 19 bp, Homo sapiens
gagaggggacgcaggcccc

SEQ ID NO: 3523921 - DNA, 21 bp, Homo sapiens
gagaggggacgcaggcccctc

SEQ ID NO: 3523922 - DNA, 16 bp, Homo sapiens
gagataccatcttctg

SEQ ID NO: 3523923 - DNA, 16 bp, Homo sapiens
gagatcagcctgggca

SEQ ID NO: 3523924 - DNA, 12 bp, Homo sapiens
gagatcctcctg

SEQ ID NO: 3523925 - DNA, 18 bp, Homo sapiens
gagatcgtgccattgcac

SEQ ID NO: 3523926 - DNA, 23 bp, Homo sapiens
gagatgcattcttggttggctgg

SEQ ID NO: 3523927 - DNA, 12 bp, Homo sapiens
gagatgctggct

SEQ ID NO: 3523928 - DNA, 13 bp, Homo sapiens
gagatggaagctt

SEQ ID NO: 3523929 - DNA, 12 bp, Homo sapiens
gagatggacaga

SEQ ID NO: 3523930 - DNA, 14 bp, Homo sapiens
gagatggagctacg

SEQ ID NO: 3523931 - DNA, 20 bp, Homo sapiens
gagatggcgctattgcactc

SEQ ID NO: 3523932 - DNA, 14 bp, Homo sapiens
gagatggggtgggg

SEQ ID NO: 3523933 - DNA, 18 bp, Homo sapiens
gagattaagatgccttga

SEQ ID NO: 3523934 - DNA, 14 bp, Homo sapiens
gagattcaatattg

SEQ ID NO: 3523935 - DNA, 13 bp, Homo sapiens
gagatttcatctg

SEQ ID NO: 3523936 - DNA, 17 bp, Homo sapiens
gagatttcatctgctct

SEQ ID NO: 3523937 - DNA, 20 bp, Homo sapiens
gagatttcatctgctctcct

SEQ ID NO: 3523938 - DNA, 21 bp, Homo sapiens
gagatttcatctgctctcctt

SEQ ID NO: 3523939 - DNA, 22 bp, Homo sapiens
gagatttcatctgctctccttc

SEQ ID NO: 3523940 - DNA, 22 bp, Homo sapiens
gagcaaaggctgagaacactgt

SEQ ID NO: 3523941 - DNA, 14 bp, Homo sapiens
gagcaagactctgt

SEQ ID NO: 3523942 - DNA, 14 bp, Homo sapiens
gagcaccctctgga

SEQ ID NO: 3523943 - DNA, 23 bp, Homo sapiens
gagcaccgtgtcaagctgctctg

SEQ ID NO: 3523944 - DNA, 14 bp, Homo sapiens
gagcacctccacat

SEQ ID NO: 3523945 - DNA, 17 bp, Homo sapiens
gagcacctccagcctga

SEQ ID NO: 3523946 - DNA, 15 bp, Homo sapiens
gagcacttaagagaa

SEQ ID NO: 3523947 - DNA, 16 bp, Homo sapiens
gagcacttaagagaat

SEQ ID NO: 3523948 - DNA, 18 bp, Homo sapiens
gagcagagcccggagctc

SEQ ID NO: 3523949 - DNA, 22 bp, Homo sapiens
gagcagagcccggagctccggc

SEQ ID NO: 3523950 - DNA, 16 bp, Homo sapiens
gagcagaggggctgaa

SEQ ID NO: 3523951 - DNA, 17 bp, Homo sapiens
gagcagcctcagaacaa

SEQ ID NO: 3523952 - DNA, 16 bp, Homo sapiens
gagcagctaaagatga

SEQ ID NO: 3523953 - DNA, 22 bp, Homo sapiens
gagcaggacctctgaaaccctg

SEQ ID NO: 3523954 - DNA, 18 bp, Homo sapiens
gagcaggcggtgggcacc

SEQ ID NO: 3523955 - DNA, 20 bp, Homo sapiens
gagcagggggacctaggctc

SEQ ID NO: 3523956 - DNA, 22 bp, Homo sapiens
gagcagggggacctaggctcct

SEQ ID NO: 3523957 - DNA, 21 bp, Homo sapiens
gagcagtgaatgattcagtgt

SEQ ID NO: 3523958 - DNA, 17 bp, Homo sapiens
gagcagtgcaggcacag

SEQ ID NO: 3523959 - DNA, 17 bp, Homo sapiens
gagcagtttctgtcctg

SEQ ID NO: 3523960 - DNA, 20 bp, Homo sapiens
gagcagtttctgtcctgctg

SEQ ID NO: 3523961 - DNA, 21 bp, Homo sapiens
gagcagtttctgtcctgctgg

SEQ ID NO: 3523962 - DNA, 12 bp, Homo sapiens
gagcatcacaga

SEQ ID NO: 3523963 - DNA, 13 bp, Homo sapiens
gagcatcacagaa

SEQ ID NO: 3523964 - DNA, 14 bp, Homo sapiens
gagcatggagctgg

SEQ ID NO: 3523965 - DNA, 19 bp, Homo sapiens
gagcatttttttattcagc

SEQ ID NO: 3523966 - DNA, 21 bp, Homo sapiens
gagcatttttttattcagcag

SEQ ID NO: 3523967 - DNA, 18 bp, Homo sapiens
gagccaaacagagcccag

SEQ ID NO: 3523968 - DNA, 18 bp, Homo sapiens
gagccaagcttcaaccct

SEQ ID NO: 3523969 - DNA, 19 bp, Homo sapiens
gagccaatttaaagaaaac

SEQ ID NO: 3523970 - DNA, 12 bp, Homo sapiens
gagccacagggt

SEQ ID NO: 3523971 - DNA, 18 bp, Homo sapiens
gagccacagggtctgcct

SEQ ID NO: 3523972 - DNA, 14 bp, Homo sapiens
gagccacagtggga

SEQ ID NO: 3523973 - DNA, 19 bp, Homo sapiens
gagccaccacacctggcta

SEQ ID NO: 3523974 - DNA, 23 bp, Homo sapiens
gagccaccacacctggctaattt

SEQ ID NO: 3523975 - DNA, 22 bp, Homo sapiens
gagccactgcaccgggccacag

SEQ ID NO: 3523976 - DNA, 13 bp, Homo sapiens
gagccactgccac

SEQ ID NO: 3523977 - DNA, 14 bp, Homo sapiens
gagccagccaggcc

SEQ ID NO: 3523978 - DNA, 18 bp, Homo sapiens
gagccagctccctctatt

SEQ ID NO: 3523979 - DNA, 14 bp, Homo sapiens
gagcccaagggaat

SEQ ID NO: 3523980 - DNA, 11 bp, Homo sapiens
gagcccactgt

SEQ ID NO: 3523981 - DNA, 20 bp, Homo sapiens
gagcccagaaaacctccagt

SEQ ID NO: 3523982 - DNA, 12 bp, Homo sapiens
gagcccagctcc

SEQ ID NO: 3523983 - DNA, 13 bp, Homo sapiens
gagcccagctcca

SEQ ID NO: 3523984 - DNA, 12 bp, Homo sapiens
gagcccagctct

SEQ ID NO: 3523985 - DNA, 14 bp, Homo sapiens
gagcccagctctga

SEQ ID NO: 3523986 - DNA, 16 bp, Homo sapiens
gagcccagtctgttga

SEQ ID NO: 3523987 - DNA, 12 bp, Homo sapiens
gagccccatctg

SEQ ID NO: 3523988 - DNA, 18 bp, Homo sapiens
gagccccatcttcaccca

SEQ ID NO: 3523989 - DNA, 13 bp, Homo sapiens
gagccccgaggcc

SEQ ID NO: 3523990 - DNA, 17 bp, Homo sapiens
gagccccgaggccttct

SEQ ID NO: 3523991 - DNA, 14 bp, Homo sapiens
gagcccctggacat

SEQ ID NO: 3523992 - DNA, 23 bp, Homo sapiens
gagcccctggacatgcctgtcct

SEQ ID NO: 3523993 - DNA, 17 bp, Homo sapiens
gagccccttctgctcag

SEQ ID NO: 3523994 - DNA, 20 bp, Homo sapiens
gagccccttctgctcagctc

SEQ ID NO: 3523995 - DNA, 15 bp, Homo sapiens
gagccctcagaaccc

SEQ ID NO: 3523996 - DNA, 17 bp, Homo sapiens
gagccctccgccttcac

SEQ ID NO: 3523997 - DNA, 17 bp, Homo sapiens
gagccctggtggcagtg

SEQ ID NO: 3523998 - DNA, 18 bp, Homo sapiens
gagccctggtggcagtgg

SEQ ID NO: 3523999 - DNA, 23 bp, Homo sapiens
gatggatgccaatattaaatctg

SEQ ID NO: 3524000 - DNA, 17 bp, Homo sapiens
gatggattctccactca

SEQ ID NO: 3524001 - DNA, 16 bp, Homo sapiens
gatggcaacagatctg

SEQ ID NO: 3524002 - DNA, 21 bp, Homo sapiens
gatggcaacagatctggaacc

SEQ ID NO: 3524003 - DNA, 22 bp, Homo sapiens
gatggcaacagatctggaacct

SEQ ID NO: 3524004 - DNA, 20 bp, Homo sapiens
gatggcaggacgtgggctgg

SEQ ID NO: 3524005 - DNA, 14 bp, Homo sapiens
gatggccccagcac

SEQ ID NO: 3524006 - DNA, 15 bp, Homo sapiens
gatggccccagcaca

SEQ ID NO: 3524007 - DNA, 18 bp, Homo sapiens
gatggccgtggatggccg

SEQ ID NO: 3524008 - DNA, 20 bp, Homo sapiens
gatggcctggccagggcctg

SEQ ID NO: 3524009 - DNA, 20 bp, Homo sapiens
gatgggatggtggagggcca

SEQ ID NO: 3524010 - DNA, 20 bp, Homo sapiens
gatgggcaacccccagcctg

SEQ ID NO: 3524011 - DNA, 20 bp, Homo sapiens
gatgggcatatgtgtcagtg

SEQ ID NO: 3524012 - DNA, 18 bp, Homo sapiens
gatgggcctttgagcctg

SEQ ID NO: 3524013 - DNA, 14 bp, Homo sapiens
gatggggaaggagg

SEQ ID NO: 3524014 - DNA, 11 bp, Homo sapiens
gatggggaggg

SEQ ID NO: 3524015 - DNA, 21 bp, Homo sapiens
gatggggccctaattcagcca

SEQ ID NO: 3524016 - DNA, 16 bp, Homo sapiens
gatgggggaactcaga

SEQ ID NO: 3524017 - DNA, 19 bp, Homo sapiens
gatgggggaactcagatcc

SEQ ID NO: 3524018 - DNA, 16 bp, Homo sapiens
gatgggggcagggctg

SEQ ID NO: 3524019 - DNA, 20 bp, Homo sapiens
gatgggggcagggctgtgct

SEQ ID NO: 3524020 - DNA, 23 bp, Homo sapiens
gatggggtctcacagtgttgccc

SEQ ID NO: 3524021 - DNA, 20 bp, Homo sapiens
gatgggtcaggtagggggga

SEQ ID NO: 3524022 - DNA, 18 bp, Homo sapiens
gatgggttttatgagatg

SEQ ID NO: 3524023 - DNA, 16 bp, Homo sapiens
gatggtacgtgaccct

SEQ ID NO: 3524024 - DNA, 20 bp, Homo sapiens
gatggtacgtgaccctctgc

SEQ ID NO: 3524025 - DNA, 17 bp, Homo sapiens
gatggtctggtctatgt

SEQ ID NO: 3524026 - DNA, 12 bp, Homo sapiens
gatggtgctgag

SEQ ID NO: 3524027 - DNA, 14 bp, Homo sapiens
gatggtggagggcc

SEQ ID NO: 3524028 - DNA, 17 bp, Homo sapiens
gatggtggcacattcct

SEQ ID NO: 3524029 - DNA, 15 bp, Homo sapiens
gatggtgggcttcag

SEQ ID NO: 3524030 - DNA, 19 bp, Homo sapiens
gatggtgggcttcagggca

SEQ ID NO: 3524031 - DNA, 15 bp, Homo sapiens
gatggtgtgccttcc

SEQ ID NO: 3524032 - DNA, 18 bp, Homo sapiens
gatggtgtgggtgtcctg

SEQ ID NO: 3524033 - DNA, 14 bp, Homo sapiens
gatgtaaggcctta

SEQ ID NO: 3524034 - DNA, 22 bp, Homo sapiens
gatgtacatttccaaattcaca

SEQ ID NO: 3524035 - DNA, 15 bp, Homo sapiens
gatgtactaaagtag

SEQ ID NO: 3524036 - DNA, 21 bp, Homo sapiens
gatgtatattcctttgaagat

SEQ ID NO: 3524037 - DNA, 20 bp, Homo sapiens
gatgtatcgggaagatttct

SEQ ID NO: 3524038 - DNA, 22 bp, Homo sapiens
gatgtatcgggaagatttctaa

SEQ ID NO: 3524039 - DNA, 13 bp, Homo sapiens
gatgtccagagct

SEQ ID NO: 3524040 - DNA, 15 bp, Homo sapiens
gatgtgcctgggtgg

SEQ ID NO: 3524041 - DNA, 19 bp, Homo sapiens
gatgtggggctgagctggg

SEQ ID NO: 3524042 - DNA, 16 bp, Homo sapiens
gatgtggttttcttaa

SEQ ID NO: 3524043 - DNA, 16 bp, Homo sapiens
gatgtgtttgctttct

SEQ ID NO: 3524044 - DNA, 15 bp, Homo sapiens
gatgttctctatcat

SEQ ID NO: 3524045 - DNA, 19 bp, Homo sapiens
gatgttctctatcatttaa

SEQ ID NO: 3524046 - DNA, 21 bp, Homo sapiens
gatgttctctatcatttaata

SEQ ID NO: 3524047 - DNA, 16 bp, Homo sapiens
gatgttctgggacaca

SEQ ID NO: 3524048 - DNA, 15 bp, Homo sapiens
gatgttggctgggaa

SEQ ID NO: 3524049 - DNA, 12 bp, Homo sapiens
gatgtttccaga

SEQ ID NO: 3524050 - DNA, 18 bp, Homo sapiens
gatgtttcttttgtatgt

SEQ ID NO: 3524051 - DNA, 18 bp, Homo sapiens
gatgtttgcccaaaattt

SEQ ID NO: 3524052 - DNA, 12 bp, Homo sapiens
gatgtttggcct

SEQ ID NO: 3524053 - DNA, 15 bp, Homo sapiens
gattaaatatttgaa

SEQ ID NO: 3524054 - DNA, 19 bp, Homo sapiens
gattaaccacttcagctga

SEQ ID NO: 3524055 - DNA, 21 bp, Homo sapiens
gattaaccacttcagctgact

SEQ ID NO: 3524056 - DNA, 13 bp, Homo sapiens
gattacaagcgtg

SEQ ID NO: 3524057 - DNA, 20 bp, Homo sapiens
gattacaggtgtgaaccacc

SEQ ID NO: 3524058 - DNA, 17 bp, Homo sapiens
gattacctcctgagaaa

SEQ ID NO: 3524059 - DNA, 11 bp, Homo sapiens
gattaggtatg

SEQ ID NO: 3524060 - DNA, 22 bp, Homo sapiens
gattagttttcttgttgctttg

SEQ ID NO: 3524061 - DNA, 16 bp, Homo sapiens
gattatctatttgtgt

SEQ ID NO: 3524062 - DNA, 19 bp, Homo sapiens
gattatgtagcaaaataca

SEQ ID NO: 3524063 - DNA, 15 bp, Homo sapiens
gattcaaaatattta

SEQ ID NO: 3524064 - DNA, 19 bp, Homo sapiens
gattcaaactgctccaagt

SEQ ID NO: 3524065 - DNA, 14 bp, Homo sapiens
gattcacatctgca

SEQ ID NO: 3524066 - DNA, 13 bp, Homo sapiens
gattcagctctgc

SEQ ID NO: 3524067 - DNA, 15 bp, Homo sapiens
gattcagctctgcaa

SEQ ID NO: 3524068 - DNA, 15 bp, Homo sapiens
gattcagttttcatt

SEQ ID NO: 3524069 - DNA, 16 bp, Homo sapiens
gattcatagtaacttc

SEQ ID NO: 3524070 - DNA, 20 bp, Homo sapiens
gattcccaagctctgctcct

SEQ ID NO: 3524071 - DNA, 21 bp, Homo sapiens
gattcccaagctctgctcctc

SEQ ID NO: 3524072 - DNA, 17 bp, Homo sapiens
gattccccatctcaggc

SEQ ID NO: 3524073 - DNA, 20 bp, Homo sapiens
gattccccatctcaggccag

SEQ ID NO: 3524074 - DNA, 15 bp, Homo sapiens
gattcccctgtgtca

SEQ ID NO: 3524075 - DNA, 16 bp, Homo sapiens
gattcggtatcccccc

SEQ ID NO: 3524076 - DNA, 15 bp, Homo sapiens
gattctatttatatg

SEQ ID NO: 3524077 - DNA, 21 bp, Homo sapiens
gattctatttatatgtacatg

SEQ ID NO: 3524078 - DNA, 19 bp, Homo sapiens
gattctcagggtctctgct

SEQ ID NO: 3524079 - DNA, 15 bp, Homo sapiens
gattctcctgcctca

SEQ ID NO: 3524080 - DNA, 18 bp, Homo sapiens
gattctccttcagccctc

SEQ ID NO: 3524081 - DNA, 15 bp, Homo sapiens
gattctgcagtaaat

SEQ ID NO: 3524082 - DNA, 22 bp, Homo sapiens
gattctggttccagggtccctc

SEQ ID NO: 3524083 - DNA, 21 bp, Homo sapiens
gattcttctgcttcagcctcc

SEQ ID NO: 3524084 - DNA, 14 bp, Homo sapiens
gattctttaaatat

SEQ ID NO: 3524085 - DNA, 20 bp, Homo sapiens
gattctttcccaattcacat

SEQ ID NO: 3524086 - DNA, 18 bp, Homo sapiens
gattgcaacaggctgggc

SEQ ID NO: 3524087 - DNA, 20 bp, Homo sapiens
gattgcaacaggctgggctt

SEQ ID NO: 3524088 - DNA, 17 bp, Homo sapiens
gattgcatgtgactctg

SEQ ID NO: 3524089 - DNA, 11 bp, Homo sapiens
gattgctgcca

SEQ ID NO: 3524090 - DNA, 16 bp, Homo sapiens
gattgctgccccatca

SEQ ID NO: 3524091 - DNA, 20 bp, Homo sapiens
gattgctgccccatcagtgc

SEQ ID NO: 3524092 - DNA, 14 bp, Homo sapiens
gattgcttaaaata

SEQ ID NO: 3524093 - DNA, 17 bp, Homo sapiens
gattgcttaaaatagca

SEQ ID NO: 3524094 - DNA, 17 bp, Homo sapiens
gattggctcacactgag

SEQ ID NO: 3524095 - DNA, 20 bp, Homo sapiens
gattggctcacactgagaat

SEQ ID NO: 3524096 - DNA, 13 bp, Homo sapiens
gattgggagaaag

SEQ ID NO: 3524097 - DNA, 18 bp, Homo sapiens
gattggtatgatgctgcc

SEQ ID NO: 3524098 - DNA, 19 bp, Homo sapiens
gattgtcctcatttctcca

SEQ ID NO: 3524099 - DNA, 20 bp, Homo sapiens
gattgtcctttaaaaaagaa

SEQ ID NO: 3524100 - DNA, 16 bp, Homo sapiens
gattgttaaaataact

SEQ ID NO: 3524101 - DNA, 18 bp, Homo sapiens
gattgtttacaggatatt

SEQ ID NO: 3524102 - DNA, 17 bp, Homo sapiens
gatttaaacacacagat

SEQ ID NO: 3524103 - DNA, 12 bp, Homo sapiens
gatttaaatcag

SEQ ID NO: 3524104 - DNA, 17 bp, Homo sapiens
gatttaagttacaatgt

SEQ ID NO: 3524105 - DNA, 13 bp, Homo sapiens
gatttatttgctt

SEQ ID NO: 3524106 - DNA, 22 bp, Homo sapiens
gatttccagtctccaccaggaa

SEQ ID NO: 3524107 - DNA, 21 bp, Homo sapiens
gatttcccccctccgcctcca

SEQ ID NO: 3524108 - DNA, 22 bp, Homo sapiens
gatttccttgaatgtggcttga

SEQ ID NO: 3524109 - DNA, 19 bp, Homo sapiens
gatttctgtctactaagtg

SEQ ID NO: 3524110 - DNA, 23 bp, Homo sapiens
gatttcttttgtaataaactatt

SEQ ID NO: 3524111 - DNA, 12 bp, Homo sapiens
gatttgggctgg

SEQ ID NO: 3524112 - DNA, 20 bp, Homo sapiens
gatttgtcagagaacctgtt

SEQ ID NO: 3524113 - DNA, 18 bp, Homo sapiens
gatttgtgtttctttata

SEQ ID NO: 3524114 - DNA, 22 bp, Homo sapiens
gattttaatagggaatatatct

SEQ ID NO: 3524115 - DNA, 17 bp, Homo sapiens
gattttaatcaagttga

SEQ ID NO: 3524116 - DNA, 17 bp, Homo sapiens
gattttcaaaagataat

SEQ ID NO: 3524117 - DNA, 15 bp, Homo sapiens
gattttgctgtatat

SEQ ID NO: 3524118 - DNA, 19 bp, Homo sapiens
gattttggttttgttcccc

SEQ ID NO: 3524119 - DNA, 22 bp, Homo sapiens
gattttggttttgttcccctcc

SEQ ID NO: 3524120 - DNA, 21 bp, Homo sapiens
gattttttcagacttgtcaag

SEQ ID NO: 3524121 - DNA, 12 bp, Homo sapiens
gcaaaaaaatta

SEQ ID NO: 3524122 - DNA, 21 bp, Homo sapiens
gcaaaaaaattaaaatggatg

SEQ ID NO: 3524123 - DNA, 21 bp, Homo sapiens
gcaaaaaatactttttctaat

SEQ ID NO: 3524124 - DNA, 13 bp, Homo sapiens
gcaaaaagcaaaa

SEQ ID NO: 3524125 - DNA, 14 bp, Homo sapiens
gcaaaaatatttat

SEQ ID NO: 3524126 - DNA, 12 bp, Homo sapiens
gcaaaaccagaa

SEQ ID NO: 3524127 - DNA, 20 bp, Homo sapiens
gcaaaactaaatacttgctc

SEQ ID NO: 3524128 - DNA, 23 bp, Homo sapiens
gcaaaactaaatacttgctccat

SEQ ID NO: 3524129 - DNA, 22 bp, Homo sapiens
gcaaaactctacttaatccaat

SEQ ID NO: 3524130 - DNA, 23 bp, Homo sapiens
gcaaaactctacttaatccaatg

SEQ ID NO: 3524131 - DNA, 16 bp, Homo sapiens
gccaagctccttggga

SEQ ID NO: 3524132 - DNA, 19 bp, Homo sapiens
gccaagctccttgggaggc

SEQ ID NO: 3524133 - DNA, 20 bp, Homo sapiens
gccaaggcagcgaccccagg

SEQ ID NO: 3524134 - DNA, 11 bp, Homo sapiens
gccaaggccta

SEQ ID NO: 3524135 - DNA, 13 bp, Homo sapiens
gccaaggcctagg

SEQ ID NO: 3524136 - DNA, 15 bp, Homo sapiens
gccaagggccagaca

SEQ ID NO: 3524137 - DNA, 17 bp, Homo sapiens
gccaagggccagacaga

SEQ ID NO: 3524138 - DNA, 16 bp, Homo sapiens
gccaagggctttgttt

SEQ ID NO: 3524139 - DNA, 14 bp, Homo sapiens
gccaaggtgggagg

SEQ ID NO: 3524140 - DNA, 15 bp, Homo sapiens
gccaaggtgggagga

SEQ ID NO: 3524141 - DNA, 20 bp, Homo sapiens
gccaagtttatatacaatta

SEQ ID NO: 3524142 - DNA, 17 bp, Homo sapiens
gccaatatgccagcttg

SEQ ID NO: 3524143 - DNA, 18 bp, Homo sapiens
gccaatattaaatctgct

SEQ ID NO: 3524144 - DNA, 18 bp, Homo sapiens
gccaatctgcaatttcta

SEQ ID NO: 3524145 - DNA, 15 bp, Homo sapiens
gccaattatgttaaa

SEQ ID NO: 3524146 - DNA, 17 bp, Homo sapiens
gccaattatgttaaact

SEQ ID NO: 3524147 - DNA, 18 bp, Homo sapiens
gccaattcagacaggcaa

SEQ ID NO: 3524148 - DNA, 17 bp, Homo sapiens
gccacaaggacttcctg

SEQ ID NO: 3524149 - DNA, 13 bp, Homo sapiens
gccacaccaggat

SEQ ID NO: 3524150 - DNA, 21 bp, Homo sapiens
gccacaccaggatagagactg

SEQ ID NO: 3524151 - DNA, 16 bp, Homo sapiens
gccacactcagcacaa

SEQ ID NO: 3524152 - DNA, 19 bp, Homo sapiens
gccacactcagcacaaggc

SEQ ID NO: 3524153 - DNA, 14 bp, Homo sapiens
gccacagagaaagt

SEQ ID NO: 3524154 - DNA, 21 bp, Homo sapiens
gccacagcctcccctgccagg

SEQ ID NO: 3524155 - DNA, 13 bp, Homo sapiens
gccacaggcctga

SEQ ID NO: 3524156 - DNA, 22 bp, Homo sapiens
gccacaggcctgagatttcatc

SEQ ID NO: 3524157 - DNA, 18 bp, Homo sapiens
gccacagggtctgcctcc

SEQ ID NO: 3524158 - DNA, 20 bp, Homo sapiens
gccacagggtctgcctccag

SEQ ID NO: 3524159 - DNA, 18 bp, Homo sapiens
gccacagtatggatgggt

SEQ ID NO: 3524160 - DNA, 22 bp, Homo sapiens
gccacagtatggatgggtggat

SEQ ID NO: 3524161 - DNA, 19 bp, Homo sapiens
gccaccaagagggacgcct

SEQ ID NO: 3524162 - DNA, 14 bp, Homo sapiens
gccaccagcatcca

SEQ ID NO: 3524163 - DNA, 18 bp, Homo sapiens
gccaccaggccacctccc

SEQ ID NO: 3524164 - DNA, 20 bp, Homo sapiens
gccaccaggtgcctttcaaa

SEQ ID NO: 3524165 - DNA, 18 bp, Homo sapiens
gccaccatggccagccaa

SEQ ID NO: 3524166 - DNA, 18 bp, Homo sapiens
gccacccacctccctgcc

SEQ ID NO: 3524167 - DNA, 17 bp, Homo sapiens
gccacccccagttccta

SEQ ID NO: 3524168 - DNA, 16 bp, Homo sapiens
gccacgctccagctgc

SEQ ID NO: 3524169 - DNA, 14 bp, Homo sapiens
gccacggccaggcc

SEQ ID NO: 3524170 - DNA, 18 bp, Homo sapiens
gccacggccaggccagag

SEQ ID NO: 3524171 - DNA, 19 bp, Homo sapiens
gccacggccaggccagagg

SEQ ID NO: 3524172 - DNA, 22 bp, Homo sapiens
gccacgttggagaagcccgtgt

SEQ ID NO: 3524173 - DNA, 14 bp, Homo sapiens
gccactaagcagag

SEQ ID NO: 3524174 - DNA, 17 bp, Homo sapiens
gccactaagcagaggag

SEQ ID NO: 3524175 - DNA, 19 bp, Homo sapiens
gccactaagcagaggaggg

SEQ ID NO: 3524176 - DNA, 15 bp, Homo sapiens
gccactcactaggcc

SEQ ID NO: 3524177 - DNA, 15 bp, Homo sapiens
gccactccagtcctg

SEQ ID NO: 3524178 - DNA, 18 bp, Homo sapiens
gccactccagtcctgcca

SEQ ID NO: 3524179 - DNA, 16 bp, Homo sapiens
gccactcctccctccg

SEQ ID NO: 3524180 - DNA, 18 bp, Homo sapiens
gccactgcaccgggccac

SEQ ID NO: 3524181 - DNA, 19 bp, Homo sapiens
gccactgcaccgggccaca

SEQ ID NO: 3524182 - DNA, 20 bp, Homo sapiens
gccactgccactccagtcct

SEQ ID NO: 3524183 - DNA, 16 bp, Homo sapiens
gccactggtttctcag

SEQ ID NO: 3524184 - DNA, 21 bp, Homo sapiens
gccactgtgtaacatagctga

SEQ ID NO: 3524185 - DNA, 14 bp, Homo sapiens
gccacttctgggtg

SEQ ID NO: 3524186 - DNA, 16 bp, Homo sapiens
gccacttctgtccata

SEQ ID NO: 3524187 - DNA, 17 bp, Homo sapiens
gccacttctgtccatat

SEQ ID NO: 3524188 - DNA, 21 bp, Homo sapiens
gccagaagctgagcaccaggg

SEQ ID NO: 3524189 - DNA, 17 bp, Homo sapiens
gccagacacaggccctc

SEQ ID NO: 3524190 - DNA, 19 bp, Homo sapiens
gccagagaagtctggtcag

SEQ ID NO: 3524191 - DNA, 21 bp, Homo sapiens
gccagagagcctggtgctgct

SEQ ID NO: 3524192 - DNA, 13 bp, Homo sapiens
gccagagatccaa

SEQ ID NO: 3524193 - DNA, 22 bp, Homo sapiens
gccagagatccaaaagaagccc

SEQ ID NO: 3524194 - DNA, 14 bp, Homo sapiens
gccagagcaggggg

SEQ ID NO: 3524195 - DNA, 22 bp, Homo sapiens
gccagagccaaggggcttcagg

SEQ ID NO: 3524196 - DNA, 15 bp, Homo sapiens
gccagaggcccccag

SEQ ID NO: 3524197 - DNA, 19 bp, Homo sapiens
gccagaggcccccagccca

SEQ ID NO: 3524198 - DNA, 22 bp, Homo sapiens
gccagaggctcgttgactggct

SEQ ID NO: 3524199 - DNA, 17 bp, Homo sapiens
gccagagggagtgacag

SEQ ID NO: 3524200 - DNA, 18 bp, Homo sapiens
gccagagggagtgacaga

SEQ ID NO: 3524201 - DNA, 22 bp, Homo sapiens
gccagagggagtgacagaggca

SEQ ID NO: 3524202 - DNA, 23 bp, Homo sapiens
gccagagggagtgacagaggcag

SEQ ID NO: 3524203 - DNA, 15 bp, Homo sapiens
gccagaggtgcttca

SEQ ID NO: 3524204 - DNA, 16 bp, Homo sapiens
gccagatccagcctgg

SEQ ID NO: 3524205 - DNA, 18 bp, Homo sapiens
gccagatgcaccagccct

SEQ ID NO: 3524206 - DNA, 16 bp, Homo sapiens
gccagatttgtctttt

SEQ ID NO: 3524207 - DNA, 15 bp, Homo sapiens
gccagcacacagggc

SEQ ID NO: 3524208 - DNA, 16 bp, Homo sapiens
gccagcacacagggca

SEQ ID NO: 3524209 - DNA, 18 bp, Homo sapiens
gccagcacacagggcagt

SEQ ID NO: 3524210 - DNA, 14 bp, Homo sapiens
gccagcacctggca

SEQ ID NO: 3524211 - DNA, 14 bp, Homo sapiens
gccagcagcataga

SEQ ID NO: 3524212 - DNA, 18 bp, Homo sapiens
gccagccagaagcctctg

SEQ ID NO: 3524213 - DNA, 16 bp, Homo sapiens
gccagccaggccctgc

SEQ ID NO: 3524214 - DNA, 12 bp, Homo sapiens
gccagcgtcctc

SEQ ID NO: 3524215 - DNA, 15 bp, Homo sapiens
gccagctatctgcct

SEQ ID NO: 3524216 - DNA, 19 bp, Homo sapiens
gccagctatctgcctgaca

SEQ ID NO: 3524217 - DNA, 13 bp, Homo sapiens
gccagctctgtat

SEQ ID NO: 3524218 - DNA, 20 bp, Homo sapiens
gccagctgcactgatgctgc

SEQ ID NO: 3524219 - DNA, 15 bp, Homo sapiens
gccagctgccctatg

SEQ ID NO: 3524220 - DNA, 22 bp, Homo sapiens
gccagctgccctatgggcctgc

SEQ ID NO: 3524221 - DNA, 13 bp, Homo sapiens
gccagctgcctcc

SEQ ID NO: 3524222 - DNA, 16 bp, Homo sapiens
gccagctgctccccag

SEQ ID NO: 3524223 - DNA, 14 bp, Homo sapiens
gccagctggcagca

SEQ ID NO: 3524224 - DNA, 18 bp, Homo sapiens
gccagcttgttatttata

SEQ ID NO: 3524225 - DNA, 17 bp, Homo sapiens
gccaggaatttcccagg

SEQ ID NO: 3524226 - DNA, 20 bp, Homo sapiens
gccaggaatttcccaggacc

SEQ ID NO: 3524227 - DNA, 22 bp, Homo sapiens
gccaggaatttcccaggaccct

SEQ ID NO: 3524228 - DNA, 16 bp, Homo sapiens
gccaggagcgcatctc

SEQ ID NO: 3524229 - DNA, 20 bp, Homo sapiens
gccaggatggaacacggcca

SEQ ID NO: 3524230 - DNA, 12 bp, Homo sapiens
gccaggccagag

SEQ ID NO: 3524231 - DNA, 17 bp, Homo sapiens
gccaggcctcttggcag

SEQ ID NO: 3524232 - DNA, 21 bp, Homo sapiens
gccaggcctcttggcagtcac

SEQ ID NO: 3524233 - DNA, 16 bp, Homo sapiens
gccaggcgagatgggg

SEQ ID NO: 3524234 - DNA, 15 bp, Homo sapiens
gccaggctgaccaca

SEQ ID NO: 3524235 - DNA, 16 bp, Homo sapiens
gccaggctgaccacag

SEQ ID NO: 3524236 - DNA, 20 bp, Homo sapiens
gccaggctgaccacagcaca

SEQ ID NO: 3524237 - DNA, 18 bp, Homo sapiens
gccagggagacctggaca

SEQ ID NO: 3524238 - DNA, 19 bp, Homo sapiens
gccagggagacctggacac

SEQ ID NO: 3524239 - DNA, 22 bp, Homo sapiens
gccagggaggtggaaggaccct

SEQ ID NO: 3524240 - DNA, 19 bp, Homo sapiens
gccagggcagggccccagg

SEQ ID NO: 3524241 - DNA, 19 bp, Homo sapiens
gccagggccacgctccagc

SEQ ID NO: 3524242 - DNA, 20 bp, Homo sapiens
gccagggccacgctccagct

SEQ ID NO: 3524243 - DNA, 10 bp, Homo sapiens
gccagggctt

SEQ ID NO: 3524244 - DNA, 12 bp, Homo sapiens
gccagggcttcc

SEQ ID NO: 3524245 - DNA, 16 bp, Homo sapiens
gccagggcttcctctt

SEQ ID NO: 3524246 - DNA, 20 bp, Homo sapiens
gccaggggggtgaggagctg

SEQ ID NO: 3524247 - DNA, 17 bp, Homo sapiens
gccaggtttttggtctg

SEQ ID NO: 3524248 - DNA, 14 bp, Homo sapiens
gccagtccaggctg

SEQ ID NO: 3524249 - DNA, 13 bp, Homo sapiens
gccagtctgtgga

SEQ ID NO: 3524250 - DNA, 20 bp, Homo sapiens
gccagtctgtggatcagaga

SEQ ID NO: 3524251 - DNA, 17 bp, Homo sapiens
gccagtgacctgaggaa

SEQ ID NO: 3524252 - DNA, 13 bp, Homo sapiens
gccagtgtgacaa

SEQ ID NO: 3524253 - DNA, 21 bp, Homo sapiens
gccataaaacattaagaaaat

SEQ ID NO: 3524254 - DNA, 22 bp, Homo sapiens
gccataaaacattaagaaaatc

SEQ ID NO: 3524255 - DNA, 16 bp, Homo sapiens
gccatagccaggagcg

SEQ ID NO: 3524256 - DNA, 17 bp, Homo sapiens
gccatattttcaccatt

SEQ ID NO: 3524257 - DNA, 14 bp, Homo sapiens
gccatcaaaatgct

SEQ ID NO: 3524258 - DNA, 16 bp, Homo sapiens
gccatcaaaatgcttt

SEQ ID NO: 3524259 - DNA, 19 bp, Homo sapiens
gccatccaggttcagcttg

SEQ ID NO: 3524260 - DNA, 20 bp, Homo sapiens
gccatccaggttcagcttgt

SEQ ID NO: 3524261 - DNA, 21 bp, Homo sapiens
gccatcctcaaacactgcagg

SEQ ID NO: 3524262 - DNA, 15 bp, Homo sapiens
gccatctctggatgc

SEQ ID NO: 3524263 - DNA, 13 bp, Homo sapiens
gcctaggcctcag

SEQ ID NO: 3524264 - DNA, 16 bp, Homo sapiens
gcctaggcctcagcca

SEQ ID NO: 3524265 - DNA, 17 bp, Homo sapiens
gcctaggcctcagccag

SEQ ID NO: 3524266 - DNA, 20 bp, Homo sapiens
gcctaggtcccccaagcatg

SEQ ID NO: 3524267 - DNA, 20 bp, Homo sapiens
gcctattgcttgggtctctc

SEQ ID NO: 3524268 - DNA, 13 bp, Homo sapiens
gcctatttgtgtg

SEQ ID NO: 3524269 - DNA, 20 bp, Homo sapiens
gcctcaaaaacgccctcaag

SEQ ID NO: 3524270 - DNA, 19 bp, Homo sapiens
gcctcaagtgattctcctg

SEQ ID NO: 3524271 - DNA, 22 bp, Homo sapiens
gcctcaagtgattctcctgcct

SEQ ID NO: 3524272 - DNA, 18 bp, Homo sapiens
gcctcacccacccctgca

SEQ ID NO: 3524273 - DNA, 15 bp, Homo sapiens
gcctcaccttggggc

SEQ ID NO: 3524274 - DNA, 19 bp, Homo sapiens
gcctcactaatttttgtat

SEQ ID NO: 3524275 - DNA, 18 bp, Homo sapiens
gcctcagcatcctggcac

SEQ ID NO: 3524276 - DNA, 17 bp, Homo sapiens
gcctcagccctgaccct

SEQ ID NO: 3524277 - DNA, 22 bp, Homo sapiens
gcctcagccctgaccctgtgga

SEQ ID NO: 3524278 - DNA, 14 bp, Homo sapiens
gcctcagcctccca

SEQ ID NO: 3524279 - DNA, 16 bp, Homo sapiens
gcctcagcctcccaag

SEQ ID NO: 3524280 - DNA, 18 bp, Homo sapiens
gcctcagcgcggccctcc

SEQ ID NO: 3524281 - DNA, 12 bp, Homo sapiens
gcctcagtgccc

SEQ ID NO: 3524282 - DNA, 15 bp, Homo sapiens
gcctcagtgccccat

SEQ ID NO: 3524283 - DNA, 15 bp, Homo sapiens
gcctcatgtggctgg

SEQ ID NO: 3524284 - DNA, 16 bp, Homo sapiens
gcctcatgtggctgga

SEQ ID NO: 3524285 - DNA, 19 bp, Homo sapiens
gcctcatgtggctggaaga

SEQ ID NO: 3524286 - DNA, 18 bp, Homo sapiens
gcctccagggctggactg

SEQ ID NO: 3524287 - DNA, 21 bp, Homo sapiens
gcctccagggctggactgagg

SEQ ID NO: 3524288 - DNA, 12 bp, Homo sapiens
gcctccatcctc

SEQ ID NO: 3524289 - DNA, 22 bp, Homo sapiens
gcctccatcctcatctctcttg

SEQ ID NO: 3524290 - DNA, 19 bp, Homo sapiens
gcctccattatccattccc

SEQ ID NO: 3524291 - DNA, 16 bp, Homo sapiens
gcctcccaaagtgctg

SEQ ID NO: 3524292 - DNA, 17 bp, Homo sapiens
gcctcccaaagtgctgg

SEQ ID NO: 3524293 - DNA, 12 bp, Homo sapiens
gcctcccacccc

SEQ ID NO: 3524294 - DNA, 14 bp, Homo sapiens
gcctcccctgccag

SEQ ID NO: 3524295 - DNA, 20 bp, Homo sapiens
gcctcccgaatagctgggac

SEQ ID NO: 3524296 - DNA, 14 bp, Homo sapiens
gcctcccgaggctt

SEQ ID NO: 3524297 - DNA, 18 bp, Homo sapiens
gcctccctgaagcctttg

SEQ ID NO: 3524298 - DNA, 14 bp, Homo sapiens
gcctccgacgctgc

SEQ ID NO: 3524299 - DNA, 17 bp, Homo sapiens
gcctcgaactggctgca

SEQ ID NO: 3524300 - DNA, 15 bp, Homo sapiens
gcctcgaggtgcctt

SEQ ID NO: 3524301 - DNA, 19 bp, Homo sapiens
gcctcgctctgttacccag

SEQ ID NO: 3524302 - DNA, 17 bp, Homo sapiens
gcctcggcctcccaaag

SEQ ID NO: 3524303 - DNA, 18 bp, Homo sapiens
gcctcggcttttctcagc

SEQ ID NO: 3524304 - DNA, 19 bp, Homo sapiens
gcctcggcttttctcagct

SEQ ID NO: 3524305 - DNA, 20 bp, Homo sapiens
gcctcggcttttctcagctg

SEQ ID NO: 3524306 - DNA, 20 bp, Homo sapiens
gcctctccttgtggcctggg

SEQ ID NO: 3524307 - DNA, 15 bp, Homo sapiens
gcctctgacacacag

SEQ ID NO: 3524308 - DNA, 19 bp, Homo sapiens
gcctctgacacacagctct

SEQ ID NO: 3524309 - DNA, 17 bp, Homo sapiens
gcctctgcaactgctca

SEQ ID NO: 3524310 - DNA, 13 bp, Homo sapiens
gcctctgggtcag

SEQ ID NO: 3524311 - DNA, 22 bp, Homo sapiens
gcctctgtccccttctctcatc

SEQ ID NO: 3524312 - DNA, 12 bp, Homo sapiens
gcctctgtgcct

SEQ ID NO: 3524313 - DNA, 14 bp, Homo sapiens
gcctctgtgctgtg

SEQ ID NO: 3524314 - DNA, 12 bp, Homo sapiens
gcctcttctcta

SEQ ID NO: 3524315 - DNA, 23 bp, Homo sapiens
gcctcttctctactctagggaaa

SEQ ID NO: 3524316 - DNA, 14 bp, Homo sapiens
gcctcttctgggag

SEQ ID NO: 3524317 - DNA, 19 bp, Homo sapiens
gcctcttggggaaggggca

SEQ ID NO: 3524318 - DNA, 14 bp, Homo sapiens
gcctcttgggttca

SEQ ID NO: 3524319 - DNA, 16 bp, Homo sapiens
gcctcttttacctgct

SEQ ID NO: 3524320 - DNA, 17 bp, Homo sapiens
gcctgaaactttgagga

SEQ ID NO: 3524321 - DNA, 16 bp, Homo sapiens
gcctgaagccagctgc

SEQ ID NO: 3524322 - DNA, 16 bp, Homo sapiens
gcctgacaaggccagc

SEQ ID NO: 3524323 - DNA, 18 bp, Homo sapiens
gcctgacagtgtgggaca

SEQ ID NO: 3524324 - DNA, 22 bp, Homo sapiens
gcctgagatttcatctgctctc

SEQ ID NO: 3524325 - DNA, 23 bp, Homo sapiens
gcctgagcgctcctgccgcagag

SEQ ID NO: 3524326 - DNA, 14 bp, Homo sapiens
gcctgagctgcttc

SEQ ID NO: 3524327 - DNA, 22 bp, Homo sapiens
gcctgagctgcttcactaggga

SEQ ID NO: 3524328 - DNA, 21 bp, Homo sapiens
gcctgagtagaaaggccttta

SEQ ID NO: 3524329 - DNA, 23 bp, Homo sapiens
gcctgagtccacgacctaggcag

SEQ ID NO: 3524330 - DNA, 20 bp, Homo sapiens
gcctgatgagatttttaaaa

SEQ ID NO: 3524331 - DNA, 13 bp, Homo sapiens
gcctgatggacct

SEQ ID NO: 3524332 - DNA, 19 bp, Homo sapiens
gcctgattgccaagctcag

SEQ ID NO: 3524333 - DNA, 21 bp, Homo sapiens
gcctgattgccaagctcagga

SEQ ID NO: 3524334 - DNA, 16 bp, Homo sapiens
gcctgcaaacgctgcc

SEQ ID NO: 3524335 - DNA, 20 bp, Homo sapiens
gcctgcaaacgctgcctgcc

SEQ ID NO: 3524336 - DNA, 21 bp, Homo sapiens
gcctgcaaacgctgcctgccc

SEQ ID NO: 3524337 - DNA, 21 bp, Homo sapiens
gcctgcagaagtaagcctcat

SEQ ID NO: 3524338 - DNA, 13 bp, Homo sapiens
gcctgcagcagga

SEQ ID NO: 3524339 - DNA, 14 bp, Homo sapiens
gcctgcaggacctg

SEQ ID NO: 3524340 - DNA, 15 bp, Homo sapiens
gcctgccagctgcac

SEQ ID NO: 3524341 - DNA, 14 bp, Homo sapiens
gcctgcccaggccc

SEQ ID NO: 3524342 - DNA, 15 bp, Homo sapiens
gcctgcccaggcccc

SEQ ID NO: 3524343 - DNA, 17 bp, Homo sapiens
gcctgcccaggcccctg

SEQ ID NO: 3524344 - DNA, 19 bp, Homo sapiens
gcctgcccaggcccctgcc

SEQ ID NO: 3524345 - DNA, 20 bp, Homo sapiens
gcctgcccaggcccctgcca

SEQ ID NO: 3524346 - DNA, 23 bp, Homo sapiens
gcctgccccaaacaaatatgcaa

SEQ ID NO: 3524347 - DNA, 21 bp, Homo sapiens
gcctgccggtaaacacgcctg

SEQ ID NO: 3524348 - DNA, 20 bp, Homo sapiens
gcctgcctatgaaatttcaa

SEQ ID NO: 3524349 - DNA, 13 bp, Homo sapiens
gcctgcctggcag

SEQ ID NO: 3524350 - DNA, 16 bp, Homo sapiens
gcctgctagctagctc

SEQ ID NO: 3524351 - DNA, 22 bp, Homo sapiens
gcctgctagctagctcaactag

SEQ ID NO: 3524352 - DNA, 13 bp, Homo sapiens
gcctgctccagac

SEQ ID NO: 3524353 - DNA, 15 bp, Homo sapiens
gcctgctccagacct

SEQ ID NO: 3524354 - DNA, 16 bp, Homo sapiens
gcctgctccagacctg

SEQ ID NO: 3524355 - DNA, 16 bp, Homo sapiens
gcctgctccagctgtt

SEQ ID NO: 3524356 - DNA, 13 bp, Homo sapiens
gcctgctggaggc

SEQ ID NO: 3524357 - DNA, 22 bp, Homo sapiens
gcctgctgtcaagtcccccagc

SEQ ID NO: 3524358 - DNA, 21 bp, Homo sapiens
gcctgctgttggtcctctctc

SEQ ID NO: 3524359 - DNA, 22 bp, Homo sapiens
gcctgctgttggtcctctctct

SEQ ID NO: 3524360 - DNA, 22 bp, Homo sapiens
gcctggaagacagagacctcct

SEQ ID NO: 3524361 - DNA, 23 bp, Homo sapiens
gcctggaagacagagacctcctg

SEQ ID NO: 3524362 - DNA, 19 bp, Homo sapiens
gcctggagacttagggcac

SEQ ID NO: 3524363 - DNA, 11 bp, Homo sapiens
gcctggagccc

SEQ ID NO: 3524364 - DNA, 13 bp, Homo sapiens
gcctggagccctc

SEQ ID NO: 3524365 - DNA, 24 bp, Homo sapiens
gcctggagtgtatgactgcacatg

SEQ ID NO: 3524366 - DNA, 13 bp, Homo sapiens
gcctggcagctca

SEQ ID NO: 3524367 - DNA, 20 bp, Homo sapiens
gcctggcagctcagcttccc

SEQ ID NO: 3524368 - DNA, 17 bp, Homo sapiens
gcctggccagacacagg

SEQ ID NO: 3524369 - DNA, 16 bp, Homo sapiens
gcctggccagatgcac

SEQ ID NO: 3524370 - DNA, 16 bp, Homo sapiens
gcctggccccatggtc

SEQ ID NO: 3524371 - DNA, 15 bp, Homo sapiens
gcctggccggctcca

SEQ ID NO: 3524372 - DNA, 16 bp, Homo sapiens
gcctgggccgctgcca

SEQ ID NO: 3524373 - DNA, 22 bp, Homo sapiens
gcctgggccgtatctccggctc

SEQ ID NO: 3524374 - DNA, 22 bp, Homo sapiens
gcctgggggacccctggctctg

SEQ ID NO: 3524375 - DNA, 14 bp, Homo sapiens
gcctggggtctgga

SEQ ID NO: 3524376 - DNA, 20 bp, Homo sapiens
gcctgggtgacaaagcgaga

SEQ ID NO: 3524377 - DNA, 22 bp, Homo sapiens
gcctgggttttgttccctattt

SEQ ID NO: 3524378 - DNA, 14 bp, Homo sapiens
gcctggtattttca

SEQ ID NO: 3524379 - DNA, 18 bp, Homo sapiens
gcctggtggcagctgcgg

SEQ ID NO: 3524380 - DNA, 17 bp, Homo sapiens
gcctgtaatcccagcac

SEQ ID NO: 3524381 - DNA, 20 bp, Homo sapiens
gcctgtaatcctagcacttt

SEQ ID NO: 3524382 - DNA, 22 bp, Homo sapiens
gcctgtagaatagcctgtggcc

SEQ ID NO: 3524383 - DNA, 19 bp, Homo sapiens
gcctgtagcccactctgct

SEQ ID NO: 3524384 - DNA, 14 bp, Homo sapiens
gcctgtcctgaaag

SEQ ID NO: 3524385 - DNA, 15 bp, Homo sapiens
gcctgtcctgaaagc

SEQ ID NO: 3524386 - DNA, 18 bp, Homo sapiens
gcctgtcctgaaagcggc

SEQ ID NO: 3524387 - DNA, 20 bp, Homo sapiens
gcctgtcctgaaagcggctg

SEQ ID NO: 3524388 - DNA, 13 bp, Homo sapiens
gcctgtctgcccc

SEQ ID NO: 3524389 - DNA, 15 bp, Homo sapiens
gcctgtctgccccag

SEQ ID NO: 3524390 - DNA, 21 bp, Homo sapiens
gcctgtctgccccagcccaga

SEQ ID NO: 3524391 - DNA, 16 bp, Homo sapiens
gcctgtctgtgacctg

SEQ ID NO: 3524392 - DNA, 14 bp, Homo sapiens
gcctgtggccctgt

SEQ ID NO: 3524393 - DNA, 16 bp, Homo sapiens
gcctgtggcctttgca

SEQ ID NO: 3524394 - DNA, 21 bp, Homo sapiens
gcctgtggcgccgtctccagg

SEQ ID NO: 3524395 - DNA, 15 bp, Homo sapiens
gcttcattagagcag

SEQ ID NO: 3524396 - DNA, 16 bp, Homo sapiens
gcttcattagagcagg

SEQ ID NO: 3524397 - DNA, 15 bp, Homo sapiens
gcttcattctccttg

SEQ ID NO: 3524398 - DNA, 17 bp, Homo sapiens
gcttcattctttgcagg

SEQ ID NO: 3524399 - DNA, 13 bp, Homo sapiens
gcttcatttcctg

SEQ ID NO: 3524400 - DNA, 20 bp, Homo sapiens
gcttcatttttgtaataaca

SEQ ID NO: 3524401 - DNA, 23 bp, Homo sapiens
gcttcatttttgtaataacattt

SEQ ID NO: 3524402 - DNA, 14 bp, Homo sapiens
gcttccatgattct

SEQ ID NO: 3524403 - DNA, 19 bp, Homo sapiens
gcttccatgattctattta

SEQ ID NO: 3524404 - DNA, 20 bp, Homo sapiens
gcttcccagtggctgctgcc

SEQ ID NO: 3524405 - DNA, 21 bp, Homo sapiens
gcttcccagtggctgctgccc

SEQ ID NO: 3524406 - DNA, 18 bp, Homo sapiens
gcttcccctctctcctcc

SEQ ID NO: 3524407 - DNA, 17 bp, Homo sapiens
gcttccctccatccccc

SEQ ID NO: 3524408 - DNA, 11 bp, Homo sapiens
gcttccctgaa

SEQ ID NO: 3524409 - DNA, 22 bp, Homo sapiens
gcttcctcatagtatggtggct

SEQ ID NO: 3524410 - DNA, 21 bp, Homo sapiens
gcttcctcttccgggcagaaa

SEQ ID NO: 3524411 - DNA, 20 bp, Homo sapiens
gcttcctgtccccatctgtc

SEQ ID NO: 3524412 - DNA, 22 bp, Homo sapiens
gcttctagaggctcatggccct

SEQ ID NO: 3524413 - DNA, 22 bp, Homo sapiens
gcttctcactgccatgccagct

SEQ ID NO: 3524414 - DNA, 17 bp, Homo sapiens
gcttctcatcctgcagg

SEQ ID NO: 3524415 - DNA, 23 bp, Homo sapiens
gcttctctatgataattacaata

SEQ ID NO: 3524416 - DNA, 20 bp, Homo sapiens
gcttctctgacttctgcctg

SEQ ID NO: 3524417 - DNA, 16 bp, Homo sapiens
gcttctggccaggaag

SEQ ID NO: 3524418 - DNA, 15 bp, Homo sapiens
gcttctgtctccagc

SEQ ID NO: 3524419 - DNA, 18 bp, Homo sapiens
gcttcttactgataattt

SEQ ID NO: 3524420 - DNA, 16 bp, Homo sapiens
gcttcttccaggtgcc

SEQ ID NO: 3524421 - DNA, 19 bp, Homo sapiens
gcttcttccaggtgcccag

SEQ ID NO: 3524422 - DNA, 12 bp, Homo sapiens
gcttctttcttt

SEQ ID NO: 3524423 - DNA, 13 bp, Homo sapiens
gcttgaacccagg

SEQ ID NO: 3524424 - DNA, 18 bp, Homo sapiens
gcttgaaggccctgctga

SEQ ID NO: 3524425 - DNA, 20 bp, Homo sapiens
gcttgagaaatatggacact

SEQ ID NO: 3524426 - DNA, 16 bp, Homo sapiens
gcttgagggttgggct

SEQ ID NO: 3524427 - DNA, 19 bp, Homo sapiens
gcttgatgggattctggac

SEQ ID NO: 3524428 - DNA, 14 bp, Homo sapiens
gcttgccacagagc

SEQ ID NO: 3524429 - DNA, 16 bp, Homo sapiens
gcttgccacagagcgg

SEQ ID NO: 3524430 - DNA, 15 bp, Homo sapiens
gcttggacatcagtg

SEQ ID NO: 3524431 - DNA, 15 bp, Homo sapiens
gcttggatcctgggc

SEQ ID NO: 3524432 - DNA, 16 bp, Homo sapiens
gcttggggctcacaca

SEQ ID NO: 3524433 - DNA, 20 bp, Homo sapiens
gcttggggctcacacacctg

SEQ ID NO: 3524434 - DNA, 17 bp, Homo sapiens
gcttgggtctctctcca

SEQ ID NO: 3524435 - DNA, 18 bp, Homo sapiens
gcttgtcactagcagctg

SEQ ID NO: 3524436 - DNA, 15 bp, Homo sapiens
gcttgttatttataa

SEQ ID NO: 3524437 - DNA, 18 bp, Homo sapiens
gcttgttccctctccctg

SEQ ID NO: 3524438 - DNA, 14 bp, Homo sapiens
gcttgttttccaaa

SEQ ID NO: 3524439 - DNA, 22 bp, Homo sapiens
gcttgttttccaaagaaaagta

SEQ ID NO: 3524440 - DNA, 21 bp, Homo sapiens
gctttaatttttttaaccaaa

SEQ ID NO: 3524441 - DNA, 21 bp, Homo sapiens
gctttactttaaaattcaagt

SEQ ID NO: 3524442 - DNA, 16 bp, Homo sapiens
gctttatcctctttag

SEQ ID NO: 3524443 - DNA, 21 bp, Homo sapiens
gctttcaattccgtagccagc

SEQ ID NO: 3524444 - DNA, 12 bp, Homo sapiens
gctttcatgtaa

SEQ ID NO: 3524445 - DNA, 21 bp, Homo sapiens
gctttcatgtaaactgtgcac

SEQ ID NO: 3524446 - DNA, 15 bp, Homo sapiens
gctttccatgggacc

SEQ ID NO: 3524447 - DNA, 23 bp, Homo sapiens
gctttccttttttaaaaatgcaa

SEQ ID NO: 3524448 - DNA, 19 bp, Homo sapiens
gctttctacccagcgagcc

SEQ ID NO: 3524449 - DNA, 13 bp, Homo sapiens
gctttctcctttc

SEQ ID NO: 3524450 - DNA, 23 bp, Homo sapiens
gctttctttagaatttttaccca

SEQ ID NO: 3524451 - DNA, 15 bp, Homo sapiens
gctttgaaacagaaa

SEQ ID NO: 3524452 - DNA, 12 bp, Homo sapiens
gctttgctctgc

SEQ ID NO: 3524453 - DNA, 18 bp, Homo sapiens
gctttgctgctgaaggct

SEQ ID NO: 3524454 - DNA, 19 bp, Homo sapiens
gctttgctttctgctcagc

SEQ ID NO: 3524455 - DNA, 16 bp, Homo sapiens
gctttggcagtgccat

SEQ ID NO: 3524456 - DNA, 17 bp, Homo sapiens
gctttggtgagaacctg

SEQ ID NO: 3524457 - DNA, 16 bp, Homo sapiens
gctttgttgcactgaa

SEQ ID NO: 3524458 - DNA, 19 bp, Homo sapiens
gcttttaacagagtctgaa

SEQ ID NO: 3524459 - DNA, 20 bp, Homo sapiens
gcttttaatgaaaaggaatc

SEQ ID NO: 3524460 - DNA, 21 bp, Homo sapiens
gcttttccttggcattccgca

SEQ ID NO: 3524461 - DNA, 20 bp, Homo sapiens
gcttttccttggggcaggca

SEQ ID NO: 3524462 - DNA, 22 bp, Homo sapiens
gcttttccttggggcaggcagt

SEQ ID NO: 3524463 - DNA, 14 bp, Homo sapiens
gcttttctcagctg

SEQ ID NO: 3524464 - DNA, 15 bp, Homo sapiens
gcttttggtctgtgt

SEQ ID NO: 3524465 - DNA, 13 bp, Homo sapiens
gctttttcttctc

SEQ ID NO: 3524466 - DNA, 22 bp, Homo sapiens
ggaaaacttgcagctaaggagg

SEQ ID NO: 3524467 - DNA, 20 bp, Homo sapiens
ggaaaagctgctgacagtgt

SEQ ID NO: 3524468 - DNA, 20 bp, Homo sapiens
ggaaaatgcagcagggatgc

SEQ ID NO: 3524469 - DNA, 12 bp, Homo sapiens
ggaaaattattt

SEQ ID NO: 3524470 - DNA, 13 bp, Homo sapiens
ggaaacagactcg

SEQ ID NO: 3524471 - DNA, 13 bp, Homo sapiens
ggaaacagaggct

SEQ ID NO: 3524472 - DNA, 16 bp, Homo sapiens
ggaaaccacagctgct

SEQ ID NO: 3524473 - DNA, 23 bp, Homo sapiens
ggaaacgctacctctctgtccct

SEQ ID NO: 3524474 - DNA, 17 bp, Homo sapiens
ggaaagcacaggtgggc

SEQ ID NO: 3524475 - DNA, 18 bp, Homo sapiens
ggaaaggcaaatgcccaa

SEQ ID NO: 3524476 - DNA, 20 bp, Homo sapiens
ggaaaggcaaatgcccaagg

SEQ ID NO: 3524477 - DNA, 18 bp, Homo sapiens
ggaaaggggacaaggaag

SEQ ID NO: 3524478 - DNA, 14 bp, Homo sapiens
ggaaataacagaga

SEQ ID NO: 3524479 - DNA, 17 bp, Homo sapiens
ggaaatattgctggggt

SEQ ID NO: 3524480 - DNA, 13 bp, Homo sapiens
ggaaatgcattta

SEQ ID NO: 3524481 - DNA, 15 bp, Homo sapiens
ggaaatgcatttata

SEQ ID NO: 3524482 - DNA, 13 bp, Homo sapiens
ggaaatggccttc

SEQ ID NO: 3524483 - DNA, 18 bp, Homo sapiens
ggaaatgggggggcgggg

SEQ ID NO: 3524484 - DNA, 15 bp, Homo sapiens
ggaacaaattatttt

SEQ ID NO: 3524485 - DNA, 15 bp, Homo sapiens
ggaacactggcagac

SEQ ID NO: 3524486 - DNA, 17 bp, Homo sapiens
ggaaccaacaaggaaac

SEQ ID NO: 3524487 - DNA, 14 bp, Homo sapiens
ggaaccaggcttgg

SEQ ID NO: 3524488 - DNA, 15 bp, Homo sapiens
ggaacccagactcag

SEQ ID NO: 3524489 - DNA, 24 bp, Homo sapiens
ggaacccttacagtaggagcccag

SEQ ID NO: 3524490 - DNA, 16 bp, Homo sapiens
ggaaccgcaggaagct

SEQ ID NO: 3524491 - DNA, 21 bp, Homo sapiens
ggaaccgtaggacccaagcag

SEQ ID NO: 3524492 - DNA, 13 bp, Homo sapiens
ggaacctcagcct

SEQ ID NO: 3524493 - DNA, 14 bp, Homo sapiens
ggaacctcagcctg

SEQ ID NO: 3524494 - DNA, 15 bp, Homo sapiens
ggaacctcagcctgg

SEQ ID NO: 3524495 - DNA, 16 bp, Homo sapiens
ggaacctcagcctggc

SEQ ID NO: 3524496 - DNA, 19 bp, Homo sapiens
ggaacctcagcctggccag

SEQ ID NO: 3524497 - DNA, 23 bp, Homo sapiens
ggaacctcagcctggccagacac

SEQ ID NO: 3524498 - DNA, 19 bp, Homo sapiens
ggaacctccccagcctgcg

SEQ ID NO: 3524499 - DNA, 16 bp, Homo sapiens
ggaacctgcaaaaaat

SEQ ID NO: 3524500 - DNA, 17 bp, Homo sapiens
ggaactcacctggggct

SEQ ID NO: 3524501 - DNA, 15 bp, Homo sapiens
ggaactcagatccag

SEQ ID NO: 3524502 - DNA, 16 bp, Homo sapiens
ggaactcagatccagg

SEQ ID NO: 3524503 - DNA, 16 bp, Homo sapiens
ggaactgcatgctgct

SEQ ID NO: 3524504 - DNA, 22 bp, Homo sapiens
ggaacttggggagttaagacct

SEQ ID NO: 3524505 - DNA, 23 bp, Homo sapiens
ggaacttggggagttaagacctg

SEQ ID NO: 3524506 - DNA, 18 bp, Homo sapiens
ggaacttgtctcttcatc

SEQ ID NO: 3524507 - DNA, 14 bp, Homo sapiens
ggaagacaatgtga

SEQ ID NO: 3524508 - DNA, 23 bp, Homo sapiens
ggaagacagagacctcctgcctc

SEQ ID NO: 3524509 - DNA, 16 bp, Homo sapiens
ggaagagcaggactcc

SEQ ID NO: 3524510 - DNA, 15 bp, Homo sapiens
ggaagagcccagtct

SEQ ID NO: 3524511 - DNA, 16 bp, Homo sapiens
ggaagagcccagtctg

SEQ ID NO: 3524512 - DNA, 20 bp, Homo sapiens
ggaagagcccagtctgttga

SEQ ID NO: 3524513 - DNA, 19 bp, Homo sapiens
ggaagaggctacagggcca

SEQ ID NO: 3524514 - DNA, 19 bp, Homo sapiens
ggaagagtgactctccagg

SEQ ID NO: 3524515 - DNA, 12 bp, Homo sapiens
ggaagatcctgc

SEQ ID NO: 3524516 - DNA, 19 bp, Homo sapiens
ggaagatcctgtgaggagc

SEQ ID NO: 3524517 - DNA, 13 bp, Homo sapiens
ggaagattttcat

SEQ ID NO: 3524518 - DNA, 17 bp, Homo sapiens
ggaagcacagcttcatt

SEQ ID NO: 3524519 - DNA, 23 bp, Homo sapiens
ggaagcccagcccctactgctgt

SEQ ID NO: 3524520 - DNA, 20 bp, Homo sapiens
ggaagccgtgctcgccccag

SEQ ID NO: 3524521 - DNA, 20 bp, Homo sapiens
ggaagcctttactgaccctg

SEQ ID NO: 3524522 - DNA, 21 bp, Homo sapiens
ggaagctttggtgagaacctg

SEQ ID NO: 3524523 - DNA, 21 bp, Homo sapiens
ggaaggctcttctccccagag

SEQ ID NO: 3524524 - DNA, 21 bp, Homo sapiens
ggaaggcttgttgtgctttta

SEQ ID NO: 3524525 - DNA, 22 bp, Homo sapiens
ggaaggggacccccgccccctg

SEQ ID NO: 3524526 - DNA, 13 bp, Homo sapiens
ggaagggtggtgg

SEQ ID NO: 3524527 - DNA, 14 bp, Homo sapiens
ggcccccctgccct

SEQ ID NO: 3524528 - DNA, 14 bp, Homo sapiens
ggcccctctcctcc

SEQ ID NO: 3524529 - DNA, 22 bp, Homo sapiens
ggcccctctcctccgtggcaca

SEQ ID NO: 3524530 - DNA, 23 bp, Homo sapiens
ggcccctctcctccgtggcacat

SEQ ID NO: 3524531 - DNA, 13 bp, Homo sapiens
ggcccctgccacc

SEQ ID NO: 3524532 - DNA, 20 bp, Homo sapiens
ggcccctgccacctcctgcc

SEQ ID NO: 3524533 - DNA, 17 bp, Homo sapiens
ggcccctgcccggctgc

SEQ ID NO: 3524534 - DNA, 16 bp, Homo sapiens
ggcccctgctgtctct

SEQ ID NO: 3524535 - DNA, 18 bp, Homo sapiens
ggcccctgctgtctctct

SEQ ID NO: 3524536 - DNA, 12 bp, Homo sapiens
ggcccctggagg

SEQ ID NO: 3524537 - DNA, 14 bp, Homo sapiens
ggcccctggaggct

SEQ ID NO: 3524538 - DNA, 17 bp, Homo sapiens
ggcccgcgccacaggac

SEQ ID NO: 3524539 - DNA, 13 bp, Homo sapiens
ggcccggcagggc

SEQ ID NO: 3524540 - DNA, 18 bp, Homo sapiens
ggcccggcagggcgggca

SEQ ID NO: 3524541 - DNA, 20 bp, Homo sapiens
ggcccggccagccatgtctg

SEQ ID NO: 3524542 - DNA, 20 bp, Homo sapiens
ggcccggcctattgcttggg

SEQ ID NO: 3524543 - DNA, 16 bp, Homo sapiens
ggccctaattcagcca

SEQ ID NO: 3524544 - DNA, 12 bp, Homo sapiens
ggccctcccagt

SEQ ID NO: 3524545 - DNA, 19 bp, Homo sapiens
ggccctccctgttccccag

SEQ ID NO: 3524546 - DNA, 23 bp, Homo sapiens
ggccctccctgttccccagagaa

SEQ ID NO: 3524547 - DNA, 22 bp, Homo sapiens
ggccctcgctgccagctctgta

SEQ ID NO: 3524548 - DNA, 18 bp, Homo sapiens
ggccctctcttctcacct

SEQ ID NO: 3524549 - DNA, 18 bp, Homo sapiens
ggccctctggagtggcca

SEQ ID NO: 3524550 - DNA, 16 bp, Homo sapiens
ggccctgcagccagct

SEQ ID NO: 3524551 - DNA, 17 bp, Homo sapiens
ggccctgcagccagctc

SEQ ID NO: 3524552 - DNA, 16 bp, Homo sapiens
ggccctgccagagcag

SEQ ID NO: 3524553 - DNA, 21 bp, Homo sapiens
ggccctgccagagcaggggga

SEQ ID NO: 3524554 - DNA, 13 bp, Homo sapiens
ggccctggcctcc

SEQ ID NO: 3524555 - DNA, 12 bp, Homo sapiens
ggccctgggctg

SEQ ID NO: 3524556 - DNA, 13 bp, Homo sapiens
ggccctgggctgg

SEQ ID NO: 3524557 - DNA, 14 bp, Homo sapiens
ggccctgggctgga

SEQ ID NO: 3524558 - DNA, 17 bp, Homo sapiens
ggccctggtcctggcct

SEQ ID NO: 3524559 - DNA, 20 bp, Homo sapiens
ggccctgtagttaggcctgg

SEQ ID NO: 3524560 - DNA, 15 bp, Homo sapiens
ggccctgtggcagga

SEQ ID NO: 3524561 - DNA, 16 bp, Homo sapiens
ggcccttcctctttgg

SEQ ID NO: 3524562 - DNA, 12 bp, Homo sapiens
ggccgctgccac

SEQ ID NO: 3524563 - DNA, 16 bp, Homo sapiens
ggccgctgccccagcc

SEQ ID NO: 3524564 - DNA, 18 bp, Homo sapiens
ggccggcagccccagcct

SEQ ID NO: 3524565 - DNA, 20 bp, Homo sapiens
ggccggcagccccagcctgc

SEQ ID NO: 3524566 - DNA, 18 bp, Homo sapiens
ggccggcgagccctgtgg

SEQ ID NO: 3524567 - DNA, 14 bp, Homo sapiens
ggccgggcctgggg

SEQ ID NO: 3524568 - DNA, 18 bp, Homo sapiens
ggccgtatctccggctcc

SEQ ID NO: 3524569 - DNA, 20 bp, Homo sapiens
ggccgtatctccggctccca

SEQ ID NO: 3524570 - DNA, 19 bp, Homo sapiens
ggcctaaatttattaaata

SEQ ID NO: 3524571 - DNA, 23 bp, Homo sapiens
ggcctacagctttgatccctgac

SEQ ID NO: 3524572 - DNA, 18 bp, Homo sapiens
ggcctatctcctagggct

SEQ ID NO: 3524573 - DNA, 17 bp, Homo sapiens
ggcctcagccagagaag

SEQ ID NO: 3524574 - DNA, 18 bp, Homo sapiens
ggcctcaggtgctgtcca

SEQ ID NO: 3524575 - DNA, 19 bp, Homo sapiens
ggcctcaggtgctgtccat

SEQ ID NO: 3524576 - DNA, 17 bp, Homo sapiens
ggcctcatctctgcctg

SEQ ID NO: 3524577 - DNA, 14 bp, Homo sapiens
ggcctcatgtggct

SEQ ID NO: 3524578 - DNA, 16 bp, Homo sapiens
ggcctccatcctcatc

SEQ ID NO: 3524579 - DNA, 14 bp, Homo sapiens
ggcctcccacagac

SEQ ID NO: 3524580 - DNA, 17 bp, Homo sapiens
ggcctcccacagactca

SEQ ID NO: 3524581 - DNA, 17 bp, Homo sapiens
ggcctcttgaagagaaa

SEQ ID NO: 3524582 - DNA, 20 bp, Homo sapiens
ggcctcttgaagagaaaaaa

SEQ ID NO: 3524583 - DNA, 13 bp, Homo sapiens
ggcctgaagagtc

SEQ ID NO: 3524584 - DNA, 16 bp, Homo sapiens
ggcctgaagccagctg

SEQ ID NO: 3524585 - DNA, 20 bp, Homo sapiens
ggcctgaagccagctgccct

SEQ ID NO: 3524586 - DNA, 17 bp, Homo sapiens
ggcctgaatcatgagcc

SEQ ID NO: 3524587 - DNA, 15 bp, Homo sapiens
ggcctgagagtcagc

SEQ ID NO: 3524588 - DNA, 16 bp, Homo sapiens
ggcctgagcctggcca

SEQ ID NO: 3524589 - DNA, 13 bp, Homo sapiens
ggcctgagctgct

SEQ ID NO: 3524590 - DNA, 14 bp, Homo sapiens
ggcctgcacagtga

SEQ ID NO: 3524591 - DNA, 20 bp, Homo sapiens
ggcctgcaggacctgcctgt

SEQ ID NO: 3524592 - DNA, 18 bp, Homo sapiens
ggcctgcccagtcgaccc

SEQ ID NO: 3524593 - DNA, 14 bp, Homo sapiens
ggcctgccgggctg

SEQ ID NO: 3524594 - DNA, 17 bp, Homo sapiens
ggcctgctccagacctg

SEQ ID NO: 3524595 - DNA, 16 bp, Homo sapiens
ggcctggaagacagag

SEQ ID NO: 3524596 - DNA, 17 bp, Homo sapiens
ggcctggagatcctcct

SEQ ID NO: 3524597 - DNA, 12 bp, Homo sapiens
ggcctggccaga

SEQ ID NO: 3524598 - DNA, 15 bp, Homo sapiens
ggcctggccagatgc

SEQ ID NO: 3524599 - DNA, 14 bp, Homo sapiens
ggcctgggccagag

SEQ ID NO: 3524600 - DNA, 23 bp, Homo sapiens
ggcctgggccgtatctccggctc

SEQ ID NO: 3524601 - DNA, 19 bp, Homo sapiens
ggcctggttgaagaagatg

SEQ ID NO: 3524602 - DNA, 14 bp, Homo sapiens
ggcctgtcctccaa

SEQ ID NO: 3524603 - DNA, 18 bp, Homo sapiens
ggcctgtgtggccacttc

SEQ ID NO: 3524604 - DNA, 19 bp, Homo sapiens
ggccttcagtttatttcca

SEQ ID NO: 3524605 - DNA, 12 bp, Homo sapiens
ggccttcccgcc

SEQ ID NO: 3524606 - DNA, 18 bp, Homo sapiens
ggccttcccgccggaggc

SEQ ID NO: 3524607 - DNA, 21 bp, Homo sapiens
ggccttcccgccggaggccag

SEQ ID NO: 3524608 - DNA, 17 bp, Homo sapiens
ggccttctcccctcttc

SEQ ID NO: 3524609 - DNA, 15 bp, Homo sapiens
ggccttctctgaagg

SEQ ID NO: 3524610 - DNA, 16 bp, Homo sapiens
ggccttctctgaagga

SEQ ID NO: 3524611 - DNA, 15 bp, Homo sapiens
ggccttgcctggcct

SEQ ID NO: 3524612 - DNA, 17 bp, Homo sapiens
ggccttgcctggcctga

SEQ ID NO: 3524613 - DNA, 12 bp, Homo sapiens
ggccttgtccca

SEQ ID NO: 3524614 - DNA, 22 bp, Homo sapiens
ggcctttaaaatttttttagaa

SEQ ID NO: 3524615 - DNA, 11 bp, Homo sapiens
ggcgacctcct

SEQ ID NO: 3524616 - DNA, 17 bp, Homo sapiens
ggcgcaaagggcatggg

SEQ ID NO: 3524617 - DNA, 22 bp, Homo sapiens
ggcgccgcaaaccacactggac

SEQ ID NO: 3524618 - DNA, 20 bp, Homo sapiens
ggcgccgtctccaggggctg

SEQ ID NO: 3524619 - DNA, 22 bp, Homo sapiens
ggcgcgcacctgtaatcccagc

SEQ ID NO: 3524620 - DNA, 15 bp, Homo sapiens
ggcgcggtggctcac

SEQ ID NO: 3524621 - DNA, 23 bp, Homo sapiens
ggcgctacaaaataaagctgttc

SEQ ID NO: 3524622 - DNA, 17 bp, Homo sapiens
ggcgctattgcactcca

SEQ ID NO: 3524623 - DNA, 18 bp, Homo sapiens
ggcgctattgcactccag

SEQ ID NO: 3524624 - DNA, 22 bp, Homo sapiens
ggcgctattgcactccagtctg

SEQ ID NO: 3524625 - DNA, 23 bp, Homo sapiens
ggcgctgccccatctcccctcag

SEQ ID NO: 3524626 - DNA, 20 bp, Homo sapiens
ggcggagctggccccgccgc

SEQ ID NO: 3524627 - DNA, 18 bp, Homo sapiens
ggcgggacagtgctgcag

SEQ ID NO: 3524628 - DNA, 14 bp, Homo sapiens
ggcgtacaggctgg

SEQ ID NO: 3524629 - DNA, 17 bp, Homo sapiens
ggcgtacgctggtgctg

SEQ ID NO: 3524630 - DNA, 14 bp, Homo sapiens
ggcgtgcagtggtg

SEQ ID NO: 3524631 - DNA, 15 bp, Homo sapiens
ggcgtggagctgcct

SEQ ID NO: 3524632 - DNA, 23 bp, Homo sapiens
ggcgttcttaggctgctgggatg

SEQ ID NO: 3524633 - DNA, 20 bp, Homo sapiens
ggctaagcttcactgtaaaa

SEQ ID NO: 3524634 - DNA, 12 bp, Homo sapiens
ggctacacaggg

SEQ ID NO: 3524635 - DNA, 22 bp, Homo sapiens
ggctaccaacttgtatccaggc

SEQ ID NO: 3524636 - DNA, 16 bp, Homo sapiens
ggctaggacccctcca

SEQ ID NO: 3524637 - DNA, 14 bp, Homo sapiens
ggctagggggagcc

SEQ ID NO: 3524638 - DNA, 16 bp, Homo sapiens
ggctagtcaagctcct

SEQ ID NO: 3524639 - DNA, 15 bp, Homo sapiens
ggctagttgggcttc

SEQ ID NO: 3524640 - DNA, 16 bp, Homo sapiens
ggctagttgggcttcc

SEQ ID NO: 3524641 - DNA, 13 bp, Homo sapiens
ggctattcacaac

SEQ ID NO: 3524642 - DNA, 15 bp, Homo sapiens
ggctcaagtcctctt

SEQ ID NO: 3524643 - DNA, 12 bp, Homo sapiens
ggctcacactga

SEQ ID NO: 3524644 - DNA, 17 bp, Homo sapiens
ggctcacactgagaatg

SEQ ID NO: 3524645 - DNA, 13 bp, Homo sapiens
ggctcactgcagc

SEQ ID NO: 3524646 - DNA, 21 bp, Homo sapiens
ggctcagcggggacagctcct

SEQ ID NO: 3524647 - DNA, 14 bp, Homo sapiens
ggctcatggccctg

SEQ ID NO: 3524648 - DNA, 16 bp, Homo sapiens
ggctcatggccctgta

SEQ ID NO: 3524649 - DNA, 16 bp, Homo sapiens
ggctccagagggcact

SEQ ID NO: 3524650 - DNA, 16 bp, Homo sapiens
ggctccagatgcaggg

SEQ ID NO: 3524651 - DNA, 17 bp, Homo sapiens
ggctccagatgcagggc

SEQ ID NO: 3524652 - DNA, 15 bp, Homo sapiens
ggctccagccatctc

SEQ ID NO: 3524653 - DNA, 14 bp, Homo sapiens
ggctccaggctcct

SEQ ID NO: 3524654 - DNA, 18 bp, Homo sapiens
ggctccagtttccccatg

SEQ ID NO: 3524655 - DNA, 17 bp, Homo sapiens
ggctcccagggacacct

SEQ ID NO: 3524656 - DNA, 14 bp, Homo sapiens
ggctcccccaggcc

SEQ ID NO: 3524657 - DNA, 13 bp, Homo sapiens
ggctccttcacca

SEQ ID NO: 3524658 - DNA, 18 bp, Homo sapiens
ggctcgaatctctgtgcc

SEQ ID NO: 3524659 - DNA, 19 bp, Homo sapiens
ggctcgaatctctgtgcct

SEQ ID NO: 3524660 - DNA, 20 bp, Homo sapiens
ggctcgattttgtatctgca

SEQ ID NO: 3524661 - DNA, 15 bp, Homo sapiens
gggagcaggcggtgg

SEQ ID NO: 3524662 - DNA, 14 bp, Homo sapiens
gggagccactgcca

SEQ ID NO: 3524663 - DNA, 17 bp, Homo sapiens
gggagccactgccactc

SEQ ID NO: 3524664 - DNA, 19 bp, Homo sapiens
gggagccatgcgccccctc

SEQ ID NO: 3524665 - DNA, 10 bp, Homo sapiens
gggagcccac

SEQ ID NO: 3524666 - DNA, 20 bp, Homo sapiens
gggagcccactgtcctgggc

SEQ ID NO: 3524667 - DNA, 21 bp, Homo sapiens
gggagcctttggttctggcca

SEQ ID NO: 3524668 - DNA, 22 bp, Homo sapiens
gggagcctttggttctggccag

SEQ ID NO: 3524669 - DNA, 14 bp, Homo sapiens
gggaggagcccctg

SEQ ID NO: 3524670 - DNA, 19 bp, Homo sapiens
gggaggccaaggtgggagg

SEQ ID NO: 3524671 - DNA, 16 bp, Homo sapiens
gggaggccccactggg

SEQ ID NO: 3524672 - DNA, 13 bp, Homo sapiens
gggaggctcaggt

SEQ ID NO: 3524673 - DNA, 22 bp, Homo sapiens
gggagggcggcaggggcctgga

SEQ ID NO: 3524674 - DNA, 17 bp, Homo sapiens
gggaggggaagcttctg

SEQ ID NO: 3524675 - DNA, 17 bp, Homo sapiens
gggaggtcgaggcagga

SEQ ID NO: 3524676 - DNA, 23 bp, Homo sapiens
gggagtctgaagcagatgcaaag

SEQ ID NO: 3524677 - DNA, 11 bp, Homo sapiens
gggagtgagct

SEQ ID NO: 3524678 - DNA, 16 bp, Homo sapiens
gggagttaagacctgg

SEQ ID NO: 3524679 - DNA, 23 bp, Homo sapiens
gggagttaagacctggcagctct

SEQ ID NO: 3524680 - DNA, 22 bp, Homo sapiens
gggagttgtcaagtctctgctg

SEQ ID NO: 3524681 - DNA, 13 bp, Homo sapiens
gggatcatgaaag

SEQ ID NO: 3524682 - DNA, 20 bp, Homo sapiens
gggatccctcccccccatgc

SEQ ID NO: 3524683 - DNA, 23 bp, Homo sapiens
gggatctggtcctacccatcccc

SEQ ID NO: 3524684 - DNA, 20 bp, Homo sapiens
gggatgacatgcactcagct

SEQ ID NO: 3524685 - DNA, 12 bp, Homo sapiens
gggatggtgccc

SEQ ID NO: 3524686 - DNA, 13 bp, Homo sapiens
gggatggtgccct

SEQ ID NO: 3524687 - DNA, 17 bp, Homo sapiens
gggatggtggagggcca

SEQ ID NO: 3524688 - DNA, 18 bp, Homo sapiens
gggatggtggagggccac

SEQ ID NO: 3524689 - DNA, 19 bp, Homo sapiens
gggatggtgggcttcaggg

SEQ ID NO: 3524690 - DNA, 21 bp, Homo sapiens
gggcaacattgttcacctttg

SEQ ID NO: 3524691 - DNA, 16 bp, Homo sapiens
gggcaacccccagcct

SEQ ID NO: 3524692 - DNA, 18 bp, Homo sapiens
gggcaatttagaaaaaga

SEQ ID NO: 3524693 - DNA, 12 bp, Homo sapiens
gggcacacactg

SEQ ID NO: 3524694 - DNA, 15 bp, Homo sapiens
gggcacacgcctccc

SEQ ID NO: 3524695 - DNA, 12 bp, Homo sapiens
gggcacctgcca

SEQ ID NO: 3524696 - DNA, 16 bp, Homo sapiens
gggcactcagaagaca

SEQ ID NO: 3524697 - DNA, 12 bp, Homo sapiens
gggcagagccca

SEQ ID NO: 3524698 - DNA, 11 bp, Homo sapiens
gggcagagctg

SEQ ID NO: 3524699 - DNA, 17 bp, Homo sapiens
gggcagagctggctctg

SEQ ID NO: 3524700 - DNA, 19 bp, Homo sapiens
gggcagagctggctctgag

SEQ ID NO: 3524701 - DNA, 16 bp, Homo sapiens
gggcagagggctggag

SEQ ID NO: 3524702 - DNA, 20 bp, Homo sapiens
gggcagcagaagggggtggt

SEQ ID NO: 3524703 - DNA, 13 bp, Homo sapiens
gggcagcgccagg

SEQ ID NO: 3524704 - DNA, 15 bp, Homo sapiens
gggcagcgccaggct

SEQ ID NO: 3524705 - DNA, 11 bp, Homo sapiens
gggcagggctg

SEQ ID NO: 3524706 - DNA, 22 bp, Homo sapiens
gggcaggtgctggagcactggg

SEQ ID NO: 3524707 - DNA, 21 bp, Homo sapiens
gggcaggttctgcctgctttg

SEQ ID NO: 3524708 - DNA, 20 bp, Homo sapiens
gggcagtggtgtggagaagc

SEQ ID NO: 3524709 - DNA, 22 bp, Homo sapiens
gggcatagatgcaggtgagccc

SEQ ID NO: 3524710 - DNA, 18 bp, Homo sapiens
gggcattgatggggaagg

SEQ ID NO: 3524711 - DNA, 15 bp, Homo sapiens
gggcattgcctgtga

SEQ ID NO: 3524712 - DNA, 18 bp, Homo sapiens
gggccaaacgctgagcca

SEQ ID NO: 3524713 - DNA, 16 bp, Homo sapiens
gggccaagccagctgc

SEQ ID NO: 3524714 - DNA, 22 bp, Homo sapiens
gggccaagccagctgcctaggt

SEQ ID NO: 3524715 - DNA, 20 bp, Homo sapiens
gggccaccaggatcagccag

SEQ ID NO: 3524716 - DNA, 20 bp, Homo sapiens
gggccactgtggtggcagtg

SEQ ID NO: 3524717 - DNA, 21 bp, Homo sapiens
gggccagacagaccttcacag

SEQ ID NO: 3524718 - DNA, 13 bp, Homo sapiens
gggccagagccag

SEQ ID NO: 3524719 - DNA, 12 bp, Homo sapiens
gggccagaggct

SEQ ID NO: 3524720 - DNA, 20 bp, Homo sapiens
gggccagagtattggtctcc

SEQ ID NO: 3524721 - DNA, 13 bp, Homo sapiens
gggccagatccag

SEQ ID NO: 3524722 - DNA, 14 bp, Homo sapiens
gggccagatccagc

SEQ ID NO: 3524723 - DNA, 22 bp, Homo sapiens
gggccatgatggcaacagatct

SEQ ID NO: 3524724 - DNA, 15 bp, Homo sapiens
gggccatgctgaggc

SEQ ID NO: 3524725 - DNA, 17 bp, Homo sapiens
gggccatgctgaggcct

SEQ ID NO: 3524726 - DNA, 20 bp, Homo sapiens
gggccatgctgaggcctggg

SEQ ID NO: 3524727 - DNA, 19 bp, Homo sapiens
gggcccacgtggttggggc

SEQ ID NO: 3524728 - DNA, 17 bp, Homo sapiens
gggcccagagagggtgg

SEQ ID NO: 3524729 - DNA, 16 bp, Homo sapiens
gggcccagagcccagc

SEQ ID NO: 3524730 - DNA, 13 bp, Homo sapiens
gggcccccacagg

SEQ ID NO: 3524731 - DNA, 13 bp, Homo sapiens
gggcccccctgcc

SEQ ID NO: 3524732 - DNA, 17 bp, Homo sapiens
gggcccccctgccctgt

SEQ ID NO: 3524733 - DNA, 19 bp, Homo sapiens
gggccccctaccctgcccc

SEQ ID NO: 3524734 - DNA, 14 bp, Homo sapiens
gggccgccagggag

SEQ ID NO: 3524735 - DNA, 13 bp, Homo sapiens
gggccgctgccac

SEQ ID NO: 3524736 - DNA, 14 bp, Homo sapiens
gggccgggcctggg

SEQ ID NO: 3524737 - DNA, 23 bp, Homo sapiens
gggccgtatctccggctcccagc

SEQ ID NO: 3524738 - DNA, 19 bp, Homo sapiens
gggccgtcccgcctgcaga

SEQ ID NO: 3524739 - DNA, 17 bp, Homo sapiens
gggcctaggcctcagcc

SEQ ID NO: 3524740 - DNA, 11 bp, Homo sapiens
gggcctcagtg

SEQ ID NO: 3524741 - DNA, 13 bp, Homo sapiens
gggcctcagtgcc

SEQ ID NO: 3524742 - DNA, 21 bp, Homo sapiens
gggcctcagtgtgcccatctg

SEQ ID NO: 3524743 - DNA, 15 bp, Homo sapiens
gggcctcctgtgtgt

SEQ ID NO: 3524744 - DNA, 20 bp, Homo sapiens
gggcctgaactcggacaagt

SEQ ID NO: 3524745 - DNA, 16 bp, Homo sapiens
gggcctgagcctggcc

SEQ ID NO: 3524746 - DNA, 18 bp, Homo sapiens
gggcctgagcctggccag

SEQ ID NO: 3524747 - DNA, 14 bp, Homo sapiens
gggcctgccgggct

SEQ ID NO: 3524748 - DNA, 19 bp, Homo sapiens
gggcctgcgccagtcctgc

SEQ ID NO: 3524749 - DNA, 13 bp, Homo sapiens
gggcctgctccag

SEQ ID NO: 3524750 - DNA, 18 bp, Homo sapiens
gggcctgctccagacctg

SEQ ID NO: 3524751 - DNA, 15 bp, Homo sapiens
gggcctgctggaggc

SEQ ID NO: 3524752 - DNA, 21 bp, Homo sapiens
gggcctgctggaggcctcagg

SEQ ID NO: 3524753 - DNA, 21 bp, Homo sapiens
gggcctggagatcctcctgca

SEQ ID NO: 3524754 - DNA, 16 bp, Homo sapiens
gggcctggcagctcag

SEQ ID NO: 3524755 - DNA, 21 bp, Homo sapiens
gggcctgggacttccatgcct

SEQ ID NO: 3524756 - DNA, 15 bp, Homo sapiens
gggcctggttgaaga

SEQ ID NO: 3524757 - DNA, 18 bp, Homo sapiens
gggcgatcgcggcggagc

SEQ ID NO: 3524758 - DNA, 22 bp, Homo sapiens
gggcgatcgcggcggagctggc

SEQ ID NO: 3524759 - DNA, 15 bp, Homo sapiens
gggcggctctgaagc

SEQ ID NO: 3524760 - DNA, 12 bp, Homo sapiens
gggcggctgggt

SEQ ID NO: 3524761 - DNA, 17 bp, Homo sapiens
gggcgggcagagggctg

SEQ ID NO: 3524762 - DNA, 22 bp, Homo sapiens
gggctaccctgagctgaggcag

SEQ ID NO: 3524763 - DNA, 22 bp, Homo sapiens
gggctatcaacttaataagata

SEQ ID NO: 3524764 - DNA, 22 bp, Homo sapiens
gggctcaagcaatcctctcacc

SEQ ID NO: 3524765 - DNA, 14 bp, Homo sapiens
gggctcacacacct

SEQ ID NO: 3524766 - DNA, 18 bp, Homo sapiens
gggctcagcaaaagatgc

SEQ ID NO: 3524767 - DNA, 17 bp, Homo sapiens
gggctcagcggggacag

SEQ ID NO: 3524768 - DNA, 13 bp, Homo sapiens
gggctccagccat

SEQ ID NO: 3524769 - DNA, 19 bp, Homo sapiens
gggctctggccaagggcca

SEQ ID NO: 3524770 - DNA, 21 bp, Homo sapiens
gggctgaaccctcagccttga

SEQ ID NO: 3524771 - DNA, 18 bp, Homo sapiens
gggctgaactgagcctag

SEQ ID NO: 3524772 - DNA, 13 bp, Homo sapiens
gggctgagctggg

SEQ ID NO: 3524773 - DNA, 13 bp, Homo sapiens
gggctgagggagc

SEQ ID NO: 3524774 - DNA, 19 bp, Homo sapiens
gggctgccgggccaggcgc

SEQ ID NO: 3524775 - DNA, 11 bp, Homo sapiens
gggctggaaca

SEQ ID NO: 3524776 - DNA, 23 bp, Homo sapiens
gggctggaacagattcacactgt

SEQ ID NO: 3524777 - DNA, 14 bp, Homo sapiens
gggctggactgagg

SEQ ID NO: 3524778 - DNA, 18 bp, Homo sapiens
gggctgggccctctcttc

SEQ ID NO: 3524779 - DNA, 14 bp, Homo sapiens
gggctggttctgta

SEQ ID NO: 3524780 - DNA, 17 bp, Homo sapiens
gggctgtcatctgtgca

SEQ ID NO: 3524781 - DNA, 16 bp, Homo sapiens
gggctgtcggcgctgc

SEQ ID NO: 3524782 - DNA, 23 bp, Homo sapiens
gggctgtgcttgaaggccctgct

SEQ ID NO: 3524783 - DNA, 13 bp, Homo sapiens
gggcttagagcag

SEQ ID NO: 3524784 - DNA, 14 bp, Homo sapiens
gggcttcagggcag

SEQ ID NO: 3524785 - DNA, 15 bp, Homo sapiens
gggcttcagggcagg

SEQ ID NO: 3524786 - DNA, 19 bp, Homo sapiens
gggcttcagggcaggtggg

SEQ ID NO: 3524787 - DNA, 17 bp, Homo sapiens
gggcttcaggtccaggc

SEQ ID NO: 3524788 - DNA, 15 bp, Homo sapiens
gggcttcagtggcag

SEQ ID NO: 3524789 - DNA, 16 bp, Homo sapiens
gggcttcagtggcagc

SEQ ID NO: 3524790 - DNA, 20 bp, Homo sapiens
gggcttcagtggcagctgct

SEQ ID NO: 3524791 - DNA, 19 bp, Homo sapiens
gggctttcgtccacagctt

SEQ ID NO: 3524792 - DNA, 16 bp, Homo sapiens
ggggaaaatcagcctg

SEQ ID NO: 3524793 - DNA, 17 bp, Homo sapiens
ggggaaaatcagcctgc

SEQ ID NO: 3524794 - DNA, 14 bp, Homo sapiens
gtagttaggcctgg

SEQ ID NO: 3524795 - DNA, 23 bp, Homo sapiens
gtagttttttttttttttatgtg

SEQ ID NO: 3524796 - DNA, 23 bp, Homo sapiens
gtataaaagatggggtctgtaaa

SEQ ID NO: 3524797 - DNA, 13 bp, Homo sapiens
gtataaaatgtaa

SEQ ID NO: 3524798 - DNA, 14 bp, Homo sapiens
gtataaacaaagtt

SEQ ID NO: 3524799 - DNA, 18 bp, Homo sapiens
gtataagtaagaaaatat

SEQ ID NO: 3524800 - DNA, 21 bp, Homo sapiens
gtataagtggaggcactttag

SEQ ID NO: 3524801 - DNA, 12 bp, Homo sapiens
gtataagttatt

SEQ ID NO: 3524802 - DNA, 21 bp, Homo sapiens
gtataagttatttttgtacat

SEQ ID NO: 3524803 - DNA, 19 bp, Homo sapiens
gtataatggttgactgggt

SEQ ID NO: 3524804 - DNA, 21 bp, Homo sapiens
gtataatggttgactgggttt

SEQ ID NO: 3524805 - DNA, 19 bp, Homo sapiens
gtatacttccttatgcttc

SEQ ID NO: 3524806 - DNA, 20 bp, Homo sapiens
gtatagcatgcatctgttta

SEQ ID NO: 3524807 - DNA, 19 bp, Homo sapiens
gtatagtactggcatggta

SEQ ID NO: 3524808 - DNA, 13 bp, Homo sapiens
gtatatacttttt

SEQ ID NO: 3524809 - DNA, 15 bp, Homo sapiens
gtatatagcccagcc

SEQ ID NO: 3524810 - DNA, 15 bp, Homo sapiens
gtatatataagaaag

SEQ ID NO: 3524811 - DNA, 17 bp, Homo sapiens
gtatatataagaaagac

SEQ ID NO: 3524812 - DNA, 15 bp, Homo sapiens
gtatattcatatatt

SEQ ID NO: 3524813 - DNA, 14 bp, Homo sapiens
gtatcaggacccag

SEQ ID NO: 3524814 - DNA, 22 bp, Homo sapiens
gtatcaggacccagaggaaggg

SEQ ID NO: 3524815 - DNA, 19 bp, Homo sapiens
gtatcataattaccaagtg

SEQ ID NO: 3524816 - DNA, 21 bp, Homo sapiens
gtatcccatgagcctcagcat

SEQ ID NO: 3524817 - DNA, 14 bp, Homo sapiens
gtatccccccatct

SEQ ID NO: 3524818 - DNA, 22 bp, Homo sapiens
gtatcctcatttggggtagcta

SEQ ID NO: 3524819 - DNA, 18 bp, Homo sapiens
gtatcctgggggacccaa

SEQ ID NO: 3524820 - DNA, 18 bp, Homo sapiens
gtatctaggcaacatagt

SEQ ID NO: 3524821 - DNA, 20 bp, Homo sapiens
gtatctccggctcccagcct

SEQ ID NO: 3524822 - DNA, 21 bp, Homo sapiens
gtatctccggctcccagcctc

SEQ ID NO: 3524823 - DNA, 22 bp, Homo sapiens
gtatctctttcacattgtttgc

SEQ ID NO: 3524824 - DNA, 17 bp, Homo sapiens
gtatctgcaggcagaca

SEQ ID NO: 3524825 - DNA, 18 bp, Homo sapiens
gtatctgcaggcagacac

SEQ ID NO: 3524826 - DNA, 19 bp, Homo sapiens
gtatctgcaggcagacacg

SEQ ID NO: 3524827 - DNA, 20 bp, Homo sapiens
gtatgatcacggctcactgc

SEQ ID NO: 3524828 - DNA, 20 bp, Homo sapiens
gtatgccaccaacttacaaa

SEQ ID NO: 3524829 - DNA, 18 bp, Homo sapiens
gtatggactatctgtctg

SEQ ID NO: 3524830 - DNA, 14 bp, Homo sapiens
gtatggtggctggg

SEQ ID NO: 3524831 - DNA, 15 bp, Homo sapiens
gtatggtggctgggt

SEQ ID NO: 3524832 - DNA, 12 bp, Homo sapiens
gtatgtaaatgt

SEQ ID NO: 3524833 - DNA, 13 bp, Homo sapiens
gtatgtaaatgtg

SEQ ID NO: 3524834 - DNA, 15 bp, Homo sapiens
gtatgtaaatgtgca

SEQ ID NO: 3524835 - DNA, 16 bp, Homo sapiens
gtatgtaacaattgtt

SEQ ID NO: 3524836 - DNA, 20 bp, Homo sapiens
gtatgttaacctaggcagtg

SEQ ID NO: 3524837 - DNA, 12 bp, Homo sapiens
gtatgtttgtaa

SEQ ID NO: 3524838 - DNA, 14 bp, Homo sapiens
gtatgtttgtaact

SEQ ID NO: 3524839 - DNA, 14 bp, Homo sapiens
gtattaccatgtaa

SEQ ID NO: 3524840 - DNA, 16 bp, Homo sapiens
gtattaccatgtaaat

SEQ ID NO: 3524841 - DNA, 13 bp, Homo sapiens
gtattacttctgc

SEQ ID NO: 3524842 - DNA, 14 bp, Homo sapiens
gtattacttctgct

SEQ ID NO: 3524843 - DNA, 22 bp, Homo sapiens
gtattagatgttctctatcatt

SEQ ID NO: 3524844 - DNA, 20 bp, Homo sapiens
gtattagttgccaatatgcc

SEQ ID NO: 3524845 - DNA, 14 bp, Homo sapiens
gtattattttccaa

SEQ ID NO: 3524846 - DNA, 13 bp, Homo sapiens
gtattcatatatt

SEQ ID NO: 3524847 - DNA, 15 bp, Homo sapiens
gtattcatatattgc

SEQ ID NO: 3524848 - DNA, 22 bp, Homo sapiens
gtattcatatattgcatttctg

SEQ ID NO: 3524849 - DNA, 21 bp, Homo sapiens
gtattcatgaaaactgttttt

SEQ ID NO: 3524850 - DNA, 13 bp, Homo sapiens
gtattctctgagc

SEQ ID NO: 3524851 - DNA, 17 bp, Homo sapiens
gtattctgttctggagg

SEQ ID NO: 3524852 - DNA, 15 bp, Homo sapiens
gtattgcatctgtat

SEQ ID NO: 3524853 - DNA, 23 bp, Homo sapiens
gtattgcatctgtataagtaaga

SEQ ID NO: 3524854 - DNA, 12 bp, Homo sapiens
gtattgtattta

SEQ ID NO: 3524855 - DNA, 16 bp, Homo sapiens
gtattgtatttattca

SEQ ID NO: 3524856 - DNA, 17 bp, Homo sapiens
gtattgtatttattcaa

SEQ ID NO: 3524857 - DNA, 22 bp, Homo sapiens
gtattgtatttattcaataaag

SEQ ID NO: 3524858 - DNA, 20 bp, Homo sapiens
gtatttaccaaaaattttgt

SEQ ID NO: 3524859 - DNA, 16 bp, Homo sapiens
gtatttacgctttgat

SEQ ID NO: 3524860 - DNA, 18 bp, Homo sapiens
gtatttgattcaaaatat

SEQ ID NO: 3524861 - DNA, 19 bp, Homo sapiens
gtatttgattcaaaatatt

SEQ ID NO: 3524862 - DNA, 12 bp, Homo sapiens
gtatttgctttt

SEQ ID NO: 3524863 - DNA, 20 bp, Homo sapiens
gtattttagtgaacttgaaa

SEQ ID NO: 3524864 - DNA, 22 bp, Homo sapiens
gtattttgtttttgtcttaaaa

SEQ ID NO: 3524865 - DNA, 14 bp, Homo sapiens
gtatttttatataa

SEQ ID NO: 3524866 - DNA, 18 bp, Homo sapiens
gtatttttcaataaagca

SEQ ID NO: 3524867 - DNA, 21 bp, Homo sapiens
gtatttttcaataaagcattt

SEQ ID NO: 3524868 - DNA, 17 bp, Homo sapiens
gtatttttgctgcttct

SEQ ID NO: 3524869 - DNA, 14 bp, Homo sapiens
gtattttttgtttg

SEQ ID NO: 3524870 - DNA, 20 bp, Homo sapiens
gtattttttgtttgtattgt

SEQ ID NO: 3524871 - DNA, 23 bp, Homo sapiens
gtcaaaaagtttggttctgtgtc

SEQ ID NO: 3524872 - DNA, 13 bp, Homo sapiens
gtcaaaatttgct

SEQ ID NO: 3524873 - DNA, 14 bp, Homo sapiens
gtcaacagttttcc

SEQ ID NO: 3524874 - DNA, 15 bp, Homo sapiens
gtcaacccttctgga

SEQ ID NO: 3524875 - DNA, 16 bp, Homo sapiens
gtcaacgttgtactgt

SEQ ID NO: 3524876 - DNA, 13 bp, Homo sapiens
gtcaagctcctcc

SEQ ID NO: 3524877 - DNA, 19 bp, Homo sapiens
gtcaagctcctcctccctg

SEQ ID NO: 3524878 - DNA, 20 bp, Homo sapiens
gtcaagctcctcctccctgc

SEQ ID NO: 3524879 - DNA, 12 bp, Homo sapiens
gtcaagctgctc

SEQ ID NO: 3524880 - DNA, 17 bp, Homo sapiens
gtcaagtctctgctggc

SEQ ID NO: 3524881 - DNA, 18 bp, Homo sapiens
gtcaagtgaaaaaggagg

SEQ ID NO: 3524882 - DNA, 18 bp, Homo sapiens
gtcaatattggtgtactg

SEQ ID NO: 3524883 - DNA, 13 bp, Homo sapiens
gtcacacactgat

SEQ ID NO: 3524884 - DNA, 16 bp, Homo sapiens
gtcacacactttggct

SEQ ID NO: 3524885 - DNA, 20 bp, Homo sapiens
gtcacacagtgttggaggtt

SEQ ID NO: 3524886 - DNA, 15 bp, Homo sapiens
gtcacaggcaggtcc

SEQ ID NO: 3524887 - DNA, 14 bp, Homo sapiens
gtcacatacaatta

SEQ ID NO: 3524888 - DNA, 13 bp, Homo sapiens
gtcacattctgct

SEQ ID NO: 3524889 - DNA, 15 bp, Homo sapiens
gtcaccattctgcat

SEQ ID NO: 3524890 - DNA, 16 bp, Homo sapiens
gtcaccattctgcatt

SEQ ID NO: 3524891 - DNA, 18 bp, Homo sapiens
gtcaccattctgcattta

SEQ ID NO: 3524892 - DNA, 21 bp, Homo sapiens
gtcaccattctgcatttagct

SEQ ID NO: 3524893 - DNA, 23 bp, Homo sapiens
gtcaccggatcctgggtggtctg

SEQ ID NO: 3524894 - DNA, 15 bp, Homo sapiens
gtcacctagcaagct

SEQ ID NO: 3524895 - DNA, 19 bp, Homo sapiens
gtcacctagcaagctgccg

SEQ ID NO: 3524896 - DNA, 23 bp, Homo sapiens
gtcacgtgcgctgggcacttccc

SEQ ID NO: 3524897 - DNA, 13 bp, Homo sapiens
gtcactagcagct

SEQ ID NO: 3524898 - DNA, 14 bp, Homo sapiens
gtcactagcagctg

SEQ ID NO: 3524899 - DNA, 15 bp, Homo sapiens
gtcactagcagctgc

SEQ ID NO: 3524900 - DNA, 23 bp, Homo sapiens
gtcactagcagctgcagtcaaca

SEQ ID NO: 3524901 - DNA, 13 bp, Homo sapiens
gtcactcaaggcg

SEQ ID NO: 3524902 - DNA, 14 bp, Homo sapiens
gtcactcaggctgg

SEQ ID NO: 3524903 - DNA, 22 bp, Homo sapiens
gtcactcattgctgagcctctg

SEQ ID NO: 3524904 - DNA, 17 bp, Homo sapiens
gtcactgcttttggcct

SEQ ID NO: 3524905 - DNA, 19 bp, Homo sapiens
gtcactgcttttggcctgg

SEQ ID NO: 3524906 - DNA, 17 bp, Homo sapiens
gtcacttcttcacctct

SEQ ID NO: 3524907 - DNA, 22 bp, Homo sapiens
gtcacttcttcacctcttccac

SEQ ID NO: 3524908 - DNA, 21 bp, Homo sapiens
gtcacttgggaagaggacttc

SEQ ID NO: 3524909 - DNA, 15 bp, Homo sapiens
gtcagaaccctgcca

SEQ ID NO: 3524910 - DNA, 16 bp, Homo sapiens
gtcagaaccctgccat

SEQ ID NO: 3524911 - DNA, 18 bp, Homo sapiens
gtcagacgcctgaggaac

SEQ ID NO: 3524912 - DNA, 16 bp, Homo sapiens
gtcagagatgggctga

SEQ ID NO: 3524913 - DNA, 15 bp, Homo sapiens
gtcagagcctgcagt

SEQ ID NO: 3524914 - DNA, 21 bp, Homo sapiens
gtcagaggagagatagcctgt

SEQ ID NO: 3524915 - DNA, 21 bp, Homo sapiens
gtcagatgcccgagggagggg

SEQ ID NO: 3524916 - DNA, 20 bp, Homo sapiens
gtcagcaaaaagcaaaatca

SEQ ID NO: 3524917 - DNA, 23 bp, Homo sapiens
gtcagcaaaaagcaaaatcattt

SEQ ID NO: 3524918 - DNA, 16 bp, Homo sapiens
gtcagctctcatctga

SEQ ID NO: 3524919 - DNA, 19 bp, Homo sapiens
gtcagctctcatctgaggc

SEQ ID NO: 3524920 - DNA, 21 bp, Homo sapiens
gtcagctctctgccctgtgta

SEQ ID NO: 3524921 - DNA, 13 bp, Homo sapiens
gtcaggcccggcc

SEQ ID NO: 3524922 - DNA, 15 bp, Homo sapiens
gtcaggtagggggga

SEQ ID NO: 3524923 - DNA, 18 bp, Homo sapiens
gtcaggtaggggggaaac

SEQ ID NO: 3524924 - DNA, 22 bp, Homo sapiens
gtcagtaccttcaaactagggc

SEQ ID NO: 3524925 - DNA, 18 bp, Homo sapiens
gtcagtggggctctctga

SEQ ID NO: 3524926 - DNA, 21 bp, Homo sapiens
gtggatgggttttatgagatg

SEQ ID NO: 3524927 - DNA, 21 bp, Homo sapiens
gtggattttggttttgttccc

SEQ ID NO: 3524928 - DNA, 16 bp, Homo sapiens
gtggcaaggctgtgct

SEQ ID NO: 3524929 - DNA, 19 bp, Homo sapiens
gtggcacattcctttgggt

SEQ ID NO: 3524930 - DNA, 13 bp, Homo sapiens
gtggcaccagcag

SEQ ID NO: 3524931 - DNA, 17 bp, Homo sapiens
gtggcagctgcggtcca

SEQ ID NO: 3524932 - DNA, 19 bp, Homo sapiens
gtggcagctgcggtccacc

SEQ ID NO: 3524933 - DNA, 15 bp, Homo sapiens
gtggcagtgggagct

SEQ ID NO: 3524934 - DNA, 17 bp, Homo sapiens
gtggcagtgggagctgc

SEQ ID NO: 3524935 - DNA, 21 bp, Homo sapiens
gtggcagtgggagctgcctgt

SEQ ID NO: 3524936 - DNA, 14 bp, Homo sapiens
gtggcatggaaggg

SEQ ID NO: 3524937 - DNA, 18 bp, Homo sapiens
gtggcatgtccacgtgtg

SEQ ID NO: 3524938 - DNA, 21 bp, Homo sapiens
gtggcatttcaattcctggcc

SEQ ID NO: 3524939 - DNA, 15 bp, Homo sapiens
gtggccaaggagctg

SEQ ID NO: 3524940 - DNA, 19 bp, Homo sapiens
gtggccaaggagctgctat

SEQ ID NO: 3524941 - DNA, 13 bp, Homo sapiens
gtggccaccagta

SEQ ID NO: 3524942 - DNA, 16 bp, Homo sapiens
gtggccgcacgcctct

SEQ ID NO: 3524943 - DNA, 17 bp, Homo sapiens
gtggccgcccaaggccc

SEQ ID NO: 3524944 - DNA, 23 bp, Homo sapiens
gtggcctctccttgtggcctggg

SEQ ID NO: 3524945 - DNA, 22 bp, Homo sapiens
gtggcctgtagaatagcctgtg

SEQ ID NO: 3524946 - DNA, 20 bp, Homo sapiens
gtggctagtcaagctcctcc

SEQ ID NO: 3524947 - DNA, 21 bp, Homo sapiens
gtggctagtcaagctcctcct

SEQ ID NO: 3524948 - DNA, 23 bp, Homo sapiens
gtggctagtcaagctcctcctcc

SEQ ID NO: 3524949 - DNA, 15 bp, Homo sapiens
gtggctgagcccctg

SEQ ID NO: 3524950 - DNA, 16 bp, Homo sapiens
gtggctgctgcccagg

SEQ ID NO: 3524951 - DNA, 12 bp, Homo sapiens
gtggctggaaga

SEQ ID NO: 3524952 - DNA, 17 bp, Homo sapiens
gtggctggaagatcctg

SEQ ID NO: 3524953 - DNA, 11 bp, Homo sapiens
gtggctgggca

SEQ ID NO: 3524954 - DNA, 19 bp, Homo sapiens
gtggctgggttggagggtg

SEQ ID NO: 3524955 - DNA, 23 bp, Homo sapiens
gtggctgtggagacaatgtctgc

SEQ ID NO: 3524956 - DNA, 19 bp, Homo sapiens
gtggcttcattagagcagg

SEQ ID NO: 3524957 - DNA, 23 bp, Homo sapiens
gtggcttcccttttctttgttca

SEQ ID NO: 3524958 - DNA, 19 bp, Homo sapiens
gtgggacggtgcccaagcc

SEQ ID NO: 3524959 - DNA, 20 bp, Homo sapiens
gtgggacggtgcccaagcca

SEQ ID NO: 3524960 - DNA, 18 bp, Homo sapiens
gtgggagctgcctgttca

SEQ ID NO: 3524961 - DNA, 23 bp, Homo sapiens
gtgggaggatctcttgagcctgg

SEQ ID NO: 3524962 - DNA, 15 bp, Homo sapiens
gtgggcaatttagaa

SEQ ID NO: 3524963 - DNA, 23 bp, Homo sapiens
gtgggcctgggataatgcccatg

SEQ ID NO: 3524964 - DNA, 15 bp, Homo sapiens
gtgggctagttgggc

SEQ ID NO: 3524965 - DNA, 15 bp, Homo sapiens
gtgggctgggccctc

SEQ ID NO: 3524966 - DNA, 15 bp, Homo sapiens
gtgggcttcagggca

SEQ ID NO: 3524967 - DNA, 22 bp, Homo sapiens
gtgggcttcccagtggctgctg

SEQ ID NO: 3524968 - DNA, 17 bp, Homo sapiens
gtggggagactgggctg

SEQ ID NO: 3524969 - DNA, 13 bp, Homo sapiens
gtgggggcttcat

SEQ ID NO: 3524970 - DNA, 10 bp, Homo sapiens
gtgggggtgg

SEQ ID NO: 3524971 - DNA, 12 bp, Homo sapiens
gtgggggtgggt

SEQ ID NO: 3524972 - DNA, 19 bp, Homo sapiens
gtggggtcatgccctcctc

SEQ ID NO: 3524973 - DNA, 18 bp, Homo sapiens
gtggggtgacgggactca

SEQ ID NO: 3524974 - DNA, 16 bp, Homo sapiens
gtggggtgtgctggga

SEQ ID NO: 3524975 - DNA, 19 bp, Homo sapiens
gtggggtgtgctgggagct

SEQ ID NO: 3524976 - DNA, 18 bp, Homo sapiens
gtggggtttcgcagcctg

SEQ ID NO: 3524977 - DNA, 12 bp, Homo sapiens
gtgggtataaaa

SEQ ID NO: 3524978 - DNA, 13 bp, Homo sapiens
gtgggtataaaag

SEQ ID NO: 3524979 - DNA, 15 bp, Homo sapiens
gtgggtataaaagat

SEQ ID NO: 3524980 - DNA, 20 bp, Homo sapiens
gtgggtccatgggcagagcc

SEQ ID NO: 3524981 - DNA, 12 bp, Homo sapiens
gtggtaaccctg

SEQ ID NO: 3524982 - DNA, 21 bp, Homo sapiens
gtggtaggtactttttgtgaa

SEQ ID NO: 3524983 - DNA, 16 bp, Homo sapiens
gtggtcacagcggagg

SEQ ID NO: 3524984 - DNA, 18 bp, Homo sapiens
gtggtcacagcggaggtg

SEQ ID NO: 3524985 - DNA, 15 bp, Homo sapiens
gtggtctgcaggcag

SEQ ID NO: 3524986 - DNA, 17 bp, Homo sapiens
gtggtctgttggcaggc

SEQ ID NO: 3524987 - DNA, 19 bp, Homo sapiens
gtggtctgttggcaggctg

SEQ ID NO: 3524988 - DNA, 21 bp, Homo sapiens
gtggtctgttggcaggctggc

SEQ ID NO: 3524989 - DNA, 22 bp, Homo sapiens
gtggtctgttggcaggctggcc

SEQ ID NO: 3524990 - DNA, 14 bp, Homo sapiens
gtggtgacctctgc

SEQ ID NO: 3524991 - DNA, 19 bp, Homo sapiens
gtggtgcgatctgggttca

SEQ ID NO: 3524992 - DNA, 14 bp, Homo sapiens
gtggtggagccagt

SEQ ID NO: 3524993 - DNA, 17 bp, Homo sapiens
gtggtggcagtggaggt

SEQ ID NO: 3524994 - DNA, 18 bp, Homo sapiens
gtggtggcctggtccctg

SEQ ID NO: 3524995 - DNA, 16 bp, Homo sapiens
gtggtggtaaccctgg

SEQ ID NO: 3524996 - DNA, 23 bp, Homo sapiens
gtggtgtgtccccctctgtccag

SEQ ID NO: 3524997 - DNA, 20 bp, Homo sapiens
gtggttggggccctgccctg

SEQ ID NO: 3524998 - DNA, 16 bp, Homo sapiens
gtggtttgattgttta

SEQ ID NO: 3524999 - DNA, 12 bp, Homo sapiens
gtggttttctta

SEQ ID NO: 3525000 - DNA, 23 bp, Homo sapiens
gtggttttcttaaggtgaggcct

SEQ ID NO: 3525001 - DNA, 17 bp, Homo sapiens
gtgtacagttggcatgg

SEQ ID NO: 3525002 - DNA, 20 bp, Homo sapiens
gtgtacatcctgcagcttat

SEQ ID NO: 3525003 - DNA, 17 bp, Homo sapiens
gtgtaccatttgcctcc

SEQ ID NO: 3525004 - DNA, 13 bp, Homo sapiens
gtgtaggcagaca

SEQ ID NO: 3525005 - DNA, 22 bp, Homo sapiens
gtgtatagaagcgatttaagtt

SEQ ID NO: 3525006 - DNA, 17 bp, Homo sapiens
gtgtatgggtagcacta

SEQ ID NO: 3525007 - DNA, 18 bp, Homo sapiens
gtgtatttaacagggagg

SEQ ID NO: 3525008 - DNA, 19 bp, Homo sapiens
gtgtatttcttatacgctt

SEQ ID NO: 3525009 - DNA, 23 bp, Homo sapiens
gtgtatttgtatttttttgcaag

SEQ ID NO: 3525010 - DNA, 21 bp, Homo sapiens
gtgtcaagctgctctgagcca

SEQ ID NO: 3525011 - DNA, 14 bp, Homo sapiens
gtgtcacctgaaga

SEQ ID NO: 3525012 - DNA, 22 bp, Homo sapiens
gtgtcacctgaagactcattct

SEQ ID NO: 3525013 - DNA, 17 bp, Homo sapiens
gtgtcagctgaggctgg

SEQ ID NO: 3525014 - DNA, 18 bp, Homo sapiens
gtgtccatgcgctcaggg

SEQ ID NO: 3525015 - DNA, 19 bp, Homo sapiens
gtgtccatgcgctcagggc

SEQ ID NO: 3525016 - DNA, 20 bp, Homo sapiens
gtgtcccaaaaagaaaggag

SEQ ID NO: 3525017 - DNA, 21 bp, Homo sapiens
gtgtcctctctgtgtccctgc

SEQ ID NO: 3525018 - DNA, 21 bp, Homo sapiens
gtgtcctgaaacgctcctttg

SEQ ID NO: 3525019 - DNA, 13 bp, Homo sapiens
gtgtcctgcctgt

SEQ ID NO: 3525020 - DNA, 17 bp, Homo sapiens
gtgtcctgcctgtctgc

SEQ ID NO: 3525021 - DNA, 18 bp, Homo sapiens
gtgtctccaaccccccag

SEQ ID NO: 3525022 - DNA, 19 bp, Homo sapiens
gtgtcttgcaatggcagcc

SEQ ID NO: 3525023 - DNA, 21 bp, Homo sapiens
gtgtcttgcaatggcagcctt

SEQ ID NO: 3525024 - DNA, 20 bp, Homo sapiens
gtgtcttgggcagagctggc

SEQ ID NO: 3525025 - DNA, 14 bp, Homo sapiens
gtgtcttgttctgt

SEQ ID NO: 3525026 - DNA, 14 bp, Homo sapiens
gtgtcttttgacat

SEQ ID NO: 3525027 - DNA, 14 bp, Homo sapiens
gtgtgaatgaacac

SEQ ID NO: 3525028 - DNA, 15 bp, Homo sapiens
gtgtgaatgaacact

SEQ ID NO: 3525029 - DNA, 20 bp, Homo sapiens
gtgtgagtcaccaagcccag

SEQ ID NO: 3525030 - DNA, 15 bp, Homo sapiens
gtgtgctctgatcat

SEQ ID NO: 3525031 - DNA, 18 bp, Homo sapiens
gtgtgctttatgctgaaa

SEQ ID NO: 3525032 - DNA, 22 bp, Homo sapiens
gtgtggagaagccacaggcctg

SEQ ID NO: 3525033 - DNA, 21 bp, Homo sapiens
gtgtggagaagcggctggcag

SEQ ID NO: 3525034 - DNA, 13 bp, Homo sapiens
gtgtggcatttgg

SEQ ID NO: 3525035 - DNA, 16 bp, Homo sapiens
gtgtgggtacctgtat

SEQ ID NO: 3525036 - DNA, 15 bp, Homo sapiens
gtgtgggttctacag

SEQ ID NO: 3525037 - DNA, 16 bp, Homo sapiens
gtgtggtagagtgtgc

SEQ ID NO: 3525038 - DNA, 11 bp, Homo sapiens
gtgtgtattaa

SEQ ID NO: 3525039 - DNA, 14 bp, Homo sapiens
gtgtgtattaaaaa

SEQ ID NO: 3525040 - DNA, 16 bp, Homo sapiens
gtgtgtcagctgaggc

SEQ ID NO: 3525041 - DNA, 16 bp, Homo sapiens
gtgtgtccccctctgt

SEQ ID NO: 3525042 - DNA, 13 bp, Homo sapiens
gtgtgtgtgaatg

SEQ ID NO: 3525043 - DNA, 15 bp, Homo sapiens
gtgtgtgtgtgtgtg

SEQ ID NO: 3525044 - DNA, 13 bp, Homo sapiens
gtgttaattgaaa

SEQ ID NO: 3525045 - DNA, 15 bp, Homo sapiens
gtgttactgctttgc

SEQ ID NO: 3525046 - DNA, 23 bp, Homo sapiens
gtgttagggaagggcctgccaca

SEQ ID NO: 3525047 - DNA, 23 bp, Homo sapiens
gtgttcaaggccatccttccctg

SEQ ID NO: 3525048 - DNA, 22 bp, Homo sapiens
gtgttcccattaagtggtagta

SEQ ID NO: 3525049 - DNA, 19 bp, Homo sapiens
gtgttccccttccactgag

SEQ ID NO: 3525050 - DNA, 22 bp, Homo sapiens
gtgttccccttccactgagggc

SEQ ID NO: 3525051 - DNA, 14 bp, Homo sapiens
gtgttctgtttgtt

SEQ ID NO: 3525052 - DNA, 15 bp, Homo sapiens
gtgttgccacaggac

SEQ ID NO: 3525053 - DNA, 17 bp, Homo sapiens
gtgttgccacaggacac

SEQ ID NO: 3525054 - DNA, 20 bp, Homo sapiens
gtgttgcccaggctggtctc

SEQ ID NO: 3525055 - DNA, 14 bp, Homo sapiens
gtgttgtcccttct

SEQ ID NO: 3525056 - DNA, 12 bp, Homo sapiens
gtgtttcttatt

SEQ ID NO: 3525057 - DNA, 12 bp, Homo sapiens
gtgtttgtcatt

SEQ ID NO: 3525058 - DNA, 17 bp, Homo sapiens
gtttttccactactgct

SEQ ID NO: 3525059 - DNA, 16 bp, Homo sapiens
gtttttgtcttaaaaa

SEQ ID NO: 3525060 - DNA, 14 bp, Homo sapiens
gttttttcaaaata

SEQ ID NO: 3525061 - DNA, 18 bp, Homo sapiens
gttttttcaaaatagaaa

SEQ ID NO: 3525062 - DNA, 13 bp, Homo sapiens
gttttttgcctaa

SEQ ID NO: 3525063 - DNA, 14 bp, Homo sapiens
gttttttgtaccaa

SEQ ID NO: 3525064 - DNA, 16 bp, Homo sapiens
gttttttgtttgagtt

SEQ ID NO: 3525065 - DNA, 14 bp, Homo sapiens
gtttttttaacctg

SEQ ID NO: 3525066 - DNA, 16 bp, Homo sapiens
gttttttttcagccac

SEQ ID NO: 3525067 - DNA, 23 bp, Homo sapiens
gttttttttttttttatgtgatc

SEQ ID NO: 3525068 - DNA, 13 bp, Homo sapiens
taaaaaaaacaaa

SEQ ID NO: 3525069 - DNA, 17 bp, Homo sapiens
taaaaaaaacaaaaaga

SEQ ID NO: 3525070 - DNA, 19 bp, Homo sapiens
taaaaaaaacaaaaagaac

SEQ ID NO: 3525071 - DNA, 22 bp, Homo sapiens
taaaaaaaacaaaaagaacaaa

SEQ ID NO: 3525072 - DNA, 19 bp, Homo sapiens
taaaaaacaaagaagacaa

SEQ ID NO: 3525073 - DNA, 18 bp, Homo sapiens
taaaaaagcatacttcta

SEQ ID NO: 3525074 - DNA, 21 bp, Homo sapiens
taaaaaatgttttctggggaa

SEQ ID NO: 3525075 - DNA, 13 bp, Homo sapiens
taaaaaattcaca

SEQ ID NO: 3525076 - DNA, 19 bp, Homo sapiens
taaaaacattgcctttgaa

SEQ ID NO: 3525077 - DNA, 21 bp, Homo sapiens
taaaaacattgcctttgaatg

SEQ ID NO: 3525078 - DNA, 17 bp, Homo sapiens
taaaaagcatgttgtga

SEQ ID NO: 3525079 - DNA, 21 bp, Homo sapiens
taaaaagtctgtatggcatga

SEQ ID NO: 3525080 - DNA, 19 bp, Homo sapiens
taaaaatacacatggaaaa

SEQ ID NO: 3525081 - DNA, 19 bp, Homo sapiens
taaaaatattttttctgta

SEQ ID NO: 3525082 - DNA, 20 bp, Homo sapiens
taaaaatattttttctgtac

SEQ ID NO: 3525083 - DNA, 13 bp, Homo sapiens
taaaaatcaactt

SEQ ID NO: 3525084 - DNA, 14 bp, Homo sapiens
taaaaatcaacttt

SEQ ID NO: 3525085 - DNA, 14 bp, Homo sapiens
taaaaatcacactg

SEQ ID NO: 3525086 - DNA, 16 bp, Homo sapiens
taaaaatcacactgta

SEQ ID NO: 3525087 - DNA, 11 bp, Homo sapiens
taaaaatgcaa

SEQ ID NO: 3525088 - DNA, 19 bp, Homo sapiens
taaaaatgcaaatcctatg

SEQ ID NO: 3525089 - DNA, 22 bp, Homo sapiens
taaaaatgtcttgctgttgaca

SEQ ID NO: 3525090 - DNA, 23 bp, Homo sapiens
taaaaattgtttcaaaataaaaa

SEQ ID NO: 3525091 - DNA, 16 bp, Homo sapiens
taaaacaaaagctcat

SEQ ID NO: 3525092 - DNA, 15 bp, Homo sapiens
taaaacaaaatttga

SEQ ID NO: 3525093 - DNA, 22 bp, Homo sapiens
taaaacaagcactaaacaaaga

SEQ ID NO: 3525094 - DNA, 15 bp, Homo sapiens
taaaacagtatctct

SEQ ID NO: 3525095 - DNA, 17 bp, Homo sapiens
taaaacattaagaaaat

SEQ ID NO: 3525096 - DNA, 21 bp, Homo sapiens
taaaaccatgtagaaaatttg

SEQ ID NO: 3525097 - DNA, 15 bp, Homo sapiens
taaaagaaaccactt

SEQ ID NO: 3525098 - DNA, 19 bp, Homo sapiens
taaaagaaagaaagaaaaa

SEQ ID NO: 3525099 - DNA, 16 bp, Homo sapiens
taaaagagagagagag

SEQ ID NO: 3525100 - DNA, 16 bp, Homo sapiens
taaaagagctcagaca

SEQ ID NO: 3525101 - DNA, 12 bp, Homo sapiens
taaaagatgctt

SEQ ID NO: 3525102 - DNA, 18 bp, Homo sapiens
taaaagatggggtctgta

SEQ ID NO: 3525103 - DNA, 11 bp, Homo sapiens
taaaagcacac

SEQ ID NO: 3525104 - DNA, 22 bp, Homo sapiens
taaaagcagaaaataaaggaag

SEQ ID NO: 3525105 - DNA, 22 bp, Homo sapiens
taaaagctcctacttttgccac

SEQ ID NO: 3525106 - DNA, 21 bp, Homo sapiens
taaaaggaaatctcaccccat

SEQ ID NO: 3525107 - DNA, 14 bp, Homo sapiens
taaaaggaagccaa

SEQ ID NO: 3525108 - DNA, 23 bp, Homo sapiens
taaaagtgggcttgattctgcag

SEQ ID NO: 3525109 - DNA, 20 bp, Homo sapiens
taaaagtttgaggaatattt

SEQ ID NO: 3525110 - DNA, 11 bp, Homo sapiens
taaaataaact

SEQ ID NO: 3525111 - DNA, 14 bp, Homo sapiens
taaaataaactgta

SEQ ID NO: 3525112 - DNA, 15 bp, Homo sapiens
taaaataaactgtaa

SEQ ID NO: 3525113 - DNA, 17 bp, Homo sapiens
taaaataaactgtaaac

SEQ ID NO: 3525114 - DNA, 14 bp, Homo sapiens
taaaataaatatat

SEQ ID NO: 3525115 - DNA, 21 bp, Homo sapiens
taaaatagcaacactctatat

SEQ ID NO: 3525116 - DNA, 19 bp, Homo sapiens
taaaatatagctgtacaaa

SEQ ID NO: 3525117 - DNA, 15 bp, Homo sapiens
taaaatatttatctg

SEQ ID NO: 3525118 - DNA, 16 bp, Homo sapiens
taaaatattttggatg

SEQ ID NO: 3525119 - DNA, 13 bp, Homo sapiens
taaaatcagccaa

SEQ ID NO: 3525120 - DNA, 15 bp, Homo sapiens
taaaatcagccaatt

SEQ ID NO: 3525121 - DNA, 22 bp, Homo sapiens
taaaatcagccaattatgttaa

SEQ ID NO: 3525122 - DNA, 13 bp, Homo sapiens
taaaatctgtcac

SEQ ID NO: 3525123 - DNA, 20 bp, Homo sapiens
taaaatctttctttcttaga

SEQ ID NO: 3525124 - DNA, 15 bp, Homo sapiens
taaaatgcaatgtaa

SEQ ID NO: 3525125 - DNA, 16 bp, Homo sapiens
taaaatgcatgatttt

SEQ ID NO: 3525126 - DNA, 21 bp, Homo sapiens
taaaatgcctcagtgtatttg

SEQ ID NO: 3525127 - DNA, 14 bp, Homo sapiens
taaaatgtcttcaa

SEQ ID NO: 3525128 - DNA, 14 bp, Homo sapiens
taaaattaaagcta

SEQ ID NO: 3525129 - DNA, 15 bp, Homo sapiens
taaaattgccatatt

SEQ ID NO: 3525130 - DNA, 18 bp, Homo sapiens
taaaatttaacttcttca

SEQ ID NO: 3525131 - DNA, 16 bp, Homo sapiens
taaaatttttttagaa

SEQ ID NO: 3525132 - DNA, 23 bp, Homo sapiens
taaaattttttttcatgttttaa

SEQ ID NO: 3525133 - DNA, 14 bp, Homo sapiens
taaacaaagttact

SEQ ID NO: 3525134 - DNA, 15 bp, Homo sapiens
taaacaaagttacta

SEQ ID NO: 3525135 - DNA, 18 bp, Homo sapiens
taaacacacagatacaca

SEQ ID NO: 3525136 - DNA, 21 bp, Homo sapiens
taaacacacagatacacacac

SEQ ID NO: 3525137 - DNA, 18 bp, Homo sapiens
taaacacgcctgcaaacg

SEQ ID NO: 3525138 - DNA, 11 bp, Homo sapiens
taaacactaca

SEQ ID NO: 3525139 - DNA, 18 bp, Homo sapiens
taaacagatatcttcagt

SEQ ID NO: 3525140 - DNA, 19 bp, Homo sapiens
taaacagatatcttcagtt

SEQ ID NO: 3525141 - DNA, 20 bp, Homo sapiens
taaacagatatcttcagttt

SEQ ID NO: 3525142 - DNA, 17 bp, Homo sapiens
taaacagtaaaccttaa

SEQ ID NO: 3525143 - DNA, 17 bp, Homo sapiens
taaacatccaatatttt

SEQ ID NO: 3525144 - DNA, 16 bp, Homo sapiens
taaaccaaaaactgaa

SEQ ID NO: 3525145 - DNA, 17 bp, Homo sapiens
taaaccaaggactgagc

SEQ ID NO: 3525146 - DNA, 15 bp, Homo sapiens
taaacctaaaaaaga

SEQ ID NO: 3525147 - DNA, 16 bp, Homo sapiens
taaacctaaaaaagat

SEQ ID NO: 3525148 - DNA, 18 bp, Homo sapiens
taaacctaaaaaagatat

SEQ ID NO: 3525149 - DNA, 11 bp, Homo sapiens
taaacctacct

SEQ ID NO: 3525150 - DNA, 15 bp, Homo sapiens
taaacgatgttgtga

SEQ ID NO: 3525151 - DNA, 21 bp, Homo sapiens
taaactaataggctggggttt

SEQ ID NO: 3525152 - DNA, 14 bp, Homo sapiens
taaactacatcttg

SEQ ID NO: 3525153 - DNA, 21 bp, Homo sapiens
taaactagcatatctgccttt

SEQ ID NO: 3525154 - DNA, 22 bp, Homo sapiens
taaactagcatatctgccttta

SEQ ID NO: 3525155 - DNA, 20 bp, Homo sapiens
taaactccttcctggcctga

SEQ ID NO: 3525156 - DNA, 15 bp, Homo sapiens
taaactctgttgcaa

SEQ ID NO: 3525157 - DNA, 11 bp, Homo sapiens
taaactgtaaa

SEQ ID NO: 3525158 - DNA, 16 bp, Homo sapiens
taaagaaagcaacttt

SEQ ID NO: 3525159 - DNA, 15 bp, Homo sapiens
taaagaatacttgaa

SEQ ID NO: 3525160 - DNA, 16 bp, Homo sapiens
taaagaatacttgaac

SEQ ID NO: 3525161 - DNA, 20 bp, Homo sapiens
taaagaatacttgaacttgt

SEQ ID NO: 3525162 - DNA, 16 bp, Homo sapiens
taaagaatatgacttt

SEQ ID NO: 3525163 - DNA, 17 bp, Homo sapiens
taaagacaatcactgcc

SEQ ID NO: 3525164 - DNA, 12 bp, Homo sapiens
taaagagaagac

SEQ ID NO: 3525165 - DNA, 19 bp, Homo sapiens
taaagagagaacaggacta

SEQ ID NO: 3525166 - DNA, 23 bp, Homo sapiens
taaagatacagaactctttcaaa

SEQ ID NO: 3525167 - DNA, 13 bp, Homo sapiens
taaagatgattga

SEQ ID NO: 3525168 - DNA, 17 bp, Homo sapiens
taaagcaatatgcattt

SEQ ID NO: 3525169 - DNA, 15 bp, Homo sapiens
taaagccatgctgga

SEQ ID NO: 3525170 - DNA, 14 bp, Homo sapiens
taaaggaatttaaa

SEQ ID NO: 3525171 - DNA, 21 bp, Homo sapiens
taaaggagcatttttttattc

SEQ ID NO: 3525172 - DNA, 20 bp, Homo sapiens
taaagggcgcaaagggcatg

SEQ ID NO: 3525173 - DNA, 18 bp, Homo sapiens
taaaggggtctgaaattt

SEQ ID NO: 3525174 - DNA, 14 bp, Homo sapiens
taaaggttgtgaat

SEQ ID NO: 3525175 - DNA, 16 bp, Homo sapiens
taaagtatttaattag

SEQ ID NO: 3525176 - DNA, 21 bp, Homo sapiens
taaagtatttaattagtgcta

SEQ ID NO: 3525177 - DNA, 22 bp, Homo sapiens
taaagtatttaattagtgctaa

SEQ ID NO: 3525178 - DNA, 19 bp, Homo sapiens
taaagtgattgacttgact

SEQ ID NO: 3525179 - DNA, 13 bp, Homo sapiens
taaagtgtttagc

SEQ ID NO: 3525180 - DNA, 16 bp, Homo sapiens
taaagttatatttcag

SEQ ID NO: 3525181 - DNA, 23 bp, Homo sapiens
taaagttctgtactcaaatgtag

SEQ ID NO: 3525182 - DNA, 17 bp, Homo sapiens
taaagttggttggataa

SEQ ID NO: 3525183 - DNA, 18 bp, Homo sapiens
taaagttggttggataag

SEQ ID NO: 3525184 - DNA, 17 bp, Homo sapiens
taaagtttgcttagaaa

SEQ ID NO: 3525185 - DNA, 17 bp, Homo sapiens
taaataaattgtatatt

SEQ ID NO: 3525186 - DNA, 21 bp, Homo sapiens
taaataagaaacaactctttg

SEQ ID NO: 3525187 - DNA, 22 bp, Homo sapiens
taaataagaaacaactctttga

SEQ ID NO: 3525188 - DNA, 22 bp, Homo sapiens
taaataatttcctacacaaatg

SEQ ID NO: 3525189 - DNA, 17 bp, Homo sapiens
taaatacaaaacttcca

SEQ ID NO: 3525190 - DNA, 17 bp, Homo sapiens
taaatacagtcttccat

SEQ ID NO: 3525191 - DNA, 18 bp, Homo sapiens
taccttgacacatagttt

SEQ ID NO: 3525192 - DNA, 16 bp, Homo sapiens
taccttgcttttgctt

SEQ ID NO: 3525193 - DNA, 15 bp, Homo sapiens
tacctttcctacatt

SEQ ID NO: 3525194 - DNA, 16 bp, Homo sapiens
taccttttttgttcca

SEQ ID NO: 3525195 - DNA, 22 bp, Homo sapiens
taccttttttgttttttcaaaa

SEQ ID NO: 3525196 - DNA, 14 bp, Homo sapiens
tacgaatacttttg

SEQ ID NO: 3525197 - DNA, 22 bp, Homo sapiens
tacgccaggggaaaatcagcct

SEQ ID NO: 3525198 - DNA, 13 bp, Homo sapiens
tacgcctcttctg

SEQ ID NO: 3525199 - DNA, 14 bp, Homo sapiens
tacgctggtgctga

SEQ ID NO: 3525200 - DNA, 15 bp, Homo sapiens
tacgctttgattcat

SEQ ID NO: 3525201 - DNA, 17 bp, Homo sapiens
tacgcttttctttgtta

SEQ ID NO: 3525202 - DNA, 16 bp, Homo sapiens
tacgtctgacaggcaa

SEQ ID NO: 3525203 - DNA, 17 bp, Homo sapiens
tacgtgaccctctgctg

SEQ ID NO: 3525204 - DNA, 22 bp, Homo sapiens
tacgtgaccctctgctgaagac

SEQ ID NO: 3525205 - DNA, 19 bp, Homo sapiens
tacgtgggcattgtctttt

SEQ ID NO: 3525206 - DNA, 15 bp, Homo sapiens
tactaaaagtttaga

SEQ ID NO: 3525207 - DNA, 17 bp, Homo sapiens
tactaaaagtttagaac

SEQ ID NO: 3525208 - DNA, 14 bp, Homo sapiens
tactaaagccaaac

SEQ ID NO: 3525209 - DNA, 13 bp, Homo sapiens
tactaataaacca

SEQ ID NO: 3525210 - DNA, 16 bp, Homo sapiens
tactaataaaccagtt

SEQ ID NO: 3525211 - DNA, 15 bp, Homo sapiens
tactacagctatgaa

SEQ ID NO: 3525212 - DNA, 13 bp, Homo sapiens
tactaccttgaaa

SEQ ID NO: 3525213 - DNA, 14 bp, Homo sapiens
tactaccttgaaaa

SEQ ID NO: 3525214 - DNA, 16 bp, Homo sapiens
tactaccttgaaaata

SEQ ID NO: 3525215 - DNA, 12 bp, Homo sapiens
tactactttgtt

SEQ ID NO: 3525216 - DNA, 21 bp, Homo sapiens
tactagaaatgggaatcatgg

SEQ ID NO: 3525217 - DNA, 22 bp, Homo sapiens
tactagaaatgggaatcatggc

SEQ ID NO: 3525218 - DNA, 14 bp, Homo sapiens
tactagctctttga

SEQ ID NO: 3525219 - DNA, 19 bp, Homo sapiens
tactagggagccatttgag

SEQ ID NO: 3525220 - DNA, 13 bp, Homo sapiens
tactaggtaactt

SEQ ID NO: 3525221 - DNA, 15 bp, Homo sapiens
tactaggtaacttca

SEQ ID NO: 3525222 - DNA, 16 bp, Homo sapiens
tactagtcctctagaa

SEQ ID NO: 3525223 - DNA, 19 bp, Homo sapiens
tactagttttagttttctc

SEQ ID NO: 3525224 - DNA, 13 bp, Homo sapiens
tactataaagaga

SEQ ID NO: 3525225 - DNA, 15 bp, Homo sapiens
tactatctactctcc

SEQ ID NO: 3525226 - DNA, 22 bp, Homo sapiens
tactatgatctcaggagcttgc

SEQ ID NO: 3525227 - DNA, 14 bp, Homo sapiens
tactatgcctgtgt

SEQ ID NO: 3525228 - DNA, 14 bp, Homo sapiens
tactatgtatgttt

SEQ ID NO: 3525229 - DNA, 15 bp, Homo sapiens
tactattaacatgat

SEQ ID NO: 3525230 - DNA, 19 bp, Homo sapiens
tactattaacatgatgtac

SEQ ID NO: 3525231 - DNA, 16 bp, Homo sapiens
tactcagataaggtaa

SEQ ID NO: 3525232 - DNA, 13 bp, Homo sapiens
tactcaggaagaa

SEQ ID NO: 3525233 - DNA, 20 bp, Homo sapiens
tactccaaagatgacttccc

SEQ ID NO: 3525234 - DNA, 21 bp, Homo sapiens
tactccaaagatgacttcccc

SEQ ID NO: 3525235 - DNA, 21 bp, Homo sapiens
tactccagtgccaacaatcct

SEQ ID NO: 3525236 - DNA, 22 bp, Homo sapiens
tactctacaattcctctgataa

SEQ ID NO: 3525237 - DNA, 21 bp, Homo sapiens
tactctagatacctaaaacat

SEQ ID NO: 3525238 - DNA, 14 bp, Homo sapiens
tactctagatgaag

SEQ ID NO: 3525239 - DNA, 14 bp, Homo sapiens
tactctcctcatct

SEQ ID NO: 3525240 - DNA, 14 bp, Homo sapiens
tactctccttttat

SEQ ID NO: 3525241 - DNA, 16 bp, Homo sapiens
tactctgccctctaga

SEQ ID NO: 3525242 - DNA, 22 bp, Homo sapiens
tactcttacatgtataaagtga

SEQ ID NO: 3525243 - DNA, 12 bp, Homo sapiens
tactctttccta

SEQ ID NO: 3525244 - DNA, 13 bp, Homo sapiens
tactctttcctat

SEQ ID NO: 3525245 - DNA, 17 bp, Homo sapiens
tactgaaggtaaaattg

SEQ ID NO: 3525246 - DNA, 22 bp, Homo sapiens
tactgaccctggggctggcttt

SEQ ID NO: 3525247 - DNA, 21 bp, Homo sapiens
tactgagttttttattccagt

SEQ ID NO: 3525248 - DNA, 22 bp, Homo sapiens
tactgcagcctttgcctccccg

SEQ ID NO: 3525249 - DNA, 22 bp, Homo sapiens
tactgccgtcagtgctgtgctg

SEQ ID NO: 3525250 - DNA, 12 bp, Homo sapiens
tactgcgacttt

SEQ ID NO: 3525251 - DNA, 16 bp, Homo sapiens
tactgcgactttctgc

SEQ ID NO: 3525252 - DNA, 19 bp, Homo sapiens
tactgcgactttctgcctg

SEQ ID NO: 3525253 - DNA, 15 bp, Homo sapiens
tactgctactgtaat

SEQ ID NO: 3525254 - DNA, 20 bp, Homo sapiens
tactgctgagatacatacag

SEQ ID NO: 3525255 - DNA, 16 bp, Homo sapiens
tactgcttcatttttg

SEQ ID NO: 3525256 - DNA, 21 bp, Homo sapiens
tactgcttcatttttgtaata

SEQ ID NO: 3525257 - DNA, 16 bp, Homo sapiens
tactgctttgcaaaga

SEQ ID NO: 3525258 - DNA, 11 bp, Homo sapiens
tactgtaacac

SEQ ID NO: 3525259 - DNA, 14 bp, Homo sapiens
tactgtaagaataa

SEQ ID NO: 3525260 - DNA, 20 bp, Homo sapiens
tactgtaagaataatttata

SEQ ID NO: 3525261 - DNA, 13 bp, Homo sapiens
tactgtaattcct

SEQ ID NO: 3525262 - DNA, 12 bp, Homo sapiens
tactgtaatttt

SEQ ID NO: 3525263 - DNA, 14 bp, Homo sapiens
tactgtaattttat

SEQ ID NO: 3525264 - DNA, 20 bp, Homo sapiens
tactgtaattttatatgaag

SEQ ID NO: 3525265 - DNA, 14 bp, Homo sapiens
tactgtatgtgatg

SEQ ID NO: 3525266 - DNA, 12 bp, Homo sapiens
tactgtatttga

SEQ ID NO: 3525267 - DNA, 14 bp, Homo sapiens
tactgtgtgtgtga

SEQ ID NO: 3525268 - DNA, 17 bp, Homo sapiens
tactgtgtgtgtgaatg

SEQ ID NO: 3525269 - DNA, 18 bp, Homo sapiens
tactgtgtgtgtgaatga

SEQ ID NO: 3525270 - DNA, 21 bp, Homo sapiens
tactgtgtgtgtgaatgaaca

SEQ ID NO: 3525271 - DNA, 22 bp, Homo sapiens
tactgtgtgtgtgaatgaacac

SEQ ID NO: 3525272 - DNA, 23 bp, Homo sapiens
tactgtgtgtgtgaatgaacact

SEQ ID NO: 3525273 - DNA, 16 bp, Homo sapiens
tactgttaaaggaaaa

SEQ ID NO: 3525274 - DNA, 18 bp, Homo sapiens
tactgttgcaaagcttcc

SEQ ID NO: 3525275 - DNA, 19 bp, Homo sapiens
tactgttgtacaatcatgt

SEQ ID NO: 3525276 - DNA, 13 bp, Homo sapiens
tacttaactgttt

SEQ ID NO: 3525277 - DNA, 14 bp, Homo sapiens
tacttacattctct

SEQ ID NO: 3525278 - DNA, 15 bp, Homo sapiens
tacttacattctcta

SEQ ID NO: 3525279 - DNA, 22 bp, Homo sapiens
tacttacattctctaataagaa

SEQ ID NO: 3525280 - DNA, 16 bp, Homo sapiens
tacttagaaagtaaga

SEQ ID NO: 3525281 - DNA, 14 bp, Homo sapiens
tacttataaagaag

SEQ ID NO: 3525282 - DNA, 18 bp, Homo sapiens
tacttatccctgcccatt

SEQ ID NO: 3525283 - DNA, 23 bp, Homo sapiens
tacttatccctgcccatttcata

SEQ ID NO: 3525284 - DNA, 19 bp, Homo sapiens
tacttcattttcagagtga

SEQ ID NO: 3525285 - DNA, 15 bp, Homo sapiens
tacttctgctacata

SEQ ID NO: 3525286 - DNA, 14 bp, Homo sapiens
tacttgaagggcca

SEQ ID NO: 3525287 - DNA, 16 bp, Homo sapiens
tacttgaagggccaga

SEQ ID NO: 3525288 - DNA, 16 bp, Homo sapiens
tacttgagcccaggag

SEQ ID NO: 3525289 - DNA, 20 bp, Homo sapiens
tacttggctttttactatta

SEQ ID NO: 3525290 - DNA, 15 bp, Homo sapiens
tacttgtggactaaa

SEQ ID NO: 3525291 - DNA, 19 bp, Homo sapiens
tacttgtggactaaaagat

SEQ ID NO: 3525292 - DNA, 14 bp, Homo sapiens
tacttgttataaac

SEQ ID NO: 3525293 - DNA, 17 bp, Homo sapiens
tactttaaatgttctgt

SEQ ID NO: 3525294 - DNA, 21 bp, Homo sapiens
tactttagatggcaagcatgt

SEQ ID NO: 3525295 - DNA, 18 bp, Homo sapiens
tactttgaagtcatacca

SEQ ID NO: 3525296 - DNA, 15 bp, Homo sapiens
tactttgattctgat

SEQ ID NO: 3525297 - DNA, 21 bp, Homo sapiens
tactttgattctgataatgct

SEQ ID NO: 3525298 - DNA, 15 bp, Homo sapiens
tacttttgccctttg

SEQ ID NO: 3525299 - DNA, 19 bp, Homo sapiens
tactttttagtaatttctt

SEQ ID NO: 3525300 - DNA, 16 bp, Homo sapiens
tactttttatttctaa

SEQ ID NO: 3525301 - DNA, 12 bp, Homo sapiens
tactttttctaa

SEQ ID NO: 3525302 - DNA, 19 bp, Homo sapiens
tactttttgaacttttcat

SEQ ID NO: 3525303 - DNA, 20 bp, Homo sapiens
tacttttttaaatattttct

SEQ ID NO: 3525304 - DNA, 23 bp, Homo sapiens
tacttttttaaatattttctatt

SEQ ID NO: 3525305 - DNA, 20 bp, Homo sapiens
tagaaaaagaacatgcagtt

SEQ ID NO: 3525306 - DNA, 20 bp, Homo sapiens
tagaaaaattcagcaaacca

SEQ ID NO: 3525307 - DNA, 14 bp, Homo sapiens
tagaaaatataagt

SEQ ID NO: 3525308 - DNA, 22 bp, Homo sapiens
tagaaaatataagtaaagtgat

SEQ ID NO: 3525309 - DNA, 14 bp, Homo sapiens
tagaaagaagccca

SEQ ID NO: 3525310 - DNA, 18 bp, Homo sapiens
tagaaagcatttgaatgc

SEQ ID NO: 3525311 - DNA, 22 bp, Homo sapiens
tagaaagcatttgaatgcattt

SEQ ID NO: 3525312 - DNA, 15 bp, Homo sapiens
tagaaagtaagagct

SEQ ID NO: 3525313 - DNA, 20 bp, Homo sapiens
tagaaataaaggatgtgatt

SEQ ID NO: 3525314 - DNA, 16 bp, Homo sapiens
tagaaataatatgcat

SEQ ID NO: 3525315 - DNA, 21 bp, Homo sapiens
tagaaatggaaattttgctat

SEQ ID NO: 3525316 - DNA, 20 bp, Homo sapiens
tagaaatgggaatcatggcc

SEQ ID NO: 3525317 - DNA, 17 bp, Homo sapiens
tagaaatggttgtatta

SEQ ID NO: 3525318 - DNA, 19 bp, Homo sapiens
tagaaatggttgtattaga

SEQ ID NO: 3525319 - DNA, 20 bp, Homo sapiens
tagaaatggttgtattagat

SEQ ID NO: 3525320 - DNA, 23 bp, Homo sapiens
tagaacagagaaagaggaagctt

SEQ ID NO: 3525321 - DNA, 22 bp, Homo sapiens
tagaacagtcattaattttcaa

SEQ ID NO: 3525322 - DNA, 18 bp, Homo sapiens
tagaacatccctgccagc

SEQ ID NO: 3525323 - DNA, 20 bp, Homo sapiens
tagaaccaccaacaagcaag

SEQ ID NO: 3525324 - DNA, 16 bp, Homo sapiens
tattgtaaaaaattca

SEQ ID NO: 3525325 - DNA, 23 bp, Homo sapiens
tattgtaaaaaattcacataata

SEQ ID NO: 3525326 - DNA, 10 bp, Homo sapiens
tattgtattt

SEQ ID NO: 3525327 - DNA, 16 bp, Homo sapiens
tattgtatttattcaa

SEQ ID NO: 3525328 - DNA, 15 bp, Homo sapiens
tattgtccattgtcc

SEQ ID NO: 3525329 - DNA, 17 bp, Homo sapiens
tattgtgtttgtcatta

SEQ ID NO: 3525330 - DNA, 16 bp, Homo sapiens
tattgtgtttgtgtat

SEQ ID NO: 3525331 - DNA, 13 bp, Homo sapiens
tattgtttatgta

SEQ ID NO: 3525332 - DNA, 15 bp, Homo sapiens
tattgttttctcctt

SEQ ID NO: 3525333 - DNA, 16 bp, Homo sapiens
tatttaaaaatgtctt

SEQ ID NO: 3525334 - DNA, 16 bp, Homo sapiens
tatttaaaagagtaga

SEQ ID NO: 3525335 - DNA, 24 bp, Homo sapiens
tatttaaactctgttgcaagtgca

SEQ ID NO: 3525336 - DNA, 18 bp, Homo sapiens
tatttaaagacaaagaca

SEQ ID NO: 3525337 - DNA, 15 bp, Homo sapiens
tatttaactggtgca

SEQ ID NO: 3525338 - DNA, 21 bp, Homo sapiens
tatttaagcaacatcttttta

SEQ ID NO: 3525339 - DNA, 16 bp, Homo sapiens
tatttaatgttttaaa

SEQ ID NO: 3525340 - DNA, 20 bp, Homo sapiens
tatttaatgttttaaatgta

SEQ ID NO: 3525341 - DNA, 21 bp, Homo sapiens
tatttaatgttttaaatgtac

SEQ ID NO: 3525342 - DNA, 22 bp, Homo sapiens
tatttaatgttttaaatgtaca

SEQ ID NO: 3525343 - DNA, 21 bp, Homo sapiens
tatttaattagtgctaagtgt

SEQ ID NO: 3525344 - DNA, 22 bp, Homo sapiens
tatttacgctttgattcatagt

SEQ ID NO: 3525345 - DNA, 19 bp, Homo sapiens
tatttactgagcttctctg

SEQ ID NO: 3525346 - DNA, 22 bp, Homo sapiens
tatttactgagcttctctgtga

SEQ ID NO: 3525347 - DNA, 19 bp, Homo sapiens
tatttagattgttaaaata

SEQ ID NO: 3525348 - DNA, 22 bp, Homo sapiens
tatttagattgttaaaataact

SEQ ID NO: 3525349 - DNA, 15 bp, Homo sapiens
tatttaggaagtgtt

SEQ ID NO: 3525350 - DNA, 14 bp, Homo sapiens
tatttataaaactt

SEQ ID NO: 3525351 - DNA, 17 bp, Homo sapiens
tatttataaaacttctc

SEQ ID NO: 3525352 - DNA, 20 bp, Homo sapiens
tatttataacaacctaaatt

SEQ ID NO: 3525353 - DNA, 20 bp, Homo sapiens
tatttatccaaaatgtgtat

SEQ ID NO: 3525354 - DNA, 21 bp, Homo sapiens
tatttatctgattaagttgtc

SEQ ID NO: 3525355 - DNA, 15 bp, Homo sapiens
tatttattacctctg

SEQ ID NO: 3525356 - DNA, 16 bp, Homo sapiens
tatttattacctctga

SEQ ID NO: 3525357 - DNA, 12 bp, Homo sapiens
tatttattcaat

SEQ ID NO: 3525358 - DNA, 16 bp, Homo sapiens
tatttattcaataaag

SEQ ID NO: 3525359 - DNA, 23 bp, Homo sapiens
tatttattcattatttgtcaaat

SEQ ID NO: 3525360 - DNA, 11 bp, Homo sapiens
tatttatttac

SEQ ID NO: 3525361 - DNA, 20 bp, Homo sapiens
tatttcacaaataataggtg

SEQ ID NO: 3525362 - DNA, 13 bp, Homo sapiens
tatttcagatgta

SEQ ID NO: 3525363 - DNA, 21 bp, Homo sapiens
tatttccactattttcaaaga

SEQ ID NO: 3525364 - DNA, 18 bp, Homo sapiens
tatttcctggatgtttgg

SEQ ID NO: 3525365 - DNA, 15 bp, Homo sapiens
tatttctagagacaa

SEQ ID NO: 3525366 - DNA, 16 bp, Homo sapiens
tatttcttaaacactt

SEQ ID NO: 3525367 - DNA, 17 bp, Homo sapiens
tatttgattcaaaatat

SEQ ID NO: 3525368 - DNA, 11 bp, Homo sapiens
tatttgctttt

SEQ ID NO: 3525369 - DNA, 23 bp, Homo sapiens
tatttgggcctgctccagacctg

SEQ ID NO: 3525370 - DNA, 21 bp, Homo sapiens
tatttggtttggccatctctg

SEQ ID NO: 3525371 - DNA, 23 bp, Homo sapiens
tatttgtactgtttaatgttctg

SEQ ID NO: 3525372 - DNA, 18 bp, Homo sapiens
tatttgtgatagcacttt

SEQ ID NO: 3525373 - DNA, 13 bp, Homo sapiens
tatttgtgtattt

SEQ ID NO: 3525374 - DNA, 20 bp, Homo sapiens
tattttactagaaatgggaa

SEQ ID NO: 3525375 - DNA, 21 bp, Homo sapiens
tattttactagaaatgggaat

SEQ ID NO: 3525376 - DNA, 14 bp, Homo sapiens
tattttataagaaa

SEQ ID NO: 3525377 - DNA, 13 bp, Homo sapiens
tattttattccct

SEQ ID NO: 3525378 - DNA, 13 bp, Homo sapiens
tattttcaccatt

SEQ ID NO: 3525379 - DNA, 14 bp, Homo sapiens
tattttcaccattt

SEQ ID NO: 3525380 - DNA, 22 bp, Homo sapiens
tattttccaaaagtggcctctt

SEQ ID NO: 3525381 - DNA, 14 bp, Homo sapiens
tattttctgttcta

SEQ ID NO: 3525382 - DNA, 11 bp, Homo sapiens
tattttggaac

SEQ ID NO: 3525383 - DNA, 16 bp, Homo sapiens
tattttggaactatga

SEQ ID NO: 3525384 - DNA, 23 bp, Homo sapiens
tattttggattgtatattgtgtt

SEQ ID NO: 3525385 - DNA, 13 bp, Homo sapiens
tatttttaaataa

SEQ ID NO: 3525386 - DNA, 18 bp, Homo sapiens
tatttttatataatatct

SEQ ID NO: 3525387 - DNA, 18 bp, Homo sapiens
tatttttgctgcttctga

SEQ ID NO: 3525388 - DNA, 13 bp, Homo sapiens
tatttttgtacat

SEQ ID NO: 3525389 - DNA, 17 bp, Homo sapiens
tatttttgtagagccag

SEQ ID NO: 3525390 - DNA, 14 bp, Homo sapiens
tattttttgtttgt

SEQ ID NO: 3525391 - DNA, 16 bp, Homo sapiens
tatttttttttttgtt

SEQ ID NO: 3525392 - DNA, 22 bp, Homo sapiens
tcaaaaacgccctcaagaacat

SEQ ID NO: 3525393 - DNA, 21 bp, Homo sapiens
tcaaaaagtattatcattgct

SEQ ID NO: 3525394 - DNA, 15 bp, Homo sapiens
tcaaaaccttttgaa

SEQ ID NO: 3525395 - DNA, 18 bp, Homo sapiens
tcaaaactcatttcctat

SEQ ID NO: 3525396 - DNA, 14 bp, Homo sapiens
tcaaaatagaaaag

SEQ ID NO: 3525397 - DNA, 14 bp, Homo sapiens
tcaaaatatttaaa

SEQ ID NO: 3525398 - DNA, 12 bp, Homo sapiens
tcaaaatgcttt

SEQ ID NO: 3525399 - DNA, 14 bp, Homo sapiens
tcaaacaaagccag

SEQ ID NO: 3525400 - DNA, 15 bp, Homo sapiens
tcaaacaaagccaga

SEQ ID NO: 3525401 - DNA, 14 bp, Homo sapiens
tcaaacactgcagg

SEQ ID NO: 3525402 - DNA, 16 bp, Homo sapiens
tcaaactgctccaagt

SEQ ID NO: 3525403 - DNA, 14 bp, Homo sapiens
tcaaactggggcct

SEQ ID NO: 3525404 - DNA, 16 bp, Homo sapiens
tcaaactggggcctcc

SEQ ID NO: 3525405 - DNA, 19 bp, Homo sapiens
tcaaactggggcctccaga

SEQ ID NO: 3525406 - DNA, 20 bp, Homo sapiens
tcaaactggggcctccagaa

SEQ ID NO: 3525407 - DNA, 23 bp, Homo sapiens
tcaaactggggcctccagaactc

SEQ ID NO: 3525408 - DNA, 19 bp, Homo sapiens
tcaaacttctggctccctc

SEQ ID NO: 3525409 - DNA, 14 bp, Homo sapiens
tcaaagaaaataga

SEQ ID NO: 3525410 - DNA, 21 bp, Homo sapiens
tcaaagaggctgaggctggca

SEQ ID NO: 3525411 - DNA, 23 bp, Homo sapiens
tcaaagaggttttaaaaaaatcc

SEQ ID NO: 3525412 - DNA, 17 bp, Homo sapiens
tcaaagatgacttgaaa

SEQ ID NO: 3525413 - DNA, 14 bp, Homo sapiens
tcaaagatttttat

SEQ ID NO: 3525414 - DNA, 10 bp, Homo sapiens
tcaaagcaga

SEQ ID NO: 3525415 - DNA, 18 bp, Homo sapiens
tcaaagccaagtttatat

SEQ ID NO: 3525416 - DNA, 14 bp, Homo sapiens
tcaaagctgaaatg

SEQ ID NO: 3525417 - DNA, 19 bp, Homo sapiens
tcaaaggtagccatcatgg

SEQ ID NO: 3525418 - DNA, 14 bp, Homo sapiens
tcaaagtaaaactt

SEQ ID NO: 3525419 - DNA, 17 bp, Homo sapiens
tcaaagttctgctttct

SEQ ID NO: 3525420 - DNA, 16 bp, Homo sapiens
tcaaatgcagtatatt

SEQ ID NO: 3525421 - DNA, 19 bp, Homo sapiens
tcaaatgcagtatatttct

SEQ ID NO: 3525422 - DNA, 14 bp, Homo sapiens
tcaaatgctcagac

SEQ ID NO: 3525423 - DNA, 12 bp, Homo sapiens
tcaaattaataa

SEQ ID NO: 3525424 - DNA, 21 bp, Homo sapiens
tcaaattcctatttttaaata

SEQ ID NO: 3525425 - DNA, 22 bp, Homo sapiens
tcaaatttagaaactaattgac

SEQ ID NO: 3525426 - DNA, 23 bp, Homo sapiens
tcaaatttagaaactaattgact

SEQ ID NO: 3525427 - DNA, 18 bp, Homo sapiens
tcaacaaaaattgtccct

SEQ ID NO: 3525428 - DNA, 13 bp, Homo sapiens
tcaacaagcctga

SEQ ID NO: 3525429 - DNA, 18 bp, Homo sapiens
tcaacactcccttcccat

SEQ ID NO: 3525430 - DNA, 17 bp, Homo sapiens
tcaacagtgaagacaga

SEQ ID NO: 3525431 - DNA, 15 bp, Homo sapiens
tcaacagttttccta

SEQ ID NO: 3525432 - DNA, 15 bp, Homo sapiens
tcaacatcttttaca

SEQ ID NO: 3525433 - DNA, 19 bp, Homo sapiens
tcaaccacctaggcaatga

SEQ ID NO: 3525434 - DNA, 20 bp, Homo sapiens
tcaaccccttcgctcctgtg

SEQ ID NO: 3525435 - DNA, 16 bp, Homo sapiens
tcaacccttctggaaa

SEQ ID NO: 3525436 - DNA, 13 bp, Homo sapiens
tcaacctcctggg

SEQ ID NO: 3525437 - DNA, 17 bp, Homo sapiens
tcaacctgggcaaagcc

SEQ ID NO: 3525438 - DNA, 17 bp, Homo sapiens
tcaaccttggccttctc

SEQ ID NO: 3525439 - DNA, 22 bp, Homo sapiens
tcaactagtggggtttcctggc

SEQ ID NO: 3525440 - DNA, 19 bp, Homo sapiens
tcaacttattaacaattag

SEQ ID NO: 3525441 - DNA, 14 bp, Homo sapiens
tcaactttgaataa

SEQ ID NO: 3525442 - DNA, 18 bp, Homo sapiens
tcaactttttattgcctt

SEQ ID NO: 3525443 - DNA, 19 bp, Homo sapiens
tcaactttttattgccttc

SEQ ID NO: 3525444 - DNA, 22 bp, Homo sapiens
tcaagaaataaaaggaagccaa

SEQ ID NO: 3525445 - DNA, 18 bp, Homo sapiens
tcaagaacatgatgggcc

SEQ ID NO: 3525446 - DNA, 20 bp, Homo sapiens
tcaagaagggctgcatgatg

SEQ ID NO: 3525447 - DNA, 19 bp, Homo sapiens
tcaagactggaaggtgggg

SEQ ID NO: 3525448 - DNA, 16 bp, Homo sapiens
tcaagatgacagctct

SEQ ID NO: 3525449 - DNA, 20 bp, Homo sapiens
tcaagatgggggcagggctg

SEQ ID NO: 3525450 - DNA, 21 bp, Homo sapiens
tcaagcagacatagaagagcc

SEQ ID NO: 3525451 - DNA, 12 bp, Homo sapiens
tcaagcagccaa

SEQ ID NO: 3525452 - DNA, 19 bp, Homo sapiens
tcaagcagtcgtgcctgtg

SEQ ID NO: 3525453 - DNA, 22 bp, Homo sapiens
tcaagcagtcgtgcctgtgtcc

SEQ ID NO: 3525454 - DNA, 15 bp, Homo sapiens
tcaagcatttaggaa

SEQ ID NO: 3525455 - DNA, 14 bp, Homo sapiens
tcaagccaagcagc

SEQ ID NO: 3525456 - DNA, 20 bp, Homo sapiens
tcaagccaagcagccaagct

SEQ ID NO: 3525457 - DNA, 14 bp, Homo sapiens
tcatgtaaactgtg

SEQ ID NO: 3525458 - DNA, 16 bp, Homo sapiens
tcatgtaaactgtgca

SEQ ID NO: 3525459 - DNA, 17 bp, Homo sapiens
tcatgtaaactgtgcac

SEQ ID NO: 3525460 - DNA, 15 bp, Homo sapiens
tcatgtaatcctcaa

SEQ ID NO: 3525461 - DNA, 16 bp, Homo sapiens
tcatgtacaagatgaa

SEQ ID NO: 3525462 - DNA, 13 bp, Homo sapiens
tcatgtacttttt

SEQ ID NO: 3525463 - DNA, 19 bp, Homo sapiens
tcatgtctattccattccc

SEQ ID NO: 3525464 - DNA, 13 bp, Homo sapiens
tcatgtctggcta

SEQ ID NO: 3525465 - DNA, 13 bp, Homo sapiens
tcatgtggctgga

SEQ ID NO: 3525466 - DNA, 12 bp, Homo sapiens
tcatgtgtgtcc

SEQ ID NO: 3525467 - DNA, 16 bp, Homo sapiens
tcatgtgtgtccacga

SEQ ID NO: 3525468 - DNA, 20 bp, Homo sapiens
tcatgttggtttattttcac

SEQ ID NO: 3525469 - DNA, 11 bp, Homo sapiens
tcatgtttctt

SEQ ID NO: 3525470 - DNA, 21 bp, Homo sapiens
tcatgttttaaagcttgctca

SEQ ID NO: 3525471 - DNA, 14 bp, Homo sapiens
tcatgttttaacaa

SEQ ID NO: 3525472 - DNA, 15 bp, Homo sapiens
tcattaatgacactt

SEQ ID NO: 3525473 - DNA, 22 bp, Homo sapiens
tcattaatgacacttgtcccca

SEQ ID NO: 3525474 - DNA, 14 bp, Homo sapiens
tcattacaaatggt

SEQ ID NO: 3525475 - DNA, 23 bp, Homo sapiens
tcattattcgtagatattggaca

SEQ ID NO: 3525476 - DNA, 13 bp, Homo sapiens
tcattatttgtca

SEQ ID NO: 3525477 - DNA, 15 bp, Homo sapiens
tcattatttgtcaaa

SEQ ID NO: 3525478 - DNA, 22 bp, Homo sapiens
tcattcaaaagttgaaattaac

SEQ ID NO: 3525479 - DNA, 18 bp, Homo sapiens
tcattccctctcatctca

SEQ ID NO: 3525480 - DNA, 17 bp, Homo sapiens
tcattccgttgtctgtg

SEQ ID NO: 3525481 - DNA, 15 bp, Homo sapiens
tcattcctgttcttt

SEQ ID NO: 3525482 - DNA, 18 bp, Homo sapiens
tcattcctgttctttctt

SEQ ID NO: 3525483 - DNA, 14 bp, Homo sapiens
tcattctctgtctc

SEQ ID NO: 3525484 - DNA, 15 bp, Homo sapiens
tcattctctgtctca

SEQ ID NO: 3525485 - DNA, 19 bp, Homo sapiens
tcattctctgtctcatcca

SEQ ID NO: 3525486 - DNA, 16 bp, Homo sapiens
tcattctgcaagtata

SEQ ID NO: 3525487 - DNA, 17 bp, Homo sapiens
tcattcttgaaagctgt

SEQ ID NO: 3525488 - DNA, 18 bp, Homo sapiens
tcattcttgaaagctgtg

SEQ ID NO: 3525489 - DNA, 14 bp, Homo sapiens
tcattctttgcagg

SEQ ID NO: 3525490 - DNA, 17 bp, Homo sapiens
tcattgaggataaattg

SEQ ID NO: 3525491 - DNA, 18 bp, Homo sapiens
tcattgatttcctgtgtc

SEQ ID NO: 3525492 - DNA, 17 bp, Homo sapiens
tcattgctgagcctctg

SEQ ID NO: 3525493 - DNA, 16 bp, Homo sapiens
tcattggctttatcct

SEQ ID NO: 3525494 - DNA, 24 bp, Homo sapiens
tcattgtaacactgtttattgaaa

SEQ ID NO: 3525495 - DNA, 15 bp, Homo sapiens
tcattgtatgttatt

SEQ ID NO: 3525496 - DNA, 20 bp, Homo sapiens
tcattgttggtgttaattga

SEQ ID NO: 3525497 - DNA, 11 bp, Homo sapiens
tcatttaataa

SEQ ID NO: 3525498 - DNA, 18 bp, Homo sapiens
tcatttagtgccctcttt

SEQ ID NO: 3525499 - DNA, 18 bp, Homo sapiens
tcatttattgtttatgta

SEQ ID NO: 3525500 - DNA, 23 bp, Homo sapiens
tcatttcacccctccctttctcc

SEQ ID NO: 3525501 - DNA, 15 bp, Homo sapiens
tcatttctaggcaaa

SEQ ID NO: 3525502 - DNA, 23 bp, Homo sapiens
tcatttctaggcaaaattgtgaa

SEQ ID NO: 3525503 - DNA, 13 bp, Homo sapiens
tcatttctatttc

SEQ ID NO: 3525504 - DNA, 19 bp, Homo sapiens
tcatttgagcagggctcag

SEQ ID NO: 3525505 - DNA, 15 bp, Homo sapiens
tcatttgagtctctt

SEQ ID NO: 3525506 - DNA, 18 bp, Homo sapiens
tcatttggttcattaatt

SEQ ID NO: 3525507 - DNA, 17 bp, Homo sapiens
tcatttggttggcacta

SEQ ID NO: 3525508 - DNA, 17 bp, Homo sapiens
tcatttgtggctttctg

SEQ ID NO: 3525509 - DNA, 21 bp, Homo sapiens
tcatttgtggtgatatagaat

SEQ ID NO: 3525510 - DNA, 23 bp, Homo sapiens
tcatttgtggtgatatagaatta

SEQ ID NO: 3525511 - DNA, 12 bp, Homo sapiens
tcattttcagag

SEQ ID NO: 3525512 - DNA, 14 bp, Homo sapiens
tcattttctagata

SEQ ID NO: 3525513 - DNA, 20 bp, Homo sapiens
tcattttctagatacaataa

SEQ ID NO: 3525514 - DNA, 14 bp, Homo sapiens
tcattttgcactgt

SEQ ID NO: 3525515 - DNA, 15 bp, Homo sapiens
tcatttttaaatgtg

SEQ ID NO: 3525516 - DNA, 21 bp, Homo sapiens
tcatttttgtaataacattta

SEQ ID NO: 3525517 - DNA, 16 bp, Homo sapiens
tcatttttttccaggc

SEQ ID NO: 3525518 - DNA, 15 bp, Homo sapiens
tccaaaagaagcccc

SEQ ID NO: 3525519 - DNA, 21 bp, Homo sapiens
tccaaaagaagcccccagcta

SEQ ID NO: 3525520 - DNA, 19 bp, Homo sapiens
tccaaaagtggcctctttg

SEQ ID NO: 3525521 - DNA, 20 bp, Homo sapiens
tccaaaataaaaaccttcca

SEQ ID NO: 3525522 - DNA, 21 bp, Homo sapiens
tccaaaataaaaaccttccaa

SEQ ID NO: 3525523 - DNA, 22 bp, Homo sapiens
tccaaaccactttttgcagctt

SEQ ID NO: 3525524 - DNA, 18 bp, Homo sapiens
tccaaacttggatttttg

SEQ ID NO: 3525525 - DNA, 22 bp, Homo sapiens
tccaaagagtagaattgcattg

SEQ ID NO: 3525526 - DNA, 20 bp, Homo sapiens
tccaaagatgacttcccctg

SEQ ID NO: 3525527 - DNA, 13 bp, Homo sapiens
tccaaagcagggt

SEQ ID NO: 3525528 - DNA, 22 bp, Homo sapiens
tccaaaggccatggagagctgg

SEQ ID NO: 3525529 - DNA, 20 bp, Homo sapiens
tccaaatggcgtctggaagt

SEQ ID NO: 3525530 - DNA, 17 bp, Homo sapiens
tccaacaccaagcacag

SEQ ID NO: 3525531 - DNA, 21 bp, Homo sapiens
tccaacaccaagcacagcagc

SEQ ID NO: 3525532 - DNA, 23 bp, Homo sapiens
tccaacaccaagcacagcagcct

SEQ ID NO: 3525533 - DNA, 18 bp, Homo sapiens
tccaaccccccagcactg

SEQ ID NO: 3525534 - DNA, 19 bp, Homo sapiens
tccaaccccccagcactga

SEQ ID NO: 3525535 - DNA, 20 bp, Homo sapiens
tccaaccccccagcactgag

SEQ ID NO: 3525536 - DNA, 21 bp, Homo sapiens
tccaagcaacagcctttgaat

SEQ ID NO: 3525537 - DNA, 23 bp, Homo sapiens
tccaagccccatcttctaaatgg

SEQ ID NO: 3525538 - DNA, 12 bp, Homo sapiens
tccaagcttcca

SEQ ID NO: 3525539 - DNA, 22 bp, Homo sapiens
tccaagcttccatagctgctgc

SEQ ID NO: 3525540 - DNA, 15 bp, Homo sapiens
tccaatgcttcttat

SEQ ID NO: 3525541 - DNA, 17 bp, Homo sapiens
tccacaccaagcagcaa

SEQ ID NO: 3525542 - DNA, 21 bp, Homo sapiens
tccacaccttttattgacaca

SEQ ID NO: 3525543 - DNA, 14 bp, Homo sapiens
tccacagcttcctg

SEQ ID NO: 3525544 - DNA, 14 bp, Homo sapiens
tccacatcccggga

SEQ ID NO: 3525545 - DNA, 19 bp, Homo sapiens
tccacatcctccacgttct

SEQ ID NO: 3525546 - DNA, 15 bp, Homo sapiens
tccaccaggaacctc

SEQ ID NO: 3525547 - DNA, 13 bp, Homo sapiens
tccacccacctca

SEQ ID NO: 3525548 - DNA, 12 bp, Homo sapiens
tccacccaggag

SEQ ID NO: 3525549 - DNA, 14 bp, Homo sapiens
tccacccaggagcc

SEQ ID NO: 3525550 - DNA, 20 bp, Homo sapiens
tccacccaggagccccgagg

SEQ ID NO: 3525551 - DNA, 14 bp, Homo sapiens
tccacgactgtctc

SEQ ID NO: 3525552 - DNA, 15 bp, Homo sapiens
tccacggagccactc

SEQ ID NO: 3525553 - DNA, 21 bp, Homo sapiens
tccacggagccactcctctga

SEQ ID NO: 3525554 - DNA, 19 bp, Homo sapiens
tccacgttctgctcatcat

SEQ ID NO: 3525555 - DNA, 19 bp, Homo sapiens
tccactcaaagagggtgag

SEQ ID NO: 3525556 - DNA, 14 bp, Homo sapiens
tccactcccaggca

SEQ ID NO: 3525557 - DNA, 12 bp, Homo sapiens
tccactctcccc

SEQ ID NO: 3525558 - DNA, 22 bp, Homo sapiens
tccactctcccccaccccctcc

SEQ ID NO: 3525559 - DNA, 19 bp, Homo sapiens
tccactctgcttctctgac

SEQ ID NO: 3525560 - DNA, 14 bp, Homo sapiens
tccacttgtttgca

SEQ ID NO: 3525561 - DNA, 23 bp, Homo sapiens
tccactttgtttcgtggggaggt

SEQ ID NO: 3525562 - DNA, 14 bp, Homo sapiens
tccagaaggagaca

SEQ ID NO: 3525563 - DNA, 22 bp, Homo sapiens
tccagaagtttgagatcagcct

SEQ ID NO: 3525564 - DNA, 17 bp, Homo sapiens
tccagaatgctgtacat

SEQ ID NO: 3525565 - DNA, 21 bp, Homo sapiens
tccagaatgctgtacatctat

SEQ ID NO: 3525566 - DNA, 19 bp, Homo sapiens
tccagacattctcgcttcc

SEQ ID NO: 3525567 - DNA, 15 bp, Homo sapiens
tccagacccggctgc

SEQ ID NO: 3525568 - DNA, 18 bp, Homo sapiens
tccagacccggctgcgtg

SEQ ID NO: 3525569 - DNA, 19 bp, Homo sapiens
tccagacctgatcctggag

SEQ ID NO: 3525570 - DNA, 14 bp, Homo sapiens
tccagacttccttg

SEQ ID NO: 3525571 - DNA, 16 bp, Homo sapiens
tccagagattcatttt

SEQ ID NO: 3525572 - DNA, 18 bp, Homo sapiens
tccagagattcattttct

SEQ ID NO: 3525573 - DNA, 19 bp, Homo sapiens
tccagagattcattttcta

SEQ ID NO: 3525574 - DNA, 21 bp, Homo sapiens
tccagagattcattttctaga

SEQ ID NO: 3525575 - DNA, 17 bp, Homo sapiens
tccagagggcactctgc

SEQ ID NO: 3525576 - DNA, 13 bp, Homo sapiens
tccagatcccagg

SEQ ID NO: 3525577 - DNA, 17 bp, Homo sapiens
tccagcagaagacaaaa

SEQ ID NO: 3525578 - DNA, 14 bp, Homo sapiens
tccagcagtcactt

SEQ ID NO: 3525579 - DNA, 19 bp, Homo sapiens
tccagcagtctctgccttg

SEQ ID NO: 3525580 - DNA, 17 bp, Homo sapiens
tccagcattgctggact

SEQ ID NO: 3525581 - DNA, 20 bp, Homo sapiens
tccagccactggctgctaac

SEQ ID NO: 3525582 - DNA, 13 bp, Homo sapiens
tccagccagctcc

SEQ ID NO: 3525583 - DNA, 16 bp, Homo sapiens
tccagccagctcctgg

SEQ ID NO: 3525584 - DNA, 22 bp, Homo sapiens
tccagccagctcctgggcagct

SEQ ID NO: 3525585 - DNA, 15 bp, Homo sapiens
tccagccagggctgc

SEQ ID NO: 3525586 - DNA, 17 bp, Homo sapiens
tccagccagggctgcta

SEQ ID NO: 3525587 - DNA, 17 bp, Homo sapiens
tccagccccttctcaga

SEQ ID NO: 3525588 - DNA, 14 bp, Homo sapiens
tccagcctggagat

SEQ ID NO: 3525589 - DNA, 23 bp, Homo sapiens
tccccagagaaaggggagcccac

SEQ ID NO: 3525590 - DNA, 17 bp, Homo sapiens
tccccagagttccccat

SEQ ID NO: 3525591 - DNA, 18 bp, Homo sapiens
tccccagagttccccatg

SEQ ID NO: 3525592 - DNA, 20 bp, Homo sapiens
tccccagagttccccatgca

SEQ ID NO: 3525593 - DNA, 18 bp, Homo sapiens
tccccagattgcaacagg

SEQ ID NO: 3525594 - DNA, 22 bp, Homo sapiens
tccccagattgcaacaggctgg

SEQ ID NO: 3525595 - DNA, 23 bp, Homo sapiens
tccccagattgcaacaggctggg

SEQ ID NO: 3525596 - DNA, 22 bp, Homo sapiens
tccccagcaagtgagagctggg

SEQ ID NO: 3525597 - DNA, 20 bp, Homo sapiens
tccccagcattccagcccct

SEQ ID NO: 3525598 - DNA, 12 bp, Homo sapiens
tccccagcccag

SEQ ID NO: 3525599 - DNA, 17 bp, Homo sapiens
tccccagcccagagaca

SEQ ID NO: 3525600 - DNA, 23 bp, Homo sapiens
tccccagcctttgatcaggtggg

SEQ ID NO: 3525601 - DNA, 11 bp, Homo sapiens
tccccagctcc

SEQ ID NO: 3525602 - DNA, 22 bp, Homo sapiens
tccccagctccatactctgtcc

SEQ ID NO: 3525603 - DNA, 17 bp, Homo sapiens
tccccagctccccagga

SEQ ID NO: 3525604 - DNA, 23 bp, Homo sapiens
tccccaggactcaccctcatacc

SEQ ID NO: 3525605 - DNA, 17 bp, Homo sapiens
tccccaggtctctccac

SEQ ID NO: 3525606 - DNA, 15 bp, Homo sapiens
tccccagtaaaattg

SEQ ID NO: 3525607 - DNA, 18 bp, Homo sapiens
tccccatcatctgtggaa

SEQ ID NO: 3525608 - DNA, 14 bp, Homo sapiens
tccccatcttctaa

SEQ ID NO: 3525609 - DNA, 19 bp, Homo sapiens
tccccatcttctaaaccca

SEQ ID NO: 3525610 - DNA, 24 bp, Homo sapiens
tccccattagctttcaattccgta

SEQ ID NO: 3525611 - DNA, 16 bp, Homo sapiens
tccccattcagacact

SEQ ID NO: 3525612 - DNA, 22 bp, Homo sapiens
tcccccaagcatgggggacccc

SEQ ID NO: 3525613 - DNA, 18 bp, Homo sapiens
tcccccagcagaaccagc

SEQ ID NO: 3525614 - DNA, 22 bp, Homo sapiens
tcccccagcagaaccagcctca

SEQ ID NO: 3525615 - DNA, 14 bp, Homo sapiens
tcccccaggcctga

SEQ ID NO: 3525616 - DNA, 21 bp, Homo sapiens
tcccccaggcctgagctgctt

SEQ ID NO: 3525617 - DNA, 19 bp, Homo sapiens
tcccccatcccccactgcc

SEQ ID NO: 3525618 - DNA, 15 bp, Homo sapiens
tccccccatcttgct

SEQ ID NO: 3525619 - DNA, 13 bp, Homo sapiens
tcccccccatgca

SEQ ID NO: 3525620 - DNA, 15 bp, Homo sapiens
tcccccctcctctga

SEQ ID NO: 3525621 - DNA, 14 bp, Homo sapiens
tcccccttcacaaa

SEQ ID NO: 3525622 - DNA, 15 bp, Homo sapiens
tcccccttcacaaag

SEQ ID NO: 3525623 - DNA, 22 bp, Homo sapiens
tcccccttcacaaagcccaagg

SEQ ID NO: 3525624 - DNA, 18 bp, Homo sapiens
tccccgaagagtcagccc

SEQ ID NO: 3525625 - DNA, 20 bp, Homo sapiens
tccccgaagagtcagccccg

SEQ ID NO: 3525626 - DNA, 20 bp, Homo sapiens
tccccgcagtgtgcactaag

SEQ ID NO: 3525627 - DNA, 15 bp, Homo sapiens
tccccggagggctgc

SEQ ID NO: 3525628 - DNA, 14 bp, Homo sapiens
tcccctaacctcat

SEQ ID NO: 3525629 - DNA, 12 bp, Homo sapiens
tcccctccaacc

SEQ ID NO: 3525630 - DNA, 13 bp, Homo sapiens
tcccctcccagag

SEQ ID NO: 3525631 - DNA, 20 bp, Homo sapiens
tcccctccggactggtgccc

SEQ ID NO: 3525632 - DNA, 21 bp, Homo sapiens
tcccctccggactggtgccct

SEQ ID NO: 3525633 - DNA, 14 bp, Homo sapiens
tcccctctctgcac

SEQ ID NO: 3525634 - DNA, 21 bp, Homo sapiens
tcccctctgaaagttgtacat

SEQ ID NO: 3525635 - DNA, 22 bp, Homo sapiens
tcccctctgaaagttgtacatg

SEQ ID NO: 3525636 - DNA, 14 bp, Homo sapiens
tcccctgccaccag

SEQ ID NO: 3525637 - DNA, 16 bp, Homo sapiens
tcccctgccaccaggc

SEQ ID NO: 3525638 - DNA, 20 bp, Homo sapiens
tcccctgccagggcagggcc

SEQ ID NO: 3525639 - DNA, 15 bp, Homo sapiens
tcccctgcccccagg

SEQ ID NO: 3525640 - DNA, 18 bp, Homo sapiens
tcccctgcccccaggact

SEQ ID NO: 3525641 - DNA, 19 bp, Homo sapiens
tcccctgccccttccttta

SEQ ID NO: 3525642 - DNA, 14 bp, Homo sapiens
tcccctggggaccc

SEQ ID NO: 3525643 - DNA, 22 bp, Homo sapiens
tcccctgtagagtgggagctga

SEQ ID NO: 3525644 - DNA, 12 bp, Homo sapiens
tcccctgtgtca

SEQ ID NO: 3525645 - DNA, 18 bp, Homo sapiens
tccccttacccttagaat

SEQ ID NO: 3525646 - DNA, 15 bp, Homo sapiens
tccccttctctcatc

SEQ ID NO: 3525647 - DNA, 23 bp, Homo sapiens
tccccttgatttaaacacacaga

SEQ ID NO: 3525648 - DNA, 12 bp, Homo sapiens
tcccctttcctg

SEQ ID NO: 3525649 - DNA, 17 bp, Homo sapiens
tccccttttattgctgc

SEQ ID NO: 3525650 - DNA, 18 bp, Homo sapiens
tcccgaggcttgctgccc

SEQ ID NO: 3525651 - DNA, 16 bp, Homo sapiens
tcccgagtagctggga

SEQ ID NO: 3525652 - DNA, 17 bp, Homo sapiens
tcccgagtagctgggac

SEQ ID NO: 3525653 - DNA, 15 bp, Homo sapiens
tcccggctctgtggg

SEQ ID NO: 3525654 - DNA, 21 bp, Homo sapiens
tcccgggccagggctgcccct

SEQ ID NO: 3525655 - DNA, 15 bp, Homo sapiens
tccctaacacttacc

SEQ ID NO: 3525656 - DNA, 23 bp, Homo sapiens
tccctaatctatggtcgggagac

SEQ ID NO: 3525657 - DNA, 19 bp, Homo sapiens
tccctagaaacttccaaat

SEQ ID NO: 3525658 - DNA, 20 bp, Homo sapiens
tccctagactttaggctttc

SEQ ID NO: 3525659 - DNA, 22 bp, Homo sapiens
tccctagactttaggctttcag

SEQ ID NO: 3525660 - DNA, 17 bp, Homo sapiens
tccctatactgcttgga

SEQ ID NO: 3525661 - DNA, 18 bp, Homo sapiens
tccctattagagaagaga

SEQ ID NO: 3525662 - DNA, 18 bp, Homo sapiens
tccctatttttctctcct

SEQ ID NO: 3525663 - DNA, 22 bp, Homo sapiens
tccctatttttctctcctgtcc

SEQ ID NO: 3525664 - DNA, 23 bp, Homo sapiens
tccctcatttcaggagcagcctc

SEQ ID NO: 3525665 - DNA, 21 bp, Homo sapiens
tccctcccccccatgcactgt

SEQ ID NO: 3525666 - DNA, 22 bp, Homo sapiens
tccctcgctgcacaaatactcc

SEQ ID NO: 3525667 - DNA, 16 bp, Homo sapiens
tccctctaatttatct

SEQ ID NO: 3525668 - DNA, 21 bp, Homo sapiens
tccctctacagagcttccctg

SEQ ID NO: 3525669 - DNA, 19 bp, Homo sapiens
tccctctatttatgtttgc

SEQ ID NO: 3525670 - DNA, 14 bp, Homo sapiens
tccctctcatctca

SEQ ID NO: 3525671 - DNA, 13 bp, Homo sapiens
tccctctgcccca

SEQ ID NO: 3525672 - DNA, 15 bp, Homo sapiens
tccctctgggggctc

SEQ ID NO: 3525673 - DNA, 22 bp, Homo sapiens
tccctgaccctgtatatagccc

SEQ ID NO: 3525674 - DNA, 16 bp, Homo sapiens
tccctgacctccctct

SEQ ID NO: 3525675 - DNA, 19 bp, Homo sapiens
tccctgagaaacccaccag

SEQ ID NO: 3525676 - DNA, 14 bp, Homo sapiens
tccctgaggatggg

SEQ ID NO: 3525677 - DNA, 15 bp, Homo sapiens
tccctgaggatgggt

SEQ ID NO: 3525678 - DNA, 18 bp, Homo sapiens
tccctgcatctgaccagc

SEQ ID NO: 3525679 - DNA, 20 bp, Homo sapiens
tccctggggaaaacttgcag

SEQ ID NO: 3525680 - DNA, 19 bp, Homo sapiens
tccctgtaacctcttcaga

SEQ ID NO: 3525681 - DNA, 23 bp, Homo sapiens
tccctgtctttactcctcacact

SEQ ID NO: 3525682 - DNA, 20 bp, Homo sapiens
tccctgtctttcctaagacc

SEQ ID NO: 3525683 - DNA, 23 bp, Homo sapiens
tccctgtctttcctaagacctgg

SEQ ID NO: 3525684 - DNA, 16 bp, Homo sapiens
tccctgtgtctttttc

SEQ ID NO: 3525685 - DNA, 15 bp, Homo sapiens
tccctgttccccaga

SEQ ID NO: 3525686 - DNA, 17 bp, Homo sapiens
tccctgttccccagaga

SEQ ID NO: 3525687 - DNA, 15 bp, Homo sapiens
tcccttaaacaaaaa

SEQ ID NO: 3525688 - DNA, 22 bp, Homo sapiens
tcccttaaacaaaaattaaaat

SEQ ID NO: 3525689 - DNA, 22 bp, Homo sapiens
tcccttcccatgacccaggctg

SEQ ID NO: 3525690 - DNA, 15 bp, Homo sapiens
tcccttcggccaaac

SEQ ID NO: 3525691 - DNA, 20 bp, Homo sapiens
tcccttgactttgctcctca

SEQ ID NO: 3525692 - DNA, 22 bp, Homo sapiens
tcccttgcctttcgaggcctga

SEQ ID NO: 3525693 - DNA, 22 bp, Homo sapiens
tccctttccaaatgcccagctt

SEQ ID NO: 3525694 - DNA, 17 bp, Homo sapiens
tcccttttacatactgc

SEQ ID NO: 3525695 - DNA, 19 bp, Homo sapiens
tcccttttacatactgctg

SEQ ID NO: 3525696 - DNA, 16 bp, Homo sapiens
tccctttttgaagtgt

SEQ ID NO: 3525697 - DNA, 19 bp, Homo sapiens
tccgactctttctgagtgc

SEQ ID NO: 3525698 - DNA, 12 bp, Homo sapiens
tccgactgcttt

SEQ ID NO: 3525699 - DNA, 19 bp, Homo sapiens
tccgcctggccggctccag

SEQ ID NO: 3525700 - DNA, 21 bp, Homo sapiens
tccgcctggccggctccagtt

SEQ ID NO: 3525701 - DNA, 15 bp, Homo sapiens
tccgctatccaccaa

SEQ ID NO: 3525702 - DNA, 18 bp, Homo sapiens
tccgctttctacccagcg

SEQ ID NO: 3525703 - DNA, 20 bp, Homo sapiens
tccgctttctacccagcgag

SEQ ID NO: 3525704 - DNA, 14 bp, Homo sapiens
tccggactggtgcc

SEQ ID NO: 3525705 - DNA, 16 bp, Homo sapiens
tccggactggtgccct

SEQ ID NO: 3525706 - DNA, 21 bp, Homo sapiens
tccggaggatattaaaatgct

SEQ ID NO: 3525707 - DNA, 15 bp, Homo sapiens
tccggctcccagcct

SEQ ID NO: 3525708 - DNA, 16 bp, Homo sapiens
tccggctgtgctggga

SEQ ID NO: 3525709 - DNA, 12 bp, Homo sapiens
tccgggcagaaa

SEQ ID NO: 3525710 - DNA, 13 bp, Homo sapiens
tccgtgctgacag

SEQ ID NO: 3525711 - DNA, 24 bp, Homo sapiens
tccgtgcttgtttgctcacctggg

SEQ ID NO: 3525712 - DNA, 22 bp, Homo sapiens
tccgtgttgcaggttcatggat

SEQ ID NO: 3525713 - DNA, 15 bp, Homo sapiens
tccgttagctcctgt

SEQ ID NO: 3525714 - DNA, 19 bp, Homo sapiens
tccgtttgaccaatttgca

SEQ ID NO: 3525715 - DNA, 14 bp, Homo sapiens
tcctaaatattatg

SEQ ID NO: 3525716 - DNA, 21 bp, Homo sapiens
tcctaaatattatgagatgct

SEQ ID NO: 3525717 - DNA, 15 bp, Homo sapiens
tcctaagacctgggg

SEQ ID NO: 3525718 - DNA, 16 bp, Homo sapiens
tcctaagacctggggt

SEQ ID NO: 3525719 - DNA, 18 bp, Homo sapiens
tcctaagacctggggttg

SEQ ID NO: 3525720 - DNA, 19 bp, Homo sapiens
tctgacccagtgcccccac

SEQ ID NO: 3525721 - DNA, 13 bp, Homo sapiens
tctgactcagggc

SEQ ID NO: 3525722 - DNA, 15 bp, Homo sapiens
tctgactcagggctc

SEQ ID NO: 3525723 - DNA, 20 bp, Homo sapiens
tctgactcagggctcctggg

SEQ ID NO: 3525724 - DNA, 14 bp, Homo sapiens
tctgactccactca

SEQ ID NO: 3525725 - DNA, 17 bp, Homo sapiens
tctgacttctgcctgga

SEQ ID NO: 3525726 - DNA, 14 bp, Homo sapiens
tctgacttggggac

SEQ ID NO: 3525727 - DNA, 13 bp, Homo sapiens
tctgagaactcat

SEQ ID NO: 3525728 - DNA, 22 bp, Homo sapiens
tctgagaatctttattgagaaa

SEQ ID NO: 3525729 - DNA, 22 bp, Homo sapiens
tctgagaccaaaattttgtccc

SEQ ID NO: 3525730 - DNA, 18 bp, Homo sapiens
tctgagaggacttttctt

SEQ ID NO: 3525731 - DNA, 12 bp, Homo sapiens
tctgagcacaga

SEQ ID NO: 3525732 - DNA, 19 bp, Homo sapiens
tctgagcagtgaatgattc

SEQ ID NO: 3525733 - DNA, 17 bp, Homo sapiens
tctgagccacagtggga

SEQ ID NO: 3525734 - DNA, 9 bp, Homo sapiens
tctgagcta

SEQ ID NO: 3525735 - DNA, 17 bp, Homo sapiens
tctgaggaatccagacc

SEQ ID NO: 3525736 - DNA, 21 bp, Homo sapiens
tctgaggaatccagacccggc

SEQ ID NO: 3525737 - DNA, 18 bp, Homo sapiens
tctgaggcatcctctgac

SEQ ID NO: 3525738 - DNA, 18 bp, Homo sapiens
tctgagtctatgttcaaa

SEQ ID NO: 3525739 - DNA, 22 bp, Homo sapiens
tctgagtctatgttcaaagact

SEQ ID NO: 3525740 - DNA, 13 bp, Homo sapiens
tctgagtgaacct

SEQ ID NO: 3525741 - DNA, 23 bp, Homo sapiens
tctgagtgttttatgagaaagcc

SEQ ID NO: 3525742 - DNA, 20 bp, Homo sapiens
tctgataatatattttcaag

SEQ ID NO: 3525743 - DNA, 17 bp, Homo sapiens
tctgatcatccactgtg

SEQ ID NO: 3525744 - DNA, 22 bp, Homo sapiens
tctgatccctctgggggctctg

SEQ ID NO: 3525745 - DNA, 18 bp, Homo sapiens
tctgattcccaagctctg

SEQ ID NO: 3525746 - DNA, 23 bp, Homo sapiens
tctgattcccaagctctgctcct

SEQ ID NO: 3525747 - DNA, 15 bp, Homo sapiens
tctgattttgcttct

SEQ ID NO: 3525748 - DNA, 14 bp, Homo sapiens
tctgcaaaaatatt

SEQ ID NO: 3525749 - DNA, 20 bp, Homo sapiens
tctgcaaaatgaggaatgta

SEQ ID NO: 3525750 - DNA, 21 bp, Homo sapiens
tctgcaaaatgaggaatgtat

SEQ ID NO: 3525751 - DNA, 24 bp, Homo sapiens
tctgcaaacaccaacatgttggga

SEQ ID NO: 3525752 - DNA, 14 bp, Homo sapiens
tctgcaactgctca

SEQ ID NO: 3525753 - DNA, 17 bp, Homo sapiens
tctgcaactgctcagct

SEQ ID NO: 3525754 - DNA, 22 bp, Homo sapiens
tctgcaactgctcagctctggt

SEQ ID NO: 3525755 - DNA, 15 bp, Homo sapiens
tctgcaagtgctcag

SEQ ID NO: 3525756 - DNA, 21 bp, Homo sapiens
tctgcaagtgctcagggaaat

SEQ ID NO: 3525757 - DNA, 14 bp, Homo sapiens
tctgcacaagctgc

SEQ ID NO: 3525758 - DNA, 13 bp, Homo sapiens
tctgcacagcttt

SEQ ID NO: 3525759 - DNA, 17 bp, Homo sapiens
tctgcacagcttttcca

SEQ ID NO: 3525760 - DNA, 19 bp, Homo sapiens
tctgcacagcttttccaaa

SEQ ID NO: 3525761 - DNA, 18 bp, Homo sapiens
tctgcaccgtactgtgga

SEQ ID NO: 3525762 - DNA, 15 bp, Homo sapiens
tctgcaccttgccag

SEQ ID NO: 3525763 - DNA, 18 bp, Homo sapiens
tctgcaccttgccaggga

SEQ ID NO: 3525764 - DNA, 13 bp, Homo sapiens
tctgcagaaggaa

SEQ ID NO: 3525765 - DNA, 21 bp, Homo sapiens
tctgcagaaggaaaaatgtgt

SEQ ID NO: 3525766 - DNA, 18 bp, Homo sapiens
tctgcagacttcccagct

SEQ ID NO: 3525767 - DNA, 15 bp, Homo sapiens
tctgcagccctgaga

SEQ ID NO: 3525768 - DNA, 15 bp, Homo sapiens
tctgcaggcagacac

SEQ ID NO: 3525769 - DNA, 15 bp, Homo sapiens
tctgcaggtgagcag

SEQ ID NO: 3525770 - DNA, 21 bp, Homo sapiens
tctgcaggtgagcagacagga

SEQ ID NO: 3525771 - DNA, 15 bp, Homo sapiens
tctgcagtaaatctt

SEQ ID NO: 3525772 - DNA, 16 bp, Homo sapiens
tctgcagtgtgccccc

SEQ ID NO: 3525773 - DNA, 21 bp, Homo sapiens
tctgcatccagagattcattt

SEQ ID NO: 3525774 - DNA, 23 bp, Homo sapiens
tctgcatccagagattcattttc

SEQ ID NO: 3525775 - DNA, 16 bp, Homo sapiens
tctgcatttagctgta

SEQ ID NO: 3525776 - DNA, 15 bp, Homo sapiens
tctgcatttcggtgg

SEQ ID NO: 3525777 - DNA, 18 bp, Homo sapiens
tctgcatttttctgcaga

SEQ ID NO: 3525778 - DNA, 13 bp, Homo sapiens
tctgccaccccta

SEQ ID NO: 3525779 - DNA, 14 bp, Homo sapiens
tctgccaggccccc

SEQ ID NO: 3525780 - DNA, 15 bp, Homo sapiens
tctgccccagcccag

SEQ ID NO: 3525781 - DNA, 15 bp, Homo sapiens
tctgccctgtgtact

SEQ ID NO: 3525782 - DNA, 15 bp, Homo sapiens
tctgccgctacctcc

SEQ ID NO: 3525783 - DNA, 18 bp, Homo sapiens
tctgccgctacctccctc

SEQ ID NO: 3525784 - DNA, 19 bp, Homo sapiens
tctgccgctacctccctcc

SEQ ID NO: 3525785 - DNA, 15 bp, Homo sapiens
tctgccggccctggg

SEQ ID NO: 3525786 - DNA, 13 bp, Homo sapiens
tctgcctccagcc

SEQ ID NO: 3525787 - DNA, 14 bp, Homo sapiens
tctgcctccagcca

SEQ ID NO: 3525788 - DNA, 15 bp, Homo sapiens
tctgcctccagccaa

SEQ ID NO: 3525789 - DNA, 13 bp, Homo sapiens
tctgcctccttta

SEQ ID NO: 3525790 - DNA, 13 bp, Homo sapiens
tctgcctctccag

SEQ ID NO: 3525791 - DNA, 18 bp, Homo sapiens
tctgcctctccaggcatt

SEQ ID NO: 3525792 - DNA, 22 bp, Homo sapiens
tctgcctctgacacacagctct

SEQ ID NO: 3525793 - DNA, 23 bp, Homo sapiens
tctgcctctgacacacagctctg

SEQ ID NO: 3525794 - DNA, 17 bp, Homo sapiens
tctgcctgacaaggcca

SEQ ID NO: 3525795 - DNA, 18 bp, Homo sapiens
tctgcctgacaaggccag

SEQ ID NO: 3525796 - DNA, 18 bp, Homo sapiens
tctgcctgccagctgcac

SEQ ID NO: 3525797 - DNA, 21 bp, Homo sapiens
tctgcctgccagctgcactga

SEQ ID NO: 3525798 - DNA, 15 bp, Homo sapiens
tctgcctgcccaggc

SEQ ID NO: 3525799 - DNA, 18 bp, Homo sapiens
tctgcctgcccaggcccc

SEQ ID NO: 3525800 - DNA, 20 bp, Homo sapiens
tctgcctgcccaggcccctg

SEQ ID NO: 3525801 - DNA, 21 bp, Homo sapiens
tctgcctgcccaggcccctgc

SEQ ID NO: 3525802 - DNA, 21 bp, Homo sapiens
tctgccttcgaggtcagagga

SEQ ID NO: 3525803 - DNA, 12 bp, Homo sapiens
tctgccttgcct

SEQ ID NO: 3525804 - DNA, 20 bp, Homo sapiens
tctgcctttattgtgtttgt

SEQ ID NO: 3525805 - DNA, 19 bp, Homo sapiens
tctgcgtgtcacctgtgct

SEQ ID NO: 3525806 - DNA, 17 bp, Homo sapiens
tctgctcacatatctgt

SEQ ID NO: 3525807 - DNA, 19 bp, Homo sapiens
tctgctcacatatctgtca

SEQ ID NO: 3525808 - DNA, 15 bp, Homo sapiens
tctgctcagcttctc

SEQ ID NO: 3525809 - DNA, 18 bp, Homo sapiens
tctgctcagcttctcctg

SEQ ID NO: 3525810 - DNA, 19 bp, Homo sapiens
tctgctctccttcctggag

SEQ ID NO: 3525811 - DNA, 16 bp, Homo sapiens
tctgctctgcgtgtca

SEQ ID NO: 3525812 - DNA, 16 bp, Homo sapiens
tctgctgaagacttgc

SEQ ID NO: 3525813 - DNA, 17 bp, Homo sapiens
tctgctgacagacacag

SEQ ID NO: 3525814 - DNA, 21 bp, Homo sapiens
tctgctgacagacacaggccc

SEQ ID NO: 3525815 - DNA, 20 bp, Homo sapiens
tctgctgccccgcttcccca

SEQ ID NO: 3525816 - DNA, 21 bp, Homo sapiens
tctgctgccccgcttccccac

SEQ ID NO: 3525817 - DNA, 22 bp, Homo sapiens
tctgctgccccgcttccccaca

SEQ ID NO: 3525818 - DNA, 13 bp, Homo sapiens
tctgctggagttt

SEQ ID NO: 3525819 - DNA, 23 bp, Homo sapiens
tctgctggagtttcatgtacaag

SEQ ID NO: 3525820 - DNA, 15 bp, Homo sapiens
tctgcttcagcctcc

SEQ ID NO: 3525821 - DNA, 12 bp, Homo sapiens
tctgcttcccag

SEQ ID NO: 3525822 - DNA, 14 bp, Homo sapiens
tctgcttcccaggt

SEQ ID NO: 3525823 - DNA, 22 bp, Homo sapiens
tctgcttctctgacttctgcct

SEQ ID NO: 3525824 - DNA, 16 bp, Homo sapiens
tctggaacccagactc

SEQ ID NO: 3525825 - DNA, 23 bp, Homo sapiens
tctggaacccagactcagacatt

SEQ ID NO: 3525826 - DNA, 16 bp, Homo sapiens
tctggaacctcagcct

SEQ ID NO: 3525827 - DNA, 18 bp, Homo sapiens
tctggaacctcagcctgg

SEQ ID NO: 3525828 - DNA, 23 bp, Homo sapiens
tctggaacctcagcctggccaga

SEQ ID NO: 3525829 - DNA, 13 bp, Homo sapiens
tctggaagaaaaa

SEQ ID NO: 3525830 - DNA, 15 bp, Homo sapiens
tctggaatctgaggc

SEQ ID NO: 3525831 - DNA, 21 bp, Homo sapiens
tctggagaccagggagccttt

SEQ ID NO: 3525832 - DNA, 24 bp, Homo sapiens
tctggagatggaagcttgttgaaa

SEQ ID NO: 3525833 - DNA, 18 bp, Homo sapiens
tctggaggaaagggagga

SEQ ID NO: 3525834 - DNA, 19 bp, Homo sapiens
tctggaggaaagggaggag

SEQ ID NO: 3525835 - DNA, 15 bp, Homo sapiens
tctggagtggccact

SEQ ID NO: 3525836 - DNA, 21 bp, Homo sapiens
tctggatggtgtgccttccag

SEQ ID NO: 3525837 - DNA, 22 bp, Homo sapiens
tctggatggtgtgccttccaga

SEQ ID NO: 3525838 - DNA, 13 bp, Homo sapiens
tctggattcccag

SEQ ID NO: 3525839 - DNA, 14 bp, Homo sapiens
tctggattcccagg

SEQ ID NO: 3525840 - DNA, 21 bp, Homo sapiens
tctggattctgaatctcaaga

SEQ ID NO: 3525841 - DNA, 21 bp, Homo sapiens
tctggcaaagcttttagaaat

SEQ ID NO: 3525842 - DNA, 21 bp, Homo sapiens
tctggcagcctcccatccagg

SEQ ID NO: 3525843 - DNA, 21 bp, Homo sapiens
tctggccaagggccagacaga

SEQ ID NO: 3525844 - DNA, 16 bp, Homo sapiens
tctggccaggaagctt

SEQ ID NO: 3525845 - DNA, 17 bp, Homo sapiens
tctggccaggaagcttt

SEQ ID NO: 3525846 - DNA, 14 bp, Homo sapiens
tctggccctagact

SEQ ID NO: 3525847 - DNA, 17 bp, Homo sapiens
tctggctgtgacagcct

SEQ ID NO: 3525848 - DNA, 23 bp, Homo sapiens
tctggctgtgacagcctctgcag

SEQ ID NO: 3525849 - DNA, 14 bp, Homo sapiens
tctgggactccagg

SEQ ID NO: 3525850 - DNA, 13 bp, Homo sapiens
tctgggagggcag

SEQ ID NO: 3525851 - DNA, 17 bp, Homo sapiens
tctgggagtcacacagt

SEQ ID NO: 3525852 - DNA, 15 bp, Homo sapiens
tgaatgctgggactc

SEQ ID NO: 3525853 - DNA, 19 bp, Homo sapiens
tgaatgctgggactcagcc

SEQ ID NO: 3525854 - DNA, 13 bp, Homo sapiens
tgaatgggatcat

SEQ ID NO: 3525855 - DNA, 18 bp, Homo sapiens
tgaatgggatcatgaaag

SEQ ID NO: 3525856 - DNA, 22 bp, Homo sapiens
tgaatgggcaattccagaaatc

SEQ ID NO: 3525857 - DNA, 14 bp, Homo sapiens
tgaatgtaaccaat

SEQ ID NO: 3525858 - DNA, 11 bp, Homo sapiens
tgaatgtattt

SEQ ID NO: 3525859 - DNA, 15 bp, Homo sapiens
tgaatgtatttattt

SEQ ID NO: 3525860 - DNA, 17 bp, Homo sapiens
tgaatgtatttatttgg

SEQ ID NO: 3525861 - DNA, 22 bp, Homo sapiens
tgaatgtcttttttcaaacttt

SEQ ID NO: 3525862 - DNA, 21 bp, Homo sapiens
tgaatgttaaataaattgtat

SEQ ID NO: 3525863 - DNA, 15 bp, Homo sapiens
tgaattatctataca

SEQ ID NO: 3525864 - DNA, 18 bp, Homo sapiens
tgaattcctagaattaaa

SEQ ID NO: 3525865 - DNA, 20 bp, Homo sapiens
tgaattgaggggattaatat

SEQ ID NO: 3525866 - DNA, 14 bp, Homo sapiens
tgaatttgcaaagt

SEQ ID NO: 3525867 - DNA, 21 bp, Homo sapiens
tgaatttgcaaagtactgtaa

SEQ ID NO: 3525868 - DNA, 16 bp, Homo sapiens
tgaattttcaaggcct

SEQ ID NO: 3525869 - DNA, 13 bp, Homo sapiens
tgaattttgggga

SEQ ID NO: 3525870 - DNA, 23 bp, Homo sapiens
tgaatttttttcatcttctctgg

SEQ ID NO: 3525871 - DNA, 19 bp, Homo sapiens
tgaatttttttctgcacag

SEQ ID NO: 3525872 - DNA, 21 bp, Homo sapiens
tgaattttttttaatgcttaa

SEQ ID NO: 3525873 - DNA, 18 bp, Homo sapiens
tgacaaaaaatgttttaa

SEQ ID NO: 3525874 - DNA, 21 bp, Homo sapiens
tgacaaaaaatgttttaaaga

SEQ ID NO: 3525875 - DNA, 13 bp, Homo sapiens
tgacaactggcag

SEQ ID NO: 3525876 - DNA, 15 bp, Homo sapiens
tgacaactggcaggc

SEQ ID NO: 3525877 - DNA, 11 bp, Homo sapiens
tgacaaggcca

SEQ ID NO: 3525878 - DNA, 13 bp, Homo sapiens
tgacaaggccagc

SEQ ID NO: 3525879 - DNA, 21 bp, Homo sapiens
tgacaaggccagcacccaaag

SEQ ID NO: 3525880 - DNA, 14 bp, Homo sapiens
tgacaagtgtcttt

SEQ ID NO: 3525881 - DNA, 13 bp, Homo sapiens
tgacaattctgca

SEQ ID NO: 3525882 - DNA, 12 bp, Homo sapiens
tgacacaaacac

SEQ ID NO: 3525883 - DNA, 17 bp, Homo sapiens
tgacacaaacacacaca

SEQ ID NO: 3525884 - DNA, 17 bp, Homo sapiens
tgacacaagtggacctt

SEQ ID NO: 3525885 - DNA, 15 bp, Homo sapiens
tgacacacagctctg

SEQ ID NO: 3525886 - DNA, 18 bp, Homo sapiens
tgacacaggtctttccta

SEQ ID NO: 3525887 - DNA, 18 bp, Homo sapiens
tgacacatcgttttgggg

SEQ ID NO: 3525888 - DNA, 23 bp, Homo sapiens
tgacacctttcataatctttgct

SEQ ID NO: 3525889 - DNA, 21 bp, Homo sapiens
tgacactggtattcctgcctc

SEQ ID NO: 3525890 - DNA, 15 bp, Homo sapiens
tgacactgtttcctg

SEQ ID NO: 3525891 - DNA, 19 bp, Homo sapiens
tgacactgtttcctgataa

SEQ ID NO: 3525892 - DNA, 23 bp, Homo sapiens
tgacactgtttcctgataataaa

SEQ ID NO: 3525893 - DNA, 21 bp, Homo sapiens
tgacagaaagcagttctgatg

SEQ ID NO: 3525894 - DNA, 23 bp, Homo sapiens
tgacagaaagcagttctgatgct

SEQ ID NO: 3525895 - DNA, 18 bp, Homo sapiens
tgacagagacccagatct

SEQ ID NO: 3525896 - DNA, 21 bp, Homo sapiens
tgacagagcaagactctgtct

SEQ ID NO: 3525897 - DNA, 13 bp, Homo sapiens
tgacagaggcagc

SEQ ID NO: 3525898 - DNA, 23 bp, Homo sapiens
tgacagaggcagccccattctgc

SEQ ID NO: 3525899 - DNA, 14 bp, Homo sapiens
tgacagagtgagac

SEQ ID NO: 3525900 - DNA, 17 bp, Homo sapiens
tgacagagtgagactct

SEQ ID NO: 3525901 - DNA, 11 bp, Homo sapiens
tgacagccaga

SEQ ID NO: 3525902 - DNA, 14 bp, Homo sapiens
tgacagccagagcc

SEQ ID NO: 3525903 - DNA, 11 bp, Homo sapiens
tgacagcctcc

SEQ ID NO: 3525904 - DNA, 17 bp, Homo sapiens
tgacagcctcccacccc

SEQ ID NO: 3525905 - DNA, 19 bp, Homo sapiens
tgacagcctcccaccccca

SEQ ID NO: 3525906 - DNA, 12 bp, Homo sapiens
tgacagctgctc

SEQ ID NO: 3525907 - DNA, 15 bp, Homo sapiens
tgacagctgctccta

SEQ ID NO: 3525908 - DNA, 14 bp, Homo sapiens
tgacagctttgctg

SEQ ID NO: 3525909 - DNA, 18 bp, Homo sapiens
tgacagctttgctgctga

SEQ ID NO: 3525910 - DNA, 20 bp, Homo sapiens
tgacagctttgctgctgaag

SEQ ID NO: 3525911 - DNA, 21 bp, Homo sapiens
tgacagctttgctgctgaagg

SEQ ID NO: 3525912 - DNA, 17 bp, Homo sapiens
tgacaggcaatgctggc

SEQ ID NO: 3525913 - DNA, 21 bp, Homo sapiens
tgacagggcacaccgggcact

SEQ ID NO: 3525914 - DNA, 22 bp, Homo sapiens
tgacagtattatacgctggcaa

SEQ ID NO: 3525915 - DNA, 19 bp, Homo sapiens
tgacagtgctctaggctgc

SEQ ID NO: 3525916 - DNA, 22 bp, Homo sapiens
tgacagtgctctaggctgcccc

SEQ ID NO: 3525917 - DNA, 21 bp, Homo sapiens
tgacagtggccgcccaaggcc

SEQ ID NO: 3525918 - DNA, 17 bp, Homo sapiens
tgacagtgtgggacagg

SEQ ID NO: 3525919 - DNA, 19 bp, Homo sapiens
tgacagtgtgggacaggct

SEQ ID NO: 3525920 - DNA, 22 bp, Homo sapiens
tgacagtgtgggacaggctctt

SEQ ID NO: 3525921 - DNA, 17 bp, Homo sapiens
tgacatatttaatgttt

SEQ ID NO: 3525922 - DNA, 23 bp, Homo sapiens
tgacatatttaatgttttaaatg

SEQ ID NO: 3525923 - DNA, 23 bp, Homo sapiens
tgacatgaggaaaataatgtaat

SEQ ID NO: 3525924 - DNA, 17 bp, Homo sapiens
tgacatggaggcactga

SEQ ID NO: 3525925 - DNA, 21 bp, Homo sapiens
tgacatggaggcactgaagcc

SEQ ID NO: 3525926 - DNA, 18 bp, Homo sapiens
tgacattcacctgcccca

SEQ ID NO: 3525927 - DNA, 15 bp, Homo sapiens
tgacattcatgcctg

SEQ ID NO: 3525928 - DNA, 19 bp, Homo sapiens
tgacattgcgtttgacctt

SEQ ID NO: 3525929 - DNA, 21 bp, Homo sapiens
tgacattgttggccaaagcca

SEQ ID NO: 3525930 - DNA, 22 bp, Homo sapiens
tgacatttatttttctcatgaa

SEQ ID NO: 3525931 - DNA, 12 bp, Homo sapiens
tgacatttcttt

SEQ ID NO: 3525932 - DNA, 12 bp, Homo sapiens
tgacattttatt

SEQ ID NO: 3525933 - DNA, 14 bp, Homo sapiens
tgaccaaagtcctt

SEQ ID NO: 3525934 - DNA, 16 bp, Homo sapiens
tgaccaacctgtttct

SEQ ID NO: 3525935 - DNA, 18 bp, Homo sapiens
tgaccaacctgtttctac

SEQ ID NO: 3525936 - DNA, 16 bp, Homo sapiens
tgaccaagcaggaagc

SEQ ID NO: 3525937 - DNA, 18 bp, Homo sapiens
tgaccaagcaggaagctc

SEQ ID NO: 3525938 - DNA, 13 bp, Homo sapiens
tgaccaatgtctt

SEQ ID NO: 3525939 - DNA, 11 bp, Homo sapiens
tgaccagcagc

SEQ ID NO: 3525940 - DNA, 12 bp, Homo sapiens
tgaccaggcctg

SEQ ID NO: 3525941 - DNA, 15 bp, Homo sapiens
tgaccaggcctgggc

SEQ ID NO: 3525942 - DNA, 21 bp, Homo sapiens
tgaccagtttaacctgatgca

SEQ ID NO: 3525943 - DNA, 23 bp, Homo sapiens
tgaccagtttaacctgatgcagt

SEQ ID NO: 3525944 - DNA, 18 bp, Homo sapiens
tgacccagtgcccccact

SEQ ID NO: 3525945 - DNA, 14 bp, Homo sapiens
tgaccctgagctga

SEQ ID NO: 3525946 - DNA, 18 bp, Homo sapiens
tgaccctggggctggctt

SEQ ID NO: 3525947 - DNA, 17 bp, Homo sapiens
tgaccctgtatatagcc

SEQ ID NO: 3525948 - DNA, 19 bp, Homo sapiens
tgaccgcgactaatttcaa

SEQ ID NO: 3525949 - DNA, 15 bp, Homo sapiens
tgacctccacagctt

SEQ ID NO: 3525950 - DNA, 17 bp, Homo sapiens
tgacctccacagcttcc

SEQ ID NO: 3525951 - DNA, 14 bp, Homo sapiens
tgacctgaggaagc

SEQ ID NO: 3525952 - DNA, 12 bp, Homo sapiens
tgacctgcattg

SEQ ID NO: 3525953 - DNA, 16 bp, Homo sapiens
tgacctgcattgtaaa

SEQ ID NO: 3525954 - DNA, 19 bp, Homo sapiens
tgacctttgtacagcccag

SEQ ID NO: 3525955 - DNA, 23 bp, Homo sapiens
tgaccttttatgtagtaattgac

SEQ ID NO: 3525956 - DNA, 22 bp, Homo sapiens
tgacgtgaccggacttttctgc

SEQ ID NO: 3525957 - DNA, 15 bp, Homo sapiens
tgactaaaaaacaaa

SEQ ID NO: 3525958 - DNA, 22 bp, Homo sapiens
tgactaaaaaacaaagaagaca

SEQ ID NO: 3525959 - DNA, 16 bp, Homo sapiens
tgactaatggcatgag

SEQ ID NO: 3525960 - DNA, 18 bp, Homo sapiens
tgactaattttacatgtt

SEQ ID NO: 3525961 - DNA, 16 bp, Homo sapiens
tgactacagtcaggaa

SEQ ID NO: 3525962 - DNA, 19 bp, Homo sapiens
tgactatgtctagagcctc

SEQ ID NO: 3525963 - DNA, 14 bp, Homo sapiens
tgactcagggctcc

SEQ ID NO: 3525964 - DNA, 15 bp, Homo sapiens
tgactcagggctcct

SEQ ID NO: 3525965 - DNA, 18 bp, Homo sapiens
tgactcagggctcctggg

SEQ ID NO: 3525966 - DNA, 18 bp, Homo sapiens
tgactccactcaaagagg

SEQ ID NO: 3525967 - DNA, 15 bp, Homo sapiens
tgactctcacctgta

SEQ ID NO: 3525968 - DNA, 16 bp, Homo sapiens
tgactctcacctgtac

SEQ ID NO: 3525969 - DNA, 22 bp, Homo sapiens
tgactctggcaaagcttttaga

SEQ ID NO: 3525970 - DNA, 13 bp, Homo sapiens
tgactctgggtcc

SEQ ID NO: 3525971 - DNA, 17 bp, Homo sapiens
tgactctgggtccttcc

SEQ ID NO: 3525972 - DNA, 18 bp, Homo sapiens
tgactctgggtccttcct

SEQ ID NO: 3525973 - DNA, 19 bp, Homo sapiens
tgactctgggtccttcctg

SEQ ID NO: 3525974 - DNA, 12 bp, Homo sapiens
tgactcttctct

SEQ ID NO: 3525975 - DNA, 13 bp, Homo sapiens
tgactgaacatta

SEQ ID NO: 3525976 - DNA, 21 bp, Homo sapiens
tgactgcccggcacagatgct

SEQ ID NO: 3525977 - DNA, 20 bp, Homo sapiens
tgactgccttgcctcctcag

SEQ ID NO: 3525978 - DNA, 22 bp, Homo sapiens
tgactgctcagaacttgctgct

SEQ ID NO: 3525979 - DNA, 13 bp, Homo sapiens
tgacttaatgtga

SEQ ID NO: 3525980 - DNA, 18 bp, Homo sapiens
tgacttctgcctggagac

SEQ ID NO: 3525981 - DNA, 16 bp, Homo sapiens
tgacttgactttagtc

SEQ ID NO: 3525982 - DNA, 20 bp, Homo sapiens
tgactttagaaagctgacat

SEQ ID NO: 3525983 - DNA, 19 bp, Homo sapiens
tgactttagtctgcaaaat

SEQ ID NO: 3525984 - DNA, 22 bp, Homo sapiens
tgcatctgaccagcagcgcctt

SEQ ID NO: 3525985 - DNA, 23 bp, Homo sapiens
tgcatctgtataagtaagaaaat

SEQ ID NO: 3525986 - DNA, 18 bp, Homo sapiens
tgcatctttttttcattt

SEQ ID NO: 3525987 - DNA, 14 bp, Homo sapiens
tgcatgatgtttgc

SEQ ID NO: 3525988 - DNA, 14 bp, Homo sapiens
tgcatgccctctca

SEQ ID NO: 3525989 - DNA, 20 bp, Homo sapiens
tgcatggtgccccaggacca

SEQ ID NO: 3525990 - DNA, 13 bp, Homo sapiens
tgcatgtgactct

SEQ ID NO: 3525991 - DNA, 17 bp, Homo sapiens
tgcatgtgactctgaag

SEQ ID NO: 3525992 - DNA, 17 bp, Homo sapiens
tgcattaaattcacaaa

SEQ ID NO: 3525993 - DNA, 19 bp, Homo sapiens
tgcattaaattcacaaact

SEQ ID NO: 3525994 - DNA, 19 bp, Homo sapiens
tgcattaccgcgttgtaaa

SEQ ID NO: 3525995 - DNA, 22 bp, Homo sapiens
tgcattaccgcgttgtaaaata

SEQ ID NO: 3525996 - DNA, 20 bp, Homo sapiens
tgcattcttggttggctggc

SEQ ID NO: 3525997 - DNA, 16 bp, Homo sapiens
tgcattcttttaaaag

SEQ ID NO: 3525998 - DNA, 21 bp, Homo sapiens
tgcattcttttaaaagacaag

SEQ ID NO: 3525999 - DNA, 15 bp, Homo sapiens
tgcattgaacacaaa

SEQ ID NO: 3526000 - DNA, 17 bp, Homo sapiens
tgcattgaacacaaact

SEQ ID NO: 3526001 - DNA, 22 bp, Homo sapiens
tgcattgaccgcgactaatttc

SEQ ID NO: 3526002 - DNA, 15 bp, Homo sapiens
tgcattgagaactgc

SEQ ID NO: 3526003 - DNA, 16 bp, Homo sapiens
tgcattgtgacaagaa

SEQ ID NO: 3526004 - DNA, 22 bp, Homo sapiens
tgcatttatagatcatttctag

SEQ ID NO: 3526005 - DNA, 23 bp, Homo sapiens
tgcatttatagatcatttctagg

SEQ ID NO: 3526006 - DNA, 12 bp, Homo sapiens
tgcatttctgta

SEQ ID NO: 3526007 - DNA, 21 bp, Homo sapiens
tgcatttggaatttttgcttg

SEQ ID NO: 3526008 - DNA, 15 bp, Homo sapiens
tgcatttttctgcag

SEQ ID NO: 3526009 - DNA, 17 bp, Homo sapiens
tgccaaaatgctctagt

SEQ ID NO: 3526010 - DNA, 18 bp, Homo sapiens
tgccaaaatgctctagtg

SEQ ID NO: 3526011 - DNA, 19 bp, Homo sapiens
tgccaaaattcatttctaa

SEQ ID NO: 3526012 - DNA, 20 bp, Homo sapiens
tgccaacactcaagaagcag

SEQ ID NO: 3526013 - DNA, 21 bp, Homo sapiens
tgccaacactcaagaagcagg

SEQ ID NO: 3526014 - DNA, 23 bp, Homo sapiens
tgccaacactcaagaagcaggct

SEQ ID NO: 3526015 - DNA, 17 bp, Homo sapiens
tgccaaggctgatgcag

SEQ ID NO: 3526016 - DNA, 19 bp, Homo sapiens
tgccaatattaaatctgct

SEQ ID NO: 3526017 - DNA, 23 bp, Homo sapiens
tgccaatccttaaatatgtgaaa

SEQ ID NO: 3526018 - DNA, 15 bp, Homo sapiens
tgccacaaggacttc

SEQ ID NO: 3526019 - DNA, 23 bp, Homo sapiens
tgccacaatgcagttctgagcac

SEQ ID NO: 3526020 - DNA, 15 bp, Homo sapiens
tgccacagagcgggg

SEQ ID NO: 3526021 - DNA, 12 bp, Homo sapiens
tgccacaggaca

SEQ ID NO: 3526022 - DNA, 20 bp, Homo sapiens
tgccacaggacacagtcaga

SEQ ID NO: 3526023 - DNA, 22 bp, Homo sapiens
tgccaccaccctgtcttcctct

SEQ ID NO: 3526024 - DNA, 22 bp, Homo sapiens
tgccaccactataaaatgtctt

SEQ ID NO: 3526025 - DNA, 16 bp, Homo sapiens
tgccacccacctccct

SEQ ID NO: 3526026 - DNA, 15 bp, Homo sapiens
tgccacccccagttc

SEQ ID NO: 3526027 - DNA, 22 bp, Homo sapiens
tgccacccccagttcctatgac

SEQ ID NO: 3526028 - DNA, 13 bp, Homo sapiens
tgccacccctaaa

SEQ ID NO: 3526029 - DNA, 19 bp, Homo sapiens
tgccaccctggggagaaag

SEQ ID NO: 3526030 - DNA, 16 bp, Homo sapiens
tgccacgaatttctgt

SEQ ID NO: 3526031 - DNA, 17 bp, Homo sapiens
tgccactccagtcctgc

SEQ ID NO: 3526032 - DNA, 19 bp, Homo sapiens
tgccactccagtcctgcca

SEQ ID NO: 3526033 - DNA, 14 bp, Homo sapiens
tgccactcctccct

SEQ ID NO: 3526034 - DNA, 21 bp, Homo sapiens
tgccactgccttcgcttcttg

SEQ ID NO: 3526035 - DNA, 11 bp, Homo sapiens
tgccagagcag

SEQ ID NO: 3526036 - DNA, 14 bp, Homo sapiens
tgccagatcctctt

SEQ ID NO: 3526037 - DNA, 15 bp, Homo sapiens
tgccagatgctgcag

SEQ ID NO: 3526038 - DNA, 11 bp, Homo sapiens
tgccagccaga

SEQ ID NO: 3526039 - DNA, 22 bp, Homo sapiens
tgccagctctgtatcaggaccc

SEQ ID NO: 3526040 - DNA, 10 bp, Homo sapiens
tgccaggcat

SEQ ID NO: 3526041 - DNA, 16 bp, Homo sapiens
tgccagggaggtggaa

SEQ ID NO: 3526042 - DNA, 11 bp, Homo sapiens
tgccagggcag

SEQ ID NO: 3526043 - DNA, 22 bp, Homo sapiens
tgccaggtttttggtctgaccc

SEQ ID NO: 3526044 - DNA, 17 bp, Homo sapiens
tgccagtcaagaagaaa

SEQ ID NO: 3526045 - DNA, 14 bp, Homo sapiens
tgccataaaacatt

SEQ ID NO: 3526046 - DNA, 16 bp, Homo sapiens
tgccataaaacattaa

SEQ ID NO: 3526047 - DNA, 20 bp, Homo sapiens
tgccataaaacattaagaaa

SEQ ID NO: 3526048 - DNA, 16 bp, Homo sapiens
tgccatagccaggagc

SEQ ID NO: 3526049 - DNA, 16 bp, Homo sapiens
tgccatattgcacatg

SEQ ID NO: 3526050 - DNA, 14 bp, Homo sapiens
tgccatcattgctg

SEQ ID NO: 3526051 - DNA, 22 bp, Homo sapiens
tgccatcattgctgtctgcagc

SEQ ID NO: 3526052 - DNA, 15 bp, Homo sapiens
tgccatccaggttca

SEQ ID NO: 3526053 - DNA, 16 bp, Homo sapiens
tgccatgatgcctctg

SEQ ID NO: 3526054 - DNA, 20 bp, Homo sapiens
tgccatgatgcctctgtctt

SEQ ID NO: 3526055 - DNA, 21 bp, Homo sapiens
tgccatgatgcctctgtcttc

SEQ ID NO: 3526056 - DNA, 18 bp, Homo sapiens
tgccatggaactgtttcc

SEQ ID NO: 3526057 - DNA, 22 bp, Homo sapiens
tgccatggaagaggctacaggg

SEQ ID NO: 3526058 - DNA, 20 bp, Homo sapiens
tgccatgtaaatccccactg

SEQ ID NO: 3526059 - DNA, 22 bp, Homo sapiens
tgccatgtctgcagtgtgcccc

SEQ ID NO: 3526060 - DNA, 16 bp, Homo sapiens
tgccatgtgactctgg

SEQ ID NO: 3526061 - DNA, 21 bp, Homo sapiens
tgccatgtgactctggcttgg

SEQ ID NO: 3526062 - DNA, 18 bp, Homo sapiens
tgccatgttggccaggct

SEQ ID NO: 3526063 - DNA, 20 bp, Homo sapiens
tgccatgttggccaggctgg

SEQ ID NO: 3526064 - DNA, 16 bp, Homo sapiens
tgccattagccaagga

SEQ ID NO: 3526065 - DNA, 21 bp, Homo sapiens
tgccattctcttgcattgtga

SEQ ID NO: 3526066 - DNA, 15 bp, Homo sapiens
tgccattgcactcca

SEQ ID NO: 3526067 - DNA, 20 bp, Homo sapiens
tgcccaacccttccctcacc

SEQ ID NO: 3526068 - DNA, 20 bp, Homo sapiens
tgcccaagccagaggctggg

SEQ ID NO: 3526069 - DNA, 14 bp, Homo sapiens
tgcccacaggatca

SEQ ID NO: 3526070 - DNA, 20 bp, Homo sapiens
tgcccacaggatcagtctga

SEQ ID NO: 3526071 - DNA, 12 bp, Homo sapiens
tgcccacaggcc

SEQ ID NO: 3526072 - DNA, 22 bp, Homo sapiens
tgcccagctatacctgtgcctc

SEQ ID NO: 3526073 - DNA, 15 bp, Homo sapiens
tgcccaggcactgca

SEQ ID NO: 3526074 - DNA, 12 bp, Homo sapiens
tgcccaggcagg

SEQ ID NO: 3526075 - DNA, 13 bp, Homo sapiens
tgcccaggcaggt

SEQ ID NO: 3526076 - DNA, 15 bp, Homo sapiens
tgcccaggcccagac

SEQ ID NO: 3526077 - DNA, 17 bp, Homo sapiens
tgcccaggcccctgcca

SEQ ID NO: 3526078 - DNA, 20 bp, Homo sapiens
tgcccaggcccctgccaccc

SEQ ID NO: 3526079 - DNA, 13 bp, Homo sapiens
tgcccaggctggc

SEQ ID NO: 3526080 - DNA, 19 bp, Homo sapiens
tgcccaggctggcgtgcag

SEQ ID NO: 3526081 - DNA, 13 bp, Homo sapiens
tgcccaggctggt

SEQ ID NO: 3526082 - DNA, 17 bp, Homo sapiens
tgcccaggctggtctca

SEQ ID NO: 3526083 - DNA, 16 bp, Homo sapiens
tgcccaggctggtctt

SEQ ID NO: 3526084 - DNA, 16 bp, Homo sapiens
tgcccagtcgacccca

SEQ ID NO: 3526085 - DNA, 14 bp, Homo sapiens
tgcccagtctttca

SEQ ID NO: 3526086 - DNA, 12 bp, Homo sapiens
tgcccatttcat

SEQ ID NO: 3526087 - DNA, 18 bp, Homo sapiens
tgccccacatgtggccat

SEQ ID NO: 3526088 - DNA, 20 bp, Homo sapiens
tgccccacccctccccatta

SEQ ID NO: 3526089 - DNA, 14 bp, Homo sapiens
tgccccagcccaga

SEQ ID NO: 3526090 - DNA, 13 bp, Homo sapiens
tgccccagccccg

SEQ ID NO: 3526091 - DNA, 14 bp, Homo sapiens
tgccccaggaccag

SEQ ID NO: 3526092 - DNA, 18 bp, Homo sapiens
tgccccatcagtgctccc

SEQ ID NO: 3526093 - DNA, 21 bp, Homo sapiens
tgccccatcagtgctccctca

SEQ ID NO: 3526094 - DNA, 21 bp, Homo sapiens
tgccccatctcccctcagctc

SEQ ID NO: 3526095 - DNA, 15 bp, Homo sapiens
tgcccccaggactgg

SEQ ID NO: 3526096 - DNA, 19 bp, Homo sapiens
tgcccccaggactgggcca

SEQ ID NO: 3526097 - DNA, 17 bp, Homo sapiens
tgccccccacccctgga

SEQ ID NO: 3526098 - DNA, 17 bp, Homo sapiens
tgccccgcttccccaca

SEQ ID NO: 3526099 - DNA, 19 bp, Homo sapiens
tgccccgcttccccacaga

SEQ ID NO: 3526100 - DNA, 21 bp, Homo sapiens
tgccccgcttccccacagaac

SEQ ID NO: 3526101 - DNA, 21 bp, Homo sapiens
tgccccgggtccccagctccc

SEQ ID NO: 3526102 - DNA, 22 bp, Homo sapiens
tgccccgggtccccagctcccc

SEQ ID NO: 3526103 - DNA, 18 bp, Homo sapiens
tgcccctaatctctgtag

SEQ ID NO: 3526104 - DNA, 20 bp, Homo sapiens
tgccccttgacaactggcag

SEQ ID NO: 3526105 - DNA, 16 bp, Homo sapiens
tgcccgagggagggga

SEQ ID NO: 3526106 - DNA, 17 bp, Homo sapiens
tgcccgcagacctctgg

SEQ ID NO: 3526107 - DNA, 12 bp, Homo sapiens
tgcccggctgcg

SEQ ID NO: 3526108 - DNA, 18 bp, Homo sapiens
tgccctagttttctttcc

SEQ ID NO: 3526109 - DNA, 14 bp, Homo sapiens
tgccctcacctccc

SEQ ID NO: 3526110 - DNA, 14 bp, Homo sapiens
tgccctcctcactc

SEQ ID NO: 3526111 - DNA, 16 bp, Homo sapiens
tgccctccttcccaat

SEQ ID NO: 3526112 - DNA, 16 bp, Homo sapiens
tgccctggaggtggct

SEQ ID NO: 3526113 - DNA, 12 bp, Homo sapiens
tgccctggctcc

SEQ ID NO: 3526114 - DNA, 14 bp, Homo sapiens
tgccctggctccag

SEQ ID NO: 3526115 - DNA, 21 bp, Homo sapiens
tgccctggctccagtgaaact

SEQ ID NO: 3526116 - DNA, 15 bp, Homo sapiens
tggagcactgggctc

SEQ ID NO: 3526117 - DNA, 19 bp, Homo sapiens
tggagcccagaggagggca

SEQ ID NO: 3526118 - DNA, 20 bp, Homo sapiens
tggagcccagggagcggaaa

SEQ ID NO: 3526119 - DNA, 17 bp, Homo sapiens
tggagccctccgccttc

SEQ ID NO: 3526120 - DNA, 19 bp, Homo sapiens
tggagccctccgccttcac

SEQ ID NO: 3526121 - DNA, 22 bp, Homo sapiens
tggagctctgtgggtctctgga

SEQ ID NO: 3526122 - DNA, 12 bp, Homo sapiens
tggagctgagca

SEQ ID NO: 3526123 - DNA, 15 bp, Homo sapiens
tggagctgcctgata

SEQ ID NO: 3526124 - DNA, 14 bp, Homo sapiens
tggaggagagagcc

SEQ ID NO: 3526125 - DNA, 16 bp, Homo sapiens
tggaggagagagcctt

SEQ ID NO: 3526126 - DNA, 18 bp, Homo sapiens
tggaggagagagccttgg

SEQ ID NO: 3526127 - DNA, 21 bp, Homo sapiens
tggaggagcaaaggctgagaa

SEQ ID NO: 3526128 - DNA, 13 bp, Homo sapiens
tggaggagcagtg

SEQ ID NO: 3526129 - DNA, 21 bp, Homo sapiens
tggaggagcagtgcaggcaca

SEQ ID NO: 3526130 - DNA, 22 bp, Homo sapiens
tggaggattgctgccagagaag

SEQ ID NO: 3526131 - DNA, 16 bp, Homo sapiens
tggaggcagatgtggg

SEQ ID NO: 3526132 - DNA, 21 bp, Homo sapiens
tggaggcagatgtggggctga

SEQ ID NO: 3526133 - DNA, 15 bp, Homo sapiens
tggaggccagccagt

SEQ ID NO: 3526134 - DNA, 14 bp, Homo sapiens
tggaggcctcaggt

SEQ ID NO: 3526135 - DNA, 24 bp, Homo sapiens
tggaggcctcaggtgctgtccatg

SEQ ID NO: 3526136 - DNA, 17 bp, Homo sapiens
tggaggcgggcttggaa

SEQ ID NO: 3526137 - DNA, 19 bp, Homo sapiens
tggaggctgacgtgtgagg

SEQ ID NO: 3526138 - DNA, 17 bp, Homo sapiens
tggaggctgcctcccaa

SEQ ID NO: 3526139 - DNA, 22 bp, Homo sapiens
tggagggacaagtggactcagg

SEQ ID NO: 3526140 - DNA, 19 bp, Homo sapiens
tggaggttaaggctgagga

SEQ ID NO: 3526141 - DNA, 22 bp, Homo sapiens
tggaggttaaggctgaggaaag

SEQ ID NO: 3526142 - DNA, 15 bp, Homo sapiens
tggagtacttagcta

SEQ ID NO: 3526143 - DNA, 15 bp, Homo sapiens
tggagtgtgagccac

SEQ ID NO: 3526144 - DNA, 20 bp, Homo sapiens
tggagtgtttctaataaact

SEQ ID NO: 3526145 - DNA, 13 bp, Homo sapiens
tggatccgtttga

SEQ ID NO: 3526146 - DNA, 19 bp, Homo sapiens
tggatccgtttgaccaatt

SEQ ID NO: 3526147 - DNA, 17 bp, Homo sapiens
tggatgagccctcagaa

SEQ ID NO: 3526148 - DNA, 20 bp, Homo sapiens
tggatgcatgttttccagct

SEQ ID NO: 3526149 - DNA, 22 bp, Homo sapiens
tggatgccgatttctgtaaact

SEQ ID NO: 3526150 - DNA, 13 bp, Homo sapiens
tggatgcctgatt

SEQ ID NO: 3526151 - DNA, 15 bp, Homo sapiens
tggatgcctggtggc

SEQ ID NO: 3526152 - DNA, 12 bp, Homo sapiens
tggatgccttga

SEQ ID NO: 3526153 - DNA, 21 bp, Homo sapiens
tggatgcttagagggatttct

SEQ ID NO: 3526154 - DNA, 14 bp, Homo sapiens
tggatggaaatgta

SEQ ID NO: 3526155 - DNA, 20 bp, Homo sapiens
tggatggaaggttggatgga

SEQ ID NO: 3526156 - DNA, 15 bp, Homo sapiens
tggatggccccagca

SEQ ID NO: 3526157 - DNA, 16 bp, Homo sapiens
tggatggccccagcac

SEQ ID NO: 3526158 - DNA, 20 bp, Homo sapiens
tggatgggcctttgagcctg

SEQ ID NO: 3526159 - DNA, 22 bp, Homo sapiens
tggatgggggaactcagatcca

SEQ ID NO: 3526160 - DNA, 17 bp, Homo sapiens
tggatgggtggatggcc

SEQ ID NO: 3526161 - DNA, 16 bp, Homo sapiens
tggatgtggacttttt

SEQ ID NO: 3526162 - DNA, 21 bp, Homo sapiens
tggatgtggacttttttgtac

SEQ ID NO: 3526163 - DNA, 10 bp, Homo sapiens
tggattcttt

SEQ ID NO: 3526164 - DNA, 20 bp, Homo sapiens
tggattggaatgcagaggtc

SEQ ID NO: 3526165 - DNA, 12 bp, Homo sapiens
tggattgtggat

SEQ ID NO: 3526166 - DNA, 21 bp, Homo sapiens
tggatttaacagcatgacaaa

SEQ ID NO: 3526167 - DNA, 14 bp, Homo sapiens
tggatttcttttgt

SEQ ID NO: 3526168 - DNA, 16 bp, Homo sapiens
tggatttcttttgtaa

SEQ ID NO: 3526169 - DNA, 20 bp, Homo sapiens
tggcaaaactctacttaatc

SEQ ID NO: 3526170 - DNA, 20 bp, Homo sapiens
tggcaaaaggatctttgtgg

SEQ ID NO: 3526171 - DNA, 13 bp, Homo sapiens
tggcaacacagag

SEQ ID NO: 3526172 - DNA, 15 bp, Homo sapiens
tggcaacagatctgg

SEQ ID NO: 3526173 - DNA, 16 bp, Homo sapiens
tggcaacagatctgga

SEQ ID NO: 3526174 - DNA, 22 bp, Homo sapiens
tggcaacagatctggaacctca

SEQ ID NO: 3526175 - DNA, 16 bp, Homo sapiens
tggcaacattccaaga

SEQ ID NO: 3526176 - DNA, 20 bp, Homo sapiens
tggcaaggctgtgctccctg

SEQ ID NO: 3526177 - DNA, 21 bp, Homo sapiens
tggcacaggagtgtcctcttc

SEQ ID NO: 3526178 - DNA, 14 bp, Homo sapiens
tggcacattccttt

SEQ ID NO: 3526179 - DNA, 18 bp, Homo sapiens
tggcacattcctttgggt

SEQ ID NO: 3526180 - DNA, 18 bp, Homo sapiens
tggcacatttaagagaca

SEQ ID NO: 3526181 - DNA, 17 bp, Homo sapiens
tggcaccagacacccag

SEQ ID NO: 3526182 - DNA, 21 bp, Homo sapiens
tggcaccagacacccaggact

SEQ ID NO: 3526183 - DNA, 16 bp, Homo sapiens
tggcaccagcagcctg

SEQ ID NO: 3526184 - DNA, 21 bp, Homo sapiens
tggcacccggcccctgctggt

SEQ ID NO: 3526185 - DNA, 19 bp, Homo sapiens
tggcaccctggccacccca

SEQ ID NO: 3526186 - DNA, 16 bp, Homo sapiens
tggcactgctaaaata

SEQ ID NO: 3526187 - DNA, 22 bp, Homo sapiens
tggcactgctaaaatagaatat

SEQ ID NO: 3526188 - DNA, 15 bp, Homo sapiens
tggcactggatgcag

SEQ ID NO: 3526189 - DNA, 23 bp, Homo sapiens
tggcagaaatacagtcttccaca

SEQ ID NO: 3526190 - DNA, 22 bp, Homo sapiens
tggcagagcttggactggatgc

SEQ ID NO: 3526191 - DNA, 19 bp, Homo sapiens
tggcagagttgtaaatata

SEQ ID NO: 3526192 - DNA, 18 bp, Homo sapiens
tggcagcacctgtctcct

SEQ ID NO: 3526193 - DNA, 19 bp, Homo sapiens
tggcagcctcccatccagg

SEQ ID NO: 3526194 - DNA, 22 bp, Homo sapiens
tggcagctgcggtccacccagg

SEQ ID NO: 3526195 - DNA, 17 bp, Homo sapiens
tggcaggaaggcttgtt

SEQ ID NO: 3526196 - DNA, 15 bp, Homo sapiens
tggcaggggacagga

SEQ ID NO: 3526197 - DNA, 17 bp, Homo sapiens
tggcaggtcctcccctc

SEQ ID NO: 3526198 - DNA, 14 bp, Homo sapiens
tggcagtccagcca

SEQ ID NO: 3526199 - DNA, 16 bp, Homo sapiens
tggcagtccagccagc

SEQ ID NO: 3526200 - DNA, 19 bp, Homo sapiens
tggcagtccagccagctcc

SEQ ID NO: 3526201 - DNA, 12 bp, Homo sapiens
tggcagtggagg

SEQ ID NO: 3526202 - DNA, 14 bp, Homo sapiens
tggcagtgggagct

SEQ ID NO: 3526203 - DNA, 16 bp, Homo sapiens
tggcagtgggagctgc

SEQ ID NO: 3526204 - DNA, 22 bp, Homo sapiens
tggcatcgcaccattctgactc

SEQ ID NO: 3526205 - DNA, 13 bp, Homo sapiens
tggcatgagaaat

SEQ ID NO: 3526206 - DNA, 18 bp, Homo sapiens
tggcatggaaggggcttc

SEQ ID NO: 3526207 - DNA, 19 bp, Homo sapiens
tggcatggtagtatacaaa

SEQ ID NO: 3526208 - DNA, 23 bp, Homo sapiens
tggcatttcaattcctggccctg

SEQ ID NO: 3526209 - DNA, 20 bp, Homo sapiens
tggccaaagagcctttccaa

SEQ ID NO: 3526210 - DNA, 21 bp, Homo sapiens
tggccaaagccaaagctaggc

SEQ ID NO: 3526211 - DNA, 18 bp, Homo sapiens
tggccaaggagctgctat

SEQ ID NO: 3526212 - DNA, 19 bp, Homo sapiens
tggccaaggagctgctata

SEQ ID NO: 3526213 - DNA, 10 bp, Homo sapiens
tggccaaggg

SEQ ID NO: 3526214 - DNA, 15 bp, Homo sapiens
tggccaagggccaga

SEQ ID NO: 3526215 - DNA, 18 bp, Homo sapiens
tggccaagggccagacag

SEQ ID NO: 3526216 - DNA, 12 bp, Homo sapiens
tggccagacaca

SEQ ID NO: 3526217 - DNA, 13 bp, Homo sapiens
tggccagacacag

SEQ ID NO: 3526218 - DNA, 23 bp, Homo sapiens
tggccagagagcctggtgctgct

SEQ ID NO: 3526219 - DNA, 17 bp, Homo sapiens
tggccagatgcaccagc

SEQ ID NO: 3526220 - DNA, 21 bp, Homo sapiens
tggccagatgcaccagccctt

SEQ ID NO: 3526221 - DNA, 13 bp, Homo sapiens
tggccagcctaca

SEQ ID NO: 3526222 - DNA, 21 bp, Homo sapiens
tggccaggaagctttggtgag

SEQ ID NO: 3526223 - DNA, 19 bp, Homo sapiens
tggccaggcctcttggcag

SEQ ID NO: 3526224 - DNA, 14 bp, Homo sapiens
tggccagtccaggc

SEQ ID NO: 3526225 - DNA, 21 bp, Homo sapiens
tggccagtccaggctgccgtg

SEQ ID NO: 3526226 - DNA, 14 bp, Homo sapiens
tggccatctctgga

SEQ ID NO: 3526227 - DNA, 20 bp, Homo sapiens
tggccatgcctcagccctga

SEQ ID NO: 3526228 - DNA, 14 bp, Homo sapiens
tggccatggcctct

SEQ ID NO: 3526229 - DNA, 16 bp, Homo sapiens
tggccatggcctctgc

SEQ ID NO: 3526230 - DNA, 18 bp, Homo sapiens
tggccatggcctctgcaa

SEQ ID NO: 3526231 - DNA, 21 bp, Homo sapiens
tggcccaagtggcagagcttg

SEQ ID NO: 3526232 - DNA, 13 bp, Homo sapiens
tggcccactgcat

SEQ ID NO: 3526233 - DNA, 22 bp, Homo sapiens
tggcccagccaaaccctgtctg

SEQ ID NO: 3526234 - DNA, 23 bp, Homo sapiens
tggcccagggcccagagcccagc

SEQ ID NO: 3526235 - DNA, 15 bp, Homo sapiens
tggccccaccctggg

SEQ ID NO: 3526236 - DNA, 14 bp, Homo sapiens
tggccccagcacag

SEQ ID NO: 3526237 - DNA, 17 bp, Homo sapiens
tggccccagcacagctt

SEQ ID NO: 3526238 - DNA, 19 bp, Homo sapiens
tggccccagcacagcttga

SEQ ID NO: 3526239 - DNA, 12 bp, Homo sapiens
tggccccaggac

SEQ ID NO: 3526240 - DNA, 15 bp, Homo sapiens
tggccccaggacctg

SEQ ID NO: 3526241 - DNA, 13 bp, Homo sapiens
tggccccgccgcc

SEQ ID NO: 3526242 - DNA, 15 bp, Homo sapiens
tggccccgccgcctg

SEQ ID NO: 3526243 - DNA, 20 bp, Homo sapiens
tggccccgccgcctggtact

SEQ ID NO: 3526244 - DNA, 15 bp, Homo sapiens
tggccccgcctgcct

SEQ ID NO: 3526245 - DNA, 20 bp, Homo sapiens
tggcccctgcccggctgcgg

SEQ ID NO: 3526246 - DNA, 21 bp, Homo sapiens
tggcccctgctgtctctctgg

SEQ ID NO: 3526247 - DNA, 20 bp, Homo sapiens
tggccctgtagttaggcctg

SEQ ID NO: 3526248 - DNA, 21 bp, Homo sapiens
tgtataatttttttcttgtag

SEQ ID NO: 3526249 - DNA, 23 bp, Homo sapiens
tgtatagtaaagtgataatttct

SEQ ID NO: 3526250 - DNA, 14 bp, Homo sapiens
tgtatagttcacgt

SEQ ID NO: 3526251 - DNA, 12 bp, Homo sapiens
tgtatatacttt

SEQ ID NO: 3526252 - DNA, 17 bp, Homo sapiens
tgtatatatattaagag

SEQ ID NO: 3526253 - DNA, 14 bp, Homo sapiens
tgtatattcacttt

SEQ ID NO: 3526254 - DNA, 20 bp, Homo sapiens
tgtatcagtcagtgctggag

SEQ ID NO: 3526255 - DNA, 19 bp, Homo sapiens
tgtatctgcaggcagacac

SEQ ID NO: 3526256 - DNA, 20 bp, Homo sapiens
tgtatctgcaggcagacacg

SEQ ID NO: 3526257 - DNA, 14 bp, Homo sapiens
tgtatgctgatcat

SEQ ID NO: 3526258 - DNA, 17 bp, Homo sapiens
tgtatggagagaaaaca

SEQ ID NO: 3526259 - DNA, 15 bp, Homo sapiens
tgtatgtaaatgtgc

SEQ ID NO: 3526260 - DNA, 21 bp, Homo sapiens
tgtatgtaacaattgtttgtt

SEQ ID NO: 3526261 - DNA, 14 bp, Homo sapiens
tgtattaagccact

SEQ ID NO: 3526262 - DNA, 13 bp, Homo sapiens
tgtattacaaatc

SEQ ID NO: 3526263 - DNA, 19 bp, Homo sapiens
tgtattagatgttctctat

SEQ ID NO: 3526264 - DNA, 17 bp, Homo sapiens
tgtattcccagttactt

SEQ ID NO: 3526265 - DNA, 14 bp, Homo sapiens
tgtattctctgagc

SEQ ID NO: 3526266 - DNA, 21 bp, Homo sapiens
tgtattctctgagctgtgcag

SEQ ID NO: 3526267 - DNA, 22 bp, Homo sapiens
tgtattgaacttggaaagaaat

SEQ ID NO: 3526268 - DNA, 14 bp, Homo sapiens
tgtattgtaaaaaa

SEQ ID NO: 3526269 - DNA, 11 bp, Homo sapiens
tgtatttaatt

SEQ ID NO: 3526270 - DNA, 13 bp, Homo sapiens
tgtatttaccaaa

SEQ ID NO: 3526271 - DNA, 18 bp, Homo sapiens
tgtatttcttatacgctt

SEQ ID NO: 3526272 - DNA, 16 bp, Homo sapiens
tgtcaaacaaagccag

SEQ ID NO: 3526273 - DNA, 22 bp, Homo sapiens
tgtcaaacaaagccagaagctg

SEQ ID NO: 3526274 - DNA, 17 bp, Homo sapiens
tgtcaaagagagggctt

SEQ ID NO: 3526275 - DNA, 17 bp, Homo sapiens
tgtcaagagtagttata

SEQ ID NO: 3526276 - DNA, 15 bp, Homo sapiens
tgtcaagctgctctg

SEQ ID NO: 3526277 - DNA, 19 bp, Homo sapiens
tgtcaagctgctctgagcc

SEQ ID NO: 3526278 - DNA, 18 bp, Homo sapiens
tgtcaagtctctgctggc

SEQ ID NO: 3526279 - DNA, 17 bp, Homo sapiens
tgtcaatccagatggtg

SEQ ID NO: 3526280 - DNA, 15 bp, Homo sapiens
tgtcaatttctgtgt

SEQ ID NO: 3526281 - DNA, 20 bp, Homo sapiens
tgtcacatgaaacatttgca

SEQ ID NO: 3526282 - DNA, 18 bp, Homo sapiens
tgtcaccggatcctgggt

SEQ ID NO: 3526283 - DNA, 23 bp, Homo sapiens
tgtcacctcttccgactctttct

SEQ ID NO: 3526284 - DNA, 17 bp, Homo sapiens
tgtcactagcagctgca

SEQ ID NO: 3526285 - DNA, 14 bp, Homo sapiens
tgtcactcaaggcg

SEQ ID NO: 3526286 - DNA, 12 bp, Homo sapiens
tgtcactcaggc

SEQ ID NO: 3526287 - DNA, 16 bp, Homo sapiens
tgtcactcattgctga

SEQ ID NO: 3526288 - DNA, 23 bp, Homo sapiens
tgtcactcattgctgagcctctg

SEQ ID NO: 3526289 - DNA, 19 bp, Homo sapiens
tgtcagcaaaaagcaaaat

SEQ ID NO: 3526290 - DNA, 16 bp, Homo sapiens
tgtcagctgaacctgg

SEQ ID NO: 3526291 - DNA, 19 bp, Homo sapiens
tgtcagctgaacctgggta

SEQ ID NO: 3526292 - DNA, 24 bp, Homo sapiens
tgtcagctgaggctgggggagagc

SEQ ID NO: 3526293 - DNA, 17 bp, Homo sapiens
tgtcaggtggggcagct

SEQ ID NO: 3526294 - DNA, 14 bp, Homo sapiens
tgtcagtcacagcc

SEQ ID NO: 3526295 - DNA, 18 bp, Homo sapiens
tgtcagtggggctctctg

SEQ ID NO: 3526296 - DNA, 17 bp, Homo sapiens
tgtcatatactgccatg

SEQ ID NO: 3526297 - DNA, 23 bp, Homo sapiens
tgtcatctttcttctattttatt

SEQ ID NO: 3526298 - DNA, 17 bp, Homo sapiens
tgtcatgcttcatcatt

SEQ ID NO: 3526299 - DNA, 21 bp, Homo sapiens
tgtcattagcctgagtagaaa

SEQ ID NO: 3526300 - DNA, 17 bp, Homo sapiens
tgtcatttatgtgtcag

SEQ ID NO: 3526301 - DNA, 17 bp, Homo sapiens
tgtcattttgcactgta

SEQ ID NO: 3526302 - DNA, 16 bp, Homo sapiens
tgtccaaaactgcctc

SEQ ID NO: 3526303 - DNA, 12 bp, Homo sapiens
tgtccaaagcag

SEQ ID NO: 3526304 - DNA, 17 bp, Homo sapiens
tgtccacgactgtctcc

SEQ ID NO: 3526305 - DNA, 11 bp, Homo sapiens
tgtccagctcc

SEQ ID NO: 3526306 - DNA, 12 bp, Homo sapiens
tgtccagctcca

SEQ ID NO: 3526307 - DNA, 16 bp, Homo sapiens
tgtccagctccaacct

SEQ ID NO: 3526308 - DNA, 20 bp, Homo sapiens
tgtccagctccaacctgcaa

SEQ ID NO: 3526309 - DNA, 23 bp, Homo sapiens
tgtccagctccaacctgcaaaga

SEQ ID NO: 3526310 - DNA, 18 bp, Homo sapiens
tgtccatgcgctcagggc

SEQ ID NO: 3526311 - DNA, 14 bp, Homo sapiens
tgtccattgtccaa

SEQ ID NO: 3526312 - DNA, 18 bp, Homo sapiens
tgtcccatagtccctgcc

SEQ ID NO: 3526313 - DNA, 19 bp, Homo sapiens
tgtcccatagtccctgcca

SEQ ID NO: 3526314 - DNA, 12 bp, Homo sapiens
tgtcccatctct

SEQ ID NO: 3526315 - DNA, 19 bp, Homo sapiens
tgtcccatctggtcatttg

SEQ ID NO: 3526316 - DNA, 20 bp, Homo sapiens
tgtcccatctggtcatttgg

SEQ ID NO: 3526317 - DNA, 13 bp, Homo sapiens
tgtccccatctgt

SEQ ID NO: 3526318 - DNA, 21 bp, Homo sapiens
tgtcccctcctcactcccttc

SEQ ID NO: 3526319 - DNA, 14 bp, Homo sapiens
tgtccccttctctc

SEQ ID NO: 3526320 - DNA, 15 bp, Homo sapiens
tgtccctctgcccca

SEQ ID NO: 3526321 - DNA, 14 bp, Homo sapiens
tgtccctgcacttg

SEQ ID NO: 3526322 - DNA, 20 bp, Homo sapiens
tgtccctgcacttgcagact

SEQ ID NO: 3526323 - DNA, 20 bp, Homo sapiens
tgtcccttctgtccctcaca

SEQ ID NO: 3526324 - DNA, 13 bp, Homo sapiens
tgtccgagctttg

SEQ ID NO: 3526325 - DNA, 22 bp, Homo sapiens
tgtccggaggatattaaaatgc

SEQ ID NO: 3526326 - DNA, 22 bp, Homo sapiens
tgtcctaaaacacctggtagga

SEQ ID NO: 3526327 - DNA, 14 bp, Homo sapiens
tgtcctaattcttc

SEQ ID NO: 3526328 - DNA, 20 bp, Homo sapiens
tgtcctaattcttctgtcct

SEQ ID NO: 3526329 - DNA, 16 bp, Homo sapiens
tgtcctacccaccctc

SEQ ID NO: 3526330 - DNA, 21 bp, Homo sapiens
tgtcctatgaatgctttgcat

SEQ ID NO: 3526331 - DNA, 14 bp, Homo sapiens
tgtcctcaccacat

SEQ ID NO: 3526332 - DNA, 14 bp, Homo sapiens
tgtcctcagcagct

SEQ ID NO: 3526333 - DNA, 16 bp, Homo sapiens
tgtcctcagccttgcc

SEQ ID NO: 3526334 - DNA, 16 bp, Homo sapiens
tgtcctccaggagctt

SEQ ID NO: 3526335 - DNA, 12 bp, Homo sapiens
tgtcctgctggt

SEQ ID NO: 3526336 - DNA, 12 bp, Homo sapiens
tgtccttagaac

SEQ ID NO: 3526337 - DNA, 18 bp, Homo sapiens
tgtcctttctagagcact

SEQ ID NO: 3526338 - DNA, 14 bp, Homo sapiens
tgtcgcccagtctg

SEQ ID NO: 3526339 - DNA, 15 bp, Homo sapiens
tgtcgcccagtctgg

SEQ ID NO: 3526340 - DNA, 14 bp, Homo sapiens
tgtcgctcatgtgt

SEQ ID NO: 3526341 - DNA, 17 bp, Homo sapiens
tgtctaaaacaataaaa

SEQ ID NO: 3526342 - DNA, 22 bp, Homo sapiens
tgtctaaacaatgctgatttgg

SEQ ID NO: 3526343 - DNA, 11 bp, Homo sapiens
tgtctaaactg

SEQ ID NO: 3526344 - DNA, 21 bp, Homo sapiens
tgtctaacttttgtgaagaac

SEQ ID NO: 3526345 - DNA, 15 bp, Homo sapiens
tgtctactaagtgat

SEQ ID NO: 3526346 - DNA, 22 bp, Homo sapiens
tgtctactaagtgatgctgtga

SEQ ID NO: 3526347 - DNA, 19 bp, Homo sapiens
tgtctactcagcatttgat

SEQ ID NO: 3526348 - DNA, 16 bp, Homo sapiens
tgtctagagcctcttg

SEQ ID NO: 3526349 - DNA, 15 bp, Homo sapiens
tgtctatgggactca

SEQ ID NO: 3526350 - DNA, 16 bp, Homo sapiens
tgtctatgggactcaa

SEQ ID NO: 3526351 - DNA, 16 bp, Homo sapiens
tgtctattccattccc

SEQ ID NO: 3526352 - DNA, 17 bp, Homo sapiens
tgtctattccattccct

SEQ ID NO: 3526353 - DNA, 15 bp, Homo sapiens
tgtctcaatgctcat

SEQ ID NO: 3526354 - DNA, 19 bp, Homo sapiens
tgtctcaatgctcataacg

SEQ ID NO: 3526355 - DNA, 16 bp, Homo sapiens
tgtctcatccatcatc

SEQ ID NO: 3526356 - DNA, 22 bp, Homo sapiens
tgtctcatctagtacctttgga

SEQ ID NO: 3526357 - DNA, 17 bp, Homo sapiens
tgtctccaaccccccag

SEQ ID NO: 3526358 - DNA, 22 bp, Homo sapiens
tgtctccaaccccccagcactg

SEQ ID NO: 3526359 - DNA, 12 bp, Homo sapiens
tgtctccagctt

SEQ ID NO: 3526360 - DNA, 18 bp, Homo sapiens
tgtctcctatatatttct

SEQ ID NO: 3526361 - DNA, 17 bp, Homo sapiens
tgtctccttaacactga

SEQ ID NO: 3526362 - DNA, 22 bp, Homo sapiens
tgtctctagaagtgccatctca

SEQ ID NO: 3526363 - DNA, 23 bp, Homo sapiens
tgtctctgggcttggggcttcct

SEQ ID NO: 3526364 - DNA, 14 bp, Homo sapiens
tgtctgagtgaacc

SEQ ID NO: 3526365 - DNA, 15 bp, Homo sapiens
tgtctgagtgaacct

SEQ ID NO: 3526366 - DNA, 12 bp, Homo sapiens
tgtctgcagccc

SEQ ID NO: 3526367 - DNA, 16 bp, Homo sapiens
tgtctgcagtgtgccc

SEQ ID NO: 3526368 - DNA, 13 bp, Homo sapiens
tgtctgccagggc

SEQ ID NO: 3526369 - DNA, 18 bp, Homo sapiens
tgtctgccatgttgcccc

SEQ ID NO: 3526370 - DNA, 13 bp, Homo sapiens
tgtctggtggccc

SEQ ID NO: 3526371 - DNA, 14 bp, Homo sapiens
tgtctggtggcccc

SEQ ID NO: 3526372 - DNA, 21 bp, Homo sapiens
tgtctgtgtgtgtgtgtgcat

SEQ ID NO: 3526373 - DNA, 14 bp, Homo sapiens
tgtcttaatgaagt

SEQ ID NO: 3526374 - DNA, 22 bp, Homo sapiens
tgtcttaatgaagtttgaatgt

SEQ ID NO: 3526375 - DNA, 20 bp, Homo sapiens
tgtcttcaaggcttcagtct

SEQ ID NO: 3526376 - DNA, 24 bp, Homo sapiens
tgtcttcacctgattcaactaaaa

SEQ ID NO: 3526377 - DNA, 15 bp, Homo sapiens
tgtcttcatagcaga

SEQ ID NO: 3526378 - DNA, 13 bp, Homo sapiens
tgtcttcctctgc

SEQ ID NO: 3526379 - DNA, 23 bp, Homo sapiens
tgtcttcctctgcaagtgctcag

SEQ ID NO: 3526380 - DNA, 22 bp, Homo sapiens
tgtcttgatgcatgcactgttc

SEQ ID NO: 3526381 - DNA, 14 bp, Homo sapiens
ttataggtgagaaa

SEQ ID NO: 3526382 - DNA, 16 bp, Homo sapiens
ttatatttacaaatgg

SEQ ID NO: 3526383 - DNA, 15 bp, Homo sapiens
ttatatttcagatgt

SEQ ID NO: 3526384 - DNA, 21 bp, Homo sapiens
ttatcaacttcctaaatatta

SEQ ID NO: 3526385 - DNA, 12 bp, Homo sapiens
ttatcacctcat

SEQ ID NO: 3526386 - DNA, 14 bp, Homo sapiens
ttatcagcaaaaaa

SEQ ID NO: 3526387 - DNA, 14 bp, Homo sapiens
ttatcagtcaatat

SEQ ID NO: 3526388 - DNA, 19 bp, Homo sapiens
ttatcattgctcccctgat

SEQ ID NO: 3526389 - DNA, 21 bp, Homo sapiens
ttatccaaaatgtgtatttct

SEQ ID NO: 3526390 - DNA, 22 bp, Homo sapiens
ttatccaaaatgtgtatttctt

SEQ ID NO: 3526391 - DNA, 12 bp, Homo sapiens
ttatccataatg

SEQ ID NO: 3526392 - DNA, 15 bp, Homo sapiens
ttatccataatgatg

SEQ ID NO: 3526393 - DNA, 14 bp, Homo sapiens
ttatccattcccaa

SEQ ID NO: 3526394 - DNA, 20 bp, Homo sapiens
ttatcctagcacatgcttca

SEQ ID NO: 3526395 - DNA, 15 bp, Homo sapiens
ttatctaaaagaaat

SEQ ID NO: 3526396 - DNA, 15 bp, Homo sapiens
ttatctaagaataca

SEQ ID NO: 3526397 - DNA, 19 bp, Homo sapiens
ttatctcttttatatttgt

SEQ ID NO: 3526398 - DNA, 20 bp, Homo sapiens
ttatctgggcatagatgcag

SEQ ID NO: 3526399 - DNA, 18 bp, Homo sapiens
ttatcttatactgtacaa

SEQ ID NO: 3526400 - DNA, 16 bp, Homo sapiens
ttatcttgtctctggg

SEQ ID NO: 3526401 - DNA, 18 bp, Homo sapiens
ttatgaaaggtttacatt

SEQ ID NO: 3526402 - DNA, 18 bp, Homo sapiens
ttatgacctcttccttta

SEQ ID NO: 3526403 - DNA, 15 bp, Homo sapiens
ttatgagaaagcctt

SEQ ID NO: 3526404 - DNA, 11 bp, Homo sapiens
ttatgatatca

SEQ ID NO: 3526405 - DNA, 19 bp, Homo sapiens
ttatgctctcactgtttgt

SEQ ID NO: 3526406 - DNA, 18 bp, Homo sapiens
ttatgctgtagtcttacc

SEQ ID NO: 3526407 - DNA, 14 bp, Homo sapiens
ttatggaattgatt

SEQ ID NO: 3526408 - DNA, 23 bp, Homo sapiens
ttatggaattgatttgcattgaa

SEQ ID NO: 3526409 - DNA, 20 bp, Homo sapiens
ttatgtaaaaggccaaacct

SEQ ID NO: 3526410 - DNA, 15 bp, Homo sapiens
ttatgtataaaatgt

SEQ ID NO: 3526411 - DNA, 20 bp, Homo sapiens
ttatgtataaaatgtaacac

SEQ ID NO: 3526412 - DNA, 11 bp, Homo sapiens
ttatgtatttc

SEQ ID NO: 3526413 - DNA, 21 bp, Homo sapiens
ttatgtcttttgatgaataga

SEQ ID NO: 3526414 - DNA, 14 bp, Homo sapiens
ttatgtgtaggtga

SEQ ID NO: 3526415 - DNA, 22 bp, Homo sapiens
ttatgtgtaggtgaacagtcac

SEQ ID NO: 3526416 - DNA, 11 bp, Homo sapiens
ttatgttaaac

SEQ ID NO: 3526417 - DNA, 14 bp, Homo sapiens
ttattaaaattctg

SEQ ID NO: 3526418 - DNA, 18 bp, Homo sapiens
ttattaaacagatatctt

SEQ ID NO: 3526419 - DNA, 18 bp, Homo sapiens
ttattaaatacaaaactt

SEQ ID NO: 3526420 - DNA, 16 bp, Homo sapiens
ttattaacaattaggc

SEQ ID NO: 3526421 - DNA, 18 bp, Homo sapiens
ttattacatgtaatttga

SEQ ID NO: 3526422 - DNA, 12 bp, Homo sapiens
ttattacctctg

SEQ ID NO: 3526423 - DNA, 21 bp, Homo sapiens
ttattagagattacctcctga

SEQ ID NO: 3526424 - DNA, 18 bp, Homo sapiens
ttattagggagaaaattc

SEQ ID NO: 3526425 - DNA, 23 bp, Homo sapiens
ttattagggagaaaattcaattg

SEQ ID NO: 3526426 - DNA, 16 bp, Homo sapiens
ttattatggaaaacat

SEQ ID NO: 3526427 - DNA, 16 bp, Homo sapiens
ttattattttcacctg

SEQ ID NO: 3526428 - DNA, 14 bp, Homo sapiens
ttattcaataaagt

SEQ ID NO: 3526429 - DNA, 19 bp, Homo sapiens
ttattcaataaagtattta

SEQ ID NO: 3526430 - DNA, 15 bp, Homo sapiens
ttattcattatttgt

SEQ ID NO: 3526431 - DNA, 19 bp, Homo sapiens
ttattcattatttgtcaaa

SEQ ID NO: 3526432 - DNA, 17 bp, Homo sapiens
ttattccagaatgctgt

SEQ ID NO: 3526433 - DNA, 12 bp, Homo sapiens
ttattcttggtt

SEQ ID NO: 3526434 - DNA, 14 bp, Homo sapiens
ttattgaaagaatt

SEQ ID NO: 3526435 - DNA, 18 bp, Homo sapiens
ttattgaatctatttaag

SEQ ID NO: 3526436 - DNA, 22 bp, Homo sapiens
ttattgacaataatttcaggtt

SEQ ID NO: 3526437 - DNA, 16 bp, Homo sapiens
ttattgactctgggtc

SEQ ID NO: 3526438 - DNA, 14 bp, Homo sapiens
ttattgagaaagag

SEQ ID NO: 3526439 - DNA, 23 bp, Homo sapiens
ttattgagaaagagcacttaaga

SEQ ID NO: 3526440 - DNA, 13 bp, Homo sapiens
ttattgcattata

SEQ ID NO: 3526441 - DNA, 15 bp, Homo sapiens
ttattgcccacgctg

SEQ ID NO: 3526442 - DNA, 22 bp, Homo sapiens
ttattgccttctcaccagctgc

SEQ ID NO: 3526443 - DNA, 15 bp, Homo sapiens
ttattgtacctctct

SEQ ID NO: 3526444 - DNA, 16 bp, Homo sapiens
ttattgtgtttgtcat

SEQ ID NO: 3526445 - DNA, 22 bp, Homo sapiens
ttattgtgtttgtcattagcct

SEQ ID NO: 3526446 - DNA, 23 bp, Homo sapiens
ttatttaacagctgaattatcta

SEQ ID NO: 3526447 - DNA, 15 bp, Homo sapiens
ttatttacagatgaa

SEQ ID NO: 3526448 - DNA, 17 bp, Homo sapiens
ttatttactgagcttct

SEQ ID NO: 3526449 - DNA, 23 bp, Homo sapiens
ttatttatttgattaggtatgtt

SEQ ID NO: 3526450 - DNA, 21 bp, Homo sapiens
ttatttcctagttctgtagaa

SEQ ID NO: 3526451 - DNA, 20 bp, Homo sapiens
ttatttctgcatatgttgaa

SEQ ID NO: 3526452 - DNA, 15 bp, Homo sapiens
ttatttgactttaat

SEQ ID NO: 3526453 - DNA, 16 bp, Homo sapiens
ttatttgccagagcca

SEQ ID NO: 3526454 - DNA, 18 bp, Homo sapiens
ttatttggttcccttcct

SEQ ID NO: 3526455 - DNA, 15 bp, Homo sapiens
ttattttcaccctct

SEQ ID NO: 3526456 - DNA, 12 bp, Homo sapiens
ttattttgcaac

SEQ ID NO: 3526457 - DNA, 18 bp, Homo sapiens
ttattttggaactatgaa

SEQ ID NO: 3526458 - DNA, 17 bp, Homo sapiens
ttattttggattgtgga

SEQ ID NO: 3526459 - DNA, 14 bp, Homo sapiens
ttatttttaaagat

SEQ ID NO: 3526460 - DNA, 18 bp, Homo sapiens
ttatttttagacagagtc

SEQ ID NO: 3526461 - DNA, 14 bp, Homo sapiens
ttattttttacatt

SEQ ID NO: 3526462 - DNA, 17 bp, Homo sapiens
ttcaaaaccttttgaaa

SEQ ID NO: 3526463 - DNA, 20 bp, Homo sapiens
ttcaaaatatttaaaaatgt

SEQ ID NO: 3526464 - DNA, 22 bp, Homo sapiens
ttcaaaatatttaaaaatgtct

SEQ ID NO: 3526465 - DNA, 17 bp, Homo sapiens
ttcaaaatgctttttat

SEQ ID NO: 3526466 - DNA, 18 bp, Homo sapiens
ttcaaaattctaaatgta

SEQ ID NO: 3526467 - DNA, 21 bp, Homo sapiens
ttcaaagccaagacctcacac

SEQ ID NO: 3526468 - DNA, 23 bp, Homo sapiens
ttcaaagccaagtttatatacaa

SEQ ID NO: 3526469 - DNA, 13 bp, Homo sapiens
ttcaaagccagcg

SEQ ID NO: 3526470 - DNA, 23 bp, Homo sapiens
ttcaaagccagcgtcctcctctg

SEQ ID NO: 3526471 - DNA, 22 bp, Homo sapiens
ttcaaattcctatttttaaata

SEQ ID NO: 3526472 - DNA, 18 bp, Homo sapiens
ttcaacagtgaagacaga

SEQ ID NO: 3526473 - DNA, 16 bp, Homo sapiens
ttcaaccataaaagaa

SEQ ID NO: 3526474 - DNA, 16 bp, Homo sapiens
ttcaaccctcagcctt

SEQ ID NO: 3526475 - DNA, 21 bp, Homo sapiens
ttcaactcctcgacatcactg

SEQ ID NO: 3526476 - DNA, 21 bp, Homo sapiens
ttcaactgccaaaatgctcta

SEQ ID NO: 3526477 - DNA, 15 bp, Homo sapiens
ttcaactttgaataa

SEQ ID NO: 3526478 - DNA, 16 bp, Homo sapiens
ttcaactttgaataaa

SEQ ID NO: 3526479 - DNA, 20 bp, Homo sapiens
ttcaactttgaataaagaat

SEQ ID NO: 3526480 - DNA, 18 bp, Homo sapiens
ttcaagcagtcgtgcctg

SEQ ID NO: 3526481 - DNA, 22 bp, Homo sapiens
ttcaagcagtcgtgcctgtgtc

SEQ ID NO: 3526482 - DNA, 17 bp, Homo sapiens
ttcaaggccatccttcc

SEQ ID NO: 3526483 - DNA, 12 bp, Homo sapiens
ttcaaggccttc

SEQ ID NO: 3526484 - DNA, 20 bp, Homo sapiens
ttcaaggccttcagtttatt

SEQ ID NO: 3526485 - DNA, 19 bp, Homo sapiens
ttcaaggtaatttcttgtg

SEQ ID NO: 3526486 - DNA, 21 bp, Homo sapiens
ttcaagtactgtaactgtgtc

SEQ ID NO: 3526487 - DNA, 19 bp, Homo sapiens
ttcaataaagcactgagca

SEQ ID NO: 3526488 - DNA, 21 bp, Homo sapiens
ttcaataaagtatttaattag

SEQ ID NO: 3526489 - DNA, 15 bp, Homo sapiens
ttcaatatcctttgc

SEQ ID NO: 3526490 - DNA, 11 bp, Homo sapiens
ttcaatattta

SEQ ID NO: 3526491 - DNA, 16 bp, Homo sapiens
ttcaattcctggccct

SEQ ID NO: 3526492 - DNA, 12 bp, Homo sapiens
ttcaattgtaaa

SEQ ID NO: 3526493 - DNA, 15 bp, Homo sapiens
ttcacaaacttttat

SEQ ID NO: 3526494 - DNA, 16 bp, Homo sapiens
ttcacaaacttttata

SEQ ID NO: 3526495 - DNA, 13 bp, Homo sapiens
ttcacaaataata

SEQ ID NO: 3526496 - DNA, 12 bp, Homo sapiens
ttcacaacctgg

SEQ ID NO: 3526497 - DNA, 23 bp, Homo sapiens
ttcacaattccatttccagttca

SEQ ID NO: 3526498 - DNA, 14 bp, Homo sapiens
ttcacacagataga

SEQ ID NO: 3526499 - DNA, 19 bp, Homo sapiens
ttcacagatgcctactttt

SEQ ID NO: 3526500 - DNA, 12 bp, Homo sapiens
ttcacataataa

SEQ ID NO: 3526501 - DNA, 13 bp, Homo sapiens
ttcacataataaa

SEQ ID NO: 3526502 - DNA, 22 bp, Homo sapiens
ttcacattaatatttgctgaca

SEQ ID NO: 3526503 - DNA, 15 bp, Homo sapiens
ttcacattcttggct

SEQ ID NO: 3526504 - DNA, 16 bp, Homo sapiens
ttcacattcttggctt

SEQ ID NO: 3526505 - DNA, 22 bp, Homo sapiens
ttcaccacatgtgcacatgcac

SEQ ID NO: 3526506 - DNA, 19 bp, Homo sapiens
ttcaccagaatggaaagac

SEQ ID NO: 3526507 - DNA, 15 bp, Homo sapiens
ttcacccctcccttt

SEQ ID NO: 3526508 - DNA, 20 bp, Homo sapiens
ttcacccctccctttctccc

SEQ ID NO: 3526509 - DNA, 22 bp, Homo sapiens
ttcacccctccctttctcccct

SEQ ID NO: 3526510 - DNA, 15 bp, Homo sapiens
ttcacctccttcaat

SEQ ID NO: 3526511 - DNA, 21 bp, Homo sapiens
ttcacctcttccactccttct

SEQ ID NO: 3526512 - DNA, 21 bp, Homo sapiens
ttcacctgattcaactaaaaa

SEQ ID NO: 3526513 - DNA, 18 bp, Homo sapiens
ttgaaattaacctctcac

SEQ ID NO: 3526514 - DNA, 12 bp, Homo sapiens
ttgaaattctga

SEQ ID NO: 3526515 - DNA, 13 bp, Homo sapiens
ttgaaattctgaa

SEQ ID NO: 3526516 - DNA, 15 bp, Homo sapiens
ttgaaattctgaatt

SEQ ID NO: 3526517 - DNA, 17 bp, Homo sapiens
ttgaaattctgaatttg

SEQ ID NO: 3526518 - DNA, 18 bp, Homo sapiens
ttgaacacaaactgtaaa

SEQ ID NO: 3526519 - DNA, 22 bp, Homo sapiens
ttgaacagatatgtttttattt

SEQ ID NO: 3526520 - DNA, 22 bp, Homo sapiens
ttgaacgcccccccccacccct

SEQ ID NO: 3526521 - DNA, 15 bp, Homo sapiens
ttgaactcctggcct

SEQ ID NO: 3526522 - DNA, 14 bp, Homo sapiens
ttgaactctgggct

SEQ ID NO: 3526523 - DNA, 22 bp, Homo sapiens
ttgaacttgaaatctaatattt

SEQ ID NO: 3526524 - DNA, 19 bp, Homo sapiens
ttgaacttttcattccctg

SEQ ID NO: 3526525 - DNA, 22 bp, Homo sapiens
ttgaacttttcattccctgtag

SEQ ID NO: 3526526 - DNA, 15 bp, Homo sapiens
ttgaaggcaaaattg

SEQ ID NO: 3526527 - DNA, 17 bp, Homo sapiens
ttgaaggcaaaattgca

SEQ ID NO: 3526528 - DNA, 15 bp, Homo sapiens
ttgaagggaggggct

SEQ ID NO: 3526529 - DNA, 20 bp, Homo sapiens
ttgaagtgtaggcagacaca

SEQ ID NO: 3526530 - DNA, 21 bp, Homo sapiens
ttgaagttgttactaactaaa

SEQ ID NO: 3526531 - DNA, 17 bp, Homo sapiens
ttgaataaaaacctttt

SEQ ID NO: 3526532 - DNA, 12 bp, Homo sapiens
ttgaataaataa

SEQ ID NO: 3526533 - DNA, 18 bp, Homo sapiens
ttgaatactctgccctct

SEQ ID NO: 3526534 - DNA, 17 bp, Homo sapiens
ttgaatcagtataaaca

SEQ ID NO: 3526535 - DNA, 17 bp, Homo sapiens
ttgaatcttgtctcaat

SEQ ID NO: 3526536 - DNA, 23 bp, Homo sapiens
ttgaatcttgtctcaatgctcat

SEQ ID NO: 3526537 - DNA, 23 bp, Homo sapiens
ttgaatgcattttgtttggtatt

SEQ ID NO: 3526538 - DNA, 21 bp, Homo sapiens
ttgaatgtggcttgagaaata

SEQ ID NO: 3526539 - DNA, 15 bp, Homo sapiens
ttgaatgttaaataa

SEQ ID NO: 3526540 - DNA, 18 bp, Homo sapiens
ttgaatgttaaataaatt

SEQ ID NO: 3526541 - DNA, 20 bp, Homo sapiens
ttgaattgaggggattaata

SEQ ID NO: 3526542 - DNA, 15 bp, Homo sapiens
ttgacaagtgtcttt

SEQ ID NO: 3526543 - DNA, 13 bp, Homo sapiens
ttgacaataaaat

SEQ ID NO: 3526544 - DNA, 19 bp, Homo sapiens
ttgacaataaaatattatt

SEQ ID NO: 3526545 - DNA, 14 bp, Homo sapiens
ttgacaattctgca

SEQ ID NO: 3526546 - DNA, 17 bp, Homo sapiens
ttgacacaagtggacct

SEQ ID NO: 3526547 - DNA, 18 bp, Homo sapiens
ttgacacaagtggacctt

SEQ ID NO: 3526548 - DNA, 16 bp, Homo sapiens
ttgacacagaaaatgt

SEQ ID NO: 3526549 - DNA, 13 bp, Homo sapiens
ttgacacaggtct

SEQ ID NO: 3526550 - DNA, 22 bp, Homo sapiens
ttgacacaggtctttcctaagg

SEQ ID NO: 3526551 - DNA, 20 bp, Homo sapiens
ttgacacttccattgtttaa

SEQ ID NO: 3526552 - DNA, 14 bp, Homo sapiens
ttgacagctttgct

SEQ ID NO: 3526553 - DNA, 12 bp, Homo sapiens
ttgacagggcac

SEQ ID NO: 3526554 - DNA, 19 bp, Homo sapiens
ttgacagggcacaccgggc

SEQ ID NO: 3526555 - DNA, 15 bp, Homo sapiens
ttgacatgggtattt

SEQ ID NO: 3526556 - DNA, 15 bp, Homo sapiens
ttgacctcaggtgat

SEQ ID NO: 3526557 - DNA, 13 bp, Homo sapiens
ttgacctgaggct

SEQ ID NO: 3526558 - DNA, 19 bp, Homo sapiens
ttgacctgaggctgtggtc

SEQ ID NO: 3526559 - DNA, 17 bp, Homo sapiens
ttgacctgcattgtaaa

SEQ ID NO: 3526560 - DNA, 15 bp, Homo sapiens
ttgacctttgtacag

SEQ ID NO: 3526561 - DNA, 15 bp, Homo sapiens
ttgactaattttaca

SEQ ID NO: 3526562 - DNA, 13 bp, Homo sapiens
ttgactctgggtc

SEQ ID NO: 3526563 - DNA, 19 bp, Homo sapiens
ttgactggctgtgtgacct

SEQ ID NO: 3526564 - DNA, 21 bp, Homo sapiens
ttgacttaatgtgattactgc

SEQ ID NO: 3526565 - DNA, 12 bp, Homo sapiens
ttgactttcagg

SEQ ID NO: 3526566 - DNA, 11 bp, Homo sapiens
ttgactttgtc

SEQ ID NO: 3526567 - DNA, 22 bp, Homo sapiens
ttgagaaaccttattgtacctc

SEQ ID NO: 3526568 - DNA, 23 bp, Homo sapiens
ttgagaaaccttattgtacctct

SEQ ID NO: 3526569 - DNA, 21 bp, Homo sapiens
ttgagaaatatggacacttaa

SEQ ID NO: 3526570 - DNA, 19 bp, Homo sapiens
ttgagaactgcatatgttt

SEQ ID NO: 3526571 - DNA, 21 bp, Homo sapiens
ttgagaactgcatatgtttcg

SEQ ID NO: 3526572 - DNA, 18 bp, Homo sapiens
ttgagaagaaaacatcta

SEQ ID NO: 3526573 - DNA, 14 bp, Homo sapiens
ttgagaaggtgcct

SEQ ID NO: 3526574 - DNA, 15 bp, Homo sapiens
ttgagaaggtgcctg

SEQ ID NO: 3526575 - DNA, 16 bp, Homo sapiens
ttgagaaggtgcctgc

SEQ ID NO: 3526576 - DNA, 18 bp, Homo sapiens
ttgagaaggtgcctgcca

SEQ ID NO: 3526577 - DNA, 22 bp, Homo sapiens
ttgagacacggagcccagccct

SEQ ID NO: 3526578 - DNA, 11 bp, Homo sapiens
ttgagacagag

SEQ ID NO: 3526579 - DNA, 13 bp, Homo sapiens
ttgagacttaaaa

SEQ ID NO: 3526580 - DNA, 15 bp, Homo sapiens
ttgagcaatttcccc

SEQ ID NO: 3526581 - DNA, 16 bp, Homo sapiens
ttgagcatcacagaat

SEQ ID NO: 3526582 - DNA, 11 bp, Homo sapiens
ttgagcctggg

SEQ ID NO: 3526583 - DNA, 14 bp, Homo sapiens
ttgagcctgggagg

SEQ ID NO: 3526584 - DNA, 23 bp, Homo sapiens
ttgaggaaaacaagcattcacaa

SEQ ID NO: 3526585 - DNA, 15 bp, Homo sapiens
ttgaggggattaata

SEQ ID NO: 3526586 - DNA, 20 bp, Homo sapiens
ttgaggggattaatatgaaa

SEQ ID NO: 3526587 - DNA, 22 bp, Homo sapiens
ttgaggggattaatatgaaaac

SEQ ID NO: 3526588 - DNA, 11 bp, Homo sapiens
ttgagtctctt

SEQ ID NO: 3526589 - DNA, 17 bp, Homo sapiens
ttgagtggatgatgttt

SEQ ID NO: 3526590 - DNA, 14 bp, Homo sapiens
ttgagtttcatgtt

SEQ ID NO: 3526591 - DNA, 19 bp, Homo sapiens
ttgagttttcagtggggca

SEQ ID NO: 3526592 - DNA, 12 bp, Homo sapiens
ttgagttttgta

SEQ ID NO: 3526593 - DNA, 14 bp, Homo sapiens
ttgagttttgtagc

SEQ ID NO: 3526594 - DNA, 21 bp, Homo sapiens
ttgataagctattgtctgtaa

SEQ ID NO: 3526595 - DNA, 22 bp, Homo sapiens
ttgataagctattgtctgtaat

SEQ ID NO: 3526596 - DNA, 20 bp, Homo sapiens
ttgatacataaacttttgca

SEQ ID NO: 3526597 - DNA, 15 bp, Homo sapiens
ttgatagaaatgcca

SEQ ID NO: 3526598 - DNA, 13 bp, Homo sapiens
ttgatagcaaagc

SEQ ID NO: 3526599 - DNA, 17 bp, Homo sapiens
ttgatatagaacagtgc

SEQ ID NO: 3526600 - DNA, 18 bp, Homo sapiens
ttgatatgcaactgcagt

SEQ ID NO: 3526601 - DNA, 21 bp, Homo sapiens
ttgatatgttttatttcattg

SEQ ID NO: 3526602 - DNA, 17 bp, Homo sapiens
ttgatattttttctctc

SEQ ID NO: 3526603 - DNA, 21 bp, Homo sapiens
ttgatccatccagcttgccag

SEQ ID NO: 3526604 - DNA, 14 bp, Homo sapiens
ttgatctggaaccc

SEQ ID NO: 3526605 - DNA, 17 bp, Homo sapiens
ttgatctggaacccaga

SEQ ID NO: 3526606 - DNA, 19 bp, Homo sapiens
ttgatctggaacccagact

SEQ ID NO: 3526607 - DNA, 11 bp, Homo sapiens
ttgatgactgc

SEQ ID NO: 3526608 - DNA, 21 bp, Homo sapiens
ttgatgactgccttgcctcct

SEQ ID NO: 3526609 - DNA, 16 bp, Homo sapiens
ttgatggagtgtgagc

SEQ ID NO: 3526610 - DNA, 17 bp, Homo sapiens
ttgatgggattctggac

SEQ ID NO: 3526611 - DNA, 14 bp, Homo sapiens
ttgatggggaagga

SEQ ID NO: 3526612 - DNA, 14 bp, Homo sapiens
ttgatgttacagat

SEQ ID NO: 3526613 - DNA, 13 bp, Homo sapiens
ttgatgttggctg

SEQ ID NO: 3526614 - DNA, 14 bp, Homo sapiens
ttgattacagtgca

SEQ ID NO: 3526615 - DNA, 13 bp, Homo sapiens
ttgattaggtatg

SEQ ID NO: 3526616 - DNA, 12 bp, Homo sapiens
ttgattcaaaat

SEQ ID NO: 3526617 - DNA, 22 bp, Homo sapiens
ttgattcaaaatatttaaaaat

SEQ ID NO: 3526618 - DNA, 14 bp, Homo sapiens
ttgattcagcctgt

SEQ ID NO: 3526619 - DNA, 19 bp, Homo sapiens
ttgattcatagtaacttct

SEQ ID NO: 3526620 - DNA, 12 bp, Homo sapiens
ttgattctcctt

SEQ ID NO: 3526621 - DNA, 13 bp, Homo sapiens
ttgattgatttga

SEQ ID NO: 3526622 - DNA, 20 bp, Homo sapiens
ttgattgttcgggtgtgcaa

SEQ ID NO: 3526623 - DNA, 12 bp, Homo sapiens
ttgattgtttac

SEQ ID NO: 3526624 - DNA, 14 bp, Homo sapiens
ttgattgtttacag

SEQ ID NO: 3526625 - DNA, 17 bp, Homo sapiens
ttgatttaaacacacag

SEQ ID NO: 3526626 - DNA, 13 bp, Homo sapiens
ttgatttgcattg

SEQ ID NO: 3526627 - DNA, 21 bp, Homo sapiens
ttgcaaagtattgtaaattat

SEQ ID NO: 3526628 - DNA, 12 bp, Homo sapiens
ttgcaaatcttg

SEQ ID NO: 3526629 - DNA, 15 bp, Homo sapiens
ttgcaaatcttgaaa

SEQ ID NO: 3526630 - DNA, 14 bp, Homo sapiens
ttgcaacctcgctg

SEQ ID NO: 3526631 - DNA, 22 bp, Homo sapiens
ttgcaagggaaaagtctcttgt

SEQ ID NO: 3526632 - DNA, 17 bp, Homo sapiens
ttgcaataatgcagtat

SEQ ID NO: 3526633 - DNA, 19 bp, Homo sapiens
ttgcacacccactcagctc

SEQ ID NO: 3526634 - DNA, 21 bp, Homo sapiens
ttgcacagaagtcctgtatgt

SEQ ID NO: 3526635 - DNA, 19 bp, Homo sapiens
ttgcacagggattctcaca

SEQ ID NO: 3526636 - DNA, 13 bp, Homo sapiens
ttgcacatgtctt

SEQ ID NO: 3526637 - DNA, 15 bp, Homo sapiens
ttgcacatgtcttaa

SEQ ID NO: 3526638 - DNA, 16 bp, Homo sapiens
ttgcacatgtcttaat

SEQ ID NO: 3526639 - DNA, 17 bp, Homo sapiens
ttgcacatgtcttaatg

SEQ ID NO: 3526640 - DNA, 21 bp, Homo sapiens
ttgcacatgtcttaatgaagt

SEQ ID NO: 3526641 - DNA, 18 bp, Homo sapiens
ttgcaccactgcactcca

SEQ ID NO: 3526642 - DNA, 21 bp, Homo sapiens
ttgcaccagttttatccataa

SEQ ID NO: 3526643 - DNA, 22 bp, Homo sapiens
ttgcaccagttttatccataat

SEQ ID NO: 3526644 - DNA, 23 bp, Homo sapiens
ttgcaccagttttatccataatg

SEQ ID NO: 3526645 - DNA, 15 bp, Homo sapiens
ttgcactaactgctg

SEQ ID NO: 3526646 - DNA, 15 bp, Homo sapiens
tttgattcatagtaa

SEQ ID NO: 3526647 - DNA, 20 bp, Homo sapiens
tttgattcatagtaacttct

SEQ ID NO: 3526648 - DNA, 15 bp, Homo sapiens
tttgattgatttgaa

SEQ ID NO: 3526649 - DNA, 19 bp, Homo sapiens
tttgattgtttacaggata

SEQ ID NO: 3526650 - DNA, 16 bp, Homo sapiens
tttgcaaagtactgta

SEQ ID NO: 3526651 - DNA, 14 bp, Homo sapiens
tttgcaacctcgct

SEQ ID NO: 3526652 - DNA, 13 bp, Homo sapiens
tttgcaataatgc

SEQ ID NO: 3526653 - DNA, 16 bp, Homo sapiens
tttgcaataatgcagt

SEQ ID NO: 3526654 - DNA, 19 bp, Homo sapiens
tttgcacatgtttcctcta

SEQ ID NO: 3526655 - DNA, 17 bp, Homo sapiens
tttgcactgtgtgctga

SEQ ID NO: 3526656 - DNA, 21 bp, Homo sapiens
tttgcacttgtgattatttat

SEQ ID NO: 3526657 - DNA, 17 bp, Homo sapiens
tttgcagaagagggtgt

SEQ ID NO: 3526658 - DNA, 17 bp, Homo sapiens
tttgcataacaattcct

SEQ ID NO: 3526659 - DNA, 20 bp, Homo sapiens
tttgcataacaattcctcta

SEQ ID NO: 3526660 - DNA, 18 bp, Homo sapiens
tttgcattaaattcacaa

SEQ ID NO: 3526661 - DNA, 22 bp, Homo sapiens
tttgccatgttggccaggctgg

SEQ ID NO: 3526662 - DNA, 22 bp, Homo sapiens
tttgcctccagaagcactggga

SEQ ID NO: 3526663 - DNA, 16 bp, Homo sapiens
tttgctcacctggggt

SEQ ID NO: 3526664 - DNA, 10 bp, Homo sapiens
tttgctgcca

SEQ ID NO: 3526665 - DNA, 15 bp, Homo sapiens
tttgctgccaaatgc

SEQ ID NO: 3526666 - DNA, 12 bp, Homo sapiens
tttgcttagaaa

SEQ ID NO: 3526667 - DNA, 14 bp, Homo sapiens
tttgcttctagagc

SEQ ID NO: 3526668 - DNA, 19 bp, Homo sapiens
tttgcttgctcatatgcat

SEQ ID NO: 3526669 - DNA, 15 bp, Homo sapiens
tttgctttgcccagc

SEQ ID NO: 3526670 - DNA, 20 bp, Homo sapiens
tttgctttttgcgtacacag

SEQ ID NO: 3526671 - DNA, 15 bp, Homo sapiens
tttggaaacaacatt

SEQ ID NO: 3526672 - DNA, 15 bp, Homo sapiens
tttggaagctcttct

SEQ ID NO: 3526673 - DNA, 19 bp, Homo sapiens
tttggacctaaatggcctc

SEQ ID NO: 3526674 - DNA, 19 bp, Homo sapiens
tttggagtgttatgtattt

SEQ ID NO: 3526675 - DNA, 15 bp, Homo sapiens
tttggatctgtgaca

SEQ ID NO: 3526676 - DNA, 14 bp, Homo sapiens
tttggattgtatat

SEQ ID NO: 3526677 - DNA, 14 bp, Homo sapiens
tttggcaaggaaag

SEQ ID NO: 3526678 - DNA, 23 bp, Homo sapiens
tttggcaaggaaaggggagaagg

SEQ ID NO: 3526679 - DNA, 22 bp, Homo sapiens
tttggctgaaattctcctggag

SEQ ID NO: 3526680 - DNA, 15 bp, Homo sapiens
tttggctgtgtctaa

SEQ ID NO: 3526681 - DNA, 17 bp, Homo sapiens
tttggcttgcttatgtg

SEQ ID NO: 3526682 - DNA, 20 bp, Homo sapiens
tttgggaagtgaagactgga

SEQ ID NO: 3526683 - DNA, 22 bp, Homo sapiens
tttgggaagtgaagactggaag

SEQ ID NO: 3526684 - DNA, 16 bp, Homo sapiens
tttgggaatatttgaa

SEQ ID NO: 3526685 - DNA, 15 bp, Homo sapiens
tttgggcttcagcct

SEQ ID NO: 3526686 - DNA, 22 bp, Homo sapiens
tttggggccgattgggagaaag

SEQ ID NO: 3526687 - DNA, 21 bp, Homo sapiens
tttggggtacccactgctctg

SEQ ID NO: 3526688 - DNA, 13 bp, Homo sapiens
tttgggtatgtta

SEQ ID NO: 3526689 - DNA, 13 bp, Homo sapiens
tttggtattgtat

SEQ ID NO: 3526690 - DNA, 14 bp, Homo sapiens
tttggttcctgtga

SEQ ID NO: 3526691 - DNA, 13 bp, Homo sapiens
tttggttctaata

SEQ ID NO: 3526692 - DNA, 19 bp, Homo sapiens
tttggttttgttcccctcc

SEQ ID NO: 3526693 - DNA, 22 bp, Homo sapiens
tttgtaaagttggttggataag

SEQ ID NO: 3526694 - DNA, 11 bp, Homo sapiens
tttgtaaattc

SEQ ID NO: 3526695 - DNA, 20 bp, Homo sapiens
tttgtaacccagattttgct

SEQ ID NO: 3526696 - DNA, 19 bp, Homo sapiens
tttgtaataacatttaatt

SEQ ID NO: 3526697 - DNA, 14 bp, Homo sapiens
tttgtaatgaattc

SEQ ID NO: 3526698 - DNA, 17 bp, Homo sapiens
tttgtaccagtgaattt

SEQ ID NO: 3526699 - DNA, 21 bp, Homo sapiens
tttgtatgaaattataatctg

SEQ ID NO: 3526700 - DNA, 17 bp, Homo sapiens
tttgtatttttttgcaa

SEQ ID NO: 3526701 - DNA, 19 bp, Homo sapiens
tttgtcgctcatgtgtgca

SEQ ID NO: 3526702 - DNA, 15 bp, Homo sapiens
tttgtctaaaatgcc

SEQ ID NO: 3526703 - DNA, 19 bp, Homo sapiens
tttgtctcatcccattctg

SEQ ID NO: 3526704 - DNA, 17 bp, Homo sapiens
tttgtctttaactgtca

SEQ ID NO: 3526705 - DNA, 14 bp, Homo sapiens
tttgtgctagaaat

SEQ ID NO: 3526706 - DNA, 21 bp, Homo sapiens
tttgtgctagaaattttcaag

SEQ ID NO: 3526707 - DNA, 21 bp, Homo sapiens
tttgtggccaaggagctgcta

SEQ ID NO: 3526708 - DNA, 14 bp, Homo sapiens
tttgtggtctaaag

SEQ ID NO: 3526709 - DNA, 16 bp, Homo sapiens
tttgtggtgatataga

SEQ ID NO: 3526710 - DNA, 20 bp, Homo sapiens
tttgtgtatttaacagggag

SEQ ID NO: 3526711 - DNA, 11 bp, Homo sapiens
tttgtgtcctc

SEQ ID NO: 3526712 - DNA, 18 bp, Homo sapiens
tttgtgtcctccaggagc

SEQ ID NO: 3526713 - DNA, 19 bp, Homo sapiens
tttgtgtcctccaggagct

SEQ ID NO: 3526714 - DNA, 20 bp, Homo sapiens
tttgtgttgttggaaaaagt

SEQ ID NO: 3526715 - DNA, 21 bp, Homo sapiens
tttgtgttgttggaaaaagtc

SEQ ID NO: 3526716 - DNA, 14 bp, Homo sapiens
tttgttaaaaataa

SEQ ID NO: 3526717 - DNA, 24 bp, Homo sapiens
tttgttaaaatacagttctgtcat

SEQ ID NO: 3526718 - DNA, 15 bp, Homo sapiens
tttgttattttgcaa

SEQ ID NO: 3526719 - DNA, 21 bp, Homo sapiens
tttgttccacttgtttgcact

SEQ ID NO: 3526720 - DNA, 16 bp, Homo sapiens
tttgttcccctcctcc

SEQ ID NO: 3526721 - DNA, 13 bp, Homo sapiens
tttgttcccggct

SEQ ID NO: 3526722 - DNA, 12 bp, Homo sapiens
tttgttctctgt

SEQ ID NO: 3526723 - DNA, 19 bp, Homo sapiens
tttgtttaatggacacttt

SEQ ID NO: 3526724 - DNA, 11 bp, Homo sapiens
tttgtttgttt

SEQ ID NO: 3526725 - DNA, 17 bp, Homo sapiens
ttttaaaaatagacact

SEQ ID NO: 3526726 - DNA, 15 bp, Homo sapiens
ttttaaaagacaaga

SEQ ID NO: 3526727 - DNA, 17 bp, Homo sapiens
ttttaaaataaactgta

SEQ ID NO: 3526728 - DNA, 23 bp, Homo sapiens
ttttaaaataaactgtaaactaa

SEQ ID NO: 3526729 - DNA, 18 bp, Homo sapiens
ttttaaattttgtaatga

SEQ ID NO: 3526730 - DNA, 14 bp, Homo sapiens
ttttaaccaaaggt

SEQ ID NO: 3526731 - DNA, 15 bp, Homo sapiens
ttttaaccaaaggtg

SEQ ID NO: 3526732 - DNA, 12 bp, Homo sapiens
ttttaactagaa

SEQ ID NO: 3526733 - DNA, 16 bp, Homo sapiens
ttttaactagaattta

SEQ ID NO: 3526734 - DNA, 18 bp, Homo sapiens
ttttaactcttttggaca

SEQ ID NO: 3526735 - DNA, 15 bp, Homo sapiens
ttttaagaggcaggg

SEQ ID NO: 3526736 - DNA, 21 bp, Homo sapiens
ttttaaggtctttcagtactt

SEQ ID NO: 3526737 - DNA, 20 bp, Homo sapiens
ttttaagtattgtttcctga

SEQ ID NO: 3526738 - DNA, 15 bp, Homo sapiens
ttttaatgaaaagga

SEQ ID NO: 3526739 - DNA, 14 bp, Homo sapiens
ttttacaattgaaa

SEQ ID NO: 3526740 - DNA, 15 bp, Homo sapiens
ttttacatactgctg

SEQ ID NO: 3526741 - DNA, 15 bp, Homo sapiens
ttttacatggagaaa

SEQ ID NO: 3526742 - DNA, 9 bp, Homo sapiens
ttttacatt

SEQ ID NO: 3526743 - DNA, 21 bp, Homo sapiens
ttttaccctgaggtcactgct

SEQ ID NO: 3526744 - DNA, 15 bp, Homo sapiens
ttttacctgctgctt

SEQ ID NO: 3526745 - DNA, 19 bp, Homo sapiens
ttttactaagttttcaaat

SEQ ID NO: 3526746 - DNA, 19 bp, Homo sapiens
ttttactagaaatgggaat

SEQ ID NO: 3526747 - DNA, 18 bp, Homo sapiens
ttttactattaacatgat

SEQ ID NO: 3526748 - DNA, 21 bp, Homo sapiens
ttttagacagtctcactttgt

SEQ ID NO: 3526749 - DNA, 21 bp, Homo sapiens
ttttagaccctattgctgctt

SEQ ID NO: 3526750 - DNA, 21 bp, Homo sapiens
ttttagagaatgtgtttcaaa

SEQ ID NO: 3526751 - DNA, 23 bp, Homo sapiens
ttttagagaatgtgtttcaaaac

SEQ ID NO: 3526752 - DNA, 19 bp, Homo sapiens
ttttaggatacttaacaaa

SEQ ID NO: 3526753 - DNA, 15 bp, Homo sapiens
ttttaggtagaaaaa

SEQ ID NO: 3526754 - DNA, 14 bp, Homo sapiens
ttttagtaatttct

SEQ ID NO: 3526755 - DNA, 15 bp, Homo sapiens
ttttagtagagacag

SEQ ID NO: 3526756 - DNA, 13 bp, Homo sapiens
ttttatactcttt

SEQ ID NO: 3526757 - DNA, 13 bp, Homo sapiens
ttttatgatcagt

SEQ ID NO: 3526758 - DNA, 12 bp, Homo sapiens
ttttattaagaa

SEQ ID NO: 3526759 - DNA, 13 bp, Homo sapiens
ttttattcagcag

SEQ ID NO: 3526760 - DNA, 18 bp, Homo sapiens
ttttattgacacagaaaa

SEQ ID NO: 3526761 - DNA, 15 bp, Homo sapiens
ttttattgccttctc

SEQ ID NO: 3526762 - DNA, 23 bp, Homo sapiens
ttttattgccttctcaccagctg

SEQ ID NO: 3526763 - DNA, 13 bp, Homo sapiens
ttttattttggaa

SEQ ID NO: 3526764 - DNA, 15 bp, Homo sapiens
ttttcaaaagataat

SEQ ID NO: 3526765 - DNA, 20 bp, Homo sapiens
ttttcaaaatagaaaagtta

SEQ ID NO: 3526766 - DNA, 15 bp, Homo sapiens
ttttcaactttgaat

SEQ ID NO: 3526767 - DNA, 16 bp, Homo sapiens
ttttcaactttgaata

SEQ ID NO: 3526768 - DNA, 21 bp, Homo sapiens
ttttcaaggccttcagtttat

SEQ ID NO: 3526769 - DNA, 18 bp, Homo sapiens
ttttcacattagaagaca

SEQ ID NO: 3526770 - DNA, 19 bp, Homo sapiens
ttttcacggaagttttcaa

SEQ ID NO: 3526771 - DNA, 18 bp, Homo sapiens
ttttcagatgtgaaccat

SEQ ID NO: 3526772 - DNA, 23 bp, Homo sapiens
ttttcaggctcgccaaggcctag

SEQ ID NO: 3526773 - DNA, 13 bp, Homo sapiens
ttttcatcccctt

SEQ ID NO: 3526774 - DNA, 21 bp, Homo sapiens
ttttcatcttctctggcgaca

SEQ ID NO: 3526775 - DNA, 19 bp, Homo sapiens
ttttcattgaggataaatt

SEQ ID NO: 3526776 - DNA, 18 bp, Homo sapiens
ttttccaaagaaaagtat

SEQ ID NO: 3526777 - DNA, 21 bp, Homo sapiens
ttttccaacttggctgcagga

SEQ ID NO: 3526778 - DNA, 21 bp, Homo sapiens
ttttccatggcaggaaggctt

SEQ ID NO: 3526779 - DNA, 20 bp, Homo sapiens
agacaatcactgccaacccc

SEQ ID NO: 3526780 - DNA, 16 bp, Homo sapiens
agacaattgacaacag

SEQ ID NO: 3526781 - DNA, 15 bp, Homo sapiens
agacacaacaactcc

SEQ ID NO: 3526782 - DNA, 11 bp, Homo sapiens
agacacacaca

SEQ ID NO: 3526783 - DNA, 12 bp, Homo sapiens
agacacacacac

SEQ ID NO: 3526784 - DNA, 13 bp, Homo sapiens
agacacacacaca

SEQ ID NO: 3526785 - DNA, 20 bp, Homo sapiens
agacacaggcccggctccag

SEQ ID NO: 3526786 - DNA, 21 bp, Homo sapiens
gccaagccatgggtagcctgg

SEQ ID NO: 3526787 - DNA, 16 bp, Homo sapiens
gccaaggaatgatcca

SEQ ID NO: 3526788 - DNA, 17 bp, Homo sapiens
gccacgttcagggaggg

SEQ ID NO: 3526789 - DNA, 17 bp, Homo sapiens
gccagccatctttggca

SEQ ID NO: 3526790 - DNA, 19 bp, Homo sapiens
gccagcccaaaccttgggc

SEQ ID NO: 3526791 - DNA, 13 bp, Homo sapiens
gccagggaggcag

SEQ ID NO: 3526792 - DNA, 23 bp, Homo sapiens
gccagggaggcagagcgggaggg

SEQ ID NO: 3526793 - DNA, 13 bp, Homo sapiens
gccatcagccatg

SEQ ID NO: 3526794 - DNA, 12 bp, Homo sapiens
gccatgggaggc

SEQ ID NO: 3526795 - DNA, 15 bp, Homo sapiens
gccatgggaggcctt

SEQ ID NO: 3526796 - DNA, 20 bp, Homo sapiens
gccccaggcccgcgggcaca

SEQ ID NO: 3526797 - DNA, 14 bp, Homo sapiens
gccccaggggacgt

SEQ ID NO: 3526798 - DNA, 21 bp, Homo sapiens
gccccaggggacgtgggccct

SEQ ID NO: 3526799 - DNA, 23 bp, Homo sapiens
gccccaggggacgtgggccctgc

SEQ ID NO: 3526800 - DNA, 19 bp, Homo sapiens
gccccatggacaacactaa

SEQ ID NO: 3526801 - DNA, 13 bp, Homo sapiens
gcccccccagccc

SEQ ID NO: 3526802 - DNA, 23 bp, Homo sapiens
gcccccgacccccgcagaggcag

SEQ ID NO: 3526803 - DNA, 15 bp, Homo sapiens
gcccccgggacaccg

SEQ ID NO: 3526804 - DNA, 19 bp, Homo sapiens
gcccctgtaaggtttcaat

SEQ ID NO: 3526805 - DNA, 15 bp, Homo sapiens
gcccgcgggcacagc

SEQ ID NO: 3526806 - DNA, 16 bp, Homo sapiens
gccctccctcagccgt

SEQ ID NO: 3526807 - DNA, 23 bp, Homo sapiens
gccctccctcagccgtcagccat

SEQ ID NO: 3526808 - DNA, 18 bp, Homo sapiens
gccctgaggggctgggga

SEQ ID NO: 3526809 - DNA, 20 bp, Homo sapiens
gccctgaggggctggggagg

SEQ ID NO: 3526810 - DNA, 22 bp, Homo sapiens
gccctgaggggctggggagggg

SEQ ID NO: 3526811 - DNA, 17 bp, Homo sapiens
gccctgcaggctgcagg

SEQ ID NO: 3526812 - DNA, 22 bp, Homo sapiens
gccctgcaggctgcaggagggc

SEQ ID NO: 3526813 - DNA, 17 bp, Homo sapiens
gccctggaagagtcctc

SEQ ID NO: 3526814 - DNA, 21 bp, Homo sapiens
gccctggtgaccagaccaagg

SEQ ID NO: 3526815 - DNA, 14 bp, Homo sapiens
gcccttttgtctct

SEQ ID NO: 3526816 - DNA, 13 bp, Homo sapiens
gccggctggcctg

SEQ ID NO: 3526817 - DNA, 19 bp, Homo sapiens
gccggctggcctggaggct

SEQ ID NO: 3526818 - DNA, 22 bp, Homo sapiens
gccggctggcctggaggctcag

SEQ ID NO: 3526819 - DNA, 13 bp, Homo sapiens
gccgtcagccatc

SEQ ID NO: 3526820 - DNA, 19 bp, Homo sapiens
gccgtcagccatcagccat

SEQ ID NO: 3526821 - DNA, 13 bp, Homo sapiens
gcctcaggcactc

SEQ ID NO: 3526822 - DNA, 19 bp, Homo sapiens
gcctccccaacttgagcct

SEQ ID NO: 3526823 - DNA, 14 bp, Homo sapiens
gcctcggtggccct

SEQ ID NO: 3526824 - DNA, 14 bp, Homo sapiens
gcctctgagagcat

SEQ ID NO: 3526825 - DNA, 16 bp, Homo sapiens
gcctctgagagcatca

SEQ ID NO: 3526826 - DNA, 20 bp, Homo sapiens
gcctgactgccaagccatgg

SEQ ID NO: 3526827 - DNA, 19 bp, Homo sapiens
gcctgcttttgtgtcccat

SEQ ID NO: 3526828 - DNA, 10 bp, Homo sapiens
gtctcaggag

SEQ ID NO: 3526829 - DNA, 16 bp, Homo sapiens
gtctcaggaggaggct

SEQ ID NO: 3526830 - DNA, 16 bp, Homo sapiens
gtctgattgaaacatg

SEQ ID NO: 3526831 - DNA, 22 bp, Homo sapiens
gtctgttttcccaacctcctgt

SEQ ID NO: 3526832 - DNA, 20 bp, Homo sapiens
gtcttctaatgtaaatttta

SEQ ID NO: 3526833 - DNA, 17 bp, Homo sapiens
gtctttattagtaacat

SEQ ID NO: 3526834 - DNA, 16 bp, Homo sapiens
gtgaaaggcctgcttt

SEQ ID NO: 3526835 - DNA, 15 bp, Homo sapiens
gtgacaatctgcctt

SEQ ID NO: 3526836 - DNA, 15 bp, Homo sapiens
gtgactaagttgcaa

SEQ ID NO: 3526837 - DNA, 17 bp, Homo sapiens
gtgactcagcagaggca

SEQ ID NO: 3526838 - DNA, 20 bp, Homo sapiens
gtgactcgggggctgtctca

SEQ ID NO: 3526839 - DNA, 14 bp, Homo sapiens
gtgagaggggaggg

SEQ ID NO: 3526840 - DNA, 22 bp, Homo sapiens
gtgagtactcataaaggacact

SEQ ID NO: 3526841 - DNA, 22 bp, Homo sapiens
gtgagtctccccttgcagcctg

SEQ ID NO: 3526842 - DNA, 15 bp, Homo sapiens
gtgatggccagagga

SEQ ID NO: 3526843 - DNA, 12 bp, Homo sapiens
gtgccagccaat

SEQ ID NO: 3526844 - DNA, 18 bp, Homo sapiens
gtggacggcgctgcctca

SEQ ID NO: 3526845 - DNA, 15 bp, Homo sapiens
gtggagctgagaaga

SEQ ID NO: 3526846 - DNA, 17 bp, Homo sapiens
gtggagctgagaagagg

SEQ ID NO: 3526847 - DNA, 22 bp, Homo sapiens
gtggagctgagaagaggaggag

SEQ ID NO: 3526848 - DNA, 17 bp, Homo sapiens
gtggatctccccctcat

SEQ ID NO: 3526849 - DNA, 19 bp, Homo sapiens
gtggccaccgggggtggct

SEQ ID NO: 3526850 - DNA, 22 bp, Homo sapiens
gtggccaccgggggtggctctg

SEQ ID NO: 3526851 - DNA, 20 bp, Homo sapiens
gtggccacgttcagggaggg

SEQ ID NO: 3526852 - DNA, 23 bp, Homo sapiens
gtggccctgactgtcagggaggg

SEQ ID NO: 3526853 - DNA, 17 bp, Homo sapiens
gtggccttaactgttca

SEQ ID NO: 3526854 - DNA, 13 bp, Homo sapiens
gtgggcccaggga

SEQ ID NO: 3526855 - DNA, 16 bp, Homo sapiens
gtgtatgcactgctca

SEQ ID NO: 3526856 - DNA, 12 bp, Homo sapiens
gtgtgaccagtt

SEQ ID NO: 3526857 - DNA, 23 bp, Homo sapiens
gtgtttaattttggagtaacgtt

SEQ ID NO: 3526858 - DNA, 12 bp, Homo sapiens
gttacttccctt

SEQ ID NO: 3526859 - DNA, 14 bp, Homo sapiens
gttacttccctttc

SEQ ID NO: 3526860 - DNA, 17 bp, Homo sapiens
gttagtagcagaaatat

SEQ ID NO: 3526861 - DNA, 16 bp, Homo sapiens
gttcagggaggggccg

SEQ ID NO: 3526862 - DNA, 19 bp, Homo sapiens
gttctataaacaggcttgg

SEQ ID NO: 3526863 - DNA, 23 bp, Homo sapiens
gttctgaggggtgtccgagaggc

SEQ ID NO: 3526864 - DNA, 23 bp, Homo sapiens
gttcttagattcaggggaagggc

SEQ ID NO: 3526865 - DNA, 19 bp, Homo sapiens
gttgaggaagtcaggctgt

SEQ ID NO: 3526866 - DNA, 12 bp, Homo sapiens
gttggaaagaac

SEQ ID NO: 3526867 - DNA, 17 bp, Homo sapiens
gttggaaagaacattta

SEQ ID NO: 3526868 - DNA, 13 bp, Homo sapiens
gttggtcccaagt

SEQ ID NO: 3526869 - DNA, 18 bp, Homo sapiens
gttgtgggtagtggggaa

SEQ ID NO: 3526870 - DNA, 16 bp, Homo sapiens
gtttaatattccaata

SEQ ID NO: 3526871 - DNA, 22 bp, Homo sapiens
gtttgtacaaactatttcagaa

SEQ ID NO: 3526872 - DNA, 16 bp, Homo sapiens
gttttatttatgaagt

SEQ ID NO: 3526873 - DNA, 18 bp, Homo sapiens
gtttttattttaaacatt

SEQ ID NO: 3526874 - DNA, 20 bp, Homo sapiens
gtttttattttaaacatttt

SEQ ID NO: 3526875 - DNA, 12 bp, Homo sapiens
taaaaaatcaag

SEQ ID NO: 3526876 - DNA, 13 bp, Homo sapiens
taaaaacagaaaa

SEQ ID NO: 3526877 - DNA, 11 bp, Homo sapiens
taaaagagctt

SEQ ID NO: 3526878 - DNA, 12 bp, Homo sapiens
taaaagagcttt

SEQ ID NO: 3526879 - DNA, 20 bp, Homo sapiens
taaaatctgctgatctctgt

SEQ ID NO: 3526880 - DNA, 14 bp, Homo sapiens
taaaattaaataaa

SEQ ID NO: 3526881 - DNA, 17 bp, Homo sapiens
taaaattaaataaattt

SEQ ID NO: 3526882 - DNA, 11 bp, Homo sapiens
taaacattttt

SEQ ID NO: 3526883 - DNA, 19 bp, Homo sapiens
taaacttgcacatttgaat

SEQ ID NO: 3526884 - DNA, 15 bp, Homo sapiens
taaaggatgagattt

SEQ ID NO: 3526885 - DNA, 22 bp, Homo sapiens
taaaggatgagatttttcatgt

SEQ ID NO: 3526886 - DNA, 23 bp, Homo sapiens
taaaggatgagatttttcatgta

SEQ ID NO: 3526887 - DNA, 15 bp, Homo sapiens
taaagtaggaaagaa

SEQ ID NO: 3526888 - DNA, 16 bp, Homo sapiens
taaagtaggaaagaat

SEQ ID NO: 3526889 - DNA, 15 bp, Homo sapiens
taaataaattttaat

SEQ ID NO: 3526890 - DNA, 16 bp, Homo sapiens
taaattactaattatc

SEQ ID NO: 3526891 - DNA, 17 bp, Homo sapiens
taaattactaattatct

SEQ ID NO: 3526892 - DNA, 12 bp, Homo sapiens
taaattcaatgc

SEQ ID NO: 3526893 - DNA, 16 bp, Homo sapiens
taaattttaatgttaa

SEQ ID NO: 3526894 - DNA, 12 bp, Homo sapiens
taaattttaatt

SEQ ID NO: 3526895 - DNA, 15 bp, Homo sapiens
taaatttttaaaatc

SEQ ID NO: 3526896 - DNA, 18 bp, Homo sapiens
taacctgttgctccagga

SEQ ID NO: 3526897 - DNA, 16 bp, Homo sapiens
taacgttttccttgtg

SEQ ID NO: 3526898 - DNA, 20 bp, Homo sapiens
taactggagaccagaaacct

SEQ ID NO: 3526899 - DNA, 21 bp, Homo sapiens
taagtatctcaacaacatgtc

SEQ ID NO: 3526900 - DNA, 15 bp, Homo sapiens
taagtgtgaccagtt

SEQ ID NO: 3526901 - DNA, 18 bp, Homo sapiens
taagttgcaagatcttat

SEQ ID NO: 3526902 - DNA, 11 bp, Homo sapiens
taatattccaa

SEQ ID NO: 3526903 - DNA, 20 bp, Homo sapiens
taatgactgagatttgtaaa

SEQ ID NO: 3526904 - DNA, 23 bp, Homo sapiens
taatggactcttaaggcattgag

SEQ ID NO: 3526905 - DNA, 17 bp, Homo sapiens
taatgtaaattttaatg

SEQ ID NO: 3526906 - DNA, 16 bp, Homo sapiens
taatgtatacttgaaa

SEQ ID NO: 3526907 - DNA, 15 bp, Homo sapiens
taatgttaactttca

SEQ ID NO: 3526908 - DNA, 18 bp, Homo sapiens
taattaaaaacagaaaat

SEQ ID NO: 3526909 - DNA, 19 bp, Homo sapiens
taattaaaaacagaaaatt

SEQ ID NO: 3526910 - DNA, 21 bp, Homo sapiens
taattttggttgtaattaaat

SEQ ID NO: 3526911 - DNA, 23 bp, Homo sapiens
taattttttaagggatgttgcaa

SEQ ID NO: 3526912 - DNA, 19 bp, Homo sapiens
tacaaatgaagtatttcat

SEQ ID NO: 3526913 - DNA, 21 bp, Homo sapiens
tacaaatgaagtatttcatgt

SEQ ID NO: 3526914 - DNA, 17 bp, Homo sapiens
tacaaggtgttgttaaa

SEQ ID NO: 3526915 - DNA, 13 bp, Homo sapiens
tacaataaaagag

SEQ ID NO: 3526916 - DNA, 16 bp, Homo sapiens
tacaataaaagagctt

SEQ ID NO: 3526917 - DNA, 17 bp, Homo sapiens
tacaataaaagagcttt

SEQ ID NO: 3526918 - DNA, 14 bp, Homo sapiens
tacaccaaacattt

SEQ ID NO: 3526919 - DNA, 16 bp, Homo sapiens
tacaccaaacatttct

SEQ ID NO: 3526920 - DNA, 13 bp, Homo sapiens
tacacttaaactt

SEQ ID NO: 3526921 - DNA, 24 bp, Homo sapiens
tacagaaaatttgcaacatataaa

SEQ ID NO: 3526922 - DNA, 18 bp, Homo sapiens
tacagagactctccctga

SEQ ID NO: 3526923 - DNA, 16 bp, Homo sapiens
tacataggttaatttt

SEQ ID NO: 3526924 - DNA, 16 bp, Homo sapiens
taccatgacatgaaga

SEQ ID NO: 3526925 - DNA, 23 bp, Homo sapiens
taccatttttttttaacactgtc

SEQ ID NO: 3526926 - DNA, 17 bp, Homo sapiens
tacccagatgttttatt

SEQ ID NO: 3526927 - DNA, 14 bp, Homo sapiens
tacctcttatgagc

SEQ ID NO: 3526928 - DNA, 20 bp, Homo sapiens
tacctcttccgttggaaaga

SEQ ID NO: 3526929 - DNA, 21 bp, Homo sapiens
tacctcttccgttggaaagaa

SEQ ID NO: 3526930 - DNA, 22 bp, Homo sapiens
tacctcttccgttggaaagaac

SEQ ID NO: 3526931 - DNA, 16 bp, Homo sapiens
tacctggctggagacc

SEQ ID NO: 3526932 - DNA, 19 bp, Homo sapiens
tacctggctggagaccgag

SEQ ID NO: 3526933 - DNA, 19 bp, Homo sapiens
tactacataggttaatttt

SEQ ID NO: 3526934 - DNA, 21 bp, Homo sapiens
tactcctgttagtagcagaaa

SEQ ID NO: 3526935 - DNA, 20 bp, Homo sapiens
tactgaaaaaatgctgagcc

SEQ ID NO: 3526936 - DNA, 15 bp, Homo sapiens
tacttccccacccct

SEQ ID NO: 3526937 - DNA, 14 bp, Homo sapiens
tacttgaaaaatgt

SEQ ID NO: 3526938 - DNA, 22 bp, Homo sapiens
tacttgaaaaatgttataactt

SEQ ID NO: 3526939 - DNA, 14 bp, Homo sapiens
ttttgcttttatga

SEQ ID NO: 3526940 - DNA, 11 bp, Homo sapiens
ttttgtctctg

SEQ ID NO: 3526941 - DNA, 14 bp, Homo sapiens
ttttgttttttaac

SEQ ID NO: 3526942 - DNA, 22 bp, Homo sapiens
tttttaacaagtcatttcaaaa

SEQ ID NO: 3526943 - DNA, 19 bp, Homo sapiens
tttttcatatgtggaaata

SEQ ID NO: 3526944 - DNA, 20 bp, Homo sapiens
tttttcatatgtggaaatat

SEQ ID NO: 3526945 - DNA, 21 bp, Homo sapiens
tgccctgaggggctggggagg

SEQ ID NO: 3526946 - DNA, 14 bp, Homo sapiens
tgccctgctgccct

SEQ ID NO: 3526947 - DNA, 22 bp, Homo sapiens
tgcctcggtggccctgactgtc

SEQ ID NO: 3526948 - DNA, 23 bp, Homo sapiens
tgcgtgtgggaggctggggaccc

SEQ ID NO: 3526949 - DNA, 16 bp, Homo sapiens
tgctaccaatctgtga

SEQ ID NO: 3526950 - DNA, 14 bp, Homo sapiens
tgctatttacaaat

SEQ ID NO: 3526951 - DNA, 20 bp, Homo sapiens
tgctctatgtcctagtaact

SEQ ID NO: 3526952 - DNA, 20 bp, Homo sapiens
tgctgaccggaatggtcaaa

SEQ ID NO: 3526953 - DNA, 12 bp, Homo sapiens
tgctgagccagc

SEQ ID NO: 3526954 - DNA, 19 bp, Homo sapiens
tgctgagccagccatcttt

SEQ ID NO: 3526955 - DNA, 23 bp, Homo sapiens
tgctgccctccccctcctctcca

SEQ ID NO: 3526956 - DNA, 20 bp, Homo sapiens
tgctgctctaggcccacaag

SEQ ID NO: 3526957 - DNA, 16 bp, Homo sapiens
tgctggtagctgaggg

SEQ ID NO: 3526958 - DNA, 18 bp, Homo sapiens
tgctgttaacagctgtca

SEQ ID NO: 3526959 - DNA, 19 bp, Homo sapiens
tgctgttaacagctgtcaa

SEQ ID NO: 3526960 - DNA, 17 bp, Homo sapiens
tgctgttagaatatgtt

SEQ ID NO: 3526961 - DNA, 14 bp, Homo sapiens
tgctgtttgtacaa

SEQ ID NO: 3526962 - DNA, 20 bp, Homo sapiens
tgcttgctaccaatctgtga

SEQ ID NO: 3526963 - DNA, 22 bp, Homo sapiens
tgcttgctaccaatctgtgaga

SEQ ID NO: 3526964 - DNA, 12 bp, Homo sapiens
tgcttttgtgtc

SEQ ID NO: 3526965 - DNA, 15 bp, Homo sapiens
tgcttttgtgtccca

SEQ ID NO: 3526966 - DNA, 23 bp, Homo sapiens
tggaatgcttctgcatcaaagga

SEQ ID NO: 3526967 - DNA, 22 bp, Homo sapiens
tggactccacgatgcctttgag

SEQ ID NO: 3526968 - DNA, 14 bp, Homo sapiens
tggagctgagaaga

SEQ ID NO: 3526969 - DNA, 20 bp, Homo sapiens
tggaggctcagcccaccctc

SEQ ID NO: 3526970 - DNA, 19 bp, Homo sapiens
tggagtaacgttttccttg

SEQ ID NO: 3526971 - DNA, 19 bp, Homo sapiens
tggatcaagttcagccacc

SEQ ID NO: 3526972 - DNA, 22 bp, Homo sapiens
tggatgatccccacgccacagc

SEQ ID NO: 3526973 - DNA, 13 bp, Homo sapiens
tggatttttacca

SEQ ID NO: 3526974 - DNA, 21 bp, Homo sapiens
tggcaagagcgttactgtaga

SEQ ID NO: 3526975 - DNA, 22 bp, Homo sapiens
tggcaagagcgttactgtagac

SEQ ID NO: 3526976 - DNA, 19 bp, Homo sapiens
tggccacgttcagggaggg

SEQ ID NO: 3526977 - DNA, 22 bp, Homo sapiens
tggccacgttcagggaggggcc

SEQ ID NO: 3526978 - DNA, 15 bp, Homo sapiens
tggccatgggaggcc

SEQ ID NO: 3526979 - DNA, 22 bp, Homo sapiens
tggccatgggaggcctttccct

SEQ ID NO: 3526980 - DNA, 23 bp, Homo sapiens
tggccatgggaggcctttcccta

SEQ ID NO: 3526981 - DNA, 16 bp, Homo sapiens
tggcccccccagcccc

SEQ ID NO: 3526982 - DNA, 14 bp, Homo sapiens
tggcctggaggctc

SEQ ID NO: 3526983 - DNA, 21 bp, Homo sapiens
tggcctggaggctcagcccac

SEQ ID NO: 3526984 - DNA, 16 bp, Homo sapiens
tggccttaactgttca

SEQ ID NO: 3526985 - DNA, 18 bp, Homo sapiens
tggccttgcctcggtggc

SEQ ID NO: 3526986 - DNA, 11 bp, Homo sapiens
tggctggagac

SEQ ID NO: 3526987 - DNA, 18 bp, Homo sapiens
tggctgttcctgattttt

SEQ ID NO: 3526988 - DNA, 11 bp, Homo sapiens
tgggaggagac

SEQ ID NO: 3526989 - DNA, 20 bp, Homo sapiens
tgggaggatcctgagctgct

SEQ ID NO: 3526990 - DNA, 19 bp, Homo sapiens
tgggaggctggggacccag

SEQ ID NO: 3526991 - DNA, 22 bp, Homo sapiens
tgggccctgcaggctgcaggag

SEQ ID NO: 3526992 - DNA, 23 bp, Homo sapiens
tgggcgcagaggcttttccagtg

SEQ ID NO: 3526993 - DNA, 22 bp, Homo sapiens
tgggcttaattcccccaagcag

SEQ ID NO: 3526994 - DNA, 11 bp, Homo sapiens
tggggacccag

SEQ ID NO: 3526995 - DNA, 13 bp, Homo sapiens
tggggacccagac

SEQ ID NO: 3526996 - DNA, 17 bp, Homo sapiens
tggggagaaaagacaaa

SEQ ID NO: 3526997 - DNA, 11 bp, Homo sapiens
tggggaggggg

SEQ ID NO: 3526998 - DNA, 13 bp, Homo sapiens
tggggcccctccc

SEQ ID NO: 3526999 - DNA, 17 bp, Homo sapiens
tgggggctggaggtgct

SEQ ID NO: 3527000 - DNA, 19 bp, Homo sapiens
tgggggctttcggggaggg

SEQ ID NO: 3527001 - DNA, 19 bp, Homo sapiens
tggggtgatggccagagga

SEQ ID NO: 3527002 - DNA, 20 bp, Homo sapiens
tgggtaattaaaaacagaaa

SEQ ID NO: 3527003 - DNA, 17 bp, Homo sapiens
tgggttctctgctgtcc

SEQ ID NO: 3527004 - DNA, 14 bp, Homo sapiens
tggtagctgagggg

SEQ ID NO: 3527005 - DNA, 21 bp, Homo sapiens
tggtagctgaggggacgggca

SEQ ID NO: 3527006 - DNA, 23 bp, Homo sapiens
tggtgaaaccaaacaaatacaaa

SEQ ID NO: 3527007 - DNA, 19 bp, Homo sapiens
tggtgctaaagattgttaa

SEQ ID NO: 3527008 - DNA, 21 bp, Homo sapiens
tggtgctaaagattgttaaat

SEQ ID NO: 3527009 - DNA, 18 bp, Homo sapiens
tgtaaatctttgtgaaca

SEQ ID NO: 3527010 - DNA, 23 bp, Homo sapiens
tgtaaattttaatgttaactttc

SEQ ID NO: 3527011 - DNA, 23 bp, Homo sapiens
tgtaatgtatacttgaaaaatgt

SEQ ID NO: 3527012 - DNA, 12 bp, Homo sapiens
tgtaattaaatt

SEQ ID NO: 3527013 - DNA, 13 bp, Homo sapiens
tgtaattaaattt

SEQ ID NO: 3527014 - DNA, 14 bp, Homo sapiens
tgtaattaaatttt

SEQ ID NO: 3527015 - DNA, 18 bp, Homo sapiens
tgtacaaactatttcaga

SEQ ID NO: 3527016 - DNA, 13 bp, Homo sapiens
tgtaggtcactct

SEQ ID NO: 3527017 - DNA, 22 bp, Homo sapiens
tgtaggtcactctccagcagtt

SEQ ID NO: 3527018 - DNA, 19 bp, Homo sapiens
tgtatacacttaaacttgc

SEQ ID NO: 3527019 - DNA, 14 bp, Homo sapiens
tgtatacttgaaaa

SEQ ID NO: 3527020 - DNA, 11 bp, Homo sapiens
tgtattgtaat

SEQ ID NO: 3527021 - DNA, 23 bp, Homo sapiens
tgtcagacgttggtcccaagttt

SEQ ID NO: 3527022 - DNA, 14 bp, Homo sapiens
tgtcagggagggcc

SEQ ID NO: 3527023 - DNA, 17 bp, Homo sapiens
tgtcagggagggccagg

SEQ ID NO: 3527024 - DNA, 22 bp, Homo sapiens
tgtcagggagggccagggaggc

SEQ ID NO: 3527025 - DNA, 22 bp, Homo sapiens
tgtccaaagctgaaaatgtgta

SEQ ID NO: 3527026 - DNA, 22 bp, Homo sapiens
tgtctaaaggatgagatttttc

SEQ ID NO: 3527027 - DNA, 15 bp, Homo sapiens
tgtctctagcagtga

SEQ ID NO: 3527028 - DNA, 17 bp, Homo sapiens
tgtctctagcagtgagt

SEQ ID NO: 3527029 - DNA, 18 bp, Homo sapiens
tgtctctagcagtgagta

SEQ ID NO: 3527030 - DNA, 19 bp, Homo sapiens
tgtctgtgaagtgagacct

SEQ ID NO: 3527031 - DNA, 13 bp, Homo sapiens
tgtgaatgtgagt

SEQ ID NO: 3527032 - DNA, 16 bp, Homo sapiens
tgtgaccttgggacca

SEQ ID NO: 3527033 - DNA, 19 bp, Homo sapiens
tgtgactaagttgcaagat

SEQ ID NO: 3527034 - DNA, 16 bp, Homo sapiens
tgtgactcagcagagg

SEQ ID NO: 3527035 - DNA, 19 bp, Homo sapiens
tgtgactcagcagaggcag

SEQ ID NO: 3527036 - DNA, 12 bp, Homo sapiens
tgtgagaagttt

SEQ ID NO: 3527037 - DNA, 12 bp, Homo sapiens
tgtgatgaaaag

SEQ ID NO: 3527038 - DNA, 15 bp, Homo sapiens
tatcatataaaattt

SEQ ID NO: 3527039 - DNA, 13 bp, Homo sapiens
tatcccccaccaa

SEQ ID NO: 3527040 - DNA, 17 bp, Homo sapiens
tatccttctctttcaat

SEQ ID NO: 3527041 - DNA, 16 bp, Homo sapiens
tatctactgactgaaa

SEQ ID NO: 3527042 - DNA, 19 bp, Homo sapiens
tatctactgactgaaatca

SEQ ID NO: 3527043 - DNA, 21 bp, Homo sapiens
tatctactgactgaaatcagt

SEQ ID NO: 3527044 - DNA, 17 bp, Homo sapiens
tatctcaacaacatgtc

SEQ ID NO: 3527045 - DNA, 18 bp, Homo sapiens
tatctcaacaacatgtca

SEQ ID NO: 3527046 - DNA, 16 bp, Homo sapiens
tatcttatagtcactc

SEQ ID NO: 3527047 - DNA, 21 bp, Homo sapiens
tatcttatctactgactgaaa

SEQ ID NO: 3527048 - DNA, 18 bp, Homo sapiens
tatgaagtaaagtttctg

SEQ ID NO: 3527049 - DNA, 20 bp, Homo sapiens
tatgaagtttttattttaaa

SEQ ID NO: 3527050 - DNA, 16 bp, Homo sapiens
tatgaggggacccagc

SEQ ID NO: 3527051 - DNA, 15 bp, Homo sapiens
tatgctgtttgtaca

SEQ ID NO: 3527052 - DNA, 20 bp, Homo sapiens
tatgtgctgttagaatatgt

SEQ ID NO: 3527053 - DNA, 13 bp, Homo sapiens
tatgtggaaatat

SEQ ID NO: 3527054 - DNA, 17 bp, Homo sapiens
tatgtgtatctcacact

SEQ ID NO: 3527055 - DNA, 18 bp, Homo sapiens
tattaactaggtatgaag

SEQ ID NO: 3527056 - DNA, 14 bp, Homo sapiens
tattgacacaccca

SEQ ID NO: 3527057 - DNA, 15 bp, Homo sapiens
tattgcctctgagag

SEQ ID NO: 3527058 - DNA, 21 bp, Homo sapiens
tattgtaatgtatacttgaaa

SEQ ID NO: 3527059 - DNA, 18 bp, Homo sapiens
tattgtctgattgaaaca

SEQ ID NO: 3527060 - DNA, 14 bp, Homo sapiens
tatttacaaatgaa

SEQ ID NO: 3527061 - DNA, 13 bp, Homo sapiens
tatttatgaagtt

SEQ ID NO: 3527062 - DNA, 15 bp, Homo sapiens
tatttatttatgcta

SEQ ID NO: 3527063 - DNA, 14 bp, Homo sapiens
tattttaaacattt

SEQ ID NO: 3527064 - DNA, 14 bp, Homo sapiens
tcaaaatatgtgta

SEQ ID NO: 3527065 - DNA, 23 bp, Homo sapiens
tcaaatctctccacctctagtca

SEQ ID NO: 3527066 - DNA, 20 bp, Homo sapiens
tcaaggagtcttctaatgta

SEQ ID NO: 3527067 - DNA, 17 bp, Homo sapiens
tcaagtagattggctgg

SEQ ID NO: 3527068 - DNA, 16 bp, Homo sapiens
tcaatgcatacaataa

SEQ ID NO: 3527069 - DNA, 17 bp, Homo sapiens
tcaatgcatacaataaa

SEQ ID NO: 3527070 - DNA, 13 bp, Homo sapiens
tcacagagccact

SEQ ID NO: 3527071 - DNA, 14 bp, Homo sapiens
tcacagagccactc

SEQ ID NO: 3527072 - DNA, 23 bp, Homo sapiens
tcacagagccactcttcaagtag

SEQ ID NO: 3527073 - DNA, 17 bp, Homo sapiens
tcacatgattccagcca

SEQ ID NO: 3527074 - DNA, 19 bp, Homo sapiens
tcacatgattccagccatc

SEQ ID NO: 3527075 - DNA, 16 bp, Homo sapiens
tcaccttagaccacca

SEQ ID NO: 3527076 - DNA, 21 bp, Homo sapiens
tcaccttagaccaccaagcct

SEQ ID NO: 3527077 - DNA, 13 bp, Homo sapiens
tcactctccagca

SEQ ID NO: 3527078 - DNA, 23 bp, Homo sapiens
tcactctccagcagttaggcacc

SEQ ID NO: 3527079 - DNA, 16 bp, Homo sapiens
tcactgtggggaaaca

SEQ ID NO: 3527080 - DNA, 19 bp, Homo sapiens
tcactgtggggaaacaatt

SEQ ID NO: 3527081 - DNA, 19 bp, Homo sapiens
tcagaatattttgtaagct

SEQ ID NO: 3527082 - DNA, 19 bp, Homo sapiens
tcagaatgggggctttcgg

SEQ ID NO: 3527083 - DNA, 19 bp, Homo sapiens
tcagacgactagcccagga

SEQ ID NO: 3527084 - DNA, 17 bp, Homo sapiens
tcagacgttggtcccaa

SEQ ID NO: 3527085 - DNA, 19 bp, Homo sapiens
tcagacgttggtcccaagt

SEQ ID NO: 3527086 - DNA, 14 bp, Homo sapiens
tcagatgctcttgg

SEQ ID NO: 3527087 - DNA, 17 bp, Homo sapiens
tcagcactctggactcc

SEQ ID NO: 3527088 - DNA, 15 bp, Homo sapiens
tcagccatcagccat

SEQ ID NO: 3527089 - DNA, 14 bp, Homo sapiens
tcagcccaccctcc

SEQ ID NO: 3527090 - DNA, 18 bp, Homo sapiens
tcaggaggaggctgccct

SEQ ID NO: 3527091 - DNA, 20 bp, Homo sapiens
tcaggcccgctgccctagga

SEQ ID NO: 3527092 - DNA, 17 bp, Homo sapiens
tcaggcctagaggcctg

SEQ ID NO: 3527093 - DNA, 14 bp, Homo sapiens
tcagggagggccag

SEQ ID NO: 3527094 - DNA, 16 bp, Homo sapiens
tcagggagggccaggg

SEQ ID NO: 3527095 - DNA, 22 bp, Homo sapiens
tcagggagggccagggaggcag

SEQ ID NO: 3527096 - DNA, 14 bp, Homo sapiens
tcagggaggggccg

SEQ ID NO: 3527097 - DNA, 14 bp, Homo sapiens
tcaggggaagggca

SEQ ID NO: 3527098 - DNA, 17 bp, Homo sapiens
tcaggggaagggcaggc

SEQ ID NO: 3527099 - DNA, 20 bp, Homo sapiens
tcataagatagttacattta

SEQ ID NO: 3527100 - DNA, 15 bp, Homo sapiens
tcatagagaggcctg

SEQ ID NO: 3527101 - DNA, 17 bp, Homo sapiens
tcatatgaggggaccca

SEQ ID NO: 3527102 - DNA, 18 bp, Homo sapiens
tcatatgaggggacccag

SEQ ID NO: 3527103 - DNA, 19 bp, Homo sapiens
tcatatgaggggacccagc

SEQ ID NO: 3527104 - DNA, 22 bp, Homo sapiens
tcatgagaattacagaaaattt

SEQ ID NO: 3527105 - DNA, 19 bp, Homo sapiens
tcatgtaatataagtgaac

SEQ ID NO: 3527106 - DNA, 16 bp, Homo sapiens
tcatttcaaaatatgt

SEQ ID NO: 3527107 - DNA, 19 bp, Homo sapiens
tccaactccgaaagtctga

SEQ ID NO: 3527108 - DNA, 20 bp, Homo sapiens
tccaagaaacgtggatctcc

SEQ ID NO: 3527109 - DNA, 22 bp, Homo sapiens
tccaagaaacgtggatctcccc

SEQ ID NO: 3527110 - DNA, 12 bp, Homo sapiens
tccacaggacac

SEQ ID NO: 3527111 - DNA, 20 bp, Homo sapiens
tccaccctttggagaccagg

SEQ ID NO: 3527112 - DNA, 16 bp, Homo sapiens
tccacgatgcctttga

SEQ ID NO: 3527113 - DNA, 17 bp, Homo sapiens
tccagcttttcctcagg

SEQ ID NO: 3527114 - DNA, 20 bp, Homo sapiens
tccatactgaaaaaatgctg

SEQ ID NO: 3527115 - DNA, 22 bp, Homo sapiens
tccatactgaaaaaatgctgag

SEQ ID NO: 3527116 - DNA, 23 bp, Homo sapiens
tccatactgaaaaaatgctgagc

SEQ ID NO: 3527117 - DNA, 16 bp, Homo sapiens
tccatgaaaataaacg

SEQ ID NO: 3527118 - DNA, 16 bp, Homo sapiens
tccatgggtctggcct

SEQ ID NO: 3527119 - DNA, 22 bp, Homo sapiens
tcccaacctcctgtgggcctca

SEQ ID NO: 3527120 - DNA, 15 bp, Homo sapiens
tcccaaggagggcac

SEQ ID NO: 3527121 - DNA, 17 bp, Homo sapiens
tcccaccctatggccac

SEQ ID NO: 3527122 - DNA, 16 bp, Homo sapiens
gaccagggtggagctg

SEQ ID NO: 3527123 - DNA, 23 bp, Homo sapiens
gacccaaaatgtgaatgaagcta

SEQ ID NO: 3527124 - DNA, 16 bp, Homo sapiens
gacccccgcagaggca

SEQ ID NO: 3527125 - DNA, 21 bp, Homo sapiens
gacccttctccaaaggctctg

SEQ ID NO: 3527126 - DNA, 21 bp, Homo sapiens
gacctgggttatttattgaca

SEQ ID NO: 3527127 - DNA, 21 bp, Homo sapiens
gaccttgggaccaaaggggga

SEQ ID NO: 3527128 - DNA, 15 bp, Homo sapiens
gacggctgccattgg

SEQ ID NO: 3527129 - DNA, 20 bp, Homo sapiens
gacggctgccattggtccac

SEQ ID NO: 3527130 - DNA, 19 bp, Homo sapiens
gacgtgggccctgcaggct

SEQ ID NO: 3527131 - DNA, 16 bp, Homo sapiens
gactccacgatgcctt

SEQ ID NO: 3527132 - DNA, 15 bp, Homo sapiens
gactgacccaaaatg

SEQ ID NO: 3527133 - DNA, 12 bp, Homo sapiens
gactgccaagcc

SEQ ID NO: 3527134 - DNA, 14 bp, Homo sapiens
gactgccaagccat

SEQ ID NO: 3527135 - DNA, 15 bp, Homo sapiens
gactgccaagccatg

SEQ ID NO: 3527136 - DNA, 20 bp, Homo sapiens
gactggccagcgtaaatgac

SEQ ID NO: 3527137 - DNA, 14 bp, Homo sapiens
gactgtcagggagg

SEQ ID NO: 3527138 - DNA, 22 bp, Homo sapiens
gacttcccaagccctggtgacc

SEQ ID NO: 3527139 - DNA, 16 bp, Homo sapiens
gacttctggtgctgct

SEQ ID NO: 3527140 - DNA, 17 bp, Homo sapiens
gacttctggtgctgctg

SEQ ID NO: 3527141 - DNA, 17 bp, Homo sapiens
gagaaaagacaaatgtg

SEQ ID NO: 3527142 - DNA, 14 bp, Homo sapiens
gagaaagacaaaat

SEQ ID NO: 3527143 - DNA, 14 bp, Homo sapiens
gagaagaggaggag

SEQ ID NO: 3527144 - DNA, 19 bp, Homo sapiens
gagaattacagaaaatttg

SEQ ID NO: 3527145 - DNA, 18 bp, Homo sapiens
gagaatttcaaggcaggg

SEQ ID NO: 3527146 - DNA, 13 bp, Homo sapiens
gagaggggaggga

SEQ ID NO: 3527147 - DNA, 14 bp, Homo sapiens
gagaggggagggag

SEQ ID NO: 3527148 - DNA, 12 bp, Homo sapiens
gagatttgtaaa

SEQ ID NO: 3527149 - DNA, 18 bp, Homo sapiens
gagatttttcatgtatct

SEQ ID NO: 3527150 - DNA, 18 bp, Homo sapiens
gagccactcttcaagtag

SEQ ID NO: 3527151 - DNA, 20 bp, Homo sapiens
gagcctgtgaccttgggacc

SEQ ID NO: 3527152 - DNA, 18 bp, Homo sapiens
gagctagcaaatacagga

SEQ ID NO: 3527153 - DNA, 14 bp, Homo sapiens
gagctcttgctatc

SEQ ID NO: 3527154 - DNA, 16 bp, Homo sapiens
gagctgagaagaggag

SEQ ID NO: 3527155 - DNA, 19 bp, Homo sapiens
gagctgagaagaggaggag

SEQ ID NO: 3527156 - DNA, 22 bp, Homo sapiens
gagctgagaagaggaggaggtg

SEQ ID NO: 3527157 - DNA, 15 bp, Homo sapiens
gagctgggaggtctc

SEQ ID NO: 3527158 - DNA, 15 bp, Homo sapiens
gaggaccagggtgga

SEQ ID NO: 3527159 - DNA, 16 bp, Homo sapiens
gaggaccagggtggag

SEQ ID NO: 3527160 - DNA, 20 bp, Homo sapiens
gaggaccagggtggagctga

SEQ ID NO: 3527161 - DNA, 22 bp, Homo sapiens
gaggagaccagcggtccatggg

SEQ ID NO: 3527162 - DNA, 12 bp, Homo sapiens
gaggatcctgag

SEQ ID NO: 3527163 - DNA, 16 bp, Homo sapiens
gaggatcctgagctgc

SEQ ID NO: 3527164 - DNA, 19 bp, Homo sapiens
gaggatttccctgaagcta

SEQ ID NO: 3527165 - DNA, 14 bp, Homo sapiens
gaggcagagcggga

SEQ ID NO: 3527166 - DNA, 17 bp, Homo sapiens
gaggcagagcgggaggg

SEQ ID NO: 3527167 - DNA, 18 bp, Homo sapiens
gaggcagagcgggaggga

SEQ ID NO: 3527168 - DNA, 16 bp, Homo sapiens
gagggaagtcctggga

SEQ ID NO: 3527169 - DNA, 24 bp, Homo sapiens
ctgggaggatcctgagctgctgtt

SEQ ID NO: 3527170 - DNA, 18 bp, Homo sapiens
ctgggcaaaagaatgttt

SEQ ID NO: 3527171 - DNA, 17 bp, Homo sapiens
ctgggccttaactgttg

SEQ ID NO: 3527172 - DNA, 13 bp, Homo sapiens
ctggggacccaga

SEQ ID NO: 3527173 - DNA, 17 bp, Homo sapiens
ctggggagggggtacct

SEQ ID NO: 3527174 - DNA, 21 bp, Homo sapiens
ctgggtgtaaaacctggagat

SEQ ID NO: 3527175 - DNA, 23 bp, Homo sapiens
ctggtgactcgggggctgtctca

SEQ ID NO: 3527176 - DNA, 18 bp, Homo sapiens
ctggttcccaagagctat

SEQ ID NO: 3527177 - DNA, 16 bp, Homo sapiens
ctgtcagaagtttcta

SEQ ID NO: 3527178 - DNA, 22 bp, Homo sapiens
ctgtcagacgttggtcccaagt

SEQ ID NO: 3527179 - DNA, 14 bp, Homo sapiens
ctgtcagggagggc

SEQ ID NO: 3527180 - DNA, 18 bp, Homo sapiens
ctgtcagggagggccagg

SEQ ID NO: 3527181 - DNA, 23 bp, Homo sapiens
ctgtcagggagggccagggaggc

SEQ ID NO: 3527182 - DNA, 13 bp, Homo sapiens
ctgtcatctgtag

SEQ ID NO: 3527183 - DNA, 21 bp, Homo sapiens
ctgtcatctgtaggtcactct

SEQ ID NO: 3527184 - DNA, 20 bp, Homo sapiens
ctgtcctacctccactctct

SEQ ID NO: 3527185 - DNA, 23 bp, Homo sapiens
ctgtctcagacgactagcccagg

SEQ ID NO: 3527186 - DNA, 13 bp, Homo sapiens
ctgtgaccttggg

SEQ ID NO: 3527187 - DNA, 13 bp, Homo sapiens
ctgtgagaagttt

SEQ ID NO: 3527188 - DNA, 16 bp, Homo sapiens
ctgtgagaagtttttg

SEQ ID NO: 3527189 - DNA, 20 bp, Homo sapiens
ctgtgagtctccccttgcag

SEQ ID NO: 3527190 - DNA, 19 bp, Homo sapiens
ctgttagaatatgttgatt

SEQ ID NO: 3527191 - DNA, 17 bp, Homo sapiens
ctgttagtagcagaaat

SEQ ID NO: 3527192 - DNA, 18 bp, Homo sapiens
ctgttagtagcagaaata

SEQ ID NO: 3527193 - DNA, 16 bp, Homo sapiens
ctgttggcgtgtccca

SEQ ID NO: 3527194 - DNA, 13 bp, Homo sapiens
ctgttgttttaac

SEQ ID NO: 3527195 - DNA, 22 bp, Homo sapiens
ctgttttcccaacctcctgtgg

SEQ ID NO: 3527196 - DNA, 16 bp, Homo sapiens
cttagaggcttgatga

SEQ ID NO: 3527197 - DNA, 18 bp, Homo sapiens
cttagaggcttgatgatg

SEQ ID NO: 3527198 - DNA, 17 bp, Homo sapiens
cttcagatgctcttggg

SEQ ID NO: 3527199 - DNA, 23 bp, Homo sapiens
cttccagagaacacagggctgca

SEQ ID NO: 3527200 - DNA, 21 bp, Homo sapiens
cttccccccagatacccatct

SEQ ID NO: 3527201 - DNA, 13 bp, Homo sapiens
cttctattgcctc

SEQ ID NO: 3527202 - DNA, 22 bp, Homo sapiens
cttctattgcctctgagagcat

SEQ ID NO: 3527203 - DNA, 18 bp, Homo sapiens
cttctccaaaggctctgt

SEQ ID NO: 3527204 - DNA, 16 bp, Homo sapiens
cttctctttcaatgtg

SEQ ID NO: 3527205 - DNA, 14 bp, Homo sapiens
cttctggtgctgct

SEQ ID NO: 3527206 - DNA, 23 bp, Homo sapiens
cttcttccaaggagcagagaggt

SEQ ID NO: 3527207 - DNA, 16 bp, Homo sapiens
cttcttggccatggga

SEQ ID NO: 3527208 - DNA, 19 bp, Homo sapiens
cttgctaccaatctgtgag

SEQ ID NO: 3527209 - DNA, 22 bp, Homo sapiens
cttgctaccaatctgtgagaag

SEQ ID NO: 3527210 - DNA, 16 bp, Homo sapiens
cttggccatgggaggc

SEQ ID NO: 3527211 - DNA, 23 bp, Homo sapiens
cttggccatgggaggcctttccc

SEQ ID NO: 3527212 - DNA, 21 bp, Homo sapiens
cttggggttcataggggcagg

SEQ ID NO: 3527213 - DNA, 21 bp, Homo sapiens
cttgtccaaagctgaaaatgt

SEQ ID NO: 3527214 - DNA, 20 bp, Homo sapiens
cttgtgactaagttgcaaga

SEQ ID NO: 3527215 - DNA, 15 bp, Homo sapiens
ctttcacgggcccca

SEQ ID NO: 3527216 - DNA, 14 bp, Homo sapiens
ctttcatagagagg

SEQ ID NO: 3527217 - DNA, 23 bp, Homo sapiens
ctttcatatgaggggacccagcg

SEQ ID NO: 3527218 - DNA, 12 bp, Homo sapiens
ctttccctaagc

SEQ ID NO: 3527219 - DNA, 17 bp, Homo sapiens
ctttccctaagccagct

SEQ ID NO: 3527220 - DNA, 15 bp, Homo sapiens
ctttcggggagggcg

SEQ ID NO: 3527221 - DNA, 18 bp, Homo sapiens
ctttgccctgctgccctc

SEQ ID NO: 3527222 - DNA, 14 bp, Homo sapiens
ctttgctgaccctc

SEQ ID NO: 3527223 - DNA, 23 bp, Homo sapiens
ctttgctgaccctccccaaaggc

SEQ ID NO: 3527224 - DNA, 22 bp, Homo sapiens
ctttggcaaaggtccctgagct

SEQ ID NO: 3527225 - DNA, 22 bp, Homo sapiens
ctttggctgaaaggaagctgtg

SEQ ID NO: 3527226 - DNA, 17 bp, Homo sapiens
ctttggttcttcagatg

SEQ ID NO: 3527227 - DNA, 13 bp, Homo sapiens
cttttgtgtccca

SEQ ID NO: 3527228 - DNA, 13 bp, Homo sapiens
cttttgttctgag

SEQ ID NO: 3527229 - DNA, 18 bp, Homo sapiens
gaaaaaatgctgagccag

SEQ ID NO: 3527230 - DNA, 14 bp, Homo sapiens
gaaaaacactattt

SEQ ID NO: 3527231 - DNA, 20 bp, Homo sapiens
gaaaagaagctgtcagaagt

SEQ ID NO: 3527232 - DNA, 17 bp, Homo sapiens
gaaaataagaaagaatt

SEQ ID NO: 3527233 - DNA, 20 bp, Homo sapiens
gaaaatagcacggggaggaa

SEQ ID NO: 3527234 - DNA, 12 bp, Homo sapiens
gaaaatgtgtat

SEQ ID NO: 3527235 - DNA, 14 bp, Homo sapiens
gaaacaactcatgt

SEQ ID NO: 3527236 - DNA, 16 bp, Homo sapiens
gaaacaactcatgtct

SEQ ID NO: 3527237 - DNA, 15 bp, Homo sapiens
gaaaccgaaactgac

SEQ ID NO: 3527238 - DNA, 14 bp, Homo sapiens
gaaaccttccagag

SEQ ID NO: 3527239 - DNA, 20 bp, Homo sapiens
gaaaccttccagagaacaca

SEQ ID NO: 3527240 - DNA, 22 bp, Homo sapiens
gaaactatccttctctttcaat

SEQ ID NO: 3527241 - DNA, 16 bp, Homo sapiens
gaaactgacttgctca

SEQ ID NO: 3527242 - DNA, 11 bp, Homo sapiens
gaaagaacatt

SEQ ID NO: 3527243 - DNA, 23 bp, Homo sapiens
gaaagaacatttaaaattaaata

SEQ ID NO: 3527244 - DNA, 22 bp, Homo sapiens
gaaagaattgcagtaaagtctt

SEQ ID NO: 3527245 - DNA, 17 bp, Homo sapiens
gaaagaggtctttcaga

SEQ ID NO: 3527246 - DNA, 16 bp, Homo sapiens
gaaaggaagctgtgcg

SEQ ID NO: 3527247 - DNA, 20 bp, Homo sapiens
gaaataaagtaggaaagaat

SEQ ID NO: 3527248 - DNA, 20 bp, Homo sapiens
gaaatatattatgaaaatta

SEQ ID NO: 3527249 - DNA, 20 bp, Homo sapiens
gaaatcagtggtgttacatt

SEQ ID NO: 3527250 - DNA, 13 bp, Homo sapiens
gaaatctgaaaaa

SEQ ID NO: 3527251 - DNA, 23 bp, Homo sapiens
gaaatttttgatgcccagacagc

SEQ ID NO: 3527252 - DNA, 19 bp, Homo sapiens
gaacattcaagagagctcg

SEQ ID NO: 3527253 - DNA, 22 bp, Homo sapiens
gaaccacgggttgaggaagtca

SEQ ID NO: 3527254 - DNA, 18 bp, Homo sapiens
gaacccatagggagctga

SEQ ID NO: 3527255 - DNA, 13 bp, Homo sapiens
gaactagaaaccc

SEQ ID NO: 3527256 - DNA, 23 bp, Homo sapiens
gaactataacattcaatttgcta

SEQ ID NO: 3527257 - DNA, 19 bp, Homo sapiens
gaagaaaacccgagggaca

SEQ ID NO: 3527258 - DNA, 22 bp, Homo sapiens
gaagcagtggggtaggctgctg

SEQ ID NO: 3527259 - DNA, 14 bp, Homo sapiens
gaagctaatgtgaa

SEQ ID NO: 3527260 - DNA, 18 bp, Homo sapiens
gaaggggtgcaggtgggg

SEQ ID NO: 3527261 - DNA, 23 bp, Homo sapiens
gaagtttttattttaaacatttt

SEQ ID NO: 3527262 - DNA, 16 bp, Homo sapiens
gaataatgcggacact

SEQ ID NO: 3527263 - DNA, 13 bp, Homo sapiens
gaatatgttgatt

SEQ ID NO: 3527264 - DNA, 13 bp, Homo sapiens
gaatctcccaagg

SEQ ID NO: 3527265 - DNA, 15 bp, Homo sapiens
gaatctcccaaggag

SEQ ID NO: 3527266 - DNA, 19 bp, Homo sapiens
gaatctcccaaggagggca

SEQ ID NO: 3527267 - DNA, 20 bp, Homo sapiens
gaatgaacccatagggagct

SEQ ID NO: 3527268 - DNA, 21 bp, Homo sapiens
gaatgcttctgcatcaaagga

SEQ ID NO: 3527269 - DNA, 14 bp, Homo sapiens
gaattacagaaaat

SEQ ID NO: 3527270 - DNA, 17 bp, Homo sapiens
gaattacagaaaatttg

SEQ ID NO: 3527271 - DNA, 19 bp, Homo sapiens
gaattacagaaaatttgca

SEQ ID NO: 3527272 - DNA, 15 bp, Homo sapiens
gaattgttagtttct

SEQ ID NO: 3527273 - DNA, 18 bp, Homo sapiens
gacaccgtggggaagggg

SEQ ID NO: 3527274 - DNA, 21 bp, Homo sapiens
gacaccgtggggaaggggtgc

SEQ ID NO: 3527275 - DNA, 14 bp, Homo sapiens
gacagtgaggaaaa

SEQ ID NO: 3527276 - DNA, 20 bp, Homo sapiens
gaccaaggcagggcccagca

SEQ ID NO: 3527277 - DNA, 12 bp, Homo sapiens
gaccaccaagcc

SEQ ID NO: 3527278 - DNA, 14 bp, Homo sapiens
gaccaggcctcagc

SEQ ID NO: 3527279 - DNA, 21 bp, Homo sapiens
ctaccaatctgtgagaagttt

SEQ ID NO: 3527280 - DNA, 12 bp, Homo sapiens
ctacctgatttc

SEQ ID NO: 3527281 - DNA, 16 bp, Homo sapiens
ctacctggctggagac

SEQ ID NO: 3527282 - DNA, 15 bp, Homo sapiens
ctagaagaaaacccg

SEQ ID NO: 3527283 - DNA, 16 bp, Homo sapiens
ctagagaaagacaaaa

SEQ ID NO: 3527284 - DNA, 17 bp, Homo sapiens
ctagagaaagacaaaat

SEQ ID NO: 3527285 - DNA, 21 bp, Homo sapiens
ctagaggcctgactgccaagc

SEQ ID NO: 3527286 - DNA, 15 bp, Homo sapiens
ctagcaaatacagga

SEQ ID NO: 3527287 - DNA, 22 bp, Homo sapiens
ctaggatatgccctcctggtga

SEQ ID NO: 3527288 - DNA, 17 bp, Homo sapiens
ctaggcccacaagtgta

SEQ ID NO: 3527289 - DNA, 16 bp, Homo sapiens
ctataacatatttatt

SEQ ID NO: 3527290 - DNA, 15 bp, Homo sapiens
ctatccaaagtgtca

SEQ ID NO: 3527291 - DNA, 22 bp, Homo sapiens
ctatgctgttaacagctgtcaa

SEQ ID NO: 3527292 - DNA, 14 bp, Homo sapiens
ctatggccactggc

SEQ ID NO: 3527293 - DNA, 19 bp, Homo sapiens
ctatgtcctagtaactctt

SEQ ID NO: 3527294 - DNA, 11 bp, Homo sapiens
ctattgcctct

SEQ ID NO: 3527295 - DNA, 16 bp, Homo sapiens
ctatttacaaatgaag

SEQ ID NO: 3527296 - DNA, 22 bp, Homo sapiens
ctcaaattctccctaaagtgtt

SEQ ID NO: 3527297 - DNA, 22 bp, Homo sapiens
ctcacactcatgcattgtcctc

SEQ ID NO: 3527298 - DNA, 23 bp, Homo sapiens
ctcacactcatgcattgtcctct

SEQ ID NO: 3527299 - DNA, 17 bp, Homo sapiens
ctcagaatgggggcttt

SEQ ID NO: 3527300 - DNA, 14 bp, Homo sapiens
ctcagacgactagc

SEQ ID NO: 3527301 - DNA, 17 bp, Homo sapiens
ctcagacgactagccca

SEQ ID NO: 3527302 - DNA, 14 bp, Homo sapiens
ctcagcactctgga

SEQ ID NO: 3527303 - DNA, 18 bp, Homo sapiens
ctcagcactctggactcc

SEQ ID NO: 3527304 - DNA, 14 bp, Homo sapiens
ctcagcagaggcag

SEQ ID NO: 3527305 - DNA, 16 bp, Homo sapiens
ctcagccgtcagccat

SEQ ID NO: 3527306 - DNA, 23 bp, Homo sapiens
ctcaggaggaggctgccctgagg

SEQ ID NO: 3527307 - DNA, 13 bp, Homo sapiens
ctcaggcactctc

SEQ ID NO: 3527308 - DNA, 18 bp, Homo sapiens
ctcataaaggacactgga

SEQ ID NO: 3527309 - DNA, 16 bp, Homo sapiens
ctcatcggtggaagca

SEQ ID NO: 3527310 - DNA, 16 bp, Homo sapiens
ctcatgcattgtcctc

SEQ ID NO: 3527311 - DNA, 16 bp, Homo sapiens
ctccaccatcgtcttc

SEQ ID NO: 3527312 - DNA, 16 bp, Homo sapiens
ctccactcagcactct

SEQ ID NO: 3527313 - DNA, 17 bp, Homo sapiens
ctccactcagcactctg

SEQ ID NO: 3527314 - DNA, 19 bp, Homo sapiens
ctccagcagttaggcacct

SEQ ID NO: 3527315 - DNA, 18 bp, Homo sapiens
ctccagcttttcctcagg

SEQ ID NO: 3527316 - DNA, 20 bp, Homo sapiens
ctccagcttttcctcagggt

SEQ ID NO: 3527317 - DNA, 18 bp, Homo sapiens
ctccatgttgcttcactc

SEQ ID NO: 3527318 - DNA, 23 bp, Homo sapiens
ctcccatatcatataaaatttca

SEQ ID NO: 3527319 - DNA, 19 bp, Homo sapiens
ctccccaaaggctttgccc

SEQ ID NO: 3527320 - DNA, 18 bp, Homo sapiens
ctccccaacttgagcctg

SEQ ID NO: 3527321 - DNA, 22 bp, Homo sapiens
ctccccatctcggggctgctgt

SEQ ID NO: 3527322 - DNA, 13 bp, Homo sapiens
ctcccctcccgaa

SEQ ID NO: 3527323 - DNA, 22 bp, Homo sapiens
ctcccggcctggcttcactctc

SEQ ID NO: 3527324 - DNA, 19 bp, Homo sapiens
ctccctggatttttaccag

SEQ ID NO: 3527325 - DNA, 14 bp, Homo sapiens
ctccgaaagtctga

SEQ ID NO: 3527326 - DNA, 23 bp, Homo sapiens
ctccgaaagtctgaatctcccaa

SEQ ID NO: 3527327 - DNA, 13 bp, Homo sapiens
ctcctctccacca

SEQ ID NO: 3527328 - DNA, 15 bp, Homo sapiens
ctcctctccaccatc

SEQ ID NO: 3527329 - DNA, 22 bp, Homo sapiens
ctcctgttagtagcagaaatat

SEQ ID NO: 3527330 - DNA, 17 bp, Homo sapiens
ctccttggtgctaaaga

SEQ ID NO: 3527331 - DNA, 19 bp, Homo sapiens
ctcgggggctgtctcagac

SEQ ID NO: 3527332 - DNA, 13 bp, Homo sapiens
ctcggtcactgag

SEQ ID NO: 3527333 - DNA, 22 bp, Homo sapiens
ctcggttaagtacccgaggcct

SEQ ID NO: 3527334 - DNA, 19 bp, Homo sapiens
ctcgtctcttgtgactcag

SEQ ID NO: 3527335 - DNA, 23 bp, Homo sapiens
ctcgttcctgcagccagaaagga

SEQ ID NO: 3527336 - DNA, 16 bp, Homo sapiens
agcatgaatatttctt

SEQ ID NO: 3527337 - DNA, 20 bp, Homo sapiens
agcatgcagcgaattcagaa

SEQ ID NO: 3527338 - DNA, 20 bp, Homo sapiens
agcatttgaatactcctgtt

SEQ ID NO: 3527339 - DNA, 20 bp, Homo sapiens
agccacagttcccctatgtg

SEQ ID NO: 3527340 - DNA, 16 bp, Homo sapiens
agccactcttcaagta

SEQ ID NO: 3527341 - DNA, 11 bp, Homo sapiens
agccagaaagg

SEQ ID NO: 3527342 - DNA, 13 bp, Homo sapiens
agccagctgcccc

SEQ ID NO: 3527343 - DNA, 19 bp, Homo sapiens
agccatcagccatggccct

SEQ ID NO: 3527344 - DNA, 18 bp, Homo sapiens
agccatgggtagcctggg

SEQ ID NO: 3527345 - DNA, 22 bp, Homo sapiens
agcccagccttttgagagtaat

SEQ ID NO: 3527346 - DNA, 11 bp, Homo sapiens
agccccacacc

SEQ ID NO: 3527347 - DNA, 12 bp, Homo sapiens
agcctgggtgta

SEQ ID NO: 3527348 - DNA, 22 bp, Homo sapiens
agcgctggcccccccagcccca

SEQ ID NO: 3527349 - DNA, 13 bp, Homo sapiens
agctaatgtgaat

SEQ ID NO: 3527350 - DNA, 21 bp, Homo sapiens
agctatgtctctagcagtgag

SEQ ID NO: 3527351 - DNA, 13 bp, Homo sapiens
agctcttgctatc

SEQ ID NO: 3527352 - DNA, 20 bp, Homo sapiens
agctcttgctatctctcaag

SEQ ID NO: 3527353 - DNA, 18 bp, Homo sapiens
agctcttggtgggcccag

SEQ ID NO: 3527354 - DNA, 20 bp, Homo sapiens
agctgagaagaggaggaggt

SEQ ID NO: 3527355 - DNA, 19 bp, Homo sapiens
agctgcccccagagccaca

SEQ ID NO: 3527356 - DNA, 17 bp, Homo sapiens
agctgggcagtgccagc

SEQ ID NO: 3527357 - DNA, 18 bp, Homo sapiens
agctgtcagaagtttcta

SEQ ID NO: 3527358 - DNA, 16 bp, Homo sapiens
agctgtgcgtgtgtgt

SEQ ID NO: 3527359 - DNA, 16 bp, Homo sapiens
agcttaaagagcacag

SEQ ID NO: 3527360 - DNA, 15 bp, Homo sapiens
aggaaagagaagctt

SEQ ID NO: 3527361 - DNA, 22 bp, Homo sapiens
tgttggcgtgtcccagcaccac

SEQ ID NO: 3527362 - DNA, 13 bp, Homo sapiens
tgttgttaaaaca

SEQ ID NO: 3527363 - DNA, 23 bp, Homo sapiens
tgttttcccaacctcctgtgggc

SEQ ID NO: 3527364 - DNA, 22 bp, Homo sapiens
ttaaaatctgctgatctctgta

SEQ ID NO: 3527365 - DNA, 16 bp, Homo sapiens
ttaaaattaaataaat

SEQ ID NO: 3527366 - DNA, 18 bp, Homo sapiens
ttaaaattaaatactttt

SEQ ID NO: 3527367 - DNA, 12 bp, Homo sapiens
ttaaacattttt

SEQ ID NO: 3527368 - DNA, 17 bp, Homo sapiens
ttaaagtggtctgaact

SEQ ID NO: 3527369 - DNA, 15 bp, Homo sapiens
ttaaataaattttaa

SEQ ID NO: 3527370 - DNA, 11 bp, Homo sapiens
ttaacaagtca

SEQ ID NO: 3527371 - DNA, 19 bp, Homo sapiens
ttaactggagaccagaaac

SEQ ID NO: 3527372 - DNA, 17 bp, Homo sapiens
ttaactgttcagtattg

SEQ ID NO: 3527373 - DNA, 14 bp, Homo sapiens
ttaagattattgtc

SEQ ID NO: 3527374 - DNA, 17 bp, Homo sapiens
ttaagattattgtctga

SEQ ID NO: 3527375 - DNA, 16 bp, Homo sapiens
ttaatgttaactttca

SEQ ID NO: 3527376 - DNA, 22 bp, Homo sapiens
ttacaaatgaagtatttcatgt

SEQ ID NO: 3527377 - DNA, 17 bp, Homo sapiens
ttacagagactctccct

SEQ ID NO: 3527378 - DNA, 12 bp, Homo sapiens
ttacatttatgt

SEQ ID NO: 3527379 - DNA, 17 bp, Homo sapiens
ttagaccaccaagcctt

SEQ ID NO: 3527380 - DNA, 16 bp, Homo sapiens
ttaggaaagagaagct

SEQ ID NO: 3527381 - DNA, 16 bp, Homo sapiens
ttatcagctgggcagt

SEQ ID NO: 3527382 - DNA, 19 bp, Homo sapiens
ttatcaggctttccttgtt

SEQ ID NO: 3527383 - DNA, 22 bp, Homo sapiens
ttatctactgactgaaatcagt

SEQ ID NO: 3527384 - DNA, 23 bp, Homo sapiens
ttatgaagtttttattttaaaca

SEQ ID NO: 3527385 - DNA, 16 bp, Homo sapiens
ttatgaattattttga

SEQ ID NO: 3527386 - DNA, 18 bp, Homo sapiens
ttatgagctccatgttgc

SEQ ID NO: 3527387 - DNA, 15 bp, Homo sapiens
ttatttatgaagttt

SEQ ID NO: 3527388 - DNA, 12 bp, Homo sapiens
ttatttattgac

SEQ ID NO: 3527389 - DNA, 16 bp, Homo sapiens
ttcaatgcatacaata

SEQ ID NO: 3527390 - DNA, 18 bp, Homo sapiens
ttcaatgcatacaataaa

SEQ ID NO: 3527391 - DNA, 18 bp, Homo sapiens
ttcaatgtgtttaatttt

SEQ ID NO: 3527392 - DNA, 13 bp, Homo sapiens
ttcagaaggaaac

SEQ ID NO: 3527393 - DNA, 15 bp, Homo sapiens
ttcagcacaataaat

SEQ ID NO: 3527394 - DNA, 17 bp, Homo sapiens
ttcaggggaagggcagg

SEQ ID NO: 3527395 - DNA, 17 bp, Homo sapiens
ttcatatgaggggaccc

SEQ ID NO: 3527396 - DNA, 19 bp, Homo sapiens
ttcatatgaggggacccag

SEQ ID NO: 3527397 - DNA, 19 bp, Homo sapiens
ttccaaggagcagagaggt

SEQ ID NO: 3527398 - DNA, 12 bp, Homo sapiens
ttccagccatca

SEQ ID NO: 3527399 - DNA, 11 bp, Homo sapiens
ttccagtgtgt

SEQ ID NO: 3527400 - DNA, 17 bp, Homo sapiens
ttcccaacctcctgtgg

SEQ ID NO: 3527401 - DNA, 14 bp, Homo sapiens
ttccccaaaggcat

SEQ ID NO: 3527402 - DNA, 14 bp, Homo sapiens
ttccctgaagctat

SEQ ID NO: 3527403 - DNA, 15 bp, Homo sapiens
ttccgttggaaagaa

SEQ ID NO: 3527404 - DNA, 16 bp, Homo sapiens
ttccgttggaaagaac

SEQ ID NO: 3527405 - DNA, 19 bp, Homo sapiens
ttccgttggaaagaacatt

SEQ ID NO: 3527406 - DNA, 12 bp, Homo sapiens
ttccttttactt

SEQ ID NO: 3527407 - DNA, 18 bp, Homo sapiens
ttccttttacttttcttc

SEQ ID NO: 3527408 - DNA, 19 bp, Homo sapiens
ttctaagaataatggactc

SEQ ID NO: 3527409 - DNA, 13 bp, Homo sapiens
ttctattgcctct

SEQ ID NO: 3527410 - DNA, 23 bp, Homo sapiens
ttctcacacggatttagtcccac

SEQ ID NO: 3527411 - DNA, 16 bp, Homo sapiens
ttctctgctgtcctaa

SEQ ID NO: 3527412 - DNA, 15 bp, Homo sapiens
ttctgataggagggg

SEQ ID NO: 3527413 - DNA, 17 bp, Homo sapiens
ttctgataggagggggc

SEQ ID NO: 3527414 - DNA, 15 bp, Homo sapiens
ttctgcatcaaagga

SEQ ID NO: 3527415 - DNA, 15 bp, Homo sapiens
ttctggtgctgctgg

SEQ ID NO: 3527416 - DNA, 15 bp, Homo sapiens
ttctgtgaaactatc

SEQ ID NO: 3527417 - DNA, 14 bp, Homo sapiens
ttgaggcacaaatc

SEQ ID NO: 3527418 - DNA, 11 bp, Homo sapiens
ttgataaatta

SEQ ID NO: 3527419 - DNA, 16 bp, Homo sapiens
ttgatatttatttatg

SEQ ID NO: 3527420 - DNA, 19 bp, Homo sapiens
ttgcaaagggattactaga

SEQ ID NO: 3527421 - DNA, 18 bp, Homo sapiens
ttgcacatttgaattcat

SEQ ID NO: 3527422 - DNA, 17 bp, Homo sapiens
ttgccagttgtcctcct

SEQ ID NO: 3527423 - DNA, 16 bp, Homo sapiens
ttgccctgctgccctc

SEQ ID NO: 3527424 - DNA, 19 bp, Homo sapiens
ttgcctctgagagcatcag

SEQ ID NO: 3527425 - DNA, 18 bp, Homo sapiens
ttgctatttacaaatgaa

SEQ ID NO: 3527426 - DNA, 15 bp, Homo sapiens
ttgctgaccctcccc

SEQ ID NO: 3527427 - DNA, 13 bp, Homo sapiens
ttggaaagaacat

SEQ ID NO: 3527428 - DNA, 17 bp, Homo sapiens
ttggaaagaacatttaa

SEQ ID NO: 3527429 - DNA, 17 bp, Homo sapiens
ttggacaccctgtcaga

SEQ ID NO: 3527430 - DNA, 12 bp, Homo sapiens
ttggcaaaggtc

SEQ ID NO: 3527431 - DNA, 11 bp, Homo sapiens
ttgggccctgg

SEQ ID NO: 3527432 - DNA, 22 bp, Homo sapiens
ttggtgaaaataagaaagaatt

SEQ ID NO: 3527433 - DNA, 17 bp, Homo sapiens
ttgtaattaaattttta

SEQ ID NO: 3527434 - DNA, 21 bp, Homo sapiens
ttgtccaaagctgaaaatgtg

SEQ ID NO: 3527435 - DNA, 22 bp, Homo sapiens
ttgtccaaagctgaaaatgtgt

SEQ ID NO: 3527436 - DNA, 20 bp, Homo sapiens
ttgtctctgcaaactgcctt

SEQ ID NO: 3527437 - DNA, 14 bp, Homo sapiens
ttgtctgattgaaa

SEQ ID NO: 3527438 - DNA, 16 bp, Homo sapiens
ttgtgactaagttgca

SEQ ID NO: 3527439 - DNA, 12 bp, Homo sapiens
ttgttctgaggg

SEQ ID NO: 3527440 - DNA, 12 bp, Homo sapiens
tttaaaattaaa

SEQ ID NO: 3527441 - DNA, 23 bp, Homo sapiens
tttaacgaggatttccctgaagc

SEQ ID NO: 3527442 - DNA, 17 bp, Homo sapiens
tttaattaaaaaatcaa

SEQ ID NO: 3527443 - DNA, 13 bp, Homo sapiens
tttacaaatgaag

SEQ ID NO: 3527444 - DNA, 13 bp, Homo sapiens
tttatcagtgtta

SEQ ID NO: 3527445 - DNA, 22 bp, Homo sapiens
tttatgaagtttttattttaaa

SEQ ID NO: 3527446 - DNA, 22 bp, Homo sapiens
tttatgaattattttgataaat

SEQ ID NO: 3527447 - DNA, 12 bp, Homo sapiens
tttatgacaaat

SEQ ID NO: 3527448 - DNA, 14 bp, Homo sapiens
tttatttatgaagt

SEQ ID NO: 3527449 - DNA, 13 bp, Homo sapiens
tttcaatgtgttt

SEQ ID NO: 3527450 - DNA, 19 bp, Homo sapiens
tttcaatgtgtttaatttt

SEQ ID NO: 3527451 - DNA, 14 bp, Homo sapiens
tttcagaatatttt

SEQ ID NO: 3527452 - DNA, 14 bp, Homo sapiens
tttcattgtctgtg

SEQ ID NO: 3527453 - DNA, 15 bp, Homo sapiens
tttcattgtctgtga

SEQ ID NO: 3527454 - DNA, 19 bp, Homo sapiens
tttcctcagggtgtcctga

SEQ ID NO: 3527455 - DNA, 21 bp, Homo sapiens
tttctgatagtagtctttaaa

SEQ ID NO: 3527456 - DNA, 19 bp, Homo sapiens
tttcttctattgcctctga

SEQ ID NO: 3527457 - DNA, 16 bp, Homo sapiens
tttgataaattactaa

SEQ ID NO: 3527458 - DNA, 11 bp, Homo sapiens
tttgcaacata

SEQ ID NO: 3527459 - DNA, 23 bp, Homo sapiens
tttggcaagagcgttactgtaga

SEQ ID NO: 3527460 - DNA, 21 bp, Homo sapiens
acctcttatgagctccatgtt

SEQ ID NO: 3527461 - DNA, 22 bp, Homo sapiens
acctcttatgagctccatgttg

SEQ ID NO: 3527462 - DNA, 20 bp, Homo sapiens
acctcttccgttggaaagaa

SEQ ID NO: 3527463 - DNA, 21 bp, Homo sapiens
acctgatttcagcacaataaa

SEQ ID NO: 3527464 - DNA, 21 bp, Homo sapiens
acctgcatctaagcatctggg

SEQ ID NO: 3527465 - DNA, 21 bp, Homo sapiens
accttagaccaccaagccttg

SEQ ID NO: 3527466 - DNA, 13 bp, Homo sapiens
accttgggccctg

SEQ ID NO: 3527467 - DNA, 14 bp, Homo sapiens
accttgggccctgg

SEQ ID NO: 3527468 - DNA, 14 bp, Homo sapiens
acctttgttttgtt

SEQ ID NO: 3527469 - DNA, 17 bp, Homo sapiens
acgaaggctgcccctgt

SEQ ID NO: 3527470 - DNA, 22 bp, Homo sapiens
acgaggatttccctgaagctat

SEQ ID NO: 3527471 - DNA, 16 bp, Homo sapiens
acggcgctgcctcagg

SEQ ID NO: 3527472 - DNA, 18 bp, Homo sapiens
acgggcaagtgagagggg

SEQ ID NO: 3527473 - DNA, 23 bp, Homo sapiens
acgggcaagtgagaggggaggga

SEQ ID NO: 3527474 - DNA, 15 bp, Homo sapiens
acggtgaaagtgctg

SEQ ID NO: 3527475 - DNA, 17 bp, Homo sapiens
acgtgggccctgcaggc

SEQ ID NO: 3527476 - DNA, 14 bp, Homo sapiens
acgttcagggaggg

SEQ ID NO: 3527477 - DNA, 19 bp, Homo sapiens
actagagaaagacaaaatg

SEQ ID NO: 3527478 - DNA, 22 bp, Homo sapiens
actagagaaagacaaaatgtga

SEQ ID NO: 3527479 - DNA, 12 bp, Homo sapiens
actataacattc

SEQ ID NO: 3527480 - DNA, 16 bp, Homo sapiens
aaaaacactatttctg

SEQ ID NO: 3527481 - DNA, 19 bp, Homo sapiens
aaaaacactatttctggaa

SEQ ID NO: 3527482 - DNA, 15 bp, Homo sapiens
aaaaagcatgaatat

SEQ ID NO: 3527483 - DNA, 12 bp, Homo sapiens
aaaagaagctgt

SEQ ID NO: 3527484 - DNA, 12 bp, Homo sapiens
aaaagagcttta

SEQ ID NO: 3527485 - DNA, 16 bp, Homo sapiens
aaaagagctttatccc

SEQ ID NO: 3527486 - DNA, 16 bp, Homo sapiens
aaaagcatgaatattt

SEQ ID NO: 3527487 - DNA, 20 bp, Homo sapiens
aaaagcatgaatatttctta

SEQ ID NO: 3527488 - DNA, 14 bp, Homo sapiens
aaaataagaaagaa

SEQ ID NO: 3527489 - DNA, 15 bp, Homo sapiens
aaaataagaaagaat

SEQ ID NO: 3527490 - DNA, 17 bp, Homo sapiens
aaaatatatttttatat

SEQ ID NO: 3527491 - DNA, 23 bp, Homo sapiens
aaaatcaaggagtcttctaatgt

SEQ ID NO: 3527492 - DNA, 15 bp, Homo sapiens
aaaattaagattatt

SEQ ID NO: 3527493 - DNA, 20 bp, Homo sapiens
aaaattagccttgatattct

SEQ ID NO: 3527494 - DNA, 14 bp, Homo sapiens
aaacaattttttgt

SEQ ID NO: 3527495 - DNA, 20 bp, Homo sapiens
aaacaattttttgtgatgaa

SEQ ID NO: 3527496 - DNA, 22 bp, Homo sapiens
aaacaattttttgtgatgaaaa

SEQ ID NO: 3527497 - DNA, 13 bp, Homo sapiens
aaacatttctgtg

SEQ ID NO: 3527498 - DNA, 14 bp, Homo sapiens
aaacatttctgtga

SEQ ID NO: 3527499 - DNA, 20 bp, Homo sapiens
aaacatttctgtgaaactat

SEQ ID NO: 3527500 - DNA, 14 bp, Homo sapiens
aaacccattttggt

SEQ ID NO: 3527501 - DNA, 15 bp, Homo sapiens
aaacccgagggacag

SEQ ID NO: 3527502 - DNA, 19 bp, Homo sapiens
aaactatccttctctttca

SEQ ID NO: 3527503 - DNA, 22 bp, Homo sapiens
aaactatccttctctttcaatg

SEQ ID NO: 3527504 - DNA, 13 bp, Homo sapiens
aaactgacttgct

SEQ ID NO: 3527505 - DNA, 15 bp, Homo sapiens
aaacttgcacatttg

SEQ ID NO: 3527506 - DNA, 13 bp, Homo sapiens
aaagaacatttaa

SEQ ID NO: 3527507 - DNA, 11 bp, Homo sapiens
aaagaagctgt

SEQ ID NO: 3527508 - DNA, 20 bp, Homo sapiens
aaagaagctgtcagaagttt

SEQ ID NO: 3527509 - DNA, 12 bp, Homo sapiens
aaagaatttgta

SEQ ID NO: 3527510 - DNA, 20 bp, Homo sapiens
aaagaatttgtatcatgttt

SEQ ID NO: 3527511 - DNA, 15 bp, Homo sapiens
aaagatgggaggaga

SEQ ID NO: 3527512 - DNA, 23 bp, Homo sapiens
aaagatgggaggagaccagcggt

SEQ ID NO: 3527513 - DNA, 18 bp, Homo sapiens
aaagattgttaaattcaa

SEQ ID NO: 3527514 - DNA, 16 bp, Homo sapiens
aaagcatgaatatttc

SEQ ID NO: 3527515 - DNA, 21 bp, Homo sapiens
aaagcatgaatatttcttaag

SEQ ID NO: 3527516 - DNA, 16 bp, Homo sapiens
aaagctgcatgtgtag

SEQ ID NO: 3527517 - DNA, 15 bp, Homo sapiens
aaaggacactggatc

SEQ ID NO: 3527518 - DNA, 21 bp, Homo sapiens
aaaggcatgcagtcatgagaa

SEQ ID NO: 3527519 - DNA, 13 bp, Homo sapiens
aaagtaggaaaga

SEQ ID NO: 3527520 - DNA, 17 bp, Homo sapiens
aaagtggtctgaactgc

SEQ ID NO: 3527521 - DNA, 23 bp, Homo sapiens
aaataagacttctggtgctgctg

SEQ ID NO: 3527522 - DNA, 20 bp, Homo sapiens
aaatagcacggggaggaata

SEQ ID NO: 3527523 - DNA, 20 bp, Homo sapiens
aaatagcatacaccaaacat

SEQ ID NO: 3527524 - DNA, 22 bp, Homo sapiens
aaatagcatacaccaaacattt

SEQ ID NO: 3527525 - DNA, 14 bp, Homo sapiens
aaatatattatgaa

SEQ ID NO: 3527526 - DNA, 18 bp, Homo sapiens
aaatctttgtgaacattc

SEQ ID NO: 3527527 - DNA, 19 bp, Homo sapiens
aaatctttgtgaacattct

SEQ ID NO: 3527528 - DNA, 14 bp, Homo sapiens
aaattaaataaatt

SEQ ID NO: 3527529 - DNA, 23 bp, Homo sapiens
aaatttcagggaaaacagaagca

SEQ ID NO: 3527530 - DNA, 23 bp, Homo sapiens
aaattttaatgttaactttcaaa

SEQ ID NO: 3527531 - DNA, 15 bp, Homo sapiens
aaatttttaaaatct

SEQ ID NO: 3527532 - DNA, 16 bp, Homo sapiens
aaatttttaaaatctg

SEQ ID NO: 3527533 - DNA, 19 bp, Homo sapiens
aacaactcatgtctttatt

SEQ ID NO: 3527534 - DNA, 21 bp, Homo sapiens
aacaatcagacatgagtccac

SEQ ID NO: 3527535 - DNA, 15 bp, Homo sapiens
aacaattttttgtga

SEQ ID NO: 3527536 - DNA, 15 bp, Homo sapiens
aacacaaaatgaata

SEQ ID NO: 3527537 - DNA, 14 bp, Homo sapiens
aacatttaaaatta

SEQ ID NO: 3527538 - DNA, 16 bp, Homo sapiens
aacatttaaaattaaa

SEQ ID NO: 3527539 - DNA, 13 bp, Homo sapiens
aacatttctgtga

SEQ ID NO: 3527540 - DNA, 16 bp, Homo sapiens
aacccattttggtgca

SEQ ID NO: 3527541 - DNA, 22 bp, Homo sapiens
aacctgccgggctgttgtttta

SEQ ID NO: 3527542 - DNA, 15 bp, Homo sapiens
aaccttgggccctgg

SEQ ID NO: 3527543 - DNA, 20 bp, Homo sapiens
aacgaggatttccctgaagc

SEQ ID NO: 3527544 - DNA, 13 bp, Homo sapiens
aacgttttccttg

SEQ ID NO: 3527545 - DNA, 16 bp, Homo sapiens
aactaggtatgaagta

SEQ ID NO: 3527546 - DNA, 20 bp, Homo sapiens
aactggtttgaaatttttga

SEQ ID NO: 3527547 - DNA, 15 bp, Homo sapiens
aacttacaaactggt

SEQ ID NO: 3527548 - DNA, 18 bp, Homo sapiens
aacttacctctgcttctg

SEQ ID NO: 3527549 - DNA, 23 bp, Homo sapiens
aacttgagcctgtgaccttggga

SEQ ID NO: 3527550 - DNA, 12 bp, Homo sapiens
aactttcaaatc

SEQ ID NO: 3527551 - DNA, 13 bp, Homo sapiens
aagaacatttaaa

SEQ ID NO: 3527552 - DNA, 19 bp, Homo sapiens
aagaagctgtcagaagttt

SEQ ID NO: 3527553 - DNA, 13 bp, Homo sapiens
aagaatgttttgg

SEQ ID NO: 3527554 - DNA, 16 bp, Homo sapiens
aagaggaggaggtggg

SEQ ID NO: 3527555 - DNA, 11 bp, Homo sapiens
aagagtgctga

SEQ ID NO: 3527556 - DNA, 18 bp, Homo sapiens
aagatagttacatttatg

SEQ ID NO: 3527557 - DNA, 22 bp, Homo sapiens
aagatagttacatttatgtgct

SEQ ID NO: 3527558 - DNA, 15 bp, Homo sapiens
aagatcttatttatt

SEQ ID NO: 3527559 - DNA, 14 bp, Homo sapiens
aagatgggaggaga

SEQ ID NO: 3527560 - DNA, 23 bp, Homo sapiens
aagattattgtctgattgaaaca

SEQ ID NO: 3527561 - DNA, 15 bp, Homo sapiens
aagcacagaaatctg

SEQ ID NO: 3527562 - DNA, 16 bp, Homo sapiens
aagcagccaggaggga

SEQ ID NO: 3527563 - DNA, 21 bp, Homo sapiens
aagccatgggtagcctgggtg

SEQ ID NO: 3527564 - DNA, 12 bp, Homo sapiens
aagctaatgtga

SEQ ID NO: 3527565 - DNA, 18 bp, Homo sapiens
aagctataacatatttat

SEQ ID NO: 3527566 - DNA, 21 bp, Homo sapiens
aagctataacatatttattgt

SEQ ID NO: 3527567 - DNA, 17 bp, Homo sapiens
aagctatgtctctagca

SEQ ID NO: 3527568 - DNA, 13 bp, Homo sapiens
aagctgaaaatgt

SEQ ID NO: 3527569 - DNA, 15 bp, Homo sapiens
aagctgaaaatgtgt

SEQ ID NO: 3527570 - DNA, 13 bp, Homo sapiens
aaggcatgcagtc

SEQ ID NO: 3527571 - DNA, 12 bp, Homo sapiens
aaggctgcccct

SEQ ID NO: 3527572 - DNA, 19 bp, Homo sapiens
aaggctgcccctgtaaggt

SEQ ID NO: 3527573 - DNA, 21 bp, Homo sapiens
aaggctgcccctgtaaggttt

SEQ ID NO: 3527574 - DNA, 22 bp, Homo sapiens
aaggctttgccctgctgccctc

SEQ ID NO: 3527575 - DNA, 17 bp, Homo sapiens
aaggtgaaacattttct

SEQ ID NO: 3527576 - DNA, 20 bp, Homo sapiens
aagtatttcatgtaatataa

SEQ ID NO: 3527577 - DNA, 15 bp, Homo sapiens
aagtcaggctgttgg

SEQ ID NO: 3527578 - DNA, 20 bp, Homo sapiens
aagtcctgggaggatcctga

SEQ ID NO: 3527579 - DNA, 14 bp, Homo sapiens
aagtgagaggggag

SEQ ID NO: 3527580 - DNA, 19 bp, Homo sapiens
aagtgagaggggagggagg

SEQ ID NO: 3527581 - DNA, 15 bp, Homo sapiens
aagtggtctgaactg

SEQ ID NO: 3527582 - DNA, 21 bp, Homo sapiens
aagtggtctgaactgcttgct

SEQ ID NO: 3527583 - DNA, 13 bp, Homo sapiens
aagtgtattgtaa

SEQ ID NO: 3527584 - DNA, 14 bp, Homo sapiens
aataaaagagcttt

SEQ ID NO: 3527585 - DNA, 19 bp, Homo sapiens
aataaaagagctttatccc

SEQ ID NO: 3527586 - DNA, 19 bp, Homo sapiens
aataaagtaggaaagaatt

SEQ ID NO: 3527587 - DNA, 13 bp, Homo sapiens
aataagaaagaat

SEQ ID NO: 3527588 - DNA, 17 bp, Homo sapiens
aataatgcggacacttt

SEQ ID NO: 3527589 - DNA, 19 bp, Homo sapiens
aataccatacccagatgtt

SEQ ID NO: 3527590 - DNA, 23 bp, Homo sapiens
aatagcccagccttttgagagta

SEQ ID NO: 3527591 - DNA, 22 bp, Homo sapiens
aataggttactttggactgagt

SEQ ID NO: 3527592 - DNA, 15 bp, Homo sapiens
atcatataaaatttc

SEQ ID NO: 3527593 - DNA, 17 bp, Homo sapiens
atcatataaaatttcag

SEQ ID NO: 3527594 - DNA, 16 bp, Homo sapiens
atcattaagtgacttt

SEQ ID NO: 3527595 - DNA, 13 bp, Homo sapiens
atccaactccgaa

SEQ ID NO: 3527596 - DNA, 14 bp, Homo sapiens
atccatactgaaaa

SEQ ID NO: 3527597 - DNA, 21 bp, Homo sapiens
atccatactgaaaaaatgctg

SEQ ID NO: 3527598 - DNA, 17 bp, Homo sapiens
atccatgaaaataaacg

SEQ ID NO: 3527599 - DNA, 15 bp, Homo sapiens
atccccacgccacag

SEQ ID NO: 3527600 - DNA, 22 bp, Homo sapiens
atctaagaggattcaacacctt

SEQ ID NO: 3527601 - DNA, 16 bp, Homo sapiens
atctactgactgaaat

SEQ ID NO: 3527602 - DNA, 20 bp, Homo sapiens
atctactgactgaaatcagt

SEQ ID NO: 3527603 - DNA, 11 bp, Homo sapiens
atctcacactc

SEQ ID NO: 3527604 - DNA, 19 bp, Homo sapiens
atctcccccatagcaccct

SEQ ID NO: 3527605 - DNA, 21 bp, Homo sapiens
atctcccccatagcaccctgc

SEQ ID NO: 3527606 - DNA, 15 bp, Homo sapiens
atctcctgtggctca

SEQ ID NO: 3527607 - DNA, 20 bp, Homo sapiens
atctcgttgaggccaaggaa

SEQ ID NO: 3527608 - DNA, 20 bp, Homo sapiens
atctctcaagagtgctgaga

SEQ ID NO: 3527609 - DNA, 17 bp, Homo sapiens
atctctccacctctagt

SEQ ID NO: 3527610 - DNA, 16 bp, Homo sapiens
atctgtaggtcactct

SEQ ID NO: 3527611 - DNA, 23 bp, Homo sapiens
atctgtaggtcactctccagcag

SEQ ID NO: 3527612 - DNA, 22 bp, Homo sapiens
atcttagaggcttgatgatgat

SEQ ID NO: 3527613 - DNA, 16 bp, Homo sapiens
atctttgtgaacattc

SEQ ID NO: 3527614 - DNA, 17 bp, Homo sapiens
atgaaacaactcatgtc

SEQ ID NO: 3527615 - DNA, 16 bp, Homo sapiens
atgaaatatagatgtt

SEQ ID NO: 3527616 - DNA, 17 bp, Homo sapiens
atgaagctaatgtgaat

SEQ ID NO: 3527617 - DNA, 21 bp, Homo sapiens
atgaagctaatgtgaatgtga

SEQ ID NO: 3527618 - DNA, 14 bp, Homo sapiens
atgaagtaaagttt

SEQ ID NO: 3527619 - DNA, 14 bp, Homo sapiens
atgaagtatttcat

SEQ ID NO: 3527620 - DNA, 14 bp, Homo sapiens
atgaatatttctta

SEQ ID NO: 3527621 - DNA, 17 bp, Homo sapiens
atgaatatttcttaagt

SEQ ID NO: 3527622 - DNA, 21 bp, Homo sapiens
atgaatatttcttaagtatct

SEQ ID NO: 3527623 - DNA, 20 bp, Homo sapiens
atgactgacccaaaatgtga

SEQ ID NO: 3527624 - DNA, 19 bp, Homo sapiens
atgacttgaggcacaaatc

SEQ ID NO: 3527625 - DNA, 22 bp, Homo sapiens
atgacttgaggcacaaatcact

SEQ ID NO: 3527626 - DNA, 17 bp, Homo sapiens
atgagatttttcatgta

SEQ ID NO: 3527627 - DNA, 13 bp, Homo sapiens
atgaggggaccca

SEQ ID NO: 3527628 - DNA, 15 bp, Homo sapiens
atgatgatggtgttg

SEQ ID NO: 3527629 - DNA, 13 bp, Homo sapiens
atgattccagcca

SEQ ID NO: 3527630 - DNA, 14 bp, Homo sapiens
atgattttgctgac

SEQ ID NO: 3527631 - DNA, 16 bp, Homo sapiens
atgcagtcatgagaat

SEQ ID NO: 3527632 - DNA, 20 bp, Homo sapiens
atgcatacaataaaagagct

SEQ ID NO: 3527633 - DNA, 17 bp, Homo sapiens
caccaaacatttctgtg

SEQ ID NO: 3527634 - DNA, 21 bp, Homo sapiens
caccacccctaaagtgccagg

SEQ ID NO: 3527635 - DNA, 15 bp, Homo sapiens
cacccaaggggcccg

SEQ ID NO: 3527636 - DNA, 20 bp, Homo sapiens
caccctgccctcatgggacc

SEQ ID NO: 3527637 - DNA, 23 bp, Homo sapiens
caccctgtcagacgttggtccca

SEQ ID NO: 3527638 - DNA, 17 bp, Homo sapiens
caccctttggagaccag

SEQ ID NO: 3527639 - DNA, 23 bp, Homo sapiens
caccctttggagaccaggcctca

SEQ ID NO: 3527640 - DNA, 17 bp, Homo sapiens
cacctccactcagcact

SEQ ID NO: 3527641 - DNA, 18 bp, Homo sapiens
cacctccactcagcactc

SEQ ID NO: 3527642 - DNA, 21 bp, Homo sapiens
caccttagaccaccaagcctt

SEQ ID NO: 3527643 - DNA, 16 bp, Homo sapiens
cacgatgcctttgagt

SEQ ID NO: 3527644 - DNA, 12 bp, Homo sapiens
cacgccacagcc

SEQ ID NO: 3527645 - DNA, 16 bp, Homo sapiens
cacgttcagggagggg

SEQ ID NO: 3527646 - DNA, 15 bp, Homo sapiens
cactaattgtccaca

SEQ ID NO: 3527647 - DNA, 12 bp, Homo sapiens
cactcagcactc

SEQ ID NO: 3527648 - DNA, 13 bp, Homo sapiens
cactcagcactct

SEQ ID NO: 3527649 - DNA, 17 bp, Homo sapiens
cactcatgcattgtcct

SEQ ID NO: 3527650 - DNA, 20 bp, Homo sapiens
cactctatccaaagtgtcac

SEQ ID NO: 3527651 - DNA, 23 bp, Homo sapiens
cactctctgcccctaaagatggg

SEQ ID NO: 3527652 - DNA, 20 bp, Homo sapiens
cactggatcaagttcagcca

SEQ ID NO: 3527653 - DNA, 23 bp, Homo sapiens
cactggatcaagttcagccaccg

SEQ ID NO: 3527654 - DNA, 13 bp, Homo sapiens
cactgtcatctgt

SEQ ID NO: 3527655 - DNA, 18 bp, Homo sapiens
cacttaaacttgcacatt

SEQ ID NO: 3527656 - DNA, 15 bp, Homo sapiens
cagaactagaaaccc

SEQ ID NO: 3527657 - DNA, 22 bp, Homo sapiens
cagaactataacattcaatttg

SEQ ID NO: 3527658 - DNA, 17 bp, Homo sapiens
cagaatgggggctttcg

SEQ ID NO: 3527659 - DNA, 15 bp, Homo sapiens
cagaccaaggcaggg

SEQ ID NO: 3527660 - DNA, 14 bp, Homo sapiens
cagacgactagccc

SEQ ID NO: 3527661 - DNA, 17 bp, Homo sapiens
cagacgactagcccagg

SEQ ID NO: 3527662 - DNA, 18 bp, Homo sapiens
cagacgactagcccagga

SEQ ID NO: 3527663 - DNA, 15 bp, Homo sapiens
cagagaggtggccac

SEQ ID NO: 3527664 - DNA, 12 bp, Homo sapiens
cagagccacagt

SEQ ID NO: 3527665 - DNA, 13 bp, Homo sapiens
cagagccacagtt

SEQ ID NO: 3527666 - DNA, 22 bp, Homo sapiens
cagaggcttttccagtgtgtat

SEQ ID NO: 3527667 - DNA, 23 bp, Homo sapiens
cagagtataattttggttgtaat

SEQ ID NO: 3527668 - DNA, 15 bp, Homo sapiens
cagatccaagatgtt

SEQ ID NO: 3527669 - DNA, 17 bp, Homo sapiens
cagattccacaggacac

SEQ ID NO: 3527670 - DNA, 14 bp, Homo sapiens
cagcacaataaata

SEQ ID NO: 3527671 - DNA, 17 bp, Homo sapiens
cagcagattccacagga

SEQ ID NO: 3527672 - DNA, 20 bp, Homo sapiens
cagcagattccacaggacac

SEQ ID NO: 3527673 - DNA, 16 bp, Homo sapiens
cagcagttaggcacct

SEQ ID NO: 3527674 - DNA, 16 bp, Homo sapiens
cagcccaaaccttggg

SEQ ID NO: 3527675 - DNA, 20 bp, Homo sapiens
cagccgtcagccatcagcca

SEQ ID NO: 3527676 - DNA, 15 bp, Homo sapiens
cagcggtccatgggt

SEQ ID NO: 3527677 - DNA, 22 bp, Homo sapiens
cagctcggttaagtacccgagg

SEQ ID NO: 3527678 - DNA, 19 bp, Homo sapiens
cagctctaagcagccagga

SEQ ID NO: 3527679 - DNA, 16 bp, Homo sapiens
cagctcttggtgggcc

SEQ ID NO: 3527680 - DNA, 23 bp, Homo sapiens
cagctcttggtgggcccagggac

SEQ ID NO: 3527681 - DNA, 16 bp, Homo sapiens
cagctgcccccagagc

SEQ ID NO: 3527682 - DNA, 17 bp, Homo sapiens
cagctgcccccagagcc

SEQ ID NO: 3527683 - DNA, 21 bp, Homo sapiens
cagctgcccccagagccacag

SEQ ID NO: 3527684 - DNA, 12 bp, Homo sapiens
cagctgggcagt

SEQ ID NO: 3527685 - DNA, 13 bp, Homo sapiens
cagctgggcagtg

SEQ ID NO: 3527686 - DNA, 20 bp, Homo sapiens
cagctgggcagtgccagcca

SEQ ID NO: 3527687 - DNA, 15 bp, Homo sapiens
caggctgcaggaggg

SEQ ID NO: 3527688 - DNA, 16 bp, Homo sapiens
caggctgcaggagggc

SEQ ID NO: 3527689 - DNA, 18 bp, Homo sapiens
caggctgcaggagggcac

SEQ ID NO: 3527690 - DNA, 21 bp, Homo sapiens
caggctgcaggagggcactgg

SEQ ID NO: 3527691 - DNA, 20 bp, Homo sapiens
caggctgttggcgtgtccca

SEQ ID NO: 3527692 - DNA, 14 bp, Homo sapiens
cagggaggcagagc

SEQ ID NO: 3527693 - DNA, 13 bp, Homo sapiens
cagggagggccag

SEQ ID NO: 3527694 - DNA, 14 bp, Homo sapiens
cagggaggggccgg

SEQ ID NO: 3527695 - DNA, 20 bp, Homo sapiens
cagggaggggccggctggcc

SEQ ID NO: 3527696 - DNA, 14 bp, Homo sapiens
cagggcccagcata

SEQ ID NO: 3527697 - DNA, 16 bp, Homo sapiens
cagggctgggccttgt

SEQ ID NO: 3527698 - DNA, 17 bp, Homo sapiens
caggggacgtgggccct

SEQ ID NO: 3527699 - DNA, 17 bp, Homo sapiens
actagcccaggacccat

SEQ ID NO: 3527700 - DNA, 15 bp, Homo sapiens
actaggtatgaagta

SEQ ID NO: 3527701 - DNA, 13 bp, Homo sapiens
actataacattca

SEQ ID NO: 3527702 - DNA, 21 bp, Homo sapiens
actatccttctctttcaatgt

SEQ ID NO: 3527703 - DNA, 16 bp, Homo sapiens
actcagaatgggggct

SEQ ID NO: 3527704 - DNA, 13 bp, Homo sapiens
actcagcagaggc

SEQ ID NO: 3527705 - DNA, 16 bp, Homo sapiens
actcatgcattgtcct

SEQ ID NO: 3527706 - DNA, 22 bp, Homo sapiens
actccaagaaacgtggatctcc

SEQ ID NO: 3527707 - DNA, 16 bp, Homo sapiens
actccacgatgccttt

SEQ ID NO: 3527708 - DNA, 20 bp, Homo sapiens
actccacgatgcctttgagt

SEQ ID NO: 3527709 - DNA, 21 bp, Homo sapiens
actccgaaagtctgaatctcc

SEQ ID NO: 3527710 - DNA, 22 bp, Homo sapiens
actccgaaagtctgaatctccc

SEQ ID NO: 3527711 - DNA, 20 bp, Homo sapiens
actcgggggctgtctcagac

SEQ ID NO: 3527712 - DNA, 15 bp, Homo sapiens
actgaaaaaatgctg

SEQ ID NO: 3527713 - DNA, 20 bp, Homo sapiens
actgagatttgtaaatcttt

SEQ ID NO: 3527714 - DNA, 23 bp, Homo sapiens
actgagatttgtaaatctttgtg

SEQ ID NO: 3527715 - DNA, 21 bp, Homo sapiens
actggagaccagaaaccttcc

SEQ ID NO: 3527716 - DNA, 16 bp, Homo sapiens
actgtcagggagggcc

SEQ ID NO: 3527717 - DNA, 13 bp, Homo sapiens
actgttcagtatt

SEQ ID NO: 3527718 - DNA, 14 bp, Homo sapiens
actgttcagtattg

SEQ ID NO: 3527719 - DNA, 15 bp, Homo sapiens
acttccccaccccta

SEQ ID NO: 3527720 - DNA, 18 bp, Homo sapiens
acttgaggcacaaatcac

SEQ ID NO: 3527721 - DNA, 15 bp, Homo sapiens
acttgcacatttgaa

SEQ ID NO: 3527722 - DNA, 18 bp, Homo sapiens
acttttcttctattgcct

SEQ ID NO: 3527723 - DNA, 14 bp, Homo sapiens
agaaaatttgcaac

SEQ ID NO: 3527724 - DNA, 23 bp, Homo sapiens
agaaaatttgcaacatataaagt

SEQ ID NO: 3527725 - DNA, 22 bp, Homo sapiens
agaaaccccgggccatcccact

SEQ ID NO: 3527726 - DNA, 15 bp, Homo sapiens
agaaaccttccagag

SEQ ID NO: 3527727 - DNA, 19 bp, Homo sapiens
agaaacggtctttatgaat

SEQ ID NO: 3527728 - DNA, 22 bp, Homo sapiens
agaaacgtggatctccccctca

SEQ ID NO: 3527729 - DNA, 20 bp, Homo sapiens
agaaagaattgcagtaaagt

SEQ ID NO: 3527730 - DNA, 18 bp, Homo sapiens
agaaagacaaaatgtgac

SEQ ID NO: 3527731 - DNA, 17 bp, Homo sapiens
agaaatatattatgaaa

SEQ ID NO: 3527732 - DNA, 21 bp, Homo sapiens
agaaccacggtgaaagtgctg

SEQ ID NO: 3527733 - DNA, 16 bp, Homo sapiens
agaactataacattca

SEQ ID NO: 3527734 - DNA, 13 bp, Homo sapiens
agaagaggaggag

SEQ ID NO: 3527735 - DNA, 19 bp, Homo sapiens
agaagctttcaggggaagg

SEQ ID NO: 3527736 - DNA, 22 bp, Homo sapiens
agaatgggggctttcggggagg

SEQ ID NO: 3527737 - DNA, 18 bp, Homo sapiens
agaattacagaaaatttg

SEQ ID NO: 3527738 - DNA, 19 bp, Homo sapiens
agaattacagaaaatttgc

SEQ ID NO: 3527739 - DNA, 16 bp, Homo sapiens
agaattgcagtaaagt

SEQ ID NO: 3527740 - DNA, 14 bp, Homo sapiens
agaccaccaagcct

SEQ ID NO: 3527741 - DNA, 14 bp, Homo sapiens
agagactctccctg

SEQ ID NO: 3527742 - DNA, 20 bp, Homo sapiens
agagagctcgttcctacctg

SEQ ID NO: 3527743 - DNA, 13 bp, Homo sapiens
agagaggcctgct

SEQ ID NO: 3527744 - DNA, 14 bp, Homo sapiens
agagaggtggccac

SEQ ID NO: 3527745 - DNA, 15 bp, Homo sapiens
agagccactcttcaa

SEQ ID NO: 3527746 - DNA, 17 bp, Homo sapiens
agagcgttactgtagac

SEQ ID NO: 3527747 - DNA, 19 bp, Homo sapiens
agaggaatgatgggctttt

SEQ ID NO: 3527748 - DNA, 19 bp, Homo sapiens
agaggaggaggtgggggct

SEQ ID NO: 3527749 - DNA, 22 bp, Homo sapiens
agaggctggtgtatgcactgct

SEQ ID NO: 3527750 - DNA, 14 bp, Homo sapiens
agaggggagggagg

SEQ ID NO: 3527751 - DNA, 15 bp, Homo sapiens
agaggggagggaggg

SEQ ID NO: 3527752 - DNA, 19 bp, Homo sapiens
agagtataattttggttgt

SEQ ID NO: 3527753 - DNA, 12 bp, Homo sapiens
agagtgctctga

SEQ ID NO: 3527754 - DNA, 18 bp, Homo sapiens
agatcttatttattaact

SEQ ID NO: 3527755 - DNA, 17 bp, Homo sapiens
agatgttttatttatga

SEQ ID NO: 3527756 - DNA, 18 bp, Homo sapiens
agatgttttatttatgaa

SEQ ID NO: 3527757 - DNA, 21 bp, Homo sapiens
agatgttttatttatgaagtt

SEQ ID NO: 3527758 - DNA, 13 bp, Homo sapiens
agattcaggggaa

SEQ ID NO: 3527759 - DNA, 23 bp, Homo sapiens
agattccacaggacacgaaggct

SEQ ID NO: 3527760 - DNA, 17 bp, Homo sapiens
agattctttgagatagc

SEQ ID NO: 3527761 - DNA, 19 bp, Homo sapiens
agattgttaaattcaatgc

SEQ ID NO: 3527762 - DNA, 13 bp, Homo sapiens
agatttgtaaatc

SEQ ID NO: 3527763 - DNA, 18 bp, Homo sapiens
agatttgtaaatctttgt

SEQ ID NO: 3527764 - DNA, 20 bp, Homo sapiens
agatttgtaaatctttgtga

SEQ ID NO: 3527765 - DNA, 12 bp, Homo sapiens
agatttttcatg

SEQ ID NO: 3527766 - DNA, 14 bp, Homo sapiens
agatttttcatgta

SEQ ID NO: 3527767 - DNA, 15 bp, Homo sapiens
agcaaccctctgaag

SEQ ID NO: 3527768 - DNA, 15 bp, Homo sapiens
agcaatcattaagtg

SEQ ID NO: 3527769 - DNA, 13 bp, Homo sapiens
agcaatctgaccc

SEQ ID NO: 3527770 - DNA, 15 bp, Homo sapiens
agcaatgttccagga

SEQ ID NO: 3527771 - DNA, 13 bp, Homo sapiens
agcaccctgccct

SEQ ID NO: 3527772 - DNA, 14 bp, Homo sapiens
agcacggggaggaa

SEQ ID NO: 3527773 - DNA, 12 bp, Homo sapiens
agcactctggac

SEQ ID NO: 3527774 - DNA, 14 bp, Homo sapiens
agcactctggactc

SEQ ID NO: 3527775 - DNA, 23 bp, Homo sapiens
agcagaaatatattatgaaaatt

SEQ ID NO: 3527776 - DNA, 14 bp, Homo sapiens
agcagaggcagtgg

SEQ ID NO: 3527777 - DNA, 18 bp, Homo sapiens
agcagaggcagtggccac

SEQ ID NO: 3527778 - DNA, 13 bp, Homo sapiens
agcagattccaca

SEQ ID NO: 3527779 - DNA, 17 bp, Homo sapiens
agcagattccacaggac

SEQ ID NO: 3527780 - DNA, 15 bp, Homo sapiens
agcagccaggaggga

SEQ ID NO: 3527781 - DNA, 14 bp, Homo sapiens
agcagttaggcacc

SEQ ID NO: 3527782 - DNA, 18 bp, Homo sapiens
agcatacaccaaacattt

SEQ ID NO: 3527783 - DNA, 19 bp, Homo sapiens
agcatacaccaaacatttc

SEQ ID NO: 3527784 - DNA, 20 bp, Homo sapiens
agcatacaccaaacatttct

SEQ ID NO: 3527785 - DNA, 21 bp, Homo sapiens
agcatgcagcgaattcagaaa

SEQ ID NO: 3527786 - DNA, 14 bp, Homo sapiens
agcatttgacacac

SEQ ID NO: 3527787 - DNA, 21 bp, Homo sapiens
agccacagcccccgggacacc

SEQ ID NO: 3527788 - DNA, 19 bp, Homo sapiens
agccagcccaaaccttggg

SEQ ID NO: 3527789 - DNA, 14 bp, Homo sapiens
agccagctgccccc

SEQ ID NO: 3527790 - DNA, 13 bp, Homo sapiens
agccaggagggac

SEQ ID NO: 3527791 - DNA, 17 bp, Homo sapiens
agccaggagggacctgc

SEQ ID NO: 3527792 - DNA, 14 bp, Homo sapiens
agccatcaccttag

SEQ ID NO: 3527793 - DNA, 14 bp, Homo sapiens
agcccaaaccttgg

SEQ ID NO: 3527794 - DNA, 17 bp, Homo sapiens
agcccagccttttgaga

SEQ ID NO: 3527795 - DNA, 15 bp, Homo sapiens
agcccccgggacacc

SEQ ID NO: 3527796 - DNA, 22 bp, Homo sapiens
agccctccccatctcggggctg

SEQ ID NO: 3527797 - DNA, 16 bp, Homo sapiens
agccctggtgaccaga

SEQ ID NO: 3527798 - DNA, 15 bp, Homo sapiens
agcccttttgtctct

SEQ ID NO: 3527799 - DNA, 14 bp, Homo sapiens
agccgtcagccatc

SEQ ID NO: 3527800 - DNA, 20 bp, Homo sapiens
agcctgggtgtaaaacctgg

SEQ ID NO: 3527801 - DNA, 15 bp, Homo sapiens
agcctgtgaccttgg

SEQ ID NO: 3527802 - DNA, 19 bp, Homo sapiens
agccttgattggtgttgcc

SEQ ID NO: 3527803 - DNA, 20 bp, Homo sapiens
agcgctggcccccccagccc

SEQ ID NO: 3527804 - DNA, 22 bp, Homo sapiens
agcgggagggagtctcaggagg

SEQ ID NO: 3527805 - DNA, 16 bp, Homo sapiens
agctataacatattta

SEQ ID NO: 3527806 - DNA, 15 bp, Homo sapiens
agctcgggtctccct

SEQ ID NO: 3527807 - DNA, 19 bp, Homo sapiens
agctctaagcagccaggag

SEQ ID NO: 3527808 - DNA, 18 bp, Homo sapiens
agctcttgctatctctca

SEQ ID NO: 3527809 - DNA, 12 bp, Homo sapiens
cagccagaaagg

SEQ ID NO: 3527810 - DNA, 13 bp, Homo sapiens
cagccagaaagga

SEQ ID NO: 3527811 - DNA, 21 bp, Homo sapiens
cagccatcaccttagaccacc

SEQ ID NO: 3527812 - DNA, 15 bp, Homo sapiens
cagccatcagccatg

SEQ ID NO: 3527813 - DNA, 16 bp, Homo sapiens
cagccgtcagccatca

SEQ ID NO: 3527814 - DNA, 18 bp, Homo sapiens
cagcgaattcagaaagag

SEQ ID NO: 3527815 - DNA, 19 bp, Homo sapiens
cagcgccggggggagggag

SEQ ID NO: 3527816 - DNA, 18 bp, Homo sapiens
cagcggtccatgggtctg

SEQ ID NO: 3527817 - DNA, 19 bp, Homo sapiens
cagctcttggtgggcccag

SEQ ID NO: 3527818 - DNA, 18 bp, Homo sapiens
cagctgcccccagagcca

SEQ ID NO: 3527819 - DNA, 20 bp, Homo sapiens
cagctgcccccagagccaca

SEQ ID NO: 3527820 - DNA, 22 bp, Homo sapiens
cagctgcccccagagccacagt

SEQ ID NO: 3527821 - DNA, 19 bp, Homo sapiens
cagctgggcagtgccagcc

SEQ ID NO: 3527822 - DNA, 12 bp, Homo sapiens
caggagggacct

SEQ ID NO: 3527823 - DNA, 15 bp, Homo sapiens
caggcccgcgggcac

SEQ ID NO: 3527824 - DNA, 22 bp, Homo sapiens
caggcccgcgggcacagccagc

SEQ ID NO: 3527825 - DNA, 20 bp, Homo sapiens
caggcctagaggcctgactg

SEQ ID NO: 3527826 - DNA, 19 bp, Homo sapiens
caggctgttggcgtgtccc

SEQ ID NO: 3527827 - DNA, 20 bp, Homo sapiens
cagggacacccacacaggtg

SEQ ID NO: 3527828 - DNA, 21 bp, Homo sapiens
cagggaggcagagcgggaggg

SEQ ID NO: 3527829 - DNA, 14 bp, Homo sapiens
cagggagggccagg

SEQ ID NO: 3527830 - DNA, 15 bp, Homo sapiens
cagggagggccaggg

SEQ ID NO: 3527831 - DNA, 18 bp, Homo sapiens
cagggagggccagggagg

SEQ ID NO: 3527832 - DNA, 19 bp, Homo sapiens
cagggagggccagggaggc

SEQ ID NO: 3527833 - DNA, 18 bp, Homo sapiens
cagggcccctgaccctcc

SEQ ID NO: 3527834 - DNA, 12 bp, Homo sapiens
caggggaagggc

SEQ ID NO: 3527835 - DNA, 15 bp, Homo sapiens
caggggaagggcagg

SEQ ID NO: 3527836 - DNA, 18 bp, Homo sapiens
caggggaagggcaggcac

SEQ ID NO: 3527837 - DNA, 23 bp, Homo sapiens
cagggggcccctttgctgaccct

SEQ ID NO: 3527838 - DNA, 15 bp, Homo sapiens
cagggtggagctgag

SEQ ID NO: 3527839 - DNA, 16 bp, Homo sapiens
cagggtgtcctgaggt

SEQ ID NO: 3527840 - DNA, 16 bp, Homo sapiens
caggtgatctcctgtg

SEQ ID NO: 3527841 - DNA, 21 bp, Homo sapiens
caggtggggtgatggccagag

SEQ ID NO: 3527842 - DNA, 16 bp, Homo sapiens
cagtcaccaagtgtat

SEQ ID NO: 3527843 - DNA, 23 bp, Homo sapiens
cagtcaccaagtgtattgtaatg

SEQ ID NO: 3527844 - DNA, 23 bp, Homo sapiens
cagtcatgagaattacagaaaat

SEQ ID NO: 3527845 - DNA, 22 bp, Homo sapiens
cagtctcacatgattccagcca

SEQ ID NO: 3527846 - DNA, 23 bp, Homo sapiens
cagtggtgttacattttcttgtc

SEQ ID NO: 3527847 - DNA, 17 bp, Homo sapiens
cagtgttaaagtggtct

SEQ ID NO: 3527848 - DNA, 19 bp, Homo sapiens
cagtttaatattccaatac

SEQ ID NO: 3527849 - DNA, 13 bp, Homo sapiens
cataaaggacact

SEQ ID NO: 3527850 - DNA, 19 bp, Homo sapiens
cataaaggacactggatca

SEQ ID NO: 3527851 - DNA, 20 bp, Homo sapiens
cataagcacagaaatctgaa

SEQ ID NO: 3527852 - DNA, 15 bp, Homo sapiens
catacaataaaagag

SEQ ID NO: 3527853 - DNA, 17 bp, Homo sapiens
catacaataaaagagct

SEQ ID NO: 3527854 - DNA, 22 bp, Homo sapiens
catacaataaaagagctttatc

SEQ ID NO: 3527855 - DNA, 18 bp, Homo sapiens
catactgaaaaaatgctg

SEQ ID NO: 3527856 - DNA, 23 bp, Homo sapiens
catactgaaaaaatgctgagcca

SEQ ID NO: 3527857 - DNA, 13 bp, Homo sapiens
cataggggcaggt

SEQ ID NO: 3527858 - DNA, 19 bp, Homo sapiens
catatgaggggacccagcg

SEQ ID NO: 3527859 - DNA, 13 bp, Homo sapiens
catatgtggaaat

SEQ ID NO: 3527860 - DNA, 17 bp, Homo sapiens
catcaaaggagattctt

SEQ ID NO: 3527861 - DNA, 19 bp, Homo sapiens
catcaggcctagaggcctg

SEQ ID NO: 3527862 - DNA, 21 bp, Homo sapiens
catcataagatagttacattt

SEQ ID NO: 3527863 - DNA, 15 bp, Homo sapiens
catctcggggctgct

SEQ ID NO: 3527864 - DNA, 17 bp, Homo sapiens
catctcggggctgctgt

SEQ ID NO: 3527865 - DNA, 23 bp, Homo sapiens
catctgtaggtcactctccagca

SEQ ID NO: 3527866 - DNA, 19 bp, Homo sapiens
catctttggcaaaggtccc

SEQ ID NO: 3527867 - DNA, 23 bp, Homo sapiens
catgacttgaggcacaaatcact

SEQ ID NO: 3527868 - DNA, 19 bp, Homo sapiens
catgcagcgaattcagaaa

SEQ ID NO: 3527869 - DNA, 15 bp, Homo sapiens
catgcattgtcctct

SEQ ID NO: 3527870 - DNA, 13 bp, Homo sapiens
catgggtctggcc

SEQ ID NO: 3527871 - DNA, 15 bp, Homo sapiens
catgggtctggcctg

SEQ ID NO: 3527872 - DNA, 21 bp, Homo sapiens
catgtctttattagtaacatc

SEQ ID NO: 3527873 - DNA, 21 bp, Homo sapiens
cattcaatttgctatttacaa

SEQ ID NO: 3527874 - DNA, 17 bp, Homo sapiens
cattctgataggagggg

SEQ ID NO: 3527875 - DNA, 20 bp, Homo sapiens
cattcttcggtctgaatttt

SEQ ID NO: 3527876 - DNA, 13 bp, Homo sapiens
cattgagggctct

SEQ ID NO: 3527877 - DNA, 13 bp, Homo sapiens
cattgtcctcttt

SEQ ID NO: 3527878 - DNA, 13 bp, Homo sapiens
catttcaaaatat

SEQ ID NO: 3527879 - DNA, 16 bp, Homo sapiens
catttgaattcatttg

SEQ ID NO: 3527880 - DNA, 14 bp, Homo sapiens
ccaaacatttctgt

SEQ ID NO: 3527881 - DNA, 16 bp, Homo sapiens
ccaactccgaaagtct

SEQ ID NO: 3527882 - DNA, 22 bp, Homo sapiens
ccaactccgaaagtctgaatct

SEQ ID NO: 3527883 - DNA, 14 bp, Homo sapiens
ccaaggagcagaga

SEQ ID NO: 3527884 - DNA, 15 bp, Homo sapiens
ccaaggcagggccca

SEQ ID NO: 3527885 - DNA, 14 bp, Homo sapiens
ccaatccctggcca

SEQ ID NO: 3527886 - DNA, 18 bp, Homo sapiens
ccaatctgtgagaagttt

SEQ ID NO: 3527887 - DNA, 14 bp, Homo sapiens
ccacacaggtggcc

SEQ ID NO: 3527888 - DNA, 15 bp, Homo sapiens
ccacacaggtggcca

SEQ ID NO: 3527889 - DNA, 17 bp, Homo sapiens
ccacacaggtggccatc

SEQ ID NO: 3527890 - DNA, 20 bp, Homo sapiens
ccacagcccttttgtctctg

SEQ ID NO: 3527891 - DNA, 19 bp, Homo sapiens
ccaccctttcatagagagg

SEQ ID NO: 3527892 - DNA, 17 bp, Homo sapiens
ccaccctttggagacca

SEQ ID NO: 3527893 - DNA, 19 bp, Homo sapiens
ccaccctttggagaccagg

SEQ ID NO: 3527894 - DNA, 18 bp, Homo sapiens
ccacgccacagccctttt

SEQ ID NO: 3527895 - DNA, 19 bp, Homo sapiens
ccacggtgaaagtgctgct

SEQ ID NO: 3527896 - DNA, 17 bp, Homo sapiens
ccacgttcagggagggg

SEQ ID NO: 3527897 - DNA, 15 bp, Homo sapiens
ccagaccaaggcagg

SEQ ID NO: 3527898 - DNA, 14 bp, Homo sapiens
ccagagccacagtt

SEQ ID NO: 3527899 - DNA, 22 bp, Homo sapiens
ccagaggaatgatgggcttttg

SEQ ID NO: 3527900 - DNA, 23 bp, Homo sapiens
ccagaggaatgatgggcttttgt

SEQ ID NO: 3527901 - DNA, 18 bp, Homo sapiens
ccagatgttttatttatg

SEQ ID NO: 3527902 - DNA, 19 bp, Homo sapiens
ccagatgttttatttatga

SEQ ID NO: 3527903 - DNA, 23 bp, Homo sapiens
ccagccatcaccttagaccacca

SEQ ID NO: 3527904 - DNA, 13 bp, Homo sapiens
ccagccttttgag

SEQ ID NO: 3527905 - DNA, 21 bp, Homo sapiens
ccagcgctggcccccccagcc

SEQ ID NO: 3527906 - DNA, 22 bp, Homo sapiens
ccagcgctggcccccccagccc

SEQ ID NO: 3527907 - DNA, 19 bp, Homo sapiens
ccagcggtccatgggtctg

SEQ ID NO: 3527908 - DNA, 18 bp, Homo sapiens
ccagctctaagcagccag

SEQ ID NO: 3527909 - DNA, 21 bp, Homo sapiens
ccagctgcccccagagccaca

SEQ ID NO: 3527910 - DNA, 17 bp, Homo sapiens
ccagcttttcctcaggg

SEQ ID NO: 3527911 - DNA, 19 bp, Homo sapiens
ccaggacccatctttctca

SEQ ID NO: 3527912 - DNA, 18 bp, Homo sapiens
ccaggcccgcgggcacag

SEQ ID NO: 3527913 - DNA, 17 bp, Homo sapiens
ccagggacacccacaca

SEQ ID NO: 3527914 - DNA, 22 bp, Homo sapiens
ccagggtggagctgagaagagg

SEQ ID NO: 3527915 - DNA, 20 bp, Homo sapiens
ccaggtgatctcctgtggct

SEQ ID NO: 3527916 - DNA, 12 bp, Homo sapiens
ccagttgtcctc

SEQ ID NO: 3527917 - DNA, 14 bp, Homo sapiens
ccagttgtcctcct

SEQ ID NO: 3527918 - DNA, 21 bp, Homo sapiens
gaatttacctcttatgagctc

SEQ ID NO: 3527919 - DNA, 15 bp, Homo sapiens
gaatttgtatcatgt

SEQ ID NO: 3527920 - DNA, 14 bp, Homo sapiens
gacaacactaattg

SEQ ID NO: 3527921 - DNA, 22 bp, Homo sapiens
gacaacactaattgtccacagc

SEQ ID NO: 3527922 - DNA, 10 bp, Homo sapiens
gacacaccca

SEQ ID NO: 3527923 - DNA, 16 bp, Homo sapiens
gacaccgtggggaagg

SEQ ID NO: 3527924 - DNA, 21 bp, Homo sapiens
gaccaaggcagggcccagcat

SEQ ID NO: 3527925 - DNA, 14 bp, Homo sapiens
gaccaccaagcctt

SEQ ID NO: 3527926 - DNA, 15 bp, Homo sapiens
gaccaccaagccttg

SEQ ID NO: 3527927 - DNA, 21 bp, Homo sapiens
gaccagcggtccatgggtctg

SEQ ID NO: 3527928 - DNA, 23 bp, Homo sapiens
gaccagggtggagctgagaagag

SEQ ID NO: 3527929 - DNA, 14 bp, Homo sapiens
gacccatctttctc

SEQ ID NO: 3527930 - DNA, 15 bp, Homo sapiens
gacccatctttctca

SEQ ID NO: 3527931 - DNA, 14 bp, Homo sapiens
gaccccactgcagc

SEQ ID NO: 3527932 - DNA, 17 bp, Homo sapiens
gacccccgcagaggcag

SEQ ID NO: 3527933 - DNA, 22 bp, Homo sapiens
gaccttgggaccaaagggggag

SEQ ID NO: 3527934 - DNA, 13 bp, Homo sapiens
gacggcgctgcct

SEQ ID NO: 3527935 - DNA, 17 bp, Homo sapiens
gacggcgctgcctcagg

SEQ ID NO: 3527936 - DNA, 14 bp, Homo sapiens
gacgtgggccctgc

SEQ ID NO: 3527937 - DNA, 23 bp, Homo sapiens
gacgtgggccctgcaggctgcag

SEQ ID NO: 3527938 - DNA, 18 bp, Homo sapiens
gactccacgatgcctttg

SEQ ID NO: 3527939 - DNA, 17 bp, Homo sapiens
gactgacccaaaatgtg

SEQ ID NO: 3527940 - DNA, 16 bp, Homo sapiens
gactgagatttgtaaa

SEQ ID NO: 3527941 - DNA, 16 bp, Homo sapiens
gactgccaagccatgg

SEQ ID NO: 3527942 - DNA, 15 bp, Homo sapiens
gactgtcagggaggg

SEQ ID NO: 3527943 - DNA, 16 bp, Homo sapiens
gactgtcagggagggc

SEQ ID NO: 3527944 - DNA, 17 bp, Homo sapiens
gactgtcagggagggcc

SEQ ID NO: 3527945 - DNA, 18 bp, Homo sapiens
gacttttggccccagcgc

SEQ ID NO: 3527946 - DNA, 21 bp, Homo sapiens
gagaaagacaaaatgtgacca

SEQ ID NO: 3527947 - DNA, 13 bp, Homo sapiens
gagaagaggagga

SEQ ID NO: 3527948 - DNA, 15 bp, Homo sapiens
gagaattacagaaaa

SEQ ID NO: 3527949 - DNA, 22 bp, Homo sapiens
gagaggctggtgtatgcactgc

SEQ ID NO: 3527950 - DNA, 17 bp, Homo sapiens
gagcctgtgaccttggg

SEQ ID NO: 3527951 - DNA, 14 bp, Homo sapiens
gagcgggagggagt

SEQ ID NO: 3527952 - DNA, 15 bp, Homo sapiens
gagctcttgctatct

SEQ ID NO: 3527953 - DNA, 18 bp, Homo sapiens
gagctgagaagaggagga

SEQ ID NO: 3527954 - DNA, 23 bp, Homo sapiens
gagctgagaagaggaggaggtgg

SEQ ID NO: 3527955 - DNA, 14 bp, Homo sapiens
gaggagaccagcgg

SEQ ID NO: 3527956 - DNA, 19 bp, Homo sapiens
gaggaggctgccctgaggg

SEQ ID NO: 3527957 - DNA, 21 bp, Homo sapiens
gaggatttccctgaagctatg

SEQ ID NO: 3527958 - DNA, 15 bp, Homo sapiens
gaggcttttccagtg

SEQ ID NO: 3527959 - DNA, 16 bp, Homo sapiens
gaggcttttccagtgt

SEQ ID NO: 3527960 - DNA, 20 bp, Homo sapiens
gagggaagtcctgggaggat

SEQ ID NO: 3527961 - DNA, 15 bp, Homo sapiens
gagggagtctcagga

SEQ ID NO: 3527962 - DNA, 22 bp, Homo sapiens
gagggagtctcaggaggaggct

SEQ ID NO: 3527963 - DNA, 19 bp, Homo sapiens
gagggcactggagctggga

SEQ ID NO: 3527964 - DNA, 16 bp, Homo sapiens
gagggccagggaggca

SEQ ID NO: 3527965 - DNA, 17 bp, Homo sapiens
gagggccagggaggcag

SEQ ID NO: 3527966 - DNA, 20 bp, Homo sapiens
gagggccagggaggcagagc

SEQ ID NO: 3527967 - DNA, 11 bp, Homo sapiens
gaggggaccca

SEQ ID NO: 3527968 - DNA, 13 bp, Homo sapiens
gaggggacccagc

SEQ ID NO: 3527969 - DNA, 19 bp, Homo sapiens
gaggggctggggagggggt

SEQ ID NO: 3527970 - DNA, 13 bp, Homo sapiens
gaggtggccaccg

SEQ ID NO: 3527971 - DNA, 22 bp, Homo sapiens
gaggtgggggctggaggtgctg

SEQ ID NO: 3527972 - DNA, 23 bp, Homo sapiens
gagtaacgttttccttgtgacta

SEQ ID NO: 3527973 - DNA, 16 bp, Homo sapiens
gagtactcataaagga

SEQ ID NO: 3527974 - DNA, 17 bp, Homo sapiens
gagtactcataaaggac

SEQ ID NO: 3527975 - DNA, 18 bp, Homo sapiens
gagtagtcagaactataa

SEQ ID NO: 3527976 - DNA, 15 bp, Homo sapiens
gagtatacatgactg

SEQ ID NO: 3527977 - DNA, 16 bp, Homo sapiens
gagtcctccaccccat

SEQ ID NO: 3527978 - DNA, 16 bp, Homo sapiens
gagtctcaggaggagg

SEQ ID NO: 3527979 - DNA, 11 bp, Homo sapiens
gagtgctctga

SEQ ID NO: 3527980 - DNA, 14 bp, Homo sapiens
gataggagggggcg

SEQ ID NO: 3527981 - DNA, 22 bp, Homo sapiens
gataggagggggcggcagggct

SEQ ID NO: 3527982 - DNA, 13 bp, Homo sapiens
gatcaagttcagc

SEQ ID NO: 3527983 - DNA, 22 bp, Homo sapiens
gatccatactgaaaaaatgctg

SEQ ID NO: 3527984 - DNA, 19 bp, Homo sapiens
gatccccacgccacagccc

SEQ ID NO: 3527985 - DNA, 21 bp, Homo sapiens
gatccccacgccacagccctt

SEQ ID NO: 3527986 - DNA, 14 bp, Homo sapiens
gatctcctgtggct

SEQ ID NO: 3527987 - DNA, 20 bp, Homo sapiens
gatgatccccacgccacagc

SEQ ID NO: 3527988 - DNA, 21 bp, Homo sapiens
gatgatccccacgccacagcc

SEQ ID NO: 3527989 - DNA, 19 bp, Homo sapiens
gatgcattctgataggagg

SEQ ID NO: 3527990 - DNA, 21 bp, Homo sapiens
gatgggcttttgttctgaggg

SEQ ID NO: 3527991 - DNA, 20 bp, Homo sapiens
gatgtatgctgtttgtacaa

SEQ ID NO: 3527992 - DNA, 21 bp, Homo sapiens
gatgttacaaggtgttgttaa

SEQ ID NO: 3527993 - DNA, 16 bp, Homo sapiens
gattcaggggaagggc

SEQ ID NO: 3527994 - DNA, 20 bp, Homo sapiens
gattcaggggaagggcaggc

SEQ ID NO: 3527995 - DNA, 13 bp, Homo sapiens
gattgttaaattc

SEQ ID NO: 3527996 - DNA, 18 bp, Homo sapiens
gatttccctgaagctatg

SEQ ID NO: 3527997 - DNA, 14 bp, Homo sapiens
gatttgtaaatctt

SEQ ID NO: 3527998 - DNA, 22 bp, Homo sapiens
gatttttcatatgtggaaatat

SEQ ID NO: 3527999 - DNA, 19 bp, Homo sapiens
gcaaagggattactagaga

SEQ ID NO: 3528000 - DNA, 14 bp, Homo sapiens
gcaaagggcaagga

SEQ ID NO: 3528001 - DNA, 22 bp, Homo sapiens
gcaacaatcagacatgagtcca

SEQ ID NO: 3528002 - DNA, 14 bp, Homo sapiens
gcaagtgagagggg

SEQ ID NO: 3528003 - DNA, 21 bp, Homo sapiens
gcaagtgagaggggagggagg

SEQ ID NO: 3528004 - DNA, 15 bp, Homo sapiens
gcacaaatcactgtg

SEQ ID NO: 3528005 - DNA, 14 bp, Homo sapiens
gcacaataaatata

SEQ ID NO: 3528006 - DNA, 17 bp, Homo sapiens
gcaccatcttacagaga

SEQ ID NO: 3528007 - DNA, 16 bp, Homo sapiens
gcactggagctgggag

SEQ ID NO: 3528008 - DNA, 22 bp, Homo sapiens
gcactggagctgggaggtctcg

SEQ ID NO: 3528009 - DNA, 14 bp, Homo sapiens
gcagagcgggaggg

SEQ ID NO: 3528010 - DNA, 17 bp, Homo sapiens
gcagaggcttttccagt

SEQ ID NO: 3528011 - DNA, 13 bp, Homo sapiens
gcagccaggaggg

SEQ ID NO: 3528012 - DNA, 13 bp, Homo sapiens
gcaggagggcact

SEQ ID NO: 3528013 - DNA, 19 bp, Homo sapiens
gcagggcccctgaccctcc

SEQ ID NO: 3528014 - DNA, 23 bp, Homo sapiens
gcagggcccctgaccctcccggc

SEQ ID NO: 3528015 - DNA, 17 bp, Homo sapiens
gcagtatatcacagagc

SEQ ID NO: 3528016 - DNA, 20 bp, Homo sapiens
gcagtgtagggagttgtggg

SEQ ID NO: 3528017 - DNA, 22 bp, Homo sapiens
gcagttaggcaccttaactgga

SEQ ID NO: 3528018 - DNA, 15 bp, Homo sapiens
gcatacaataaaaga

SEQ ID NO: 3528019 - DNA, 22 bp, Homo sapiens
gcatacaataaaagagctttat

SEQ ID NO: 3528020 - DNA, 20 bp, Homo sapiens
gcatacaccaaacatttctg

SEQ ID NO: 3528021 - DNA, 19 bp, Homo sapiens
gcatcaggcctagaggcct

SEQ ID NO: 3528022 - DNA, 13 bp, Homo sapiens
gcattaaaattaa

SEQ ID NO: 3528023 - DNA, 19 bp, Homo sapiens
gcatttgaatactcctgtt

SEQ ID NO: 3528024 - DNA, 20 bp, Homo sapiens
gccacagcccttttgtctct

SEQ ID NO: 3528025 - DNA, 14 bp, Homo sapiens
gccacagttcccct

SEQ ID NO: 3528026 - DNA, 15 bp, Homo sapiens
gccacagttccccta

SEQ ID NO: 3528027 - DNA, 14 bp, Homo sapiens
gccaccgggggtgg

SEQ ID NO: 3528028 - DNA, 14 bp, Homo sapiens
tagtagcagaaata

SEQ ID NO: 3528029 - DNA, 13 bp, Homo sapiens
tagttacatttat

SEQ ID NO: 3528030 - DNA, 12 bp, Homo sapiens
tagtttctgagt

SEQ ID NO: 3528031 - DNA, 20 bp, Homo sapiens
tagtttctgagttttaccaa

SEQ ID NO: 3528032 - DNA, 18 bp, Homo sapiens
tataacattcaatttgct

SEQ ID NO: 3528033 - DNA, 22 bp, Homo sapiens
tataagtgaacaactggaaata

SEQ ID NO: 3528034 - DNA, 23 bp, Homo sapiens
tatacacttaaacttgcacattt

SEQ ID NO: 3528035 - DNA, 17 bp, Homo sapiens
tatagtcactcattctt

SEQ ID NO: 3528036 - DNA, 14 bp, Homo sapiens
tatattatgaaaat

SEQ ID NO: 3528037 - DNA, 20 bp, Homo sapiens
tatctcaacaacatgtcaaa

SEQ ID NO: 3528038 - DNA, 21 bp, Homo sapiens
tatctcaacaacatgtcaaag

SEQ ID NO: 3528039 - DNA, 12 bp, Homo sapiens
tatctcacactc

SEQ ID NO: 3528040 - DNA, 19 bp, Homo sapiens
tatgaattattttgataaa

SEQ ID NO: 3528041 - DNA, 22 bp, Homo sapiens
tatgctaatatttttaacaagt

SEQ ID NO: 3528042 - DNA, 17 bp, Homo sapiens
tatgctgtttgtacaaa

SEQ ID NO: 3528043 - DNA, 21 bp, Homo sapiens
tattatgaaaattaagattat

SEQ ID NO: 3528044 - DNA, 20 bp, Homo sapiens
tattctccagaccaaagcaa

SEQ ID NO: 3528045 - DNA, 12 bp, Homo sapiens
tattgtctgatt

SEQ ID NO: 3528046 - DNA, 16 bp, Homo sapiens
tattgtctgattgaaa

SEQ ID NO: 3528047 - DNA, 16 bp, Homo sapiens
tatttatgctaatatt

SEQ ID NO: 3528048 - DNA, 20 bp, Homo sapiens
tatttattaactaggtatga

SEQ ID NO: 3528049 - DNA, 14 bp, Homo sapiens
tatttcagaatatt

SEQ ID NO: 3528050 - DNA, 18 bp, Homo sapiens
tatttcagaatattttgt

SEQ ID NO: 3528051 - DNA, 15 bp, Homo sapiens
tattttaaacatttt

SEQ ID NO: 3528052 - DNA, 14 bp, Homo sapiens
tattttgataaatt

SEQ ID NO: 3528053 - DNA, 17 bp, Homo sapiens
tattttgataaattact

SEQ ID NO: 3528054 - DNA, 15 bp, Homo sapiens
tcaaaatatgtgtat

SEQ ID NO: 3528055 - DNA, 21 bp, Homo sapiens
tcaaattctccctaaagtgtt

SEQ ID NO: 3528056 - DNA, 19 bp, Homo sapiens
tcaaggagtcttctaatgt

SEQ ID NO: 3528057 - DNA, 20 bp, Homo sapiens
tcacacggatttagtcccac

SEQ ID NO: 3528058 - DNA, 22 bp, Homo sapiens
tcacagagccactcttcaagta

SEQ ID NO: 3528059 - DNA, 16 bp, Homo sapiens
tcacagccccatggac

SEQ ID NO: 3528060 - DNA, 17 bp, Homo sapiens
tcacagtcaccaagtgt

SEQ ID NO: 3528061 - DNA, 18 bp, Homo sapiens
tcacatccagttgtctaa

SEQ ID NO: 3528062 - DNA, 20 bp, Homo sapiens
tcaccttagaccaccaagcc

SEQ ID NO: 3528063 - DNA, 17 bp, Homo sapiens
tcactgtggggaaacaa

SEQ ID NO: 3528064 - DNA, 22 bp, Homo sapiens
tcagcacaataaatatacttct

SEQ ID NO: 3528065 - DNA, 16 bp, Homo sapiens
tcagcactctggactc

SEQ ID NO: 3528066 - DNA, 20 bp, Homo sapiens
tcagcagaggcagtggccac

SEQ ID NO: 3528067 - DNA, 16 bp, Homo sapiens
tcagccatcagccatg

SEQ ID NO: 3528068 - DNA, 16 bp, Homo sapiens
tcagccgtcagccatc

SEQ ID NO: 3528069 - DNA, 23 bp, Homo sapiens
tcagctcttggtgggcccaggga

SEQ ID NO: 3528070 - DNA, 23 bp, Homo sapiens
tcagctgggcagtgccagccaat

SEQ ID NO: 3528071 - DNA, 14 bp, Homo sapiens
tcaggaggaggctg

SEQ ID NO: 3528072 - DNA, 17 bp, Homo sapiens
tcaggcactctcctgtc

SEQ ID NO: 3528073 - DNA, 13 bp, Homo sapiens
tcaggctgttggc

SEQ ID NO: 3528074 - DNA, 10 bp, Homo sapiens
tcagggaggg

SEQ ID NO: 3528075 - DNA, 15 bp, Homo sapiens
tcaggggaagggcag

SEQ ID NO: 3528076 - DNA, 19 bp, Homo sapiens
tcataagatagttacattt

SEQ ID NO: 3528077 - DNA, 13 bp, Homo sapiens
tcatagagacttg

SEQ ID NO: 3528078 - DNA, 14 bp, Homo sapiens
tcataggggcaggt

SEQ ID NO: 3528079 - DNA, 16 bp, Homo sapiens
tcatataaaatttcag

SEQ ID NO: 3528080 - DNA, 20 bp, Homo sapiens
tcatatgaggggacccagcg

SEQ ID NO: 3528081 - DNA, 15 bp, Homo sapiens
tcatatgtggaaata

SEQ ID NO: 3528082 - DNA, 17 bp, Homo sapiens
tcatgagaattacagaa

SEQ ID NO: 3528083 - DNA, 20 bp, Homo sapiens
tcatgagaattacagaaaat

SEQ ID NO: 3528084 - DNA, 19 bp, Homo sapiens
tcatgaggaccagggtgga

SEQ ID NO: 3528085 - DNA, 15 bp, Homo sapiens
tcatgtaatataagt

SEQ ID NO: 3528086 - DNA, 22 bp, Homo sapiens
tcattcttcggtctgaatttta

SEQ ID NO: 3528087 - DNA, 19 bp, Homo sapiens
tcatttcaaaatatgtgta

SEQ ID NO: 3528088 - DNA, 23 bp, Homo sapiens
tccaagaaacgtggatctccccc

SEQ ID NO: 3528089 - DNA, 13 bp, Homo sapiens
tccaaggagcaga

SEQ ID NO: 3528090 - DNA, 15 bp, Homo sapiens
tccaataccctagaa

SEQ ID NO: 3528091 - DNA, 19 bp, Homo sapiens
tccaataccctagaagaaa

SEQ ID NO: 3528092 - DNA, 19 bp, Homo sapiens
tccaccctttggagaccag

SEQ ID NO: 3528093 - DNA, 15 bp, Homo sapiens
tccactcagcactct

SEQ ID NO: 3528094 - DNA, 17 bp, Homo sapiens
tccactcagcactctgg

SEQ ID NO: 3528095 - DNA, 19 bp, Homo sapiens
tccactcagcactctggac

SEQ ID NO: 3528096 - DNA, 16 bp, Homo sapiens
tccagaccaaagcaat

SEQ ID NO: 3528097 - DNA, 19 bp, Homo sapiens
tcccaagccctggtgacca

SEQ ID NO: 3528098 - DNA, 17 bp, Homo sapiens
tcccaaggagggcacca

SEQ ID NO: 3528099 - DNA, 23 bp, Homo sapiens
tccccaaaggctttgccctgctg

SEQ ID NO: 3528100 - DNA, 14 bp, Homo sapiens
tccccacgccacag

SEQ ID NO: 3528101 - DNA, 15 bp, Homo sapiens
tccccacgccacagc

SEQ ID NO: 3528102 - DNA, 20 bp, Homo sapiens
tcccccaagcagaagaccag

SEQ ID NO: 3528103 - DNA, 13 bp, Homo sapiens
tccctaaagtgtt

SEQ ID NO: 3528104 - DNA, 13 bp, Homo sapiens
tccctaagccagc

SEQ ID NO: 3528105 - DNA, 20 bp, Homo sapiens
tccctcagccgtcagccatc

SEQ ID NO: 3528106 - DNA, 17 bp, Homo sapiens
tccctggatttttacca

SEQ ID NO: 3528107 - DNA, 18 bp, Homo sapiens
tccctggatttttaccag

SEQ ID NO: 3528108 - DNA, 19 bp, Homo sapiens
tccctggatttttaccagt

SEQ ID NO: 3528109 - DNA, 20 bp, Homo sapiens
tcccttcaggcccgctgccc

SEQ ID NO: 3528110 - DNA, 23 bp, Homo sapiens
tccctttcatatgaggggaccca

SEQ ID NO: 3528111 - DNA, 14 bp, Homo sapiens
tccgttggaaagaa

SEQ ID NO: 3528112 - DNA, 15 bp, Homo sapiens
tccgttggaaagaac

SEQ ID NO: 3528113 - DNA, 17 bp, Homo sapiens
tcctcagggtgtcctga

SEQ ID NO: 3528114 - DNA, 17 bp, Homo sapiens
tcctgatttttcatatg

SEQ ID NO: 3528115 - DNA, 18 bp, Homo sapiens
tcctgatttttcatatgt

SEQ ID NO: 3528116 - DNA, 23 bp, Homo sapiens
tcctggtgactcgggggctgtct

SEQ ID NO: 3528117 - DNA, 14 bp, Homo sapiens
tcctgtctgaacct

SEQ ID NO: 3528118 - DNA, 18 bp, Homo sapiens
tccttctctttcaatgtg

SEQ ID NO: 3528119 - DNA, 16 bp, Homo sapiens
tccttggtgctaaaga

SEQ ID NO: 3528120 - DNA, 14 bp, Homo sapiens
tcggtcactgagtc

SEQ ID NO: 3528121 - DNA, 21 bp, Homo sapiens
tcggtcactgagtctggagtg

SEQ ID NO: 3528122 - DNA, 13 bp, Homo sapiens
tcggtggccctga

SEQ ID NO: 3528123 - DNA, 16 bp, Homo sapiens
tcggtgttacttccct

SEQ ID NO: 3528124 - DNA, 15 bp, Homo sapiens
tcgtcttcttggcca

SEQ ID NO: 3528125 - DNA, 18 bp, Homo sapiens
tctaaaggatgagatttt

SEQ ID NO: 3528126 - DNA, 22 bp, Homo sapiens
tctaagaggattcaacaccttt

SEQ ID NO: 3528127 - DNA, 13 bp, Homo sapiens
tctaatgtaaatt

SEQ ID NO: 3528128 - DNA, 16 bp, Homo sapiens
tctaggcccacaagtg

SEQ ID NO: 3528129 - DNA, 12 bp, Homo sapiens
tctattgcctct

SEQ ID NO: 3528130 - DNA, 15 bp, Homo sapiens
tctcaacaacatgtc

SEQ ID NO: 3528131 - DNA, 16 bp, Homo sapiens
tctcgttgaggccaag

SEQ ID NO: 3528132 - DNA, 18 bp, Homo sapiens
tctctcaagagtgctgag

SEQ ID NO: 3528133 - DNA, 17 bp, Homo sapiens
tctgaccctgggctttc

SEQ ID NO: 3528134 - DNA, 17 bp, Homo sapiens
tctgaggggtgtccgag

SEQ ID NO: 3528135 - DNA, 14 bp, Homo sapiens
tctgagttttacca

SEQ ID NO: 3528136 - DNA, 22 bp, Homo sapiens
tctgatagtagtctttaaaaga

SEQ ID NO: 3528137 - DNA, 17 bp, Homo sapiens
tctgattgaaacatgaa

SEQ ID NO: 3528138 - DNA, 13 bp, Homo sapiens
aaaaaagcatgaa

SEQ ID NO: 3528139 - DNA, 12 bp, Homo sapiens
aaaaaatgctga

SEQ ID NO: 3528140 - DNA, 17 bp, Homo sapiens
aaaaagcatgaatattt

SEQ ID NO: 3528141 - DNA, 19 bp, Homo sapiens
aaaaattagccttgatatt

SEQ ID NO: 3528142 - DNA, 18 bp, Homo sapiens
aaaacacaaaatgaataa

SEQ ID NO: 3528143 - DNA, 19 bp, Homo sapiens
aaaacactatttctggaat

SEQ ID NO: 3528144 - DNA, 14 bp, Homo sapiens
aaaagacaaatgtg

SEQ ID NO: 3528145 - DNA, 13 bp, Homo sapiens
aaaagagctttat

SEQ ID NO: 3528146 - DNA, 18 bp, Homo sapiens
aaaagcatgaatatttct

SEQ ID NO: 3528147 - DNA, 21 bp, Homo sapiens
aaaaggcagcatttgaatact

SEQ ID NO: 3528148 - DNA, 18 bp, Homo sapiens
aaaatgaataaaagtgag

SEQ ID NO: 3528149 - DNA, 15 bp, Homo sapiens
aaacacaaaatgaat

SEQ ID NO: 3528150 - DNA, 19 bp, Homo sapiens
aaacatttctgtgaaacta

SEQ ID NO: 3528151 - DNA, 21 bp, Homo sapiens
aaacattttttttaaaaatta

SEQ ID NO: 3528152 - DNA, 21 bp, Homo sapiens
aaacccattttggtgcaatat

SEQ ID NO: 3528153 - DNA, 18 bp, Homo sapiens
aaacgtggatctccccct

SEQ ID NO: 3528154 - DNA, 17 bp, Homo sapiens
aggtcactctccagcag

SEQ ID NO: 3528155 - DNA, 19 bp, Homo sapiens
aggtctcgtcccagccctc

SEQ ID NO: 3528156 - DNA, 16 bp, Homo sapiens
aggtgaaacattttct

SEQ ID NO: 3528157 - DNA, 20 bp, Homo sapiens
aggtgctggtagctgagggg

SEQ ID NO: 3528158 - DNA, 11 bp, Homo sapiens
aggtggccatc

SEQ ID NO: 3528159 - DNA, 12 bp, Homo sapiens
aggtttcaatgc

SEQ ID NO: 3528160 - DNA, 13 bp, Homo sapiens
aggtttcaatgca

SEQ ID NO: 3528161 - DNA, 18 bp, Homo sapiens
agtaatttgggaaaagaa

SEQ ID NO: 3528162 - DNA, 13 bp, Homo sapiens
agtagattggctg

SEQ ID NO: 3528163 - DNA, 12 bp, Homo sapiens
agtagcagaaat

SEQ ID NO: 3528164 - DNA, 14 bp, Homo sapiens
agtaggaaagaatt

SEQ ID NO: 3528165 - DNA, 18 bp, Homo sapiens
agtatctcaacaacatgt

SEQ ID NO: 3528166 - DNA, 12 bp, Homo sapiens
agtatttcatgt

SEQ ID NO: 3528167 - DNA, 13 bp, Homo sapiens
agtatttcatgta

SEQ ID NO: 3528168 - DNA, 19 bp, Homo sapiens
agtattttttttgctttta

SEQ ID NO: 3528169 - DNA, 15 bp, Homo sapiens
agtcagagtataatt

SEQ ID NO: 3528170 - DNA, 23 bp, Homo sapiens
agtcaggctgttggcgtgtccca

SEQ ID NO: 3528171 - DNA, 13 bp, Homo sapiens
agtcatgagaatt

SEQ ID NO: 3528172 - DNA, 21 bp, Homo sapiens
agtcatttcaaaatatgtgta

SEQ ID NO: 3528173 - DNA, 19 bp, Homo sapiens
agtcccaccctatggccac

SEQ ID NO: 3528174 - DNA, 21 bp, Homo sapiens
agtctcacatgattccagcca

SEQ ID NO: 3528175 - DNA, 22 bp, Homo sapiens
agtctcacatgattccagccat

SEQ ID NO: 3528176 - DNA, 14 bp, Homo sapiens
agtctcaggaggag

SEQ ID NO: 3528177 - DNA, 15 bp, Homo sapiens
agtctgaatctccca

SEQ ID NO: 3528178 - DNA, 16 bp, Homo sapiens
agtctgaatctcccaa

SEQ ID NO: 3528179 - DNA, 16 bp, Homo sapiens
agtctggagtgaacca

SEQ ID NO: 3528180 - DNA, 18 bp, Homo sapiens
agtcttctaatgtaaatt

SEQ ID NO: 3528181 - DNA, 20 bp, Homo sapiens
agtgagaccttccttttact

SEQ ID NO: 3528182 - DNA, 23 bp, Homo sapiens
agtgagtactcataaaggacact

SEQ ID NO: 3528183 - DNA, 15 bp, Homo sapiens
agtgcactccaagaa

SEQ ID NO: 3528184 - DNA, 19 bp, Homo sapiens
agtgctgagaaccacggtg

SEQ ID NO: 3528185 - DNA, 24 bp, Homo sapiens
agtgctgctctaggcccacaagtg

SEQ ID NO: 3528186 - DNA, 14 bp, Homo sapiens
agtggtctgaactg

SEQ ID NO: 3528187 - DNA, 16 bp, Homo sapiens
agtggtgttacatttt

SEQ ID NO: 3528188 - DNA, 21 bp, Homo sapiens
agtgtgtaatgactgagattt

SEQ ID NO: 3528189 - DNA, 12 bp, Homo sapiens
agttacatttat

SEQ ID NO: 3528190 - DNA, 14 bp, Homo sapiens
agttacatttatgt

SEQ ID NO: 3528191 - DNA, 18 bp, Homo sapiens
agttcccctatgtggaag

SEQ ID NO: 3528192 - DNA, 23 bp, Homo sapiens
agttcttagattcaggggaaggg

SEQ ID NO: 3528193 - DNA, 22 bp, Homo sapiens
agttgtctaaaggatgagattt

SEQ ID NO: 3528194 - DNA, 20 bp, Homo sapiens
agtttaattagatttctgaa

SEQ ID NO: 3528195 - DNA, 16 bp, Homo sapiens
agtttctaacttacaa

SEQ ID NO: 3528196 - DNA, 17 bp, Homo sapiens
agtttctgagttttacc

SEQ ID NO: 3528197 - DNA, 21 bp, Homo sapiens
ataaaaaatatatttttatat

SEQ ID NO: 3528198 - DNA, 13 bp, Homo sapiens
ataaaagagcttt

SEQ ID NO: 3528199 - DNA, 23 bp, Homo sapiens
ataaacccattttggtgcaatat

SEQ ID NO: 3528200 - DNA, 18 bp, Homo sapiens
ataaaggacactggatca

SEQ ID NO: 3528201 - DNA, 18 bp, Homo sapiens
ataacattcaatttgcta

SEQ ID NO: 3528202 - DNA, 18 bp, Homo sapiens
ataagaaagaattgcagt

SEQ ID NO: 3528203 - DNA, 22 bp, Homo sapiens
ataagatagttacatttatgtg

SEQ ID NO: 3528204 - DNA, 22 bp, Homo sapiens
ataagtgaacaactggaaataa

SEQ ID NO: 3528205 - DNA, 23 bp, Homo sapiens
ataagtgaacaactggaaataaa

SEQ ID NO: 3528206 - DNA, 11 bp, Homo sapiens
atacaataaaa

SEQ ID NO: 3528207 - DNA, 15 bp, Homo sapiens
atacaataaaagagc

SEQ ID NO: 3528208 - DNA, 18 bp, Homo sapiens
atacaataaaagagcttt

SEQ ID NO: 3528209 - DNA, 13 bp, Homo sapiens
atacaccaaacat

SEQ ID NO: 3528210 - DNA, 11 bp, Homo sapiens
ataccctagaa

SEQ ID NO: 3528211 - DNA, 18 bp, Homo sapiens
ataccctagaagaaaacc

SEQ ID NO: 3528212 - DNA, 17 bp, Homo sapiens
atactgaaaaaatgctg

SEQ ID NO: 3528213 - DNA, 21 bp, Homo sapiens
atactgaaaaaatgctgagcc

SEQ ID NO: 3528214 - DNA, 18 bp, Homo sapiens
atacttctgctgtgggaa

SEQ ID NO: 3528215 - DNA, 19 bp, Homo sapiens
atacttctgctgtgggaaa

SEQ ID NO: 3528216 - DNA, 22 bp, Homo sapiens
atacttctgctgtgggaaaaat

SEQ ID NO: 3528217 - DNA, 15 bp, Homo sapiens
atagagaggcctgct

SEQ ID NO: 3528218 - DNA, 21 bp, Homo sapiens
atagcatacaccaaacatttc

SEQ ID NO: 3528219 - DNA, 21 bp, Homo sapiens
atagcccagccttttgagagt

SEQ ID NO: 3528220 - DNA, 15 bp, Homo sapiens
atataaaatttcagg

SEQ ID NO: 3528221 - DNA, 18 bp, Homo sapiens
atataagacttaatatgt

SEQ ID NO: 3528222 - DNA, 16 bp, Homo sapiens
atatcacagagccact

SEQ ID NO: 3528223 - DNA, 22 bp, Homo sapiens
atatcacagagccactcttcaa

SEQ ID NO: 3528224 - DNA, 14 bp, Homo sapiens
atatcatataaaat

SEQ ID NO: 3528225 - DNA, 16 bp, Homo sapiens
atatgaggggacccag

SEQ ID NO: 3528226 - DNA, 17 bp, Homo sapiens
atatgtggaaatatacc

SEQ ID NO: 3528227 - DNA, 16 bp, Homo sapiens
atattatgaaaattaa

SEQ ID NO: 3528228 - DNA, 21 bp, Homo sapiens
atattatgaaaattaagatta

SEQ ID NO: 3528229 - DNA, 17 bp, Homo sapiens
atatttttatatgtgga

SEQ ID NO: 3528230 - DNA, 16 bp, Homo sapiens
atcaagttcagccacc

SEQ ID NO: 3528231 - DNA, 17 bp, Homo sapiens
atcaagttcagccaccg

SEQ ID NO: 3528232 - DNA, 19 bp, Homo sapiens
atcacagaaacggtcttta

SEQ ID NO: 3528233 - DNA, 15 bp, Homo sapiens
atcactagagtgctc

SEQ ID NO: 3528234 - DNA, 18 bp, Homo sapiens
atcactagagtgctctga

SEQ ID NO: 3528235 - DNA, 12 bp, Homo sapiens
atcagctgggca

SEQ ID NO: 3528236 - DNA, 15 bp, Homo sapiens
atcaggctttccttg

SEQ ID NO: 3528237 - DNA, 18 bp, Homo sapiens
atcatataaaatttcagg

SEQ ID NO: 3528238 - DNA, 16 bp, Homo sapiens
atcatggagcaagaga

SEQ ID NO: 3528239 - DNA, 22 bp, Homo sapiens
atcatggagcaagagaatttca

SEQ ID NO: 3528240 - DNA, 20 bp, Homo sapiens
atccaagatgtttggacacc

SEQ ID NO: 3528241 - DNA, 22 bp, Homo sapiens
atcccagtttaatattccaata

SEQ ID NO: 3528242 - DNA, 16 bp, Homo sapiens
atccccacgccacagc

SEQ ID NO: 3528243 - DNA, 17 bp, Homo sapiens
atccccacgccacagcc

SEQ ID NO: 3528244 - DNA, 18 bp, Homo sapiens
atccccacgccacagccc

SEQ ID NO: 3528245 - DNA, 20 bp, Homo sapiens
atccccacgccacagccctt

SEQ ID NO: 3528246 - DNA, 21 bp, Homo sapiens
atccccacgccacagcccttt

SEQ ID NO: 3528247 - DNA, 20 bp, Homo sapiens
atcccgagcaaccctctgaa

SEQ ID NO: 3528248 - DNA, 18 bp, Homo sapiens
atcctctgggagcttctt

SEQ ID NO: 3528249 - DNA, 18 bp, Homo sapiens
atccttctctttcaatgt

SEQ ID NO: 3528250 - DNA, 18 bp, Homo sapiens
atctactgactgaaatca

SEQ ID NO: 3528251 - DNA, 15 bp, Homo sapiens
atctcgttgaggcca

SEQ ID NO: 3528252 - DNA, 17 bp, Homo sapiens
atctgaaaaatggccat

SEQ ID NO: 3528253 - DNA, 18 bp, Homo sapiens
atctgaaaaatggccatg

SEQ ID NO: 3528254 - DNA, 18 bp, Homo sapiens
atctgagggctgctcccc

SEQ ID NO: 3528255 - DNA, 13 bp, Homo sapiens
atctgtgagaagt

SEQ ID NO: 3528256 - DNA, 14 bp, Homo sapiens
atctgtgagaagtt

SEQ ID NO: 3528257 - DNA, 14 bp, Homo sapiens
atcttatctactga

SEQ ID NO: 3528258 - DNA, 23 bp, Homo sapiens
atcttatctactgactgaaatca

SEQ ID NO: 3528259 - DNA, 15 bp, Homo sapiens
atctttgtgaacatt

SEQ ID NO: 3528260 - DNA, 18 bp, Homo sapiens
atctttgtgaacattctg

SEQ ID NO: 3528261 - DNA, 21 bp, Homo sapiens
atgaaaaggcagcatttgaat

SEQ ID NO: 3528262 - DNA, 21 bp, Homo sapiens
atgaaacaactcatgtcttta

SEQ ID NO: 3528263 - DNA, 15 bp, Homo sapiens
atgaagctaatgtga

SEQ ID NO: 3528264 - DNA, 16 bp, Homo sapiens
ctcttggtgggcccag

SEQ ID NO: 3528265 - DNA, 20 bp, Homo sapiens
ctcttggtgggcccagggac

SEQ ID NO: 3528266 - DNA, 19 bp, Homo sapiens
ctgaaaaaatgctgagcca

SEQ ID NO: 3528267 - DNA, 13 bp, Homo sapiens
ctgaaaatgtgta

SEQ ID NO: 3528268 - DNA, 22 bp, Homo sapiens
ctgaaggtgaaacattttctcc

SEQ ID NO: 3528269 - DNA, 14 bp, Homo sapiens
ctgaatctcccaag

SEQ ID NO: 3528270 - DNA, 16 bp, Homo sapiens
ctgaatctcccaagga

SEQ ID NO: 3528271 - DNA, 14 bp, Homo sapiens
ctgaatctcgttga

SEQ ID NO: 3528272 - DNA, 22 bp, Homo sapiens
ctgaccctccccaaaggctttg

SEQ ID NO: 3528273 - DNA, 23 bp, Homo sapiens
ctgacccttctccaaaggctctg

SEQ ID NO: 3528274 - DNA, 16 bp, Homo sapiens
ctgactgtcagggagg

SEQ ID NO: 3528275 - DNA, 14 bp, Homo sapiens
ctgacttcccaagc

SEQ ID NO: 3528276 - DNA, 22 bp, Homo sapiens
ctgacttcccaagccctggtga

SEQ ID NO: 3528277 - DNA, 14 bp, Homo sapiens
ctgacttgctcacc

SEQ ID NO: 3528278 - DNA, 18 bp, Homo sapiens
ctgagaaatagtgcactc

SEQ ID NO: 3528279 - DNA, 15 bp, Homo sapiens
ctgagaaccacggtg

SEQ ID NO: 3528280 - DNA, 23 bp, Homo sapiens
ctgagaaccacggtgaaagtgct

SEQ ID NO: 3528281 - DNA, 24 bp, Homo sapiens
ctgagaaccacggtgaaagtgctg

SEQ ID NO: 3528282 - DNA, 15 bp, Homo sapiens
ctgagatttgtaaat

SEQ ID NO: 3528283 - DNA, 20 bp, Homo sapiens
ctgagctagcaaatacagga

SEQ ID NO: 3528284 - DNA, 22 bp, Homo sapiens
ctgagctcttgctatctctcaa

SEQ ID NO: 3528285 - DNA, 24 bp, Homo sapiens
ctgaggggacgggcaagtgagagg

SEQ ID NO: 3528286 - DNA, 20 bp, Homo sapiens
ctgaggggtgtccgagaggc

SEQ ID NO: 3528287 - DNA, 22 bp, Homo sapiens
ctgaggggtgtccgagaggctg

SEQ ID NO: 3528288 - DNA, 14 bp, Homo sapiens
ctgagtaaagtgtt

SEQ ID NO: 3528289 - DNA, 20 bp, Homo sapiens
ctgatagtagtctttaaaag

SEQ ID NO: 3528290 - DNA, 14 bp, Homo sapiens
ctgatttttcatat

SEQ ID NO: 3528291 - DNA, 15 bp, Homo sapiens
ctgcagcagaaaaca

SEQ ID NO: 3528292 - DNA, 17 bp, Homo sapiens
ctgcagcagaaaacaaa

SEQ ID NO: 3528293 - DNA, 16 bp, Homo sapiens
ctgcagccagaaagga

SEQ ID NO: 3528294 - DNA, 15 bp, Homo sapiens
ctgcaggagggcact

SEQ ID NO: 3528295 - DNA, 16 bp, Homo sapiens
ctgcaggagggcactg

SEQ ID NO: 3528296 - DNA, 19 bp, Homo sapiens
ctgcaggctgcaggagggc

SEQ ID NO: 3528297 - DNA, 21 bp, Homo sapiens
ctgcccctaaagatgggagga

SEQ ID NO: 3528298 - DNA, 20 bp, Homo sapiens
ctgccctaggatatgccctc

SEQ ID NO: 3528299 - DNA, 18 bp, Homo sapiens
ctgccctccctcagccgt

SEQ ID NO: 3528300 - DNA, 13 bp, Homo sapiens
ctgccctgagggg

SEQ ID NO: 3528301 - DNA, 14 bp, Homo sapiens
ctgccctgaggggc

SEQ ID NO: 3528302 - DNA, 15 bp, Homo sapiens
ctgccctgaggggct

SEQ ID NO: 3528303 - DNA, 18 bp, Homo sapiens
ctgccctgaggggctggg

SEQ ID NO: 3528304 - DNA, 23 bp, Homo sapiens
ctgccctgaggggctggggaggg

SEQ ID NO: 3528305 - DNA, 17 bp, Homo sapiens
ctgcctcaggcactctc

SEQ ID NO: 3528306 - DNA, 19 bp, Homo sapiens
ctgctcacggaccccatgt

SEQ ID NO: 3528307 - DNA, 13 bp, Homo sapiens
ctgctgccctccc

SEQ ID NO: 3528308 - DNA, 16 bp, Homo sapiens
ctgctgtgggaaaaat

SEQ ID NO: 3528309 - DNA, 15 bp, Homo sapiens
ctggaatgcttctgc

SEQ ID NO: 3528310 - DNA, 18 bp, Homo sapiens
ctggaatgcttctgcatc

SEQ ID NO: 3528311 - DNA, 17 bp, Homo sapiens
ctggactccacgatgcc

SEQ ID NO: 3528312 - DNA, 15 bp, Homo sapiens
ctggagctgggaggt

SEQ ID NO: 3528313 - DNA, 19 bp, Homo sapiens
ctggaggctcagcccaccc

SEQ ID NO: 3528314 - DNA, 15 bp, Homo sapiens
ctggatttttaccag

SEQ ID NO: 3528315 - DNA, 22 bp, Homo sapiens
ctggccatttggccccagggga

SEQ ID NO: 3528316 - DNA, 23 bp, Homo sapiens
ctggcccccccagccccacaccc

SEQ ID NO: 3528317 - DNA, 20 bp, Homo sapiens
ctgggaggatcctgagctgc

SEQ ID NO: 3528318 - DNA, 21 bp, Homo sapiens
ctgggaggatcctgagctgct

SEQ ID NO: 3528319 - DNA, 19 bp, Homo sapiens
ctgggcagtgccagccaat

SEQ ID NO: 3528320 - DNA, 14 bp, Homo sapiens
ctggggacccagac

SEQ ID NO: 3528321 - DNA, 18 bp, Homo sapiens
ctggggtatgttctgggc

SEQ ID NO: 3528322 - DNA, 14 bp, Homo sapiens
ctggtagctgaggg

SEQ ID NO: 3528323 - DNA, 15 bp, Homo sapiens
ctggtagctgagggg

SEQ ID NO: 3528324 - DNA, 19 bp, Homo sapiens
ctggtgaccagaccaaggc

SEQ ID NO: 3528325 - DNA, 21 bp, Homo sapiens
ctggtgactcgggggctgtct

SEQ ID NO: 3528326 - DNA, 13 bp, Homo sapiens
ctgtcagaagttt

SEQ ID NO: 3528327 - DNA, 17 bp, Homo sapiens
ctgtcagggagggccag

SEQ ID NO: 3528328 - DNA, 14 bp, Homo sapiens
ctgtgaccttggga

SEQ ID NO: 3528329 - DNA, 20 bp, Homo sapiens
ctgtgaccttgggaccaaag

SEQ ID NO: 3528330 - DNA, 22 bp, Homo sapiens
ctgtgcgtgtgtgtgtgtgtat

SEQ ID NO: 3528331 - DNA, 17 bp, Homo sapiens
ctgttaacagctgtcaa

SEQ ID NO: 3528332 - DNA, 23 bp, Homo sapiens
ctgttagtagcagaaatatatta

SEQ ID NO: 3528333 - DNA, 14 bp, Homo sapiens
ctgttgctccagga

SEQ ID NO: 3528334 - DNA, 23 bp, Homo sapiens
ctgttgctccaggatgcattctg

SEQ ID NO: 3528335 - DNA, 17 bp, Homo sapiens
ctgttggcgtgtcccag

SEQ ID NO: 3528336 - DNA, 21 bp, Homo sapiens
ctgttgttttaacgaggattt

SEQ ID NO: 3528337 - DNA, 17 bp, Homo sapiens
ctgtttgtacaaactat

SEQ ID NO: 3528338 - DNA, 21 bp, Homo sapiens
cttaactgttcagtattgcaa

SEQ ID NO: 3528339 - DNA, 12 bp, Homo sapiens
cttaatacaaaa

SEQ ID NO: 3528340 - DNA, 13 bp, Homo sapiens
cttaatatgtttt

SEQ ID NO: 3528341 - DNA, 19 bp, Homo sapiens
cttacagagactctccctg

SEQ ID NO: 3528342 - DNA, 15 bp, Homo sapiens
cttagaccaccaagc

SEQ ID NO: 3528343 - DNA, 16 bp, Homo sapiens
cttagattcaggggaa

SEQ ID NO: 3528344 - DNA, 17 bp, Homo sapiens
cttagattcaggggaag

SEQ ID NO: 3528345 - DNA, 18 bp, Homo sapiens
cttagattcaggggaagg

SEQ ID NO: 3528346 - DNA, 24 bp, Homo sapiens
cttagattcaggggaagggcaggc

SEQ ID NO: 3528347 - DNA, 16 bp, Homo sapiens
cttcagatgctcttgg

SEQ ID NO: 3528348 - DNA, 19 bp, Homo sapiens
cttcatagagacttgggaa

SEQ ID NO: 3528349 - DNA, 19 bp, Homo sapiens
cttccttttactaccattt

SEQ ID NO: 3528350 - DNA, 14 bp, Homo sapiens
cttctaatgtaaat

SEQ ID NO: 3528351 - DNA, 14 bp, Homo sapiens
cttctattgcctct

SEQ ID NO: 3528352 - DNA, 16 bp, Homo sapiens
cttctattgcctctga

SEQ ID NO: 3528353 - DNA, 18 bp, Homo sapiens
cttctggtgctgctgggg

SEQ ID NO: 3528354 - DNA, 19 bp, Homo sapiens
cttcttccaaggagcagag

SEQ ID NO: 3528355 - DNA, 18 bp, Homo sapiens
cttcttggccatgggagg

SEQ ID NO: 3528356 - DNA, 16 bp, Homo sapiens
cttgcagcctggtcac

SEQ ID NO: 3528357 - DNA, 15 bp, Homo sapiens
cttgctaccaatctg

SEQ ID NO: 3528358 - DNA, 19 bp, Homo sapiens
cttggccatgggaggcctt

SEQ ID NO: 3528359 - DNA, 20 bp, Homo sapiens
cttggccatgggaggccttt

SEQ ID NO: 3528360 - DNA, 18 bp, Homo sapiens
cttgggaccaaaggggga

SEQ ID NO: 3528361 - DNA, 20 bp, Homo sapiens
cttggggttcataggggcag

SEQ ID NO: 3528362 - DNA, 22 bp, Homo sapiens
cttggggttcataggggcaggt

SEQ ID NO: 3528363 - DNA, 14 bp, Homo sapiens
cttggtgctaaaga

SEQ ID NO: 3528364 - DNA, 18 bp, Homo sapiens
cttggtgggcccagggac

SEQ ID NO: 3528365 - DNA, 22 bp, Homo sapiens
cttgtctggtgacccagagatc

SEQ ID NO: 3528366 - DNA, 19 bp, Homo sapiens
cttgtgactcagcagaggc

SEQ ID NO: 3528367 - DNA, 22 bp, Homo sapiens
ctttagattttgatagcaatgt

SEQ ID NO: 3528368 - DNA, 20 bp, Homo sapiens
ctttcaatgtgtttaatttt

SEQ ID NO: 3528369 - DNA, 23 bp, Homo sapiens
ctttcaccacatggccttgcctc

SEQ ID NO: 3528370 - DNA, 16 bp, Homo sapiens
ctttcatagagaggcc

SEQ ID NO: 3528371 - DNA, 14 bp, Homo sapiens
ctttcggggagggc

SEQ ID NO: 3528372 - DNA, 20 bp, Homo sapiens
ctttgagatagcccatcttc

SEQ ID NO: 3528373 - DNA, 22 bp, Homo sapiens
gggcaagtgagaggggagggag

SEQ ID NO: 3528374 - DNA, 23 bp, Homo sapiens
gggcaccatcttacagagactct

SEQ ID NO: 3528375 - DNA, 15 bp, Homo sapiens
gggccagggaggcag

SEQ ID NO: 3528376 - DNA, 18 bp, Homo sapiens
gggccctgcaggctgcag

SEQ ID NO: 3528377 - DNA, 23 bp, Homo sapiens
gggccggctggcctggaggctca

SEQ ID NO: 3528378 - DNA, 12 bp, Homo sapiens
gggcggcagggc

SEQ ID NO: 3528379 - DNA, 13 bp, Homo sapiens
gggctggggaggg

SEQ ID NO: 3528380 - DNA, 17 bp, Homo sapiens
gggctttcggggagggc

SEQ ID NO: 3528381 - DNA, 14 bp, Homo sapiens
ggggaaggggtgca

SEQ ID NO: 3528382 - DNA, 20 bp, Homo sapiens
ggggacgggcaagtgagagg

SEQ ID NO: 3528383 - DNA, 19 bp, Homo sapiens
ggggccggctggcctggag

SEQ ID NO: 3528384 - DNA, 18 bp, Homo sapiens
ggggctgcgtgtgggagg

SEQ ID NO: 3528385 - DNA, 11 bp, Homo sapiens
ggggctgctgt

SEQ ID NO: 3528386 - DNA, 17 bp, Homo sapiens
ggggctttcggggaggg

SEQ ID NO: 3528387 - DNA, 18 bp, Homo sapiens
ggggctttcggggagggc

SEQ ID NO: 3528388 - DNA, 15 bp, Homo sapiens
ggggtaggctgctgc

SEQ ID NO: 3528389 - DNA, 16 bp, Homo sapiens
ggggtgatggccagag

SEQ ID NO: 3528390 - DNA, 17 bp, Homo sapiens
ggggtgatggccagagg

SEQ ID NO: 3528391 - DNA, 21 bp, Homo sapiens
ggggtgatggccagaggaatg

SEQ ID NO: 3528392 - DNA, 14 bp, Homo sapiens
gggtacctcatgag

SEQ ID NO: 3528393 - DNA, 15 bp, Homo sapiens
gggtgtccgagaggc

SEQ ID NO: 3528394 - DNA, 16 bp, Homo sapiens
gggttcataggggcag

SEQ ID NO: 3528395 - DNA, 18 bp, Homo sapiens
gggttcataggggcaggt

SEQ ID NO: 3528396 - DNA, 23 bp, Homo sapiens
ggtagaaacctgccgggctgttg

SEQ ID NO: 3528397 - DNA, 12 bp, Homo sapiens
ggtagctgaggg

SEQ ID NO: 3528398 - DNA, 16 bp, Homo sapiens
ggtaggctgctgccct

SEQ ID NO: 3528399 - DNA, 18 bp, Homo sapiens
ggtaggctgctgccctgc

SEQ ID NO: 3528400 - DNA, 19 bp, Homo sapiens
ggtcctagtcgggcagggc

SEQ ID NO: 3528401 - DNA, 13 bp, Homo sapiens
ggtctgaatttta

SEQ ID NO: 3528402 - DNA, 22 bp, Homo sapiens
ggtctttcagaaggaaaccgaa

SEQ ID NO: 3528403 - DNA, 20 bp, Homo sapiens
ggtgaccagaccaaggcagg

SEQ ID NO: 3528404 - DNA, 21 bp, Homo sapiens
ggtgactcgggggctgtctca

SEQ ID NO: 3528405 - DNA, 13 bp, Homo sapiens
ggtgcaggtgggg

SEQ ID NO: 3528406 - DNA, 11 bp, Homo sapiens
ggtgctgctgg

SEQ ID NO: 3528407 - DNA, 16 bp, Homo sapiens
ggtgctggtagctgag

SEQ ID NO: 3528408 - DNA, 20 bp, Homo sapiens
ggtggccctgactgtcaggg

SEQ ID NO: 3528409 - DNA, 21 bp, Homo sapiens
ggtggccctgactgtcaggga

SEQ ID NO: 3528410 - DNA, 14 bp, Homo sapiens
ggtgggcccaggga

SEQ ID NO: 3528411 - DNA, 16 bp, Homo sapiens
ggtgggggctggaggt

SEQ ID NO: 3528412 - DNA, 17 bp, Homo sapiens
ggttcataggggcaggt

SEQ ID NO: 3528413 - DNA, 16 bp, Homo sapiens
ggttctctgctgtcct

SEQ ID NO: 3528414 - DNA, 22 bp, Homo sapiens
ggttgtaattaaatttttaaaa

SEQ ID NO: 3528415 - DNA, 22 bp, Homo sapiens
ggtttcaatgcatacaataaaa

SEQ ID NO: 3528416 - DNA, 20 bp, Homo sapiens
gtaatgactgagatttgtaa

SEQ ID NO: 3528417 - DNA, 20 bp, Homo sapiens
gtactcataaaggacactgg

SEQ ID NO: 3528418 - DNA, 22 bp, Homo sapiens
gtagagaaaataagacttctgg

SEQ ID NO: 3528419 - DNA, 13 bp, Homo sapiens
gtagctgagggga

SEQ ID NO: 3528420 - DNA, 15 bp, Homo sapiens
gtagctgaggggacg

SEQ ID NO: 3528421 - DNA, 22 bp, Homo sapiens
gtaggctgctgccctgctgtgg

SEQ ID NO: 3528422 - DNA, 19 bp, Homo sapiens
gtaggtcactctccagcag

SEQ ID NO: 3528423 - DNA, 22 bp, Homo sapiens
gtagtcagaactataacattca

SEQ ID NO: 3528424 - DNA, 16 bp, Homo sapiens
gtatacacttaaactt

SEQ ID NO: 3528425 - DNA, 12 bp, Homo sapiens
gtatacttgaaa

SEQ ID NO: 3528426 - DNA, 21 bp, Homo sapiens
gtatatcacagagccactctt

SEQ ID NO: 3528427 - DNA, 19 bp, Homo sapiens
gtatgtgtatctcacactc

SEQ ID NO: 3528428 - DNA, 12 bp, Homo sapiens
gtatgtgtgtgt

SEQ ID NO: 3528429 - DNA, 13 bp, Homo sapiens
gtcactctccagc

SEQ ID NO: 3528430 - DNA, 12 bp, Homo sapiens
gtcagggagggc

SEQ ID NO: 3528431 - DNA, 15 bp, Homo sapiens
gtcagggagggccag

SEQ ID NO: 3528432 - DNA, 16 bp, Homo sapiens
gtcagggagggccagg

SEQ ID NO: 3528433 - DNA, 22 bp, Homo sapiens
gtcagggagggccagggaggca

SEQ ID NO: 3528434 - DNA, 21 bp, Homo sapiens
gtcatccaaatggactggcca

SEQ ID NO: 3528435 - DNA, 17 bp, Homo sapiens
gtccataacttacctct

SEQ ID NO: 3528436 - DNA, 15 bp, Homo sapiens
gtccatgggtctggc

SEQ ID NO: 3528437 - DNA, 23 bp, Homo sapiens
gtccctcgtctcttgtgactcag

SEQ ID NO: 3528438 - DNA, 12 bp, Homo sapiens
gtccgagaggct

SEQ ID NO: 3528439 - DNA, 22 bp, Homo sapiens
gtcctagtcgggcagggcccct

SEQ ID NO: 3528440 - DNA, 13 bp, Homo sapiens
gtcgggcagggcc

SEQ ID NO: 3528441 - DNA, 23 bp, Homo sapiens
gtctcacatgattccagccatca

SEQ ID NO: 3528442 - DNA, 20 bp, Homo sapiens
gtctcagacgactagcccag

SEQ ID NO: 3528443 - DNA, 17 bp, Homo sapiens
gtctcaggaggaggctg

SEQ ID NO: 3528444 - DNA, 19 bp, Homo sapiens
gtctcaggaggaggctgcc

SEQ ID NO: 3528445 - DNA, 14 bp, Homo sapiens
gtctctagcagtga

SEQ ID NO: 3528446 - DNA, 17 bp, Homo sapiens
gtctctgcaaactgcct

SEQ ID NO: 3528447 - DNA, 16 bp, Homo sapiens
gtctgaatctcccaag

SEQ ID NO: 3528448 - DNA, 18 bp, Homo sapiens
gtctgaatctcccaagga

SEQ ID NO: 3528449 - DNA, 18 bp, Homo sapiens
gtctgtgaagtgagacct

SEQ ID NO: 3528450 - DNA, 12 bp, Homo sapiens
gtcttcttggcc

SEQ ID NO: 3528451 - DNA, 18 bp, Homo sapiens
gtgaattgttagtttctg

SEQ ID NO: 3528452 - DNA, 21 bp, Homo sapiens
gtgaccagttttgatatttat

SEQ ID NO: 3528453 - DNA, 18 bp, Homo sapiens
gtgaccttgggaccaaag

SEQ ID NO: 3528454 - DNA, 19 bp, Homo sapiens
gtgactcgggggctgtctc

SEQ ID NO: 3528455 - DNA, 11 bp, Homo sapiens
gtgagaagttt

SEQ ID NO: 3528456 - DNA, 12 bp, Homo sapiens
gtgagaggggag

SEQ ID NO: 3528457 - DNA, 19 bp, Homo sapiens
gtgatctcctgtggctcat

SEQ ID NO: 3528458 - DNA, 14 bp, Homo sapiens
gtgatggccagagg

SEQ ID NO: 3528459 - DNA, 12 bp, Homo sapiens
gtgcaatattct

SEQ ID NO: 3528460 - DNA, 21 bp, Homo sapiens
gtgcattaaaattaaatactt

SEQ ID NO: 3528461 - DNA, 21 bp, Homo sapiens
gtgccagccaatccctggcca

SEQ ID NO: 3528462 - DNA, 17 bp, Homo sapiens
gtgctggtagctgaggg

SEQ ID NO: 3528463 - DNA, 18 bp, Homo sapiens
gtgctggtagctgagggg

SEQ ID NO: 3528464 - DNA, 13 bp, Homo sapiens
gtggacggcgctg

SEQ ID NO: 3528465 - DNA, 21 bp, Homo sapiens
gtggacggcgctgcctcaggc

SEQ ID NO: 3528466 - DNA, 19 bp, Homo sapiens
gtggagctgagaagaggag

SEQ ID NO: 3528467 - DNA, 15 bp, Homo sapiens
gtggggaaggggtgc

SEQ ID NO: 3528468 - DNA, 16 bp, Homo sapiens
gtggggaaggggtgca

SEQ ID NO: 3528469 - DNA, 15 bp, Homo sapiens
gtgggggctggaggt

SEQ ID NO: 3528470 - DNA, 21 bp, Homo sapiens
gtggggtaggctgctgccctg

SEQ ID NO: 3528471 - DNA, 13 bp, Homo sapiens
gtgtattgtaatg

SEQ ID NO: 3528472 - DNA, 19 bp, Homo sapiens
gtgtcccagcaccacacca

SEQ ID NO: 3528473 - DNA, 24 bp, Homo sapiens
gttacacctccactcagcactctg

SEQ ID NO: 3528474 - DNA, 14 bp, Homo sapiens
gttcataggggcag

SEQ ID NO: 3528475 - DNA, 15 bp, Homo sapiens
gttcataggggcagg

SEQ ID NO: 3528476 - DNA, 19 bp, Homo sapiens
gttcctgcagccagaaagg

SEQ ID NO: 3528477 - DNA, 15 bp, Homo sapiens
gttctctgctgtcct

SEQ ID NO: 3528478 - DNA, 15 bp, Homo sapiens
gttgaggccaaggaa

SEQ ID NO: 3528479 - DNA, 11 bp, Homo sapiens
gttggaaagaa

SEQ ID NO: 3528480 - DNA, 20 bp, Homo sapiens
gttgtcctccttccggggaa

SEQ ID NO: 3528481 - DNA, 22 bp, Homo sapiens
gttgtcctccttccggggaagg

SEQ ID NO: 3528482 - DNA, 23 bp, Homo sapiens
gtttcaatgcatacaataaaaga

SEQ ID NO: 3528483 - DNA, 18 bp, Homo sapiens
tggtgctaaagattgtta

SEQ ID NO: 3528484 - DNA, 14 bp, Homo sapiens
tggtgtttgggaat

SEQ ID NO: 3528485 - DNA, 16 bp, Homo sapiens
tgtaactatgctgtta

SEQ ID NO: 3528486 - DNA, 15 bp, Homo sapiens
tgtaagctataacat

SEQ ID NO: 3528487 - DNA, 16 bp, Homo sapiens
tgtaagctataacata

SEQ ID NO: 3528488 - DNA, 18 bp, Homo sapiens
tgtaagctataacatatt

SEQ ID NO: 3528489 - DNA, 19 bp, Homo sapiens
tgtaagctataacatattt

SEQ ID NO: 3528490 - DNA, 16 bp, Homo sapiens
tgtaaggtttcaatgc

SEQ ID NO: 3528491 - DNA, 17 bp, Homo sapiens
tgtaatgactgagattt

SEQ ID NO: 3528492 - DNA, 15 bp, Homo sapiens
tgtacaaactatttc

SEQ ID NO: 3528493 - DNA, 22 bp, Homo sapiens
tgtacaaactatttcagaatat

SEQ ID NO: 3528494 - DNA, 14 bp, Homo sapiens
tgtaggatgtatgc

SEQ ID NO: 3528495 - DNA, 14 bp, Homo sapiens
tgtatacacttaaa

SEQ ID NO: 3528496 - DNA, 17 bp, Homo sapiens
tgtatacacttaaactt

SEQ ID NO: 3528497 - DNA, 18 bp, Homo sapiens
tgtatgctgtttgtacaa

SEQ ID NO: 3528498 - DNA, 20 bp, Homo sapiens
tgtcagacgttggtcccaag

SEQ ID NO: 3528499 - DNA, 21 bp, Homo sapiens
tgtcagggagggccagggagg

SEQ ID NO: 3528500 - DNA, 15 bp, Homo sapiens
tgtccaaagctgaaa

SEQ ID NO: 3528501 - DNA, 18 bp, Homo sapiens
tgtctctgcaaactgcct

SEQ ID NO: 3528502 - DNA, 14 bp, Homo sapiens
tgtgaatgaagcta

SEQ ID NO: 3528503 - DNA, 19 bp, Homo sapiens
tgtgaccagttttgatatt

SEQ ID NO: 3528504 - DNA, 21 bp, Homo sapiens
tgtgagtctccccttgcagcc

SEQ ID NO: 3528505 - DNA, 14 bp, Homo sapiens
tgtggacggcgctg

SEQ ID NO: 3528506 - DNA, 21 bp, Homo sapiens
tgtgtatacacttaaacttgc

SEQ ID NO: 3528507 - DNA, 23 bp, Homo sapiens
tgttagtttctgagttttaccaa

SEQ ID NO: 3528508 - DNA, 22 bp, Homo sapiens
tgttcacatccagttgtctaaa

SEQ ID NO: 3528509 - DNA, 12 bp, Homo sapiens
tgttgattttta

SEQ ID NO: 3528510 - DNA, 14 bp, Homo sapiens
tgtttgtacaaact

SEQ ID NO: 3528511 - DNA, 15 bp, Homo sapiens
tgttttatttatgaa

SEQ ID NO: 3528512 - DNA, 19 bp, Homo sapiens
tgttttatttatgaagttt

SEQ ID NO: 3528513 - DNA, 18 bp, Homo sapiens
ttaaaattaaataaattt

SEQ ID NO: 3528514 - DNA, 11 bp, Homo sapiens
ttaaacatttt

SEQ ID NO: 3528515 - DNA, 17 bp, Homo sapiens
ttaaagagcacaggttc

SEQ ID NO: 3528516 - DNA, 15 bp, Homo sapiens
ttaagtacccgaggc

SEQ ID NO: 3528517 - DNA, 21 bp, Homo sapiens
ttaataccatacccagatgtt

SEQ ID NO: 3528518 - DNA, 18 bp, Homo sapiens
ttaatgttaactttcaaa

SEQ ID NO: 3528519 - DNA, 22 bp, Homo sapiens
ttaatgttaactttcaaatcca

SEQ ID NO: 3528520 - DNA, 18 bp, Homo sapiens
ttacaaggtgttgttaaa

SEQ ID NO: 3528521 - DNA, 21 bp, Homo sapiens
ttacaaggtgttgttaaaaca

SEQ ID NO: 3528522 - DNA, 23 bp, Homo sapiens
ttacacctccactcagcactctg

SEQ ID NO: 3528523 - DNA, 13 bp, Homo sapiens
ttacagaaaattt

SEQ ID NO: 3528524 - DNA, 11 bp, Homo sapiens
ttacattttct

SEQ ID NO: 3528525 - DNA, 13 bp, Homo sapiens
ttacattttcttg

SEQ ID NO: 3528526 - DNA, 16 bp, Homo sapiens
ttagaccaccaagcct

SEQ ID NO: 3528527 - DNA, 19 bp, Homo sapiens
ttagaccaccaagccttga

SEQ ID NO: 3528528 - DNA, 13 bp, Homo sapiens
ttagtttctgagt

SEQ ID NO: 3528529 - DNA, 15 bp, Homo sapiens
ttatcaggctttcct

SEQ ID NO: 3528530 - DNA, 16 bp, Homo sapiens
ttatgtgctgttagaa

SEQ ID NO: 3528531 - DNA, 22 bp, Homo sapiens
ttatgtgctgttagaatatgtt

SEQ ID NO: 3528532 - DNA, 16 bp, Homo sapiens
ttattagtaacatcat

SEQ ID NO: 3528533 - DNA, 12 bp, Homo sapiens
ttatttatgaag

SEQ ID NO: 3528534 - DNA, 15 bp, Homo sapiens
ttattttaaacattt

SEQ ID NO: 3528535 - DNA, 15 bp, Homo sapiens
ttcaaaatatgtgta

SEQ ID NO: 3528536 - DNA, 19 bp, Homo sapiens
ttcaatgcatacaataaaa

SEQ ID NO: 3528537 - DNA, 23 bp, Homo sapiens
ttcaatgcatacaataaaagagc

SEQ ID NO: 3528538 - DNA, 21 bp, Homo sapiens
ttcacagtcaccaagtgtatt

SEQ ID NO: 3528539 - DNA, 13 bp, Homo sapiens
ttcacgggcccca

SEQ ID NO: 3528540 - DNA, 11 bp, Homo sapiens
ttcagaaagag

SEQ ID NO: 3528541 - DNA, 16 bp, Homo sapiens
ttcagcacaataaata

SEQ ID NO: 3528542 - DNA, 19 bp, Homo sapiens
ttcagcttctataagtgtg

SEQ ID NO: 3528543 - DNA, 15 bp, Homo sapiens
ttcataggggcaggt

SEQ ID NO: 3528544 - DNA, 20 bp, Homo sapiens
ttcatatgaggggacccagc

SEQ ID NO: 3528545 - DNA, 23 bp, Homo sapiens
ttcatatgaggggacccagcgcc

SEQ ID NO: 3528546 - DNA, 16 bp, Homo sapiens
ttcatatgtggaaata

SEQ ID NO: 3528547 - DNA, 13 bp, Homo sapiens
ttccctgaagcta

SEQ ID NO: 3528548 - DNA, 16 bp, Homo sapiens
ttcctgatttttcata

SEQ ID NO: 3528549 - DNA, 16 bp, Homo sapiens
ttctaatgtaaatttt

SEQ ID NO: 3528550 - DNA, 17 bp, Homo sapiens
ttctccaaaggctctgt

SEQ ID NO: 3528551 - DNA, 16 bp, Homo sapiens
ttctgagttttaccaa

SEQ ID NO: 3528552 - DNA, 21 bp, Homo sapiens
ttctgataggagggggcggca

SEQ ID NO: 3528553 - DNA, 12 bp, Homo sapiens
ttctggaatgct

SEQ ID NO: 3528554 - DNA, 13 bp, Homo sapiens
ttctggaatgctt

SEQ ID NO: 3528555 - DNA, 18 bp, Homo sapiens
ttcttctattgcctctga

SEQ ID NO: 3528556 - DNA, 24 bp, Homo sapiens
ttcttgactccttggtgctaaaga

SEQ ID NO: 3528557 - DNA, 17 bp, Homo sapiens
ttcttggccatgggagg

SEQ ID NO: 3528558 - DNA, 20 bp, Homo sapiens
ttgaaaaatgttataactta

SEQ ID NO: 3528559 - DNA, 14 bp, Homo sapiens
ttgacacacagttg

SEQ ID NO: 3528560 - DNA, 12 bp, Homo sapiens
ttgatgttacaa

SEQ ID NO: 3528561 - DNA, 13 bp, Homo sapiens
ttgatgttacaag

SEQ ID NO: 3528562 - DNA, 13 bp, Homo sapiens
ttgcaagatctta

SEQ ID NO: 3528563 - DNA, 13 bp, Homo sapiens
ttgcacatttgaa

SEQ ID NO: 3528564 - DNA, 21 bp, Homo sapiens
ttgcagcttaaagagcacagg

SEQ ID NO: 3528565 - DNA, 15 bp, Homo sapiens
ttgcagtaaagtctt

SEQ ID NO: 3528566 - DNA, 18 bp, Homo sapiens
ttgcctctgagagcatca

SEQ ID NO: 3528567 - DNA, 23 bp, Homo sapiens
ttgctaccaatctgtgagaagtt

SEQ ID NO: 3528568 - DNA, 14 bp, Homo sapiens
ttgctgaccctccc

SEQ ID NO: 3528569 - DNA, 18 bp, Homo sapiens
ttgcttttatcagtgtta

SEQ ID NO: 3528570 - DNA, 14 bp, Homo sapiens
ttggaaagaacatt

SEQ ID NO: 3528571 - DNA, 16 bp, Homo sapiens
ttggaaagaacattta

SEQ ID NO: 3528572 - DNA, 22 bp, Homo sapiens
ttggaaagaacatttaaaatta

SEQ ID NO: 3528573 - DNA, 21 bp, Homo sapiens
ttggcaaaggtccctgagctc

SEQ ID NO: 3528574 - DNA, 14 bp, Homo sapiens
ttggccatgggagg

SEQ ID NO: 3528575 - DNA, 17 bp, Homo sapiens
ttgggttctctgctgtc

SEQ ID NO: 3528576 - DNA, 14 bp, Homo sapiens
ttgtaaatctttgt

SEQ ID NO: 3528577 - DNA, 24 bp, Homo sapiens
ttgtaaatctttgtgaacattctg

SEQ ID NO: 3528578 - DNA, 17 bp, Homo sapiens
ttgtaagctataacata

SEQ ID NO: 3528579 - DNA, 15 bp, Homo sapiens
ttgtaattaaatttt

SEQ ID NO: 3528580 - DNA, 17 bp, Homo sapiens
ttgtccacagcaaaggg

SEQ ID NO: 3528581 - DNA, 22 bp, Homo sapiens
ttgtctctgcaaactgccttct

SEQ ID NO: 3528582 - DNA, 17 bp, Homo sapiens
ttgtgactcagcagagg

SEQ ID NO: 3528583 - DNA, 23 bp, Homo sapiens
ttgtgatgaaaaggcagcatttg

SEQ ID NO: 3528584 - DNA, 13 bp, Homo sapiens
ttgtgcattaaaa

SEQ ID NO: 3528585 - DNA, 13 bp, Homo sapiens
ttgttctgagggg

SEQ ID NO: 3528586 - DNA, 15 bp, Homo sapiens
ttgttgaatgactga

SEQ ID NO: 3528587 - DNA, 15 bp, Homo sapiens
tttaaaatctgctga

SEQ ID NO: 3528588 - DNA, 13 bp, Homo sapiens
tttatttatgaag

SEQ ID NO: 3528589 - DNA, 17 bp, Homo sapiens
tttcaaaatatgtgtat

SEQ ID NO: 3528590 - DNA, 17 bp, Homo sapiens
tttcatatgtggaaata

SEQ ID NO: 3528591 - DNA, 16 bp, Homo sapiens
tttcattgtctgtgaa

SEQ ID NO: 3528592 - DNA, 20 bp, Homo sapiens
tttctccctggatttttacc

SEQ ID NO: 3528593 - DNA, 22 bp, Homo sapiens
tttctccctggatttttaccag

SEQ ID NO: 3528594 - DNA, 23 bp, Homo sapiens
gagggagtctcaggaggaggctg

SEQ ID NO: 3528595 - DNA, 16 bp, Homo sapiens
gagggcactggagctg

SEQ ID NO: 3528596 - DNA, 20 bp, Homo sapiens
gagggcactggagctgggag

SEQ ID NO: 3528597 - DNA, 19 bp, Homo sapiens
gagggccagggaggcagag

SEQ ID NO: 3528598 - DNA, 12 bp, Homo sapiens
gaggggacccag

SEQ ID NO: 3528599 - DNA, 17 bp, Homo sapiens
gagggggcggcagggct

SEQ ID NO: 3528600 - DNA, 23 bp, Homo sapiens
gaggggtgtccgagaggctggtg

SEQ ID NO: 3528601 - DNA, 17 bp, Homo sapiens
gaggtccaagattctgg

SEQ ID NO: 3528602 - DNA, 21 bp, Homo sapiens
gaggtggccaccgggggtggc

SEQ ID NO: 3528603 - DNA, 22 bp, Homo sapiens
gagtagtcagaactataacatt

SEQ ID NO: 3528604 - DNA, 13 bp, Homo sapiens
gagtataattttg

SEQ ID NO: 3528605 - DNA, 19 bp, Homo sapiens
gagtccctcgtctcttgtg

SEQ ID NO: 3528606 - DNA, 14 bp, Homo sapiens
gagtcctccacccc

SEQ ID NO: 3528607 - DNA, 18 bp, Homo sapiens
gagtctcaggaggaggct

SEQ ID NO: 3528608 - DNA, 19 bp, Homo sapiens
gagtctcaggaggaggctg

SEQ ID NO: 3528609 - DNA, 16 bp, Homo sapiens
gagtcttctaatgtaa

SEQ ID NO: 3528610 - DNA, 18 bp, Homo sapiens
gatagcaatgttccagga

SEQ ID NO: 3528611 - DNA, 16 bp, Homo sapiens
gatatgccctcctggt

SEQ ID NO: 3528612 - DNA, 16 bp, Homo sapiens
gatccccacgccacag

SEQ ID NO: 3528613 - DNA, 15 bp, Homo sapiens
gatcctgagctgctg

SEQ ID NO: 3528614 - DNA, 15 bp, Homo sapiens
gatgatccccacgcc

SEQ ID NO: 3528615 - DNA, 12 bp, Homo sapiens
gatggccagagg

SEQ ID NO: 3528616 - DNA, 20 bp, Homo sapiens
gatgggcttttgttctgagg

SEQ ID NO: 3528617 - DNA, 23 bp, Homo sapiens
gatgggcttttgttctgaggggt

SEQ ID NO: 3528618 - DNA, 12 bp, Homo sapiens
gatgtccagggc

SEQ ID NO: 3528619 - DNA, 20 bp, Homo sapiens
gatgttttatttatgaagtt

SEQ ID NO: 3528620 - DNA, 18 bp, Homo sapiens
gattactagagaaagaca

SEQ ID NO: 3528621 - DNA, 14 bp, Homo sapiens
gattattgtctgat

SEQ ID NO: 3528622 - DNA, 23 bp, Homo sapiens
gattattgtctgattgaaacatg

SEQ ID NO: 3528623 - DNA, 18 bp, Homo sapiens
gattcaggggaagggcag

SEQ ID NO: 3528624 - DNA, 18 bp, Homo sapiens
gattccagccatcacctt

SEQ ID NO: 3528625 - DNA, 13 bp, Homo sapiens
gattttgctgact

SEQ ID NO: 3528626 - DNA, 12 bp, Homo sapiens
gatttttaccag

SEQ ID NO: 3528627 - DNA, 18 bp, Homo sapiens
gatttttcatatgtggaa

SEQ ID NO: 3528628 - DNA, 18 bp, Homo sapiens
gcaatgttccaggaatga

SEQ ID NO: 3528629 - DNA, 13 bp, Homo sapiens
gcacagccagccc

SEQ ID NO: 3528630 - DNA, 16 bp, Homo sapiens
gcactctcctgtctga

SEQ ID NO: 3528631 - DNA, 18 bp, Homo sapiens
gcactctggactccacga

SEQ ID NO: 3528632 - DNA, 22 bp, Homo sapiens
gcagaatgaacccatagggagc

SEQ ID NO: 3528633 - DNA, 17 bp, Homo sapiens
gcagagaggtggccacc

SEQ ID NO: 3528634 - DNA, 17 bp, Homo sapiens
gcagagcgggagggagt

SEQ ID NO: 3528635 - DNA, 13 bp, Homo sapiens
gcagaggcagaat

SEQ ID NO: 3528636 - DNA, 19 bp, Homo sapiens
gcagaggcttttccagtgt

SEQ ID NO: 3528637 - DNA, 12 bp, Homo sapiens
gcagattccaca

SEQ ID NO: 3528638 - DNA, 15 bp, Homo sapiens
gcagccaggagggac

SEQ ID NO: 3528639 - DNA, 16 bp, Homo sapiens
gcagccaggagggacc

SEQ ID NO: 3528640 - DNA, 24 bp, Homo sapiens
gcagcctggtcactaggcatcacc

SEQ ID NO: 3528641 - DNA, 18 bp, Homo sapiens
gcagcgaattcagaaaga

SEQ ID NO: 3528642 - DNA, 23 bp, Homo sapiens
gcaggagggcactggagctggga

SEQ ID NO: 3528643 - DNA, 10 bp, Homo sapiens
gcaggcacca

SEQ ID NO: 3528644 - DNA, 19 bp, Homo sapiens
gcaggcaccaacaactcag

SEQ ID NO: 3528645 - DNA, 16 bp, Homo sapiens
gcaggctgcaggaggg

SEQ ID NO: 3528646 - DNA, 20 bp, Homo sapiens
gcaggctgcaggagggcact

SEQ ID NO: 3528647 - DNA, 12 bp, Homo sapiens
gcagggcccagc

SEQ ID NO: 3528648 - DNA, 12 bp, Homo sapiens
gcagggcccctg

SEQ ID NO: 3528649 - DNA, 12 bp, Homo sapiens
gcagtgccagcc

SEQ ID NO: 3528650 - DNA, 13 bp, Homo sapiens
gcagtgccagcca

SEQ ID NO: 3528651 - DNA, 14 bp, Homo sapiens
gcagtgccagccaa

SEQ ID NO: 3528652 - DNA, 12 bp, Homo sapiens
gcatacaataaa

SEQ ID NO: 3528653 - DNA, 16 bp, Homo sapiens
gcatacaataaaagag

SEQ ID NO: 3528654 - DNA, 17 bp, Homo sapiens
gcatacaataaaagagc

SEQ ID NO: 3528655 - DNA, 17 bp, Homo sapiens
gcatacaccaaacattt

SEQ ID NO: 3528656 - DNA, 17 bp, Homo sapiens
gcattctgataggaggg

SEQ ID NO: 3528657 - DNA, 19 bp, Homo sapiens
gcattctgataggaggggg

SEQ ID NO: 3528658 - DNA, 23 bp, Homo sapiens
gcattgagggctctaaacaggat

SEQ ID NO: 3528659 - DNA, 19 bp, Homo sapiens
ggatttccctgaagctatg

SEQ ID NO: 3528660 - DNA, 12 bp, Homo sapiens
ggatttttacca

SEQ ID NO: 3528661 - DNA, 20 bp, Homo sapiens
ggcaaggaatcctctgggag

SEQ ID NO: 3528662 - DNA, 14 bp, Homo sapiens
ggcaagtgagaggg

SEQ ID NO: 3528663 - DNA, 16 bp, Homo sapiens
ggcaagtgagagggga

SEQ ID NO: 3528664 - DNA, 18 bp, Homo sapiens
ggcaagtgagaggggagg

SEQ ID NO: 3528665 - DNA, 20 bp, Homo sapiens
ggcaagtgagaggggaggga

SEQ ID NO: 3528666 - DNA, 16 bp, Homo sapiens
ggcagagcgggaggga

SEQ ID NO: 3528667 - DNA, 18 bp, Homo sapiens
ggcagagcgggagggagt

SEQ ID NO: 3528668 - DNA, 23 bp, Homo sapiens
ggcaggtcctagtcgggcagggc

SEQ ID NO: 3528669 - DNA, 12 bp, Homo sapiens
ggcagtgccagc

SEQ ID NO: 3528670 - DNA, 19 bp, Homo sapiens
ggccacgttcagggagggg

SEQ ID NO: 3528671 - DNA, 14 bp, Homo sapiens
ggccagggaggcag

SEQ ID NO: 3528672 - DNA, 21 bp, Homo sapiens
ggccatcacagccccatggac

SEQ ID NO: 3528673 - DNA, 15 bp, Homo sapiens
ggccatgggaggcct

SEQ ID NO: 3528674 - DNA, 21 bp, Homo sapiens
ggccatgggaggcctttccct

SEQ ID NO: 3528675 - DNA, 12 bp, Homo sapiens
ggcccagggaca

SEQ ID NO: 3528676 - DNA, 12 bp, Homo sapiens
ggccctggaaga

SEQ ID NO: 3528677 - DNA, 14 bp, Homo sapiens
ggccctggaagagt

SEQ ID NO: 3528678 - DNA, 16 bp, Homo sapiens
ggcctgactgccaagc

SEQ ID NO: 3528679 - DNA, 15 bp, Homo sapiens
ggcctggaggctcag

SEQ ID NO: 3528680 - DNA, 13 bp, Homo sapiens
ggcgctgcctcag

SEQ ID NO: 3528681 - DNA, 15 bp, Homo sapiens
ggcgctgcctcaggc

SEQ ID NO: 3528682 - DNA, 14 bp, Homo sapiens
ggcggcagggctgg

SEQ ID NO: 3528683 - DNA, 13 bp, Homo sapiens
ggctgcaggaggg

SEQ ID NO: 3528684 - DNA, 14 bp, Homo sapiens
ggctgcaggagggc

SEQ ID NO: 3528685 - DNA, 18 bp, Homo sapiens
ggctgcaggagggcactg

SEQ ID NO: 3528686 - DNA, 17 bp, Homo sapiens
ggctgccattggtccac

SEQ ID NO: 3528687 - DNA, 23 bp, Homo sapiens
ggctgcccctgtaaggtttcaat

SEQ ID NO: 3528688 - DNA, 12 bp, Homo sapiens
ggctgccctgag

SEQ ID NO: 3528689 - DNA, 23 bp, Homo sapiens
ggctgctgccctgctgtggaaga

SEQ ID NO: 3528690 - DNA, 21 bp, Homo sapiens
ggctggcctggaggctcagcc

SEQ ID NO: 3528691 - DNA, 13 bp, Homo sapiens
ggctggggaccca

SEQ ID NO: 3528692 - DNA, 22 bp, Homo sapiens
ggcttaattcccccaagcagaa

SEQ ID NO: 3528693 - DNA, 14 bp, Homo sapiens
ggcttttgttctga

SEQ ID NO: 3528694 - DNA, 19 bp, Homo sapiens
gggaaggggtgcaggtggg

SEQ ID NO: 3528695 - DNA, 16 bp, Homo sapiens
gggaagtcctgggagg

SEQ ID NO: 3528696 - DNA, 17 bp, Homo sapiens
gggaggcagagcgggag

SEQ ID NO: 3528697 - DNA, 20 bp, Homo sapiens
gggaggctggggacccagac

SEQ ID NO: 3528698 - DNA, 21 bp, Homo sapiens
gggaggtctcgtcccagccct

SEQ ID NO: 3528699 - DNA, 16 bp, Homo sapiens
gggagtctcaggagga

SEQ ID NO: 3528700 - DNA, 20 bp, Homo sapiens
gggagtctcaggaggaggct

SEQ ID NO: 3528701 - DNA, 17 bp, Homo sapiens
gggcaagtgagagggga

SEQ ID NO: 3528702 - DNA, 19 bp, Homo sapiens
gggcaagtgagaggggagg

SEQ ID NO: 3528703 - DNA, 13 bp, Homo sapiens
gggcacagccagc

SEQ ID NO: 3528704 - DNA, 13 bp, Homo sapiens
gggcagggcccct

SEQ ID NO: 3528705 - DNA, 14 bp, Homo sapiens
gggcagggcccctg

SEQ ID NO: 3528706 - DNA, 17 bp, Homo sapiens
gggcagtgccagccaat

SEQ ID NO: 3528707 - DNA, 13 bp, Homo sapiens
gggccagggaggc

SEQ ID NO: 3528708 - DNA, 14 bp, Homo sapiens
gggccagggaggca

SEQ ID NO: 3528709 - DNA, 17 bp, Homo sapiens
gggccagggaggcagag

SEQ ID NO: 3528710 - DNA, 18 bp, Homo sapiens
gggcccctttgctgaccc

SEQ ID NO: 3528711 - DNA, 17 bp, Homo sapiens
gggccctgcaggctgca

SEQ ID NO: 3528712 - DNA, 14 bp, Homo sapiens
gggccggctggcct

SEQ ID NO: 3528713 - DNA, 14 bp, Homo sapiens
gggctgctcccctt

SEQ ID NO: 3528714 - DNA, 11 bp, Homo sapiens
gggctgctgtg

SEQ ID NO: 3528715 - DNA, 14 bp, Homo sapiens
gggctggaggtgct

SEQ ID NO: 3528716 - DNA, 14 bp, Homo sapiens
gggctgtctcagac

SEQ ID NO: 3528717 - DNA, 15 bp, Homo sapiens
gggcttttgttctga

SEQ ID NO: 3528718 - DNA, 18 bp, Homo sapiens
gggcttttgttctgaggg

SEQ ID NO: 3528719 - DNA, 10 bp, Homo sapiens
ggggagggcg

SEQ ID NO: 3528720 - DNA, 14 bp, Homo sapiens
ggggccggctggcc

SEQ ID NO: 3528721 - DNA, 12 bp, Homo sapiens
ggggctggaggt

SEQ ID NO: 3528722 - DNA, 13 bp, Homo sapiens
ggggctggggagg

SEQ ID NO: 3528723 - DNA, 14 bp, Homo sapiens
ggggctggggaggg

SEQ ID NO: 3528724 - DNA, 16 bp, Homo sapiens
ggggctttcggggagg

SEQ ID NO: 3528725 - DNA, 19 bp, Homo sapiens
ggggctttcggggagggcg

SEQ ID NO: 3528726 - DNA, 20 bp, Homo sapiens
ggggctttcggggagggcgc

SEQ ID NO: 3528727 - DNA, 15 bp, Homo sapiens
gggtagaaacctgcc

SEQ ID NO: 3528728 - DNA, 22 bp, Homo sapiens
gggtggagctgagaagaggagg

SEQ ID NO: 3528729 - DNA, 18 bp, Homo sapiens
gggtgtaaaacctggaga

SEQ ID NO: 3528730 - DNA, 17 bp, Homo sapiens
gggtgtccgagaggctg

SEQ ID NO: 3528731 - DNA, 14 bp, Homo sapiens
gggttatttattga

SEQ ID NO: 3528732 - DNA, 16 bp, Homo sapiens
gggttatttattgaca

SEQ ID NO: 3528733 - DNA, 13 bp, Homo sapiens
ggtagctgagggg

SEQ ID NO: 3528734 - DNA, 15 bp, Homo sapiens
ggtcactctccagca

SEQ ID NO: 3528735 - DNA, 18 bp, Homo sapiens
ggtccaagattctggagc

SEQ ID NO: 3528736 - DNA, 14 bp, Homo sapiens
ggtctttatgaatt

SEQ ID NO: 3528737 - DNA, 20 bp, Homo sapiens
ggtgaaacattttctccctg

SEQ ID NO: 3528738 - DNA, 14 bp, Homo sapiens
ggtgatggccagag

SEQ ID NO: 3528739 - DNA, 15 bp, Homo sapiens
ggtgatggccagagg

SEQ ID NO: 3528740 - DNA, 19 bp, Homo sapiens
ggtgctggtagctgagggg

SEQ ID NO: 3528741 - DNA, 18 bp, Homo sapiens
ggtggagctgagaagagg

SEQ ID NO: 3528742 - DNA, 17 bp, Homo sapiens
ggtgggaggatgtgaat

SEQ ID NO: 3528743 - DNA, 19 bp, Homo sapiens
ggtggggtgatggccagag

SEQ ID NO: 3528744 - DNA, 16 bp, Homo sapiens
ggtgtccgagaggctg

SEQ ID NO: 3528745 - DNA, 14 bp, Homo sapiens
ggtgttacattttc

SEQ ID NO: 3528746 - DNA, 16 bp, Homo sapiens
ggttactttggactga

SEQ ID NO: 3528747 - DNA, 21 bp, Homo sapiens
ggttatttattgacacaccca

SEQ ID NO: 3528748 - DNA, 14 bp, Homo sapiens
ggttcataggggca

SEQ ID NO: 3528749 - DNA, 15 bp, Homo sapiens
ggttcataggggcag

SEQ ID NO: 3528750 - DNA, 16 bp, Homo sapiens
ggttcataggggcagg

SEQ ID NO: 3528751 - DNA, 16 bp, Homo sapiens
ggttgtaattaaattt

SEQ ID NO: 3528752 - DNA, 15 bp, Homo sapiens
gtaaggtttcaatgc

SEQ ID NO: 3528753 - DNA, 16 bp, Homo sapiens
gtaaggtttcaatgca

SEQ ID NO: 3528754 - DNA, 12 bp, Homo sapiens
gtacaaactatt

SEQ ID NO: 3528755 - DNA, 16 bp, Homo sapiens
gtacaaactatttcag

SEQ ID NO: 3528756 - DNA, 17 bp, Homo sapiens
gtacaaactatttcaga

SEQ ID NO: 3528757 - DNA, 14 bp, Homo sapiens
gtacccgaggcctc

SEQ ID NO: 3528758 - DNA, 23 bp, Homo sapiens
gtagacctttctccctccttcct

SEQ ID NO: 3528759 - DNA, 22 bp, Homo sapiens
gtaggatgtatgctgtttgtac

SEQ ID NO: 3528760 - DNA, 17 bp, Homo sapiens
gtatacacttaaacttg

SEQ ID NO: 3528761 - DNA, 17 bp, Homo sapiens
gtattttttttgctttt

SEQ ID NO: 3528762 - DNA, 20 bp, Homo sapiens
gtcagacgttggtcccaagt

SEQ ID NO: 3528763 - DNA, 23 bp, Homo sapiens
gtcagccatcagccatggccctc

SEQ ID NO: 3528764 - DNA, 23 bp, Homo sapiens
gtcaggctgttggcgtgtcccag

SEQ ID NO: 3528765 - DNA, 13 bp, Homo sapiens
gtccagggcccca

SEQ ID NO: 3528766 - DNA, 18 bp, Homo sapiens
gtcccaccctatggccac

SEQ ID NO: 3528767 - DNA, 16 bp, Homo sapiens
gtcccagcaccacacc

SEQ ID NO: 3528768 - DNA, 12 bp, Homo sapiens
gtcctgggagga

SEQ ID NO: 3528769 - DNA, 19 bp, Homo sapiens
gtcctgggaggatcctgag

SEQ ID NO: 3528770 - DNA, 23 bp, Homo sapiens
gtcctgggaggatcctgagctgc

SEQ ID NO: 3528771 - DNA, 23 bp, Homo sapiens
gtctcagacgactagcccaggac

SEQ ID NO: 3528772 - DNA, 22 bp, Homo sapiens
tccccaaaggctttgccctgct

SEQ ID NO: 3528773 - DNA, 17 bp, Homo sapiens
tccccctgttcacatcc

SEQ ID NO: 3528774 - DNA, 15 bp, Homo sapiens
tccccttgcagcctg

SEQ ID NO: 3528775 - DNA, 16 bp, Homo sapiens
tccccttgcagcctgg

SEQ ID NO: 3528776 - DNA, 19 bp, Homo sapiens
tcccgaacactgagaaata

SEQ ID NO: 3528777 - DNA, 18 bp, Homo sapiens
tcccgagcaaccctctga

SEQ ID NO: 3528778 - DNA, 21 bp, Homo sapiens
tcccgagcaaccctctgaaga

SEQ ID NO: 3528779 - DNA, 14 bp, Homo sapiens
tccctaagccagct

SEQ ID NO: 3528780 - DNA, 14 bp, Homo sapiens
tccctcctgcagct

SEQ ID NO: 3528781 - DNA, 20 bp, Homo sapiens
tccctgaagctatgtctcta

SEQ ID NO: 3528782 - DNA, 20 bp, Homo sapiens
tccctggatttttaccagtc

SEQ ID NO: 3528783 - DNA, 21 bp, Homo sapiens
tccgttggaaagaacatttaa

SEQ ID NO: 3528784 - DNA, 21 bp, Homo sapiens
tcctacctccactctctgccc

SEQ ID NO: 3528785 - DNA, 12 bp, Homo sapiens
tcctagcccctt

SEQ ID NO: 3528786 - DNA, 20 bp, Homo sapiens
tcctccttccggggaaggat

SEQ ID NO: 3528787 - DNA, 22 bp, Homo sapiens
tcctcggtgttacttccctttc

SEQ ID NO: 3528788 - DNA, 12 bp, Homo sapiens
tcctgatttttc

SEQ ID NO: 3528789 - DNA, 11 bp, Homo sapiens
tcctgggagga

SEQ ID NO: 3528790 - DNA, 12 bp, Homo sapiens
tcctgggaggat

SEQ ID NO: 3528791 - DNA, 18 bp, Homo sapiens
tcctgggaggatcctgag

SEQ ID NO: 3528792 - DNA, 11 bp, Homo sapiens
tcggggagggc

SEQ ID NO: 3528793 - DNA, 17 bp, Homo sapiens
tctaaaggatgagattt

SEQ ID NO: 3528794 - DNA, 15 bp, Homo sapiens
tctaagcagccagga

SEQ ID NO: 3528795 - DNA, 13 bp, Homo sapiens
tactttggactga

SEQ ID NO: 3528796 - DNA, 13 bp, Homo sapiens
tagaatatgttga

SEQ ID NO: 3528797 - DNA, 19 bp, Homo sapiens
tagaccaccaagccttgat

SEQ ID NO: 3528798 - DNA, 14 bp, Homo sapiens
tagagaaagacaaa

SEQ ID NO: 3528799 - DNA, 21 bp, Homo sapiens
tagagaaagacaaaatgtgac

SEQ ID NO: 3528800 - DNA, 21 bp, Homo sapiens
tagaggcctgactgccaagcc

SEQ ID NO: 3528801 - DNA, 22 bp, Homo sapiens
tagaggcctgactgccaagcca

SEQ ID NO: 3528802 - DNA, 19 bp, Homo sapiens
tagattcaggggaagggca

SEQ ID NO: 3528803 - DNA, 18 bp, Homo sapiens
tagcccatcttcctgagc

SEQ ID NO: 3528804 - DNA, 12 bp, Homo sapiens
tagctgagggga

SEQ ID NO: 3528805 - DNA, 13 bp, Homo sapiens
tagctgaggggac

SEQ ID NO: 3528806 - DNA, 20 bp, Homo sapiens
tagctgaggggacgggcaag

SEQ ID NO: 3528807 - DNA, 21 bp, Homo sapiens
taggagggggcggcagggctg

SEQ ID NO: 3528808 - DNA, 17 bp, Homo sapiens
taggcaccttaactgga

SEQ ID NO: 3528809 - DNA, 18 bp, Homo sapiens
taggctgctgccctgctg

SEQ ID NO: 3528810 - DNA, 15 bp, Homo sapiens
taggtcactctccag

SEQ ID NO: 3528811 - DNA, 11 bp, Homo sapiens
tagtaactctt

SEQ ID NO: 3528812 - DNA, 13 bp, Homo sapiens
tagtcagaactat

SEQ ID NO: 3528813 - DNA, 18 bp, Homo sapiens
tagtcagaactataacat

SEQ ID NO: 3528814 - DNA, 20 bp, Homo sapiens
tagtcccaccctatggccac

SEQ ID NO: 3528815 - DNA, 15 bp, Homo sapiens
tagttacatttatgt

SEQ ID NO: 3528816 - DNA, 20 bp, Homo sapiens
tataacatatttattgtgca

SEQ ID NO: 3528817 - DNA, 18 bp, Homo sapiens
tataagtgtgaccagttt

SEQ ID NO: 3528818 - DNA, 18 bp, Homo sapiens
tataattttggttgtaat

SEQ ID NO: 3528819 - DNA, 16 bp, Homo sapiens
tatacttgaaaaatgt

SEQ ID NO: 3528820 - DNA, 20 bp, Homo sapiens
tatatcacagagccactctt

SEQ ID NO: 3528821 - DNA, 15 bp, Homo sapiens
tatcacagagccact

SEQ ID NO: 3528822 - DNA, 15 bp, Homo sapiens
tgcactgctcacgga

SEQ ID NO: 3528823 - DNA, 13 bp, Homo sapiens
tgcaggagggcac

SEQ ID NO: 3528824 - DNA, 18 bp, Homo sapiens
tgcaggctgcaggagggc

SEQ ID NO: 3528825 - DNA, 19 bp, Homo sapiens
tgcaggctgcaggagggca

SEQ ID NO: 3528826 - DNA, 14 bp, Homo sapiens
tgcagtaaagtctt

SEQ ID NO: 3528827 - DNA, 21 bp, Homo sapiens
tgcagtatatcacagagccac

SEQ ID NO: 3528828 - DNA, 13 bp, Homo sapiens
tgcagtctaaccc

SEQ ID NO: 3528829 - DNA, 15 bp, Homo sapiens
tgcatacaataaaag

SEQ ID NO: 3528830 - DNA, 20 bp, Homo sapiens
tgcattctgataggaggggg

SEQ ID NO: 3528831 - DNA, 21 bp, Homo sapiens
tgccagccaatccctggccat

SEQ ID NO: 3528832 - DNA, 22 bp, Homo sapiens
tgccagttgtcctccttccggg

SEQ ID NO: 3528833 - DNA, 14 bp, Homo sapiens
tgccatggcaatgg

SEQ ID NO: 3528834 - DNA, 19 bp, Homo sapiens
tgccattggtccacccttt

SEQ ID NO: 3528835 - DNA, 17 bp, Homo sapiens
tgccctaggatatgccc

SEQ ID NO: 3528836 - DNA, 23 bp, Homo sapiens
tgccctccctcagccgtcagcca

SEQ ID NO: 3528837 - DNA, 20 bp, Homo sapiens
tgccctcggtcactgagtct

SEQ ID NO: 3528838 - DNA, 15 bp, Homo sapiens
tgccctgaggggctg

SEQ ID NO: 3528839 - DNA, 22 bp, Homo sapiens
gcctgggtgtaaaacctggaga

SEQ ID NO: 3528840 - DNA, 16 bp, Homo sapiens
gcctgtgaccttggga

SEQ ID NO: 3528841 - DNA, 15 bp, Homo sapiens
gccttaactgttgtt

SEQ ID NO: 3528842 - DNA, 17 bp, Homo sapiens
gcgctgcctcaggcact

SEQ ID NO: 3528843 - DNA, 17 bp, Homo sapiens
gcgggcacagccagccc

SEQ ID NO: 3528844 - DNA, 15 bp, Homo sapiens
gctaaagattgttaa

SEQ ID NO: 3528845 - DNA, 12 bp, Homo sapiens
gctataacatat

SEQ ID NO: 3528846 - DNA, 19 bp, Homo sapiens
gctatttacaaatgaagta

SEQ ID NO: 3528847 - DNA, 17 bp, Homo sapiens
gctcatcggtggaagca

SEQ ID NO: 3528848 - DNA, 23 bp, Homo sapiens
gctccaggatgcattctgatagg

SEQ ID NO: 3528849 - DNA, 16 bp, Homo sapiens
gctccatgttgcttca

SEQ ID NO: 3528850 - DNA, 19 bp, Homo sapiens
gctcctcggtgttacttcc

SEQ ID NO: 3528851 - DNA, 21 bp, Homo sapiens
gctctgttatcagctgggcag

SEQ ID NO: 3528852 - DNA, 18 bp, Homo sapiens
gctcttggtgggcccagg

SEQ ID NO: 3528853 - DNA, 16 bp, Homo sapiens
gctgcaggagggcact

SEQ ID NO: 3528854 - DNA, 18 bp, Homo sapiens
gctgcatcccgagcaacc

SEQ ID NO: 3528855 - DNA, 23 bp, Homo sapiens
gctgcatcccgagcaaccctctg

SEQ ID NO: 3528856 - DNA, 21 bp, Homo sapiens
gctgccattggtccacccttt

SEQ ID NO: 3528857 - DNA, 21 bp, Homo sapiens
gctgcccccagagccacagtt

SEQ ID NO: 3528858 - DNA, 14 bp, Homo sapiens
gctgccctgagggg

SEQ ID NO: 3528859 - DNA, 12 bp, Homo sapiens
gctgcctcaggc

SEQ ID NO: 3528860 - DNA, 19 bp, Homo sapiens
gctgctgccctgctgtgga

SEQ ID NO: 3528861 - DNA, 16 bp, Homo sapiens
gctgggcagtgccagc

SEQ ID NO: 3528862 - DNA, 17 bp, Homo sapiens
gctgggcagtgccagcc

SEQ ID NO: 3528863 - DNA, 15 bp, Homo sapiens
gctggtagctgaggg

SEQ ID NO: 3528864 - DNA, 14 bp, Homo sapiens
gctgtcagaagttt

SEQ ID NO: 3528865 - DNA, 16 bp, Homo sapiens
gctgtcctaagaactt

SEQ ID NO: 3528866 - DNA, 18 bp, Homo sapiens
gctgttagaatatgttga

SEQ ID NO: 3528867 - DNA, 23 bp, Homo sapiens
gctgttcctgatttttcatatgt

SEQ ID NO: 3528868 - DNA, 21 bp, Homo sapiens
gcttaaagagcacaggttcca

SEQ ID NO: 3528869 - DNA, 19 bp, Homo sapiens
gcttgctaccaatctgtga

SEQ ID NO: 3528870 - DNA, 19 bp, Homo sapiens
gcttttatcagtgttaaag

SEQ ID NO: 3528871 - DNA, 14 bp, Homo sapiens
gcttttcctcaggg

SEQ ID NO: 3528872 - DNA, 14 bp, Homo sapiens
gcttttgtgtccca

SEQ ID NO: 3528873 - DNA, 16 bp, Homo sapiens
ggaaagaacatttaaa

SEQ ID NO: 3528874 - DNA, 21 bp, Homo sapiens
ggaaagaagaaggtgggagga

SEQ ID NO: 3528875 - DNA, 22 bp, Homo sapiens
ggaacacctgatggtgaaacca

SEQ ID NO: 3528876 - DNA, 20 bp, Homo sapiens
ggaagctgtgcgtgtgtgtg

SEQ ID NO: 3528877 - DNA, 18 bp, Homo sapiens
ggaaggggtgcaggtggg

SEQ ID NO: 3528878 - DNA, 21 bp, Homo sapiens
ggaaggggtgcaggtggggtg

SEQ ID NO: 3528879 - DNA, 20 bp, Homo sapiens
ggaataatgcggacactttt

SEQ ID NO: 3528880 - DNA, 18 bp, Homo sapiens
ggaatgatgggcttttgt

SEQ ID NO: 3528881 - DNA, 15 bp, Homo sapiens
ggaatggtcaaatct

SEQ ID NO: 3528882 - DNA, 17 bp, Homo sapiens
ggacaccgtggggaagg

SEQ ID NO: 3528883 - DNA, 16 bp, Homo sapiens
ggacacttttgaggac

SEQ ID NO: 3528884 - DNA, 14 bp, Homo sapiens
ggaccaaaggggga

SEQ ID NO: 3528885 - DNA, 17 bp, Homo sapiens
ggaccagggtggagctg

SEQ ID NO: 3528886 - DNA, 16 bp, Homo sapiens
ggacccatctttctca

SEQ ID NO: 3528887 - DNA, 17 bp, Homo sapiens
ggacccatctttctcac

SEQ ID NO: 3528888 - DNA, 23 bp, Homo sapiens
ggacccatctttctcacacggat

SEQ ID NO: 3528889 - DNA, 15 bp, Homo sapiens
ggacgtgggccctgc

SEQ ID NO: 3528890 - DNA, 19 bp, Homo sapiens
ggactccacgatgcctttg

SEQ ID NO: 3528891 - DNA, 14 bp, Homo sapiens
ggagcagagaggtg

SEQ ID NO: 3528892 - DNA, 12 bp, Homo sapiens
ggagctgggagg

SEQ ID NO: 3528893 - DNA, 12 bp, Homo sapiens
ggaggaggctgc

SEQ ID NO: 3528894 - DNA, 20 bp, Homo sapiens
ggaggatcctgagctgctgt

SEQ ID NO: 3528895 - DNA, 15 bp, Homo sapiens
ggaggctcagcccac

SEQ ID NO: 3528896 - DNA, 18 bp, Homo sapiens
ggaggctgccctgagggg

SEQ ID NO: 3528897 - DNA, 14 bp, Homo sapiens
ggagggagggaagt

SEQ ID NO: 3528898 - DNA, 21 bp, Homo sapiens
ggagggccagggaggcagagc

SEQ ID NO: 3528899 - DNA, 14 bp, Homo sapiens
ggagggggcggcag

SEQ ID NO: 3528900 - DNA, 20 bp, Homo sapiens
ggagggggcggcagggctgg

SEQ ID NO: 3528901 - DNA, 24 bp, Homo sapiens
ggagggggcggcagggctgggcct

SEQ ID NO: 3528902 - DNA, 17 bp, Homo sapiens
ggaggtctcgtcccagc

SEQ ID NO: 3528903 - DNA, 13 bp, Homo sapiens
ggaggtgggggct

SEQ ID NO: 3528904 - DNA, 20 bp, Homo sapiens
ggagtctcaggaggaggctg

SEQ ID NO: 3528905 - DNA, 16 bp, Homo sapiens
ggatatgccctcctgg

SEQ ID NO: 3528906 - DNA, 22 bp, Homo sapiens
ggatgaacattcaagagagctc

SEQ ID NO: 3528907 - DNA, 12 bp, Homo sapiens
ggatgttgcaaa

SEQ ID NO: 3528908 - DNA, 16 bp, Homo sapiens
ccaaggaatgatccat

SEQ ID NO: 3528909 - DNA, 22 bp, Homo sapiens
ccaaggaatgatccatactgaa

SEQ ID NO: 3528910 - DNA, 13 bp, Homo sapiens
ccaaggagcagag

SEQ ID NO: 3528911 - DNA, 17 bp, Homo sapiens
ccaaggagcagagaggt

SEQ ID NO: 3528912 - DNA, 23 bp, Homo sapiens
ccaaggagcagagaggtggccac

SEQ ID NO: 3528913 - DNA, 17 bp, Homo sapiens
ccaaggcagggcccagc

SEQ ID NO: 3528914 - DNA, 12 bp, Homo sapiens
ccaaggggcccg

SEQ ID NO: 3528915 - DNA, 16 bp, Homo sapiens
ccaagtgtattgtaat

SEQ ID NO: 3528916 - DNA, 14 bp, Homo sapiens
ccaataccctagaa

SEQ ID NO: 3528917 - DNA, 22 bp, Homo sapiens
ccaataccctagaagaaaaccc

SEQ ID NO: 3528918 - DNA, 13 bp, Homo sapiens
ccaatctgtgaga

SEQ ID NO: 3528919 - DNA, 23 bp, Homo sapiens
ccacaccacccctaaagtgccag

SEQ ID NO: 3528920 - DNA, 24 bp, Homo sapiens
ccacaccacccctaaagtgccagg

SEQ ID NO: 3528921 - DNA, 18 bp, Homo sapiens
ccacagcccttttgtctc

SEQ ID NO: 3528922 - DNA, 20 bp, Homo sapiens
ccacaggacacgaaggctgc

SEQ ID NO: 3528923 - DNA, 12 bp, Homo sapiens
ccaccaagcctt

SEQ ID NO: 3528924 - DNA, 21 bp, Homo sapiens
ccaccctttcatagagaggcc

SEQ ID NO: 3528925 - DNA, 17 bp, Homo sapiens
ccactcagcactctgga

SEQ ID NO: 3528926 - DNA, 22 bp, Homo sapiens
ccactcagcactctggactcca

SEQ ID NO: 3528927 - DNA, 17 bp, Homo sapiens
ccagaaaccttccagag

SEQ ID NO: 3528928 - DNA, 14 bp, Homo sapiens
ccagaccaaagcaa

SEQ ID NO: 3528929 - DNA, 20 bp, Homo sapiens
ccagacttttggccccagcg

SEQ ID NO: 3528930 - DNA, 17 bp, Homo sapiens
ccagaggaatgatgggc

SEQ ID NO: 3528931 - DNA, 21 bp, Homo sapiens
ccagaggaatgatgggctttt

SEQ ID NO: 3528932 - DNA, 20 bp, Homo sapiens
ccagatgttttatttatgaa

SEQ ID NO: 3528933 - DNA, 23 bp, Homo sapiens
ccagcccaaaccttgggccctgg

SEQ ID NO: 3528934 - DNA, 12 bp, Homo sapiens
ccagccccacac

SEQ ID NO: 3528935 - DNA, 16 bp, Homo sapiens
ccagccttttgagagt

SEQ ID NO: 3528936 - DNA, 19 bp, Homo sapiens
ccagctctaagcagccagg

SEQ ID NO: 3528937 - DNA, 22 bp, Homo sapiens
ccagctgcccccagagccacag

SEQ ID NO: 3528938 - DNA, 23 bp, Homo sapiens
ccaggaatgaaatatagatgtta

SEQ ID NO: 3528939 - DNA, 22 bp, Homo sapiens
ccaggcccgcgggcacagccag

SEQ ID NO: 3528940 - DNA, 23 bp, Homo sapiens
ccaggcccgcgggcacagccagc

SEQ ID NO: 3528941 - DNA, 20 bp, Homo sapiens
ccagggacacccacacaggt

SEQ ID NO: 3528942 - DNA, 19 bp, Homo sapiens
ccagggaggcagagcggga

SEQ ID NO: 3528943 - DNA, 22 bp, Homo sapiens
ccagggaggcagagcgggaggg

SEQ ID NO: 3528944 - DNA, 17 bp, Homo sapiens
ccagggtggagctgaga

SEQ ID NO: 3528945 - DNA, 22 bp, Homo sapiens
ccaggtgatctcctgtggctca

SEQ ID NO: 3528946 - DNA, 15 bp, Homo sapiens
ccagtgcctcctagc

SEQ ID NO: 3528947 - DNA, 13 bp, Homo sapiens
ccagttgtcctcc

SEQ ID NO: 3528948 - DNA, 16 bp, Homo sapiens
ccagttgtcctccttc

SEQ ID NO: 3528949 - DNA, 13 bp, Homo sapiens
ccatagcaccctg

SEQ ID NO: 3528950 - DNA, 23 bp, Homo sapiens
ccatagcaccctgccctcatggg

SEQ ID NO: 3528951 - DNA, 20 bp, Homo sapiens
ccatcttacagagactctcc

SEQ ID NO: 3528952 - DNA, 18 bp, Homo sapiens
ccatctttctcacacgga

SEQ ID NO: 3528953 - DNA, 13 bp, Homo sapiens
ccatgttgcttca

SEQ ID NO: 3528954 - DNA, 13 bp, Homo sapiens
cccaaaatgtgaa

SEQ ID NO: 3528955 - DNA, 13 bp, Homo sapiens
cccaaaccttggg

SEQ ID NO: 3528956 - DNA, 14 bp, Homo sapiens
cccaaaccttgggc

SEQ ID NO: 3528957 - DNA, 13 bp, Homo sapiens
cccaagacaccat

SEQ ID NO: 3528958 - DNA, 16 bp, Homo sapiens
cccaagccctggtgac

SEQ ID NO: 3528959 - DNA, 20 bp, Homo sapiens
cccaagccctggtgaccaga

SEQ ID NO: 3528960 - DNA, 23 bp, Homo sapiens
cccaagccctggtgaccagacca

SEQ ID NO: 3528961 - DNA, 21 bp, Homo sapiens
cccaccctatggccactggcc

SEQ ID NO: 3528962 - DNA, 13 bp, Homo sapiens
cccagccccacac

SEQ ID NO: 3528963 - DNA, 18 bp, Homo sapiens
cccagcgccggggggagg

SEQ ID NO: 3528964 - DNA, 13 bp, Homo sapiens
cccagctctaagc

SEQ ID NO: 3528965 - DNA, 19 bp, Homo sapiens
cccagctctaagcagccag

SEQ ID NO: 3528966 - DNA, 23 bp, Homo sapiens
cccagctctaagcagccaggagg

SEQ ID NO: 3528967 - DNA, 16 bp, Homo sapiens
cccaggacccatcttt

SEQ ID NO: 3528968 - DNA, 20 bp, Homo sapiens
cccagtgcctcctagcccct

SEQ ID NO: 3528969 - DNA, 23 bp, Homo sapiens
cccatatcatataaaatttcagg

SEQ ID NO: 3528970 - DNA, 13 bp, Homo sapiens
ccccacgccacag

SEQ ID NO: 3528971 - DNA, 14 bp, Homo sapiens
ccccacgccacagc

SEQ ID NO: 3528972 - DNA, 15 bp, Homo sapiens
ccccacgccacagcc

SEQ ID NO: 3528973 - DNA, 13 bp, Homo sapiens
ccccagagccaca

SEQ ID NO: 3528974 - DNA, 15 bp, Homo sapiens
ccccagagccacagt

SEQ ID NO: 3528975 - DNA, 16 bp, Homo sapiens
ccccagagccacagtt

SEQ ID NO: 3528976 - DNA, 18 bp, Homo sapiens
ccccagatacccatcttg

SEQ ID NO: 3528977 - DNA, 24 bp, Homo sapiens
ccccagctctaagcagccaggagg

SEQ ID NO: 3528978 - DNA, 23 bp, Homo sapiens
cccccagctctaagcagccagga

SEQ ID NO: 3528979 - DNA, 15 bp, Homo sapiens
cccccatagcaccct

SEQ ID NO: 3528980 - DNA, 17 bp, Homo sapiens
cccccgcagaggcagaa

SEQ ID NO: 3528981 - DNA, 19 bp, Homo sapiens
cccgacccccgcagaggca

SEQ ID NO: 3528982 - DNA, 20 bp, Homo sapiens
cccgagcaaccctctgaaga

SEQ ID NO: 3528983 - DNA, 18 bp, Homo sapiens
cccgcgggcacagccagc

SEQ ID NO: 3528984 - DNA, 12 bp, Homo sapiens
ccctaagccagc

SEQ ID NO: 3528985 - DNA, 23 bp, Homo sapiens
ccctccccatctcggggctgctg

SEQ ID NO: 3528986 - DNA, 14 bp, Homo sapiens
ccctcccggcctgg

SEQ ID NO: 3528987 - DNA, 16 bp, Homo sapiens
ccctccctcagccgtc

SEQ ID NO: 3528988 - DNA, 14 bp, Homo sapiens
ccctcctggtgact

SEQ ID NO: 3528989 - DNA, 23 bp, Homo sapiens
ccctctgaagaagggaattaggc

SEQ ID NO: 3528990 - DNA, 18 bp, Homo sapiens
ccctgactgtcagggagg

SEQ ID NO: 3528991 - DNA, 19 bp, Homo sapiens
ccctgactgtcagggaggg

SEQ ID NO: 3528992 - DNA, 20 bp, Homo sapiens
ccctgactgtcagggagggc

SEQ ID NO: 3528993 - DNA, 23 bp, Homo sapiens
ccctgagctcttgctatctctca

SEQ ID NO: 3528994 - DNA, 15 bp, Homo sapiens
ccctgaggggctggg

SEQ ID NO: 3528995 - DNA, 22 bp, Homo sapiens
ccctgcaggctgcaggagggca

SEQ ID NO: 3528996 - DNA, 14 bp, Homo sapiens
ccctgccctcatgg

SEQ ID NO: 3528997 - DNA, 16 bp, Homo sapiens
ccctgccctcatggga

SEQ ID NO: 3528998 - DNA, 21 bp, Homo sapiens
ccctggaagagtcctccaccc

SEQ ID NO: 3528999 - DNA, 12 bp, Homo sapiens
ccctgtaaggtt

SEQ ID NO: 3529000 - DNA, 20 bp, Homo sapiens
ccctttcatagagaggcctg

SEQ ID NO: 3529001 - DNA, 22 bp, Homo sapiens
cccttttagaatttacctctta

SEQ ID NO: 3529002 - DNA, 13 bp, Homo sapiens
cccttttgtctct

SEQ ID NO: 3529003 - DNA, 23 bp, Homo sapiens
ccgaaagtctgaatctcccaagg

SEQ ID NO: 3529004 - DNA, 16 bp, Homo sapiens
ccgaacactgagaaat

SEQ ID NO: 3529005 - DNA, 20 bp, Homo sapiens
ccgacccccgcagaggcaga

SEQ ID NO: 3529006 - DNA, 16 bp, Homo sapiens
ccgagcaaccctctga

SEQ ID NO: 3529007 - DNA, 11 bp, Homo sapiens
ccgcagaggca

SEQ ID NO: 3529008 - DNA, 17 bp, Homo sapiens
ccgcgggcacagccagc

SEQ ID NO: 3529009 - DNA, 21 bp, Homo sapiens
ccggctggcctggaggctcag

SEQ ID NO: 3529010 - DNA, 19 bp, Homo sapiens
ccgggacaccgtggggaag

SEQ ID NO: 3529011 - DNA, 16 bp, Homo sapiens
cctaagccagctgccc

SEQ ID NO: 3529012 - DNA, 17 bp, Homo sapiens
cctagaagaaaacccga

SEQ ID NO: 3529013 - DNA, 16 bp, Homo sapiens
cctagtcgggcagggc

SEQ ID NO: 3529014 - DNA, 19 bp, Homo sapiens
cctcagccgtcagccatca

SEQ ID NO: 3529015 - DNA, 19 bp, Homo sapiens
cctcatccaactccgaaag

SEQ ID NO: 3529016 - DNA, 17 bp, Homo sapiens
cctcccgaacactgaga

SEQ ID NO: 3529017 - DNA, 22 bp, Homo sapiens
cctccctcagccgtcagccatc

SEQ ID NO: 3529018 - DNA, 21 bp, Homo sapiens
atttttaacaagtcatttcaa

SEQ ID NO: 3529019 - DNA, 18 bp, Homo sapiens
caaacatttctgtgaaac

SEQ ID NO: 3529020 - DNA, 20 bp, Homo sapiens
caaagctcgggtctccctcc

SEQ ID NO: 3529021 - DNA, 15 bp, Homo sapiens
caaagctgaaaatgt

SEQ ID NO: 3529022 - DNA, 21 bp, Homo sapiens
caaaggctttgccctgctgcc

SEQ ID NO: 3529023 - DNA, 21 bp, Homo sapiens
caaatagcatacaccaaacat

SEQ ID NO: 3529024 - DNA, 22 bp, Homo sapiens
caaatagcatacaccaaacatt

SEQ ID NO: 3529025 - DNA, 18 bp, Homo sapiens
caaatcactgtggggaaa

SEQ ID NO: 3529026 - DNA, 20 bp, Homo sapiens
caaatgaagtatttcatgta

SEQ ID NO: 3529027 - DNA, 22 bp, Homo sapiens
caaatgaagtatttcatgtaat

SEQ ID NO: 3529028 - DNA, 14 bp, Homo sapiens
caacatataaagta

SEQ ID NO: 3529029 - DNA, 22 bp, Homo sapiens
caacatgtcaaagctgcatgtg

SEQ ID NO: 3529030 - DNA, 16 bp, Homo sapiens
caaccctctgaagaag

SEQ ID NO: 3529031 - DNA, 17 bp, Homo sapiens
caactggaaataaagta

SEQ ID NO: 3529032 - DNA, 21 bp, Homo sapiens
caagagaatttcaaggcaggg

SEQ ID NO: 3529033 - DNA, 15 bp, Homo sapiens
caagcagaagaccag

SEQ ID NO: 3529034 - DNA, 16 bp, Homo sapiens
caagcagatctgcttt

SEQ ID NO: 3529035 - DNA, 21 bp, Homo sapiens
caagccatgggtagcctgggt

SEQ ID NO: 3529036 - DNA, 13 bp, Homo sapiens
caagccctggtga

SEQ ID NO: 3529037 - DNA, 12 bp, Homo sapiens
caaggagcagag

SEQ ID NO: 3529038 - DNA, 22 bp, Homo sapiens
caaggagtcttctaatgtaaat

SEQ ID NO: 3529039 - DNA, 13 bp, Homo sapiens
caagtgagagggg

SEQ ID NO: 3529040 - DNA, 14 bp, Homo sapiens
caagttacacctcc

SEQ ID NO: 3529041 - DNA, 15 bp, Homo sapiens
caagttcagccaccg

SEQ ID NO: 3529042 - DNA, 17 bp, Homo sapiens
caataaatatacttctg

SEQ ID NO: 3529043 - DNA, 17 bp, Homo sapiens
caatgcatacaataaaa

SEQ ID NO: 3529044 - DNA, 21 bp, Homo sapiens
caatgcatacaataaaagagc

SEQ ID NO: 3529045 - DNA, 19 bp, Homo sapiens
caatttgctatttacaaat

SEQ ID NO: 3529046 - DNA, 12 bp, Homo sapiens
cacaaaatgaat

SEQ ID NO: 3529047 - DNA, 13 bp, Homo sapiens
cacaaaatgaata

SEQ ID NO: 3529048 - DNA, 13 bp, Homo sapiens
cacaaatcactgt

SEQ ID NO: 3529049 - DNA, 21 bp, Homo sapiens
cacaagtgtaactatgctgtt

SEQ ID NO: 3529050 - DNA, 17 bp, Homo sapiens
cacacaggtggccatca

SEQ ID NO: 3529051 - DNA, 23 bp, Homo sapiens
cacacaggtggccatcacagccc

SEQ ID NO: 3529052 - DNA, 23 bp, Homo sapiens
cacacagttgttgaatgactgac

SEQ ID NO: 3529053 - DNA, 14 bp, Homo sapiens
cacagaaatctgaa

SEQ ID NO: 3529054 - DNA, 23 bp, Homo sapiens
cacagaaatctgaaaaatggcca

SEQ ID NO: 3529055 - DNA, 12 bp, Homo sapiens
cacagccagccc

SEQ ID NO: 3529056 - DNA, 22 bp, Homo sapiens
cacagccagcccaaaccttggg

SEQ ID NO: 3529057 - DNA, 20 bp, Homo sapiens
cacaggacacgaaggctgcc

SEQ ID NO: 3529058 - DNA, 15 bp, Homo sapiens
cacagggctgcatcc

SEQ ID NO: 3529059 - DNA, 21 bp, Homo sapiens
cacagttgttgaatgactgac

SEQ ID NO: 3529060 - DNA, 21 bp, Homo sapiens
cacatttgaattcatttgctg

SEQ ID NO: 3529061 - DNA, 12 bp, Homo sapiens
aaagaacattta

SEQ ID NO: 3529062 - DNA, 20 bp, Homo sapiens
aaagaagaaggtgggaggat

SEQ ID NO: 3529063 - DNA, 13 bp, Homo sapiens
aaagacaaaatgt

SEQ ID NO: 3529064 - DNA, 20 bp, Homo sapiens
aaagattgttaaattcaatg

SEQ ID NO: 3529065 - DNA, 15 bp, Homo sapiens
aaagcaatcattaag

SEQ ID NO: 3529066 - DNA, 20 bp, Homo sapiens
aaagcaatcattaagtgact

SEQ ID NO: 3529067 - DNA, 22 bp, Homo sapiens
aaagcaatcattaagtgacttt

SEQ ID NO: 3529068 - DNA, 14 bp, Homo sapiens
aaagctgaaaatgt

SEQ ID NO: 3529069 - DNA, 16 bp, Homo sapiens
aaagctgaaaatgtgt

SEQ ID NO: 3529070 - DNA, 13 bp, Homo sapiens
aaaggacactgga

SEQ ID NO: 3529071 - DNA, 17 bp, Homo sapiens
aaaggagattctttgag

SEQ ID NO: 3529072 - DNA, 16 bp, Homo sapiens
aaaggcctgcttttgt

SEQ ID NO: 3529073 - DNA, 15 bp, Homo sapiens
aaagtaggaaagaat

SEQ ID NO: 3529074 - DNA, 19 bp, Homo sapiens
aaagtaggaaagaatttgt

SEQ ID NO: 3529075 - DNA, 17 bp, Homo sapiens
aaagtcttgtctggtga

SEQ ID NO: 3529076 - DNA, 16 bp, Homo sapiens
aaagtggtctgaactg

SEQ ID NO: 3529077 - DNA, 14 bp, Homo sapiens
aaataagaaagaat

SEQ ID NO: 3529078 - DNA, 14 bp, Homo sapiens
aaataagacttctg

SEQ ID NO: 3529079 - DNA, 13 bp, Homo sapiens
aaatatagatgtt

SEQ ID NO: 3529080 - DNA, 22 bp, Homo sapiens
aaatcaaggagtcttctaatgt

SEQ ID NO: 3529081 - DNA, 19 bp, Homo sapiens
aaatcactgtggggaaaca

SEQ ID NO: 3529082 - DNA, 23 bp, Homo sapiens
aaatcactgtggggaaacaattt

SEQ ID NO: 3529083 - DNA, 20 bp, Homo sapiens
aaatcagtggtgttacattt

SEQ ID NO: 3529084 - DNA, 22 bp, Homo sapiens
aaatcagtggtgttacattttc

SEQ ID NO: 3529085 - DNA, 19 bp, Homo sapiens
aaatctgctgatctctgta

SEQ ID NO: 3529086 - DNA, 22 bp, Homo sapiens
aaatctgctgatctctgtagaa

SEQ ID NO: 3529087 - DNA, 11 bp, Homo sapiens
aaatctttgtg

SEQ ID NO: 3529088 - DNA, 21 bp, Homo sapiens
aaatctttgtgaacattctgt

SEQ ID NO: 3529089 - DNA, 22 bp, Homo sapiens
aaatctttgtgaacattctgta

SEQ ID NO: 3529090 - DNA, 13 bp, Homo sapiens
aaatgaagtattt

SEQ ID NO: 3529091 - DNA, 16 bp, Homo sapiens
aaatgaataaaagtga

SEQ ID NO: 3529092 - DNA, 16 bp, Homo sapiens
aaattactaattatct

SEQ ID NO: 3529093 - DNA, 21 bp, Homo sapiens
aaattagccttgatattctcc

SEQ ID NO: 3529094 - DNA, 15 bp, Homo sapiens
aaatttcagggaaaa

SEQ ID NO: 3529095 - DNA, 18 bp, Homo sapiens
aaatttgcaacatataaa

SEQ ID NO: 3529096 - DNA, 10 bp, Homo sapiens
aaattttaat

SEQ ID NO: 3529097 - DNA, 17 bp, Homo sapiens
aaatttttaaaatctgc

SEQ ID NO: 3529098 - DNA, 13 bp, Homo sapiens
aacaacatgtcaa

SEQ ID NO: 3529099 - DNA, 21 bp, Homo sapiens
aacaactcatgtctttattag

SEQ ID NO: 3529100 - DNA, 21 bp, Homo sapiens
aacaattttttgtgatgaaaa

SEQ ID NO: 3529101 - DNA, 17 bp, Homo sapiens
aacacctttgttttgtt

SEQ ID NO: 3529102 - DNA, 19 bp, Homo sapiens
aacacctttgttttgttgc

SEQ ID NO: 3529103 - DNA, 22 bp, Homo sapiens
aacactaattgtccacagcaaa

SEQ ID NO: 3529104 - DNA, 12 bp, Homo sapiens
aacagctgtcaa

SEQ ID NO: 3529105 - DNA, 14 bp, Homo sapiens
aacatataaagtag

SEQ ID NO: 3529106 - DNA, 22 bp, Homo sapiens
aacatgaaacaactcatgtctt

SEQ ID NO: 3529107 - DNA, 16 bp, Homo sapiens
aacattcaatttgcta

SEQ ID NO: 3529108 - DNA, 12 bp, Homo sapiens
aacattctgtac

SEQ ID NO: 3529109 - DNA, 19 bp, Homo sapiens
aacatttctgtgaaactat

SEQ ID NO: 3529110 - DNA, 10 bp, Homo sapiens
aacctgccct

SEQ ID NO: 3529111 - DNA, 15 bp, Homo sapiens
aacctggagatggtg

SEQ ID NO: 3529112 - DNA, 14 bp, Homo sapiens
aaccttgggccctg

SEQ ID NO: 3529113 - DNA, 16 bp, Homo sapiens
aacgttttccttgtga

SEQ ID NO: 3529114 - DNA, 21 bp, Homo sapiens
aactatccttctctttcaatg

SEQ ID NO: 3529115 - DNA, 17 bp, Homo sapiens
aactatttcagaatatt

SEQ ID NO: 3529116 - DNA, 14 bp, Homo sapiens
aactcagaatgggg

SEQ ID NO: 3529117 - DNA, 15 bp, Homo sapiens
aactcatgtctttat

SEQ ID NO: 3529118 - DNA, 18 bp, Homo sapiens
aacttacaaactggtttg

SEQ ID NO: 3529119 - DNA, 19 bp, Homo sapiens
aacttacaaactggtttga

SEQ ID NO: 3529120 - DNA, 17 bp, Homo sapiens
aacttacctctgcttct

SEQ ID NO: 3529121 - DNA, 18 bp, Homo sapiens
aacttgcacatttgaatt

SEQ ID NO: 3529122 - DNA, 13 bp, Homo sapiens
aagaaaacccgag

SEQ ID NO: 3529123 - DNA, 12 bp, Homo sapiens
aagaacatttaa

SEQ ID NO: 3529124 - DNA, 15 bp, Homo sapiens
aagaacatttaaaat

SEQ ID NO: 3529125 - DNA, 22 bp, Homo sapiens
aagaacttcagtgtagagaaaa

SEQ ID NO: 3529126 - DNA, 12 bp, Homo sapiens
aagaggaggagg

SEQ ID NO: 3529127 - DNA, 14 bp, Homo sapiens
aagagtgctgagaa

SEQ ID NO: 3529128 - DNA, 13 bp, Homo sapiens
aagatgggaggag

SEQ ID NO: 3529129 - DNA, 12 bp, Homo sapiens
aagattattgtc

SEQ ID NO: 3529130 - DNA, 16 bp, Homo sapiens
aagattgttaaattca

SEQ ID NO: 3529131 - DNA, 15 bp, Homo sapiens
aagcagccaggaggg

SEQ ID NO: 3529132 - DNA, 17 bp, Homo sapiens
aagcatgaatatttctt

SEQ ID NO: 3529133 - DNA, 20 bp, Homo sapiens
aagccagctgcccccagagc

SEQ ID NO: 3529134 - DNA, 22 bp, Homo sapiens
aagccagctgcccccagagcca

SEQ ID NO: 3529135 - DNA, 18 bp, Homo sapiens
aagccatgggtagcctgg

SEQ ID NO: 3529136 - DNA, 23 bp, Homo sapiens
aagccttgattggtgttgccagt

SEQ ID NO: 3529137 - DNA, 13 bp, Homo sapiens
aagctaatgtgaa

SEQ ID NO: 3529138 - DNA, 11 bp, Homo sapiens
aagctgtcaga

SEQ ID NO: 3529139 - DNA, 22 bp, Homo sapiens
aaggaatgatccatactgaaaa

SEQ ID NO: 3529140 - DNA, 20 bp, Homo sapiens
aaggagcagagaggtggcca

SEQ ID NO: 3529141 - DNA, 17 bp, Homo sapiens
aaggagtcttctaatgt

SEQ ID NO: 3529142 - DNA, 19 bp, Homo sapiens
aaggagtcttctaatgtaa

SEQ ID NO: 3529143 - DNA, 21 bp, Homo sapiens
aaggatgagatttttcatgta

SEQ ID NO: 3529144 - DNA, 20 bp, Homo sapiens
aaggcagcatttgaatactc

SEQ ID NO: 3529145 - DNA, 15 bp, Homo sapiens
aaggcctgcttttgt

SEQ ID NO: 3529146 - DNA, 16 bp, Homo sapiens
aaggctgcccctgtaa

SEQ ID NO: 3529147 - DNA, 16 bp, Homo sapiens
aagggattactagaga

SEQ ID NO: 3529148 - DNA, 18 bp, Homo sapiens
aagggattactagagaaa

SEQ ID NO: 3529149 - DNA, 21 bp, Homo sapiens
aagggcaaggaatcctctggg

SEQ ID NO: 3529150 - DNA, 14 bp, Homo sapiens
aaggtgttgttaaa

SEQ ID NO: 3529151 - DNA, 13 bp, Homo sapiens
aaggtttcaatgc

SEQ ID NO: 3529152 - DNA, 20 bp, Homo sapiens
aagtatctcaacaacatgtc

SEQ ID NO: 3529153 - DNA, 12 bp, Homo sapiens
aagtgagagggg

SEQ ID NO: 3529154 - DNA, 23 bp, Homo sapiens
aagtgagagtagtcagaactata

SEQ ID NO: 3529155 - DNA, 20 bp, Homo sapiens
aagtggtctgaactgcttgc

SEQ ID NO: 3529156 - DNA, 18 bp, Homo sapiens
aagtgtaactatgctgtt

SEQ ID NO: 3529157 - DNA, 22 bp, Homo sapiens
aagttacacctccactcagcac

SEQ ID NO: 3529158 - DNA, 15 bp, Homo sapiens
aagttacgcttttct

SEQ ID NO: 3529159 - DNA, 17 bp, Homo sapiens
aagttcagccaccgaat

SEQ ID NO: 3529160 - DNA, 22 bp, Homo sapiens
aagtttttattttaaacatttt

SEQ ID NO: 3529161 - DNA, 21 bp, Homo sapiens
aagtttttgtttttgttttgt

SEQ ID NO: 3529162 - DNA, 16 bp, Homo sapiens
aataaaaaatatattt

SEQ ID NO: 3529163 - DNA, 20 bp, Homo sapiens
aataaagtaggaaagaattt

SEQ ID NO: 3529164 - DNA, 20 bp, Homo sapiens
aataaatatacttctgctgt

SEQ ID NO: 3529165 - DNA, 13 bp, Homo sapiens
aataaattttaat

SEQ ID NO: 3529166 - DNA, 23 bp, Homo sapiens
aatagcatacaccaaacatttct

SEQ ID NO: 3529167 - DNA, 17 bp, Homo sapiens
aatatacttctgctgtg

SEQ ID NO: 3529168 - DNA, 16 bp, Homo sapiens
aatatgttgattttta

SEQ ID NO: 3529169 - DNA, 22 bp, Homo sapiens
aatatgttttattcagcttcta

SEQ ID NO: 3529170 - DNA, 14 bp, Homo sapiens
aatatttcttaagt

SEQ ID NO: 3529171 - DNA, 12 bp, Homo sapiens
ataaaagagctt

SEQ ID NO: 3529172 - DNA, 16 bp, Homo sapiens
ataaaggacactggat

SEQ ID NO: 3529173 - DNA, 17 bp, Homo sapiens
ataaaggacactggatc

SEQ ID NO: 3529174 - DNA, 18 bp, Homo sapiens
ataaagtaggaaagaatt

SEQ ID NO: 3529175 - DNA, 12 bp, Homo sapiens
ataaattttaat

SEQ ID NO: 3529176 - DNA, 12 bp, Homo sapiens
ataagaaagaat

SEQ ID NO: 3529177 - DNA, 13 bp, Homo sapiens
ataagacttctgg

SEQ ID NO: 3529178 - DNA, 16 bp, Homo sapiens
ataagatagttacatt

SEQ ID NO: 3529179 - DNA, 20 bp, Homo sapiens
ataagtgaacaactggaaat

SEQ ID NO: 3529180 - DNA, 15 bp, Homo sapiens
atacaccaaacattt

SEQ ID NO: 3529181 - DNA, 17 bp, Homo sapiens
atacaccaaacatttct

SEQ ID NO: 3529182 - DNA, 23 bp, Homo sapiens
atacccagatgttttatttatga

SEQ ID NO: 3529183 - DNA, 18 bp, Homo sapiens
atactgaaaaaatgctga

SEQ ID NO: 3529184 - DNA, 22 bp, Homo sapiens
atactgaaaaaatgctgagcca

SEQ ID NO: 3529185 - DNA, 15 bp, Homo sapiens
atacttgaaaaatgt

SEQ ID NO: 3529186 - DNA, 16 bp, Homo sapiens
atagagacttgggaat

SEQ ID NO: 3529187 - DNA, 14 bp, Homo sapiens
atagagaggcctgc

SEQ ID NO: 3529188 - DNA, 21 bp, Homo sapiens
atagcaccctgccctcatggg

SEQ ID NO: 3529189 - DNA, 21 bp, Homo sapiens
ataggagggggcggcagggct

SEQ ID NO: 3529190 - DNA, 21 bp, Homo sapiens
ataggttactttggactgagt

SEQ ID NO: 3529191 - DNA, 18 bp, Homo sapiens
atagtagtctttaaaaga

SEQ ID NO: 3529192 - DNA, 20 bp, Homo sapiens
atataaaatttcagggaaaa

SEQ ID NO: 3529193 - DNA, 20 bp, Homo sapiens
atataagacttaatatgttt

SEQ ID NO: 3529194 - DNA, 15 bp, Homo sapiens
atatattatgaaaat

SEQ ID NO: 3529195 - DNA, 19 bp, Homo sapiens
atatatttttatatgtgga

SEQ ID NO: 3529196 - DNA, 18 bp, Homo sapiens
atatcacagagccactct

SEQ ID NO: 3529197 - DNA, 15 bp, Homo sapiens
atattatgaaaatta

SEQ ID NO: 3529198 - DNA, 19 bp, Homo sapiens
atcaccttagaccaccaag

SEQ ID NO: 3529199 - DNA, 14 bp, Homo sapiens
atcagctgggcagt

SEQ ID NO: 3529200 - DNA, 21 bp, Homo sapiens
atcaggctttccttgttttga

SEQ ID NO: 3529201 - DNA, 20 bp, Homo sapiens
atcagtggtgttacattttc

SEQ ID NO: 3529202 - DNA, 22 bp, Homo sapiens
atcagttcttagattcagggga

SEQ ID NO: 3529203 - DNA, 20 bp, Homo sapiens
atcataagatagttacattt

SEQ ID NO: 3529204 - DNA, 21 bp, Homo sapiens
atcataagatagttacattta

SEQ ID NO: 3529205 - DNA, 22 bp, Homo sapiens
atcataagatagttacatttat

SEQ ID NO: 3529206 - DNA, 15 bp, Homo sapiens
atcatggagcaagag

SEQ ID NO: 3529207 - DNA, 22 bp, Homo sapiens
atcccgagcaaccctctgaaga

SEQ ID NO: 3529208 - DNA, 21 bp, Homo sapiens
atccttctctttcaatgtgtt

SEQ ID NO: 3529209 - DNA, 20 bp, Homo sapiens
atctcaacaacatgtcaaag

SEQ ID NO: 3529210 - DNA, 20 bp, Homo sapiens
atctcacactcatgcattgt

SEQ ID NO: 3529211 - DNA, 22 bp, Homo sapiens
atctcacactcatgcattgtcc

SEQ ID NO: 3529212 - DNA, 13 bp, Homo sapiens
atctcccaaggag

SEQ ID NO: 3529213 - DNA, 16 bp, Homo sapiens
atctcgttgaggccaa

SEQ ID NO: 3529214 - DNA, 17 bp, Homo sapiens
atctctcaagagtgctg

SEQ ID NO: 3529215 - DNA, 24 bp, Homo sapiens
atctctcaagagtgctgagaacca

SEQ ID NO: 3529216 - DNA, 19 bp, Homo sapiens
atctgaaaaatggccatgt

SEQ ID NO: 3529217 - DNA, 21 bp, Homo sapiens
atctgacccttctccaaaggc

SEQ ID NO: 3529218 - DNA, 17 bp, Homo sapiens
atctgtaggtcactctc

SEQ ID NO: 3529219 - DNA, 20 bp, Homo sapiens
atcttatctactgactgaaa

SEQ ID NO: 3529220 - DNA, 20 bp, Homo sapiens
atgaaaaggcagcatttgaa

SEQ ID NO: 3529221 - DNA, 12 bp, Homo sapiens
atgaaaattaag

SEQ ID NO: 3529222 - DNA, 14 bp, Homo sapiens
atgaaaattaagat

SEQ ID NO: 3529223 - DNA, 14 bp, Homo sapiens
atgaacccataggg

SEQ ID NO: 3529224 - DNA, 20 bp, Homo sapiens
atgaacccatagggagctga

SEQ ID NO: 3529225 - DNA, 15 bp, Homo sapiens
atgaagtatttcatg

SEQ ID NO: 3529226 - DNA, 15 bp, Homo sapiens
atgaatatttcttaa

SEQ ID NO: 3529227 - DNA, 15 bp, Homo sapiens
atgaattattttgat

SEQ ID NO: 3529228 - DNA, 22 bp, Homo sapiens
atgacaaaatagcccagccttt

SEQ ID NO: 3529229 - DNA, 19 bp, Homo sapiens
atgactgacccaaaatgtg

SEQ ID NO: 3529230 - DNA, 22 bp, Homo sapiens
atgactgagatttgtaaatctt

SEQ ID NO: 3529231 - DNA, 17 bp, Homo sapiens
atgaggaccagggtgga

SEQ ID NO: 3529232 - DNA, 18 bp, Homo sapiens
atgatgggcttttgttct

SEQ ID NO: 3529233 - DNA, 20 bp, Homo sapiens
atgatgggcttttgttctga

SEQ ID NO: 3529234 - DNA, 21 bp, Homo sapiens
atgatggtgttggtgaaaata

SEQ ID NO: 3529235 - DNA, 15 bp, Homo sapiens
atgcagtcatgagaa

SEQ ID NO: 3529236 - DNA, 15 bp, Homo sapiens
atgcatacaataaaa

SEQ ID NO: 3529237 - DNA, 13 bp, Homo sapiens
atgcattctgata

SEQ ID NO: 3529238 - DNA, 22 bp, Homo sapiens
atgcattctgataggagggggc

SEQ ID NO: 3529239 - DNA, 14 bp, Homo sapiens
atgcattgtcctct

SEQ ID NO: 3529240 - DNA, 18 bp, Homo sapiens
atgccagaagttggggga

SEQ ID NO: 3529241 - DNA, 23 bp, Homo sapiens
atgcccccgacccccgcagaggc

SEQ ID NO: 3529242 - DNA, 14 bp, Homo sapiens
atgccctcctggtg

SEQ ID NO: 3529243 - DNA, 19 bp, Homo sapiens
atgctgttaacagctgtca

SEQ ID NO: 3529244 - DNA, 13 bp, Homo sapiens
atgcttgatgtta

SEQ ID NO: 3529245 - DNA, 12 bp, Homo sapiens
atggactggcca

SEQ ID NO: 3529246 - DNA, 11 bp, Homo sapiens
atggccagagg

SEQ ID NO: 3529247 - DNA, 12 bp, Homo sapiens
atggccagagga

SEQ ID NO: 3529248 - DNA, 13 bp, Homo sapiens
atggccagaggaa

SEQ ID NO: 3529249 - DNA, 18 bp, Homo sapiens
atgtaaattttaatgtta

SEQ ID NO: 3529250 - DNA, 13 bp, Homo sapiens
atgtatgctgttt

SEQ ID NO: 3529251 - DNA, 19 bp, Homo sapiens
atgtatgctgtttgtacaa

SEQ ID NO: 3529252 - DNA, 12 bp, Homo sapiens
atgtgaatgaag

SEQ ID NO: 3529253 - DNA, 11 bp, Homo sapiens
atgtgaattgt

SEQ ID NO: 3529254 - DNA, 20 bp, Homo sapiens
atgtgaccaaaaaaaagcat

SEQ ID NO: 3529255 - DNA, 14 bp, Homo sapiens
atgtggaaatatac

SEQ ID NO: 3529256 - DNA, 20 bp, Homo sapiens
atgtgtaggatgtatgctgt

SEQ ID NO: 3529257 - DNA, 14 bp, Homo sapiens
attaaaaacagaaa

SEQ ID NO: 3529258 - DNA, 20 bp, Homo sapiens
attaactaggtatgaagtat

SEQ ID NO: 3529259 - DNA, 14 bp, Homo sapiens
attaagattattgt

SEQ ID NO: 3529260 - DNA, 12 bp, Homo sapiens
attacagaaaat

SEQ ID NO: 3529261 - DNA, 12 bp, Homo sapiens
attagtaacatc

SEQ ID NO: 3529262 - DNA, 22 bp, Homo sapiens
attatcttatctactgactgaa

SEQ ID NO: 3529263 - DNA, 13 bp, Homo sapiens
attatgaaaatta

SEQ ID NO: 3529264 - DNA, 17 bp, Homo sapiens
attatgaaaattaagat

SEQ ID NO: 3529265 - DNA, 23 bp, Homo sapiens
attattgtctgattgaaacatga

SEQ ID NO: 3529266 - DNA, 19 bp, Homo sapiens
attattttgataaattact

SEQ ID NO: 3529267 - DNA, 21 bp, Homo sapiens
attcaatttgctatttacaaa

SEQ ID NO: 3529268 - DNA, 14 bp, Homo sapiens
attcaggggaaggg

SEQ ID NO: 3529269 - DNA, 19 bp, Homo sapiens
attcaggggaagggcaggc

SEQ ID NO: 3529270 - DNA, 12 bp, Homo sapiens
attcatttgctg

SEQ ID NO: 3529271 - DNA, 22 bp, Homo sapiens
attccacaggacacgaaggctg

SEQ ID NO: 3529272 - DNA, 17 bp, Homo sapiens
attccagccatcacctt

SEQ ID NO: 3529273 - DNA, 20 bp, Homo sapiens
attctccagaccaaagcaat

SEQ ID NO: 3529274 - DNA, 17 bp, Homo sapiens
attctgataggaggggg

SEQ ID NO: 3529275 - DNA, 13 bp, Homo sapiens
attgaaacatgaa

SEQ ID NO: 3529276 - DNA, 14 bp, Homo sapiens
attgaaacatgaaa

SEQ ID NO: 3529277 - DNA, 16 bp, Homo sapiens
attgcagtaaagtctt

SEQ ID NO: 3529278 - DNA, 13 bp, Homo sapiens
attgcctctgaga

SEQ ID NO: 3529279 - DNA, 23 bp, Homo sapiens
attggctgggcaaaagaatgttt

SEQ ID NO: 3529280 - DNA, 21 bp, Homo sapiens
attggtgttgccagttgtcct

SEQ ID NO: 3529281 - DNA, 14 bp, Homo sapiens
ccatagcaccctgc

SEQ ID NO: 3529282 - DNA, 12 bp, Homo sapiens
ccatagggagct

SEQ ID NO: 3529283 - DNA, 23 bp, Homo sapiens
ccatcaccttagaccaccaagcc

SEQ ID NO: 3529284 - DNA, 19 bp, Homo sapiens
ccatcactagagtgctctg

SEQ ID NO: 3529285 - DNA, 17 bp, Homo sapiens
ccatctcggggctgctg

SEQ ID NO: 3529286 - DNA, 23 bp, Homo sapiens
ccatcttacagagactctccctg

SEQ ID NO: 3529287 - DNA, 19 bp, Homo sapiens
ccatgggaggcctttccct

SEQ ID NO: 3529288 - DNA, 16 bp, Homo sapiens
ccattggtccaccctt

SEQ ID NO: 3529289 - DNA, 11 bp, Homo sapiens
cccaacctcct

SEQ ID NO: 3529290 - DNA, 18 bp, Homo sapiens
cccaagcagaagaccaga

SEQ ID NO: 3529291 - DNA, 21 bp, Homo sapiens
cccaagcagaagaccagatcc

SEQ ID NO: 3529292 - DNA, 15 bp, Homo sapiens
cccaaggagggcacc

SEQ ID NO: 3529293 - DNA, 10 bp, Homo sapiens
cccaaggggc

SEQ ID NO: 3529294 - DNA, 21 bp, Homo sapiens
cccacacaggtggccatcaca

SEQ ID NO: 3529295 - DNA, 16 bp, Homo sapiens
cccacgccacagccct

SEQ ID NO: 3529296 - DNA, 17 bp, Homo sapiens
cccacgccacagccctt

SEQ ID NO: 3529297 - DNA, 20 bp, Homo sapiens
cccagcgccggggggaggga

SEQ ID NO: 3529298 - DNA, 23 bp, Homo sapiens
cccagcgccggggggagggagga

SEQ ID NO: 3529299 - DNA, 20 bp, Homo sapiens
cccagctactgtatgccccc

SEQ ID NO: 3529300 - DNA, 20 bp, Homo sapiens
cccagctctaagcagccagg

SEQ ID NO: 3529301 - DNA, 20 bp, Homo sapiens
cccaggggacgtgggccctg

SEQ ID NO: 3529302 - DNA, 13 bp, Homo sapiens
cccatagggagct

SEQ ID NO: 3529303 - DNA, 22 bp, Homo sapiens
ccccaaaggctttgccctgctg

SEQ ID NO: 3529304 - DNA, 23 bp, Homo sapiens
ccccagcgctggcccccccagcc

SEQ ID NO: 3529305 - DNA, 21 bp, Homo sapiens
ccccaggggacgtgggccctg

SEQ ID NO: 3529306 - DNA, 22 bp, Homo sapiens
ccccaggggacgtgggccctgc

SEQ ID NO: 3529307 - DNA, 16 bp, Homo sapiens
ccccatctcggggctg

SEQ ID NO: 3529308 - DNA, 18 bp, Homo sapiens
ccccatctcggggctgct

SEQ ID NO: 3529309 - DNA, 20 bp, Homo sapiens
ccccatctcggggctgctgt

SEQ ID NO: 3529310 - DNA, 21 bp, Homo sapiens
cccccatagcaccctgccctc

SEQ ID NO: 3529311 - DNA, 13 bp, Homo sapiens
cccccgcagaggc

SEQ ID NO: 3529312 - DNA, 18 bp, Homo sapiens
ccccgacccccgcagagg

SEQ ID NO: 3529313 - DNA, 15 bp, Homo sapiens
cccctaaagtgccag

SEQ ID NO: 3529314 - DNA, 18 bp, Homo sapiens
cccgagcaaccctctgaa

SEQ ID NO: 3529315 - DNA, 17 bp, Homo sapiens
cccgcgggcacagccag

SEQ ID NO: 3529316 - DNA, 17 bp, Homo sapiens
ccctaaagatgggagga

SEQ ID NO: 3529317 - DNA, 14 bp, Homo sapiens
ccctagaagaaaac

SEQ ID NO: 3529318 - DNA, 15 bp, Homo sapiens
ccctagaagaaaacc

SEQ ID NO: 3529319 - DNA, 23 bp, Homo sapiens
ccctaggatatgccctcctggtg

SEQ ID NO: 3529320 - DNA, 19 bp, Homo sapiens
ccctcagccgtcagccatc

SEQ ID NO: 3529321 - DNA, 20 bp, Homo sapiens
ccctcccgaacactgagaaa

SEQ ID NO: 3529322 - DNA, 23 bp, Homo sapiens
ccctccctcagccgtcagccatc

SEQ ID NO: 3529323 - DNA, 15 bp, Homo sapiens
ccctgacggctgcca

SEQ ID NO: 3529324 - DNA, 21 bp, Homo sapiens
ccctgaggggctggggagggg

SEQ ID NO: 3529325 - DNA, 13 bp, Homo sapiens
ccctgctgccctc

SEQ ID NO: 3529326 - DNA, 12 bp, Homo sapiens
ccctgctgtgga

SEQ ID NO: 3529327 - DNA, 20 bp, Homo sapiens
ccctggatttttaccagtct

SEQ ID NO: 3529328 - DNA, 22 bp, Homo sapiens
ccctgggctttcacgggcccca

SEQ ID NO: 3529329 - DNA, 19 bp, Homo sapiens
cccttcaggcccgctgccc

SEQ ID NO: 3529330 - DNA, 13 bp, Homo sapiens
cccttgcagcctg

SEQ ID NO: 3529331 - DNA, 12 bp, Homo sapiens
ccgcagaggcag

SEQ ID NO: 3529332 - DNA, 15 bp, Homo sapiens
ccgggacaccgtggg

SEQ ID NO: 3529333 - DNA, 19 bp, Homo sapiens
ccgtcagccatcagccatg

SEQ ID NO: 3529334 - DNA, 14 bp, Homo sapiens
ccgtggggaagggg

SEQ ID NO: 3529335 - DNA, 15 bp, Homo sapiens
cctacctccactctc

SEQ ID NO: 3529336 - DNA, 16 bp, Homo sapiens
cctagaagaaaacccg

SEQ ID NO: 3529337 - DNA, 19 bp, Homo sapiens
cctcaagggtagaaacctg

SEQ ID NO: 3529338 - DNA, 23 bp, Homo sapiens
cctcagctcttggtgggcccagg

SEQ ID NO: 3529339 - DNA, 13 bp, Homo sapiens
cctcagggtgtcc

SEQ ID NO: 3529340 - DNA, 11 bp, Homo sapiens
cctcatgagga

SEQ ID NO: 3529341 - DNA, 15 bp, Homo sapiens
cctccactcagcact

SEQ ID NO: 3529342 - DNA, 18 bp, Homo sapiens
cctcccggcctggcttca

SEQ ID NO: 3529343 - DNA, 15 bp, Homo sapiens
cctcctctccaccat

SEQ ID NO: 3529344 - DNA, 13 bp, Homo sapiens
cctcggtcactga

SEQ ID NO: 3529345 - DNA, 20 bp, Homo sapiens
cctcgtctcttgtgactcag

SEQ ID NO: 3529346 - DNA, 21 bp, Homo sapiens
cctctcttaagatgtccaggg

SEQ ID NO: 3529347 - DNA, 18 bp, Homo sapiens
cctgactgtcagggaggg

SEQ ID NO: 3529348 - DNA, 19 bp, Homo sapiens
cctgactgtcagggagggc

SEQ ID NO: 3529349 - DNA, 17 bp, Homo sapiens
cctgaggggctggggag

SEQ ID NO: 3529350 - DNA, 19 bp, Homo sapiens
cctgaggggctggggaggg

SEQ ID NO: 3529351 - DNA, 19 bp, Homo sapiens
cctgatggtgaaaccaaac

SEQ ID NO: 3529352 - DNA, 16 bp, Homo sapiens
cctgcagccagaaagg

SEQ ID NO: 3529353 - DNA, 17 bp, Homo sapiens
cctgcagccagaaagga

SEQ ID NO: 3529354 - DNA, 19 bp, Homo sapiens
cctgccctccctcagccgt

SEQ ID NO: 3529355 - DNA, 12 bp, Homo sapiens
cctgctgccctc

SEQ ID NO: 3529356 - DNA, 14 bp, Homo sapiens
cctgctgccctccc

SEQ ID NO: 3529357 - DNA, 17 bp, Homo sapiens
cctggccatttggcccc

SEQ ID NO: 3529358 - DNA, 12 bp, Homo sapiens
cctgggctttca

SEQ ID NO: 3529359 - DNA, 18 bp, Homo sapiens
cctgggttatttattgac

SEQ ID NO: 3529360 - DNA, 20 bp, Homo sapiens
cctggtgaccagaccaaggc

SEQ ID NO: 3529361 - DNA, 22 bp, Homo sapiens
cctggtgaccagaccaaggcag

SEQ ID NO: 3529362 - DNA, 23 bp, Homo sapiens
cctgtcagacgttggtcccaagt

SEQ ID NO: 3529363 - DNA, 20 bp, Homo sapiens
ccttccttttactaccattt

SEQ ID NO: 3529364 - DNA, 20 bp, Homo sapiens
ccttcttccaaggagcagag

SEQ ID NO: 3529365 - DNA, 15 bp, Homo sapiens
ccttgggccctggaa

SEQ ID NO: 3529366 - DNA, 18 bp, Homo sapiens
ccttgttttgatttatgg

SEQ ID NO: 3529367 - DNA, 23 bp, Homo sapiens
cctttcatatgaggggacccagc

SEQ ID NO: 3529368 - DNA, 14 bp, Homo sapiens
cctttgctgaccct

SEQ ID NO: 3529369 - DNA, 12 bp, Homo sapiens
ccttttgtctct

SEQ ID NO: 3529370 - DNA, 19 bp, Homo sapiens
cgaaagtctgaatctccca

SEQ ID NO: 3529371 - DNA, 18 bp, Homo sapiens
cgacccccgcagaggcag

SEQ ID NO: 3529372 - DNA, 14 bp, Homo sapiens
cgactagcccagga

SEQ ID NO: 3529373 - DNA, 16 bp, Homo sapiens
cgagcaaccctctgaa

SEQ ID NO: 3529374 - DNA, 19 bp, Homo sapiens
cgaggatttccctgaagct

SEQ ID NO: 3529375 - DNA, 13 bp, Homo sapiens
cgctgcctcaggc

SEQ ID NO: 3529376 - DNA, 19 bp, Homo sapiens
cgctggcccccccagcccc

SEQ ID NO: 3529377 - DNA, 14 bp, Homo sapiens
cggacacttttgag

SEQ ID NO: 3529378 - DNA, 16 bp, Homo sapiens
cggcgctgcctcaggc

SEQ ID NO: 3529379 - DNA, 22 bp, Homo sapiens
cggctggcctggaggctcagcc

SEQ ID NO: 3529380 - DNA, 21 bp, Homo sapiens
cgggagggagtctcaggagga

SEQ ID NO: 3529381 - DNA, 17 bp, Homo sapiens
cgggcaagtgagagggg

SEQ ID NO: 3529382 - DNA, 19 bp, Homo sapiens
cgggcaagtgagaggggag

SEQ ID NO: 3529383 - DNA, 14 bp, Homo sapiens
cgggcacagccagc

SEQ ID NO: 3529384 - DNA, 15 bp, Homo sapiens
cgggcacagccagcc

SEQ ID NO: 3529385 - DNA, 13 bp, Homo sapiens
cggggaaggattt

SEQ ID NO: 3529386 - DNA, 13 bp, Homo sapiens
cggggggagggag

SEQ ID NO: 3529387 - DNA, 20 bp, Homo sapiens
cggggggagggaggagggcg

SEQ ID NO: 3529388 - DNA, 12 bp, Homo sapiens
cgtggggaaggg

SEQ ID NO: 3529389 - DNA, 16 bp, Homo sapiens
cgtgtcccagcaccac

SEQ ID NO: 3529390 - DNA, 22 bp, Homo sapiens
cgtgtgggaggctggggaccca

SEQ ID NO: 3529391 - DNA, 20 bp, Homo sapiens
gccaccgggggtggctctgt

SEQ ID NO: 3529392 - DNA, 16 bp, Homo sapiens
gccacgttcagggagg

SEQ ID NO: 3529393 - DNA, 19 bp, Homo sapiens
gccagccaatccctggcca

SEQ ID NO: 3529394 - DNA, 21 bp, Homo sapiens
gccagcccaaaccttgggccc

SEQ ID NO: 3529395 - DNA, 12 bp, Homo sapiens
gccagctgcccc

SEQ ID NO: 3529396 - DNA, 19 bp, Homo sapiens
gccagctgcccccagagcc

SEQ ID NO: 3529397 - DNA, 12 bp, Homo sapiens
gccaggagggac

SEQ ID NO: 3529398 - DNA, 20 bp, Homo sapiens
gccagggaggcagagcggga

SEQ ID NO: 3529399 - DNA, 16 bp, Homo sapiens
gccaggtgatctcctg

SEQ ID NO: 3529400 - DNA, 14 bp, Homo sapiens
gccagttgtcctcc

SEQ ID NO: 3529401 - DNA, 20 bp, Homo sapiens
gccatcaccttagaccacca

SEQ ID NO: 3529402 - DNA, 23 bp, Homo sapiens
gccatctttggcaaaggtccctg

SEQ ID NO: 3529403 - DNA, 14 bp, Homo sapiens
gccatgggaggcct

SEQ ID NO: 3529404 - DNA, 17 bp, Homo sapiens
gccattggtccaccctt

SEQ ID NO: 3529405 - DNA, 13 bp, Homo sapiens
gcccagccttttg

SEQ ID NO: 3529406 - DNA, 17 bp, Homo sapiens
gcccagggacacccaca

SEQ ID NO: 3529407 - DNA, 16 bp, Homo sapiens
gcccccagagccacag

SEQ ID NO: 3529408 - DNA, 17 bp, Homo sapiens
gcccccagagccacagt

SEQ ID NO: 3529409 - DNA, 18 bp, Homo sapiens
gcccctaaagatgggagg

SEQ ID NO: 3529410 - DNA, 20 bp, Homo sapiens
gcccctaaagatgggaggag

SEQ ID NO: 3529411 - DNA, 20 bp, Homo sapiens
gcccctgtaaggtttcaatg

SEQ ID NO: 3529412 - DNA, 20 bp, Homo sapiens
gcccctttgctgaccctccc

SEQ ID NO: 3529413 - DNA, 19 bp, Homo sapiens
gccctaggatatgccctcc

SEQ ID NO: 3529414 - DNA, 15 bp, Homo sapiens
gccctcatgggacct

SEQ ID NO: 3529415 - DNA, 19 bp, Homo sapiens
gccctgaggggctggggag

SEQ ID NO: 3529416 - DNA, 21 bp, Homo sapiens
gccctgaggggctggggaggg

SEQ ID NO: 3529417 - DNA, 19 bp, Homo sapiens
gccctgcaggctgcaggag

SEQ ID NO: 3529418 - DNA, 21 bp, Homo sapiens
gccctgcaggctgcaggaggg

SEQ ID NO: 3529419 - DNA, 14 bp, Homo sapiens
gccctgctgccctc

SEQ ID NO: 3529420 - DNA, 14 bp, Homo sapiens
gccctgctgtggaa

SEQ ID NO: 3529421 - DNA, 13 bp, Homo sapiens
gcctagaggcctg

SEQ ID NO: 3529422 - DNA, 19 bp, Homo sapiens
gcctcaggcactctcctgt

SEQ ID NO: 3529423 - DNA, 15 bp, Homo sapiens
gcctcctagcccctt

SEQ ID NO: 3529424 - DNA, 13 bp, Homo sapiens
gcctctgagagca

SEQ ID NO: 3529425 - DNA, 14 bp, Homo sapiens
gcctgactgccaag

SEQ ID NO: 3529426 - DNA, 17 bp, Homo sapiens
gcctgactgccaagcca

SEQ ID NO: 3529427 - DNA, 16 bp, Homo sapiens
gcctgcttttgtgtcc

SEQ ID NO: 3529428 - DNA, 19 bp, Homo sapiens
gcctgggtgtaaaacctgg

SEQ ID NO: 3529429 - DNA, 18 bp, Homo sapiens
gcctttccctaagccagc

SEQ ID NO: 3529430 - DNA, 19 bp, Homo sapiens
gcgccggggggagggagga

SEQ ID NO: 3529431 - DNA, 15 bp, Homo sapiens
gcgggcacagccagc

SEQ ID NO: 3529432 - DNA, 22 bp, Homo sapiens
gcgtgtgggaggctggggaccc

SEQ ID NO: 3529433 - DNA, 17 bp, Homo sapiens
gctaatgtgaatgtgag

SEQ ID NO: 3529434 - DNA, 16 bp, Homo sapiens
gctaccaatctgtgag

SEQ ID NO: 3529435 - DNA, 16 bp, Homo sapiens
gctcagcccaccctcc

SEQ ID NO: 3529436 - DNA, 20 bp, Homo sapiens
gctctaagcagccaggaggg

SEQ ID NO: 3529437 - DNA, 21 bp, Homo sapiens
gctctaagcagccaggaggga

SEQ ID NO: 3529438 - DNA, 22 bp, Homo sapiens
gctctgtcctacctccactctc

SEQ ID NO: 3529439 - DNA, 19 bp, Homo sapiens
gctcttggtgggcccaggg

SEQ ID NO: 3529440 - DNA, 23 bp, Homo sapiens
gctcttggtgggcccagggacac

SEQ ID NO: 3529441 - DNA, 19 bp, Homo sapiens
gctgacttcccaagccctg

SEQ ID NO: 3529442 - DNA, 11 bp, Homo sapiens
gctgaggggac

SEQ ID NO: 3529443 - DNA, 12 bp, Homo sapiens
gctgaggggacg

SEQ ID NO: 3529444 - DNA, 17 bp, Homo sapiens
gctgaggggacgggcaa

SEQ ID NO: 3529445 - DNA, 13 bp, Homo sapiens
gctgcaggagggc

SEQ ID NO: 3529446 - DNA, 17 bp, Homo sapiens
gctgctgccctgctgtg

SEQ ID NO: 3529447 - DNA, 13 bp, Homo sapiens
gctggaggtgctg

SEQ ID NO: 3529448 - DNA, 17 bp, Homo sapiens
gctggcccccccagccc

SEQ ID NO: 3529449 - DNA, 14 bp, Homo sapiens
gctggcctggaggc

SEQ ID NO: 3529450 - DNA, 12 bp, Homo sapiens
gctggggagggg

SEQ ID NO: 3529451 - DNA, 16 bp, Homo sapiens
gctggtagctgagggg

SEQ ID NO: 3529452 - DNA, 18 bp, Homo sapiens
gctggtagctgaggggac

SEQ ID NO: 3529453 - DNA, 22 bp, Homo sapiens
gcttcactctatccaaagtgtc

SEQ ID NO: 3529454 - DNA, 16 bp, Homo sapiens
gcttgctaccaatctg

SEQ ID NO: 3529455 - DNA, 21 bp, Homo sapiens
gcttgggggtggggagaaaag

SEQ ID NO: 3529456 - DNA, 22 bp, Homo sapiens
gctttccttgttttgatttatg

SEQ ID NO: 3529457 - DNA, 16 bp, Homo sapiens
gctttcggggagggcg

SEQ ID NO: 3529458 - DNA, 14 bp, Homo sapiens
gcttttgttctgag

SEQ ID NO: 3529459 - DNA, 23 bp, Homo sapiens
ggaagtcctgggaggatcctgag

SEQ ID NO: 3529460 - DNA, 18 bp, Homo sapiens
ggaagtggggcgggcttc

SEQ ID NO: 3529461 - DNA, 20 bp, Homo sapiens
ggaattaggctttagatttt

SEQ ID NO: 3529462 - DNA, 16 bp, Homo sapiens
ggacacccacacaggt

SEQ ID NO: 3529463 - DNA, 19 bp, Homo sapiens
ggacaccgtggggaagggg

SEQ ID NO: 3529464 - DNA, 15 bp, Homo sapiens
ggacacgaaggctgc

SEQ ID NO: 3529465 - DNA, 14 bp, Homo sapiens
ggaccagggtggag

SEQ ID NO: 3529466 - DNA, 21 bp, Homo sapiens
ggacccagacttttggcccca

SEQ ID NO: 3529467 - DNA, 23 bp, Homo sapiens
ggacccagacttttggccccagc

SEQ ID NO: 3529468 - DNA, 22 bp, Homo sapiens
ggacctgccctccctcagccgt

SEQ ID NO: 3529469 - DNA, 12 bp, Homo sapiens
ggacggcgctgc

SEQ ID NO: 3529470 - DNA, 21 bp, Homo sapiens
ggacgtgggccctgcaggctg

SEQ ID NO: 3529471 - DNA, 17 bp, Homo sapiens
ggactcttaaggcattg

SEQ ID NO: 3529472 - DNA, 18 bp, Homo sapiens
ggagaccaggcctcagct

SEQ ID NO: 3529473 - DNA, 16 bp, Homo sapiens
ggagaccgaggccaga

SEQ ID NO: 3529474 - DNA, 16 bp, Homo sapiens
ggagcaatctgaccct

SEQ ID NO: 3529475 - DNA, 12 bp, Homo sapiens
ggagcagagagg

SEQ ID NO: 3529476 - DNA, 18 bp, Homo sapiens
ggagcagagaggtggcca

SEQ ID NO: 3529477 - DNA, 19 bp, Homo sapiens
ggagctgagaagaggagga

SEQ ID NO: 3529478 - DNA, 16 bp, Homo sapiens
ggagctgggaggtctc

SEQ ID NO: 3529479 - DNA, 15 bp, Homo sapiens
ggaggaggctgccct

SEQ ID NO: 3529480 - DNA, 14 bp, Homo sapiens
ggaggctcagccca

SEQ ID NO: 3529481 - DNA, 15 bp, Homo sapiens
ggagggaagtcctgg

SEQ ID NO: 3529482 - DNA, 21 bp, Homo sapiens
ggagggggtacctcatgagga

SEQ ID NO: 3529483 - DNA, 17 bp, Homo sapiens
ggagtctcaggaggagg

SEQ ID NO: 3529484 - DNA, 21 bp, Homo sapiens
ggagtctcaggaggaggctgc

SEQ ID NO: 3529485 - DNA, 22 bp, Homo sapiens
ggatatgccctcctggtgactc

SEQ ID NO: 3529486 - DNA, 21 bp, Homo sapiens
ggatgaacattcaagagagct

SEQ ID NO: 3529487 - DNA, 22 bp, Homo sapiens
ggatgcattctgataggagggg

SEQ ID NO: 3529488 - DNA, 23 bp, Homo sapiens
ggcaagtgagaggggagggaggg

SEQ ID NO: 3529489 - DNA, 12 bp, Homo sapiens
ggcacagccagc

SEQ ID NO: 3529490 - DNA, 17 bp, Homo sapiens
ggcaccttaactggaga

SEQ ID NO: 3529491 - DNA, 22 bp, Homo sapiens
ggcaccttaactggagaccaga

SEQ ID NO: 3529492 - DNA, 16 bp, Homo sapiens
ggcactggagctggga

SEQ ID NO: 3529493 - DNA, 14 bp, Homo sapiens
ggcagggcccagca

SEQ ID NO: 3529494 - DNA, 22 bp, Homo sapiens
ggcaggtcctagtcgggcaggg

SEQ ID NO: 3529495 - DNA, 13 bp, Homo sapiens
ggcagtgccagcc

SEQ ID NO: 3529496 - DNA, 14 bp, Homo sapiens
ggcattgagggctc

SEQ ID NO: 3529497 - DNA, 20 bp, Homo sapiens
ggccaccgggggtggctctg

SEQ ID NO: 3529498 - DNA, 21 bp, Homo sapiens
ggccaccgggggtggctctgt

SEQ ID NO: 3529499 - DNA, 18 bp, Homo sapiens
ggccacgttcagggaggg

SEQ ID NO: 3529500 - DNA, 22 bp, Homo sapiens
ggccagaaggcaaaaaccagaa

SEQ ID NO: 3529501 - DNA, 14 bp, Homo sapiens
tctgcaaactgcct

SEQ ID NO: 3529502 - DNA, 15 bp, Homo sapiens
tctgcatcaaaggag

SEQ ID NO: 3529503 - DNA, 13 bp, Homo sapiens
tctgtagaatctt

SEQ ID NO: 3529504 - DNA, 19 bp, Homo sapiens
tcttcggtctgaattttag

SEQ ID NO: 3529505 - DNA, 18 bp, Homo sapiens
tcttctaatgtaaatttt

SEQ ID NO: 3529506 - DNA, 15 bp, Homo sapiens
tcttctattgcctct

SEQ ID NO: 3529507 - DNA, 16 bp, Homo sapiens
tcttctattgcctctg

SEQ ID NO: 3529508 - DNA, 23 bp, Homo sapiens
tcttcttggccatgggaggcctt

SEQ ID NO: 3529509 - DNA, 22 bp, Homo sapiens
tcttggccatgggaggcctttc

SEQ ID NO: 3529510 - DNA, 17 bp, Homo sapiens
tcttggtgggcccaggg

SEQ ID NO: 3529511 - DNA, 16 bp, Homo sapiens
tctttattagtaacat

SEQ ID NO: 3529512 - DNA, 22 bp, Homo sapiens
tctttcaatgtgtttaattttg

SEQ ID NO: 3529513 - DNA, 15 bp, Homo sapiens
tctttctcacacgga

SEQ ID NO: 3529514 - DNA, 19 bp, Homo sapiens
tgaaaaggcagcatttgaa

SEQ ID NO: 3529515 - DNA, 23 bp, Homo sapiens
tgaaaattaagattattgtctga

SEQ ID NO: 3529516 - DNA, 23 bp, Homo sapiens
tgaactgcttgctaccaatctgt

SEQ ID NO: 3529517 - DNA, 15 bp, Homo sapiens
tgaagctaatgtgaa

SEQ ID NO: 3529518 - DNA, 21 bp, Homo sapiens
tgaaggtgaaacattttctcc

SEQ ID NO: 3529519 - DNA, 18 bp, Homo sapiens
tgaagtataaacccattt

SEQ ID NO: 3529520 - DNA, 22 bp, Homo sapiens
tgaagtatttcatgtaatataa

SEQ ID NO: 3529521 - DNA, 13 bp, Homo sapiens
tgaataaaagtga

SEQ ID NO: 3529522 - DNA, 16 bp, Homo sapiens
tgaatctcccaaggag

SEQ ID NO: 3529523 - DNA, 16 bp, Homo sapiens
tgaattcatttgctga

SEQ ID NO: 3529524 - DNA, 21 bp, Homo sapiens
tgaattttagacgatcacaga

SEQ ID NO: 3529525 - DNA, 22 bp, Homo sapiens
tgaattttagacgatcacagaa

SEQ ID NO: 3529526 - DNA, 21 bp, Homo sapiens
tgacaggttggccgtttgctt

SEQ ID NO: 3529527 - DNA, 21 bp, Homo sapiens
tgaccctcccggcctggcttc

SEQ ID NO: 3529528 - DNA, 18 bp, Homo sapiens
tgacccttctccaaaggc

SEQ ID NO: 3529529 - DNA, 16 bp, Homo sapiens
tgacggctgccattgg

SEQ ID NO: 3529530 - DNA, 18 bp, Homo sapiens
tgactaagttgcaagatc

SEQ ID NO: 3529531 - DNA, 20 bp, Homo sapiens
tgactaagttgcaagatctt

SEQ ID NO: 3529532 - DNA, 18 bp, Homo sapiens
tgactccttggtgctaaa

SEQ ID NO: 3529533 - DNA, 18 bp, Homo sapiens
tgactcgggggctgtctc

SEQ ID NO: 3529534 - DNA, 19 bp, Homo sapiens
tgactcgggggctgtctca

SEQ ID NO: 3529535 - DNA, 15 bp, Homo sapiens
tgactgagatttgta

SEQ ID NO: 3529536 - DNA, 19 bp, Homo sapiens
tgactgagatttgtaaatc

SEQ ID NO: 3529537 - DNA, 13 bp, Homo sapiens
tgactgccaagcc

SEQ ID NO: 3529538 - DNA, 18 bp, Homo sapiens
tgactgtcagggagggcc

SEQ ID NO: 3529539 - DNA, 22 bp, Homo sapiens
tgagaaatagtgcactccaaga

SEQ ID NO: 3529540 - DNA, 16 bp, Homo sapiens
tgagaagaggaggagg

SEQ ID NO: 3529541 - DNA, 15 bp, Homo sapiens
tgagaattacagaaa

SEQ ID NO: 3529542 - DNA, 19 bp, Homo sapiens
tgagaattacagaaaattt

SEQ ID NO: 3529543 - DNA, 20 bp, Homo sapiens
tgagagcatcaggcctagag

SEQ ID NO: 3529544 - DNA, 11 bp, Homo sapiens
tgagaggggag

SEQ ID NO: 3529545 - DNA, 13 bp, Homo sapiens
tgagaggggaggg

SEQ ID NO: 3529546 - DNA, 17 bp, Homo sapiens
tgagaggggagggaggg

SEQ ID NO: 3529547 - DNA, 20 bp, Homo sapiens
tgagatagcccatcttcctg

SEQ ID NO: 3529548 - DNA, 13 bp, Homo sapiens
tgagatttgtaaa

SEQ ID NO: 3529549 - DNA, 15 bp, Homo sapiens
tgagatttgtaaatc

SEQ ID NO: 3529550 - DNA, 19 bp, Homo sapiens
tgagcctgtgaccttggga

SEQ ID NO: 3529551 - DNA, 18 bp, Homo sapiens
tgagctcttgctatctct

SEQ ID NO: 3529552 - DNA, 18 bp, Homo sapiens
tgagctgaaggtgaaaca

SEQ ID NO: 3529553 - DNA, 22 bp, Homo sapiens
tgaggaccagggtggagctgag

SEQ ID NO: 3529554 - DNA, 13 bp, Homo sapiens
tgaggggacccag

SEQ ID NO: 3529555 - DNA, 14 bp, Homo sapiens
tgaggggacccagc

SEQ ID NO: 3529556 - DNA, 18 bp, Homo sapiens
tgaggggacccagcgccg

SEQ ID NO: 3529557 - DNA, 19 bp, Homo sapiens
tgaggggctggggaggggg

SEQ ID NO: 3529558 - DNA, 20 bp, Homo sapiens
tgaggggtgtccgagaggct

SEQ ID NO: 3529559 - DNA, 12 bp, Homo sapiens
tgagttttacca

SEQ ID NO: 3529560 - DNA, 16 bp, Homo sapiens
tgataaattactaatt

SEQ ID NO: 3529561 - DNA, 18 bp, Homo sapiens
tgatccccacgccacagc

SEQ ID NO: 3529562 - DNA, 19 bp, Homo sapiens
tgatccccacgccacagcc

SEQ ID NO: 3529563 - DNA, 20 bp, Homo sapiens
tgatccccacgccacagccc

SEQ ID NO: 3529564 - DNA, 15 bp, Homo sapiens
tgatctctgtagaat

SEQ ID NO: 3529565 - DNA, 22 bp, Homo sapiens
tgatgatggtgttggtgaaaat

SEQ ID NO: 3529566 - DNA, 22 bp, Homo sapiens
tgatgttacaaggtgttgttaa

SEQ ID NO: 3529567 - DNA, 23 bp, Homo sapiens
tgatgttacaaggtgttgttaaa

SEQ ID NO: 3529568 - DNA, 24 bp, Homo sapiens
tgatttcagcacaataaatatact

SEQ ID NO: 3529569 - DNA, 17 bp, Homo sapiens
tgcaagatcttatttat

SEQ ID NO: 3529570 - DNA, 22 bp, Homo sapiens
tgcaataaaaaatatattttta

SEQ ID NO: 3529571 - DNA, 18 bp, Homo sapiens
tgcacatttgaattcatt

SEQ ID NO: 3529572 - DNA, 13 bp, Homo sapiens
tgcagcctggtca

SEQ ID NO: 3529573 - DNA, 16 bp, Homo sapiens
tgcaggctgcaggagg

SEQ ID NO: 3529574 - DNA, 22 bp, Homo sapiens
tgcaggctgcaggagggcactg

SEQ ID NO: 3529575 - DNA, 21 bp, Homo sapiens
tgcagttctttggctgaaagg

SEQ ID NO: 3529576 - DNA, 19 bp, Homo sapiens
tgcatacaataaaagagct

SEQ ID NO: 3529577 - DNA, 19 bp, Homo sapiens
tgcattctgataggagggg

SEQ ID NO: 3529578 - DNA, 23 bp, Homo sapiens
tgccaagccatgggtagcctggg

SEQ ID NO: 3529579 - DNA, 17 bp, Homo sapiens
tgccagaagttggggga

SEQ ID NO: 3529580 - DNA, 20 bp, Homo sapiens
tgccagccaatccctggcca

SEQ ID NO: 3529581 - DNA, 18 bp, Homo sapiens
tgcccccagagccacagt

SEQ ID NO: 3529582 - DNA, 12 bp, Homo sapiens
tgccctgagggg

SEQ ID NO: 3529583 - DNA, 13 bp, Homo sapiens
tgccctgaggggc

SEQ ID NO: 3529584 - DNA, 16 bp, Homo sapiens
tgccctgctgccctcc

SEQ ID NO: 3529585 - DNA, 22 bp, Homo sapiens
tgcctctgagagcatcaggcct

SEQ ID NO: 3529586 - DNA, 19 bp, Homo sapiens
tgcggacacttttgaggac

SEQ ID NO: 3529587 - DNA, 15 bp, Homo sapiens
tgctaaagattgtta

SEQ ID NO: 3529588 - DNA, 23 bp, Homo sapiens
tgctaccaatctgtgagaagttt

SEQ ID NO: 3529589 - DNA, 17 bp, Homo sapiens
tgctacctgatttcagc

SEQ ID NO: 3529590 - DNA, 22 bp, Homo sapiens
tgctcacggaccccatgttgga

SEQ ID NO: 3529591 - DNA, 21 bp, Homo sapiens
tgctctaggcccacaagtgta

SEQ ID NO: 3529592 - DNA, 20 bp, Homo sapiens
tgctctgaccctgggctttc

SEQ ID NO: 3529593 - DNA, 17 bp, Homo sapiens
tgctgaccctccccaaa

SEQ ID NO: 3529594 - DNA, 14 bp, Homo sapiens
tgctgatctctgta

SEQ ID NO: 3529595 - DNA, 19 bp, Homo sapiens
tgctggtagctgaggggac

SEQ ID NO: 3529596 - DNA, 14 bp, Homo sapiens
tgctgttagaatat

SEQ ID NO: 3529597 - DNA, 17 bp, Homo sapiens
tgctgtttgtacaaact

SEQ ID NO: 3529598 - DNA, 16 bp, Homo sapiens
tgcttttatgacaaat

SEQ ID NO: 3529599 - DNA, 13 bp, Homo sapiens
tggaaagaacatt

SEQ ID NO: 3529600 - DNA, 15 bp, Homo sapiens
tggaaagaacattta

SEQ ID NO: 3529601 - DNA, 22 bp, Homo sapiens
tggaaataaagtaggaaagaat

SEQ ID NO: 3529602 - DNA, 23 bp, Homo sapiens
tggaacacctgatggtgaaacca

SEQ ID NO: 3529603 - DNA, 20 bp, Homo sapiens
tggacctgggttatttattg

SEQ ID NO: 3529604 - DNA, 15 bp, Homo sapiens
tggacggcgctgcct

SEQ ID NO: 3529605 - DNA, 19 bp, Homo sapiens
tggacggcgctgcctcagg

SEQ ID NO: 3529606 - DNA, 21 bp, Homo sapiens
tggagaccaggcctcagctct

SEQ ID NO: 3529607 - DNA, 14 bp, Homo sapiens
tggagatggtggat

SEQ ID NO: 3529608 - DNA, 15 bp, Homo sapiens
tggagctgagaagag

SEQ ID NO: 3529609 - DNA, 21 bp, Homo sapiens
tggaggctcagcccaccctcc

SEQ ID NO: 3529610 - DNA, 20 bp, Homo sapiens
aaactatccttctctttcaa

SEQ ID NO: 3529611 - DNA, 21 bp, Homo sapiens
aaactatccttctctttcaat

SEQ ID NO: 3529612 - DNA, 18 bp, Homo sapiens
aaacttgcacatttgaat

SEQ ID NO: 3529613 - DNA, 11 bp, Homo sapiens
aaagaacattt

SEQ ID NO: 3529614 - DNA, 15 bp, Homo sapiens
aaagacaaaatgtga

SEQ ID NO: 3529615 - DNA, 14 bp, Homo sapiens
aaagattgttaaat

SEQ ID NO: 3529616 - DNA, 13 bp, Homo sapiens
aaagctgaaaatg

SEQ ID NO: 3529617 - DNA, 15 bp, Homo sapiens
aaagctgaaaatgtg

SEQ ID NO: 3529618 - DNA, 14 bp, Homo sapiens
aaaggacactggat

SEQ ID NO: 3529619 - DNA, 16 bp, Homo sapiens
aaaggacactggatca

SEQ ID NO: 3529620 - DNA, 10 bp, Homo sapiens
aaaggcagca

SEQ ID NO: 3529621 - DNA, 14 bp, Homo sapiens
aaagtaggaaagaa

SEQ ID NO: 3529622 - DNA, 22 bp, Homo sapiens
aaatatacttctgctgtgggaa

SEQ ID NO: 3529623 - DNA, 18 bp, Homo sapiens
aaatatattatgaaaatt

SEQ ID NO: 3529624 - DNA, 22 bp, Homo sapiens
aaatatatttttatatgtggaa

SEQ ID NO: 3529625 - DNA, 20 bp, Homo sapiens
aaatcactgtggggaaacaa

SEQ ID NO: 3529626 - DNA, 12 bp, Homo sapiens
aaattaaataaa

SEQ ID NO: 3529627 - DNA, 12 bp, Homo sapiens
aaattaaatact

SEQ ID NO: 3529628 - DNA, 19 bp, Homo sapiens
aacaattttttgtgatgaa

SEQ ID NO: 3529629 - DNA, 20 bp, Homo sapiens
aacacaaaatgaataaaagt

SEQ ID NO: 3529630 - DNA, 22 bp, Homo sapiens
aacatttaaaattaaataaatt

SEQ ID NO: 3529631 - DNA, 21 bp, Homo sapiens
aacattttttttaaaaattag

SEQ ID NO: 3529632 - DNA, 13 bp, Homo sapiens
aactataacattc

SEQ ID NO: 3529633 - DNA, 15 bp, Homo sapiens
aactataacattcaa

SEQ ID NO: 3529634 - DNA, 19 bp, Homo sapiens
aactatccttctctttcaa

SEQ ID NO: 3529635 - DNA, 14 bp, Homo sapiens
aactatttcagaat

SEQ ID NO: 3529636 - DNA, 18 bp, Homo sapiens
aactatttcagaatattt

SEQ ID NO: 3529637 - DNA, 22 bp, Homo sapiens
aactcccatatcatataaaatt

SEQ ID NO: 3529638 - DNA, 23 bp, Homo sapiens
aactccgaaagtctgaatctccc

SEQ ID NO: 3529639 - DNA, 22 bp, Homo sapiens
aactggagaccagaaaccttcc

SEQ ID NO: 3529640 - DNA, 19 bp, Homo sapiens
aacttacctctgcttctga

SEQ ID NO: 3529641 - DNA, 22 bp, Homo sapiens
aacttgcagtatatcacagagc

SEQ ID NO: 3529642 - DNA, 15 bp, Homo sapiens
aagaaaacccgaggg

SEQ ID NO: 3529643 - DNA, 16 bp, Homo sapiens
aagaaaacccgaggga

SEQ ID NO: 3529644 - DNA, 19 bp, Homo sapiens
aagaaagaattgcagtaaa

SEQ ID NO: 3529645 - DNA, 11 bp, Homo sapiens
aagaacattta

SEQ ID NO: 3529646 - DNA, 17 bp, Homo sapiens
aagaacatttaaaatta

SEQ ID NO: 3529647 - DNA, 13 bp, Homo sapiens
aagaatgaatcca

SEQ ID NO: 3529648 - DNA, 20 bp, Homo sapiens
aagacaaatgtgctctatgt

SEQ ID NO: 3529649 - DNA, 13 bp, Homo sapiens
aagacttaatatg

SEQ ID NO: 3529650 - DNA, 14 bp, Homo sapiens
aagacttaatatgt

SEQ ID NO: 3529651 - DNA, 15 bp, Homo sapiens
aagagaatttcaagg

SEQ ID NO: 3529652 - DNA, 17 bp, Homo sapiens
aagatagttacatttat

SEQ ID NO: 3529653 - DNA, 19 bp, Homo sapiens
aagatagttacatttatgt

SEQ ID NO: 3529654 - DNA, 11 bp, Homo sapiens
aagatgggagg

SEQ ID NO: 3529655 - DNA, 12 bp, Homo sapiens
aagatgggagga

SEQ ID NO: 3529656 - DNA, 22 bp, Homo sapiens
aagcaatcattaagtgactttg

SEQ ID NO: 3529657 - DNA, 12 bp, Homo sapiens
aagcacagaaat

SEQ ID NO: 3529658 - DNA, 11 bp, Homo sapiens
aagcagccagg

SEQ ID NO: 3529659 - DNA, 17 bp, Homo sapiens
aagcagccaggagggac

SEQ ID NO: 3529660 - DNA, 21 bp, Homo sapiens
aagcagtggggtaggctgctg

SEQ ID NO: 3529661 - DNA, 19 bp, Homo sapiens
aagccagctgcccccagag

SEQ ID NO: 3529662 - DNA, 22 bp, Homo sapiens
aagccatgggtagcctgggtgt

SEQ ID NO: 3529663 - DNA, 13 bp, Homo sapiens
aagctataacata

SEQ ID NO: 3529664 - DNA, 16 bp, Homo sapiens
aagctatgtctctagc

SEQ ID NO: 3529665 - DNA, 18 bp, Homo sapiens
aagctgtcagaagtttct

SEQ ID NO: 3529666 - DNA, 15 bp, Homo sapiens
aaggaagctgtgcgt

SEQ ID NO: 3529667 - DNA, 16 bp, Homo sapiens
aaggaatcctctggga

SEQ ID NO: 3529668 - DNA, 12 bp, Homo sapiens
aaggagcagaga

SEQ ID NO: 3529669 - DNA, 17 bp, Homo sapiens
aaggcattgagggctct

SEQ ID NO: 3529670 - DNA, 22 bp, Homo sapiens
aaggcctgcttttgtgtcccat

SEQ ID NO: 3529671 - DNA, 21 bp, Homo sapiens
aaggctctgttatcagctggg

SEQ ID NO: 3529672 - DNA, 23 bp, Homo sapiens
aaggctctgttatcagctgggca

SEQ ID NO: 3529673 - DNA, 21 bp, Homo sapiens
aaggctttgccctgctgccct

SEQ ID NO: 3529674 - DNA, 23 bp, Homo sapiens
aagggattactagagaaagacaa

SEQ ID NO: 3529675 - DNA, 19 bp, Homo sapiens
aaggtgaaacattttctcc

SEQ ID NO: 3529676 - DNA, 20 bp, Homo sapiens
aaggtgttgttaaaacacaa

SEQ ID NO: 3529677 - DNA, 12 bp, Homo sapiens
aagtatttcatg

SEQ ID NO: 3529678 - DNA, 16 bp, Homo sapiens
aagtatttcatgtaat

SEQ ID NO: 3529679 - DNA, 19 bp, Homo sapiens
aagtcatttcaaaatatgt

SEQ ID NO: 3529680 - DNA, 16 bp, Homo sapiens
aagtcttgtctggtga

SEQ ID NO: 3529681 - DNA, 15 bp, Homo sapiens
aagtgagaggggagg

SEQ ID NO: 3529682 - DNA, 17 bp, Homo sapiens
aagtgagaggggaggga

SEQ ID NO: 3529683 - DNA, 19 bp, Homo sapiens
aagtgagagtagtcagaac

SEQ ID NO: 3529684 - DNA, 22 bp, Homo sapiens
aagtgccaggtgatctcctgtg

SEQ ID NO: 3529685 - DNA, 23 bp, Homo sapiens
aagtgccaggtgatctcctgtgg

SEQ ID NO: 3529686 - DNA, 13 bp, Homo sapiens
aagtggtctgaac

SEQ ID NO: 3529687 - DNA, 23 bp, Homo sapiens
aagttacacctccactcagcact

SEQ ID NO: 3529688 - DNA, 16 bp, Homo sapiens
aagtttttattttaaa

SEQ ID NO: 3529689 - DNA, 21 bp, Homo sapiens
aagtttttattttaaacattt

SEQ ID NO: 3529690 - DNA, 23 bp, Homo sapiens
aagtttttattttaaacattttt

SEQ ID NO: 3529691 - DNA, 17 bp, Homo sapiens
aataaacgccacctgca

SEQ ID NO: 3529692 - DNA, 21 bp, Homo sapiens
aataaatatacttctgctgtg

SEQ ID NO: 3529693 - DNA, 18 bp, Homo sapiens
aataagaaagaattgcag

SEQ ID NO: 3529694 - DNA, 16 bp, Homo sapiens
aatacaaaatccttct

SEQ ID NO: 3529695 - DNA, 22 bp, Homo sapiens
aatagcatacaccaaacatttc

SEQ ID NO: 3529696 - DNA, 15 bp, Homo sapiens
aatatattatgaaaa

SEQ ID NO: 3529697 - DNA, 18 bp, Homo sapiens
aatatattatgaaaatta

SEQ ID NO: 3529698 - DNA, 19 bp, Homo sapiens
aatattcttgactccttgg

SEQ ID NO: 3529699 - DNA, 19 bp, Homo sapiens
aatcaaggagtcttctaat

SEQ ID NO: 3529700 - DNA, 22 bp, Homo sapiens
aatctgctgatctctgtagaat

SEQ ID NO: 3529701 - DNA, 16 bp, Homo sapiens
aatgaagtatttcatg

SEQ ID NO: 3529702 - DNA, 22 bp, Homo sapiens
aatgaagtatttcatgtaatat

SEQ ID NO: 3529703 - DNA, 20 bp, Homo sapiens
aatgactgagatttgtaaat

SEQ ID NO: 3529704 - DNA, 23 bp, Homo sapiens
aatgactgagatttgtaaatctt

SEQ ID NO: 3529705 - DNA, 16 bp, Homo sapiens
aatgattttgctgact

SEQ ID NO: 3529706 - DNA, 12 bp, Homo sapiens
aatgccaagatt

SEQ ID NO: 3529707 - DNA, 14 bp, Homo sapiens
aatgcggacacttt

SEQ ID NO: 3529708 - DNA, 21 bp, Homo sapiens
aatgggggctttcggggaggg

SEQ ID NO: 3529709 - DNA, 14 bp, Homo sapiens
aatgtaaattttaa

SEQ ID NO: 3529710 - DNA, 15 bp, Homo sapiens
aatgtaaattttaat

SEQ ID NO: 3529711 - DNA, 13 bp, Homo sapiens
aatgtatacttga

SEQ ID NO: 3529712 - DNA, 16 bp, Homo sapiens
aatgtgtttaattttg

SEQ ID NO: 3529713 - DNA, 17 bp, Homo sapiens
aatgtgtttaattttgg

SEQ ID NO: 3529714 - DNA, 17 bp, Homo sapiens
aatgttaactttcaaat

SEQ ID NO: 3529715 - DNA, 21 bp, Homo sapiens
aatgttataacttatgaagta

SEQ ID NO: 3529716 - DNA, 17 bp, Homo sapiens
aattaaaaacagaaaat

SEQ ID NO: 3529717 - DNA, 14 bp, Homo sapiens
aattaaataaattt

SEQ ID NO: 3529718 - DNA, 17 bp, Homo sapiens
aattaaataaattttaa

SEQ ID NO: 3529719 - DNA, 16 bp, Homo sapiens
aattaaatactttttc

SEQ ID NO: 3529720 - DNA, 16 bp, Homo sapiens
atgaagtatttcatgt

SEQ ID NO: 3529721 - DNA, 17 bp, Homo sapiens
atgaagtatttcatgta

SEQ ID NO: 3529722 - DNA, 16 bp, Homo sapiens
atgactgagatttgta

SEQ ID NO: 3529723 - DNA, 18 bp, Homo sapiens
atgacttgaggcacaaat

SEQ ID NO: 3529724 - DNA, 20 bp, Homo sapiens
atgagaattacagaaaattt

SEQ ID NO: 3529725 - DNA, 16 bp, Homo sapiens
atgagatttttcatgt

SEQ ID NO: 3529726 - DNA, 18 bp, Homo sapiens
atgatccccacgccacag

SEQ ID NO: 3529727 - DNA, 19 bp, Homo sapiens
atgatccccacgccacagc

SEQ ID NO: 3529728 - DNA, 16 bp, Homo sapiens
atgatggtgttggtga

SEQ ID NO: 3529729 - DNA, 20 bp, Homo sapiens
atgcagtcatgagaattaca

SEQ ID NO: 3529730 - DNA, 17 bp, Homo sapiens
atgcatacaataaaaga

SEQ ID NO: 3529731 - DNA, 22 bp, Homo sapiens
atgcatacaataaaagagcttt

SEQ ID NO: 3529732 - DNA, 21 bp, Homo sapiens
atgctcttggggttcataggg

SEQ ID NO: 3529733 - DNA, 22 bp, Homo sapiens
atgctgagccagccatctttgg

SEQ ID NO: 3529734 - DNA, 21 bp, Homo sapiens
atgggaggcctttccctaagc

SEQ ID NO: 3529735 - DNA, 19 bp, Homo sapiens
atgggcttttgttctgagg

SEQ ID NO: 3529736 - DNA, 20 bp, Homo sapiens
atgggcttttgttctgaggg

SEQ ID NO: 3529737 - DNA, 15 bp, Homo sapiens
atggtgttggtgaaa

SEQ ID NO: 3529738 - DNA, 20 bp, Homo sapiens
atgtcaaagctgcatgtgta

SEQ ID NO: 3529739 - DNA, 13 bp, Homo sapiens
atgtgctctatgt

SEQ ID NO: 3529740 - DNA, 18 bp, Homo sapiens
atgtgctgttagaatatg

SEQ ID NO: 3529741 - DNA, 21 bp, Homo sapiens
atgtgctgttagaatatgttg

SEQ ID NO: 3529742 - DNA, 23 bp, Homo sapiens
atgtgtatacacttaaacttgca

SEQ ID NO: 3529743 - DNA, 15 bp, Homo sapiens
atgttaactttcaaa

SEQ ID NO: 3529744 - DNA, 16 bp, Homo sapiens
atgttataacttatga

SEQ ID NO: 3529745 - DNA, 15 bp, Homo sapiens
atgttccaggaatga

SEQ ID NO: 3529746 - DNA, 15 bp, Homo sapiens
attaaaaacagaaaa

SEQ ID NO: 3529747 - DNA, 16 bp, Homo sapiens
attaaaaacagaaaat

SEQ ID NO: 3529748 - DNA, 14 bp, Homo sapiens
attaaataaatttt

SEQ ID NO: 3529749 - DNA, 16 bp, Homo sapiens
attaaataaattttaa

SEQ ID NO: 3529750 - DNA, 18 bp, Homo sapiens
attaaatttttaaaatct

SEQ ID NO: 3529751 - DNA, 20 bp, Homo sapiens
attaaatttttaaaatctgc

SEQ ID NO: 3529752 - DNA, 17 bp, Homo sapiens
attaagattattgtctg

SEQ ID NO: 3529753 - DNA, 22 bp, Homo sapiens
attaagattattgtctgattga

SEQ ID NO: 3529754 - DNA, 17 bp, Homo sapiens
attacagaaaatttgca

SEQ ID NO: 3529755 - DNA, 19 bp, Homo sapiens
attacagaaaatttgcaac

SEQ ID NO: 3529756 - DNA, 15 bp, Homo sapiens
attagatttctgaat

SEQ ID NO: 3529757 - DNA, 12 bp, Homo sapiens
attaggctttag

SEQ ID NO: 3529758 - DNA, 16 bp, Homo sapiens
attatcttatctactg

SEQ ID NO: 3529759 - DNA, 22 bp, Homo sapiens
attcaatttgctatttacaaat

SEQ ID NO: 3529760 - DNA, 20 bp, Homo sapiens
attctccccctgttcacatc

SEQ ID NO: 3529761 - DNA, 14 bp, Homo sapiens
attctccctaaagt

SEQ ID NO: 3529762 - DNA, 18 bp, Homo sapiens
attctccctaaagtgttg

SEQ ID NO: 3529763 - DNA, 21 bp, Homo sapiens
attcttcggtctgaattttag

SEQ ID NO: 3529764 - DNA, 23 bp, Homo sapiens
attcttgactccttggtgctaaa

SEQ ID NO: 3529765 - DNA, 18 bp, Homo sapiens
attctttgagatagccca

SEQ ID NO: 3529766 - DNA, 14 bp, Homo sapiens
attgcagtaaagtc

SEQ ID NO: 3529767 - DNA, 13 bp, Homo sapiens
attggtgttgcca

SEQ ID NO: 3529768 - DNA, 22 bp, Homo sapiens
attggtgttgccagttgtcctc

SEQ ID NO: 3529769 - DNA, 23 bp, Homo sapiens
attgtctgattgaaacatgaaac

SEQ ID NO: 3529770 - DNA, 18 bp, Homo sapiens
attgtgcattaaaattaa

SEQ ID NO: 3529771 - DNA, 21 bp, Homo sapiens
atttaaaattaaataaatttt

SEQ ID NO: 3529772 - DNA, 15 bp, Homo sapiens
atttatgaagttttt

SEQ ID NO: 3529773 - DNA, 17 bp, Homo sapiens
atttatgtgctgttaga

SEQ ID NO: 3529774 - DNA, 22 bp, Homo sapiens
atttattaactaggtatgaagt

SEQ ID NO: 3529775 - DNA, 14 bp, Homo sapiens
atttcagaatattt

SEQ ID NO: 3529776 - DNA, 18 bp, Homo sapiens
atttcagggaaaacagaa

SEQ ID NO: 3529777 - DNA, 15 bp, Homo sapiens
atttccctgaagcta

SEQ ID NO: 3529778 - DNA, 15 bp, Homo sapiens
atttctggaatgctt

SEQ ID NO: 3529779 - DNA, 17 bp, Homo sapiens
atttctggaatgcttct

SEQ ID NO: 3529780 - DNA, 23 bp, Homo sapiens
atttgggaaaagaagctgtcaga

SEQ ID NO: 3529781 - DNA, 17 bp, Homo sapiens
atttgtatcatgtttta

SEQ ID NO: 3529782 - DNA, 20 bp, Homo sapiens
attttaatgttaactttcaa

SEQ ID NO: 3529783 - DNA, 20 bp, Homo sapiens
attttagacgatcacagaaa

SEQ ID NO: 3529784 - DNA, 18 bp, Homo sapiens
attttggttgtaattaaa

SEQ ID NO: 3529785 - DNA, 20 bp, Homo sapiens
attttgtaagctataacata

SEQ ID NO: 3529786 - DNA, 11 bp, Homo sapiens
atttttaccag

SEQ ID NO: 3529787 - DNA, 23 bp, Homo sapiens
attttttaagggatgttgcaaag

SEQ ID NO: 3529788 - DNA, 20 bp, Homo sapiens
caaaaaaaagcatgaatatt

SEQ ID NO: 3529789 - DNA, 22 bp, Homo sapiens
caaaaaaaagcatgaatatttc

SEQ ID NO: 3529790 - DNA, 14 bp, Homo sapiens
caaaccttgggccc

SEQ ID NO: 3529791 - DNA, 18 bp, Homo sapiens
caaactatttcagaatat

SEQ ID NO: 3529792 - DNA, 19 bp, Homo sapiens
caaactatttcagaatatt

SEQ ID NO: 3529793 - DNA, 22 bp, Homo sapiens
caaactggtttgaaatttttga

SEQ ID NO: 3529794 - DNA, 19 bp, Homo sapiens
caaagctgaaaatgtgtat

SEQ ID NO: 3529795 - DNA, 15 bp, Homo sapiens
caaaggctttgccct

SEQ ID NO: 3529796 - DNA, 14 bp, Homo sapiens
caaatggactggcc

SEQ ID NO: 3529797 - DNA, 15 bp, Homo sapiens
caacaacatgtcaaa

SEQ ID NO: 3529798 - DNA, 15 bp, Homo sapiens
caacctcctgtgggc

SEQ ID NO: 3529799 - DNA, 16 bp, Homo sapiens
caacttaatacaaaac

SEQ ID NO: 3529800 - DNA, 20 bp, Homo sapiens
caagaaacgtggatctcccc

SEQ ID NO: 3529801 - DNA, 17 bp, Homo sapiens
caagatgtttggacacc

SEQ ID NO: 3529802 - DNA, 17 bp, Homo sapiens
caagcagatctgctttt

SEQ ID NO: 3529803 - DNA, 15 bp, Homo sapiens
caaggagcagagagg

SEQ ID NO: 3529804 - DNA, 15 bp, Homo sapiens
caaggcagggcccag

SEQ ID NO: 3529805 - DNA, 22 bp, Homo sapiens
caagggcagggggcccctttgc

SEQ ID NO: 3529806 - DNA, 19 bp, Homo sapiens
caagtagattggctgggca

SEQ ID NO: 3529807 - DNA, 15 bp, Homo sapiens
caagtgagaggggag

SEQ ID NO: 3529808 - DNA, 16 bp, Homo sapiens
caagtgagaggggagg

SEQ ID NO: 3529809 - DNA, 17 bp, Homo sapiens
caagtgagaggggaggg

SEQ ID NO: 3529810 - DNA, 20 bp, Homo sapiens
caagtgagaggggagggagg

SEQ ID NO: 3529811 - DNA, 14 bp, Homo sapiens
caagttcagccacc

SEQ ID NO: 3529812 - DNA, 13 bp, Homo sapiens
caataaaagagct

SEQ ID NO: 3529813 - DNA, 14 bp, Homo sapiens
caataaaagagctt

SEQ ID NO: 3529814 - DNA, 21 bp, Homo sapiens
caataaatatacttctgctgt

SEQ ID NO: 3529815 - DNA, 14 bp, Homo sapiens
caatataccatgac

SEQ ID NO: 3529816 - DNA, 15 bp, Homo sapiens
caatctgtgagaagt

SEQ ID NO: 3529817 - DNA, 17 bp, Homo sapiens
caatctgtgagaagttt

SEQ ID NO: 3529818 - DNA, 15 bp, Homo sapiens
caatgcatacaataa

SEQ ID NO: 3529819 - DNA, 20 bp, Homo sapiens
caatgcatacaataaaagag

SEQ ID NO: 3529820 - DNA, 15 bp, Homo sapiens
caatttgctatttac

SEQ ID NO: 3529821 - DNA, 22 bp, Homo sapiens
caatttgctatttacaaatgaa

SEQ ID NO: 3529822 - DNA, 16 bp, Homo sapiens
cacacagttgttgaat

SEQ ID NO: 3529823 - DNA, 22 bp, Homo sapiens
cacacagttgttgaatgactga

SEQ ID NO: 3529824 - DNA, 17 bp, Homo sapiens
cacacccaaggggcccg

SEQ ID NO: 3529825 - DNA, 20 bp, Homo sapiens
cacaccctatatctccgtgt

SEQ ID NO: 3529826 - DNA, 20 bp, Homo sapiens
cacagaaacggtctttatga

SEQ ID NO: 3529827 - DNA, 17 bp, Homo sapiens
cacagagccactcttca

SEQ ID NO: 3529828 - DNA, 11 bp, Homo sapiens
cacagccagcc

SEQ ID NO: 3529829 - DNA, 15 bp, Homo sapiens
catgattccagccat

SEQ ID NO: 3529830 - DNA, 16 bp, Homo sapiens
catgattccagccatc

SEQ ID NO: 3529831 - DNA, 22 bp, Homo sapiens
catgcagcgaattcagaaagag

SEQ ID NO: 3529832 - DNA, 19 bp, Homo sapiens
catgggaggcctttcccta

SEQ ID NO: 3529833 - DNA, 14 bp, Homo sapiens
catgggtctggcct

SEQ ID NO: 3529834 - DNA, 20 bp, Homo sapiens
catgtcaaagctgcatgtgt

SEQ ID NO: 3529835 - DNA, 19 bp, Homo sapiens
cattctgataggagggggc

SEQ ID NO: 3529836 - DNA, 22 bp, Homo sapiens
catttaaaattaaataaatttt

SEQ ID NO: 3529837 - DNA, 22 bp, Homo sapiens
catttatgtgctgttagaatat

SEQ ID NO: 3529838 - DNA, 17 bp, Homo sapiens
catttctgtgaaactat

SEQ ID NO: 3529839 - DNA, 12 bp, Homo sapiens
catttgaatact

SEQ ID NO: 3529840 - DNA, 20 bp, Homo sapiens
catttgaattcatttgctga

SEQ ID NO: 3529841 - DNA, 17 bp, Homo sapiens
catttggccccagggga

SEQ ID NO: 3529842 - DNA, 12 bp, Homo sapiens
cattttctccct

SEQ ID NO: 3529843 - DNA, 17 bp, Homo sapiens
cattttctccctggatt

SEQ ID NO: 3529844 - DNA, 13 bp, Homo sapiens
ccaaacatttctg

SEQ ID NO: 3529845 - DNA, 14 bp, Homo sapiens
ccaaatggactggc

SEQ ID NO: 3529846 - DNA, 22 bp, Homo sapiens
ccaacaactcagaatgggggct

SEQ ID NO: 3529847 - DNA, 18 bp, Homo sapiens
ccaagatgtttggacacc

SEQ ID NO: 3529848 - DNA, 21 bp, Homo sapiens
ccaagccatgggtagcctggg

SEQ ID NO: 3529849 - DNA, 16 bp, Homo sapiens
ccaagccctggtgacc

SEQ ID NO: 3529850 - DNA, 16 bp, Homo sapiens
ccaaggagcagagagg

SEQ ID NO: 3529851 - DNA, 14 bp, Homo sapiens
ccaaggagggcacc

SEQ ID NO: 3529852 - DNA, 16 bp, Homo sapiens
ccaaggcagggcccag

SEQ ID NO: 3529853 - DNA, 23 bp, Homo sapiens
ccacagcccccgggacaccgtgg

SEQ ID NO: 3529854 - DNA, 14 bp, Homo sapiens
ccaccaagccttga

SEQ ID NO: 3529855 - DNA, 17 bp, Homo sapiens
ccaccgggggtggctct

SEQ ID NO: 3529856 - DNA, 12 bp, Homo sapiens
ccacgccacagc

SEQ ID NO: 3529857 - DNA, 14 bp, Homo sapiens
ccacgccacagccc

SEQ ID NO: 3529858 - DNA, 21 bp, Homo sapiens
ccacgccacagcccttttgtc

SEQ ID NO: 3529859 - DNA, 16 bp, Homo sapiens
ccacgttcagggaggg

SEQ ID NO: 3529860 - DNA, 20 bp, Homo sapiens
ccacgttcagggaggggccg

SEQ ID NO: 3529861 - DNA, 14 bp, Homo sapiens
ccactgcagcagaa

SEQ ID NO: 3529862 - DNA, 16 bp, Homo sapiens
ccactgcagcagaaaa

SEQ ID NO: 3529863 - DNA, 20 bp, Homo sapiens
ccagaagttgggggaaagtt

SEQ ID NO: 3529864 - DNA, 18 bp, Homo sapiens
ccagaccaaggcagggcc

SEQ ID NO: 3529865 - DNA, 21 bp, Homo sapiens
ccagatacccatcttgaaaaa

SEQ ID NO: 3529866 - DNA, 17 bp, Homo sapiens
ccagcccaaaccttggg

SEQ ID NO: 3529867 - DNA, 23 bp, Homo sapiens
ccagcgccggggggagggaggag

SEQ ID NO: 3529868 - DNA, 20 bp, Homo sapiens
ccagcgctggcccccccagc

SEQ ID NO: 3529869 - DNA, 17 bp, Homo sapiens
ccagctgcccccagagc

SEQ ID NO: 3529870 - DNA, 19 bp, Homo sapiens
ccagctgcccccagagcca

SEQ ID NO: 3529871 - DNA, 17 bp, Homo sapiens
ccaggcctcagctcttg

SEQ ID NO: 3529872 - DNA, 13 bp, Homo sapiens
ccagggaggcaga

SEQ ID NO: 3529873 - DNA, 17 bp, Homo sapiens
ccaggtgatctcctgtg

SEQ ID NO: 3529874 - DNA, 19 bp, Homo sapiens
ccagttggatgaacattca

SEQ ID NO: 3529875 - DNA, 21 bp, Homo sapiens
ccataacttacctctgcttct

SEQ ID NO: 3529876 - DNA, 18 bp, Homo sapiens
ccatcaccttagaccacc

SEQ ID NO: 3529877 - DNA, 20 bp, Homo sapiens
ccatcactagagtgctctga

SEQ ID NO: 3529878 - DNA, 16 bp, Homo sapiens
ccatctcggggctgct

SEQ ID NO: 3529879 - DNA, 18 bp, Homo sapiens
ccatctcggggctgctgt

SEQ ID NO: 3529880 - DNA, 15 bp, Homo sapiens
ccatggacaacacta

SEQ ID NO: 3529881 - DNA, 19 bp, Homo sapiens
cccaaaggctttgccctgc

SEQ ID NO: 3529882 - DNA, 21 bp, Homo sapiens
cccaacctcctgtgggcctca

SEQ ID NO: 3529883 - DNA, 14 bp, Homo sapiens
cccacgccacagcc

SEQ ID NO: 3529884 - DNA, 15 bp, Homo sapiens
cccacgccacagccc

SEQ ID NO: 3529885 - DNA, 14 bp, Homo sapiens
cccagagccacagt

SEQ ID NO: 3529886 - DNA, 18 bp, Homo sapiens
cccagatgttttatttat

SEQ ID NO: 3529887 - DNA, 18 bp, Homo sapiens
cccagctctaagcagcca

SEQ ID NO: 3529888 - DNA, 23 bp, Homo sapiens
cccaggacccatctttctcacac

SEQ ID NO: 3529889 - DNA, 15 bp, Homo sapiens
cccaggggacgtggg

SEQ ID NO: 3529890 - DNA, 18 bp, Homo sapiens
cccatcttcctgagctag

SEQ ID NO: 3529891 - DNA, 15 bp, Homo sapiens
cccattcacatgccc

SEQ ID NO: 3529892 - DNA, 14 bp, Homo sapiens
cccattttggtgca

SEQ ID NO: 3529893 - DNA, 16 bp, Homo sapiens
ccccacgccacagccc

SEQ ID NO: 3529894 - DNA, 18 bp, Homo sapiens
ccccactgcagcagaaaa

SEQ ID NO: 3529895 - DNA, 14 bp, Homo sapiens
ccccagagccacag

SEQ ID NO: 3529896 - DNA, 20 bp, Homo sapiens
ccccaggcccgcgggcacag

SEQ ID NO: 3529897 - DNA, 15 bp, Homo sapiens
cccccagagccacag

SEQ ID NO: 3529898 - DNA, 22 bp, Homo sapiens
cccccagctctaagcagccagg

SEQ ID NO: 3529899 - DNA, 15 bp, Homo sapiens
ccccttgcagcctgg

SEQ ID NO: 3529900 - DNA, 18 bp, Homo sapiens
cccctttgctgaccctcc

SEQ ID NO: 3529901 - DNA, 18 bp, Homo sapiens
ccctaagccagctgcccc

SEQ ID NO: 3529902 - DNA, 17 bp, Homo sapiens
ccctagaagaaaacccg

SEQ ID NO: 3529903 - DNA, 14 bp, Homo sapiens
ccctcccctcccga

SEQ ID NO: 3529904 - DNA, 16 bp, Homo sapiens
ccctgactgtcaggga

SEQ ID NO: 3529905 - DNA, 21 bp, Homo sapiens
ccctgactgtcagggagggcc

SEQ ID NO: 3529906 - DNA, 22 bp, Homo sapiens
ccctgactgtcagggagggcca

SEQ ID NO: 3529907 - DNA, 19 bp, Homo sapiens
ccctgaggggctggggagg

SEQ ID NO: 3529908 - DNA, 23 bp, Homo sapiens
ccctgaggggctggggagggggt

SEQ ID NO: 3529909 - DNA, 20 bp, Homo sapiens
ccctgcaggctgcaggaggg

SEQ ID NO: 3529910 - DNA, 21 bp, Homo sapiens
ccctgcaggctgcaggagggc

SEQ ID NO: 3529911 - DNA, 15 bp, Homo sapiens
ccctgccctcatggg

SEQ ID NO: 3529912 - DNA, 19 bp, Homo sapiens
ccctggtgaccagaccaag

SEQ ID NO: 3529913 - DNA, 15 bp, Homo sapiens
cccttctccaaaggc

SEQ ID NO: 3529914 - DNA, 19 bp, Homo sapiens
cccttcttccaaggagcag

SEQ ID NO: 3529915 - DNA, 15 bp, Homo sapiens
ccctttgctgaccct

SEQ ID NO: 3529916 - DNA, 21 bp, Homo sapiens
ccgctcgttcctgcagccaga

SEQ ID NO: 3529917 - DNA, 20 bp, Homo sapiens
ccgggacaccgtggggaagg

SEQ ID NO: 3529918 - DNA, 16 bp, Homo sapiens
ccgggggtggctctgt

SEQ ID NO: 3529919 - DNA, 14 bp, Homo sapiens
ccgttggaaagaac

SEQ ID NO: 3529920 - DNA, 17 bp, Homo sapiens
cctaaagatgggaggag

SEQ ID NO: 3529921 - DNA, 13 bp, Homo sapiens
cctagaagaaaac

SEQ ID NO: 3529922 - DNA, 14 bp, Homo sapiens
cctagaagaaaacc

SEQ ID NO: 3529923 - DNA, 12 bp, Homo sapiens
cctagaggcctg

SEQ ID NO: 3529924 - DNA, 21 bp, Homo sapiens
cctagtcgggcagggcccctg

SEQ ID NO: 3529925 - DNA, 11 bp, Homo sapiens
cctatggccac

SEQ ID NO: 3529926 - DNA, 16 bp, Homo sapiens
cctcagccgtcagcca

SEQ ID NO: 3529927 - DNA, 17 bp, Homo sapiens
cctcagccgtcagccat

SEQ ID NO: 3529928 - DNA, 19 bp, Homo sapiens
cctccagcttttcctcagg

SEQ ID NO: 3529929 - DNA, 20 bp, Homo sapiens
cctccagcttttcctcaggg

SEQ ID NO: 3529930 - DNA, 15 bp, Homo sapiens
cctccccctcctctc

SEQ ID NO: 3529931 - DNA, 14 bp, Homo sapiens
cctcctagcccctt

SEQ ID NO: 3529932 - DNA, 18 bp, Homo sapiens
cctcttccgttggaaaga

SEQ ID NO: 3529933 - DNA, 19 bp, Homo sapiens
cctgaccctcccggcctgg

SEQ ID NO: 3529934 - DNA, 14 bp, Homo sapiens
cctgactgccaagc

SEQ ID NO: 3529935 - DNA, 16 bp, Homo sapiens
cctgactgtcagggag

SEQ ID NO: 3529936 - DNA, 20 bp, Homo sapiens
cctgactgtcagggagggcc

SEQ ID NO: 3529937 - DNA, 20 bp, Homo sapiens
cctgaggggctggggagggg

SEQ ID NO: 3529938 - DNA, 21 bp, Homo sapiens
cctgaggggctggggaggggg

SEQ ID NO: 3529939 - DNA, 16 bp, Homo sapiens
gagtccaccctttgga

SEQ ID NO: 3529940 - DNA, 14 bp, Homo sapiens
gagtctcaggagga

SEQ ID NO: 3529941 - DNA, 15 bp, Homo sapiens
gagttgtgggtagtg

SEQ ID NO: 3529942 - DNA, 17 bp, Homo sapiens
gatcaagttcagccacc

SEQ ID NO: 3529943 - DNA, 18 bp, Homo sapiens
gatccccacgccacagcc

SEQ ID NO: 3529944 - DNA, 13 bp, Homo sapiens
gatcctgagctgc

SEQ ID NO: 3529945 - DNA, 17 bp, Homo sapiens
gatgagatttttcatgt

SEQ ID NO: 3529946 - DNA, 15 bp, Homo sapiens
gatgatggtgttggt

SEQ ID NO: 3529947 - DNA, 16 bp, Homo sapiens
gatgcctttgagtctg

SEQ ID NO: 3529948 - DNA, 13 bp, Homo sapiens
gatggccagagga

SEQ ID NO: 3529949 - DNA, 16 bp, Homo sapiens
gatgtccagggcccca

SEQ ID NO: 3529950 - DNA, 22 bp, Homo sapiens
gatgttacaaggtgttgttaaa

SEQ ID NO: 3529951 - DNA, 12 bp, Homo sapiens
gatgttgcaaag

SEQ ID NO: 3529952 - DNA, 22 bp, Homo sapiens
gattattgtctgattgaaacat

SEQ ID NO: 3529953 - DNA, 13 bp, Homo sapiens
gattcaacacctt

SEQ ID NO: 3529954 - DNA, 23 bp, Homo sapiens
gattctttaatcatggagcaaga

SEQ ID NO: 3529955 - DNA, 19 bp, Homo sapiens
gattggctgggcaaaagaa

SEQ ID NO: 3529956 - DNA, 16 bp, Homo sapiens
gatttccctgaagcta

SEQ ID NO: 3529957 - DNA, 16 bp, Homo sapiens
gatttttcatgtatct

SEQ ID NO: 3529958 - DNA, 13 bp, Homo sapiens
gcaaaagaatgtt

SEQ ID NO: 3529959 - DNA, 22 bp, Homo sapiens
gcaaagggattactagagaaag

SEQ ID NO: 3529960 - DNA, 16 bp, Homo sapiens
gcaagtgagaggggag

SEQ ID NO: 3529961 - DNA, 18 bp, Homo sapiens
gcaagtgagaggggaggg

SEQ ID NO: 3529962 - DNA, 20 bp, Homo sapiens
gcaagtgagaggggagggag

SEQ ID NO: 3529963 - DNA, 22 bp, Homo sapiens
gcaagtgagaggggagggaggg

SEQ ID NO: 3529964 - DNA, 18 bp, Homo sapiens
gcaataaaaaatatattt

SEQ ID NO: 3529965 - DNA, 13 bp, Homo sapiens
gcaatctgaccct

SEQ ID NO: 3529966 - DNA, 22 bp, Homo sapiens
gcaatgttccaggaatgaaata

SEQ ID NO: 3529967 - DNA, 11 bp, Homo sapiens
gcacagccagc

SEQ ID NO: 3529968 - DNA, 20 bp, Homo sapiens
gcaccatcttacagagactc

SEQ ID NO: 3529969 - DNA, 21 bp, Homo sapiens
gcaccctgccctcatgggacc

SEQ ID NO: 3529970 - DNA, 16 bp, Homo sapiens
gcaccttaactggaga

SEQ ID NO: 3529971 - DNA, 17 bp, Homo sapiens
gcaccttaactggagac

SEQ ID NO: 3529972 - DNA, 20 bp, Homo sapiens
gcactctcctgtctgaacct

SEQ ID NO: 3529973 - DNA, 13 bp, Homo sapiens
gcactctggactc

SEQ ID NO: 3529974 - DNA, 15 bp, Homo sapiens
gcactctggactcca

SEQ ID NO: 3529975 - DNA, 15 bp, Homo sapiens
gcactggagctggga

SEQ ID NO: 3529976 - DNA, 14 bp, Homo sapiens
gcagaagaccagat

SEQ ID NO: 3529977 - DNA, 14 bp, Homo sapiens
gcagaggcagtggc

SEQ ID NO: 3529978 - DNA, 16 bp, Homo sapiens
gcagaggcagtggcca

SEQ ID NO: 3529979 - DNA, 17 bp, Homo sapiens
gcagaggcagtggccac

SEQ ID NO: 3529980 - DNA, 18 bp, Homo sapiens
gcagaggcttttccagtg

SEQ ID NO: 3529981 - DNA, 15 bp, Homo sapiens
gcaggagggcactgg

SEQ ID NO: 3529982 - DNA, 13 bp, Homo sapiens
gcagggctgggcc

SEQ ID NO: 3529983 - DNA, 21 bp, Homo sapiens
gcagtatatcacagagccact

SEQ ID NO: 3529984 - DNA, 23 bp, Homo sapiens
gcagtggccacgttcagggaggg

SEQ ID NO: 3529985 - DNA, 14 bp, Homo sapiens
gcagttaggcacct

SEQ ID NO: 3529986 - DNA, 13 bp, Homo sapiens
gcatacaataaaa

SEQ ID NO: 3529987 - DNA, 19 bp, Homo sapiens
gcatacaataaaagagctt

SEQ ID NO: 3529988 - DNA, 21 bp, Homo sapiens
gcatacaccaaacatttctgt

SEQ ID NO: 3529989 - DNA, 23 bp, Homo sapiens
gcatcaaaggagattctttgaga

SEQ ID NO: 3529990 - DNA, 21 bp, Homo sapiens
gcatcccgagcaaccctctga

SEQ ID NO: 3529991 - DNA, 22 bp, Homo sapiens
gcatctaagcatctgggttgcc

SEQ ID NO: 3529992 - DNA, 13 bp, Homo sapiens
gcatgaatatttc

SEQ ID NO: 3529993 - DNA, 15 bp, Homo sapiens
gcattaaaattaaat

SEQ ID NO: 3529994 - DNA, 20 bp, Homo sapiens
gcattctgataggagggggc

SEQ ID NO: 3529995 - DNA, 12 bp, Homo sapiens
gcattgtcctct

SEQ ID NO: 3529996 - DNA, 13 bp, Homo sapiens
gccacagcccttt

SEQ ID NO: 3529997 - DNA, 19 bp, Homo sapiens
gccaccgggggtggctctg

SEQ ID NO: 3529998 - DNA, 17 bp, Homo sapiens
gccagaaaggaactctg

SEQ ID NO: 3529999 - DNA, 19 bp, Homo sapiens
gccagaggaatgatgggct

SEQ ID NO: 3530000 - DNA, 15 bp, Homo sapiens
gccagggaggcagag

SEQ ID NO: 3530001 - DNA, 13 bp, Homo sapiens
gccagttgtcctc

SEQ ID NO: 3530002 - DNA, 22 bp, Homo sapiens
gccatcaccttagaccaccaag

SEQ ID NO: 3530003 - DNA, 18 bp, Homo sapiens
gccatcagccatggccct

SEQ ID NO: 3530004 - DNA, 23 bp, Homo sapiens
gccatggccctcccagtgcctcc

SEQ ID NO: 3530005 - DNA, 17 bp, Homo sapiens
gccatgggtagcctggg

SEQ ID NO: 3530006 - DNA, 15 bp, Homo sapiens
gcccatcttcctgag

SEQ ID NO: 3530007 - DNA, 19 bp, Homo sapiens
gcccatcttcctgagctag

SEQ ID NO: 3530008 - DNA, 13 bp, Homo sapiens
gccccaggggacg

SEQ ID NO: 3530009 - DNA, 17 bp, Homo sapiens
gccccaggggacgtggg

SEQ ID NO: 3530010 - DNA, 15 bp, Homo sapiens
gcccccagagccaca

SEQ ID NO: 3530011 - DNA, 17 bp, Homo sapiens
gcccctaaagatgggag

SEQ ID NO: 3530012 - DNA, 22 bp, Homo sapiens
gcccctaaagatgggaggagac

SEQ ID NO: 3530013 - DNA, 22 bp, Homo sapiens
gcccctgtaaggtttcaatgca

SEQ ID NO: 3530014 - DNA, 14 bp, Homo sapiens
gcccgcgggcacag

SEQ ID NO: 3530015 - DNA, 23 bp, Homo sapiens
gccctaggatatgccctcctggt

SEQ ID NO: 3530016 - DNA, 19 bp, Homo sapiens
gccctgactgtcagggagg

SEQ ID NO: 3530017 - DNA, 21 bp, Homo sapiens
gccctgactgtcagggagggc

SEQ ID NO: 3530018 - DNA, 13 bp, Homo sapiens
gccctgaggggct

SEQ ID NO: 3530019 - DNA, 15 bp, Homo sapiens
gccctgaggggctgg

SEQ ID NO: 3530020 - DNA, 23 bp, Homo sapiens
gccctgcaggctgcaggagggca

SEQ ID NO: 3530021 - DNA, 15 bp, Homo sapiens
gccctgctgccctcc

SEQ ID NO: 3530022 - DNA, 14 bp, Homo sapiens
gccctggtgaccag

SEQ ID NO: 3530023 - DNA, 17 bp, Homo sapiens
gccggctggcctggagg

SEQ ID NO: 3530024 - DNA, 20 bp, Homo sapiens
gccggctggcctggaggctc

SEQ ID NO: 3530025 - DNA, 13 bp, Homo sapiens
gccgtatctgagg

SEQ ID NO: 3530026 - DNA, 20 bp, Homo sapiens
gccgtcagccatcagccatg

SEQ ID NO: 3530027 - DNA, 19 bp, Homo sapiens
gcctcagctcttggtgggc

SEQ ID NO: 3530028 - DNA, 22 bp, Homo sapiens
gcctcagctcttggtgggccca

SEQ ID NO: 3530029 - DNA, 20 bp, Homo sapiens
gcctcaggcactctcctgtc

SEQ ID NO: 3530030 - DNA, 15 bp, Homo sapiens
gcctgactgccaagc

SEQ ID NO: 3530031 - DNA, 20 bp, Homo sapiens
gcgccggggggagggaggag

SEQ ID NO: 3530032 - DNA, 18 bp, Homo sapiens
gcgctggcccccccagcc

SEQ ID NO: 3530033 - DNA, 12 bp, Homo sapiens
gcgggagggagt

SEQ ID NO: 3530034 - DNA, 20 bp, Homo sapiens
gcgggagggagtctcaggag

SEQ ID NO: 3530035 - DNA, 22 bp, Homo sapiens
gcgggagggagtctcaggagga

SEQ ID NO: 3530036 - DNA, 19 bp, Homo sapiens
gcgtgggcatgggcgcaga

SEQ ID NO: 3530037 - DNA, 17 bp, Homo sapiens
gctaccaatctgtgaga

SEQ ID NO: 3530038 - DNA, 23 bp, Homo sapiens
gctatctctcaagagtgctgaga

SEQ ID NO: 3530039 - DNA, 22 bp, Homo sapiens
gctcagtgtgtaatgactgaga

SEQ ID NO: 3530040 - DNA, 21 bp, Homo sapiens
gctcctcggtgttacttccct

SEQ ID NO: 3530041 - DNA, 15 bp, Homo sapiens
gctctaagcagccag

SEQ ID NO: 3530042 - DNA, 16 bp, Homo sapiens
gctctaagcagccagg

SEQ ID NO: 3530043 - DNA, 15 bp, Homo sapiens
gctctgaccctgggc

SEQ ID NO: 3530044 - DNA, 19 bp, Homo sapiens
gctctgttatcagctgggc

SEQ ID NO: 3530045 - DNA, 22 bp, Homo sapiens
gctctgttatcagctgggcagt

SEQ ID NO: 3530046 - DNA, 22 bp, Homo sapiens
gctcttggggttcataggggca

SEQ ID NO: 3530047 - DNA, 13 bp, Homo sapiens
gctgaaaatgtgt

SEQ ID NO: 3530048 - DNA, 13 bp, Homo sapiens
gctgacttcccaa

SEQ ID NO: 3530049 - DNA, 20 bp, Homo sapiens
tgactcgggggctgtctcag

SEQ ID NO: 3530050 - DNA, 22 bp, Homo sapiens
tgactcgggggctgtctcagac

SEQ ID NO: 3530051 - DNA, 21 bp, Homo sapiens
tgactgacccaaaatgtgaat

SEQ ID NO: 3530052 - DNA, 22 bp, Homo sapiens
tgactgacccaaaatgtgaatg

SEQ ID NO: 3530053 - DNA, 21 bp, Homo sapiens
tgactgagatttgtaaatctt

SEQ ID NO: 3530054 - DNA, 14 bp, Homo sapiens
tgactgccaagcca

SEQ ID NO: 3530055 - DNA, 16 bp, Homo sapiens
tgactgccaagccatg

SEQ ID NO: 3530056 - DNA, 17 bp, Homo sapiens
tgactgccaagccatgg

SEQ ID NO: 3530057 - DNA, 15 bp, Homo sapiens
tgactgtcagggagg

SEQ ID NO: 3530058 - DNA, 13 bp, Homo sapiens
tgacttcccaagc

SEQ ID NO: 3530059 - DNA, 19 bp, Homo sapiens
tgagaccttccttttactt

SEQ ID NO: 3530060 - DNA, 15 bp, Homo sapiens
tgagaggggagggag

SEQ ID NO: 3530061 - DNA, 16 bp, Homo sapiens
tgagaggggagggagg

SEQ ID NO: 3530062 - DNA, 18 bp, Homo sapiens
tgagatttgtaaatcttt

SEQ ID NO: 3530063 - DNA, 22 bp, Homo sapiens
tgagatttttcatgtatcttat

SEQ ID NO: 3530064 - DNA, 20 bp, Homo sapiens
tgagctcttgctatctctca

SEQ ID NO: 3530065 - DNA, 12 bp, Homo sapiens
tgagctgctgtt

SEQ ID NO: 3530066 - DNA, 12 bp, Homo sapiens
tgaggaccaggg

SEQ ID NO: 3530067 - DNA, 16 bp, Homo sapiens
tgagggctgctcccct

SEQ ID NO: 3530068 - DNA, 17 bp, Homo sapiens
tgaggggacccagcgcc

SEQ ID NO: 3530069 - DNA, 17 bp, Homo sapiens
tgaggggacgggcaagt

SEQ ID NO: 3530070 - DNA, 17 bp, Homo sapiens
tgagtactcataaagga

SEQ ID NO: 3530071 - DNA, 13 bp, Homo sapiens
tgatccccacgcc

SEQ ID NO: 3530072 - DNA, 23 bp, Homo sapiens
tgatgggcttttgttctgagggg

SEQ ID NO: 3530073 - DNA, 23 bp, Homo sapiens
tgatggtgttggtgaaaataaga

SEQ ID NO: 3530074 - DNA, 15 bp, Homo sapiens
tgatttttcatatgt

SEQ ID NO: 3530075 - DNA, 24 bp, Homo sapiens
tgcaaagggattactagagaaaga

SEQ ID NO: 3530076 - DNA, 15 bp, Homo sapiens
tgcaacatataaagt

SEQ ID NO: 3530077 - DNA, 22 bp, Homo sapiens
tgcacatttgaattcatttgct

SEQ ID NO: 3530078 - DNA, 17 bp, Homo sapiens
tgcagccagaaaggaac

SEQ ID NO: 3530079 - DNA, 15 bp, Homo sapiens
tgcaggagggcactg

SEQ ID NO: 3530080 - DNA, 15 bp, Homo sapiens
tgcaggctgcaggag

SEQ ID NO: 3530081 - DNA, 17 bp, Homo sapiens
tgcaggctgcaggaggg

SEQ ID NO: 3530082 - DNA, 23 bp, Homo sapiens
tgcaggtggggtgatggccagag

SEQ ID NO: 3530083 - DNA, 15 bp, Homo sapiens
tgcagtcatgagaat

SEQ ID NO: 3530084 - DNA, 20 bp, Homo sapiens
tgcagttctttggctgaaag

SEQ ID NO: 3530085 - DNA, 14 bp, Homo sapiens
tgcatacaataaaa

SEQ ID NO: 3530086 - DNA, 20 bp, Homo sapiens
tgcatacaataaaagagctt

SEQ ID NO: 3530087 - DNA, 22 bp, Homo sapiens
tgcatacaataaaagagcttta

SEQ ID NO: 3530088 - DNA, 15 bp, Homo sapiens
tgcattaaaattaaa

SEQ ID NO: 3530089 - DNA, 16 bp, Homo sapiens
tgcccatatggtcatc

SEQ ID NO: 3530090 - DNA, 14 bp, Homo sapiens
tgcccccagagcca

SEQ ID NO: 3530091 - DNA, 16 bp, Homo sapiens
tgcccccagagccaca

SEQ ID NO: 3530092 - DNA, 17 bp, Homo sapiens
tgcccccagagccacag

SEQ ID NO: 3530093 - DNA, 19 bp, Homo sapiens
tgcccctaaagatgggagg

SEQ ID NO: 3530094 - DNA, 20 bp, Homo sapiens
tgcccctaaagatgggagga

SEQ ID NO: 3530095 - DNA, 22 bp, Homo sapiens
tgcccctgtaaggtttcaatgc

SEQ ID NO: 3530096 - DNA, 14 bp, Homo sapiens
tgccctcctggtga

SEQ ID NO: 3530097 - DNA, 12 bp, Homo sapiens
tgcctctgagag

SEQ ID NO: 3530098 - DNA, 19 bp, Homo sapiens
tgctaaagattgttaaatt

SEQ ID NO: 3530099 - DNA, 22 bp, Homo sapiens
tgctaaagattgttaaattcaa

SEQ ID NO: 3530100 - DNA, 18 bp, Homo sapiens
tgctaccaatctgtgaga

SEQ ID NO: 3530101 - DNA, 15 bp, Homo sapiens
tgctcagtgtgtaat

SEQ ID NO: 3530102 - DNA, 22 bp, Homo sapiens
tgctctaggcccacaagtgtaa

SEQ ID NO: 3530103 - DNA, 13 bp, Homo sapiens
tgctgaccctccc

SEQ ID NO: 3530104 - DNA, 22 bp, Homo sapiens
tgctgaccggaatggtcaaatc

SEQ ID NO: 3530105 - DNA, 13 bp, Homo sapiens
tgctgacttccca

SEQ ID NO: 3530106 - DNA, 15 bp, Homo sapiens
tgctgacttcccaag

SEQ ID NO: 3530107 - DNA, 16 bp, Homo sapiens
tgctgacttcccaagc

SEQ ID NO: 3530108 - DNA, 21 bp, Homo sapiens
tgctgacttcccaagccctgg

SEQ ID NO: 3530109 - DNA, 20 bp, Homo sapiens
tgctgatctctgtagaatct

SEQ ID NO: 3530110 - DNA, 17 bp, Homo sapiens
tgctggtagctgagggg

SEQ ID NO: 3530111 - DNA, 15 bp, Homo sapiens
tgctgtgggaaaaat

SEQ ID NO: 3530112 - DNA, 20 bp, Homo sapiens
tgctgtgtggacggcgctgc

SEQ ID NO: 3530113 - DNA, 16 bp, Homo sapiens
tgctgttagaatatgt

SEQ ID NO: 3530114 - DNA, 12 bp, Homo sapiens
tgctgtttgtac

SEQ ID NO: 3530115 - DNA, 17 bp, Homo sapiens
tgcttcactctatccaa

SEQ ID NO: 3530116 - DNA, 15 bp, Homo sapiens
tgcttttatcagtgt

SEQ ID NO: 3530117 - DNA, 14 bp, Homo sapiens
tgcttttgtgtccc

SEQ ID NO: 3530118 - DNA, 16 bp, Homo sapiens
tgcttttgtgtcccat

SEQ ID NO: 3530119 - DNA, 13 bp, Homo sapiens
tggaaaaataaaa

SEQ ID NO: 3530120 - DNA, 17 bp, Homo sapiens
tggaaagaacatttaaa

SEQ ID NO: 3530121 - DNA, 19 bp, Homo sapiens
tggaagtggggcgggcttc

SEQ ID NO: 3530122 - DNA, 23 bp, Homo sapiens
tggacaacactaattgtccacag

SEQ ID NO: 3530123 - DNA, 23 bp, Homo sapiens
tggacggcgctgcctcaggcact

SEQ ID NO: 3530124 - DNA, 18 bp, Homo sapiens
tggactccacgatgcctt

SEQ ID NO: 3530125 - DNA, 21 bp, Homo sapiens
tggactccacgatgcctttga

SEQ ID NO: 3530126 - DNA, 21 bp, Homo sapiens
tggactgagtttgggttctct

SEQ ID NO: 3530127 - DNA, 17 bp, Homo sapiens
tggagaccgaggccaga

SEQ ID NO: 3530128 - DNA, 20 bp, Homo sapiens
tggagctgagaagaggagga

SEQ ID NO: 3530129 - DNA, 23 bp, Homo sapiens
tggagctgagaagaggaggaggt

SEQ ID NO: 3530130 - DNA, 14 bp, Homo sapiens
tggagctgggaggt

SEQ ID NO: 3530131 - DNA, 15 bp, Homo sapiens
tggaggctcagccca

SEQ ID NO: 3530132 - DNA, 20 bp, Homo sapiens
tggaggtgctggtagctgag

SEQ ID NO: 3530133 - DNA, 15 bp, Homo sapiens
tggatctccccctca

SEQ ID NO: 3530134 - DNA, 17 bp, Homo sapiens
tggccacgttcagggag

SEQ ID NO: 3530135 - DNA, 18 bp, Homo sapiens
tggccacgttcagggagg

SEQ ID NO: 3530136 - DNA, 20 bp, Homo sapiens
tggcccccccagccccacac

SEQ ID NO: 3530137 - DNA, 21 bp, Homo sapiens
tggccctgactgtcagggagg

SEQ ID NO: 3530138 - DNA, 19 bp, Homo sapiens
tggccgtatctgagggctg

SEQ ID NO: 3530139 - DNA, 17 bp, Homo sapiens
tgggaccaaagggggag

SEQ ID NO: 3530140 - DNA, 21 bp, Homo sapiens
tgggacctgccctccctcagc

SEQ ID NO: 3530141 - DNA, 15 bp, Homo sapiens
tgggaggatcctgag

SEQ ID NO: 3530142 - DNA, 20 bp, Homo sapiens
tgggaggtctcgtcccagcc

SEQ ID NO: 3530143 - DNA, 23 bp, Homo sapiens
tgggcccagggacacccacacag

SEQ ID NO: 3530144 - DNA, 21 bp, Homo sapiens
tgggccttaactgttgttgac

SEQ ID NO: 3530145 - DNA, 17 bp, Homo sapiens
tgggccttgtgacaatc

SEQ ID NO: 3530146 - DNA, 22 bp, Homo sapiens
tgggcttttgttctgaggggtg

SEQ ID NO: 3530147 - DNA, 14 bp, Homo sapiens
tggggaaacaattt

SEQ ID NO: 3530148 - DNA, 14 bp, Homo sapiens
tggggacccagact

SEQ ID NO: 3530149 - DNA, 17 bp, Homo sapiens
tggggcccctcccctcc

SEQ ID NO: 3530150 - DNA, 18 bp, Homo sapiens
tgggggctggaggtgctg

SEQ ID NO: 3530151 - DNA, 16 bp, Homo sapiens
tggggtatgttctggg

SEQ ID NO: 3530152 - DNA, 19 bp, Homo sapiens
tggggttcataggggcagg

SEQ ID NO: 3530153 - DNA, 21 bp, Homo sapiens
tgggtaattaaaaacagaaaa

SEQ ID NO: 3530154 - DNA, 15 bp, Homo sapiens
tggtagctgagggga

SEQ ID NO: 3530155 - DNA, 16 bp, Homo sapiens
tggtgaccagaccaag

SEQ ID NO: 3530156 - DNA, 23 bp, Homo sapiens
tggtgactcgggggctgtctcag

SEQ ID NO: 3530157 - DNA, 11 bp, Homo sapiens
tggtgcaatat

SEQ ID NO: 3530158 - DNA, 12 bp, Homo sapiens
aatatagatgtt

SEQ ID NO: 3530159 - DNA, 13 bp, Homo sapiens
aatatagatgtta

SEQ ID NO: 3530160 - DNA, 12 bp, Homo sapiens
aatatattatga

SEQ ID NO: 3530161 - DNA, 16 bp, Homo sapiens
aatatattatgaaaat

SEQ ID NO: 3530162 - DNA, 17 bp, Homo sapiens
aatatattatgaaaatt

SEQ ID NO: 3530163 - DNA, 19 bp, Homo sapiens
aatatattatgaaaattaa

SEQ ID NO: 3530164 - DNA, 14 bp, Homo sapiens
aatatttttaacaa

SEQ ID NO: 3530165 - DNA, 20 bp, Homo sapiens
aatcactgtggggaaacaat

SEQ ID NO: 3530166 - DNA, 18 bp, Homo sapiens
aatctcgttgaggccaag

SEQ ID NO: 3530167 - DNA, 20 bp, Homo sapiens
aatctctccacctctagtca

SEQ ID NO: 3530168 - DNA, 18 bp, Homo sapiens
aatctgctgatctctgta

SEQ ID NO: 3530169 - DNA, 18 bp, Homo sapiens
aatctgggtaattaaaaa

SEQ ID NO: 3530170 - DNA, 14 bp, Homo sapiens
aatctgtgagaagt

SEQ ID NO: 3530171 - DNA, 16 bp, Homo sapiens
aatctgtgagaagttt

SEQ ID NO: 3530172 - DNA, 17 bp, Homo sapiens
aatctttgtgaacattc

SEQ ID NO: 3530173 - DNA, 21 bp, Homo sapiens
aatctttgtgaacattctgta

SEQ ID NO: 3530174 - DNA, 18 bp, Homo sapiens
aatgaaatatagatgtta

SEQ ID NO: 3530175 - DNA, 22 bp, Homo sapiens
aatgactgacccaaaatgtgaa

SEQ ID NO: 3530176 - DNA, 12 bp, Homo sapiens
aatgactgagat

SEQ ID NO: 3530177 - DNA, 16 bp, Homo sapiens
aatgcatacaataaaa

SEQ ID NO: 3530178 - DNA, 22 bp, Homo sapiens
aatgcatacaataaaagagctt

SEQ ID NO: 3530179 - DNA, 23 bp, Homo sapiens
aatgcatacaataaaagagcttt

SEQ ID NO: 3530180 - DNA, 20 bp, Homo sapiens
aatgctgagccagccatctt

SEQ ID NO: 3530181 - DNA, 20 bp, Homo sapiens
aatgggggctttcggggagg

SEQ ID NO: 3530182 - DNA, 23 bp, Homo sapiens
aatgggggctttcggggagggcg

SEQ ID NO: 3530183 - DNA, 13 bp, Homo sapiens
aatgtaaatttta

SEQ ID NO: 3530184 - DNA, 14 bp, Homo sapiens
aatgtatacttgaa

SEQ ID NO: 3530185 - DNA, 18 bp, Homo sapiens
aatgtgtttaattttgga

SEQ ID NO: 3530186 - DNA, 15 bp, Homo sapiens
aatgttaactttcaa

SEQ ID NO: 3530187 - DNA, 16 bp, Homo sapiens
aattaaataaatttta

SEQ ID NO: 3530188 - DNA, 12 bp, Homo sapiens
aattaaattttt

SEQ ID NO: 3530189 - DNA, 12 bp, Homo sapiens
aattacagaaaa

SEQ ID NO: 3530190 - DNA, 23 bp, Homo sapiens
aattatcttatctactgactgaa

SEQ ID NO: 3530191 - DNA, 18 bp, Homo sapiens
aattattttgataaatta

SEQ ID NO: 3530192 - DNA, 20 bp, Homo sapiens
aattattttgataaattact

SEQ ID NO: 3530193 - DNA, 19 bp, Homo sapiens
aattgtccacagcaaaggg

SEQ ID NO: 3530194 - DNA, 18 bp, Homo sapiens
aatttgggaaaagaagct

SEQ ID NO: 3530195 - DNA, 19 bp, Homo sapiens
aattttagacgatcacaga

SEQ ID NO: 3530196 - DNA, 20 bp, Homo sapiens
aattttagacgatcacagaa

SEQ ID NO: 3530197 - DNA, 17 bp, Homo sapiens
aattttggttgtaatta

SEQ ID NO: 3530198 - DNA, 14 bp, Homo sapiens
acaaactatttcag

SEQ ID NO: 3530199 - DNA, 12 bp, Homo sapiens
acaaatgaagta

SEQ ID NO: 3530200 - DNA, 20 bp, Homo sapiens
acaaatgaagtatttcatgt

SEQ ID NO: 3530201 - DNA, 9 bp, Homo sapiens
acaaatgtg

SEQ ID NO: 3530202 - DNA, 15 bp, Homo sapiens
acaagtcatttcaaa

SEQ ID NO: 3530203 - DNA, 15 bp, Homo sapiens
acaataaaagagctt

SEQ ID NO: 3530204 - DNA, 13 bp, Homo sapiens
acaataaatatac

SEQ ID NO: 3530205 - DNA, 16 bp, Homo sapiens
acaatcagacatgagt

SEQ ID NO: 3530206 - DNA, 20 bp, Homo sapiens
acaattttttgtgatgaaaa

SEQ ID NO: 3530207 - DNA, 15 bp, Homo sapiens
acacaaaatgaataa

SEQ ID NO: 3530208 - DNA, 17 bp, Homo sapiens
acacacagttgttgaat

SEQ ID NO: 3530209 - DNA, 14 bp, Homo sapiens
acaccaaacatttc

SEQ ID NO: 3530210 - DNA, 14 bp, Homo sapiens
acaccgtggggaag

SEQ ID NO: 3530211 - DNA, 17 bp, Homo sapiens
acactaattgtccacag

SEQ ID NO: 3530212 - DNA, 19 bp, Homo sapiens
acactcatgcattgtcctc

SEQ ID NO: 3530213 - DNA, 17 bp, Homo sapiens
acactggatcaagttca

SEQ ID NO: 3530214 - DNA, 23 bp, Homo sapiens
acactggatcaagttcagccacc

SEQ ID NO: 3530215 - DNA, 18 bp, Homo sapiens
acacttaaacttgcacat

SEQ ID NO: 3530216 - DNA, 20 bp, Homo sapiens
acagaaacggtctttatgaa

SEQ ID NO: 3530217 - DNA, 13 bp, Homo sapiens
acagagactctcc

SEQ ID NO: 3530218 - DNA, 17 bp, Homo sapiens
acagagactctccctga

SEQ ID NO: 3530219 - DNA, 12 bp, Homo sapiens
acagagccactc

SEQ ID NO: 3530220 - DNA, 14 bp, Homo sapiens
acagagccactctt

SEQ ID NO: 3530221 - DNA, 14 bp, Homo sapiens
acatcataagatag

SEQ ID NO: 3530222 - DNA, 22 bp, Homo sapiens
acatctcccccatagcaccctg

SEQ ID NO: 3530223 - DNA, 14 bp, Homo sapiens
acatttaaaattaa

SEQ ID NO: 3530224 - DNA, 16 bp, Homo sapiens
acatttaaaattaaat

SEQ ID NO: 3530225 - DNA, 19 bp, Homo sapiens
acatttctgtgaaactatc

SEQ ID NO: 3530226 - DNA, 11 bp, Homo sapiens
acattttctcc

SEQ ID NO: 3530227 - DNA, 17 bp, Homo sapiens
acattttctccctggat

SEQ ID NO: 3530228 - DNA, 21 bp, Homo sapiens
accaaaaaaaagcatgaatat

SEQ ID NO: 3530229 - DNA, 23 bp, Homo sapiens
accaaaaaaaagcatgaatattt

SEQ ID NO: 3530230 - DNA, 14 bp, Homo sapiens
accaaacatttctg

SEQ ID NO: 3530231 - DNA, 16 bp, Homo sapiens
accaaacatttctgtg

SEQ ID NO: 3530232 - DNA, 16 bp, Homo sapiens
accaaagcaatcatta

SEQ ID NO: 3530233 - DNA, 12 bp, Homo sapiens
accaagccttga

SEQ ID NO: 3530234 - DNA, 18 bp, Homo sapiens
accacatggccttgcctc

SEQ ID NO: 3530235 - DNA, 15 bp, Homo sapiens
accaccaagccttga

SEQ ID NO: 3530236 - DNA, 22 bp, Homo sapiens
accagaaagggaacagtccata

SEQ ID NO: 3530237 - DNA, 21 bp, Homo sapiens
accatcttacagagactctcc

SEQ ID NO: 3530238 - DNA, 14 bp, Homo sapiens
acccatagggagct

SEQ ID NO: 3530239 - DNA, 16 bp, Homo sapiens
accctagaagaaaacc

SEQ ID NO: 3530240 - DNA, 18 bp, Homo sapiens
accctagaagaaaacccg

SEQ ID NO: 3530241 - DNA, 22 bp, Homo sapiens
accctccagcttttcctcaggg

SEQ ID NO: 3530242 - DNA, 12 bp, Homo sapiens
accctctgaaga

SEQ ID NO: 3530243 - DNA, 20 bp, Homo sapiens
acccttctccaaaggctctg

SEQ ID NO: 3530244 - DNA, 21 bp, Homo sapiens
accctttcatagagaggcctg

SEQ ID NO: 3530245 - DNA, 16 bp, Homo sapiens
accgtggggaaggggt

SEQ ID NO: 3530246 - DNA, 13 bp, Homo sapiens
acctccactcagc

SEQ ID NO: 3530247 - DNA, 16 bp, Homo sapiens
acctccactcagcact

SEQ ID NO: 3530248 - DNA, 17 bp, Homo sapiens
acctcctgtgggcctca

SEQ ID NO: 3530249 - DNA, 14 bp, Homo sapiens
acctctgcttctga

SEQ ID NO: 3530250 - DNA, 15 bp, Homo sapiens
actatttcagaatat

SEQ ID NO: 3530251 - DNA, 15 bp, Homo sapiens
actcataaaggacac

SEQ ID NO: 3530252 - DNA, 16 bp, Homo sapiens
actcataaaggacact

SEQ ID NO: 3530253 - DNA, 23 bp, Homo sapiens
actcattcttcggtctgaatttt

SEQ ID NO: 3530254 - DNA, 21 bp, Homo sapiens
actcctgttagtagcagaaat

SEQ ID NO: 3530255 - DNA, 23 bp, Homo sapiens
actcctgttagtagcagaaatat

SEQ ID NO: 3530256 - DNA, 22 bp, Homo sapiens
actccttggtgctaaagattgt

SEQ ID NO: 3530257 - DNA, 14 bp, Homo sapiens
actcgggggctgtc

SEQ ID NO: 3530258 - DNA, 22 bp, Homo sapiens
actctggactccacgatgcctt

SEQ ID NO: 3530259 - DNA, 18 bp, Homo sapiens
actcttagactgagtaaa

SEQ ID NO: 3530260 - DNA, 20 bp, Homo sapiens
actcttcaagtagattggct

SEQ ID NO: 3530261 - DNA, 17 bp, Homo sapiens
actgaaaaaatgctgag

SEQ ID NO: 3530262 - DNA, 20 bp, Homo sapiens
actgaaaaaatgctgagcca

SEQ ID NO: 3530263 - DNA, 18 bp, Homo sapiens
actgacccaaaatgtgaa

SEQ ID NO: 3530264 - DNA, 16 bp, Homo sapiens
actgagatttgtaaat

SEQ ID NO: 3530265 - DNA, 19 bp, Homo sapiens
actgagatttgtaaatctt

SEQ ID NO: 3530266 - DNA, 14 bp, Homo sapiens
actgagtaaagtgt

SEQ ID NO: 3530267 - DNA, 22 bp, Homo sapiens
actgcttgctaccaatctgtga

SEQ ID NO: 3530268 - DNA, 15 bp, Homo sapiens
actggaaataaagta

SEQ ID NO: 3530269 - DNA, 19 bp, Homo sapiens
actggtttgaaatttttga

SEQ ID NO: 3530270 - DNA, 14 bp, Homo sapiens
actgtcagggaggg

SEQ ID NO: 3530271 - DNA, 15 bp, Homo sapiens
actgtcagggagggc

SEQ ID NO: 3530272 - DNA, 18 bp, Homo sapiens
actgtcagggagggccag

SEQ ID NO: 3530273 - DNA, 23 bp, Homo sapiens
actgtcagggagggccagggagg

SEQ ID NO: 3530274 - DNA, 18 bp, Homo sapiens
acttaaacttgcacattt

SEQ ID NO: 3530275 - DNA, 21 bp, Homo sapiens
acttatgaagtaaagtttctg

SEQ ID NO: 3530276 - DNA, 22 bp, Homo sapiens
acttatgaagtaaagtttctga

SEQ ID NO: 3530277 - DNA, 19 bp, Homo sapiens
acttcccaagccctggtga

SEQ ID NO: 3530278 - DNA, 11 bp, Homo sapiens
acttccctttc

SEQ ID NO: 3530279 - DNA, 18 bp, Homo sapiens
acttctggtgctgctggg

SEQ ID NO: 3530280 - DNA, 16 bp, Homo sapiens
acttgcacatttgaat

SEQ ID NO: 3530281 - DNA, 14 bp, Homo sapiens
actttcaaatccac

SEQ ID NO: 3530282 - DNA, 16 bp, Homo sapiens
agaaaccttccagaga

SEQ ID NO: 3530283 - DNA, 18 bp, Homo sapiens
agaaaccttccagagaac

SEQ ID NO: 3530284 - DNA, 21 bp, Homo sapiens
agaaacggtctttatgaatta

SEQ ID NO: 3530285 - DNA, 22 bp, Homo sapiens
agaaacggtctttatgaattat

SEQ ID NO: 3530286 - DNA, 20 bp, Homo sapiens
agaaatatattatgaaaatt

SEQ ID NO: 3530287 - DNA, 16 bp, Homo sapiens
agaacatttaaaatta

SEQ ID NO: 3530288 - DNA, 23 bp, Homo sapiens
agaacatttaaaattaaataaat

SEQ ID NO: 3530289 - DNA, 15 bp, Homo sapiens
agaactataacattc

SEQ ID NO: 3530290 - DNA, 15 bp, Homo sapiens
agaagaggaggaggt

SEQ ID NO: 3530291 - DNA, 22 bp, Homo sapiens
agaagggaattaggctttagat

SEQ ID NO: 3530292 - DNA, 22 bp, Homo sapiens
agaaggtgggaggatgtgaatt

SEQ ID NO: 3530293 - DNA, 23 bp, Homo sapiens
agaagtttttgtttttgttttgt

SEQ ID NO: 3530294 - DNA, 12 bp, Homo sapiens
agaatgttttgg

SEQ ID NO: 3530295 - DNA, 17 bp, Homo sapiens
agaattacagaaaattt

SEQ ID NO: 3530296 - DNA, 17 bp, Homo sapiens
agaatttcaaggcaggg

SEQ ID NO: 3530297 - DNA, 16 bp, Homo sapiens
agaatttgtatcatgt

SEQ ID NO: 3530298 - DNA, 13 bp, Homo sapiens
agacaaaatgtga

SEQ ID NO: 3530299 - DNA, 13 bp, Homo sapiens
agaccaccaagcc

SEQ ID NO: 3530300 - DNA, 19 bp, Homo sapiens
agaccagaaaccttccaga

SEQ ID NO: 3530301 - DNA, 16 bp, Homo sapiens
agaccagatccaagat

SEQ ID NO: 3530302 - DNA, 13 bp, Homo sapiens
agagaggtggcca

SEQ ID NO: 3530303 - DNA, 19 bp, Homo sapiens
agagatcaccatgacttga

SEQ ID NO: 3530304 - DNA, 15 bp, Homo sapiens
agagcatcaggccta

SEQ ID NO: 3530305 - DNA, 11 bp, Homo sapiens
agagccacagt

SEQ ID NO: 3530306 - DNA, 15 bp, Homo sapiens
agagcgggagggagt

SEQ ID NO: 3530307 - DNA, 17 bp, Homo sapiens
agaggcttttccagtgt

SEQ ID NO: 3530308 - DNA, 20 bp, Homo sapiens
agagtaatttgggaaaagaa

SEQ ID NO: 3530309 - DNA, 15 bp, Homo sapiens
agagtagtcagaact

SEQ ID NO: 3530310 - DNA, 15 bp, Homo sapiens
agagtataattttgg

SEQ ID NO: 3530311 - DNA, 14 bp, Homo sapiens
agagtgctgagaac

SEQ ID NO: 3530312 - DNA, 19 bp, Homo sapiens
agatacccatcttgaaaaa

SEQ ID NO: 3530313 - DNA, 22 bp, Homo sapiens
agatagcccatcttcctgagct

SEQ ID NO: 3530314 - DNA, 23 bp, Homo sapiens
agatagcccatcttcctgagcta

SEQ ID NO: 3530315 - DNA, 22 bp, Homo sapiens
agatgctcttggggttcatagg

SEQ ID NO: 3530316 - DNA, 17 bp, Homo sapiens
agatgggaggagaccag

SEQ ID NO: 3530317 - DNA, 20 bp, Homo sapiens
agatgggaggagaccagcgg

SEQ ID NO: 3530318 - DNA, 11 bp, Homo sapiens
agatggtggat

SEQ ID NO: 3530319 - DNA, 19 bp, Homo sapiens
agatgttttatttatgaag

SEQ ID NO: 3530320 - DNA, 14 bp, Homo sapiens
agattcaggggaag

SEQ ID NO: 3530321 - DNA, 14 bp, Homo sapiens
agattccacaggac

SEQ ID NO: 3530322 - DNA, 17 bp, Homo sapiens
agattgttaaattcaat

SEQ ID NO: 3530323 - DNA, 20 bp, Homo sapiens
agcaatgttccaggaatgaa

SEQ ID NO: 3530324 - DNA, 18 bp, Homo sapiens
agcacaataaatatactt

SEQ ID NO: 3530325 - DNA, 19 bp, Homo sapiens
agcacaggttccagtactg

SEQ ID NO: 3530326 - DNA, 23 bp, Homo sapiens
agcaccctgccctcatgggacct

SEQ ID NO: 3530327 - DNA, 17 bp, Homo sapiens
agcagaagaccagatcc

SEQ ID NO: 3530328 - DNA, 18 bp, Homo sapiens
agcagaagaccagatcca

SEQ ID NO: 3530329 - DNA, 13 bp, Homo sapiens
agcagaggcagtg

SEQ ID NO: 3530330 - DNA, 19 bp, Homo sapiens
agcagaggcagtggccacg

SEQ ID NO: 3530331 - DNA, 15 bp, Homo sapiens
agcagattccacagg

SEQ ID NO: 3530332 - DNA, 14 bp, Homo sapiens
agcagccaggaggg

SEQ ID NO: 3530333 - DNA, 16 bp, Homo sapiens
agcagccaggagggac

SEQ ID NO: 3530334 - DNA, 15 bp, Homo sapiens
agcagttaggcacct

SEQ ID NO: 3530335 - DNA, 17 bp, Homo sapiens
agcagttaggcacctta

SEQ ID NO: 3530336 - DNA, 18 bp, Homo sapiens
aggaataatgcggacact

SEQ ID NO: 3530337 - DNA, 14 bp, Homo sapiens
aggacaagttacac

SEQ ID NO: 3530338 - DNA, 19 bp, Homo sapiens
aggacaagttacacctcca

SEQ ID NO: 3530339 - DNA, 14 bp, Homo sapiens
aggagaccagcggt

SEQ ID NO: 3530340 - DNA, 21 bp, Homo sapiens
aggagattctttgagatagcc

SEQ ID NO: 3530341 - DNA, 17 bp, Homo sapiens
aggaggaggtgggggct

SEQ ID NO: 3530342 - DNA, 13 bp, Homo sapiens
aggaggctgccct

SEQ ID NO: 3530343 - DNA, 23 bp, Homo sapiens
aggaggctgccctgaggggctgg

SEQ ID NO: 3530344 - DNA, 23 bp, Homo sapiens
aggagtcttctaatgtaaatttt

SEQ ID NO: 3530345 - DNA, 19 bp, Homo sapiens
aggatcctgagctgctgtt

SEQ ID NO: 3530346 - DNA, 18 bp, Homo sapiens
aggatttccctgaagcta

SEQ ID NO: 3530347 - DNA, 19 bp, Homo sapiens
aggcaccttaactggagac

SEQ ID NO: 3530348 - DNA, 17 bp, Homo sapiens
aggcagagcgggaggga

SEQ ID NO: 3530349 - DNA, 15 bp, Homo sapiens
aggcagcatttgaat

SEQ ID NO: 3530350 - DNA, 17 bp, Homo sapiens
aggcccgcgggcacagc

SEQ ID NO: 3530351 - DNA, 21 bp, Homo sapiens
aggcccgcgggcacagccagc

SEQ ID NO: 3530352 - DNA, 19 bp, Homo sapiens
aggcctgactgccaagcca

SEQ ID NO: 3530353 - DNA, 17 bp, Homo sapiens
aggcctgcttttgtgtc

SEQ ID NO: 3530354 - DNA, 19 bp, Homo sapiens
aggcctgcttttgtgtccc

SEQ ID NO: 3530355 - DNA, 20 bp, Homo sapiens
aggcctgcttttgtgtccca

SEQ ID NO: 3530356 - DNA, 23 bp, Homo sapiens
aggcctgcttttgtgtcccattc

SEQ ID NO: 3530357 - DNA, 21 bp, Homo sapiens
aggctctgttatcagctgggc

SEQ ID NO: 3530358 - DNA, 13 bp, Homo sapiens
aggctgcaggagg

SEQ ID NO: 3530359 - DNA, 15 bp, Homo sapiens
aggctgcaggagggc

SEQ ID NO: 3530360 - DNA, 19 bp, Homo sapiens
aggctgccctgaggggctg

SEQ ID NO: 3530361 - DNA, 16 bp, Homo sapiens
aggctggggacccaga

SEQ ID NO: 3530362 - DNA, 15 bp, Homo sapiens
aggcttttccagtgt

SEQ ID NO: 3530363 - DNA, 14 bp, Homo sapiens
agggagggccaggg

SEQ ID NO: 3530364 - DNA, 18 bp, Homo sapiens
agggagggccagggaggc

SEQ ID NO: 3530365 - DNA, 22 bp, Homo sapiens
agggaggggccggctggcctgg

SEQ ID NO: 3530366 - DNA, 19 bp, Homo sapiens
agggagtctcaggaggagg

SEQ ID NO: 3530367 - DNA, 23 bp, Homo sapiens
agggccccaggcccgcgggcaca

SEQ ID NO: 3530368 - DNA, 22 bp, Homo sapiens
agggcgtgggcatgggcgcaga

SEQ ID NO: 3530369 - DNA, 11 bp, Homo sapiens
aggggaagggc

SEQ ID NO: 3530370 - DNA, 12 bp, Homo sapiens
aggggacccagc

SEQ ID NO: 3530371 - DNA, 16 bp, Homo sapiens
aggggacccagcgccg

SEQ ID NO: 3530372 - DNA, 18 bp, Homo sapiens
aggggacgtgggccctgc

SEQ ID NO: 3530373 - DNA, 15 bp, Homo sapiens
aggggccggctggcc

SEQ ID NO: 3530374 - DNA, 15 bp, Homo sapiens
aggggctggggaggg

SEQ ID NO: 3530375 - DNA, 22 bp, Homo sapiens
aggggctggggagggggtacct

SEQ ID NO: 3530376 - DNA, 23 bp, Homo sapiens
agggggcccctttgctgaccctc

SEQ ID NO: 3530377 - DNA, 15 bp, Homo sapiens
agggtgtcctgaggt

SEQ ID NO: 3530378 - DNA, 14 bp, Homo sapiens
aggtctttcagaag

SEQ ID NO: 3530379 - DNA, 17 bp, Homo sapiens
aggtgaaacattttctc

SEQ ID NO: 3530380 - DNA, 13 bp, Homo sapiens
aggtgatctcctg

SEQ ID NO: 3530381 - DNA, 14 bp, Homo sapiens
aggtgatctcctgt

SEQ ID NO: 3530382 - DNA, 17 bp, Homo sapiens
aggtgctggtagctgag

SEQ ID NO: 3530383 - DNA, 23 bp, Homo sapiens
aggtgctggtagctgaggggacg

SEQ ID NO: 3530384 - DNA, 20 bp, Homo sapiens
aggtgggaggatgtgaattg

SEQ ID NO: 3530385 - DNA, 17 bp, Homo sapiens
aggtggggtgatggcca

SEQ ID NO: 3530386 - DNA, 21 bp, Homo sapiens
aggtggggtgatggccagagg

SEQ ID NO: 3530387 - DNA, 22 bp, Homo sapiens
aggtgttgttaaaacacaaaat

SEQ ID NO: 3530388 - DNA, 18 bp, Homo sapiens
agtaacgttttccttgtg

SEQ ID NO: 3530389 - DNA, 14 bp, Homo sapiens
agtagcagaaatat

SEQ ID NO: 3530390 - DNA, 17 bp, Homo sapiens
agtagcagaaatatatt

SEQ ID NO: 3530391 - DNA, 12 bp, Homo sapiens
agtaggaaagaa

SEQ ID NO: 3530392 - DNA, 15 bp, Homo sapiens
agtagtcagaactat

SEQ ID NO: 3530393 - DNA, 20 bp, Homo sapiens
agtatctcaacaacatgtca

SEQ ID NO: 3530394 - DNA, 17 bp, Homo sapiens
agtccaccctttggaga

SEQ ID NO: 3530395 - DNA, 18 bp, Homo sapiens
agtcccaccctatggcca

SEQ ID NO: 3530396 - DNA, 24 bp, Homo sapiens
agtctcacatgattccagccatca

SEQ ID NO: 3530397 - DNA, 15 bp, Homo sapiens
agtctccccttgcag

SEQ ID NO: 3530398 - DNA, 23 bp, Homo sapiens
agtctgttttcccaacctcctgt

SEQ ID NO: 3530399 - DNA, 18 bp, Homo sapiens
agtgaagctcccttcagg

SEQ ID NO: 3530400 - DNA, 15 bp, Homo sapiens
agtgagaggggaggg

SEQ ID NO: 3530401 - DNA, 19 bp, Homo sapiens
agtgagaggggagggaggg

SEQ ID NO: 3530402 - DNA, 18 bp, Homo sapiens
agtgctctgaccctgggc

SEQ ID NO: 3530403 - DNA, 16 bp, Homo sapiens
agtgtgaccagttttg

SEQ ID NO: 3530404 - DNA, 21 bp, Homo sapiens
agttcttagattcaggggaag

SEQ ID NO: 3530405 - DNA, 17 bp, Homo sapiens
agttctttggctgaaag

SEQ ID NO: 3530406 - DNA, 14 bp, Homo sapiens
agttgcaagatctt

SEQ ID NO: 3530407 - DNA, 21 bp, Homo sapiens
agttgtctaaaggatgagatt

SEQ ID NO: 3530408 - DNA, 14 bp, Homo sapiens
agttgttgaatgac

SEQ ID NO: 3530409 - DNA, 21 bp, Homo sapiens
agtttttattttaaacatttt

SEQ ID NO: 3530410 - DNA, 16 bp, Homo sapiens
ataaacccattttggt

SEQ ID NO: 3530411 - DNA, 14 bp, Homo sapiens
ataaagtaggaaag

SEQ ID NO: 3530412 - DNA, 17 bp, Homo sapiens
ataaagtaggaaagaat

SEQ ID NO: 3530413 - DNA, 17 bp, Homo sapiens
ataacatatttattgtg

SEQ ID NO: 3530414 - DNA, 19 bp, Homo sapiens
ataacttacctctgcttct

SEQ ID NO: 3530415 - DNA, 17 bp, Homo sapiens
ataagtgtgaccagttt

SEQ ID NO: 3530416 - DNA, 19 bp, Homo sapiens
ataagtgtgaccagttttg

SEQ ID NO: 3530417 - DNA, 23 bp, Homo sapiens
ataagtgtgaccagttttgatat

SEQ ID NO: 3530418 - DNA, 19 bp, Homo sapiens
ataatgcggacacttttga

SEQ ID NO: 3530419 - DNA, 22 bp, Homo sapiens
ataatgcggacacttttgagga

SEQ ID NO: 3530420 - DNA, 16 bp, Homo sapiens
ataattttggttgtaa

SEQ ID NO: 3530421 - DNA, 13 bp, Homo sapiens
atacaataaaaga

SEQ ID NO: 3530422 - DNA, 14 bp, Homo sapiens
atacaataaaagag

SEQ ID NO: 3530423 - DNA, 16 bp, Homo sapiens
atacaataaaagagct

SEQ ID NO: 3530424 - DNA, 20 bp, Homo sapiens
atacaataaaagagctttat

SEQ ID NO: 3530425 - DNA, 14 bp, Homo sapiens
atacaccaaacatt

SEQ ID NO: 3530426 - DNA, 16 bp, Homo sapiens
atacaccaaacatttc

SEQ ID NO: 3530427 - DNA, 18 bp, Homo sapiens
atacaccaaacatttctg

SEQ ID NO: 3530428 - DNA, 22 bp, Homo sapiens
atacacttaaacttgcacattt

SEQ ID NO: 3530429 - DNA, 21 bp, Homo sapiens
atacaggagttttcactttct

SEQ ID NO: 3530430 - DNA, 19 bp, Homo sapiens
ataccctagaagaaaaccc

SEQ ID NO: 3530431 - DNA, 20 bp, Homo sapiens
ataccctagaagaaaacccg

SEQ ID NO: 3530432 - DNA, 19 bp, Homo sapiens
atacttgaaaaatgttata

SEQ ID NO: 3530433 - DNA, 19 bp, Homo sapiens
atagagaggcctgctttgt

SEQ ID NO: 3530434 - DNA, 17 bp, Homo sapiens
atagcaatgttccagga

SEQ ID NO: 3530435 - DNA, 14 bp, Homo sapiens
ataggttaattttt

SEQ ID NO: 3530436 - DNA, 15 bp, Homo sapiens
atagtagtctttaaa

SEQ ID NO: 3530437 - DNA, 15 bp, Homo sapiens
atagttacatttatg

SEQ ID NO: 3530438 - DNA, 13 bp, Homo sapiens
atataaaatttca

SEQ ID NO: 3530439 - DNA, 16 bp, Homo sapiens
atatgccctcctggtg

SEQ ID NO: 3530440 - DNA, 13 bp, Homo sapiens
atatgtggaaata

SEQ ID NO: 3530441 - DNA, 20 bp, Homo sapiens
atattatgaaaattaagatt

SEQ ID NO: 3530442 - DNA, 23 bp, Homo sapiens
atatttattgtgcattaaaatta

SEQ ID NO: 3530443 - DNA, 12 bp, Homo sapiens
atatttttaaca

SEQ ID NO: 3530444 - DNA, 23 bp, Homo sapiens
atcacagagccactcttcaagta

SEQ ID NO: 3530445 - DNA, 20 bp, Homo sapiens
atcaccttagaccaccaagc

SEQ ID NO: 3530446 - DNA, 17 bp, Homo sapiens
atcactagagtgctctg

SEQ ID NO: 3530447 - DNA, 21 bp, Homo sapiens
ccccaggcccgcgggcacagc

SEQ ID NO: 3530448 - DNA, 16 bp, Homo sapiens
cccccagagccacagt

SEQ ID NO: 3530449 - DNA, 17 bp, Homo sapiens
cccctaaagatgggagg

SEQ ID NO: 3530450 - DNA, 13 bp, Homo sapiens
ccccttgcagcct

SEQ ID NO: 3530451 - DNA, 18 bp, Homo sapiens
ccccttgcagcctggtca

SEQ ID NO: 3530452 - DNA, 12 bp, Homo sapiens
cccgcagaggca

SEQ ID NO: 3530453 - DNA, 15 bp, Homo sapiens
cccgcgggcacagcc

SEQ ID NO: 3530454 - DNA, 20 bp, Homo sapiens
cccgcgggcacagccagccc

SEQ ID NO: 3530455 - DNA, 16 bp, Homo sapiens
cccgggacaccgtggg

SEQ ID NO: 3530456 - DNA, 17 bp, Homo sapiens
ccctaagccagctgccc

SEQ ID NO: 3530457 - DNA, 22 bp, Homo sapiens
ccctagaagaaaacccgaggga

SEQ ID NO: 3530458 - DNA, 17 bp, Homo sapiens
ccctatggccactggcc

SEQ ID NO: 3530459 - DNA, 17 bp, Homo sapiens
ccctcctctccaccatc

SEQ ID NO: 3530460 - DNA, 13 bp, Homo sapiens
ccctcctggtgac

SEQ ID NO: 3530461 - DNA, 20 bp, Homo sapiens
ccctgaggggctggggaggg

SEQ ID NO: 3530462 - DNA, 16 bp, Homo sapiens
ccctggatttttacca

SEQ ID NO: 3530463 - DNA, 24 bp, Homo sapiens
ccctggatttttaccagtctcaca

SEQ ID NO: 3530464 - DNA, 19 bp, Homo sapiens
ccctgtaaggtttcaatgc

SEQ ID NO: 3530465 - DNA, 21 bp, Homo sapiens
ccctgtcagacgttggtccca

SEQ ID NO: 3530466 - DNA, 15 bp, Homo sapiens
ccgaaactgacttgc

SEQ ID NO: 3530467 - DNA, 20 bp, Homo sapiens
ccgaaagtctgaatctccca

SEQ ID NO: 3530468 - DNA, 18 bp, Homo sapiens
ccgaggccagaaggcaaa

SEQ ID NO: 3530469 - DNA, 14 bp, Homo sapiens
ccgcagaggcagaa

SEQ ID NO: 3530470 - DNA, 13 bp, Homo sapiens
ccggctggcctgg

SEQ ID NO: 3530471 - DNA, 19 bp, Homo sapiens
ccggctggcctggaggctc

SEQ ID NO: 3530472 - DNA, 21 bp, Homo sapiens
ccgggacaccgtggggaaggg

SEQ ID NO: 3530473 - DNA, 15 bp, Homo sapiens
ccgggggtggctctg

SEQ ID NO: 3530474 - DNA, 19 bp, Homo sapiens
ccgtatctgagggctgctc

SEQ ID NO: 3530475 - DNA, 21 bp, Homo sapiens
ccgtatctgagggctgctccc

SEQ ID NO: 3530476 - DNA, 19 bp, Homo sapiens
ccgttggaaagaacattta

SEQ ID NO: 3530477 - DNA, 18 bp, Homo sapiens
cctaaagatgggaggaga

SEQ ID NO: 3530478 - DNA, 14 bp, Homo sapiens
cctaagccagctgc

SEQ ID NO: 3530479 - DNA, 17 bp, Homo sapiens
cctaagccagctgcccc

SEQ ID NO: 3530480 - DNA, 18 bp, Homo sapiens
cctaagccagctgccccc

SEQ ID NO: 3530481 - DNA, 20 bp, Homo sapiens
cctagtcgggcagggcccct

SEQ ID NO: 3530482 - DNA, 18 bp, Homo sapiens
cctcagccgtcagccatc

SEQ ID NO: 3530483 - DNA, 21 bp, Homo sapiens
cctcagctcttggtgggccca

SEQ ID NO: 3530484 - DNA, 22 bp, Homo sapiens
cctcagctcttggtgggcccag

SEQ ID NO: 3530485 - DNA, 16 bp, Homo sapiens
cctcctgtgggcctca

SEQ ID NO: 3530486 - DNA, 13 bp, Homo sapiens
cctccttcctttt

SEQ ID NO: 3530487 - DNA, 15 bp, Homo sapiens
cctcggtggccctga

SEQ ID NO: 3530488 - DNA, 22 bp, Homo sapiens
cctcggtggccctgactgtcag

SEQ ID NO: 3530489 - DNA, 17 bp, Homo sapiens
cctcgtctcttgtgact

SEQ ID NO: 3530490 - DNA, 22 bp, Homo sapiens
cctctccaccatcgtcttcttg

SEQ ID NO: 3530491 - DNA, 22 bp, Homo sapiens
cctctcttaagatgtccagggc

SEQ ID NO: 3530492 - DNA, 13 bp, Homo sapiens
cctctgcttctga

SEQ ID NO: 3530493 - DNA, 15 bp, Homo sapiens
cctctgggagcttct

SEQ ID NO: 3530494 - DNA, 23 bp, Homo sapiens
cctgaccctcccggcctggcttc

SEQ ID NO: 3530495 - DNA, 15 bp, Homo sapiens
cctgactgccaagcc

SEQ ID NO: 3530496 - DNA, 21 bp, Homo sapiens
cctgagctagcaaatacagga

SEQ ID NO: 3530497 - DNA, 22 bp, Homo sapiens
cctgatttcagcacaataaata

SEQ ID NO: 3530498 - DNA, 11 bp, Homo sapiens
cctgatttttc

SEQ ID NO: 3530499 - DNA, 22 bp, Homo sapiens
cctgatttttcatatgtggaaa

SEQ ID NO: 3530500 - DNA, 13 bp, Homo sapiens
cctgcagccagaa

SEQ ID NO: 3530501 - DNA, 19 bp, Homo sapiens
cctgcaggctgcaggaggg

SEQ ID NO: 3530502 - DNA, 20 bp, Homo sapiens
cctgcaggctgcaggagggc

SEQ ID NO: 3530503 - DNA, 21 bp, Homo sapiens
cctgcaggctgcaggagggca

SEQ ID NO: 3530504 - DNA, 20 bp, Homo sapiens
cctgcatctaagcatctggg

SEQ ID NO: 3530505 - DNA, 11 bp, Homo sapiens
cctgctgccct

SEQ ID NO: 3530506 - DNA, 13 bp, Homo sapiens
cctgctgccctcc

SEQ ID NO: 3530507 - DNA, 16 bp, Homo sapiens
cctgcttttgtgtccc

SEQ ID NO: 3530508 - DNA, 17 bp, Homo sapiens
cctgcttttgtgtccca

SEQ ID NO: 3530509 - DNA, 14 bp, Homo sapiens
cctggaggctcagc

SEQ ID NO: 3530510 - DNA, 22 bp, Homo sapiens
cctggccatttggccccagggg

SEQ ID NO: 3530511 - DNA, 16 bp, Homo sapiens
cctggcttcactctcc

SEQ ID NO: 3530512 - DNA, 14 bp, Homo sapiens
cctgggttatttat

SEQ ID NO: 3530513 - DNA, 19 bp, Homo sapiens
cctgtaaggtttcaatgca

SEQ ID NO: 3530514 - DNA, 20 bp, Homo sapiens
cctgtcagacgttggtccca

SEQ ID NO: 3530515 - DNA, 13 bp, Homo sapiens
cctgtgaccttgg

SEQ ID NO: 3530516 - DNA, 23 bp, Homo sapiens
cctgtgaccttgggaccaaaggg

SEQ ID NO: 3530517 - DNA, 17 bp, Homo sapiens
ccttaactggagaccag

SEQ ID NO: 3530518 - DNA, 18 bp, Homo sapiens
ccttagaccaccaagcct

SEQ ID NO: 3530519 - DNA, 13 bp, Homo sapiens
ccttcttccaagg

SEQ ID NO: 3530520 - DNA, 17 bp, Homo sapiens
ccttcttccaaggagca

SEQ ID NO: 3530521 - DNA, 12 bp, Homo sapiens
cctttccctaag

SEQ ID NO: 3530522 - DNA, 17 bp, Homo sapiens
cctttgctgaccctccc

SEQ ID NO: 3530523 - DNA, 18 bp, Homo sapiens
cctttgctgaccctcccc

SEQ ID NO: 3530524 - DNA, 20 bp, Homo sapiens
cctttggagaccaggcctca

SEQ ID NO: 3530525 - DNA, 15 bp, Homo sapiens
cgaattcagaaagag

SEQ ID NO: 3530526 - DNA, 23 bp, Homo sapiens
cgagaggctggtgtatgcactgc

SEQ ID NO: 3530527 - DNA, 18 bp, Homo sapiens
cgagcaaccctctgaaga

SEQ ID NO: 3530528 - DNA, 21 bp, Homo sapiens
cgccacagcccttttgtctct

SEQ ID NO: 3530529 - DNA, 12 bp, Homo sapiens
cgcgggcacagc

SEQ ID NO: 3530530 - DNA, 15 bp, Homo sapiens
cgcgggcacagccag

SEQ ID NO: 3530531 - DNA, 16 bp, Homo sapiens
cgcgggcacagccagc

SEQ ID NO: 3530532 - DNA, 20 bp, Homo sapiens
cgctggcccccccagcccca

SEQ ID NO: 3530533 - DNA, 16 bp, Homo sapiens
cggaaagaagaaggtg

SEQ ID NO: 3530534 - DNA, 22 bp, Homo sapiens
cggacacttttgaggacaagtt

SEQ ID NO: 3530535 - DNA, 15 bp, Homo sapiens
cggcgctgcctcagg

SEQ ID NO: 3530536 - DNA, 14 bp, Homo sapiens
cggctggcctggag

SEQ ID NO: 3530537 - DNA, 17 bp, Homo sapiens
cgggacaccgtggggaa

SEQ ID NO: 3530538 - DNA, 20 bp, Homo sapiens
cgggacaccgtggggaaggg

SEQ ID NO: 3530539 - DNA, 11 bp, Homo sapiens
cgggagggagt

SEQ ID NO: 3530540 - DNA, 21 bp, Homo sapiens
cggtggaagcagtggggtagg

SEQ ID NO: 3530541 - DNA, 15 bp, Homo sapiens
cggtgttacttccct

SEQ ID NO: 3530542 - DNA, 17 bp, Homo sapiens
cgtgggcatgggcgcag

SEQ ID NO: 3530543 - DNA, 14 bp, Homo sapiens
cgtgggccctgcag

SEQ ID NO: 3530544 - DNA, 18 bp, Homo sapiens
cgtggggaaggggtgcag

SEQ ID NO: 3530545 - DNA, 13 bp, Homo sapiens
cgttggaaagaac

SEQ ID NO: 3530546 - DNA, 17 bp, Homo sapiens
cgtttgcttaatgccag

SEQ ID NO: 3530547 - DNA, 16 bp, Homo sapiens
ctaaagatgggaggag

SEQ ID NO: 3530548 - DNA, 23 bp, Homo sapiens
ctaaagatgggaggagaccagcg

SEQ ID NO: 3530549 - DNA, 15 bp, Homo sapiens
ctaaagattgttaaa

SEQ ID NO: 3530550 - DNA, 16 bp, Homo sapiens
ctaaagattgttaaat

SEQ ID NO: 3530551 - DNA, 18 bp, Homo sapiens
ctaagcagccaggaggga

SEQ ID NO: 3530552 - DNA, 15 bp, Homo sapiens
ctaagccagctgccc

SEQ ID NO: 3530553 - DNA, 17 bp, Homo sapiens
ctaatatttttaacaag

SEQ ID NO: 3530554 - DNA, 13 bp, Homo sapiens
ctaatgtaaattt

SEQ ID NO: 3530555 - DNA, 16 bp, Homo sapiens
ctaatgtaaattttaa

SEQ ID NO: 3530556 - DNA, 17 bp, Homo sapiens
ctaattatcttatctac

SEQ ID NO: 3530557 - DNA, 15 bp, Homo sapiens
ctaccaatctgtgag

SEQ ID NO: 3530558 - DNA, 22 bp, Homo sapiens
caggtggggtgatggccagagg

SEQ ID NO: 3530559 - DNA, 23 bp, Homo sapiens
caggtggggtgatggccagagga

SEQ ID NO: 3530560 - DNA, 21 bp, Homo sapiens
cagtatatcacagagccactc

SEQ ID NO: 3530561 - DNA, 13 bp, Homo sapiens
cagtccataactt

SEQ ID NO: 3530562 - DNA, 15 bp, Homo sapiens
cagtgaaaggcctgc

SEQ ID NO: 3530563 - DNA, 20 bp, Homo sapiens
cagtggccacgttcagggag

SEQ ID NO: 3530564 - DNA, 16 bp, Homo sapiens
cagtggggtaggctgc

SEQ ID NO: 3530565 - DNA, 17 bp, Homo sapiens
cagtggtgttacatttt

SEQ ID NO: 3530566 - DNA, 11 bp, Homo sapiens
cagtgtgtaat

SEQ ID NO: 3530567 - DNA, 12 bp, Homo sapiens
cagttgtcctcc

SEQ ID NO: 3530568 - DNA, 22 bp, Homo sapiens
cagttgtctaaaggatgagatt

SEQ ID NO: 3530569 - DNA, 24 bp, Homo sapiens
cagttgtctaaaggatgagatttt

SEQ ID NO: 3530570 - DNA, 16 bp, Homo sapiens
cataaaggacactgga

SEQ ID NO: 3530571 - DNA, 17 bp, Homo sapiens
cataaaggacactggat

SEQ ID NO: 3530572 - DNA, 23 bp, Homo sapiens
cataaaggacactggatcaagtt

SEQ ID NO: 3530573 - DNA, 13 bp, Homo sapiens
catacaataaaag

SEQ ID NO: 3530574 - DNA, 19 bp, Homo sapiens
catacaataaaagagcttt

SEQ ID NO: 3530575 - DNA, 16 bp, Homo sapiens
catacaccaaacattt

SEQ ID NO: 3530576 - DNA, 22 bp, Homo sapiens
catactgaaaaaatgctgagcc

SEQ ID NO: 3530577 - DNA, 18 bp, Homo sapiens
catagagacttgggaatg

SEQ ID NO: 3530578 - DNA, 13 bp, Homo sapiens
catagagaggcct

SEQ ID NO: 3530579 - DNA, 15 bp, Homo sapiens
catataaaatttcag

SEQ ID NO: 3530580 - DNA, 16 bp, Homo sapiens
catatgaggggaccca

SEQ ID NO: 3530581 - DNA, 17 bp, Homo sapiens
catatgaggggacccag

SEQ ID NO: 3530582 - DNA, 17 bp, Homo sapiens
catcaccttagaccacc

SEQ ID NO: 3530583 - DNA, 22 bp, Homo sapiens
catcaccttagaccaccaagcc

SEQ ID NO: 3530584 - DNA, 13 bp, Homo sapiens
catcccactagca

SEQ ID NO: 3530585 - DNA, 20 bp, Homo sapiens
catctcccccatagcaccct

SEQ ID NO: 3530586 - DNA, 21 bp, Homo sapiens
catctcccccatagcaccctg

SEQ ID NO: 3530587 - DNA, 17 bp, Homo sapiens
catctgtaggtcactct

SEQ ID NO: 3530588 - DNA, 15 bp, Homo sapiens
catcttacagagact

SEQ ID NO: 3530589 - DNA, 14 bp, Homo sapiens
catcttcctgagct

SEQ ID NO: 3530590 - DNA, 23 bp, Homo sapiens
catgaaaataaacgccacctgca

SEQ ID NO: 3530591 - DNA, 11 bp, Homo sapiens
catgaatattt

SEQ ID NO: 3530592 - DNA, 20 bp, Homo sapiens
catgacaaaatagcccagcc

SEQ ID NO: 3530593 - DNA, 15 bp, Homo sapiens
catgaggaccagggt

SEQ ID NO: 3530594 - DNA, 17 bp, Homo sapiens
catgattccagccatca

SEQ ID NO: 3530595 - DNA, 22 bp, Homo sapiens
catgccctcggtcactgagtct

SEQ ID NO: 3530596 - DNA, 16 bp, Homo sapiens
catgggtagcctgggt

SEQ ID NO: 3530597 - DNA, 23 bp, Homo sapiens
catgtctttattagtaacatcat

SEQ ID NO: 3530598 - DNA, 16 bp, Homo sapiens
catgtgtaggatgtat

SEQ ID NO: 3530599 - DNA, 16 bp, Homo sapiens
catgttgcttcactct

SEQ ID NO: 3530600 - DNA, 19 bp, Homo sapiens
catgttttactacataggt

SEQ ID NO: 3530601 - DNA, 12 bp, Homo sapiens
cattaaaattaa

SEQ ID NO: 3530602 - DNA, 18 bp, Homo sapiens
cattaaaattaaatactt

SEQ ID NO: 3530603 - DNA, 19 bp, Homo sapiens
cattcttcggtctgaattt

SEQ ID NO: 3530604 - DNA, 15 bp, Homo sapiens
cattggtccaccctt

SEQ ID NO: 3530605 - DNA, 18 bp, Homo sapiens
catttggccccaggggac

SEQ ID NO: 3530606 - DNA, 19 bp, Homo sapiens
cattttggtgcaatattct

SEQ ID NO: 3530607 - DNA, 19 bp, Homo sapiens
ccaaaccttgggccctgga

SEQ ID NO: 3530608 - DNA, 14 bp, Homo sapiens
ccaacctcctgtgg

SEQ ID NO: 3530609 - DNA, 20 bp, Homo sapiens
ccaacctcctgtgggcctca

SEQ ID NO: 3530610 - DNA, 20 bp, Homo sapiens
ccaagccatgggtagcctgg

SEQ ID NO: 3530611 - DNA, 22 bp, Homo sapiens
ccaagccttgattggtgttgcc

SEQ ID NO: 3530612 - DNA, 13 bp, Homo sapiens
ccaaggcagggcc

SEQ ID NO: 3530613 - DNA, 14 bp, Homo sapiens
ccaaggcagggccc

SEQ ID NO: 3530614 - DNA, 18 bp, Homo sapiens
ccaaggcagggcccagca

SEQ ID NO: 3530615 - DNA, 17 bp, Homo sapiens
ccaagtgtattgtaatg

SEQ ID NO: 3530616 - DNA, 19 bp, Homo sapiens
ccaataccctagaagaaaa

SEQ ID NO: 3530617 - DNA, 15 bp, Homo sapiens
ccaatctgtgagaag

SEQ ID NO: 3530618 - DNA, 21 bp, Homo sapiens
ccacaccctatatctccgtgt

SEQ ID NO: 3530619 - DNA, 18 bp, Homo sapiens
ccacaggacacgaaggct

SEQ ID NO: 3530620 - DNA, 13 bp, Homo sapiens
ccaccaagccttg

SEQ ID NO: 3530621 - DNA, 15 bp, Homo sapiens
ccaccctatggccac

SEQ ID NO: 3530622 - DNA, 16 bp, Homo sapiens
ccaccctatggccact

SEQ ID NO: 3530623 - DNA, 20 bp, Homo sapiens
ccaccctatggccactggcc

SEQ ID NO: 3530624 - DNA, 18 bp, Homo sapiens
ccaccgggggtggctctg

SEQ ID NO: 3530625 - DNA, 19 bp, Homo sapiens
ccaccgggggtggctctgt

SEQ ID NO: 3530626 - DNA, 14 bp, Homo sapiens
ccacgatgcctttg

SEQ ID NO: 3530627 - DNA, 15 bp, Homo sapiens
ccacgatgcctttga

SEQ ID NO: 3530628 - DNA, 16 bp, Homo sapiens
ccacgatgcctttgag

SEQ ID NO: 3530629 - DNA, 17 bp, Homo sapiens
ccacgatgcctttgagt

SEQ ID NO: 3530630 - DNA, 13 bp, Homo sapiens
ccacgccacagcc

SEQ ID NO: 3530631 - DNA, 17 bp, Homo sapiens
ccacggtgaaagtgctg

SEQ ID NO: 3530632 - DNA, 21 bp, Homo sapiens
ccacggtgaaagtgctgctct

SEQ ID NO: 3530633 - DNA, 14 bp, Homo sapiens
ccacgttcagggag

SEQ ID NO: 3530634 - DNA, 15 bp, Homo sapiens
ccacgttcagggagg

SEQ ID NO: 3530635 - DNA, 13 bp, Homo sapiens
ccactcagcactc

SEQ ID NO: 3530636 - DNA, 12 bp, Homo sapiens
ccagagaacaca

SEQ ID NO: 3530637 - DNA, 12 bp, Homo sapiens
ccagagccacag

SEQ ID NO: 3530638 - DNA, 13 bp, Homo sapiens
ccagagccacagt

SEQ ID NO: 3530639 - DNA, 15 bp, Homo sapiens
ccagagccacagttc

SEQ ID NO: 3530640 - DNA, 17 bp, Homo sapiens
ccagcagttaggcacct

SEQ ID NO: 3530641 - DNA, 18 bp, Homo sapiens
ccagcccaaaccttgggc

SEQ ID NO: 3530642 - DNA, 19 bp, Homo sapiens
ccagcccaaaccttgggcc

SEQ ID NO: 3530643 - DNA, 13 bp, Homo sapiens
ccagccccacacc

SEQ ID NO: 3530644 - DNA, 15 bp, Homo sapiens
ccagccccacaccct

SEQ ID NO: 3530645 - DNA, 17 bp, Homo sapiens
ccagctctaagcagcca

SEQ ID NO: 3530646 - DNA, 20 bp, Homo sapiens
ccagctctaagcagccagga

SEQ ID NO: 3530647 - DNA, 21 bp, Homo sapiens
ccagctctaagcagccaggag

SEQ ID NO: 3530648 - DNA, 23 bp, Homo sapiens
ccagctgcccccagagccacagt

SEQ ID NO: 3530649 - DNA, 16 bp, Homo sapiens
ccaggcccgcgggcac

SEQ ID NO: 3530650 - DNA, 14 bp, Homo sapiens
ccagggaggcagag

SEQ ID NO: 3530651 - DNA, 23 bp, Homo sapiens
ccagggaggcagagcgggaggga

SEQ ID NO: 3530652 - DNA, 16 bp, Homo sapiens
ccaggggacgtgggcc

SEQ ID NO: 3530653 - DNA, 20 bp, Homo sapiens
ccaggggacgtgggccctgc

SEQ ID NO: 3530654 - DNA, 19 bp, Homo sapiens
ccaggtgatctcctgtggc

SEQ ID NO: 3530655 - DNA, 15 bp, Homo sapiens
ccagttgtcctcctt

SEQ ID NO: 3530656 - DNA, 19 bp, Homo sapiens
ccatcaccttagaccacca

SEQ ID NO: 3530657 - DNA, 14 bp, Homo sapiens
ccatcgtcttcttg

SEQ ID NO: 3530658 - DNA, 14 bp, Homo sapiens
ccatgggaggcctt

SEQ ID NO: 3530659 - DNA, 21 bp, Homo sapiens
ccatgggaggcctttccctaa

SEQ ID NO: 3530660 - DNA, 16 bp, Homo sapiens
ccatgggtagcctggg

SEQ ID NO: 3530661 - DNA, 16 bp, Homo sapiens
ccatgggtctggcctg

SEQ ID NO: 3530662 - DNA, 11 bp, Homo sapiens
cccaaaggcat

SEQ ID NO: 3530663 - DNA, 14 bp, Homo sapiens
cccacacaggtggc

SEQ ID NO: 3530664 - DNA, 13 bp, Homo sapiens
cccacgccacagc

SEQ ID NO: 3530665 - DNA, 13 bp, Homo sapiens
cccagagccacag

SEQ ID NO: 3530666 - DNA, 22 bp, Homo sapiens
cccaggcccgcgggcacagcca

SEQ ID NO: 3530667 - DNA, 24 bp, Homo sapiens
cccatagcaccctgccctcatggg

SEQ ID NO: 3530668 - DNA, 21 bp, Homo sapiens
ccccagctctaagcagccagg

SEQ ID NO: 3530669 - DNA, 22 bp, Homo sapiens
ccccagctctaagcagccagga

SEQ ID NO: 3530670 - DNA, 22 bp, Homo sapiens
caaagctgaaaatgtgtataca

SEQ ID NO: 3530671 - DNA, 22 bp, Homo sapiens
caaaggcatgcagtcatgagaa

SEQ ID NO: 3530672 - DNA, 12 bp, Homo sapiens
caaaggctctgt

SEQ ID NO: 3530673 - DNA, 21 bp, Homo sapiens
caaatcactgtggggaaacaa

SEQ ID NO: 3530674 - DNA, 22 bp, Homo sapiens
caaatcactgtggggaaacaat

SEQ ID NO: 3530675 - DNA, 18 bp, Homo sapiens
caacactaattgtccaca

SEQ ID NO: 3530676 - DNA, 19 bp, Homo sapiens
caacactaattgtccacag

SEQ ID NO: 3530677 - DNA, 13 bp, Homo sapiens
caacctcctgtgg

SEQ ID NO: 3530678 - DNA, 12 bp, Homo sapiens
caactggaaata

SEQ ID NO: 3530679 - DNA, 22 bp, Homo sapiens
caacttgagcctgtgaccttgg

SEQ ID NO: 3530680 - DNA, 18 bp, Homo sapiens
caagagcgttactgtaga

SEQ ID NO: 3530681 - DNA, 19 bp, Homo sapiens
caagagcgttactgtagac

SEQ ID NO: 3530682 - DNA, 15 bp, Homo sapiens
caagagtgctgagaa

SEQ ID NO: 3530683 - DNA, 14 bp, Homo sapiens
caagccttgattgg

SEQ ID NO: 3530684 - DNA, 16 bp, Homo sapiens
caaggaatcctctggg

SEQ ID NO: 3530685 - DNA, 16 bp, Homo sapiens
caaggagcagagaggt

SEQ ID NO: 3530686 - DNA, 23 bp, Homo sapiens
caagggcagggggcccctttgct

SEQ ID NO: 3530687 - DNA, 14 bp, Homo sapiens
caagtcatttcaaa

SEQ ID NO: 3530688 - DNA, 18 bp, Homo sapiens
caagtcatttcaaaatat

SEQ ID NO: 3530689 - DNA, 21 bp, Homo sapiens
caagtgagaggggagggaggg

SEQ ID NO: 3530690 - DNA, 20 bp, Homo sapiens
caataaaaaatatattttta

SEQ ID NO: 3530691 - DNA, 15 bp, Homo sapiens
caataaaagagcttt

SEQ ID NO: 3530692 - DNA, 18 bp, Homo sapiens
caataaaagagctttatc

SEQ ID NO: 3530693 - DNA, 12 bp, Homo sapiens
caataccctaga

SEQ ID NO: 3530694 - DNA, 15 bp, Homo sapiens
caatataccatgaca

SEQ ID NO: 3530695 - DNA, 22 bp, Homo sapiens
caatataccatgacatgaagaa

SEQ ID NO: 3530696 - DNA, 14 bp, Homo sapiens
caatctgtgagaag

SEQ ID NO: 3530697 - DNA, 16 bp, Homo sapiens
caatctgtgagaagtt

SEQ ID NO: 3530698 - DNA, 18 bp, Homo sapiens
caatgcatacaataaaag

SEQ ID NO: 3530699 - DNA, 16 bp, Homo sapiens
caatgtgtttaatttt

SEQ ID NO: 3530700 - DNA, 14 bp, Homo sapiens
cacagccagcccaa

SEQ ID NO: 3530701 - DNA, 15 bp, Homo sapiens
cacagccccatggac

SEQ ID NO: 3530702 - DNA, 14 bp, Homo sapiens
cacagcccttttgt

SEQ ID NO: 3530703 - DNA, 17 bp, Homo sapiens
cacaggacacgaaggct

SEQ ID NO: 3530704 - DNA, 16 bp, Homo sapiens
cacagtgaaaggcctg

SEQ ID NO: 3530705 - DNA, 16 bp, Homo sapiens
cacatttgaattcatt

SEQ ID NO: 3530706 - DNA, 13 bp, Homo sapiens
caccaagccttga

SEQ ID NO: 3530707 - DNA, 16 bp, Homo sapiens
caccatcttacagaga

SEQ ID NO: 3530708 - DNA, 20 bp, Homo sapiens
caccctatggccactggccg

SEQ ID NO: 3530709 - DNA, 17 bp, Homo sapiens
caccctgccctcatggg

SEQ ID NO: 3530710 - DNA, 22 bp, Homo sapiens
caccctttcatagagaggcctg

SEQ ID NO: 3530711 - DNA, 19 bp, Homo sapiens
caccgaattgcttttatca

SEQ ID NO: 3530712 - DNA, 17 bp, Homo sapiens
caccgggggtggctctg

SEQ ID NO: 3530713 - DNA, 20 bp, Homo sapiens
caccgtggggaaggggtgca

SEQ ID NO: 3530714 - DNA, 14 bp, Homo sapiens
cacctctagtcaga

SEQ ID NO: 3530715 - DNA, 13 bp, Homo sapiens
caccttaactgga

SEQ ID NO: 3530716 - DNA, 22 bp, Homo sapiens
caccttaactggagaccagaaa

SEQ ID NO: 3530717 - DNA, 18 bp, Homo sapiens
caccttagaccaccaagc

SEQ ID NO: 3530718 - DNA, 20 bp, Homo sapiens
caccttagaccaccaagcct

SEQ ID NO: 3530719 - DNA, 11 bp, Homo sapiens
cacgccacagc

SEQ ID NO: 3530720 - DNA, 17 bp, Homo sapiens
cacggatttagtcccac

SEQ ID NO: 3530721 - DNA, 19 bp, Homo sapiens
cacgttcagggaggggccg

SEQ ID NO: 3530722 - DNA, 14 bp, Homo sapiens
cactagagtgctct

SEQ ID NO: 3530723 - DNA, 16 bp, Homo sapiens
cactagagtgctctga

SEQ ID NO: 3530724 - DNA, 18 bp, Homo sapiens
cactatttctggaatgct

SEQ ID NO: 3530725 - DNA, 14 bp, Homo sapiens
cactcagcactctg

SEQ ID NO: 3530726 - DNA, 18 bp, Homo sapiens
cactcagcactctggact

SEQ ID NO: 3530727 - DNA, 19 bp, Homo sapiens
cactcatgcattgtcctct

SEQ ID NO: 3530728 - DNA, 23 bp, Homo sapiens
cactcattcttcggtctgaattt

SEQ ID NO: 3530729 - DNA, 14 bp, Homo sapiens
cactctctgcccct

SEQ ID NO: 3530730 - DNA, 13 bp, Homo sapiens
cactctggactcc

SEQ ID NO: 3530731 - DNA, 19 bp, Homo sapiens
cactggatcaagttcagcc

SEQ ID NO: 3530732 - DNA, 16 bp, Homo sapiens
cacttaaacttgcaca

SEQ ID NO: 3530733 - DNA, 14 bp, Homo sapiens
cagaaaatttgcaa

SEQ ID NO: 3530734 - DNA, 16 bp, Homo sapiens
cagaaaccttccagag

SEQ ID NO: 3530735 - DNA, 16 bp, Homo sapiens
cagaaggaaaccgaaa

SEQ ID NO: 3530736 - DNA, 15 bp, Homo sapiens
cagaatattttgtaa

SEQ ID NO: 3530737 - DNA, 18 bp, Homo sapiens
cagaatgaacccataggg

SEQ ID NO: 3530738 - DNA, 17 bp, Homo sapiens
cagaccaaggcagggcc

SEQ ID NO: 3530739 - DNA, 19 bp, Homo sapiens
cagaccaaggcagggccca

SEQ ID NO: 3530740 - DNA, 20 bp, Homo sapiens
cagaccaaggcagggcccag

SEQ ID NO: 3530741 - DNA, 17 bp, Homo sapiens
cagacttttggccccag

SEQ ID NO: 3530742 - DNA, 16 bp, Homo sapiens
cagagactctccctga

SEQ ID NO: 3530743 - DNA, 14 bp, Homo sapiens
cagagcgggaggga

SEQ ID NO: 3530744 - DNA, 18 bp, Homo sapiens
cagaggcttttccagtgt

SEQ ID NO: 3530745 - DNA, 15 bp, Homo sapiens
cagattccacaggac

SEQ ID NO: 3530746 - DNA, 16 bp, Homo sapiens
cagcactctggactcc

SEQ ID NO: 3530747 - DNA, 19 bp, Homo sapiens
cagcactctggactccacg

SEQ ID NO: 3530748 - DNA, 14 bp, Homo sapiens
cagcagaggcagtg

SEQ ID NO: 3530749 - DNA, 20 bp, Homo sapiens
cagccagcccaaaccttggg

SEQ ID NO: 3530750 - DNA, 13 bp, Homo sapiens
cagccaggaggga

SEQ ID NO: 3530751 - DNA, 19 bp, Homo sapiens
cagccatcaccttagacca

SEQ ID NO: 3530752 - DNA, 11 bp, Homo sapiens
cagccccacac

SEQ ID NO: 3530753 - DNA, 14 bp, Homo sapiens
cagccccacaccct

SEQ ID NO: 3530754 - DNA, 14 bp, Homo sapiens
cagcccttttgtct

SEQ ID NO: 3530755 - DNA, 16 bp, Homo sapiens
cagcccttttgtctct

SEQ ID NO: 3530756 - DNA, 23 bp, Homo sapiens
cagccttttgagagtaatttggg

SEQ ID NO: 3530757 - DNA, 23 bp, Homo sapiens
cagctcggttaagtacccgaggc

SEQ ID NO: 3530758 - DNA, 18 bp, Homo sapiens
cagctctaagcagccagg

SEQ ID NO: 3530759 - DNA, 22 bp, Homo sapiens
cagctctaagcagccaggaggg

SEQ ID NO: 3530760 - DNA, 18 bp, Homo sapiens
cagctcttggtgggccca

SEQ ID NO: 3530761 - DNA, 21 bp, Homo sapiens
cagctcttggtgggcccaggg

SEQ ID NO: 3530762 - DNA, 16 bp, Homo sapiens
cagcttttcctcaggg

SEQ ID NO: 3530763 - DNA, 17 bp, Homo sapiens
caggaggaggctgccct

SEQ ID NO: 3530764 - DNA, 21 bp, Homo sapiens
caggaggaggctgccctgagg

SEQ ID NO: 3530765 - DNA, 12 bp, Homo sapiens
caggagggcact

SEQ ID NO: 3530766 - DNA, 14 bp, Homo sapiens
caggagggcactgg

SEQ ID NO: 3530767 - DNA, 21 bp, Homo sapiens
caggcccgcgggcacagccag

SEQ ID NO: 3530768 - DNA, 17 bp, Homo sapiens
caggctgcaggagggca

SEQ ID NO: 3530769 - DNA, 20 bp, Homo sapiens
caggctgcaggagggcactg

SEQ ID NO: 3530770 - DNA, 18 bp, Homo sapiens
cagggaggcagagcggga

SEQ ID NO: 3530771 - DNA, 20 bp, Homo sapiens
cagggaggcagagcgggagg

SEQ ID NO: 3530772 - DNA, 11 bp, Homo sapiens
cagggagggcc

SEQ ID NO: 3530773 - DNA, 16 bp, Homo sapiens
cagggagggccaggga

SEQ ID NO: 3530774 - DNA, 20 bp, Homo sapiens
cagggagggccagggaggca

SEQ ID NO: 3530775 - DNA, 12 bp, Homo sapiens
cagggaggggcc

SEQ ID NO: 3530776 - DNA, 17 bp, Homo sapiens
cagggctgcatcccgag

SEQ ID NO: 3530777 - DNA, 11 bp, Homo sapiens
caggggaaggg

SEQ ID NO: 3530778 - DNA, 22 bp, Homo sapiens
cagggtggagctgagaagagga

SEQ ID NO: 3530779 - DNA, 19 bp, Homo sapiens
caggtcctagtcgggcagg

SEQ ID NO: 3530780 - DNA, 20 bp, Homo sapiens
caggtcctagtcgggcaggg

SEQ ID NO: 3530781 - DNA, 21 bp, Homo sapiens
caggtgatctcctgtggctca

SEQ ID NO: 3530782 - DNA, 14 bp, Homo sapiens
atcaggcctagagg

SEQ ID NO: 3530783 - DNA, 19 bp, Homo sapiens
atcaggcctagaggcctga

SEQ ID NO: 3530784 - DNA, 19 bp, Homo sapiens
atcagtggtgttacatttt

SEQ ID NO: 3530785 - DNA, 15 bp, Homo sapiens
atcagtgttaaagtg

SEQ ID NO: 3530786 - DNA, 16 bp, Homo sapiens
atcatataaaatttca

SEQ ID NO: 3530787 - DNA, 17 bp, Homo sapiens
atccaagatgtttggac

SEQ ID NO: 3530788 - DNA, 14 bp, Homo sapiens
atccagttgtctaa

SEQ ID NO: 3530789 - DNA, 15 bp, Homo sapiens
atccatactgaaaaa

SEQ ID NO: 3530790 - DNA, 23 bp, Homo sapiens
atcccagtttaatattccaatac

SEQ ID NO: 3530791 - DNA, 21 bp, Homo sapiens
atcccgagcaaccctctgaag

SEQ ID NO: 3530792 - DNA, 22 bp, Homo sapiens
atccttctctttcaatgtgttt

SEQ ID NO: 3530793 - DNA, 15 bp, Homo sapiens
atctactgactgaaa

SEQ ID NO: 3530794 - DNA, 17 bp, Homo sapiens
atctactgactgaaatc

SEQ ID NO: 3530795 - DNA, 17 bp, Homo sapiens
atctcaacaacatgtca

SEQ ID NO: 3530796 - DNA, 14 bp, Homo sapiens
atctcggggctgct

SEQ ID NO: 3530797 - DNA, 18 bp, Homo sapiens
atctctcaagagtgctga

SEQ ID NO: 3530798 - DNA, 21 bp, Homo sapiens
atctgaaaaatggccatgttg

SEQ ID NO: 3530799 - DNA, 17 bp, Homo sapiens
atctgagggctgctccc

SEQ ID NO: 3530800 - DNA, 22 bp, Homo sapiens
atctgtaggtcactctccagca

SEQ ID NO: 3530801 - DNA, 13 bp, Homo sapiens
atcttatctactg

SEQ ID NO: 3530802 - DNA, 13 bp, Homo sapiens
atctttctcacac

SEQ ID NO: 3530803 - DNA, 19 bp, Homo sapiens
atctttgtgaacattctgt

SEQ ID NO: 3530804 - DNA, 16 bp, Homo sapiens
atgaagctaatgtgaa

SEQ ID NO: 3530805 - DNA, 17 bp, Homo sapiens
atgaagtaaagtttctg

SEQ ID NO: 3530806 - DNA, 21 bp, Homo sapiens
atgaagtataaacccattttg

SEQ ID NO: 3530807 - DNA, 13 bp, Homo sapiens
atgaatatttctt

SEQ ID NO: 3530808 - DNA, 21 bp, Homo sapiens
atgaattattttgataaatta

SEQ ID NO: 3530809 - DNA, 21 bp, Homo sapiens
atgactgacccaaaatgtgaa

SEQ ID NO: 3530810 - DNA, 17 bp, Homo sapiens
atgactgagatttgtaa

SEQ ID NO: 3530811 - DNA, 21 bp, Homo sapiens
atgactgagatttgtaaatct

SEQ ID NO: 3530812 - DNA, 18 bp, Homo sapiens
atgagaattacagaaaat

SEQ ID NO: 3530813 - DNA, 14 bp, Homo sapiens
atgaggggacccag

SEQ ID NO: 3530814 - DNA, 23 bp, Homo sapiens
atgatccccacgccacagccctt

SEQ ID NO: 3530815 - DNA, 20 bp, Homo sapiens
atgatggtgttggtgaaaat

SEQ ID NO: 3530816 - DNA, 18 bp, Homo sapiens
atgcagcgaattcagaaa

SEQ ID NO: 3530817 - DNA, 20 bp, Homo sapiens
atgcagcgaattcagaaaga

SEQ ID NO: 3530818 - DNA, 21 bp, Homo sapiens
atgcatacaataaaagagctt

SEQ ID NO: 3530819 - DNA, 21 bp, Homo sapiens
atgcattctgataggaggggg

SEQ ID NO: 3530820 - DNA, 22 bp, Homo sapiens
atgcccccgacccccgcagagg

SEQ ID NO: 3530821 - DNA, 13 bp, Homo sapiens
atgccctcctggt

SEQ ID NO: 3530822 - DNA, 15 bp, Homo sapiens
atgccctcctggtga

SEQ ID NO: 3530823 - DNA, 16 bp, Homo sapiens
atgctgtttgtacaaa

SEQ ID NO: 3530824 - DNA, 18 bp, Homo sapiens
atgctgtttgtacaaact

SEQ ID NO: 3530825 - DNA, 21 bp, Homo sapiens
atgcttgatgttacaaggtgt

SEQ ID NO: 3530826 - DNA, 21 bp, Homo sapiens
atgggcttttgttctgagggg

SEQ ID NO: 3530827 - DNA, 12 bp, Homo sapiens
atgggggctttc

SEQ ID NO: 3530828 - DNA, 21 bp, Homo sapiens
atgggggctttcggggagggc

SEQ ID NO: 3530829 - DNA, 18 bp, Homo sapiens
atggtgttggtgaaaata

SEQ ID NO: 3530830 - DNA, 23 bp, Homo sapiens
atgtatacttgaaaaatgttata

SEQ ID NO: 3530831 - DNA, 19 bp, Homo sapiens
atgtctttattagtaacat

SEQ ID NO: 3530832 - DNA, 17 bp, Homo sapiens
atgtgctgttagaatat

SEQ ID NO: 3530833 - DNA, 21 bp, Homo sapiens
atgtgtaggatgtatgctgtt

SEQ ID NO: 3530834 - DNA, 16 bp, Homo sapiens
atgtgtgtgtgtgtat

SEQ ID NO: 3530835 - DNA, 14 bp, Homo sapiens
atgttaactttcaa

SEQ ID NO: 3530836 - DNA, 21 bp, Homo sapiens
atgttaactttcaaatccact

SEQ ID NO: 3530837 - DNA, 19 bp, Homo sapiens
atgttacttccccacccct

SEQ ID NO: 3530838 - DNA, 15 bp, Homo sapiens
atgttttatttatga

SEQ ID NO: 3530839 - DNA, 19 bp, Homo sapiens
atgttttatttatgaagtt

SEQ ID NO: 3530840 - DNA, 13 bp, Homo sapiens
atgttttcacagt

SEQ ID NO: 3530841 - DNA, 13 bp, Homo sapiens
attaaaaacagaa

SEQ ID NO: 3530842 - DNA, 13 bp, Homo sapiens
attaaaattaaat

SEQ ID NO: 3530843 - DNA, 14 bp, Homo sapiens
attacagaaaattt

SEQ ID NO: 3530844 - DNA, 15 bp, Homo sapiens
attacagaaaatttg

SEQ ID NO: 3530845 - DNA, 20 bp, Homo sapiens
attacagaaaatttgcaaca

SEQ ID NO: 3530846 - DNA, 14 bp, Homo sapiens
attattgtctgatt

SEQ ID NO: 3530847 - DNA, 17 bp, Homo sapiens
attcaatgcttgatgtt

SEQ ID NO: 3530848 - DNA, 23 bp, Homo sapiens
attcagcttctataagtgtgacc

SEQ ID NO: 3530849 - DNA, 15 bp, Homo sapiens
attcaggggaagggc

SEQ ID NO: 3530850 - DNA, 21 bp, Homo sapiens
attccaataccctagaagaaa

SEQ ID NO: 3530851 - DNA, 18 bp, Homo sapiens
attctccccctgttcaca

SEQ ID NO: 3530852 - DNA, 19 bp, Homo sapiens
attctccctaaagtgttgt

SEQ ID NO: 3530853 - DNA, 19 bp, Homo sapiens
attcttcggtctgaatttt

SEQ ID NO: 3530854 - DNA, 20 bp, Homo sapiens
attggtccaccctttcatag

SEQ ID NO: 3530855 - DNA, 13 bp, Homo sapiens
attgtctgattga

SEQ ID NO: 3530856 - DNA, 21 bp, Homo sapiens
attgtctgattgaaacatgaa

SEQ ID NO: 3530857 - DNA, 17 bp, Homo sapiens
attgtgcattaaaatta

SEQ ID NO: 3530858 - DNA, 15 bp, Homo sapiens
attgttaaattcaat

SEQ ID NO: 3530859 - DNA, 14 bp, Homo sapiens
atttaaaattaaat

SEQ ID NO: 3530860 - DNA, 13 bp, Homo sapiens
atttacaaatgaa

SEQ ID NO: 3530861 - DNA, 16 bp, Homo sapiens
atttacaaatgaagta

SEQ ID NO: 3530862 - DNA, 22 bp, Homo sapiens
atttacaaatgaagtatttcat

SEQ ID NO: 3530863 - DNA, 14 bp, Homo sapiens
atttatgctaatat

SEQ ID NO: 3530864 - DNA, 20 bp, Homo sapiens
atttatgtgctgttagaata

SEQ ID NO: 3530865 - DNA, 15 bp, Homo sapiens
atttatgttttcaca

SEQ ID NO: 3530866 - DNA, 14 bp, Homo sapiens
atttatttatgcta

SEQ ID NO: 3530867 - DNA, 20 bp, Homo sapiens
atttcagcacaataaatata

SEQ ID NO: 3530868 - DNA, 18 bp, Homo sapiens
atttcatgtaatataagt

SEQ ID NO: 3530869 - DNA, 23 bp, Homo sapiens
atttctgaatctcgttgaggcca

SEQ ID NO: 3530870 - DNA, 16 bp, Homo sapiens
atttgctatttacaaa

SEQ ID NO: 3530871 - DNA, 21 bp, Homo sapiens
atttgctatttacaaatgaag

SEQ ID NO: 3530872 - DNA, 13 bp, Homo sapiens
atttgtaaatctt

SEQ ID NO: 3530873 - DNA, 14 bp, Homo sapiens
atttgtatcatgtt

SEQ ID NO: 3530874 - DNA, 15 bp, Homo sapiens
atttgtatcatgttt

SEQ ID NO: 3530875 - DNA, 13 bp, Homo sapiens
attttaaacattt

SEQ ID NO: 3530876 - DNA, 14 bp, Homo sapiens
attttaaacatttt

SEQ ID NO: 3530877 - DNA, 19 bp, Homo sapiens
attttaatgttaactttca

SEQ ID NO: 3530878 - DNA, 17 bp, Homo sapiens
attttaattaaaaaatc

SEQ ID NO: 3530879 - DNA, 21 bp, Homo sapiens
attttagacgatcacagaaac

SEQ ID NO: 3530880 - DNA, 14 bp, Homo sapiens
attttctccctgga

SEQ ID NO: 3530881 - DNA, 22 bp, Homo sapiens
attttctccctggatttttacc

SEQ ID NO: 3530882 - DNA, 16 bp, Homo sapiens
attttggagtaacgtt

SEQ ID NO: 3530883 - DNA, 22 bp, Homo sapiens
attttggttgtaattaaatttt

SEQ ID NO: 3530884 - DNA, 14 bp, Homo sapiens
atttttaaaatctg

SEQ ID NO: 3530885 - DNA, 12 bp, Homo sapiens
atttttcatgta

SEQ ID NO: 3530886 - DNA, 18 bp, Homo sapiens
caaaaaaaagcatgaata

SEQ ID NO: 3530887 - DNA, 17 bp, Homo sapiens
caaacatttctgtgaaa

SEQ ID NO: 3530888 - DNA, 21 bp, Homo sapiens
caaacatttctgtgaaactat

SEQ ID NO: 3530889 - DNA, 15 bp, Homo sapiens
caaactatttcagaa

SEQ ID NO: 3530890 - DNA, 14 bp, Homo sapiens
caaactgccttctt

SEQ ID NO: 3530891 - DNA, 13 bp, Homo sapiens
caaagctgaaaat

SEQ ID NO: 3530892 - DNA, 17 bp, Homo sapiens
caaagctgaaaatgtgt

SEQ ID NO: 3530893 - DNA, 19 bp, Homo sapiens
tttgggaaaagaagctgtc

SEQ ID NO: 3530894 - DNA, 16 bp, Homo sapiens
tttgtacaaactattt

SEQ ID NO: 3530895 - DNA, 12 bp, Homo sapiens
tttgtgtcccat

SEQ ID NO: 3530896 - DNA, 18 bp, Homo sapiens
ttttaagggatgttgcaa

SEQ ID NO: 3530897 - DNA, 23 bp, Homo sapiens
ttttactaccatttttttttaac

SEQ ID NO: 3530898 - DNA, 23 bp, Homo sapiens
ttttctccctggatttttaccag

SEQ ID NO: 3530899 - DNA, 15 bp, Homo sapiens
ttttgataaattact

SEQ ID NO: 3530900 - DNA, 22 bp, Homo sapiens
ttttgatagcaatgttccagga

SEQ ID NO: 3530901 - DNA, 16 bp, Homo sapiens
tgtgatgaaaaggcag

SEQ ID NO: 3530902 - DNA, 21 bp, Homo sapiens
tgtgcattaaaattaaatact

SEQ ID NO: 3530903 - DNA, 23 bp, Homo sapiens
tgtgcattaaaattaaatacttt

SEQ ID NO: 3530904 - DNA, 18 bp, Homo sapiens
tgtgtaatgactgagatt

SEQ ID NO: 3530905 - DNA, 22 bp, Homo sapiens
tgtgtatacacttaaacttgca

SEQ ID NO: 3530906 - DNA, 19 bp, Homo sapiens
tgtgtggacggcgctgcct

SEQ ID NO: 3530907 - DNA, 18 bp, Homo sapiens
tgttacttccccacccct

SEQ ID NO: 3530908 - DNA, 23 bp, Homo sapiens
tgttatcagctgggcagtgccag

SEQ ID NO: 3530909 - DNA, 18 bp, Homo sapiens
tgttgccagttgtcctcc

SEQ ID NO: 3530910 - DNA, 19 bp, Homo sapiens
tgttgccagttgtcctcct

SEQ ID NO: 3530911 - DNA, 15 bp, Homo sapiens
tgttgctcagtgtgt

SEQ ID NO: 3530912 - DNA, 19 bp, Homo sapiens
tgttgctcagtgtgtaatg

SEQ ID NO: 3530913 - DNA, 16 bp, Homo sapiens
tgttggcgtgtcccag

SEQ ID NO: 3530914 - DNA, 12 bp, Homo sapiens
tctaatgtaaat

SEQ ID NO: 3530915 - DNA, 14 bp, Homo sapiens
tctaatgtaaattt

SEQ ID NO: 3530916 - DNA, 18 bp, Homo sapiens
tctaggcccacaagtgta

SEQ ID NO: 3530917 - DNA, 22 bp, Homo sapiens
tctattgcctctgagagcatca

SEQ ID NO: 3530918 - DNA, 16 bp, Homo sapiens
tctcaagagtgctgag

SEQ ID NO: 3530919 - DNA, 17 bp, Homo sapiens
tctcaagagtgctgaga

SEQ ID NO: 3530920 - DNA, 19 bp, Homo sapiens
tctcacatgattccagcca

SEQ ID NO: 3530921 - DNA, 19 bp, Homo sapiens
tctccagcagttaggcacc

SEQ ID NO: 3530922 - DNA, 14 bp, Homo sapiens
tctccctaaagtgt

SEQ ID NO: 3530923 - DNA, 22 bp, Homo sapiens
tctcgttgaggccaaggaatga

SEQ ID NO: 3530924 - DNA, 13 bp, Homo sapiens
tctctagcagtga

SEQ ID NO: 3530925 - DNA, 19 bp, Homo sapiens
tctctcaagagtgctgaga

SEQ ID NO: 3530926 - DNA, 17 bp, Homo sapiens
tctctgcaaactgcctt

SEQ ID NO: 3530927 - DNA, 12 bp, Homo sapiens
tctctgctgtcc

SEQ ID NO: 3530928 - DNA, 14 bp, Homo sapiens
tctctgctgtccta

SEQ ID NO: 3530929 - DNA, 14 bp, Homo sapiens
tctctttcaatgtg

SEQ ID NO: 3530930 - DNA, 13 bp, Homo sapiens
tctgaactgcttg

SEQ ID NO: 3530931 - DNA, 18 bp, Homo sapiens
tctgaagaagggaattag

SEQ ID NO: 3530932 - DNA, 14 bp, Homo sapiens
tctgaatctcccaa

SEQ ID NO: 3530933 - DNA, 16 bp, Homo sapiens
tctgagttttaccaaa

SEQ ID NO: 3530934 - DNA, 19 bp, Homo sapiens
tctgatagtagtctttaaa

SEQ ID NO: 3530935 - DNA, 19 bp, Homo sapiens
tctgattgaaacatgaaac

SEQ ID NO: 3530936 - DNA, 15 bp, Homo sapiens
tctgcaaactgcctt

SEQ ID NO: 3530937 - DNA, 21 bp, Homo sapiens
tctgcccctaaagatgggagg

SEQ ID NO: 3530938 - DNA, 15 bp, Homo sapiens
tctggaatgcttctg

SEQ ID NO: 3530939 - DNA, 21 bp, Homo sapiens
tctggagcaatctgacccttc

SEQ ID NO: 3530940 - DNA, 18 bp, Homo sapiens
tctggtgacccagagatc

SEQ ID NO: 3530941 - DNA, 12 bp, Homo sapiens
tctggtgctgct

SEQ ID NO: 3530942 - DNA, 14 bp, Homo sapiens
tctgtgagaagttt

SEQ ID NO: 3530943 - DNA, 21 bp, Homo sapiens
tctgttatcagctgggcagtg

SEQ ID NO: 3530944 - DNA, 21 bp, Homo sapiens
tctgttttcccaacctcctgt

SEQ ID NO: 3530945 - DNA, 21 bp, Homo sapiens
tcttagactgagtaaagtgtt

SEQ ID NO: 3530946 - DNA, 22 bp, Homo sapiens
tcttagactgagtaaagtgtta

SEQ ID NO: 3530947 - DNA, 20 bp, Homo sapiens
tcttatctactgactgaaat

SEQ ID NO: 3530948 - DNA, 15 bp, Homo sapiens
tcttatttattaact

SEQ ID NO: 3530949 - DNA, 15 bp, Homo sapiens
tcttcaagtagattg

SEQ ID NO: 3530950 - DNA, 16 bp, Homo sapiens
tcttccgttggaaaga

SEQ ID NO: 3530951 - DNA, 16 bp, Homo sapiens
tcttggccatgggagg

SEQ ID NO: 3530952 - DNA, 21 bp, Homo sapiens
tcttggggttcataggggcag

SEQ ID NO: 3530953 - DNA, 21 bp, Homo sapiens
tcttgtgactcagcagaggca

SEQ ID NO: 3530954 - DNA, 13 bp, Homo sapiens
tctttgtgaacat

SEQ ID NO: 3530955 - DNA, 11 bp, Homo sapiens
tgaaaaggcag

SEQ ID NO: 3530956 - DNA, 14 bp, Homo sapiens
tgaaaataagaaag

SEQ ID NO: 3530957 - DNA, 15 bp, Homo sapiens
tgaaaataagaaaga

SEQ ID NO: 3530958 - DNA, 13 bp, Homo sapiens
tgaaaatgtgtat

SEQ ID NO: 3530959 - DNA, 14 bp, Homo sapiens
tgaaaatgtgtata

SEQ ID NO: 3530960 - DNA, 18 bp, Homo sapiens
tgaaacattttctccctg

SEQ ID NO: 3530961 - DNA, 19 bp, Homo sapiens
tgaaacattttctccctgg

SEQ ID NO: 3530962 - DNA, 12 bp, Homo sapiens
tgaaagtgctgc

SEQ ID NO: 3530963 - DNA, 16 bp, Homo sapiens
tgaaatatagatgtta

SEQ ID NO: 3530964 - DNA, 21 bp, Homo sapiens
tgaaatcagtggtgttacatt

SEQ ID NO: 3530965 - DNA, 16 bp, Homo sapiens
tgaagtatttcatgta

SEQ ID NO: 3530966 - DNA, 18 bp, Homo sapiens
tgaatactcctgttagta

SEQ ID NO: 3530967 - DNA, 23 bp, Homo sapiens
tgaatctcgttgaggccaaggaa

SEQ ID NO: 3530968 - DNA, 21 bp, Homo sapiens
tgaccagaccaaggcagggcc

SEQ ID NO: 3530969 - DNA, 13 bp, Homo sapiens
tgaccctcccggc

SEQ ID NO: 3530970 - DNA, 22 bp, Homo sapiens
tgaccctcccggcctggcttca

SEQ ID NO: 3530971 - DNA, 17 bp, Homo sapiens
tgaccggaatggtcaaa

SEQ ID NO: 3530972 - DNA, 22 bp, Homo sapiens
tgaccggaatggtcaaatctct

SEQ ID NO: 3530973 - DNA, 20 bp, Homo sapiens
tgaccttgggaccaaagggg

SEQ ID NO: 3530974 - DNA, 17 bp, Homo sapiens
tgactgagatttgtaaa

SEQ ID NO: 3530975 - DNA, 18 bp, Homo sapiens
tgactgagatttgtaaat

SEQ ID NO: 3530976 - DNA, 20 bp, Homo sapiens
tgactgagatttgtaaatct

SEQ ID NO: 3530977 - DNA, 16 bp, Homo sapiens
tgactgtcagggaggg

SEQ ID NO: 3530978 - DNA, 20 bp, Homo sapiens
tgactgtcagggagggccag

SEQ ID NO: 3530979 - DNA, 22 bp, Homo sapiens
tgactgtcagggagggccaggg

SEQ ID NO: 3530980 - DNA, 21 bp, Homo sapiens
tgacttgaggcacaaatcact

SEQ ID NO: 3530981 - DNA, 13 bp, Homo sapiens
tgagaattacaga

SEQ ID NO: 3530982 - DNA, 18 bp, Homo sapiens
tgagaattacagaaaatt

SEQ ID NO: 3530983 - DNA, 22 bp, Homo sapiens
tgagaattacagaaaatttgca

SEQ ID NO: 3530984 - DNA, 14 bp, Homo sapiens
tgagatttgtaaat

SEQ ID NO: 3530985 - DNA, 19 bp, Homo sapiens
tgagctagcaaatacagga

SEQ ID NO: 3530986 - DNA, 16 bp, Homo sapiens
tgagctcttgctatct

SEQ ID NO: 3530987 - DNA, 17 bp, Homo sapiens
tgaggaccagggtggag

SEQ ID NO: 3530988 - DNA, 21 bp, Homo sapiens
tgaggaccagggtggagctga

SEQ ID NO: 3530989 - DNA, 12 bp, Homo sapiens
tgaggccaagga

SEQ ID NO: 3530990 - DNA, 11 bp, Homo sapiens
tgaggggaccc

SEQ ID NO: 3530991 - DNA, 16 bp, Homo sapiens
tgaggggctggggagg

SEQ ID NO: 3530992 - DNA, 18 bp, Homo sapiens
tgaggggtgtccgagagg

SEQ ID NO: 3530993 - DNA, 14 bp, Homo sapiens
tgagtaaagtgtta

SEQ ID NO: 3530994 - DNA, 13 bp, Homo sapiens
tgagttttaccaa

SEQ ID NO: 3530995 - DNA, 14 bp, Homo sapiens
tgatggccagagga

SEQ ID NO: 3530996 - DNA, 12 bp, Homo sapiens
tgatgggctttt

SEQ ID NO: 3530997 - DNA, 15 bp, Homo sapiens
tgattccagccatca

SEQ ID NO: 3530998 - DNA, 13 bp, Homo sapiens
tgattgaaacatg

SEQ ID NO: 3530999 - DNA, 14 bp, Homo sapiens
tgatttatggctgt

SEQ ID NO: 3531000 - DNA, 18 bp, Homo sapiens
tgatttttatcaggcttt

SEQ ID NO: 3531001 - DNA, 20 bp, Homo sapiens
tgcacatttgaattcatttg

SEQ ID NO: 3531002 - DNA, 20 bp, Homo sapiens
tgcactccaagaaacgtgga

SEQ ID NO: 3531003 - DNA, 18 bp, Homo sapiens
ctctccctgacggctgcc

SEQ ID NO: 3531004 - DNA, 13 bp, Homo sapiens
ctctcctttttct

SEQ ID NO: 3531005 - DNA, 13 bp, Homo sapiens
ctctgaccctggg

SEQ ID NO: 3531006 - DNA, 15 bp, Homo sapiens
ctctgcaaactgcct

SEQ ID NO: 3531007 - DNA, 22 bp, Homo sapiens
ctctgttatcagctgggcagtg

SEQ ID NO: 3531008 - DNA, 19 bp, Homo sapiens
ctcttaagatgtccagggc

SEQ ID NO: 3531009 - DNA, 19 bp, Homo sapiens
ctcttccgttggaaagaac

SEQ ID NO: 3531010 - DNA, 21 bp, Homo sapiens
ctcttccgttggaaagaacat

SEQ ID NO: 3531011 - DNA, 22 bp, Homo sapiens
ctctttcaatgtgtttaatttt

SEQ ID NO: 3531012 - DNA, 20 bp, Homo sapiens
ctgaaaaaatgctgagccag

SEQ ID NO: 3531013 - DNA, 21 bp, Homo sapiens
ctgaaaaaatgctgagccagc

SEQ ID NO: 3531014 - DNA, 15 bp, Homo sapiens
ctgaatctcccaagg

SEQ ID NO: 3531015 - DNA, 11 bp, Homo sapiens
ctgaattttag

SEQ ID NO: 3531016 - DNA, 17 bp, Homo sapiens
ctgacccaaaatgtgaa

SEQ ID NO: 3531017 - DNA, 19 bp, Homo sapiens
ctgacccttctccaaaggc

SEQ ID NO: 3531018 - DNA, 22 bp, Homo sapiens
ctgaccgatggtgtttgggaat

SEQ ID NO: 3531019 - DNA, 19 bp, Homo sapiens
ctgaccggaatggtcaaat

SEQ ID NO: 3531020 - DNA, 18 bp, Homo sapiens
ctgactgccaagccatgg

SEQ ID NO: 3531021 - DNA, 18 bp, Homo sapiens
ctgactgtcagggagggc

SEQ ID NO: 3531022 - DNA, 13 bp, Homo sapiens
ctgacttcccaag

SEQ ID NO: 3531023 - DNA, 23 bp, Homo sapiens
ctgacttcccaagccctggtgac

SEQ ID NO: 3531024 - DNA, 14 bp, Homo sapiens
ctgagaagaggagg

SEQ ID NO: 3531025 - DNA, 23 bp, Homo sapiens
ctgagctcttgctatctctcaag

SEQ ID NO: 3531026 - DNA, 18 bp, Homo sapiens
ctgaggggctggggaggg

SEQ ID NO: 3531027 - DNA, 12 bp, Homo sapiens
ctgaggtccaag

SEQ ID NO: 3531028 - DNA, 21 bp, Homo sapiens
ctgaggtccaagattctggag

SEQ ID NO: 3531029 - DNA, 15 bp, Homo sapiens
ctgagtctggagtga

SEQ ID NO: 3531030 - DNA, 14 bp, Homo sapiens
ctgagttttaccaa

SEQ ID NO: 3531031 - DNA, 14 bp, Homo sapiens
ctgataggaggggg

SEQ ID NO: 3531032 - DNA, 20 bp, Homo sapiens
ctgataggagggggcggcag

SEQ ID NO: 3531033 - DNA, 18 bp, Homo sapiens
ctgatggtgaaaccaaac

SEQ ID NO: 3531034 - DNA, 13 bp, Homo sapiens
ctgattgaaacat

SEQ ID NO: 3531035 - DNA, 14 bp, Homo sapiens
ctgattgaaacatg

SEQ ID NO: 3531036 - DNA, 15 bp, Homo sapiens
ctgcagccagaaagg

SEQ ID NO: 3531037 - DNA, 14 bp, Homo sapiens
ctgcccccagagcc

SEQ ID NO: 3531038 - DNA, 23 bp, Homo sapiens
ctgcccctgtaaggtttcaatgc

SEQ ID NO: 3531039 - DNA, 14 bp, Homo sapiens
ctgccctccctcag

SEQ ID NO: 3531040 - DNA, 16 bp, Homo sapiens
ctgccctgctgtggaa

SEQ ID NO: 3531041 - DNA, 17 bp, Homo sapiens
ctgccctgctgtggaag

SEQ ID NO: 3531042 - DNA, 21 bp, Homo sapiens
ctgcgtgtgggaggctgggga

SEQ ID NO: 3531043 - DNA, 16 bp, Homo sapiens
ctgctgccctgctgtg

SEQ ID NO: 3531044 - DNA, 21 bp, Homo sapiens
ctgcttgctaccaatctgtga

SEQ ID NO: 3531045 - DNA, 17 bp, Homo sapiens
ctgcttttgtgtcccat

SEQ ID NO: 3531046 - DNA, 22 bp, Homo sapiens
ctgcttttgtgtcccattcaca

SEQ ID NO: 3531047 - DNA, 13 bp, Homo sapiens
ctggaatgcttct

SEQ ID NO: 3531048 - DNA, 14 bp, Homo sapiens
ctggacctgggtta

SEQ ID NO: 3531049 - DNA, 15 bp, Homo sapiens
ctggagaccgaggcc

SEQ ID NO: 3531050 - DNA, 14 bp, Homo sapiens
ctggagctgggagg

SEQ ID NO: 3531051 - DNA, 17 bp, Homo sapiens
ctggagctgggaggtct

SEQ ID NO: 3531052 - DNA, 20 bp, Homo sapiens
ctggaggtgctggtagctga

SEQ ID NO: 3531053 - DNA, 16 bp, Homo sapiens
ctggatcaagttcagc

SEQ ID NO: 3531054 - DNA, 21 bp, Homo sapiens
ctggatcaagttcagccaccg

SEQ ID NO: 3531055 - DNA, 14 bp, Homo sapiens
ctggatttttacca

SEQ ID NO: 3531056 - DNA, 23 bp, Homo sapiens
ctggccgtatctgagggctgctc

SEQ ID NO: 3531057 - DNA, 20 bp, Homo sapiens
atgctaatatttttaacaag

SEQ ID NO: 3531058 - DNA, 22 bp, Homo sapiens
atgctgtttgtacaaactattt

SEQ ID NO: 3531059 - DNA, 14 bp, Homo sapiens
atgcttctgcatca

SEQ ID NO: 3531060 - DNA, 17 bp, Homo sapiens
atgggcttttgttctga

SEQ ID NO: 3531061 - DNA, 22 bp, Homo sapiens
atgggggctttcggggagggcg

SEQ ID NO: 3531062 - DNA, 14 bp, Homo sapiens
atgggtctggcctg

SEQ ID NO: 3531063 - DNA, 19 bp, Homo sapiens
atggtggatgatccccacg

SEQ ID NO: 3531064 - DNA, 22 bp, Homo sapiens
atggtggatgatccccacgcca

SEQ ID NO: 3531065 - DNA, 15 bp, Homo sapiens
atggtgtttgggaat

SEQ ID NO: 3531066 - DNA, 13 bp, Homo sapiens
atgtatacttgaa

SEQ ID NO: 3531067 - DNA, 14 bp, Homo sapiens
atgtatacttgaaa

SEQ ID NO: 3531068 - DNA, 16 bp, Homo sapiens
atgtatacttgaaaaa

SEQ ID NO: 3531069 - DNA, 19 bp, Homo sapiens
atgtatcttatagtcactc

SEQ ID NO: 3531070 - DNA, 17 bp, Homo sapiens
atgtcaaagctgcatgt

SEQ ID NO: 3531071 - DNA, 16 bp, Homo sapiens
atgtctctagcagtga

SEQ ID NO: 3531072 - DNA, 21 bp, Homo sapiens
atgtctttattagtaacatca

SEQ ID NO: 3531073 - DNA, 23 bp, Homo sapiens
atgtgaattgttagtttctgagt

SEQ ID NO: 3531074 - DNA, 17 bp, Homo sapiens
atgtgtaggatgtatgc

SEQ ID NO: 3531075 - DNA, 17 bp, Homo sapiens
atgtgtatacacttaaa

SEQ ID NO: 3531076 - DNA, 22 bp, Homo sapiens
atgtgtatacacttaaacttgc

SEQ ID NO: 3531077 - DNA, 15 bp, Homo sapiens
atgtgtttaattttg

SEQ ID NO: 3531078 - DNA, 13 bp, Homo sapiens
atgttaactttca

SEQ ID NO: 3531079 - DNA, 12 bp, Homo sapiens
atgttgcaaagg

SEQ ID NO: 3531080 - DNA, 15 bp, Homo sapiens
atgttgcaaagggat

SEQ ID NO: 3531081 - DNA, 22 bp, Homo sapiens
atgtttggacaccctgtcagac

SEQ ID NO: 3531082 - DNA, 12 bp, Homo sapiens
attaaataaatt

SEQ ID NO: 3531083 - DNA, 19 bp, Homo sapiens
attaaatttttaaaatctg

SEQ ID NO: 3531084 - DNA, 17 bp, Homo sapiens
attagatttctgaatct

SEQ ID NO: 3531085 - DNA, 13 bp, Homo sapiens
attagtaacatca

SEQ ID NO: 3531086 - DNA, 22 bp, Homo sapiens
attatagtcaatataccatgac

SEQ ID NO: 3531087 - DNA, 20 bp, Homo sapiens
attatgaaaattaagattat

SEQ ID NO: 3531088 - DNA, 21 bp, Homo sapiens
attatgaaaattaagattatt

SEQ ID NO: 3531089 - DNA, 20 bp, Homo sapiens
attattgtctgattgaaaca

SEQ ID NO: 3531090 - DNA, 21 bp, Homo sapiens
attattgtctgattgaaacat

SEQ ID NO: 3531091 - DNA, 14 bp, Homo sapiens
attattttgataaa

SEQ ID NO: 3531092 - DNA, 18 bp, Homo sapiens
attcaatgcttgatgtta

SEQ ID NO: 3531093 - DNA, 20 bp, Homo sapiens
attcaatgcttgatgttaca

SEQ ID NO: 3531094 - DNA, 14 bp, Homo sapiens
attccacaggacac

SEQ ID NO: 3531095 - DNA, 21 bp, Homo sapiens
attctccagaccaaagcaatc

SEQ ID NO: 3531096 - DNA, 15 bp, Homo sapiens
attctgataggaggg

SEQ ID NO: 3531097 - DNA, 16 bp, Homo sapiens
attctgataggagggg

SEQ ID NO: 3531098 - DNA, 14 bp, Homo sapiens
attgcctctgagag

SEQ ID NO: 3531099 - DNA, 16 bp, Homo sapiens
attggtgttgccagtt

SEQ ID NO: 3531100 - DNA, 16 bp, Homo sapiens
attgtaatgtatactt

SEQ ID NO: 3531101 - DNA, 17 bp, Homo sapiens
attgtctgattgaaaca

SEQ ID NO: 3531102 - DNA, 22 bp, Homo sapiens
attgtctgattgaaacatgaaa

SEQ ID NO: 3531103 - DNA, 15 bp, Homo sapiens
attgtctgtgaagtg

SEQ ID NO: 3531104 - DNA, 15 bp, Homo sapiens
attgttagtttctga

SEQ ID NO: 3531105 - DNA, 15 bp, Homo sapiens
atttacaaatgaagt

SEQ ID NO: 3531106 - DNA, 19 bp, Homo sapiens
atttacaaatgaagtattt

SEQ ID NO: 3531107 - DNA, 23 bp, Homo sapiens
atttagtcccaccctatggccac

SEQ ID NO: 3531108 - DNA, 18 bp, Homo sapiens
atttatggctgttcctga

SEQ ID NO: 3531109 - DNA, 14 bp, Homo sapiens
atttatgtgctgtt

SEQ ID NO: 3531110 - DNA, 16 bp, Homo sapiens
atttcaaaatatgtgt

SEQ ID NO: 3531111 - DNA, 17 bp, Homo sapiens
atttcaaaatatgtgta

SEQ ID NO: 3531112 - DNA, 15 bp, Homo sapiens
atttcagaatatttt

SEQ ID NO: 3531113 - DNA, 16 bp, Homo sapiens
atttcagaatattttg

SEQ ID NO: 3531114 - DNA, 14 bp, Homo sapiens
atttcatgtaatat

SEQ ID NO: 3531115 - DNA, 19 bp, Homo sapiens
atttgaattcatttgctga

SEQ ID NO: 3531116 - DNA, 14 bp, Homo sapiens
atttgctatttaca

SEQ ID NO: 3531117 - DNA, 18 bp, Homo sapiens
atttgggaaaagaagctg

SEQ ID NO: 3531118 - DNA, 22 bp, Homo sapiens
atttgggaaaagaagctgtcag

SEQ ID NO: 3531119 - DNA, 23 bp, Homo sapiens
atttgtaaatctttgtgaacatt

SEQ ID NO: 3531120 - DNA, 17 bp, Homo sapiens
attttaatgttaacttt

SEQ ID NO: 3531121 - DNA, 21 bp, Homo sapiens
attttaatgttaactttcaaa

SEQ ID NO: 3531122 - DNA, 14 bp, Homo sapiens
attttgataaatta

SEQ ID NO: 3531123 - DNA, 23 bp, Homo sapiens
attttgatagcaatgttccagga

SEQ ID NO: 3531124 - DNA, 22 bp, Homo sapiens
attttgtaagctataacatatt

SEQ ID NO: 3531125 - DNA, 18 bp, Homo sapiens
caggggacgtgggccctg

SEQ ID NO: 3531126 - DNA, 22 bp, Homo sapiens
caggggacgtgggccctgcagg

SEQ ID NO: 3531127 - DNA, 18 bp, Homo sapiens
caggtggccatcacagcc

SEQ ID NO: 3531128 - DNA, 15 bp, Homo sapiens
cagtaaagtcttgtc

SEQ ID NO: 3531129 - DNA, 14 bp, Homo sapiens
cagtgccagccaat

SEQ ID NO: 3531130 - DNA, 23 bp, Homo sapiens
cagtggccacgttcagggagggg

SEQ ID NO: 3531131 - DNA, 18 bp, Homo sapiens
cagtgttaaagtggtctg

SEQ ID NO: 3531132 - DNA, 20 bp, Homo sapiens
cagttcttagattcagggga

SEQ ID NO: 3531133 - DNA, 22 bp, Homo sapiens
cagttcttagattcaggggaag

SEQ ID NO: 3531134 - DNA, 15 bp, Homo sapiens
cagttgtcctccttc

SEQ ID NO: 3531135 - DNA, 17 bp, Homo sapiens
cagtttaatattccaat

SEQ ID NO: 3531136 - DNA, 12 bp, Homo sapiens
catacaataaaa

SEQ ID NO: 3531137 - DNA, 18 bp, Homo sapiens
catacaataaaagagctt

SEQ ID NO: 3531138 - DNA, 15 bp, Homo sapiens
catacaccaaacatt

SEQ ID NO: 3531139 - DNA, 17 bp, Homo sapiens
catacaccaaacatttc

SEQ ID NO: 3531140 - DNA, 15 bp, Homo sapiens
catagagaggcctgc

SEQ ID NO: 3531141 - DNA, 18 bp, Homo sapiens
catatcatataaaatttc

SEQ ID NO: 3531142 - DNA, 21 bp, Homo sapiens
catatcatataaaatttcagg

SEQ ID NO: 3531143 - DNA, 15 bp, Homo sapiens
catatgaggggaccc

SEQ ID NO: 3531144 - DNA, 17 bp, Homo sapiens
catcgtcttcttggcca

SEQ ID NO: 3531145 - DNA, 16 bp, Homo sapiens
catctcggggctgctg

SEQ ID NO: 3531146 - DNA, 24 bp, Homo sapiens
catctgtaggtcactctccagcag

SEQ ID NO: 3531147 - DNA, 19 bp, Homo sapiens
catgacttgaggcacaaat

SEQ ID NO: 3531148 - DNA, 19 bp, Homo sapiens
catgagaattacagaaaat

SEQ ID NO: 3531149 - DNA, 14 bp, Homo sapiens
catgattccagcca

SEQ ID NO: 3531150 - DNA, 21 bp, Homo sapiens
catgcagcgaattcagaaaga

SEQ ID NO: 3531151 - DNA, 18 bp, Homo sapiens
catggcaatggcatgccc

SEQ ID NO: 3531152 - DNA, 21 bp, Homo sapiens
catgggaggcctttccctaag

SEQ ID NO: 3531153 - DNA, 15 bp, Homo sapiens
catgggtagcctggg

SEQ ID NO: 3531154 - DNA, 22 bp, Homo sapiens
catgtcaaagctgcatgtgtag

SEQ ID NO: 3531155 - DNA, 22 bp, Homo sapiens
catgttgcttcactctatccaa

SEQ ID NO: 3531156 - DNA, 14 bp, Homo sapiens
cattaagtgacttt

SEQ ID NO: 3531157 - DNA, 16 bp, Homo sapiens
cattctgataggaggg

SEQ ID NO: 3531158 - DNA, 18 bp, Homo sapiens
cattctgataggaggggg

SEQ ID NO: 3531159 - DNA, 20 bp, Homo sapiens
catttaaaattaaataaatt

SEQ ID NO: 3531160 - DNA, 21 bp, Homo sapiens
catttaaaattaaataaattt

SEQ ID NO: 3531161 - DNA, 18 bp, Homo sapiens
catttcaaaatatgtgta

SEQ ID NO: 3531162 - DNA, 16 bp, Homo sapiens
catttctgtgaaacta

SEQ ID NO: 3531163 - DNA, 23 bp, Homo sapiens
catttgacacacagttgttgaat

SEQ ID NO: 3531164 - DNA, 16 bp, Homo sapiens
catttggccccagggg

SEQ ID NO: 3531165 - DNA, 20 bp, Homo sapiens
catttggccccaggggacgt

SEQ ID NO: 3531166 - DNA, 13 bp, Homo sapiens
cattttctccctg

SEQ ID NO: 3531167 - DNA, 11 bp, Homo sapiens
ccaaacatttc

SEQ ID NO: 3531168 - DNA, 19 bp, Homo sapiens
ccaagaaacgtggatctcc

SEQ ID NO: 3531169 - DNA, 18 bp, Homo sapiens
ccaagccctggtgaccag

SEQ ID NO: 3531170 - DNA, 21 bp, Homo sapiens
aaaaacacagtgaaaggcctg

SEQ ID NO: 3531171 - DNA, 11 bp, Homo sapiens
aaaaacagaaa

SEQ ID NO: 3531172 - DNA, 12 bp, Homo sapiens
aaaaacagaaaa

SEQ ID NO: 3531173 - DNA, 22 bp, Homo sapiens
aaaaactcccatatcatataaa

SEQ ID NO: 3531174 - DNA, 16 bp, Homo sapiens
aaaaagcatgaatatt

SEQ ID NO: 3531175 - DNA, 17 bp, Homo sapiens
aaaacacaaaatgaata

SEQ ID NO: 3531176 - DNA, 14 bp, Homo sapiens
aaaagcatgaatat

SEQ ID NO: 3531177 - DNA, 15 bp, Homo sapiens
aaaaggcagcatttg

SEQ ID NO: 3531178 - DNA, 24 bp, Homo sapiens
aaaatcaaggagtcttctaatgta

SEQ ID NO: 3531179 - DNA, 20 bp, Homo sapiens
aaaatctgctgatctctgta

SEQ ID NO: 3531180 - DNA, 15 bp, Homo sapiens
aaaatgaataaaagt

SEQ ID NO: 3531181 - DNA, 19 bp, Homo sapiens
aaaattaaataaattttaa

SEQ ID NO: 3531182 - DNA, 14 bp, Homo sapiens
aaaattaaatactt

SEQ ID NO: 3531183 - DNA, 17 bp, Homo sapiens
aaaattaagattattgt

SEQ ID NO: 3531184 - DNA, 14 bp, Homo sapiens
aaacacaaaatgaa

SEQ ID NO: 3531185 - DNA, 21 bp, Homo sapiens
aaacacagtgaaaggcctgct

SEQ ID NO: 3531186 - DNA, 14 bp, Homo sapiens
aaacatgaaacaac

SEQ ID NO: 3531187 - DNA, 16 bp, Homo sapiens
aaacatgaaacaactc

SEQ ID NO: 3531188 - DNA, 12 bp, Homo sapiens
aaacatttctgt

SEQ ID NO: 3531189 - DNA, 16 bp, Homo sapiens
aaacatttctgtgaaa

SEQ ID NO: 3531190 - DNA, 13 bp, Homo sapiens
aaacattttctcc

SEQ ID NO: 3531191 - DNA, 11 bp, Homo sapiens
aaacctggaga

SEQ ID NO: 3531192 - DNA, 19 bp, Homo sapiens
aaacctggagatggtggat

SEQ ID NO: 3531193 - DNA, 13 bp, Homo sapiens
aaacggtctttat

SEQ ID NO: 3531194 - DNA, 22 bp, Homo sapiens
aaacggtctttatgaattattt

SEQ ID NO: 3531195 - DNA, 13 bp, Homo sapiens
aaactatttcaga

SEQ ID NO: 3531196 - DNA, 17 bp, Homo sapiens
aaactatttcagaatat

SEQ ID NO: 3531197 - DNA, 23 bp, Homo sapiens
aaactatttcagaatattttgta

SEQ ID NO: 3531198 - DNA, 22 bp, Homo sapiens
agctcttggtgggcccagggac

SEQ ID NO: 3531199 - DNA, 14 bp, Homo sapiens
agctgaaaatgtgt

SEQ ID NO: 3531200 - DNA, 15 bp, Homo sapiens
agctgaggggacggg

SEQ ID NO: 3531201 - DNA, 14 bp, Homo sapiens
agctgcccccagag

SEQ ID NO: 3531202 - DNA, 16 bp, Homo sapiens
agctgcccccagagcc

SEQ ID NO: 3531203 - DNA, 21 bp, Homo sapiens
agctgcccccagagccacagt

SEQ ID NO: 3531204 - DNA, 16 bp, Homo sapiens
agctgggcagtgccag

SEQ ID NO: 3531205 - DNA, 14 bp, Homo sapiens
agctgtcagaagtt

SEQ ID NO: 3531206 - DNA, 15 bp, Homo sapiens
agcttttcctcaggg

SEQ ID NO: 3531207 - DNA, 20 bp, Homo sapiens
agcttttcctcagggtgtcc

SEQ ID NO: 3531208 - DNA, 23 bp, Homo sapiens
aggaaagaatttgtatcatgttt

SEQ ID NO: 3531209 - DNA, 14 bp, Homo sapiens
aggaaagagaagct

SEQ ID NO: 3531210 - DNA, 22 bp, Homo sapiens
aggaactctgggcagctggagg

SEQ ID NO: 3531211 - DNA, 14 bp, Homo sapiens
aggacactggatca

SEQ ID NO: 3531212 - DNA, 14 bp, Homo sapiens
aggaccagggtgga

SEQ ID NO: 3531213 - DNA, 18 bp, Homo sapiens
aggaggaggctgccctga

SEQ ID NO: 3531214 - DNA, 18 bp, Homo sapiens
aggaggctgccctgaggg

SEQ ID NO: 3531215 - DNA, 20 bp, Homo sapiens
aggagtcttctaatgtaaat

SEQ ID NO: 3531216 - DNA, 14 bp, Homo sapiens
aggatgtatgctgt

SEQ ID NO: 3531217 - DNA, 20 bp, Homo sapiens
aggatttccctgaagctatg

SEQ ID NO: 3531218 - DNA, 16 bp, Homo sapiens
aggcaaaaaccagaaa

SEQ ID NO: 3531219 - DNA, 15 bp, Homo sapiens
aggcacaaatcactg

SEQ ID NO: 3531220 - DNA, 16 bp, Homo sapiens
aggcaccttaactgga

SEQ ID NO: 3531221 - DNA, 17 bp, Homo sapiens
aggcaccttaactggag

SEQ ID NO: 3531222 - DNA, 18 bp, Homo sapiens
aggcaccttaactggaga

SEQ ID NO: 3531223 - DNA, 15 bp, Homo sapiens
aggcactctcctgtc

SEQ ID NO: 3531224 - DNA, 18 bp, Homo sapiens
aggcactctcctgtctga

SEQ ID NO: 3531225 - DNA, 14 bp, Homo sapiens
aggcagagcgggag

SEQ ID NO: 3531226 - DNA, 19 bp, Homo sapiens
aggcagagcgggagggagt

SEQ ID NO: 3531227 - DNA, 16 bp, Homo sapiens
aggcccgcgggcacag

SEQ ID NO: 3531228 - DNA, 20 bp, Homo sapiens
aggcctcagctcttggtggg

SEQ ID NO: 3531229 - DNA, 21 bp, Homo sapiens
aggcctgactgccaagccatg

SEQ ID NO: 3531230 - DNA, 20 bp, Homo sapiens
aggcctttccctaagccagc

SEQ ID NO: 3531231 - DNA, 14 bp, Homo sapiens
aggctgcaggaggg

SEQ ID NO: 3531232 - DNA, 16 bp, Homo sapiens
aggctgcaggagggca

SEQ ID NO: 3531233 - DNA, 18 bp, Homo sapiens
aggctgcaggagggcact

SEQ ID NO: 3531234 - DNA, 13 bp, Homo sapiens
aggctgcccctgt

SEQ ID NO: 3531235 - DNA, 15 bp, Homo sapiens
aggctgccctgaggg

SEQ ID NO: 3531236 - DNA, 23 bp, Homo sapiens
aggctgccctgaggggctgggga

SEQ ID NO: 3531237 - DNA, 14 bp, Homo sapiens
aggctggggaccca

SEQ ID NO: 3531238 - DNA, 20 bp, Homo sapiens
aggctgttggcgtgtcccag

SEQ ID NO: 3531239 - DNA, 18 bp, Homo sapiens
aggctttgccctgctgcc

SEQ ID NO: 3531240 - DNA, 15 bp, Homo sapiens
agggaagtcctggga

SEQ ID NO: 3531241 - DNA, 15 bp, Homo sapiens
agggaggcagagcgg

SEQ ID NO: 3531242 - DNA, 15 bp, Homo sapiens
agggagggccaggga

SEQ ID NO: 3531243 - DNA, 17 bp, Homo sapiens
agggagggccagggagg

SEQ ID NO: 3531244 - DNA, 20 bp, Homo sapiens
agggagggccagggaggcag

SEQ ID NO: 3531245 - DNA, 20 bp, Homo sapiens
agggaggggccggctggcct

SEQ ID NO: 3531246 - DNA, 16 bp, Homo sapiens
agggcagggggcccct

SEQ ID NO: 3531247 - DNA, 15 bp, Homo sapiens
agggcccctgaccct

SEQ ID NO: 3531248 - DNA, 14 bp, Homo sapiens
aggggacgggcaag

SEQ ID NO: 3531249 - DNA, 21 bp, Homo sapiens
aggggacgggcaagtgagagg

SEQ ID NO: 3531250 - DNA, 17 bp, Homo sapiens
aggggacgtgggccctg

SEQ ID NO: 3531251 - DNA, 21 bp, Homo sapiens
aggggccggctggcctggagg

SEQ ID NO: 3531252 - DNA, 22 bp, Homo sapiens
aggggctgcgtgtgggaggctg

SEQ ID NO: 3531253 - DNA, 13 bp, Homo sapiens
aggggctggggag

SEQ ID NO: 3531254 - DNA, 16 bp, Homo sapiens
aggggctggggagggg

SEQ ID NO: 3531255 - DNA, 16 bp, Homo sapiens
agggggcggcagggct

SEQ ID NO: 3531256 - DNA, 16 bp, Homo sapiens
aggggtgtccgagagg

SEQ ID NO: 3531257 - DNA, 14 bp, Homo sapiens
agggtggagctgag

SEQ ID NO: 3531258 - DNA, 14 bp, Homo sapiens
agggtgtcctgagg

SEQ ID NO: 3531259 - DNA, 13 bp, Homo sapiens
aggtcactctcca

SEQ ID NO: 3531260 - DNA, 14 bp, Homo sapiens
aggtcactctccag

SEQ ID NO: 3531261 - DNA, 15 bp, Homo sapiens
aggtctcgtcccagc

SEQ ID NO: 3531262 - DNA, 18 bp, Homo sapiens
aggtgatctcctgtggct

SEQ ID NO: 3531263 - DNA, 22 bp, Homo sapiens
aggtgatctcctgtggctcatc

SEQ ID NO: 3531264 - DNA, 19 bp, Homo sapiens
aggtgctggtagctgaggg

SEQ ID NO: 3531265 - DNA, 23 bp, Homo sapiens
aggtggccaccgggggtggctct

SEQ ID NO: 3531266 - DNA, 13 bp, Homo sapiens
aggtgggaggatg

SEQ ID NO: 3531267 - DNA, 20 bp, Homo sapiens
aggtggggtgatggccagag

SEQ ID NO: 3531268 - DNA, 22 bp, Homo sapiens
aggtggggtgatggccagagga

SEQ ID NO: 3531269 - DNA, 22 bp, Homo sapiens
agtaatttgggaaaagaagctg

SEQ ID NO: 3531270 - DNA, 23 bp, Homo sapiens
agtaatttgggaaaagaagctgt

SEQ ID NO: 3531271 - DNA, 22 bp, Homo sapiens
agtactcataaaggacactgga

SEQ ID NO: 3531272 - DNA, 23 bp, Homo sapiens
agtactcataaaggacactggat

SEQ ID NO: 3531273 - DNA, 13 bp, Homo sapiens
agtagcagaaata

SEQ ID NO: 3531274 - DNA, 13 bp, Homo sapiens
agtaggaaagaat

SEQ ID NO: 3531275 - DNA, 17 bp, Homo sapiens
agtataaacccattttg

SEQ ID NO: 3531276 - DNA, 22 bp, Homo sapiens
agtataaacccattttggtgca

SEQ ID NO: 3531277 - DNA, 14 bp, Homo sapiens
agtataattttggt

SEQ ID NO: 3531278 - DNA, 20 bp, Homo sapiens
agtatatcacagagccactc

SEQ ID NO: 3531279 - DNA, 16 bp, Homo sapiens
agtatctcaacaacat

SEQ ID NO: 3531280 - DNA, 14 bp, Homo sapiens
agtcaggctgttgg

SEQ ID NO: 3531281 - DNA, 18 bp, Homo sapiens
agtcatttcaaaatatgt

SEQ ID NO: 3531282 - DNA, 23 bp, Homo sapiens
agtctcacatgattccagccatc

SEQ ID NO: 3531283 - DNA, 13 bp, Homo sapiens
agtctcaggagga

SEQ ID NO: 3531284 - DNA, 16 bp, Homo sapiens
agtctcaggaggaggc

SEQ ID NO: 3531285 - DNA, 20 bp, Homo sapiens
agtctccccttgcagcctgg

SEQ ID NO: 3531286 - DNA, 19 bp, Homo sapiens
agtcttctaatgtaaattt

SEQ ID NO: 3531287 - DNA, 20 bp, Homo sapiens
agtcttctaatgtaaatttt

SEQ ID NO: 3531288 - DNA, 21 bp, Homo sapiens
agtcttctaatgtaaatttta

SEQ ID NO: 3531289 - DNA, 20 bp, Homo sapiens
agtgaacaactggaaataaa

SEQ ID NO: 3531290 - DNA, 14 bp, Homo sapiens
agtgagaggggagg

SEQ ID NO: 3531291 - DNA, 16 bp, Homo sapiens
agtgagaggggaggga

SEQ ID NO: 3531292 - DNA, 17 bp, Homo sapiens
agtgctctgaccctggg

SEQ ID NO: 3531293 - DNA, 22 bp, Homo sapiens
agtggccacgttcagggagggg

SEQ ID NO: 3531294 - DNA, 22 bp, Homo sapiens
agtgggatagctattgcagctt

SEQ ID NO: 3531295 - DNA, 17 bp, Homo sapiens
agtggtgttacattttc

SEQ ID NO: 3531296 - DNA, 12 bp, Homo sapiens
agtgtattgtaa

SEQ ID NO: 3531297 - DNA, 18 bp, Homo sapiens
agtgtattgtaatgtata

SEQ ID NO: 3531298 - DNA, 13 bp, Homo sapiens
agtgttaaagtgg

SEQ ID NO: 3531299 - DNA, 17 bp, Homo sapiens
agtgttaaagtggtctg

SEQ ID NO: 3531300 - DNA, 18 bp, Homo sapiens
agttacgcttttctaaga

SEQ ID NO: 3531301 - DNA, 19 bp, Homo sapiens
agttctataaacaggcttg

SEQ ID NO: 3531302 - DNA, 18 bp, Homo sapiens
agttgttgaatgactgac

SEQ ID NO: 3531303 - DNA, 21 bp, Homo sapiens
agttgttgaatgactgaccca

SEQ ID NO: 3531304 - DNA, 18 bp, Homo sapiens
agtttctgagttttacca

SEQ ID NO: 3531305 - DNA, 19 bp, Homo sapiens
agtttctgagttttaccaa

SEQ ID NO: 3531306 - DNA, 20 bp, Homo sapiens
agtttctgagttttaccaaa

SEQ ID NO: 3531307 - DNA, 21 bp, Homo sapiens
agtttgggttctctgctgtcc

SEQ ID NO: 3531308 - DNA, 17 bp, Homo sapiens
cgttcagggaggggccg

SEQ ID NO: 3531309 - DNA, 15 bp, Homo sapiens
ctaaagatgggagga

SEQ ID NO: 3531310 - DNA, 22 bp, Homo sapiens
ctaaaggatgagatttttcatg

SEQ ID NO: 3531311 - DNA, 23 bp, Homo sapiens
ctaaaggatgagatttttcatgt

SEQ ID NO: 3531312 - DNA, 19 bp, Homo sapiens
ctaagaggattcaacacct

SEQ ID NO: 3531313 - DNA, 13 bp, Homo sapiens
ctaagcagccagg

SEQ ID NO: 3531314 - DNA, 16 bp, Homo sapiens
ctaagccagctgcccc

SEQ ID NO: 3531315 - DNA, 22 bp, Homo sapiens
ctaagccagctgcccccagagc

SEQ ID NO: 3531316 - DNA, 15 bp, Homo sapiens
ctaatatttttaaca

SEQ ID NO: 3531317 - DNA, 14 bp, Homo sapiens
ctacctggctggag

SEQ ID NO: 3531318 - DNA, 18 bp, Homo sapiens
ctacctggctggagaccg

SEQ ID NO: 3531319 - DNA, 23 bp, Homo sapiens
ctagaggcctgactgccaagcca

SEQ ID NO: 3531320 - DNA, 13 bp, Homo sapiens
ctagcccaggacc

SEQ ID NO: 3531321 - DNA, 17 bp, Homo sapiens
ctaggatatgccctcct

SEQ ID NO: 3531322 - DNA, 23 bp, Homo sapiens
ctatgtggaagtggggcgggctt

SEQ ID NO: 3531323 - DNA, 14 bp, Homo sapiens
ctattgcctctgag

SEQ ID NO: 3531324 - DNA, 18 bp, Homo sapiens
ctcaacaacatgtcaaag

SEQ ID NO: 3531325 - DNA, 18 bp, Homo sapiens
ctcaagagtgctgagaac

SEQ ID NO: 3531326 - DNA, 22 bp, Homo sapiens
ctcacatgattccagccatcac

SEQ ID NO: 3531327 - DNA, 20 bp, Homo sapiens
ctcagaatgggggctttcgg

SEQ ID NO: 3531328 - DNA, 22 bp, Homo sapiens
ctcagacgactagcccaggacc

SEQ ID NO: 3531329 - DNA, 13 bp, Homo sapiens
ctcagcactctgg

SEQ ID NO: 3531330 - DNA, 17 bp, Homo sapiens
ctcagcagaggcagtgg

SEQ ID NO: 3531331 - DNA, 14 bp, Homo sapiens
ctcagcccaccctc

SEQ ID NO: 3531332 - DNA, 18 bp, Homo sapiens
ctcagccgtcagccatca

SEQ ID NO: 3531333 - DNA, 12 bp, Homo sapiens
ctcaggaggagg

SEQ ID NO: 3531334 - DNA, 24 bp, Homo sapiens
ctcaggaggaggctgccctgaggg

SEQ ID NO: 3531335 - DNA, 23 bp, Homo sapiens
ctcagtgtgtaatgactgagatt

SEQ ID NO: 3531336 - DNA, 15 bp, Homo sapiens
ctcataaaggacact

SEQ ID NO: 3531337 - DNA, 21 bp, Homo sapiens
ctcataaaggacactggatca

SEQ ID NO: 3531338 - DNA, 13 bp, Homo sapiens
ctcatgggacctg

SEQ ID NO: 3531339 - DNA, 15 bp, Homo sapiens
ctccaaaggctctgt

SEQ ID NO: 3531340 - DNA, 19 bp, Homo sapiens
ctccacgatgcctttgagt

SEQ ID NO: 3531341 - DNA, 14 bp, Homo sapiens
ctccactcagcact

SEQ ID NO: 3531342 - DNA, 16 bp, Homo sapiens
ctccagaccaaagcaa

SEQ ID NO: 3531343 - DNA, 20 bp, Homo sapiens
ctccccaaaggctttgccct

SEQ ID NO: 3531344 - DNA, 21 bp, Homo sapiens
ctccccaaaggctttgccctg

SEQ ID NO: 3531345 - DNA, 21 bp, Homo sapiens
ctccccatctcggggctgctg

SEQ ID NO: 3531346 - DNA, 19 bp, Homo sapiens
ctcccccatagcaccctgc

SEQ ID NO: 3531347 - DNA, 18 bp, Homo sapiens
ctcccgaacactgagaaa

SEQ ID NO: 3531348 - DNA, 17 bp, Homo sapiens
ctccctgacggtggaat

SEQ ID NO: 3531349 - DNA, 13 bp, Homo sapiens
ctccctggatttt

SEQ ID NO: 3531350 - DNA, 19 bp, Homo sapiens
ctccgaaagtctgaatctc

SEQ ID NO: 3531351 - DNA, 14 bp, Homo sapiens
ctcctagccccttc

SEQ ID NO: 3531352 - DNA, 19 bp, Homo sapiens
ctcctctcctttttctctt

SEQ ID NO: 3531353 - DNA, 18 bp, Homo sapiens
ctcgggggctgtctcaga

SEQ ID NO: 3531354 - DNA, 23 bp, Homo sapiens
ctcggttaagtacccgaggcctc

SEQ ID NO: 3531355 - DNA, 15 bp, Homo sapiens
ctcgtcccagccctc

SEQ ID NO: 3531356 - DNA, 21 bp, Homo sapiens
ctcgttgaggccaaggaatga

SEQ ID NO: 3531357 - DNA, 15 bp, Homo sapiens
ctctaagcagccagg

SEQ ID NO: 3531358 - DNA, 16 bp, Homo sapiens
ctctaagcagccagga

SEQ ID NO: 3531359 - DNA, 20 bp, Homo sapiens
ctctagtcagagtataattt

SEQ ID NO: 3531360 - DNA, 21 bp, Homo sapiens
ctctagtcagagtataatttt

SEQ ID NO: 3531361 - DNA, 16 bp, Homo sapiens
ctctcaagagtgctga

SEQ ID NO: 3531362 - DNA, 13 bp, Homo sapiens
ctctcctgtctga

SEQ ID NO: 3531363 - DNA, 20 bp, Homo sapiens
ctctcctttttctcttcaca

SEQ ID NO: 3531364 - DNA, 14 bp, Homo sapiens
ctctgaccctgggc

SEQ ID NO: 3531365 - DNA, 23 bp, Homo sapiens
ctctgagagcatcaggcctagag

SEQ ID NO: 3531366 - DNA, 16 bp, Homo sapiens
ctctgcaaactgcctt

SEQ ID NO: 3531367 - DNA, 11 bp, Homo sapiens
ctctgctgtcc

SEQ ID NO: 3531368 - DNA, 14 bp, Homo sapiens
ctctgctgtcctaa

SEQ ID NO: 3531369 - DNA, 15 bp, Homo sapiens
ctctggactccacga

SEQ ID NO: 3531370 - DNA, 13 bp, Homo sapiens
ctctgtagaatct

SEQ ID NO: 3531371 - DNA, 21 bp, Homo sapiens
ctcttaaggcattgagggctc

SEQ ID NO: 3531372 - DNA, 15 bp, Homo sapiens
ctgaaaaatggccat

SEQ ID NO: 3531373 - DNA, 21 bp, Homo sapiens
ctgaaaatgtgtatacactta

SEQ ID NO: 3531374 - DNA, 12 bp, Homo sapiens
ctgaatctccca

SEQ ID NO: 3531375 - DNA, 13 bp, Homo sapiens
ctgaatctcccaa

SEQ ID NO: 3531376 - DNA, 16 bp, Homo sapiens
ctgacccaaaatgtga

SEQ ID NO: 3531377 - DNA, 15 bp, Homo sapiens
ctgaccctccccaaa

SEQ ID NO: 3531378 - DNA, 12 bp, Homo sapiens
ctgaccctgggc

SEQ ID NO: 3531379 - DNA, 13 bp, Homo sapiens
ctgaccctgggct

SEQ ID NO: 3531380 - DNA, 19 bp, Homo sapiens
ctgagaaatagtgcactcc

SEQ ID NO: 3531381 - DNA, 15 bp, Homo sapiens
ctgagaagaggagga

SEQ ID NO: 3531382 - DNA, 16 bp, Homo sapiens
ctgagaagaggaggag

SEQ ID NO: 3531383 - DNA, 20 bp, Homo sapiens
ctgagatttgtaaatctttg

SEQ ID NO: 3531384 - DNA, 16 bp, Homo sapiens
ctgagctcttgctatc

SEQ ID NO: 3531385 - DNA, 16 bp, Homo sapiens
ctgagggctgctcccc

SEQ ID NO: 3531386 - DNA, 15 bp, Homo sapiens
ctgaggggacgggca

SEQ ID NO: 3531387 - DNA, 17 bp, Homo sapiens
ctgaggggacgggcaag

SEQ ID NO: 3531388 - DNA, 17 bp, Homo sapiens
ctgaggggctggggagg

SEQ ID NO: 3531389 - DNA, 19 bp, Homo sapiens
ctgaggggctggggagggg

SEQ ID NO: 3531390 - DNA, 21 bp, Homo sapiens
ctgaggggtgtccgagaggct

SEQ ID NO: 3531391 - DNA, 13 bp, Homo sapiens
ctgagttttacca

SEQ ID NO: 3531392 - DNA, 15 bp, Homo sapiens
ctgataggagggggc

SEQ ID NO: 3531393 - DNA, 17 bp, Homo sapiens
ctgatggtgaaaccaaa

SEQ ID NO: 3531394 - DNA, 13 bp, Homo sapiens
ctgcaggagggca

SEQ ID NO: 3531395 - DNA, 17 bp, Homo sapiens
ctgcaggagggcactgg

SEQ ID NO: 3531396 - DNA, 13 bp, Homo sapiens
ctgcaggctgcag

SEQ ID NO: 3531397 - DNA, 18 bp, Homo sapiens
ctgcaggctgcaggaggg

SEQ ID NO: 3531398 - DNA, 20 bp, Homo sapiens
ctgcaggctgcaggagggca

SEQ ID NO: 3531399 - DNA, 22 bp, Homo sapiens
ctgcatcccgagcaaccctctg

SEQ ID NO: 3531400 - DNA, 19 bp, Homo sapiens
ctgcatctaagcatctggg

SEQ ID NO: 3531401 - DNA, 12 bp, Homo sapiens
ctgccaagccat

SEQ ID NO: 3531402 - DNA, 20 bp, Homo sapiens
ctgccattggtccacccttt

SEQ ID NO: 3531403 - DNA, 16 bp, Homo sapiens
ctgcccccagagccac

SEQ ID NO: 3531404 - DNA, 17 bp, Homo sapiens
ctgcccccagagccaca

SEQ ID NO: 3531405 - DNA, 18 bp, Homo sapiens
ctgcccccagagccacag

SEQ ID NO: 3531406 - DNA, 15 bp, Homo sapiens
ctgcccctgtaaggt

SEQ ID NO: 3531407 - DNA, 12 bp, Homo sapiens
ctgcctcaggca

SEQ ID NO: 3531408 - DNA, 15 bp, Homo sapiens
ctgcctcaggcactc

SEQ ID NO: 3531409 - DNA, 18 bp, Homo sapiens
ctgcctcaggcactctcc

SEQ ID NO: 3531410 - DNA, 19 bp, Homo sapiens
ctgccttcttcggaaagaa

SEQ ID NO: 3531411 - DNA, 14 bp, Homo sapiens
ctgcgtgtgggagg

SEQ ID NO: 3531412 - DNA, 14 bp, Homo sapiens
ctgctgccctcccc

SEQ ID NO: 3531413 - DNA, 20 bp, Homo sapiens
ctgctgccctgctgtggaag

SEQ ID NO: 3531414 - DNA, 21 bp, Homo sapiens
ctgctgtgtggacggcgctgc

SEQ ID NO: 3531415 - DNA, 18 bp, Homo sapiens
ctgcttgctaccaatctg

SEQ ID NO: 3531416 - DNA, 16 bp, Homo sapiens
ctgcttttgtgtccca

SEQ ID NO: 3531417 - DNA, 16 bp, Homo sapiens
ctggaacacctgatgg

SEQ ID NO: 3531418 - DNA, 15 bp, Homo sapiens
ggccagggaggcaga

SEQ ID NO: 3531419 - DNA, 16 bp, Homo sapiens
ggccagggaggcagag

SEQ ID NO: 3531420 - DNA, 22 bp, Homo sapiens
ggccatgggaggcctttcccta

SEQ ID NO: 3531421 - DNA, 14 bp, Homo sapiens
ggccatttggcccc

SEQ ID NO: 3531422 - DNA, 12 bp, Homo sapiens
ggccccaggccc

SEQ ID NO: 3531423 - DNA, 21 bp, Homo sapiens
ggccccaggggacgtgggccc

SEQ ID NO: 3531424 - DNA, 16 bp, Homo sapiens
ggcccccccagcccca

SEQ ID NO: 3531425 - DNA, 19 bp, Homo sapiens
ggcccccccagccccacac

SEQ ID NO: 3531426 - DNA, 15 bp, Homo sapiens
ggccctgcaggctgc

SEQ ID NO: 3531427 - DNA, 24 bp, Homo sapiens
ggccctgcaggctgcaggagggca

SEQ ID NO: 3531428 - DNA, 21 bp, Homo sapiens
ggccctggggcccctcccctc

SEQ ID NO: 3531429 - DNA, 19 bp, Homo sapiens
ggcctgactgccaagccat

SEQ ID NO: 3531430 - DNA, 13 bp, Homo sapiens
ggcctggcttcac

SEQ ID NO: 3531431 - DNA, 17 bp, Homo sapiens
ggcctttccctaagcca

SEQ ID NO: 3531432 - DNA, 14 bp, Homo sapiens
ggcgtgtcccagca

SEQ ID NO: 3531433 - DNA, 16 bp, Homo sapiens
ggctcagcccaccctc

SEQ ID NO: 3531434 - DNA, 15 bp, Homo sapiens
ggctgccctgagggg

SEQ ID NO: 3531435 - DNA, 20 bp, Homo sapiens
ggctgccctgaggggctggg

SEQ ID NO: 3531436 - DNA, 15 bp, Homo sapiens
ggctgctgtgtggac

SEQ ID NO: 3531437 - DNA, 14 bp, Homo sapiens
ggctggcctggagg

SEQ ID NO: 3531438 - DNA, 17 bp, Homo sapiens
ggctggcctggaggctc

SEQ ID NO: 3531439 - DNA, 20 bp, Homo sapiens
ggctggcctggaggctcagc

SEQ ID NO: 3531440 - DNA, 13 bp, Homo sapiens
ggctggggagggg

SEQ ID NO: 3531441 - DNA, 15 bp, Homo sapiens
gggaaaagaagctgt

SEQ ID NO: 3531442 - DNA, 19 bp, Homo sapiens
gggaacagtccataactta

SEQ ID NO: 3531443 - DNA, 23 bp, Homo sapiens
gggaagagggttaggagggtttc

SEQ ID NO: 3531444 - DNA, 23 bp, Homo sapiens
gggaaggagagaatgattttgct

SEQ ID NO: 3531445 - DNA, 12 bp, Homo sapiens
gggaagggcagg

SEQ ID NO: 3531446 - DNA, 16 bp, Homo sapiens
gggaccaaagggggag

SEQ ID NO: 3531447 - DNA, 17 bp, Homo sapiens
gggaccaaagggggagt

SEQ ID NO: 3531448 - DNA, 12 bp, Homo sapiens
gggaggcagagc

SEQ ID NO: 3531449 - DNA, 21 bp, Homo sapiens
gggaggctggggacccagact

SEQ ID NO: 3531450 - DNA, 22 bp, Homo sapiens
gggagggagtctcaggaggagg

SEQ ID NO: 3531451 - DNA, 13 bp, Homo sapiens
gggagggccaggg

SEQ ID NO: 3531452 - DNA, 16 bp, Homo sapiens
gggagggccagggagg

SEQ ID NO: 3531453 - DNA, 20 bp, Homo sapiens
gggagggggtacctcatgag

SEQ ID NO: 3531454 - DNA, 19 bp, Homo sapiens
gggaggtctcgtcccagcc

SEQ ID NO: 3531455 - DNA, 21 bp, Homo sapiens
gggagtctcaggaggaggctg

SEQ ID NO: 3531456 - DNA, 21 bp, Homo sapiens
gggcaaggaatcctctgggag

SEQ ID NO: 3531457 - DNA, 21 bp, Homo sapiens
gggcaagtgagaggggaggga

SEQ ID NO: 3531458 - DNA, 23 bp, Homo sapiens
gggcaagtgagaggggagggagg

SEQ ID NO: 3531459 - DNA, 17 bp, Homo sapiens
gggcactggagctggga

SEQ ID NO: 3531460 - DNA, 13 bp, Homo sapiens
gggcagtgccagc

SEQ ID NO: 3531461 - DNA, 11 bp, Homo sapiens
gggcccagcat

SEQ ID NO: 3531462 - DNA, 13 bp, Homo sapiens
gggccctggaaga

SEQ ID NO: 3531463 - DNA, 15 bp, Homo sapiens
gggcggcagggctgg

SEQ ID NO: 3531464 - DNA, 15 bp, Homo sapiens
gggctggaggtgctg

SEQ ID NO: 3531465 - DNA, 12 bp, Homo sapiens
gggctggggagg

SEQ ID NO: 3531466 - DNA, 16 bp, Homo sapiens
gggcttaattccccca

SEQ ID NO: 3531467 - DNA, 16 bp, Homo sapiens
gggctttcacgggccc

SEQ ID NO: 3531468 - DNA, 15 bp, Homo sapiens
gggctttcggggagg

SEQ ID NO: 3531469 - DNA, 16 bp, Homo sapiens
gggcttttgttctgag

SEQ ID NO: 3531470 - DNA, 19 bp, Homo sapiens
gggcttttgttctgagggg

SEQ ID NO: 3531471 - DNA, 15 bp, Homo sapiens
ggggaaggggtgcag

SEQ ID NO: 3531472 - DNA, 17 bp, Homo sapiens
ggggcccctcccctccc

SEQ ID NO: 3531473 - DNA, 21 bp, Homo sapiens
ggggccggctggcctggaggc

SEQ ID NO: 3531474 - DNA, 15 bp, Homo sapiens
ggggcggcagggctg

SEQ ID NO: 3531475 - DNA, 20 bp, Homo sapiens
ggggctgctgtgtggacggc

SEQ ID NO: 3531476 - DNA, 13 bp, Homo sapiens
gggggcggcaggg

SEQ ID NO: 3531477 - DNA, 23 bp, Homo sapiens
gggggctttcggggagggcgcct

SEQ ID NO: 3531478 - DNA, 17 bp, Homo sapiens
ggggtgtccgagaggct

SEQ ID NO: 3531479 - DNA, 18 bp, Homo sapiens
ggggtgtccgagaggctg

SEQ ID NO: 3531480 - DNA, 23 bp, Homo sapiens
gggtaggctgctgccctgctgtg

SEQ ID NO: 3531481 - DNA, 14 bp, Homo sapiens
ggtacctcatgagg

SEQ ID NO: 3531482 - DNA, 20 bp, Homo sapiens
ggtacctcatgaggaccagg

SEQ ID NO: 3531483 - DNA, 20 bp, Homo sapiens
ggtagaaacctgccgggctg

SEQ ID NO: 3531484 - DNA, 19 bp, Homo sapiens
ggtcactgagtctggagtg

SEQ ID NO: 3531485 - DNA, 18 bp, Homo sapiens
ggtctcgtcccagccctc

SEQ ID NO: 3531486 - DNA, 17 bp, Homo sapiens
ggtgaaagtgctgctct

SEQ ID NO: 3531487 - DNA, 17 bp, Homo sapiens
ggtgaccagaccaaggc

SEQ ID NO: 3531488 - DNA, 19 bp, Homo sapiens
ggtgatctcctgtggctca

SEQ ID NO: 3531489 - DNA, 15 bp, Homo sapiens
ggtgctggtagctga

SEQ ID NO: 3531490 - DNA, 20 bp, Homo sapiens
ggtgctggtagctgagggga

SEQ ID NO: 3531491 - DNA, 20 bp, Homo sapiens
ggtggatgatccccacgcca

SEQ ID NO: 3531492 - DNA, 23 bp, Homo sapiens
ggtggccatcacagccccatgga

SEQ ID NO: 3531493 - DNA, 15 bp, Homo sapiens
ggtgggcccagggac

SEQ ID NO: 3531494 - DNA, 17 bp, Homo sapiens
ggtgttgccagttgtcc

SEQ ID NO: 3531495 - DNA, 20 bp, Homo sapiens
ggttatttattgacacaccc

SEQ ID NO: 3531496 - DNA, 14 bp, Homo sapiens
ggttctctgctgtc

SEQ ID NO: 3531497 - DNA, 15 bp, Homo sapiens
ggttctctgctgtcc

SEQ ID NO: 3531498 - DNA, 20 bp, Homo sapiens
ggttcttcagatgctcttgg

SEQ ID NO: 3531499 - DNA, 12 bp, Homo sapiens
ggttgaggaagt

SEQ ID NO: 3531500 - DNA, 20 bp, Homo sapiens
gtaaaacctggagatggtgg

SEQ ID NO: 3531501 - DNA, 22 bp, Homo sapiens
gtaaatctttgtgaacattctg

SEQ ID NO: 3531502 - DNA, 23 bp, Homo sapiens
gtaaatctttgtgaacattctgt

SEQ ID NO: 3531503 - DNA, 17 bp, Homo sapiens
gtaagctataacatatt

SEQ ID NO: 3531504 - DNA, 21 bp, Homo sapiens
gtaagctataacatatttatt

SEQ ID NO: 3531505 - DNA, 16 bp, Homo sapiens
gtaatgtatacttgaa

SEQ ID NO: 3531506 - DNA, 18 bp, Homo sapiens
gtaattaaaaacagaaaa

SEQ ID NO: 3531507 - DNA, 14 bp, Homo sapiens
gtaattaaattttt

SEQ ID NO: 3531508 - DNA, 13 bp, Homo sapiens
gtacctcatgagg

SEQ ID NO: 3531509 - DNA, 21 bp, Homo sapiens
gtactcataaaggacactgga

SEQ ID NO: 3531510 - DNA, 22 bp, Homo sapiens
gtagcagaaatatattatgaaa

SEQ ID NO: 3531511 - DNA, 15 bp, Homo sapiens
gtagggagttgtggg

SEQ ID NO: 3531512 - DNA, 13 bp, Homo sapiens
gtatctcacactc

SEQ ID NO: 3531513 - DNA, 18 bp, Homo sapiens
gtcaatataccatgacat

SEQ ID NO: 3531514 - DNA, 20 bp, Homo sapiens
gtcagagtataattttggtt

SEQ ID NO: 3531515 - DNA, 15 bp, Homo sapiens
gtcagccatcagcca

SEQ ID NO: 3531516 - DNA, 16 bp, Homo sapiens
gtcatgagaattacag

SEQ ID NO: 3531517 - DNA, 17 bp, Homo sapiens
gtcatgagaattacaga

SEQ ID NO: 3531518 - DNA, 20 bp, Homo sapiens
gtcatgagaattacagaaaa

SEQ ID NO: 3531519 - DNA, 17 bp, Homo sapiens
gtccaaagctgaaaatg

SEQ ID NO: 3531520 - DNA, 19 bp, Homo sapiens
gtccaaagctgaaaatgtg

SEQ ID NO: 3531521 - DNA, 20 bp, Homo sapiens
gtccaaagctgaaaatgtgt

SEQ ID NO: 3531522 - DNA, 18 bp, Homo sapiens
gtctcagacgactagccc

SEQ ID NO: 3531523 - DNA, 21 bp, Homo sapiens
gtctcagacgactagcccagg

SEQ ID NO: 3531524 - DNA, 19 bp, Homo sapiens
gtctgaatctcccaaggag

SEQ ID NO: 3531525 - DNA, 12 bp, Homo sapiens
gtctttatgaat

SEQ ID NO: 3531526 - DNA, 12 bp, Homo sapiens
gtctttcagaag

SEQ ID NO: 3531527 - DNA, 18 bp, Homo sapiens
gtgaaacattttctccct

SEQ ID NO: 3531528 - DNA, 18 bp, Homo sapiens
tggaggtgctggtagctg

SEQ ID NO: 3531529 - DNA, 16 bp, Homo sapiens
tggatctccccctcat

SEQ ID NO: 3531530 - DNA, 17 bp, Homo sapiens
tggccaccgggggtggc

SEQ ID NO: 3531531 - DNA, 23 bp, Homo sapiens
tggccaccgggggtggctctgtc

SEQ ID NO: 3531532 - DNA, 14 bp, Homo sapiens
tggcccccccagcc

SEQ ID NO: 3531533 - DNA, 14 bp, Homo sapiens
tggccctgactgtc

SEQ ID NO: 3531534 - DNA, 21 bp, Homo sapiens
tggccgtatctgagggctgct

SEQ ID NO: 3531535 - DNA, 16 bp, Homo sapiens
tggcctggaggctcag

SEQ ID NO: 3531536 - DNA, 18 bp, Homo sapiens
tggcctggaggctcagcc

SEQ ID NO: 3531537 - DNA, 15 bp, Homo sapiens
tggcctgtgagtctc

SEQ ID NO: 3531538 - DNA, 13 bp, Homo sapiens
tggcgtgtcccag

SEQ ID NO: 3531539 - DNA, 16 bp, Homo sapiens
tggctgaaaggaagct

SEQ ID NO: 3531540 - DNA, 20 bp, Homo sapiens
tggctgggcaaaagaatgtt

SEQ ID NO: 3531541 - DNA, 23 bp, Homo sapiens
tggcttcactctccctgacggct

SEQ ID NO: 3531542 - DNA, 15 bp, Homo sapiens
tgggaccaaaggggg

SEQ ID NO: 3531543 - DNA, 21 bp, Homo sapiens
tgggagcttcttccgtttctt

SEQ ID NO: 3531544 - DNA, 16 bp, Homo sapiens
tgggaggagaccagcg

SEQ ID NO: 3531545 - DNA, 15 bp, Homo sapiens
tgggaggatgtgaat

SEQ ID NO: 3531546 - DNA, 18 bp, Homo sapiens
tgggaggctggggaccca

SEQ ID NO: 3531547 - DNA, 15 bp, Homo sapiens
tgggcagtgccagcc

SEQ ID NO: 3531548 - DNA, 14 bp, Homo sapiens
tgggcccagggaca

SEQ ID NO: 3531549 - DNA, 14 bp, Homo sapiens
tgggccctgcaggc

SEQ ID NO: 3531550 - DNA, 22 bp, Homo sapiens
tggggaaacaattttttgtgat

SEQ ID NO: 3531551 - DNA, 21 bp, Homo sapiens
tgggggctttcggggagggcg

SEQ ID NO: 3531552 - DNA, 17 bp, Homo sapiens
tggggtgatggccagag

SEQ ID NO: 3531553 - DNA, 18 bp, Homo sapiens
tggggtgatggccagagg

SEQ ID NO: 3531554 - DNA, 15 bp, Homo sapiens
tgggttatttattga

SEQ ID NO: 3531555 - DNA, 17 bp, Homo sapiens
tgggttatttattgaca

SEQ ID NO: 3531556 - DNA, 15 bp, Homo sapiens
tggtctgaactgctt

SEQ ID NO: 3531557 - DNA, 12 bp, Homo sapiens
tggtgaccagac

SEQ ID NO: 3531558 - DNA, 20 bp, Homo sapiens
tggtgactcgggggctgtct

SEQ ID NO: 3531559 - DNA, 22 bp, Homo sapiens
tggtgactcgggggctgtctca

SEQ ID NO: 3531560 - DNA, 21 bp, Homo sapiens
tggtggatgatccccacgcca

SEQ ID NO: 3531561 - DNA, 22 bp, Homo sapiens
tggtgttgccagttgtcctcct

SEQ ID NO: 3531562 - DNA, 13 bp, Homo sapiens
tggtgttggtgaa

SEQ ID NO: 3531563 - DNA, 13 bp, Homo sapiens
tgtaaatctttgt

SEQ ID NO: 3531564 - DNA, 21 bp, Homo sapiens
tgtaaatctttgtgaacattc

SEQ ID NO: 3531565 - DNA, 18 bp, Homo sapiens
tgtaatgtatacttgaaa

SEQ ID NO: 3531566 - DNA, 16 bp, Homo sapiens
tgtaattaaattttta

SEQ ID NO: 3531567 - DNA, 19 bp, Homo sapiens
tgtagaatcttagaggctt

SEQ ID NO: 3531568 - DNA, 22 bp, Homo sapiens
tgtatacttgaaaaatgttata

SEQ ID NO: 3531569 - DNA, 14 bp, Homo sapiens
tgtatcatgtttta

SEQ ID NO: 3531570 - DNA, 17 bp, Homo sapiens
tgtatgctgtttgtaca

SEQ ID NO: 3531571 - DNA, 12 bp, Homo sapiens
tgtattgtaatg

SEQ ID NO: 3531572 - DNA, 15 bp, Homo sapiens
tgtcagggagggcca

SEQ ID NO: 3531573 - DNA, 18 bp, Homo sapiens
tgtcagggagggccaggg

SEQ ID NO: 3531574 - DNA, 19 bp, Homo sapiens
tgtcagggagggccaggga

SEQ ID NO: 3531575 - DNA, 19 bp, Homo sapiens
tgtcctacctccactctct

SEQ ID NO: 3531576 - DNA, 14 bp, Homo sapiens
tgtgaatgtgagtg

SEQ ID NO: 3531577 - DNA, 14 bp, Homo sapiens
tgtgaccagttttg

SEQ ID NO: 3531578 - DNA, 20 bp, Homo sapiens
tgtgactcagcagaggcagt

SEQ ID NO: 3531579 - DNA, 14 bp, Homo sapiens
tgtgagtgaagctc

SEQ ID NO: 3531580 - DNA, 21 bp, Homo sapiens
tgtgctcctcggtgttacttc

SEQ ID NO: 3531581 - DNA, 21 bp, Homo sapiens
tgtgctgttagaatatgttga

SEQ ID NO: 3531582 - DNA, 22 bp, Homo sapiens
tgtgctgttagaatatgttgat

SEQ ID NO: 3531583 - DNA, 22 bp, Homo sapiens
tgtggacggcgctgcctcaggc

SEQ ID NO: 3531584 - DNA, 19 bp, Homo sapiens
tgtgggtagtggggaagag

SEQ ID NO: 3531585 - DNA, 14 bp, Homo sapiens
tgtgtaatgactga

SEQ ID NO: 3531586 - DNA, 21 bp, Homo sapiens
tgtgtggacggcgctgcctca

SEQ ID NO: 3531587 - DNA, 21 bp, Homo sapiens
tgttaaaacacaaaatgaata

SEQ ID NO: 3531588 - DNA, 17 bp, Homo sapiens
tgttaaattcaatgctt

SEQ ID NO: 3531589 - DNA, 16 bp, Homo sapiens
tgttaactttcaaatc

SEQ ID NO: 3531590 - DNA, 18 bp, Homo sapiens
tgttaactttcaaatcca

SEQ ID NO: 3531591 - DNA, 14 bp, Homo sapiens
tgttacttcccttt

SEQ ID NO: 3531592 - DNA, 20 bp, Homo sapiens
tgttacttccctttcatatg

SEQ ID NO: 3531593 - DNA, 17 bp, Homo sapiens
tgttagaatatgttgat

SEQ ID NO: 3531594 - DNA, 21 bp, Homo sapiens
tgttcacatccagttgtctaa

SEQ ID NO: 3531595 - DNA, 16 bp, Homo sapiens
tgttcagtattgcaat

SEQ ID NO: 3531596 - DNA, 22 bp, Homo sapiens
tgttcctgatttttcatatgtg

SEQ ID NO: 3531597 - DNA, 11 bp, Homo sapiens
tgttgcaaagg

SEQ ID NO: 3531598 - DNA, 17 bp, Homo sapiens
tgttgccagttgtcctc

SEQ ID NO: 3531599 - DNA, 17 bp, Homo sapiens
tgttggcgtgtcccagc

SEQ ID NO: 3531600 - DNA, 18 bp, Homo sapiens
tgttggcgtgtcccagca

SEQ ID NO: 3531601 - DNA, 21 bp, Homo sapiens
tgtttgtacaaactatttcag

SEQ ID NO: 3531602 - DNA, 19 bp, Homo sapiens
tgttttcccaacctcctgt

SEQ ID NO: 3531603 - DNA, 9 bp, Homo sapiens
tgtttttta

SEQ ID NO: 3531604 - DNA, 15 bp, Homo sapiens
ttaaaaacagaaaat

SEQ ID NO: 3531605 - DNA, 21 bp, Homo sapiens
ttaaaaattagccttgatatt

SEQ ID NO: 3531606 - DNA, 15 bp, Homo sapiens
ttaaaacacaaaatg

SEQ ID NO: 3531607 - DNA, 16 bp, Homo sapiens
ttaaaattaaatactt

SEQ ID NO: 3531608 - DNA, 15 bp, Homo sapiens
ttaaacttgcacatt

SEQ ID NO: 3531609 - DNA, 16 bp, Homo sapiens
ttaaacttgcacattt

SEQ ID NO: 3531610 - DNA, 11 bp, Homo sapiens
ttaactgttca

SEQ ID NO: 3531611 - DNA, 21 bp, Homo sapiens
ttacaaatgaagtatttcatg

SEQ ID NO: 3531612 - DNA, 18 bp, Homo sapiens
ttacattttcttgtccaa

SEQ ID NO: 3531613 - DNA, 15 bp, Homo sapiens
ttaccaaataaagta

SEQ ID NO: 3531614 - DNA, 14 bp, Homo sapiens
ttagactgagtaaa

SEQ ID NO: 3531615 - DNA, 21 bp, Homo sapiens
ttagattttgatagcaatgtt

SEQ ID NO: 3531616 - DNA, 16 bp, Homo sapiens
ttagtagcagaaatat

SEQ ID NO: 3531617 - DNA, 20 bp, Homo sapiens
ttagtttctgagttttacca

SEQ ID NO: 3531618 - DNA, 12 bp, Homo sapiens
ttatgaaaatta

SEQ ID NO: 3531619 - DNA, 21 bp, Homo sapiens
ttcaggcccgctgccctagga

SEQ ID NO: 3531620 - DNA, 13 bp, Homo sapiens
ttcagggaggggc

SEQ ID NO: 3531621 - DNA, 14 bp, Homo sapiens
ttcattgtctgtga

SEQ ID NO: 3531622 - DNA, 23 bp, Homo sapiens
ttcccccaagcagaagaccagat

SEQ ID NO: 3531623 - DNA, 12 bp, Homo sapiens
ttccctaagcca

SEQ ID NO: 3531624 - DNA, 21 bp, Homo sapiens
ttccgttggaaagaacattta

SEQ ID NO: 3531625 - DNA, 18 bp, Homo sapiens
ttcctcagggtgtcctga

SEQ ID NO: 3531626 - DNA, 19 bp, Homo sapiens
ttcctgcagccagaaagga

SEQ ID NO: 3531627 - DNA, 22 bp, Homo sapiens
ttccttttacttttcttctatt

SEQ ID NO: 3531628 - DNA, 23 bp, Homo sapiens
ttcggaaagaagaaggtgggagg

SEQ ID NO: 3531629 - DNA, 11 bp, Homo sapiens
ttcggggaggg

SEQ ID NO: 3531630 - DNA, 18 bp, Homo sapiens
ttctaatgtaaattttaa

SEQ ID NO: 3531631 - DNA, 23 bp, Homo sapiens
ttctataagtgtgaccagttttg

SEQ ID NO: 3531632 - DNA, 15 bp, Homo sapiens
ttctattgcctctga

SEQ ID NO: 3531633 - DNA, 19 bp, Homo sapiens
ttctccctggatttttacc

SEQ ID NO: 3531634 - DNA, 15 bp, Homo sapiens
ttctctttcaatgtg

SEQ ID NO: 3531635 - DNA, 15 bp, Homo sapiens
ttctgagttttacca

SEQ ID NO: 3531636 - DNA, 20 bp, Homo sapiens
ttctgatagtagtctttaaa

SEQ ID NO: 3531637 - DNA, 15 bp, Homo sapiens
ttcttgactccttgg

SEQ ID NO: 3531638 - DNA, 15 bp, Homo sapiens
agactgagtaaagtg

SEQ ID NO: 3531639 - DNA, 13 bp, Homo sapiens
agacttaatatgt

SEQ ID NO: 3531640 - DNA, 17 bp, Homo sapiens
agacttctggtgctgct

SEQ ID NO: 3531641 - DNA, 20 bp, Homo sapiens
agacttctggtgctgctggg

SEQ ID NO: 3531642 - DNA, 16 bp, Homo sapiens
agagaggcctgctttg

SEQ ID NO: 3531643 - DNA, 13 bp, Homo sapiens
agagcacaggttc

SEQ ID NO: 3531644 - DNA, 19 bp, Homo sapiens
agagcatcaggcctagagg

SEQ ID NO: 3531645 - DNA, 16 bp, Homo sapiens
agaggaatgatgggct

SEQ ID NO: 3531646 - DNA, 21 bp, Homo sapiens
agaggaatgatgggcttttgt

SEQ ID NO: 3531647 - DNA, 17 bp, Homo sapiens
agaggaggaggtggggg

SEQ ID NO: 3531648 - DNA, 14 bp, Homo sapiens
agaggcagtggcca

SEQ ID NO: 3531649 - DNA, 15 bp, Homo sapiens
agaggcttttccagt

SEQ ID NO: 3531650 - DNA, 19 bp, Homo sapiens
agaggcttttccagtgtgt

SEQ ID NO: 3531651 - DNA, 16 bp, Homo sapiens
agaggtctttcagaag

SEQ ID NO: 3531652 - DNA, 16 bp, Homo sapiens
agagtgctctgaccct

SEQ ID NO: 3531653 - DNA, 21 bp, Homo sapiens
agagtgctctgaccctgggct

SEQ ID NO: 3531654 - DNA, 12 bp, Homo sapiens
agagtgctgaga

SEQ ID NO: 3531655 - DNA, 16 bp, Homo sapiens
agatagttacatttat

SEQ ID NO: 3531656 - DNA, 22 bp, Homo sapiens
agatagttacatttatgtgctg

SEQ ID NO: 3531657 - DNA, 13 bp, Homo sapiens
agatgggaggaga

SEQ ID NO: 3531658 - DNA, 14 bp, Homo sapiens
agatgggaggagac

SEQ ID NO: 3531659 - DNA, 23 bp, Homo sapiens
agattattgtctgattgaaacat

SEQ ID NO: 3531660 - DNA, 17 bp, Homo sapiens
agattcaggggaagggc

SEQ ID NO: 3531661 - DNA, 21 bp, Homo sapiens
agattcaggggaagggcaggc

SEQ ID NO: 3531662 - DNA, 14 bp, Homo sapiens
agcaaccctctgaa

SEQ ID NO: 3531663 - DNA, 16 bp, Homo sapiens
agcaaccctctgaaga

SEQ ID NO: 3531664 - DNA, 18 bp, Homo sapiens
agcacagaaatctgaaaa

SEQ ID NO: 3531665 - DNA, 19 bp, Homo sapiens
agcactctggactccacga

SEQ ID NO: 3531666 - DNA, 14 bp, Homo sapiens
agcagaagaccaga

SEQ ID NO: 3531667 - DNA, 19 bp, Homo sapiens
agcagagaggtggccaccg

SEQ ID NO: 3531668 - DNA, 16 bp, Homo sapiens
agcagattccacagga

SEQ ID NO: 3531669 - DNA, 21 bp, Homo sapiens
agcatacaccaaacatttctg

SEQ ID NO: 3531670 - DNA, 18 bp, Homo sapiens
agcatgaatatttcttaa

SEQ ID NO: 3531671 - DNA, 23 bp, Homo sapiens
agcatgcagcgaattcagaaaga

SEQ ID NO: 3531672 - DNA, 20 bp, Homo sapiens
agccagcccaaaccttgggc

SEQ ID NO: 3531673 - DNA, 20 bp, Homo sapiens
agccagctgcccccagagcc

SEQ ID NO: 3531674 - DNA, 18 bp, Homo sapiens
agccatcaccttagacca

SEQ ID NO: 3531675 - DNA, 16 bp, Homo sapiens
agcccaaaccttgggc

SEQ ID NO: 3531676 - DNA, 19 bp, Homo sapiens
agcccaaaccttgggccct

SEQ ID NO: 3531677 - DNA, 22 bp, Homo sapiens
agcccaaaccttgggccctgga

SEQ ID NO: 3531678 - DNA, 17 bp, Homo sapiens
agcccaagacaccatga

SEQ ID NO: 3531679 - DNA, 14 bp, Homo sapiens
agccccacacccta

SEQ ID NO: 3531680 - DNA, 21 bp, Homo sapiens
agccccttcttccaaggagca

SEQ ID NO: 3531681 - DNA, 14 bp, Homo sapiens
agcccttttgtctc

SEQ ID NO: 3531682 - DNA, 16 bp, Homo sapiens
agcctggacctgggtt

SEQ ID NO: 3531683 - DNA, 18 bp, Homo sapiens
agcctggacctgggttat

SEQ ID NO: 3531684 - DNA, 21 bp, Homo sapiens
agcctgggtgtaaaacctgga

SEQ ID NO: 3531685 - DNA, 17 bp, Homo sapiens
agcctgtgaccttggga

SEQ ID NO: 3531686 - DNA, 15 bp, Homo sapiens
agcgaattcagaaag

SEQ ID NO: 3531687 - DNA, 16 bp, Homo sapiens
agcgaattcagaaaga

SEQ ID NO: 3531688 - DNA, 21 bp, Homo sapiens
agcggtccatgggtctggcct

SEQ ID NO: 3531689 - DNA, 22 bp, Homo sapiens
agcggtccatgggtctggcctg

SEQ ID NO: 3531690 - DNA, 20 bp, Homo sapiens
agctataacatatttattgt

SEQ ID NO: 3531691 - DNA, 20 bp, Homo sapiens
agctcgttcctacctggctg

SEQ ID NO: 3531692 - DNA, 17 bp, Homo sapiens
agctctaagcagccagg

SEQ ID NO: 3531693 - DNA, 19 bp, Homo sapiens
agctcttggtgggcccagg

SEQ ID NO: 3531694 - DNA, 18 bp, Homo sapiens
agctgaaaatagcacggg

SEQ ID NO: 3531695 - DNA, 19 bp, Homo sapiens
agctgagaagaggaggagg

SEQ ID NO: 3531696 - DNA, 17 bp, Homo sapiens
agctgcccccagagcca

SEQ ID NO: 3531697 - DNA, 13 bp, Homo sapiens
agctgggaggtct

SEQ ID NO: 3531698 - DNA, 23 bp, Homo sapiens
agctgggaggtctcgtcccagcc

SEQ ID NO: 3531699 - DNA, 15 bp, Homo sapiens
agctgtcagaagttt

SEQ ID NO: 3531700 - DNA, 17 bp, Homo sapiens
agcttctataagtgtga

SEQ ID NO: 3531701 - DNA, 20 bp, Homo sapiens
aggacacgaaggctgcccct

SEQ ID NO: 3531702 - DNA, 13 bp, Homo sapiens
aggacactggatc

SEQ ID NO: 3531703 - DNA, 14 bp, Homo sapiens
aggagcagagaggt

SEQ ID NO: 3531704 - DNA, 20 bp, Homo sapiens
aggagcagagaggtggccac

SEQ ID NO: 3531705 - DNA, 12 bp, Homo sapiens
aggaggaggctg

SEQ ID NO: 3531706 - DNA, 19 bp, Homo sapiens
aggaggctgccctgagggg

SEQ ID NO: 3531707 - DNA, 20 bp, Homo sapiens
aggaggctgccctgaggggc

SEQ ID NO: 3531708 - DNA, 21 bp, Homo sapiens
aggaggctgccctgaggggct

SEQ ID NO: 3531709 - DNA, 12 bp, Homo sapiens
aggagggcactg

SEQ ID NO: 3531710 - DNA, 15 bp, Homo sapiens
aggaggtgggggctg

SEQ ID NO: 3531711 - DNA, 18 bp, Homo sapiens
aggatatgccctcctggt

SEQ ID NO: 3531712 - DNA, 20 bp, Homo sapiens
aggatatgccctcctggtga

SEQ ID NO: 3531713 - DNA, 17 bp, Homo sapiens
aggatgcattctgatag

SEQ ID NO: 3531714 - DNA, 23 bp, Homo sapiens
aggatgcattctgataggagggg

SEQ ID NO: 3531715 - DNA, 15 bp, Homo sapiens
aggatttccctgaag

SEQ ID NO: 3531716 - DNA, 13 bp, Homo sapiens
aggcacaaatcac

SEQ ID NO: 3531717 - DNA, 22 bp, Homo sapiens
aggcaccaacaactcagaatgg

SEQ ID NO: 3531718 - DNA, 22 bp, Homo sapiens
aggcagaatgaacccataggga

SEQ ID NO: 3531719 - DNA, 14 bp, Homo sapiens
aggcagcatttgaa

SEQ ID NO: 3531720 - DNA, 21 bp, Homo sapiens
aggcatgcagtcatgagaatt

SEQ ID NO: 3531721 - DNA, 16 bp, Homo sapiens
aggcattgagggctct

SEQ ID NO: 3531722 - DNA, 20 bp, Homo sapiens
aggcccgcgggcacagccag

SEQ ID NO: 3531723 - DNA, 15 bp, Homo sapiens
aggcctagaggcctg

SEQ ID NO: 3531724 - DNA, 16 bp, Homo sapiens
aggcctgactgccaag

SEQ ID NO: 3531725 - DNA, 18 bp, Homo sapiens
aggcctgactgccaagcc

SEQ ID NO: 3531726 - DNA, 15 bp, Homo sapiens
aggcctttccctaag

SEQ ID NO: 3531727 - DNA, 18 bp, Homo sapiens
aggcctttccctaagcca

SEQ ID NO: 3531728 - DNA, 13 bp, Homo sapiens
aggctcagcccac

SEQ ID NO: 3531729 - DNA, 18 bp, Homo sapiens
aggctcagcccaccctcc

SEQ ID NO: 3531730 - DNA, 15 bp, Homo sapiens
aggctggggacccag

SEQ ID NO: 3531731 - DNA, 22 bp, Homo sapiens
aggctggtgtatgcactgctca

SEQ ID NO: 3531732 - DNA, 13 bp, Homo sapiens
aggctttgccctg

SEQ ID NO: 3531733 - DNA, 20 bp, Homo sapiens
aggctttgccctgctgccct

SEQ ID NO: 3531734 - DNA, 17 bp, Homo sapiens
aggcttttccagtgtgt

SEQ ID NO: 3531735 - DNA, 13 bp, Homo sapiens
agggagggaagtc

SEQ ID NO: 3531736 - DNA, 20 bp, Homo sapiens
agggagtctcaggaggaggc

SEQ ID NO: 3531737 - DNA, 15 bp, Homo sapiens
agggatgttgcaaag

SEQ ID NO: 3531738 - DNA, 16 bp, Homo sapiens
agggccagggaggcag

SEQ ID NO: 3531739 - DNA, 13 bp, Homo sapiens
aggggacccagcg

SEQ ID NO: 3531740 - DNA, 16 bp, Homo sapiens
aggggacgtgggccct

SEQ ID NO: 3531741 - DNA, 13 bp, Homo sapiens
aggggagggaggg

SEQ ID NO: 3531742 - DNA, 16 bp, Homo sapiens
aggggccggctggcct

SEQ ID NO: 3531743 - DNA, 23 bp, Homo sapiens
agggggagtccctcgtctcttgt

SEQ ID NO: 3531744 - DNA, 14 bp, Homo sapiens
agggggcggcaggg

SEQ ID NO: 3531745 - DNA, 22 bp, Homo sapiens
agggggcggcagggctgggcct

SEQ ID NO: 3531746 - DNA, 14 bp, Homo sapiens
aggggtgcaggtgg

SEQ ID NO: 3531747 - DNA, 19 bp, Homo sapiens
aggggtgtccgagaggctg

SEQ ID NO: 3531748 - DNA, 21 bp, Homo sapiens
cacagccagcccaaaccttgg

SEQ ID NO: 3531749 - DNA, 23 bp, Homo sapiens
cacagcccccgggacaccgtggg

SEQ ID NO: 3531750 - DNA, 13 bp, Homo sapiens
caccaaacatttc

SEQ ID NO: 3531751 - DNA, 15 bp, Homo sapiens
caccaaacatttctg

SEQ ID NO: 3531752 - DNA, 20 bp, Homo sapiens
caccaaacatttctgtgaaa

SEQ ID NO: 3531753 - DNA, 18 bp, Homo sapiens
cacccccgctttggttct

SEQ ID NO: 3531754 - DNA, 14 bp, Homo sapiens
caccgtggggaagg

SEQ ID NO: 3531755 - DNA, 15 bp, Homo sapiens
caccgtggggaaggg

SEQ ID NO: 3531756 - DNA, 15 bp, Homo sapiens
cacctccactcagca

SEQ ID NO: 3531757 - DNA, 19 bp, Homo sapiens
caccttagaccaccaagcc

SEQ ID NO: 3531758 - DNA, 14 bp, Homo sapiens
cacgccacagccct

SEQ ID NO: 3531759 - DNA, 15 bp, Homo sapiens
cacgttcagggaggg

SEQ ID NO: 3531760 - DNA, 15 bp, Homo sapiens
cactcagcactctgg

SEQ ID NO: 3531761 - DNA, 21 bp, Homo sapiens
cactctatccaaagtgtcact

SEQ ID NO: 3531762 - DNA, 14 bp, Homo sapiens
cactctccagcagt

SEQ ID NO: 3531763 - DNA, 19 bp, Homo sapiens
cactgagaaatagtgcact

SEQ ID NO: 3531764 - DNA, 17 bp, Homo sapiens
cactgctcacggacccc

SEQ ID NO: 3531765 - DNA, 16 bp, Homo sapiens
cactggagctgggagg

SEQ ID NO: 3531766 - DNA, 21 bp, Homo sapiens
cactggatcaagttcagccac

SEQ ID NO: 3531767 - DNA, 22 bp, Homo sapiens
cactggatcaagttcagccacc

SEQ ID NO: 3531768 - DNA, 19 bp, Homo sapiens
cactgtggggaaacaattt

SEQ ID NO: 3531769 - DNA, 20 bp, Homo sapiens
cagaaacggtctttatgaat

SEQ ID NO: 3531770 - DNA, 18 bp, Homo sapiens
cagaaatatattatgaaa

SEQ ID NO: 3531771 - DNA, 22 bp, Homo sapiens
cagaaatctgaaaaatggccat

SEQ ID NO: 3531772 - DNA, 14 bp, Homo sapiens
cagaagaccagatc

SEQ ID NO: 3531773 - DNA, 17 bp, Homo sapiens
cagaagttgggggaaag

SEQ ID NO: 3531774 - DNA, 23 bp, Homo sapiens
cagaccaaggcagggcccagcat

SEQ ID NO: 3531775 - DNA, 16 bp, Homo sapiens
cagacgactagcccag

SEQ ID NO: 3531776 - DNA, 18 bp, Homo sapiens
cagacgttggtcccaagt

SEQ ID NO: 3531777 - DNA, 21 bp, Homo sapiens
cagaggaatgatgggcttttg

SEQ ID NO: 3531778 - DNA, 16 bp, Homo sapiens
cagaggcagtggccac

SEQ ID NO: 3531779 - DNA, 16 bp, Homo sapiens
cagaggcttttccagt

SEQ ID NO: 3531780 - DNA, 17 bp, Homo sapiens
cagaggcttttccagtg

SEQ ID NO: 3531781 - DNA, 15 bp, Homo sapiens
cagagtataattttg

SEQ ID NO: 3531782 - DNA, 13 bp, Homo sapiens
cagatgctcttgg

SEQ ID NO: 3531783 - DNA, 17 bp, Homo sapiens
cagatgttttatttatg

SEQ ID NO: 3531784 - DNA, 18 bp, Homo sapiens
cagatgttttatttatga

SEQ ID NO: 3531785 - DNA, 19 bp, Homo sapiens
cagatgttttatttatgaa

SEQ ID NO: 3531786 - DNA, 23 bp, Homo sapiens
cagatgttttatttatgaagttt

SEQ ID NO: 3531787 - DNA, 13 bp, Homo sapiens
cagcactctggac

SEQ ID NO: 3531788 - DNA, 14 bp, Homo sapiens
cagcactctggact

SEQ ID NO: 3531789 - DNA, 19 bp, Homo sapiens
cagcagaggcagtggccac

SEQ ID NO: 3531790 - DNA, 22 bp, Homo sapiens
cagcagattccacaggacacga

SEQ ID NO: 3531791 - DNA, 18 bp, Homo sapiens
cagcagttaggcacctta

SEQ ID NO: 3531792 - DNA, 12 bp, Homo sapiens
cagcatttgaat

SEQ ID NO: 3531793 - DNA, 11 bp, Homo sapiens
cagccaggagg

SEQ ID NO: 3531794 - DNA, 12 bp, Homo sapiens
cagccaggaggg

SEQ ID NO: 3531795 - DNA, 13 bp, Homo sapiens
cagccatggccct

SEQ ID NO: 3531796 - DNA, 15 bp, Homo sapiens
cagcccaaaccttgg

SEQ ID NO: 3531797 - DNA, 12 bp, Homo sapiens
cagccccacacc

SEQ ID NO: 3531798 - DNA, 17 bp, Homo sapiens
cagcccccgggacaccg

SEQ ID NO: 3531799 - DNA, 20 bp, Homo sapiens
cagcccccgggacaccgtgg

SEQ ID NO: 3531800 - DNA, 22 bp, Homo sapiens
cagcccccgggacaccgtgggg

SEQ ID NO: 3531801 - DNA, 14 bp, Homo sapiens
cagccgtcagccat

SEQ ID NO: 3531802 - DNA, 15 bp, Homo sapiens
cagccgtcagccatc

SEQ ID NO: 3531803 - DNA, 18 bp, Homo sapiens
cagcctggacctgggtta

SEQ ID NO: 3531804 - DNA, 21 bp, Homo sapiens
cagcgctggcccccccagccc

SEQ ID NO: 3531805 - DNA, 17 bp, Homo sapiens
cagctctaagcagccag

SEQ ID NO: 3531806 - DNA, 21 bp, Homo sapiens
cagctctaagcagccaggagg

SEQ ID NO: 3531807 - DNA, 13 bp, Homo sapiens
caggaatgaaata

SEQ ID NO: 3531808 - DNA, 21 bp, Homo sapiens
caggacacgaaggctgcccct

SEQ ID NO: 3531809 - DNA, 23 bp, Homo sapiens
caggacacgaaggctgcccctgt

SEQ ID NO: 3531810 - DNA, 13 bp, Homo sapiens
caggagggcactg

SEQ ID NO: 3531811 - DNA, 19 bp, Homo sapiens
caggcactctcctgtctga

SEQ ID NO: 3531812 - DNA, 17 bp, Homo sapiens
caggcccgcgggcacag

SEQ ID NO: 3531813 - DNA, 18 bp, Homo sapiens
caggcccgcgggcacagc

SEQ ID NO: 3531814 - DNA, 21 bp, Homo sapiens
caggctgttggcgtgtcccag

SEQ ID NO: 3531815 - DNA, 15 bp, Homo sapiens
caggctttccttgtt

SEQ ID NO: 3531816 - DNA, 22 bp, Homo sapiens
cagggacacccacacaggtggc

SEQ ID NO: 3531817 - DNA, 13 bp, Homo sapiens
caggggaagggca

SEQ ID NO: 3531818 - DNA, 14 bp, Homo sapiens
cagggtggagctga

SEQ ID NO: 3531819 - DNA, 15 bp, Homo sapiens
cagggtgtcctgagg

SEQ ID NO: 3531820 - DNA, 13 bp, Homo sapiens
caggtggccatca

SEQ ID NO: 3531821 - DNA, 21 bp, Homo sapiens
cagtattgcaataaaaaatat

SEQ ID NO: 3531822 - DNA, 19 bp, Homo sapiens
cagtcatgagaattacaga

SEQ ID NO: 3531823 - DNA, 21 bp, Homo sapiens
cagtgaaaggcctgcttttgt

SEQ ID NO: 3531824 - DNA, 14 bp, Homo sapiens
cagtgaggaaaaac

SEQ ID NO: 3531825 - DNA, 22 bp, Homo sapiens
cagtggccacgttcagggaggg

SEQ ID NO: 3531826 - DNA, 18 bp, Homo sapiens
cagtggggtaggctgctg

SEQ ID NO: 3531827 - DNA, 13 bp, Homo sapiens
cagtggtgttaca

SEQ ID NO: 3531828 - DNA, 21 bp, Homo sapiens
cagtgttaaagtggtctgaac

SEQ ID NO: 3531829 - DNA, 22 bp, Homo sapiens
cagtgttaaagtggtctgaact

SEQ ID NO: 3531830 - DNA, 21 bp, Homo sapiens
cagttcttagattcaggggaa

SEQ ID NO: 3531831 - DNA, 23 bp, Homo sapiens
cagttttgatatttatttatgct

SEQ ID NO: 3531832 - DNA, 21 bp, Homo sapiens
cataacttacctctgcttctg

SEQ ID NO: 3531833 - DNA, 19 bp, Homo sapiens
cataagatagttacattta

SEQ ID NO: 3531834 - DNA, 14 bp, Homo sapiens
catacaataaaaga

SEQ ID NO: 3531835 - DNA, 20 bp, Homo sapiens
catacaataaaagagcttta

SEQ ID NO: 3531836 - DNA, 21 bp, Homo sapiens
catacaataaaagagctttat

SEQ ID NO: 3531837 - DNA, 18 bp, Homo sapiens
catacaccaaacatttct

SEQ ID NO: 3531838 - DNA, 14 bp, Homo sapiens
catagagaggcctg

SEQ ID NO: 3531839 - DNA, 23 bp, Homo sapiens
catagcaccctgccctcatggga

SEQ ID NO: 3531840 - DNA, 11 bp, Homo sapiens
cataggggcag

SEQ ID NO: 3531841 - DNA, 16 bp, Homo sapiens
catatgtggaaatata

SEQ ID NO: 3531842 - DNA, 15 bp, Homo sapiens
catcaccttagacca

SEQ ID NO: 3531843 - DNA, 18 bp, Homo sapiens
catcaccttagaccacca

SEQ ID NO: 3531844 - DNA, 23 bp, Homo sapiens
catcaccttagaccaccaagcct

SEQ ID NO: 3531845 - DNA, 18 bp, Homo sapiens
catcactagagtgctctg

SEQ ID NO: 3531846 - DNA, 22 bp, Homo sapiens
catcataagatagttacattta

SEQ ID NO: 3531847 - DNA, 15 bp, Homo sapiens
catccagttgtctaa

SEQ ID NO: 3531848 - DNA, 23 bp, Homo sapiens
catctgggttgccatggcaatgg

SEQ ID NO: 3531849 - DNA, 18 bp, Homo sapiens
catctgtaggtcactctc

SEQ ID NO: 3531850 - DNA, 23 bp, Homo sapiens
catcttacagagactctccctga

SEQ ID NO: 3531851 - DNA, 20 bp, Homo sapiens
catcttcctgagctagcaaa

SEQ ID NO: 3531852 - DNA, 14 bp, Homo sapiens
catgaatatttctt

SEQ ID NO: 3531853 - DNA, 19 bp, Homo sapiens
catgacaaaatagcccagc

SEQ ID NO: 3531854 - DNA, 15 bp, Homo sapiens
catgactgcaactgt

SEQ ID NO: 3531855 - DNA, 20 bp, Homo sapiens
catgacttgaggcacaaatc

SEQ ID NO: 3531856 - DNA, 14 bp, Homo sapiens
catgaggaccaggg

SEQ ID NO: 3531857 - DNA, 16 bp, Homo sapiens
cttttacttttcttct

SEQ ID NO: 3531858 - DNA, 15 bp, Homo sapiens
cttttgtctctgcaa

SEQ ID NO: 3531859 - DNA, 17 bp, Homo sapiens
gaaaacagaagcaaagg

SEQ ID NO: 3531860 - DNA, 13 bp, Homo sapiens
gaaaagaagctgt

SEQ ID NO: 3531861 - DNA, 16 bp, Homo sapiens
gaaaaggcagcatttg

SEQ ID NO: 3531862 - DNA, 18 bp, Homo sapiens
gaaaataagaaagaattg

SEQ ID NO: 3531863 - DNA, 19 bp, Homo sapiens
gaaaataagacttctggtg

SEQ ID NO: 3531864 - DNA, 16 bp, Homo sapiens
gaaaattaagattatt

SEQ ID NO: 3531865 - DNA, 17 bp, Homo sapiens
gaaaccttccagagaac

SEQ ID NO: 3531866 - DNA, 22 bp, Homo sapiens
gaaacggtctttatgaattatt

SEQ ID NO: 3531867 - DNA, 13 bp, Homo sapiens
gaaagaacattta

SEQ ID NO: 3531868 - DNA, 14 bp, Homo sapiens
gaaatagtgcactc

SEQ ID NO: 3531869 - DNA, 18 bp, Homo sapiens
gaaatatacctacctctt

SEQ ID NO: 3531870 - DNA, 18 bp, Homo sapiens
gaaatatattatgaaaat

SEQ ID NO: 3531871 - DNA, 17 bp, Homo sapiens
gaaatcagtggtgttac

SEQ ID NO: 3531872 - DNA, 20 bp, Homo sapiens
gaaatctgaaaaatggccat

SEQ ID NO: 3531873 - DNA, 22 bp, Homo sapiens
gaaatttttgatgcccagacag

SEQ ID NO: 3531874 - DNA, 15 bp, Homo sapiens
gaacaactggaaata

SEQ ID NO: 3531875 - DNA, 16 bp, Homo sapiens
gaacaactggaaataa

SEQ ID NO: 3531876 - DNA, 20 bp, Homo sapiens
gaacaactggaaataaagta

SEQ ID NO: 3531877 - DNA, 13 bp, Homo sapiens
gaacacagggctg

SEQ ID NO: 3531878 - DNA, 14 bp, Homo sapiens
gaacattcaagaga

SEQ ID NO: 3531879 - DNA, 14 bp, Homo sapiens
gaacatttaaaatt

SEQ ID NO: 3531880 - DNA, 18 bp, Homo sapiens
gaacatttaaaattaaat

SEQ ID NO: 3531881 - DNA, 19 bp, Homo sapiens
gaacatttaaaattaaata

SEQ ID NO: 3531882 - DNA, 20 bp, Homo sapiens
gaacatttaaaattaaataa

SEQ ID NO: 3531883 - DNA, 22 bp, Homo sapiens
gaaccacggtgaaagtgctgct

SEQ ID NO: 3531884 - DNA, 20 bp, Homo sapiens
gaactataacattcaatttg

SEQ ID NO: 3531885 - DNA, 15 bp, Homo sapiens
gaagaggaggaggtg

SEQ ID NO: 3531886 - DNA, 13 bp, Homo sapiens
gaaggctgcccct

SEQ ID NO: 3531887 - DNA, 20 bp, Homo sapiens
gaaggtgaaacattttctcc

SEQ ID NO: 3531888 - DNA, 17 bp, Homo sapiens
gaagtttttattttaaa

SEQ ID NO: 3531889 - DNA, 17 bp, Homo sapiens
gaataggttactttgga

SEQ ID NO: 3531890 - DNA, 17 bp, Homo sapiens
gaatctcgttgaggcca

SEQ ID NO: 3531891 - DNA, 20 bp, Homo sapiens
gaatctcgttgaggccaagg

SEQ ID NO: 3531892 - DNA, 17 bp, Homo sapiens
gaatgaagctaatgtga

SEQ ID NO: 3531893 - DNA, 19 bp, Homo sapiens
gaattaggctttagatttt

SEQ ID NO: 3531894 - DNA, 15 bp, Homo sapiens
gaattgcttttatca

SEQ ID NO: 3531895 - DNA, 21 bp, Homo sapiens
gacaaaatagcccagcctttt

SEQ ID NO: 3531896 - DNA, 14 bp, Homo sapiens
gacacacccaaggg

SEQ ID NO: 3531897 - DNA, 22 bp, Homo sapiens
gacacccacacaggtggccatc

SEQ ID NO: 3531898 - DNA, 17 bp, Homo sapiens
gacaccgtggggaaggg

SEQ ID NO: 3531899 - DNA, 19 bp, Homo sapiens
gacaccgtggggaaggggt

SEQ ID NO: 3531900 - DNA, 22 bp, Homo sapiens
gacaccgtggggaaggggtgca

SEQ ID NO: 3531901 - DNA, 21 bp, Homo sapiens
gacatgagtccaccctttgga

SEQ ID NO: 3531902 - DNA, 12 bp, Homo sapiens
gaccaaaggggg

SEQ ID NO: 3531903 - DNA, 16 bp, Homo sapiens
gaccaaggcagggccc

SEQ ID NO: 3531904 - DNA, 13 bp, Homo sapiens
gaccaccaagcct

SEQ ID NO: 3531905 - DNA, 20 bp, Homo sapiens
gaccccactgcagcagaaaa

SEQ ID NO: 3531906 - DNA, 18 bp, Homo sapiens
gaccctccccaaaggctt

SEQ ID NO: 3531907 - DNA, 18 bp, Homo sapiens
gaccctcccggcctggct

SEQ ID NO: 3531908 - DNA, 18 bp, Homo sapiens
gacgactagcccaggacc

SEQ ID NO: 3531909 - DNA, 15 bp, Homo sapiens
gacgatcacagaaac

SEQ ID NO: 3531910 - DNA, 13 bp, Homo sapiens
gacgtgggccctg

SEQ ID NO: 3531911 - DNA, 17 bp, Homo sapiens
gacgtgggccctgcagg

SEQ ID NO: 3531912 - DNA, 16 bp, Homo sapiens
gacgttggtcccaagt

SEQ ID NO: 3531913 - DNA, 16 bp, Homo sapiens
gactaagttgcaagat

SEQ ID NO: 3531914 - DNA, 14 bp, Homo sapiens
gactcagcagaggc

SEQ ID NO: 3531915 - DNA, 15 bp, Homo sapiens
gactcagcagaggca

SEQ ID NO: 3531916 - DNA, 14 bp, Homo sapiens
gactccttggtgct

SEQ ID NO: 3531917 - DNA, 19 bp, Homo sapiens
gactgacccaaaatgtgaa

SEQ ID NO: 3531918 - DNA, 13 bp, Homo sapiens
gactgccaagcca

SEQ ID NO: 3531919 - DNA, 22 bp, Homo sapiens
gactgtcagggagggccaggga

SEQ ID NO: 3531920 - DNA, 16 bp, Homo sapiens
gacttttggccccagc

SEQ ID NO: 3531921 - DNA, 17 bp, Homo sapiens
gagaaagacaaaatgtg

SEQ ID NO: 3531922 - DNA, 18 bp, Homo sapiens
gagaaagacaaaatgtga

SEQ ID NO: 3531923 - DNA, 15 bp, Homo sapiens
gagaagaggaggagg

SEQ ID NO: 3531924 - DNA, 21 bp, Homo sapiens
gagaagaggaggaggtggggg

SEQ ID NO: 3531925 - DNA, 18 bp, Homo sapiens
gagaatgattttgctgac

SEQ ID NO: 3531926 - DNA, 21 bp, Homo sapiens
gagaattacagaaaatttgca

SEQ ID NO: 3531927 - DNA, 15 bp, Homo sapiens
gagaccgaggccaga

SEQ ID NO: 3531928 - DNA, 14 bp, Homo sapiens
gagagcatcaggcc

SEQ ID NO: 3531929 - DNA, 16 bp, Homo sapiens
gagaggggagggaggg

SEQ ID NO: 3531930 - DNA, 20 bp, Homo sapiens
gagagtaatttgggaaaaga

SEQ ID NO: 3531931 - DNA, 21 bp, Homo sapiens
gagatggagtatacatgactg

SEQ ID NO: 3531932 - DNA, 14 bp, Homo sapiens
gagatttttcatgt

SEQ ID NO: 3531933 - DNA, 14 bp, Homo sapiens
gagcaaccctctga

SEQ ID NO: 3531934 - DNA, 14 bp, Homo sapiens
gagccactcttcaa

SEQ ID NO: 3531935 - DNA, 16 bp, Homo sapiens
gagcctgtgaccttgg

SEQ ID NO: 3531936 - DNA, 13 bp, Homo sapiens
gagcgggagggag

SEQ ID NO: 3531937 - DNA, 20 bp, Homo sapiens
gagcgggagggagtctcagg

SEQ ID NO: 3531938 - DNA, 22 bp, Homo sapiens
gagcgggagggagtctcaggag

SEQ ID NO: 3531939 - DNA, 15 bp, Homo sapiens
gagcgttactgtaga

SEQ ID NO: 3531940 - DNA, 17 bp, Homo sapiens
gagctccatgttgcttc

SEQ ID NO: 3531941 - DNA, 19 bp, Homo sapiens
gagctccatgttgcttcac

SEQ ID NO: 3531942 - DNA, 14 bp, Homo sapiens
gagctgagaagagg

SEQ ID NO: 3531943 - DNA, 21 bp, Homo sapiens
gagctgagaagaggaggaggt

SEQ ID NO: 3531944 - DNA, 15 bp, Homo sapiens
gaggacaagttacac

SEQ ID NO: 3531945 - DNA, 14 bp, Homo sapiens
gaggaccagggtgg

SEQ ID NO: 3531946 - DNA, 21 bp, Homo sapiens
gaggagaccagcggtccatgg

SEQ ID NO: 3531947 - DNA, 14 bp, Homo sapiens
gaggaggctgccct

SEQ ID NO: 3531948 - DNA, 18 bp, Homo sapiens
gaggatcctgagctgctg

SEQ ID NO: 3531949 - DNA, 19 bp, Homo sapiens
gaggcagagcgggagggag

SEQ ID NO: 3531950 - DNA, 18 bp, Homo sapiens
gaggcctgactgccaagc

SEQ ID NO: 3531951 - DNA, 19 bp, Homo sapiens
gaggcctttccctaagcca

SEQ ID NO: 3531952 - DNA, 22 bp, Homo sapiens
gaggcctttccctaagccagct

SEQ ID NO: 3531953 - DNA, 16 bp, Homo sapiens
gaggctgccctgaggg

SEQ ID NO: 3531954 - DNA, 18 bp, Homo sapiens
gaggctgccctgaggggc

SEQ ID NO: 3531955 - DNA, 16 bp, Homo sapiens
gaggctggggacccag

SEQ ID NO: 3531956 - DNA, 17 bp, Homo sapiens
gaggctggggacccaga

SEQ ID NO: 3531957 - DNA, 20 bp, Homo sapiens
gaggctggtgtatgcactgc

SEQ ID NO: 3531958 - DNA, 21 bp, Homo sapiens
gagggacctgcatctaagcat

SEQ ID NO: 3531959 - DNA, 17 bp, Homo sapiens
gagggagtctcaggagg

SEQ ID NO: 3531960 - DNA, 14 bp, Homo sapiens
gagggccagggagg

SEQ ID NO: 3531961 - DNA, 16 bp, Homo sapiens
gaggggacgggcaagt

SEQ ID NO: 3531962 - DNA, 12 bp, Homo sapiens
gaggggctgggg

SEQ ID NO: 3531963 - DNA, 14 bp, Homo sapiens
gaggggctggggag

SEQ ID NO: 3531964 - DNA, 15 bp, Homo sapiens
gaggggtgtccgaga

SEQ ID NO: 3531965 - DNA, 14 bp, Homo sapiens
gaggtctttcagaa

SEQ ID NO: 3531966 - DNA, 20 bp, Homo sapiens
gagtactcataaaggacact

SEQ ID NO: 3531967 - DNA, 16 bp, Homo sapiens
gtttctgagttttacc

SEQ ID NO: 3531968 - DNA, 17 bp, Homo sapiens
gtttctgagttttacca

SEQ ID NO: 3531969 - DNA, 22 bp, Homo sapiens
gtttctgatagtagtctttaaa

SEQ ID NO: 3531970 - DNA, 17 bp, Homo sapiens
gtttgggttctctgctg

SEQ ID NO: 3531971 - DNA, 11 bp, Homo sapiens
gttttcacagt

SEQ ID NO: 3531972 - DNA, 16 bp, Homo sapiens
gttttgttttttaact

SEQ ID NO: 3531973 - DNA, 19 bp, Homo sapiens
gtttttattttaaacattt

SEQ ID NO: 3531974 - DNA, 21 bp, Homo sapiens
gtttttattttaaacattttt

SEQ ID NO: 3531975 - DNA, 12 bp, Homo sapiens
taaaatttcagg

SEQ ID NO: 3531976 - DNA, 22 bp, Homo sapiens
taaaatttcagggaaaacagaa

SEQ ID NO: 3531977 - DNA, 10 bp, Homo sapiens
taaacatttt

SEQ ID NO: 3531978 - DNA, 22 bp, Homo sapiens
taaacattttttttaaaaatta

SEQ ID NO: 3531979 - DNA, 18 bp, Homo sapiens
taaacttgcacatttgaa

SEQ ID NO: 3531980 - DNA, 16 bp, Homo sapiens
taaaggacactggatc

SEQ ID NO: 3531981 - DNA, 21 bp, Homo sapiens
taaaggatgagatttttcatg

SEQ ID NO: 3531982 - DNA, 16 bp, Homo sapiens
taaataaattttaatt

SEQ ID NO: 3531983 - DNA, 20 bp, Homo sapiens
taaatccatgaaaataaacg

SEQ ID NO: 3531984 - DNA, 22 bp, Homo sapiens
taaatctttgtgaacattctgt

SEQ ID NO: 3531985 - DNA, 18 bp, Homo sapiens
taaattactaattatctt

SEQ ID NO: 3531986 - DNA, 16 bp, Homo sapiens
taacaagtcatttcaa

SEQ ID NO: 3531987 - DNA, 13 bp, Homo sapiens
taacattcaattt

SEQ ID NO: 3531988 - DNA, 16 bp, Homo sapiens
taacattcaatttgct

SEQ ID NO: 3531989 - DNA, 14 bp, Homo sapiens
taactgttcagtat

SEQ ID NO: 3531990 - DNA, 16 bp, Homo sapiens
taacttatgaagtaaa

SEQ ID NO: 3531991 - DNA, 13 bp, Homo sapiens
taacttctgttac

SEQ ID NO: 3531992 - DNA, 23 bp, Homo sapiens
taagaacttcagtgtagagaaaa

SEQ ID NO: 3531993 - DNA, 16 bp, Homo sapiens
taagattattgtctga

SEQ ID NO: 3531994 - DNA, 22 bp, Homo sapiens
taagattattgtctgattgaaa

SEQ ID NO: 3531995 - DNA, 15 bp, Homo sapiens
taagccagctgcccc

SEQ ID NO: 3531996 - DNA, 18 bp, Homo sapiens
taaggcattgagggctct

SEQ ID NO: 3531997 - DNA, 14 bp, Homo sapiens
taaggtttcaatgc

SEQ ID NO: 3531998 - DNA, 18 bp, Homo sapiens
taagtgtgaccagttttg

SEQ ID NO: 3531999 - DNA, 16 bp, Homo sapiens
taagttgcaagatctt

SEQ ID NO: 3532000 - DNA, 16 bp, Homo sapiens
taatatgttttattca

SEQ ID NO: 3532001 - DNA, 15 bp, Homo sapiens
taatgactgagattt

SEQ ID NO: 3532002 - DNA, 13 bp, Homo sapiens
taatgtaaatttt

SEQ ID NO: 3532003 - DNA, 14 bp, Homo sapiens
taatgttaactttc

SEQ ID NO: 3532004 - DNA, 16 bp, Homo sapiens
taatgttaactttcaa

SEQ ID NO: 3532005 - DNA, 17 bp, Homo sapiens
taatgttaactttcaaa

SEQ ID NO: 3532006 - DNA, 19 bp, Homo sapiens
taatttgggaaaagaagct

SEQ ID NO: 3532007 - DNA, 21 bp, Homo sapiens
taatttgggaaaagaagctgt

SEQ ID NO: 3532008 - DNA, 15 bp, Homo sapiens
tacaaactatttcag

SEQ ID NO: 3532009 - DNA, 22 bp, Homo sapiens
tacaccaaacatttctgtgaaa

SEQ ID NO: 3532010 - DNA, 15 bp, Homo sapiens
taccaatctgtgaga

SEQ ID NO: 3532011 - DNA, 20 bp, Homo sapiens
taccatacccagatgtttta

SEQ ID NO: 3532012 - DNA, 22 bp, Homo sapiens
taccatttttttttaacactgt

SEQ ID NO: 3532013 - DNA, 17 bp, Homo sapiens
taccctagaagaaaacc

SEQ ID NO: 3532014 - DNA, 18 bp, Homo sapiens
taccctagaagaaaaccc

SEQ ID NO: 3532015 - DNA, 19 bp, Homo sapiens
taccctagaagaaaacccg

SEQ ID NO: 3532016 - DNA, 23 bp, Homo sapiens
tactagagaaagacaaaatgtga

SEQ ID NO: 3532017 - DNA, 13 bp, Homo sapiens
tactcataaagga

SEQ ID NO: 3532018 - DNA, 14 bp, Homo sapiens
tactcataaaggac

SEQ ID NO: 3532019 - DNA, 17 bp, Homo sapiens
tagaatatgttgatttt

SEQ ID NO: 3532020 - DNA, 19 bp, Homo sapiens
tagagaggcctgctttgtt

SEQ ID NO: 3532021 - DNA, 18 bp, Homo sapiens
tagattcaggggaagggc

SEQ ID NO: 3532022 - DNA, 19 bp, Homo sapiens
tagcatacaccaaacattt

SEQ ID NO: 3532023 - DNA, 20 bp, Homo sapiens
tagcatacaccaaacatttc

SEQ ID NO: 3532024 - DNA, 21 bp, Homo sapiens
tagcatacaccaaacatttct

SEQ ID NO: 3532025 - DNA, 21 bp, Homo sapiens
tagcccagccttttgagagta

SEQ ID NO: 3532026 - DNA, 17 bp, Homo sapiens
taggatgtatgctgttt

SEQ ID NO: 3532027 - DNA, 11 bp, Homo sapiens
taggctgctgc

SEQ ID NO: 3532028 - DNA, 16 bp, Homo sapiens
taggctgctgccctgc

SEQ ID NO: 3532029 - DNA, 15 bp, Homo sapiens
taggtatgaagtata

SEQ ID NO: 3532030 - DNA, 22 bp, Homo sapiens
tagtcccaccctatggccactg

SEQ ID NO: 3532031 - DNA, 22 bp, Homo sapiens
tagtccccccagctctaagcag

SEQ ID NO: 3532032 - DNA, 18 bp, Homo sapiens
tagtcgggcagggcccct

SEQ ID NO: 3532033 - DNA, 20 bp, Homo sapiens
tagttacatttatgtgctgt

SEQ ID NO: 3532034 - DNA, 22 bp, Homo sapiens
tataacatatttattgtgcatt

SEQ ID NO: 3532035 - DNA, 16 bp, Homo sapiens
tataacttatgaagta

SEQ ID NO: 3532036 - DNA, 11 bp, Homo sapiens
tatagatgtta

SEQ ID NO: 3532037 - DNA, 19 bp, Homo sapiens
tatatcacagagccactct

SEQ ID NO: 3532038 - DNA, 13 bp, Homo sapiens
tatattatgaaaa

SEQ ID NO: 3532039 - DNA, 15 bp, Homo sapiens
tatattatgaaaatt

SEQ ID NO: 3532040 - DNA, 18 bp, Homo sapiens
tatatttttatatgtgga

SEQ ID NO: 3532041 - DNA, 16 bp, Homo sapiens
tatcagtgttaaagtg

SEQ ID NO: 3532042 - DNA, 16 bp, Homo sapiens
tatcatataaaatttc

SEQ ID NO: 3532043 - DNA, 18 bp, Homo sapiens
tatctactgactgaaatc

SEQ ID NO: 3532044 - DNA, 18 bp, Homo sapiens
tatctctcaagagtgctg

SEQ ID NO: 3532045 - DNA, 18 bp, Homo sapiens
tatgaggggacccagcgc

SEQ ID NO: 3532046 - DNA, 24 bp, Homo sapiens
tatgctgtttgtacaaactatttc

SEQ ID NO: 3532047 - DNA, 19 bp, Homo sapiens
tatgtctctagcagtgagt

SEQ ID NO: 3532048 - DNA, 13 bp, Homo sapiens
tattatgaaaatt

SEQ ID NO: 3532049 - DNA, 19 bp, Homo sapiens
tattgtctgattgaaacat

SEQ ID NO: 3532050 - DNA, 16 bp, Homo sapiens
tatttatgttttcaca

SEQ ID NO: 3532051 - DNA, 18 bp, Homo sapiens
tatttatgttttcacagt

SEQ ID NO: 3532052 - DNA, 11 bp, Homo sapiens
tatttattgac

SEQ ID NO: 3532053 - DNA, 20 bp, Homo sapiens
tattttgtaagctataacat

SEQ ID NO: 3532054 - DNA, 17 bp, Homo sapiens
tcaaagctgcatgtgta

SEQ ID NO: 3532055 - DNA, 18 bp, Homo sapiens
tcaaagctgcatgtgtag

SEQ ID NO: 3532056 - DNA, 14 bp, Homo sapiens
tcaagagtgctgag

SEQ ID NO: 3532057 - DNA, 15 bp, Homo sapiens
tcaagagtgctgaga

SEQ ID NO: 3532058 - DNA, 17 bp, Homo sapiens
tcaaggagtcttctaat

SEQ ID NO: 3532059 - DNA, 23 bp, Homo sapiens
tcaatgcatacaataaaagagct

SEQ ID NO: 3532060 - DNA, 19 bp, Homo sapiens
tcaatttgctatttacaaa

SEQ ID NO: 3532061 - DNA, 22 bp, Homo sapiens
tcacagaaacggtctttatgaa

SEQ ID NO: 3532062 - DNA, 18 bp, Homo sapiens
tcaccaagtgtattgtaa

SEQ ID NO: 3532063 - DNA, 19 bp, Homo sapiens
tcaccttagaccaccaagc

SEQ ID NO: 3532064 - DNA, 22 bp, Homo sapiens
tcaccttagaccaccaagcctt

SEQ ID NO: 3532065 - DNA, 22 bp, Homo sapiens
tcactagagtgctctgaccctg

SEQ ID NO: 3532066 - DNA, 18 bp, Homo sapiens
tcagaactataacattca

SEQ ID NO: 3532067 - DNA, 12 bp, Homo sapiens
tcagaatatttt

SEQ ID NO: 3532068 - DNA, 17 bp, Homo sapiens
tcagaatgggggctttc

SEQ ID NO: 3532069 - DNA, 15 bp, Homo sapiens
tcagatgctcttggg

SEQ ID NO: 3532070 - DNA, 23 bp, Homo sapiens
tcagcacaataaatatacttctg

SEQ ID NO: 3532071 - DNA, 13 bp, Homo sapiens
tcagcactctgga

SEQ ID NO: 3532072 - DNA, 16 bp, Homo sapiens
tcagcagaggcagtgg

SEQ ID NO: 3532073 - DNA, 14 bp, Homo sapiens
tcagccatggccct

SEQ ID NO: 3532074 - DNA, 13 bp, Homo sapiens
tcagcccaccctc

SEQ ID NO: 3532075 - DNA, 19 bp, Homo sapiens
tcagcttctataagtgtga

SEQ ID NO: 3532076 - DNA, 15 bp, Homo sapiens
tcaggcactctcctg

SEQ ID NO: 3532077 - DNA, 23 bp, Homo sapiens
tttctccctggatttttaccagt

SEQ ID NO: 3532078 - DNA, 15 bp, Homo sapiens
tttctgagttttacc

SEQ ID NO: 3532079 - DNA, 17 bp, Homo sapiens
tttctgagttttaccaa

SEQ ID NO: 3532080 - DNA, 18 bp, Homo sapiens
tttctgagttttaccaaa

SEQ ID NO: 3532081 - DNA, 19 bp, Homo sapiens
tttgaattcatttgctgac

SEQ ID NO: 3532082 - DNA, 22 bp, Homo sapiens
tttgaggacaagttacacctcc

SEQ ID NO: 3532083 - DNA, 17 bp, Homo sapiens
tttgatgcccagacagc

SEQ ID NO: 3532084 - DNA, 22 bp, Homo sapiens
tttgatgcccagacagcaagta

SEQ ID NO: 3532085 - DNA, 17 bp, Homo sapiens
tttgcagttctttggct

SEQ ID NO: 3532086 - DNA, 21 bp, Homo sapiens
tttgctatttacaaatgaagt

SEQ ID NO: 3532087 - DNA, 17 bp, Homo sapiens
tttgctgaccctcccca

SEQ ID NO: 3532088 - DNA, 19 bp, Homo sapiens
tttgctgaccctccccaaa

SEQ ID NO: 3532089 - DNA, 22 bp, Homo sapiens
tttgctgaccggaatggtcaaa

SEQ ID NO: 3532090 - DNA, 18 bp, Homo sapiens
tttgctgacttcccaagc

SEQ ID NO: 3532091 - DNA, 12 bp, Homo sapiens
tttggactgagt

SEQ ID NO: 3532092 - DNA, 22 bp, Homo sapiens
tttgggaaaagaagctgtcaga

SEQ ID NO: 3532093 - DNA, 22 bp, Homo sapiens
tttgtaaatctttgtgaacatt

SEQ ID NO: 3532094 - DNA, 21 bp, Homo sapiens
tttgtatcatgttttactaca

SEQ ID NO: 3532095 - DNA, 16 bp, Homo sapiens
tttgtgaacattctgt

SEQ ID NO: 3532096 - DNA, 16 bp, Homo sapiens
tttgttttgttgctca

SEQ ID NO: 3532097 - DNA, 13 bp, Homo sapiens
ttttaaacatttt

SEQ ID NO: 3532098 - DNA, 19 bp, Homo sapiens
ttttaatgttaactttcaa

SEQ ID NO: 3532099 - DNA, 22 bp, Homo sapiens
ttttactacataggttaatttt

SEQ ID NO: 3532100 - DNA, 14 bp, Homo sapiens
ttttatatgtggaa

SEQ ID NO: 3532101 - DNA, 13 bp, Homo sapiens
ttttggtgcaata

SEQ ID NO: 3532102 - DNA, 12 bp, Homo sapiens
ttttgtctctgc

SEQ ID NO: 3532103 - DNA, 21 bp, Homo sapiens
aggtgctggtagctgagggga

SEQ ID NO: 3532104 - DNA, 13 bp, Homo sapiens
aggtggccaccgg

SEQ ID NO: 3532105 - DNA, 11 bp, Homo sapiens
aggtgggagga

SEQ ID NO: 3532106 - DNA, 16 bp, Homo sapiens
aggtggggtgatggcc

SEQ ID NO: 3532107 - DNA, 17 bp, Homo sapiens
aggttactttggactga

SEQ ID NO: 3532108 - DNA, 17 bp, Homo sapiens
agtaacgttttccttgt

SEQ ID NO: 3532109 - DNA, 21 bp, Homo sapiens
agtaatttgggaaaagaagct

SEQ ID NO: 3532110 - DNA, 16 bp, Homo sapiens
agtagcagaaatatat

SEQ ID NO: 3532111 - DNA, 19 bp, Homo sapiens
agtatctcaacaacatgtc

SEQ ID NO: 3532112 - DNA, 16 bp, Homo sapiens
agtatttcatgtaata

SEQ ID NO: 3532113 - DNA, 23 bp, Homo sapiens
agtattttttttgcttttatgac

SEQ ID NO: 3532114 - DNA, 20 bp, Homo sapiens
agtcagaactataacattca

SEQ ID NO: 3532115 - DNA, 17 bp, Homo sapiens
agtcagagtataatttt

SEQ ID NO: 3532116 - DNA, 20 bp, Homo sapiens
agtcaggctgttggcgtgtc

SEQ ID NO: 3532117 - DNA, 20 bp, Homo sapiens
agtccaccctttggagacca

SEQ ID NO: 3532118 - DNA, 14 bp, Homo sapiens
agtcctgggaggat

SEQ ID NO: 3532119 - DNA, 15 bp, Homo sapiens
agtctcaggaggagg

SEQ ID NO: 3532120 - DNA, 18 bp, Homo sapiens
agtctccccttgcagcct

SEQ ID NO: 3532121 - DNA, 20 bp, Homo sapiens
agtctgaatctcccaaggag

SEQ ID NO: 3532122 - DNA, 14 bp, Homo sapiens
agtctggagtgaac

SEQ ID NO: 3532123 - DNA, 21 bp, Homo sapiens
agtctgttttcccaacctcct

SEQ ID NO: 3532124 - DNA, 18 bp, Homo sapiens
agtgaacaactggaaata

SEQ ID NO: 3532125 - DNA, 13 bp, Homo sapiens
agtgagaggggag

SEQ ID NO: 3532126 - DNA, 18 bp, Homo sapiens
agtgagaggggagggagg

SEQ ID NO: 3532127 - DNA, 22 bp, Homo sapiens
agtgctctgaccctgggctttc

SEQ ID NO: 3532128 - DNA, 18 bp, Homo sapiens
agtgctgctctaggccca

SEQ ID NO: 3532129 - DNA, 20 bp, Homo sapiens
agtggccacgttcagggagg

SEQ ID NO: 3532130 - DNA, 21 bp, Homo sapiens
agtggccacgttcagggaggg

SEQ ID NO: 3532131 - DNA, 16 bp, Homo sapiens
agtgtcacttggtgca

SEQ ID NO: 3532132 - DNA, 17 bp, Homo sapiens
agtgtgaccagttttga

SEQ ID NO: 3532133 - DNA, 12 bp, Homo sapiens
agtgtgtaatga

SEQ ID NO: 3532134 - DNA, 15 bp, Homo sapiens
agtgtgtataaatcc

SEQ ID NO: 3532135 - DNA, 22 bp, Homo sapiens
agttacacctccactcagcact

SEQ ID NO: 3532136 - DNA, 13 bp, Homo sapiens
agttacatttatg

SEQ ID NO: 3532137 - DNA, 14 bp, Homo sapiens
agttcccctatgtg

SEQ ID NO: 3532138 - DNA, 19 bp, Homo sapiens
agttgttgaatgactgacc

SEQ ID NO: 3532139 - DNA, 14 bp, Homo sapiens
agtttctgagtttt

SEQ ID NO: 3532140 - DNA, 20 bp, Homo sapiens
agtttgggttctctgctgtc

SEQ ID NO: 3532141 - DNA, 15 bp, Homo sapiens
agtttttattttaaa

SEQ ID NO: 3532142 - DNA, 20 bp, Homo sapiens
agtttttattttaaacattt

SEQ ID NO: 3532143 - DNA, 15 bp, Homo sapiens
ataaaagagctttat

SEQ ID NO: 3532144 - DNA, 20 bp, Homo sapiens
ataaagtaggaaagaatttg

SEQ ID NO: 3532145 - DNA, 19 bp, Homo sapiens
ataaagtagtttgatctaa

SEQ ID NO: 3532146 - DNA, 19 bp, Homo sapiens
ataaatatacttctgctgt

SEQ ID NO: 3532147 - DNA, 19 bp, Homo sapiens
ataaattactaattatctt

SEQ ID NO: 3532148 - DNA, 15 bp, Homo sapiens
ataacatatttattg

SEQ ID NO: 3532149 - DNA, 17 bp, Homo sapiens
ataacattcaatttgct

SEQ ID NO: 3532150 - DNA, 21 bp, Homo sapiens
ataacttacctctgcttctga

SEQ ID NO: 3532151 - DNA, 20 bp, Homo sapiens
ataagtgtgaccagttttga

SEQ ID NO: 3532152 - DNA, 21 bp, Homo sapiens
ataagtgtgaccagttttgat

SEQ ID NO: 3532153 - DNA, 12 bp, Homo sapiens
ataatggactct

SEQ ID NO: 3532154 - DNA, 17 bp, Homo sapiens
atacaataaaagagctt

SEQ ID NO: 3532155 - DNA, 15 bp, Homo sapiens
ataccatgacatgaa

SEQ ID NO: 3532156 - DNA, 23 bp, Homo sapiens
atactcctgttagtagcagaaat

SEQ ID NO: 3532157 - DNA, 21 bp, Homo sapiens
atactttttccccaaaggcat

SEQ ID NO: 3532158 - DNA, 18 bp, Homo sapiens
atagcatacaccaaacat

SEQ ID NO: 3532159 - DNA, 19 bp, Homo sapiens
atagcatacaccaaacatt

SEQ ID NO: 3532160 - DNA, 20 bp, Homo sapiens
atagcatacaccaaacattt

SEQ ID NO: 3532161 - DNA, 22 bp, Homo sapiens
atataaaatttcagggaaaaca

SEQ ID NO: 3532162 - DNA, 22 bp, Homo sapiens
atatacttctgctgtgggaaaa

SEQ ID NO: 3532163 - DNA, 15 bp, Homo sapiens
atatgaggggaccca

SEQ ID NO: 3532164 - DNA, 18 bp, Homo sapiens
atatgtgtatctcaaatt

SEQ ID NO: 3532165 - DNA, 14 bp, Homo sapiens
atatgttttattca

SEQ ID NO: 3532166 - DNA, 19 bp, Homo sapiens
atatttattgtgcattaaa

SEQ ID NO: 3532167 - DNA, 19 bp, Homo sapiens
atatttatttatgctaata

SEQ ID NO: 3532168 - DNA, 21 bp, Homo sapiens
atcaaggagtcttctaatgta

SEQ ID NO: 3532169 - DNA, 21 bp, Homo sapiens
atcacagagccactcttcaag

SEQ ID NO: 3532170 - DNA, 17 bp, Homo sapiens
atcagtggtgttacatt

SEQ ID NO: 3532171 - DNA, 23 bp, Homo sapiens
atcagttcttagattcaggggaa

SEQ ID NO: 3532172 - DNA, 23 bp, Homo sapiens
atcataagatagttacatttatg

SEQ ID NO: 3532173 - DNA, 16 bp, Homo sapiens
aaaacacaaaatgaat

SEQ ID NO: 3532174 - DNA, 19 bp, Homo sapiens
aaaacccgagggacagcag

SEQ ID NO: 3532175 - DNA, 19 bp, Homo sapiens
aaaagtgagagtagtcaga

SEQ ID NO: 3532176 - DNA, 23 bp, Homo sapiens
aaaataagaaagaattgcagtaa

SEQ ID NO: 3532177 - DNA, 22 bp, Homo sapiens
aaaatcaaggagtcttctaatg

SEQ ID NO: 3532178 - DNA, 17 bp, Homo sapiens
aaaattaaataaatttt

SEQ ID NO: 3532179 - DNA, 18 bp, Homo sapiens
aaaattaaataaatttta

SEQ ID NO: 3532180 - DNA, 16 bp, Homo sapiens
aaaattaaatactttt

SEQ ID NO: 3532181 - DNA, 17 bp, Homo sapiens
aaacacaaaatgaataa

SEQ ID NO: 3532182 - DNA, 11 bp, Homo sapiens
aaaccttgggc

SEQ ID NO: 3532183 - DNA, 16 bp, Homo sapiens
aaaccttgggccctgg

SEQ ID NO: 3532184 - DNA, 22 bp, Homo sapiens
aaaccttgggccctggaagagt

SEQ ID NO: 3532185 - DNA, 12 bp, Homo sapiens
aaactatttcag

SEQ ID NO: 3532186 - DNA, 22 bp, Homo sapiens
aaactatttcagaatattttgt

SEQ ID NO: 3532187 - DNA, 16 bp, Homo sapiens
aaacttgcacatttga

SEQ ID NO: 3532188 - DNA, 18 bp, Homo sapiens
aaagaattgcagtaaagt

SEQ ID NO: 3532189 - DNA, 14 bp, Homo sapiens
aaagacaaaatgtg

SEQ ID NO: 3532190 - DNA, 17 bp, Homo sapiens
aaagacaaaatgtgacc

SEQ ID NO: 3532191 - DNA, 13 bp, Homo sapiens
aaagacaaatgtg

SEQ ID NO: 3532192 - DNA, 14 bp, Homo sapiens
aaagacaaatgtgc

SEQ ID NO: 3532193 - DNA, 15 bp, Homo sapiens
aaagacaaatgtgct

SEQ ID NO: 3532194 - DNA, 21 bp, Homo sapiens
aaagacaaatgtgctctatgt

SEQ ID NO: 3532195 - DNA, 13 bp, Homo sapiens
aaagatgggagga

SEQ ID NO: 3532196 - DNA, 13 bp, Homo sapiens
aaagcatgaatat

SEQ ID NO: 3532197 - DNA, 19 bp, Homo sapiens
aaagcatgaatatttctta

SEQ ID NO: 3532198 - DNA, 22 bp, Homo sapiens
aaaggcatgcagtcatgagaat

SEQ ID NO: 3532199 - DNA, 20 bp, Homo sapiens
aaagtggtctgaactgcttg

SEQ ID NO: 3532200 - DNA, 19 bp, Homo sapiens
aaagttacgcttttctaag

SEQ ID NO: 3532201 - DNA, 13 bp, Homo sapiens
aaataaattttaa

SEQ ID NO: 3532202 - DNA, 15 bp, Homo sapiens
aaataagacttctgg

SEQ ID NO: 3532203 - DNA, 23 bp, Homo sapiens
aaatagcatacaccaaacatttc

SEQ ID NO: 3532204 - DNA, 15 bp, Homo sapiens
aaatatattatgaaa

SEQ ID NO: 3532205 - DNA, 16 bp, Homo sapiens
aaatatattatgaaaa

SEQ ID NO: 3532206 - DNA, 12 bp, Homo sapiens
aaatatgtgtat

SEQ ID NO: 3532207 - DNA, 22 bp, Homo sapiens
aaatcactgtggggaaacaatt

SEQ ID NO: 3532208 - DNA, 21 bp, Homo sapiens
aaatcagtggtgttacatttt

SEQ ID NO: 3532209 - DNA, 18 bp, Homo sapiens
aaatctgctgatctctgt

SEQ ID NO: 3532210 - DNA, 23 bp, Homo sapiens
aaatctgctgatctctgtagaat

SEQ ID NO: 3532211 - DNA, 17 bp, Homo sapiens
aaatctttgtgaacatt

SEQ ID NO: 3532212 - DNA, 13 bp, Homo sapiens
aaattaaatactt

SEQ ID NO: 3532213 - DNA, 15 bp, Homo sapiens
aaattactaattatc

SEQ ID NO: 3532214 - DNA, 18 bp, Homo sapiens
aaattcaatgcttgatgt

SEQ ID NO: 3532215 - DNA, 21 bp, Homo sapiens
aaattttaatgttaactttca

SEQ ID NO: 3532216 - DNA, 16 bp, Homo sapiens
aacaactggaaataaa

SEQ ID NO: 3532217 - DNA, 19 bp, Homo sapiens
aacaactggaaataaagta

SEQ ID NO: 3532218 - DNA, 14 bp, Homo sapiens
aacacaaaatgaat

SEQ ID NO: 3532219 - DNA, 16 bp, Homo sapiens
aacactatttctggaa

SEQ ID NO: 3532220 - DNA, 20 bp, Homo sapiens
aacatgaaacaactcatgtc

SEQ ID NO: 3532221 - DNA, 15 bp, Homo sapiens
aacattcaatttgct

SEQ ID NO: 3532222 - DNA, 15 bp, Homo sapiens
aacatttaaaattaa

SEQ ID NO: 3532223 - DNA, 19 bp, Homo sapiens
aaccacggtgaaagtgctg

SEQ ID NO: 3532224 - DNA, 22 bp, Homo sapiens
aaccacggtgaaagtgctgctc

SEQ ID NO: 3532225 - DNA, 14 bp, Homo sapiens
aacccatagggagc

SEQ ID NO: 3532226 - DNA, 17 bp, Homo sapiens
aacctggagatggtgga

SEQ ID NO: 3532227 - DNA, 22 bp, Homo sapiens
aacgaggatttccctgaagcta

SEQ ID NO: 3532228 - DNA, 15 bp, Homo sapiens
aacggtctttatgaa

SEQ ID NO: 3532229 - DNA, 19 bp, Homo sapiens
aacggtctttatgaattat

SEQ ID NO: 3532230 - DNA, 20 bp, Homo sapiens
aacggtctttatgaattatt

SEQ ID NO: 3532231 - DNA, 14 bp, Homo sapiens
aactataacattca

SEQ ID NO: 3532232 - DNA, 18 bp, Homo sapiens
aactcttagactgagtaa

SEQ ID NO: 3532233 - DNA, 19 bp, Homo sapiens
aactggagaccagaaacct

SEQ ID NO: 3532234 - DNA, 20 bp, Homo sapiens
aacttacctctgcttctgac

SEQ ID NO: 3532235 - DNA, 22 bp, Homo sapiens
aacttatgaagtaaagtttctg

SEQ ID NO: 3532236 - DNA, 24 bp, Homo sapiens
aacttatgaagtaaagtttctgat

SEQ ID NO: 3532237 - DNA, 20 bp, Homo sapiens
aacttgcacatttgaattca

SEQ ID NO: 3532238 - DNA, 22 bp, Homo sapiens
aagaacatttaaaattaaataa

SEQ ID NO: 3532239 - DNA, 17 bp, Homo sapiens
aagaagctgtcagaagt

SEQ ID NO: 3532240 - DNA, 21 bp, Homo sapiens
aagaataatggactcttaagg

SEQ ID NO: 3532241 - DNA, 20 bp, Homo sapiens
aagaatgttttggcaagagc

SEQ ID NO: 3532242 - DNA, 15 bp, Homo sapiens
aagaattgcagtaaa

SEQ ID NO: 3532243 - DNA, 14 bp, Homo sapiens
aagacaaaatgtga

SEQ ID NO: 3532244 - DNA, 13 bp, Homo sapiens
aagacaaatgtgc

SEQ ID NO: 3532245 - DNA, 18 bp, Homo sapiens
aagacttctggtgctgct

SEQ ID NO: 3532246 - DNA, 20 bp, Homo sapiens
aagacttctggtgctgctgg

SEQ ID NO: 3532247 - DNA, 21 bp, Homo sapiens
aagacttctggtgctgctggg

SEQ ID NO: 3532248 - DNA, 14 bp, Homo sapiens
aagagaatttcaag

SEQ ID NO: 3532249 - DNA, 20 bp, Homo sapiens
aagatagttacatttatgtg

SEQ ID NO: 3532250 - DNA, 24 bp, Homo sapiens
aagatagttacatttatgtgctgt

SEQ ID NO: 3532251 - DNA, 18 bp, Homo sapiens
aagatcttatttattaac

SEQ ID NO: 3532252 - DNA, 16 bp, Homo sapiens
aagatgtttggacacc

SEQ ID NO: 3532253 - DNA, 19 bp, Homo sapiens
aagcagccaggagggacct

SEQ ID NO: 3532254 - DNA, 22 bp, Homo sapiens
aagcagtggggtaggctgctgc

SEQ ID NO: 3532255 - DNA, 14 bp, Homo sapiens
aagcatgaatattt

SEQ ID NO: 3532256 - DNA, 21 bp, Homo sapiens
aagccagctgcccccagagcc

SEQ ID NO: 3532257 - DNA, 22 bp, Homo sapiens
aagccctggtgaccagaccaag

SEQ ID NO: 3532258 - DNA, 20 bp, Homo sapiens
aagccttgattggtgttgcc

SEQ ID NO: 3532259 - DNA, 19 bp, Homo sapiens
aagctataacatatttatt

SEQ ID NO: 3532260 - DNA, 16 bp, Homo sapiens
aagctgaaaatgtgta

SEQ ID NO: 3532261 - DNA, 14 bp, Homo sapiens
aagctgtcagaagt

SEQ ID NO: 3532262 - DNA, 16 bp, Homo sapiens
aagctgtcagaagttt

SEQ ID NO: 3532263 - DNA, 14 bp, Homo sapiens
aaggacactggatc

SEQ ID NO: 3532264 - DNA, 15 bp, Homo sapiens
aaggacactggatca

SEQ ID NO: 3532265 - DNA, 21 bp, Homo sapiens
aaggagtcttctaatgtaaat

SEQ ID NO: 3532266 - DNA, 14 bp, Homo sapiens
aaggattttgcagt

SEQ ID NO: 3532267 - DNA, 15 bp, Homo sapiens
aaggattttgcagtt

SEQ ID NO: 3532268 - DNA, 17 bp, Homo sapiens
aagggtagaaacctgcc

SEQ ID NO: 3532269 - DNA, 22 bp, Homo sapiens
aaggtgaaacattttctccctg

SEQ ID NO: 3532270 - DNA, 22 bp, Homo sapiens
aaggtgggaggatgtgaattgt

SEQ ID NO: 3532271 - DNA, 14 bp, Homo sapiens
aagtaaagtttctg

SEQ ID NO: 3532272 - DNA, 14 bp, Homo sapiens
aagtaggaaagaat

SEQ ID NO: 3532273 - DNA, 16 bp, Homo sapiens
aagtaggaaagaattt

SEQ ID NO: 3532274 - DNA, 19 bp, Homo sapiens
aagtatctcaacaacatgt

SEQ ID NO: 3532275 - DNA, 13 bp, Homo sapiens
aagtatttcatgt

SEQ ID NO: 3532276 - DNA, 13 bp, Homo sapiens
aagtcatttcaaa

SEQ ID NO: 3532277 - DNA, 16 bp, Homo sapiens
aagtgagaccttcctt

SEQ ID NO: 3532278 - DNA, 13 bp, Homo sapiens
aagtgagagggga

SEQ ID NO: 3532279 - DNA, 23 bp, Homo sapiens
aagtggggcgggcttcatagaga

SEQ ID NO: 3532280 - DNA, 15 bp, Homo sapiens
aagtgtattgtaatg

SEQ ID NO: 3532281 - DNA, 14 bp, Homo sapiens
aagtgtgaccagtt

SEQ ID NO: 3532282 - DNA, 13 bp, Homo sapiens
aataaaagagctt

SEQ ID NO: 3532283 - DNA, 18 bp, Homo sapiens
aataaaagagctttatcc

SEQ ID NO: 3532284 - DNA, 17 bp, Homo sapiens
aataaagtaggaaagaa

SEQ ID NO: 3532285 - DNA, 18 bp, Homo sapiens
aataaagtaggaaagaat

SEQ ID NO: 3532286 - DNA, 17 bp, Homo sapiens
aataagaaagaattgca

SEQ ID NO: 3532287 - DNA, 14 bp, Homo sapiens
aataagacttctgg

SEQ ID NO: 3532288 - DNA, 21 bp, Homo sapiens
aataccctagaagaaaacccg

SEQ ID NO: 3532289 - DNA, 16 bp, Homo sapiens
aatatacttctgctgt

SEQ ID NO: 3532290 - DNA, 21 bp, Homo sapiens
aatatacttctgctgtgggaa

SEQ ID NO: 3532291 - DNA, 20 bp, Homo sapiens
aatatgttgatttttatcag

SEQ ID NO: 3532292 - DNA, 17 bp, Homo sapiens
aatcagacatgagtcca

SEQ ID NO: 3532293 - DNA, 21 bp, Homo sapiens
aatcagtggtgttacattttc

SEQ ID NO: 3532294 - DNA, 19 bp, Homo sapiens
aatcctctgggagcttctt

SEQ ID NO: 3532295 - DNA, 20 bp, Homo sapiens
aatctgaaaaatggccatgt

SEQ ID NO: 3532296 - DNA, 17 bp, Homo sapiens
aatctgctgatctctgt

SEQ ID NO: 3532297 - DNA, 16 bp, Homo sapiens
aatctttgtgaacatt

SEQ ID NO: 3532298 - DNA, 19 bp, Homo sapiens
aatgaacccatagggagct

SEQ ID NO: 3532299 - DNA, 16 bp, Homo sapiens
aatgaagctaatgtga

SEQ ID NO: 3532300 - DNA, 21 bp, Homo sapiens
aatgaagtatttcatgtaata

SEQ ID NO: 3532301 - DNA, 13 bp, Homo sapiens
aatgactgaccca

SEQ ID NO: 3532302 - DNA, 21 bp, Homo sapiens
aatgactgacccaaaatgtga

SEQ ID NO: 3532303 - DNA, 13 bp, Homo sapiens
aatgactgagatt

SEQ ID NO: 3532304 - DNA, 14 bp, Homo sapiens
aatgcatacaataa

SEQ ID NO: 3532305 - DNA, 19 bp, Homo sapiens
aatgcatacaataaaagag

SEQ ID NO: 3532306 - DNA, 20 bp, Homo sapiens
aatgcatacaataaaagagc

SEQ ID NO: 3532307 - DNA, 12 bp, Homo sapiens
aatgctgagcca

SEQ ID NO: 3532308 - DNA, 11 bp, Homo sapiens
aatgcttctgc

SEQ ID NO: 3532309 - DNA, 15 bp, Homo sapiens
aatggactggccagc

SEQ ID NO: 3532310 - DNA, 12 bp, Homo sapiens
aatgtaaatttt

SEQ ID NO: 3532311 - DNA, 16 bp, Homo sapiens
aattaaaaacagaaaa

SEQ ID NO: 3532312 - DNA, 15 bp, Homo sapiens
aattaaataaatttt

SEQ ID NO: 3532313 - DNA, 11 bp, Homo sapiens
aattaaatttt

SEQ ID NO: 3532314 - DNA, 15 bp, Homo sapiens
aattacagaaaattt

SEQ ID NO: 3532315 - DNA, 18 bp, Homo sapiens
aattatcttatctactga

SEQ ID NO: 3532316 - DNA, 13 bp, Homo sapiens
aattcatttgctg

SEQ ID NO: 3532317 - DNA, 15 bp, Homo sapiens
aatttgcaacatata

SEQ ID NO: 3532318 - DNA, 21 bp, Homo sapiens
aatttgtatcatgttttacta

SEQ ID NO: 3532319 - DNA, 16 bp, Homo sapiens
aattttaatgttaact

SEQ ID NO: 3532320 - DNA, 20 bp, Homo sapiens
aattttggttgtaattaaat

SEQ ID NO: 3532321 - DNA, 22 bp, Homo sapiens
aatttttgatgcccagacagca

SEQ ID NO: 3532322 - DNA, 16 bp, Homo sapiens
acaaactatttcagaa

SEQ ID NO: 3532323 - DNA, 21 bp, Homo sapiens
acaaactatttcagaatattt

SEQ ID NO: 3532324 - DNA, 19 bp, Homo sapiens
acaaatgaagtatttcatg

SEQ ID NO: 3532325 - DNA, 21 bp, Homo sapiens
acaaatgaagtatttcatgta

SEQ ID NO: 3532326 - DNA, 22 bp, Homo sapiens
acaaatgaagtatttcatgtaa

SEQ ID NO: 3532327 - DNA, 17 bp, Homo sapiens
acaaatgtgctctatgt

SEQ ID NO: 3532328 - DNA, 19 bp, Homo sapiens
acaactcagaatgggggct

SEQ ID NO: 3532329 - DNA, 13 bp, Homo sapiens
acaactggaaata

SEQ ID NO: 3532330 - DNA, 15 bp, Homo sapiens
acaactggaaataaa

SEQ ID NO: 3532331 - DNA, 18 bp, Homo sapiens
acaattttttgtgatgaa

SEQ ID NO: 3532332 - DNA, 18 bp, Homo sapiens
acacagtgaaaggcctgc

SEQ ID NO: 3532333 - DNA, 13 bp, Homo sapiens
acaccaaacattt

SEQ ID NO: 3532334 - DNA, 22 bp, Homo sapiens
acacccacacaggtggccatca

SEQ ID NO: 3532335 - DNA, 16 bp, Homo sapiens
acacctccactcagca

SEQ ID NO: 3532336 - DNA, 20 bp, Homo sapiens
acactctcttgggccagccc

SEQ ID NO: 3532337 - DNA, 20 bp, Homo sapiens
acactgagaaatagtgcact

SEQ ID NO: 3532338 - DNA, 21 bp, Homo sapiens
acactgagaaatagtgcactc

SEQ ID NO: 3532339 - DNA, 21 bp, Homo sapiens
acactggatcaagttcagcca

SEQ ID NO: 3532340 - DNA, 12 bp, Homo sapiens
acacttttgagg

SEQ ID NO: 3532341 - DNA, 20 bp, Homo sapiens
acacttttgaggacaagtta

SEQ ID NO: 3532342 - DNA, 16 bp, Homo sapiens
acagaaatctgaaaaa

SEQ ID NO: 3532343 - DNA, 16 bp, Homo sapiens
acagagactctccctg

SEQ ID NO: 3532344 - DNA, 15 bp, Homo sapiens
acagcagattccaca

SEQ ID NO: 3532345 - DNA, 15 bp, Homo sapiens
acagcccttttgtct

SEQ ID NO: 3532346 - DNA, 17 bp, Homo sapiens
acagtgaaaggcctgct

SEQ ID NO: 3532347 - DNA, 18 bp, Homo sapiens
acagttcccctatgtgga

SEQ ID NO: 3532348 - DNA, 20 bp, Homo sapiens
acagttcccctatgtggaag

SEQ ID NO: 3532349 - DNA, 13 bp, Homo sapiens
acatatttattgt

SEQ ID NO: 3532350 - DNA, 23 bp, Homo sapiens
acatcataagatagttacattta

SEQ ID NO: 3532351 - DNA, 14 bp, Homo sapiens
acatgactgcaact

SEQ ID NO: 3532352 - DNA, 21 bp, Homo sapiens
acatgccctcggtcactgagt

SEQ ID NO: 3532353 - DNA, 23 bp, Homo sapiens
acatgccctcggtcactgagtct

SEQ ID NO: 3532354 - DNA, 22 bp, Homo sapiens
acatgtcaaagctgcatgtgta

SEQ ID NO: 3532355 - DNA, 14 bp, Homo sapiens
acattctgtactgg

SEQ ID NO: 3532356 - DNA, 15 bp, Homo sapiens
acatttatgtgctgt

SEQ ID NO: 3532357 - DNA, 16 bp, Homo sapiens
acatttgaattcattt

SEQ ID NO: 3532358 - DNA, 14 bp, Homo sapiens
acattttcttgtcc

SEQ ID NO: 3532359 - DNA, 14 bp, Homo sapiens
accaaggcagggcc

SEQ ID NO: 3532360 - DNA, 14 bp, Homo sapiens
accaatctgtgaga

SEQ ID NO: 3532361 - DNA, 12 bp, Homo sapiens
accaccaagcct

SEQ ID NO: 3532362 - DNA, 20 bp, Homo sapiens
accacccctaaagtgccagg

SEQ ID NO: 3532363 - DNA, 18 bp, Homo sapiens
accacggtgaaagtgctg

SEQ ID NO: 3532364 - DNA, 19 bp, Homo sapiens
accacggtgaaagtgctgc

SEQ ID NO: 3532365 - DNA, 12 bp, Homo sapiens
accagttttgat

SEQ ID NO: 3532366 - DNA, 17 bp, Homo sapiens
accagttttgatattta

SEQ ID NO: 3532367 - DNA, 19 bp, Homo sapiens
accatcgtcttcttggcca

SEQ ID NO: 3532368 - DNA, 18 bp, Homo sapiens
accatcttacagagactc

SEQ ID NO: 3532369 - DNA, 20 bp, Homo sapiens
acccagatgttttatttatg

SEQ ID NO: 3532370 - DNA, 21 bp, Homo sapiens
acccagatgttttatttatga

SEQ ID NO: 3532371 - DNA, 22 bp, Homo sapiens
acccagatgttttatttatgaa

SEQ ID NO: 3532372 - DNA, 15 bp, Homo sapiens
acccattttggtgca

SEQ ID NO: 3532373 - DNA, 13 bp, Homo sapiens
acccccgcagagg

SEQ ID NO: 3532374 - DNA, 19 bp, Homo sapiens
acccctaaagtgccaggtg

SEQ ID NO: 3532375 - DNA, 15 bp, Homo sapiens
accctagaagaaaac

SEQ ID NO: 3532376 - DNA, 19 bp, Homo sapiens
accctatggccactggccg

SEQ ID NO: 3532377 - DNA, 15 bp, Homo sapiens
accctcccggcctgg

SEQ ID NO: 3532378 - DNA, 16 bp, Homo sapiens
accctgccctcatggg

SEQ ID NO: 3532379 - DNA, 16 bp, Homo sapiens
acccttctccaaaggc

SEQ ID NO: 3532380 - DNA, 14 bp, Homo sapiens
accgtggggaaggg

SEQ ID NO: 3532381 - DNA, 17 bp, Homo sapiens
acctcatgaggaccagg

SEQ ID NO: 3532382 - DNA, 19 bp, Homo sapiens
acctccactcagcactctg

SEQ ID NO: 3532383 - DNA, 20 bp, Homo sapiens
acctccactcagcactctgg

SEQ ID NO: 3532384 - DNA, 19 bp, Homo sapiens
acctccactctctgcccct

SEQ ID NO: 3532385 - DNA, 21 bp, Homo sapiens
acctcttccgttggaaagaac

SEQ ID NO: 3532386 - DNA, 21 bp, Homo sapiens
acctgggttatttattgacac

SEQ ID NO: 3532387 - DNA, 15 bp, Homo sapiens
accttaactggagac

SEQ ID NO: 3532388 - DNA, 20 bp, Homo sapiens
accttagaccaccaagcctt

SEQ ID NO: 3532389 - DNA, 22 bp, Homo sapiens
accttagaccaccaagccttga

SEQ ID NO: 3532390 - DNA, 13 bp, Homo sapiens
accttccttttac

SEQ ID NO: 3532391 - DNA, 20 bp, Homo sapiens
accttccttttacttttctt

SEQ ID NO: 3532392 - DNA, 21 bp, Homo sapiens
accttccttttacttttcttc

SEQ ID NO: 3532393 - DNA, 12 bp, Homo sapiens
accttgggacca

SEQ ID NO: 3532394 - DNA, 15 bp, Homo sapiens
accttgggaccaaag

SEQ ID NO: 3532395 - DNA, 20 bp, Homo sapiens
acctttctccctccttcctt

SEQ ID NO: 3532396 - DNA, 15 bp, Homo sapiens
acgaaggctgcccct

SEQ ID NO: 3532397 - DNA, 12 bp, Homo sapiens
acgccacagccc

SEQ ID NO: 3532398 - DNA, 13 bp, Homo sapiens
acgttcagggagg

SEQ ID NO: 3532399 - DNA, 16 bp, Homo sapiens
acgttcagggaggggc

SEQ ID NO: 3532400 - DNA, 11 bp, Homo sapiens
actagaaaccc

SEQ ID NO: 3532401 - DNA, 14 bp, Homo sapiens
actagagaaagaca

SEQ ID NO: 3532402 - DNA, 13 bp, Homo sapiens
actagcccaggac

SEQ ID NO: 3532403 - DNA, 14 bp, Homo sapiens
actataacattcaa

SEQ ID NO: 3532404 - DNA, 17 bp, Homo sapiens
actataacattcaattt

SEQ ID NO: 3532405 - DNA, 19 bp, Homo sapiens
actatccttctctttcaat

SEQ ID NO: 3532406 - DNA, 22 bp, Homo sapiens
actatccttctctttcaatgtg

SEQ ID NO: 3532407 - DNA, 16 bp, Homo sapiens
actatttcagaatatt

SEQ ID NO: 3532408 - DNA, 20 bp, Homo sapiens
actatttcagaatattttgt

SEQ ID NO: 3532409 - DNA, 21 bp, Homo sapiens
actatttcagaatattttgta

SEQ ID NO: 3532410 - DNA, 18 bp, Homo sapiens
actcagcactctggactc

SEQ ID NO: 3532411 - DNA, 15 bp, Homo sapiens
actcagcagaggcag

SEQ ID NO: 3532412 - DNA, 18 bp, Homo sapiens
actcagcagaggcagtgg

SEQ ID NO: 3532413 - DNA, 19 bp, Homo sapiens
actcataaaggacactgga

SEQ ID NO: 3532414 - DNA, 22 bp, Homo sapiens
actcataaaggacactggatca

SEQ ID NO: 3532415 - DNA, 23 bp, Homo sapiens
actccgaaagtctgaatctccca

SEQ ID NO: 3532416 - DNA, 17 bp, Homo sapiens
actctccagcagttagg

SEQ ID NO: 3532417 - DNA, 13 bp, Homo sapiens
actctggactcca

SEQ ID NO: 3532418 - DNA, 16 bp, Homo sapiens
actctggactccacga

SEQ ID NO: 3532419 - DNA, 23 bp, Homo sapiens
actcttaaggcattgagggctct

SEQ ID NO: 3532420 - DNA, 16 bp, Homo sapiens
actcttcaagtagatt

SEQ ID NO: 3532421 - DNA, 18 bp, Homo sapiens
actgaaaaaatgctgagc

SEQ ID NO: 3532422 - DNA, 21 bp, Homo sapiens
actgaaaaaatgctgagccag

SEQ ID NO: 3532423 - DNA, 13 bp, Homo sapiens
actgacttgctca

SEQ ID NO: 3532424 - DNA, 17 bp, Homo sapiens
actgagatttgtaaatc

SEQ ID NO: 3532425 - DNA, 15 bp, Homo sapiens
actgagtaaagtgtt

SEQ ID NO: 3532426 - DNA, 22 bp, Homo sapiens
actgagtttgggttctctgctg

SEQ ID NO: 3532427 - DNA, 14 bp, Homo sapiens
actgcagcagaaaa

SEQ ID NO: 3532428 - DNA, 16 bp, Homo sapiens
actgcagcagaaaaca

SEQ ID NO: 3532429 - DNA, 12 bp, Homo sapiens
actgccaagcca

SEQ ID NO: 3532430 - DNA, 16 bp, Homo sapiens
actggagctgggaggt

SEQ ID NO: 3532431 - DNA, 21 bp, Homo sapiens
acttaaacttgcacatttgaa

SEQ ID NO: 3532432 - DNA, 16 bp, Homo sapiens
acttaatatgttttat

SEQ ID NO: 3532433 - DNA, 16 bp, Homo sapiens
acttacctctgcttct

SEQ ID NO: 3532434 - DNA, 11 bp, Homo sapiens
acttcccaagc

SEQ ID NO: 3532435 - DNA, 15 bp, Homo sapiens
acttctggtgctgct

SEQ ID NO: 3532436 - DNA, 11 bp, Homo sapiens
acttgagcctg

SEQ ID NO: 3532437 - DNA, 16 bp, Homo sapiens
acttgaggcacaaatc

SEQ ID NO: 3532438 - DNA, 23 bp, Homo sapiens
acttgcacatttgaattcatttg

SEQ ID NO: 3532439 - DNA, 19 bp, Homo sapiens
acttggtgcataagcacag

SEQ ID NO: 3532440 - DNA, 14 bp, Homo sapiens
actttggactgagt

SEQ ID NO: 3532441 - DNA, 12 bp, Homo sapiens
acttttcttcta

SEQ ID NO: 3532442 - DNA, 15 bp, Homo sapiens
agaaaagacaaatgt

SEQ ID NO: 3532443 - DNA, 21 bp, Homo sapiens
agaaaatttgcaacatataaa

SEQ ID NO: 3532444 - DNA, 22 bp, Homo sapiens
agaaaatttgcaacatataaag

SEQ ID NO: 3532445 - DNA, 18 bp, Homo sapiens
agaaatatattatgaaaa

SEQ ID NO: 3532446 - DNA, 22 bp, Homo sapiens
agaacatttaaaattaaataaa

SEQ ID NO: 3532447 - DNA, 14 bp, Homo sapiens
agaactagaaaccc

SEQ ID NO: 3532448 - DNA, 17 bp, Homo sapiens
agaactataacattcaa

SEQ ID NO: 3532449 - DNA, 19 bp, Homo sapiens
agaactataacattcaatt

SEQ ID NO: 3532450 - DNA, 22 bp, Homo sapiens
agaactataacattcaatttgc

SEQ ID NO: 3532451 - DNA, 14 bp, Homo sapiens
agaaggtgggagga

SEQ ID NO: 3532452 - DNA, 23 bp, Homo sapiens
agaatatgttgatttttatcagg

SEQ ID NO: 3532453 - DNA, 18 bp, Homo sapiens
agaatgattttgctgact

SEQ ID NO: 3532454 - DNA, 23 bp, Homo sapiens
agaatgggggctttcggggaggg

SEQ ID NO: 3532455 - DNA, 15 bp, Homo sapiens
agaattacagaaaat

SEQ ID NO: 3532456 - DNA, 17 bp, Homo sapiens
agaattgcagtaaagtc

SEQ ID NO: 3532457 - DNA, 12 bp, Homo sapiens
agacaaatgtgc

SEQ ID NO: 3532458 - DNA, 19 bp, Homo sapiens
agacttctggtgctgctgg

SEQ ID NO: 3532459 - DNA, 15 bp, Homo sapiens
agagaaagacaaaat

SEQ ID NO: 3532460 - DNA, 19 bp, Homo sapiens
agagaaagacaaaatgtga

SEQ ID NO: 3532461 - DNA, 21 bp, Homo sapiens
agagaacacagggctgcatcc

SEQ ID NO: 3532462 - DNA, 21 bp, Homo sapiens
agagaagctttcaggggaagg

SEQ ID NO: 3532463 - DNA, 22 bp, Homo sapiens
agagcgggagggagtctcagga

SEQ ID NO: 3532464 - DNA, 16 bp, Homo sapiens
agagcgttactgtaga

SEQ ID NO: 3532465 - DNA, 23 bp, Homo sapiens
agagcttgggggtggggagaaaa

SEQ ID NO: 3532466 - DNA, 14 bp, Homo sapiens
agagtaatttggga

SEQ ID NO: 3532467 - DNA, 17 bp, Homo sapiens
agagtgctctgaccctg

SEQ ID NO: 3532468 - DNA, 18 bp, Homo sapiens
agagtgctctgaccctgg

SEQ ID NO: 3532469 - DNA, 19 bp, Homo sapiens
agagtgctctgaccctggg

SEQ ID NO: 3532470 - DNA, 15 bp, Homo sapiens
agatagttacattta

SEQ ID NO: 3532471 - DNA, 18 bp, Homo sapiens
agatagttacatttatgt

SEQ ID NO: 3532472 - DNA, 21 bp, Homo sapiens
agatccaagatgtttggacac

SEQ ID NO: 3532473 - DNA, 13 bp, Homo sapiens
agatgtccagggc

SEQ ID NO: 3532474 - DNA, 16 bp, Homo sapiens
agattcaggggaaggg

SEQ ID NO: 3532475 - DNA, 13 bp, Homo sapiens
agattctttgaga

SEQ ID NO: 3532476 - DNA, 13 bp, Homo sapiens
agatttttcatgt

SEQ ID NO: 3532477 - DNA, 13 bp, Homo sapiens
agcaaccctctga

SEQ ID NO: 3532478 - DNA, 20 bp, Homo sapiens
agcaaccctctgaagaaggg

SEQ ID NO: 3532479 - DNA, 15 bp, Homo sapiens
agcactctggactcc

SEQ ID NO: 3532480 - DNA, 14 bp, Homo sapiens
agcagagaggtggc

SEQ ID NO: 3532481 - DNA, 18 bp, Homo sapiens
agcagagaggtggccacc

SEQ ID NO: 3532482 - DNA, 13 bp, Homo sapiens
agcagccaggagg

SEQ ID NO: 3532483 - DNA, 21 bp, Homo sapiens
agcagtggggtaggctgctgc

SEQ ID NO: 3532484 - DNA, 23 bp, Homo sapiens
agcagttaggcaccttaactgga

SEQ ID NO: 3532485 - DNA, 22 bp, Homo sapiens
agcatacaccaaacatttctgt

SEQ ID NO: 3532486 - DNA, 16 bp, Homo sapiens
agcatcaggcctagag

SEQ ID NO: 3532487 - DNA, 21 bp, Homo sapiens
agcatcaggcctagaggcctg

SEQ ID NO: 3532488 - DNA, 17 bp, Homo sapiens
agccaatccctggccat

SEQ ID NO: 3532489 - DNA, 19 bp, Homo sapiens
agccagctgcccccagagc

SEQ ID NO: 3532490 - DNA, 12 bp, Homo sapiens
agccaggaggga

SEQ ID NO: 3532491 - DNA, 16 bp, Homo sapiens
agccaggagggacctg

SEQ ID NO: 3532492 - DNA, 19 bp, Homo sapiens
agccatctttggcaaaggt

SEQ ID NO: 3532493 - DNA, 20 bp, Homo sapiens
agcccaaaccttgggccctg

SEQ ID NO: 3532494 - DNA, 13 bp, Homo sapiens
agcccaagacacc

SEQ ID NO: 3532495 - DNA, 12 bp, Homo sapiens
agccccacaccc

SEQ ID NO: 3532496 - DNA, 13 bp, Homo sapiens
agccccacaccct

SEQ ID NO: 3532497 - DNA, 23 bp, Homo sapiens
agccctccccatctcggggctgc

SEQ ID NO: 3532498 - DNA, 22 bp, Homo sapiens
agcctgggtgtaaaacctggag

SEQ ID NO: 3532499 - DNA, 16 bp, Homo sapiens
agcctgtgaccttggg

SEQ ID NO: 3532500 - DNA, 22 bp, Homo sapiens
agcctgtgcccatatggtcatc

SEQ ID NO: 3532501 - DNA, 18 bp, Homo sapiens
agcgccggggggagggag

SEQ ID NO: 3532502 - DNA, 21 bp, Homo sapiens
agcgccggggggagggaggag

SEQ ID NO: 3532503 - DNA, 13 bp, Homo sapiens
agcgggagggagt

SEQ ID NO: 3532504 - DNA, 21 bp, Homo sapiens
agcgggagggagtctcaggag

SEQ ID NO: 3532505 - DNA, 13 bp, Homo sapiens
agctataacatat

SEQ ID NO: 3532506 - DNA, 19 bp, Homo sapiens
agctataacatatttattg

SEQ ID NO: 3532507 - DNA, 15 bp, Homo sapiens
agctatgtctctagc

SEQ ID NO: 3532508 - DNA, 16 bp, Homo sapiens
agctccatgttgcttc

SEQ ID NO: 3532509 - DNA, 22 bp, Homo sapiens
agctcggttaagtacccgaggc

SEQ ID NO: 3532510 - DNA, 17 bp, Homo sapiens
agctgagaagaggagga

SEQ ID NO: 3532511 - DNA, 18 bp, Homo sapiens
agctgagaagaggaggag

SEQ ID NO: 3532512 - DNA, 14 bp, Homo sapiens
agctgaggggacgg

SEQ ID NO: 3532513 - DNA, 19 bp, Homo sapiens
agctgaggggacgggcaag

SEQ ID NO: 3532514 - DNA, 20 bp, Homo sapiens
agctgcccccagagccacag

SEQ ID NO: 3532515 - DNA, 15 bp, Homo sapiens
agctggaggcgcagg

SEQ ID NO: 3532516 - DNA, 18 bp, Homo sapiens
agctgggcagtgccagcc

SEQ ID NO: 3532517 - DNA, 17 bp, Homo sapiens
agctgtcagaagtttct

SEQ ID NO: 3532518 - DNA, 17 bp, Homo sapiens
agctgtgcgtgtgtgtg

SEQ ID NO: 3532519 - DNA, 16 bp, Homo sapiens
agcttcttccgtttct

SEQ ID NO: 3532520 - DNA, 17 bp, Homo sapiens
aggaccagggtggagct

SEQ ID NO: 3532521 - DNA, 13 bp, Homo sapiens
aggagcagagagg

SEQ ID NO: 3532522 - DNA, 17 bp, Homo sapiens
aggagcagagaggtggc

SEQ ID NO: 3532523 - DNA, 11 bp, Homo sapiens
aggaggaggct

SEQ ID NO: 3532524 - DNA, 15 bp, Homo sapiens
aggaggctgccctga

SEQ ID NO: 3532525 - DNA, 22 bp, Homo sapiens
aggagggcactggagctgggag

SEQ ID NO: 3532526 - DNA, 14 bp, Homo sapiens
aggaggtgggggct

SEQ ID NO: 3532527 - DNA, 22 bp, Homo sapiens
aggaggtgggggctggaggtgc

SEQ ID NO: 3532528 - DNA, 22 bp, Homo sapiens
aggatgcattctgataggaggg

SEQ ID NO: 3532529 - DNA, 15 bp, Homo sapiens
aggatgtatgctgtt

SEQ ID NO: 3532530 - DNA, 14 bp, Homo sapiens
aggatgtgaattgt

SEQ ID NO: 3532531 - DNA, 19 bp, Homo sapiens
aggatttccctgaagctat

SEQ ID NO: 3532532 - DNA, 14 bp, Homo sapiens
aggcacaaatcact

SEQ ID NO: 3532533 - DNA, 15 bp, Homo sapiens
aggcagagcgggagg

SEQ ID NO: 3532534 - DNA, 15 bp, Homo sapiens
aggcccgcgggcaca

SEQ ID NO: 3532535 - DNA, 17 bp, Homo sapiens
aggcctgactgccaagc

SEQ ID NO: 3532536 - DNA, 22 bp, Homo sapiens
aggcctgactgccaagccatgg

SEQ ID NO: 3532537 - DNA, 21 bp, Homo sapiens
aggcctgcttttgtgtcccat

SEQ ID NO: 3532538 - DNA, 14 bp, Homo sapiens
aggcctttccctaa

SEQ ID NO: 3532539 - DNA, 16 bp, Homo sapiens
aggcctttccctaagc

SEQ ID NO: 3532540 - DNA, 16 bp, Homo sapiens
aggctgccctgagggg

SEQ ID NO: 3532541 - DNA, 17 bp, Homo sapiens
aggctgccctgaggggc

SEQ ID NO: 3532542 - DNA, 18 bp, Homo sapiens
aggctgccctgaggggct

SEQ ID NO: 3532543 - DNA, 20 bp, Homo sapiens
aggctgctgccctgctgtgg

SEQ ID NO: 3532544 - DNA, 20 bp, Homo sapiens
aggctggtgtatgcactgct

SEQ ID NO: 3532545 - DNA, 23 bp, Homo sapiens
aggctgttggcgtgtcccagcac

SEQ ID NO: 3532546 - DNA, 14 bp, Homo sapiens
aggcttttccagtg

SEQ ID NO: 3532547 - DNA, 12 bp, Homo sapiens
agggaggagggc

SEQ ID NO: 3532548 - DNA, 21 bp, Homo sapiens
agggaggggccggctggcctg

SEQ ID NO: 3532549 - DNA, 16 bp, Homo sapiens
agggagtctcaggagg

SEQ ID NO: 3532550 - DNA, 16 bp, Homo sapiens
agggatgttgcaaagg

SEQ ID NO: 3532551 - DNA, 18 bp, Homo sapiens
agggcactggagctggga

SEQ ID NO: 3532552 - DNA, 21 bp, Homo sapiens
agggctgcatcccgagcaacc

SEQ ID NO: 3532553 - DNA, 12 bp, Homo sapiens
aggggaagggca

SEQ ID NO: 3532554 - DNA, 13 bp, Homo sapiens
aggggaagggcag

SEQ ID NO: 3532555 - DNA, 15 bp, Homo sapiens
aggggaagggcaggc

SEQ ID NO: 3532556 - DNA, 17 bp, Homo sapiens
aggggaagggcaggcac

SEQ ID NO: 3532557 - DNA, 16 bp, Homo sapiens
aggggacgggcaagtg

SEQ ID NO: 3532558 - DNA, 18 bp, Homo sapiens
aggggagggagggaagtc

SEQ ID NO: 3532559 - DNA, 20 bp, Homo sapiens
aggggccggctggcctggag

SEQ ID NO: 3532560 - DNA, 16 bp, Homo sapiens
agggggtacctcatga

SEQ ID NO: 3532561 - DNA, 18 bp, Homo sapiens
agggggtacctcatgagg

SEQ ID NO: 3532562 - DNA, 17 bp, Homo sapiens
aggggtgtccgagaggc

SEQ ID NO: 3532563 - DNA, 22 bp, Homo sapiens
agggtggagctgagaagaggag

SEQ ID NO: 3532564 - DNA, 15 bp, Homo sapiens
agggtttcattgtct

SEQ ID NO: 3532565 - DNA, 15 bp, Homo sapiens
aggtcactctccagc

SEQ ID NO: 3532566 - DNA, 20 bp, Homo sapiens
aggtcactctccagcagtta

SEQ ID NO: 3532567 - DNA, 16 bp, Homo sapiens
aggtccaagattctgg

SEQ ID NO: 3532568 - DNA, 13 bp, Homo sapiens
aggtctttcagaa

SEQ ID NO: 3532569 - DNA, 21 bp, Homo sapiens
cctcctagccccttcttccaa

SEQ ID NO: 3532570 - DNA, 14 bp, Homo sapiens
cctcctctccacca

SEQ ID NO: 3532571 - DNA, 14 bp, Homo sapiens
cctcggtgttactt

SEQ ID NO: 3532572 - DNA, 20 bp, Homo sapiens
cctcttccgttggaaagaac

SEQ ID NO: 3532573 - DNA, 24 bp, Homo sapiens
cctgacggctgccattggtccacc

SEQ ID NO: 3532574 - DNA, 13 bp, Homo sapiens
cctgactgccaag

SEQ ID NO: 3532575 - DNA, 16 bp, Homo sapiens
cctgactgccaagcca

SEQ ID NO: 3532576 - DNA, 18 bp, Homo sapiens
cctgactgccaagccatg

SEQ ID NO: 3532577 - DNA, 18 bp, Homo sapiens
cctgaggggctggggagg

SEQ ID NO: 3532578 - DNA, 13 bp, Homo sapiens
cctgcatctaagc

SEQ ID NO: 3532579 - DNA, 19 bp, Homo sapiens
cctgctacctgatttcagc

SEQ ID NO: 3532580 - DNA, 18 bp, Homo sapiens
cctgctgccctccccctc

SEQ ID NO: 3532581 - DNA, 21 bp, Homo sapiens
cctggccatttggccccaggg

SEQ ID NO: 3532582 - DNA, 22 bp, Homo sapiens
cctggctggagaccgaggccag

SEQ ID NO: 3532583 - DNA, 23 bp, Homo sapiens
cctggctggagaccgaggccaga

SEQ ID NO: 3532584 - DNA, 20 bp, Homo sapiens
cctgggaggatcctgagctg

SEQ ID NO: 3532585 - DNA, 18 bp, Homo sapiens
cctgtaaggtttcaatgc

SEQ ID NO: 3532586 - DNA, 19 bp, Homo sapiens
cctgtctgaacctgccctt

SEQ ID NO: 3532587 - DNA, 15 bp, Homo sapiens
cctgtgaccttggga

SEQ ID NO: 3532588 - DNA, 17 bp, Homo sapiens
cctgtgaccttgggacc

SEQ ID NO: 3532589 - DNA, 21 bp, Homo sapiens
ccttagaccaccaagccttga

SEQ ID NO: 3532590 - DNA, 19 bp, Homo sapiens
ccttccttttacttttctt

SEQ ID NO: 3532591 - DNA, 14 bp, Homo sapiens
ccttctccaaaggc

SEQ ID NO: 3532592 - DNA, 18 bp, Homo sapiens
ccttctccaaaggctctg

SEQ ID NO: 3532593 - DNA, 17 bp, Homo sapiens
ccttctctttcaatgtg

SEQ ID NO: 3532594 - DNA, 18 bp, Homo sapiens
ccttgggaccaaaggggg

SEQ ID NO: 3532595 - DNA, 14 bp, Homo sapiens
ccttgggccctgga

SEQ ID NO: 3532596 - DNA, 15 bp, Homo sapiens
cctttccctaagcca

SEQ ID NO: 3532597 - DNA, 21 bp, Homo sapiens
cctttgctgaccctccccaaa

SEQ ID NO: 3532598 - DNA, 14 bp, Homo sapiens
cgaattcagaaaga

SEQ ID NO: 3532599 - DNA, 15 bp, Homo sapiens
cgacccccgcagagg

SEQ ID NO: 3532600 - DNA, 17 bp, Homo sapiens
cgacccccgcagaggca

SEQ ID NO: 3532601 - DNA, 20 bp, Homo sapiens
cgagcaaccctctgaagaag

SEQ ID NO: 3532602 - DNA, 15 bp, Homo sapiens
cgatggtgtttggga

SEQ ID NO: 3532603 - DNA, 11 bp, Homo sapiens
cgcagaggcag

SEQ ID NO: 3532604 - DNA, 12 bp, Homo sapiens
cgcagaggcaga

SEQ ID NO: 3532605 - DNA, 13 bp, Homo sapiens
cgcagaggcagaa

SEQ ID NO: 3532606 - DNA, 12 bp, Homo sapiens
cgcagaggcttt

SEQ ID NO: 3532607 - DNA, 19 bp, Homo sapiens
cgccacagcccttttgtct

SEQ ID NO: 3532608 - DNA, 14 bp, Homo sapiens
cgcgggcacagcca

SEQ ID NO: 3532609 - DNA, 16 bp, Homo sapiens
cgctcgttcctgcagc

SEQ ID NO: 3532610 - DNA, 14 bp, Homo sapiens
cggaatggtcaaat

SEQ ID NO: 3532611 - DNA, 19 bp, Homo sapiens
cgggacaccgtggggaagg

SEQ ID NO: 3532612 - DNA, 10 bp, Homo sapiens
cggggagggc

SEQ ID NO: 3532613 - DNA, 16 bp, Homo sapiens
cgggggtggctctgtc

SEQ ID NO: 3532614 - DNA, 13 bp, Homo sapiens
cgggtctccctcc

SEQ ID NO: 3532615 - DNA, 21 bp, Homo sapiens
cgtatctgagggctgctcccc

SEQ ID NO: 3532616 - DNA, 18 bp, Homo sapiens
cgtcagccatcagccatg

SEQ ID NO: 3532617 - DNA, 18 bp, Homo sapiens
cgtgggccctgcaggctg

SEQ ID NO: 3532618 - DNA, 13 bp, Homo sapiens
cgttcagggaggg

SEQ ID NO: 3532619 - DNA, 15 bp, Homo sapiens
cgttcagggaggggc

SEQ ID NO: 3532620 - DNA, 21 bp, Homo sapiens
ctaaagattgttaaattcaat

SEQ ID NO: 3532621 - DNA, 19 bp, Homo sapiens
ctaaaggatgagatttttc

SEQ ID NO: 3532622 - DNA, 16 bp, Homo sapiens
ctaacttacaaactgg

SEQ ID NO: 3532623 - DNA, 17 bp, Homo sapiens
ctaagaataatggactc

SEQ ID NO: 3532624 - DNA, 14 bp, Homo sapiens
ctaagcagccagga

SEQ ID NO: 3532625 - DNA, 17 bp, Homo sapiens
ctaatgtaaattttaat

SEQ ID NO: 3532626 - DNA, 20 bp, Homo sapiens
ctaatgtgaatgtgagtgaa

SEQ ID NO: 3532627 - DNA, 23 bp, Homo sapiens
ctacctcttccgttggaaagaac

SEQ ID NO: 3532628 - DNA, 14 bp, Homo sapiens
ctacctgatttcag

SEQ ID NO: 3532629 - DNA, 13 bp, Homo sapiens
ctagaagaaaacc

SEQ ID NO: 3532630 - DNA, 18 bp, Homo sapiens
ctagaagaaaacccgagg

SEQ ID NO: 3532631 - DNA, 20 bp, Homo sapiens
ctagaagaaaacccgaggga

SEQ ID NO: 3532632 - DNA, 22 bp, Homo sapiens
ctagagtgctctgaccctgggc

SEQ ID NO: 3532633 - DNA, 15 bp, Homo sapiens
ctagcagtgagtact

SEQ ID NO: 3532634 - DNA, 15 bp, Homo sapiens
ctaggcatcaccccc

SEQ ID NO: 3532635 - DNA, 14 bp, Homo sapiens
ctaggtatgaagta

SEQ ID NO: 3532636 - DNA, 12 bp, Homo sapiens
ctataacattca

SEQ ID NO: 3532637 - DNA, 14 bp, Homo sapiens
ctatgtctctagca

SEQ ID NO: 3532638 - DNA, 20 bp, Homo sapiens
ctatgtctctagcagtgagt

SEQ ID NO: 3532639 - DNA, 19 bp, Homo sapiens
ctatgtggaagtggggcgg

SEQ ID NO: 3532640 - DNA, 13 bp, Homo sapiens
ctattgcctctga

SEQ ID NO: 3532641 - DNA, 17 bp, Homo sapiens
ctattgcctctgagagc

SEQ ID NO: 3532642 - DNA, 15 bp, Homo sapiens
ctcaacaacatgtca

SEQ ID NO: 3532643 - DNA, 21 bp, Homo sapiens
ctcacacggatttagtcccac

SEQ ID NO: 3532644 - DNA, 15 bp, Homo sapiens
ctcagaatgggggct

SEQ ID NO: 3532645 - DNA, 18 bp, Homo sapiens
ctcagacgactagcccag

SEQ ID NO: 3532646 - DNA, 19 bp, Homo sapiens
ctcagcactctggactcca

SEQ ID NO: 3532647 - DNA, 13 bp, Homo sapiens
ctcagcagaggca

SEQ ID NO: 3532648 - DNA, 20 bp, Homo sapiens
ctcagctcttggtgggccca

SEQ ID NO: 3532649 - DNA, 22 bp, Homo sapiens
ctcagctcttggtgggcccagg

SEQ ID NO: 3532650 - DNA, 23 bp, Homo sapiens
ctcagctcttggtgggcccaggg

SEQ ID NO: 3532651 - DNA, 13 bp, Homo sapiens
ctcaggaggaggc

SEQ ID NO: 3532652 - DNA, 14 bp, Homo sapiens
ctcaggaggaggct

SEQ ID NO: 3532653 - DNA, 16 bp, Homo sapiens
ctcatgaggaccaggg

SEQ ID NO: 3532654 - DNA, 15 bp, Homo sapiens
ctcatgggacctgcc

SEQ ID NO: 3532655 - DNA, 22 bp, Homo sapiens
ctccaccatcgtcttcttggcc

SEQ ID NO: 3532656 - DNA, 15 bp, Homo sapiens
ctccacgatgccttt

SEQ ID NO: 3532657 - DNA, 18 bp, Homo sapiens
ctccacgatgcctttgag

SEQ ID NO: 3532658 - DNA, 21 bp, Homo sapiens
ctccactcagcactctggact

SEQ ID NO: 3532659 - DNA, 18 bp, Homo sapiens
ctccagcagttaggcacc

SEQ ID NO: 3532660 - DNA, 19 bp, Homo sapiens
ctccagcttttcctcaggg

SEQ ID NO: 3532661 - DNA, 14 bp, Homo sapiens
ctccagttggatga

SEQ ID NO: 3532662 - DNA, 21 bp, Homo sapiens
ctcccaaggagggcaccatct

SEQ ID NO: 3532663 - DNA, 16 bp, Homo sapiens
ctcccccatagcaccc

SEQ ID NO: 3532664 - DNA, 17 bp, Homo sapiens
ctcccccatagcaccct

SEQ ID NO: 3532665 - DNA, 15 bp, Homo sapiens
ctccccttgcagcct

SEQ ID NO: 3532666 - DNA, 21 bp, Homo sapiens
ctccctcagccgtcagccatc

SEQ ID NO: 3532667 - DNA, 20 bp, Homo sapiens
ctcctcggtgttacttccct

SEQ ID NO: 3532668 - DNA, 14 bp, Homo sapiens
ctcggggctgctgt

SEQ ID NO: 3532669 - DNA, 20 bp, Homo sapiens
ctctaagcagccaggaggga

SEQ ID NO: 3532670 - DNA, 16 bp, Homo sapiens
ctctagcagtgagtac

SEQ ID NO: 3532671 - DNA, 18 bp, Homo sapiens
ctctcaagagtgctgaga

SEQ ID NO: 3532672 - DNA, 15 bp, Homo sapiens
ctctcctgtctgaac

SEQ ID NO: 3532673 - DNA, 18 bp, Homo sapiens
ctctcctgtctgaacctg

SEQ ID NO: 3532674 - DNA, 12 bp, Homo sapiens
ctctgaccctgg

SEQ ID NO: 3532675 - DNA, 20 bp, Homo sapiens
ctctgcaaactgccttcttc

SEQ ID NO: 3532676 - DNA, 12 bp, Homo sapiens
ctctgctgtcct

SEQ ID NO: 3532677 - DNA, 20 bp, Homo sapiens
ctctggactccacgatgcct

SEQ ID NO: 3532678 - DNA, 13 bp, Homo sapiens
ctcttatgagctc

SEQ ID NO: 3532679 - DNA, 19 bp, Homo sapiens
ctcttcaagtagattggct

SEQ ID NO: 3532680 - DNA, 22 bp, Homo sapiens
ctcttccgttggaaagaacatt

SEQ ID NO: 3532681 - DNA, 20 bp, Homo sapiens
ctcttgtgactcagcagagg

SEQ ID NO: 3532682 - DNA, 14 bp, Homo sapiens
ctctttcaatgtgt

SEQ ID NO: 3532683 - DNA, 17 bp, Homo sapiens
ctgaaaaaatgctgagc

SEQ ID NO: 3532684 - DNA, 18 bp, Homo sapiens
ctgaaaaaatgctgagcc

SEQ ID NO: 3532685 - DNA, 15 bp, Homo sapiens
ctgaaaatgtgtata

SEQ ID NO: 3532686 - DNA, 16 bp, Homo sapiens
ctgaaaggaagctgtg

SEQ ID NO: 3532687 - DNA, 18 bp, Homo sapiens
ctgaagctatgtctctag

SEQ ID NO: 3532688 - DNA, 22 bp, Homo sapiens
ctgaatctcgttgaggccaagg

SEQ ID NO: 3532689 - DNA, 14 bp, Homo sapiens
ctgactgccaagcc

SEQ ID NO: 3532690 - DNA, 15 bp, Homo sapiens
ctgactgccaagcca

SEQ ID NO: 3532691 - DNA, 16 bp, Homo sapiens
ctgactgccaagccat

SEQ ID NO: 3532692 - DNA, 17 bp, Homo sapiens
ctgactgtcagggaggg

SEQ ID NO: 3532693 - DNA, 23 bp, Homo sapiens
ctgactgtcagggagggccaggg

SEQ ID NO: 3532694 - DNA, 23 bp, Homo sapiens
ctgagaaatagtgcactccaaga

SEQ ID NO: 3532695 - DNA, 22 bp, Homo sapiens
ctgagagcatcaggcctagagg

SEQ ID NO: 3532696 - DNA, 18 bp, Homo sapiens
ctgagatttgtaaatctt

SEQ ID NO: 3532697 - DNA, 20 bp, Homo sapiens
ctgaggggctggggaggggg

SEQ ID NO: 3532698 - DNA, 13 bp, Homo sapiens
ctgaggggtgtcc

SEQ ID NO: 3532699 - DNA, 19 bp, Homo sapiens
ctgaggggtgtccgagagg

SEQ ID NO: 3532700 - DNA, 23 bp, Homo sapiens
ctgagtttgggttctctgctgtc

SEQ ID NO: 3532701 - DNA, 13 bp, Homo sapiens
ctgataggagggg

SEQ ID NO: 3532702 - DNA, 18 bp, Homo sapiens
ctgataggagggggcggc

SEQ ID NO: 3532703 - DNA, 15 bp, Homo sapiens
ctgattgaaacatga

SEQ ID NO: 3532704 - DNA, 18 bp, Homo sapiens
ctgattgaaacatgaaac

SEQ ID NO: 3532705 - DNA, 15 bp, Homo sapiens
ctgcaaactgccttc

SEQ ID NO: 3532706 - DNA, 14 bp, Homo sapiens
ctgcaggagggcac

SEQ ID NO: 3532707 - DNA, 13 bp, Homo sapiens
ctgcatcaaagga

SEQ ID NO: 3532708 - DNA, 23 bp, Homo sapiens
ctgcatcccgagcaaccctctga

SEQ ID NO: 3532709 - DNA, 13 bp, Homo sapiens
ctgccaagccatg

SEQ ID NO: 3532710 - DNA, 19 bp, Homo sapiens
ctgcccccagagccacagt

SEQ ID NO: 3532711 - DNA, 20 bp, Homo sapiens
ctgcccccagagccacagtt

SEQ ID NO: 3532712 - DNA, 21 bp, Homo sapiens
ctgcctcaggcactctcctgt

SEQ ID NO: 3532713 - DNA, 18 bp, Homo sapiens
ctgctctaggcccacaag

SEQ ID NO: 3532714 - DNA, 13 bp, Homo sapiens
ctgcttttgtgtc

SEQ ID NO: 3532715 - DNA, 23 bp, Homo sapiens
ctggaaataaagtaggaaagaat

SEQ ID NO: 3532716 - DNA, 12 bp, Homo sapiens
ctggaggtgctg

SEQ ID NO: 3532717 - DNA, 14 bp, Homo sapiens
ctggaggtgctggt

SEQ ID NO: 3532718 - DNA, 19 bp, Homo sapiens
ctggccatttggccccagg

SEQ ID NO: 3532719 - DNA, 20 bp, Homo sapiens
ctggccatttggccccaggg

SEQ ID NO: 3532720 - DNA, 22 bp, Homo sapiens
ctggcccccccagccccacacc

SEQ ID NO: 3532721 - DNA, 20 bp, Homo sapiens
ctggccgtatctgagggctg

SEQ ID NO: 3532722 - DNA, 14 bp, Homo sapiens
ctggcctggaggct

SEQ ID NO: 3532723 - DNA, 16 bp, Homo sapiens
ctggctggagaccgag

SEQ ID NO: 3532724 - DNA, 20 bp, Homo sapiens
ctggctggagaccgaggcca

SEQ ID NO: 3532725 - DNA, 22 bp, Homo sapiens
ctgggaggatcctgagctgctg

SEQ ID NO: 3532726 - DNA, 20 bp, Homo sapiens
ctgggcttaattcccccaag

SEQ ID NO: 3532727 - DNA, 22 bp, Homo sapiens
ctgggcttaattcccccaagca

SEQ ID NO: 3532728 - DNA, 11 bp, Homo sapiens
ctggggaccca

SEQ ID NO: 3532729 - DNA, 20 bp, Homo sapiens
ctgggtgtaaaacctggaga

SEQ ID NO: 3532730 - DNA, 20 bp, Homo sapiens
ctgggttgccatggcaatgg

SEQ ID NO: 3532731 - DNA, 17 bp, Homo sapiens
ctggtgaccagaccaag

SEQ ID NO: 3532732 - DNA, 15 bp, Homo sapiens
ctggtgctgctgggg

SEQ ID NO: 3532733 - DNA, 18 bp, Homo sapiens
ctgtaggtcactctccag

SEQ ID NO: 3532734 - DNA, 20 bp, Homo sapiens
ctgtcagacgttggtcccaa

SEQ ID NO: 3532735 - DNA, 21 bp, Homo sapiens
ctgtcagacgttggtcccaag

SEQ ID NO: 3532736 - DNA, 12 bp, Homo sapiens
ctgtcagggagg

SEQ ID NO: 3532737 - DNA, 13 bp, Homo sapiens
ctgtcagggaggg

SEQ ID NO: 3532738 - DNA, 20 bp, Homo sapiens
ctgtctcagacgactagccc

SEQ ID NO: 3532739 - DNA, 15 bp, Homo sapiens
ctgtgaaactatcct

SEQ ID NO: 3532740 - DNA, 22 bp, Homo sapiens
ctgtgaagtgagaccttccttt

SEQ ID NO: 3532741 - DNA, 12 bp, Homo sapiens
ctgttagaatat

SEQ ID NO: 3532742 - DNA, 14 bp, Homo sapiens
ctgttagaatatgt

SEQ ID NO: 3532743 - DNA, 15 bp, Homo sapiens
ctgttagaatatgtt

SEQ ID NO: 3532744 - DNA, 19 bp, Homo sapiens
ctgttagtagcagaaatat

SEQ ID NO: 3532745 - DNA, 18 bp, Homo sapiens
ctgttatcagctgggcag

SEQ ID NO: 3532746 - DNA, 14 bp, Homo sapiens
ctgttcctgatttt

SEQ ID NO: 3532747 - DNA, 20 bp, Homo sapiens
ctgttggcgtgtcccagcac

SEQ ID NO: 3532748 - DNA, 12 bp, Homo sapiens
cttaactgttca

SEQ ID NO: 3532749 - DNA, 20 bp, Homo sapiens
cttaaggcattgagggctct

SEQ ID NO: 3532750 - DNA, 20 bp, Homo sapiens
cttacaaactggtttgaaat

SEQ ID NO: 3532751 - DNA, 17 bp, Homo sapiens
cttagaccaccaagcct

SEQ ID NO: 3532752 - DNA, 19 bp, Homo sapiens
cttagaccaccaagccttg

SEQ ID NO: 3532753 - DNA, 20 bp, Homo sapiens
cttagaccaccaagccttga

SEQ ID NO: 3532754 - DNA, 19 bp, Homo sapiens
cttagattcaggggaaggg

SEQ ID NO: 3532755 - DNA, 18 bp, Homo sapiens
cttatctactgactgaaa

SEQ ID NO: 3532756 - DNA, 14 bp, Homo sapiens
cttccaaggagcag

SEQ ID NO: 3532757 - DNA, 20 bp, Homo sapiens
cttccaaggagcagagaggt

SEQ ID NO: 3532758 - DNA, 21 bp, Homo sapiens
cttccctttcatatgagggga

SEQ ID NO: 3532759 - DNA, 16 bp, Homo sapiens
cttccgttggaaagaa

SEQ ID NO: 3532760 - DNA, 21 bp, Homo sapiens
cttccgttggaaagaacattt

SEQ ID NO: 3532761 - DNA, 22 bp, Homo sapiens
cttccgttggaaagaacattta

SEQ ID NO: 3532762 - DNA, 20 bp, Homo sapiens
cttccttttacttttcttct

SEQ ID NO: 3532763 - DNA, 13 bp, Homo sapiens
cttctaatgtaaa

SEQ ID NO: 3532764 - DNA, 19 bp, Homo sapiens
cttctattgcctctgagag

SEQ ID NO: 3532765 - DNA, 17 bp, Homo sapiens
cttctctttcaatgtgt

SEQ ID NO: 3532766 - DNA, 22 bp, Homo sapiens
cttctgcatcaaaggagattct

SEQ ID NO: 3532767 - DNA, 11 bp, Homo sapiens
cttctgctgtg

SEQ ID NO: 3532768 - DNA, 23 bp, Homo sapiens
cttgatgttacaaggtgttgtta

SEQ ID NO: 3532769 - DNA, 19 bp, Homo sapiens
cttgattggtgttgccagt

SEQ ID NO: 3532770 - DNA, 20 bp, Homo sapiens
cttgctaccaatctgtgaga

SEQ ID NO: 3532771 - DNA, 22 bp, Homo sapiens
cttgctatctctcaagagtgct

SEQ ID NO: 3532772 - DNA, 19 bp, Homo sapiens
cttggggttcataggggca

SEQ ID NO: 3532773 - DNA, 17 bp, Homo sapiens
cttggtgctaaagattg

SEQ ID NO: 3532774 - DNA, 15 bp, Homo sapiens
cttgtgactaagttg

SEQ ID NO: 3532775 - DNA, 17 bp, Homo sapiens
cttgttttgatttatgg

SEQ ID NO: 3532776 - DNA, 23 bp, Homo sapiens
ctttatgaattattttgataaat

SEQ ID NO: 3532777 - DNA, 18 bp, Homo sapiens
ctttattagtaacatcat

SEQ ID NO: 3532778 - DNA, 20 bp, Homo sapiens
ctttcagaaggaaaccgaaa

SEQ ID NO: 3532779 - DNA, 15 bp, Homo sapiens
ctttcatagagaggc

SEQ ID NO: 3532780 - DNA, 22 bp, Homo sapiens
ctttcatatgaggggacccagc

SEQ ID NO: 3532781 - DNA, 18 bp, Homo sapiens
ctttccctaagccagctg

SEQ ID NO: 3532782 - DNA, 13 bp, Homo sapiens
ctttcggggaggg

SEQ ID NO: 3532783 - DNA, 13 bp, Homo sapiens
ctttgctgaccct

SEQ ID NO: 3532784 - DNA, 13 bp, Homo sapiens
ctttgtgaacatt

SEQ ID NO: 3532785 - DNA, 10 bp, Homo sapiens
cttttatgac

SEQ ID NO: 3532786 - DNA, 13 bp, Homo sapiens
cttttatgacaaa

SEQ ID NO: 3532787 - DNA, 14 bp, Homo sapiens
cttttatgacaaat

SEQ ID NO: 3532788 - DNA, 11 bp, Homo sapiens
cttttccagtg

SEQ ID NO: 3532789 - DNA, 14 bp, Homo sapiens
cttttccagtgtgt

SEQ ID NO: 3532790 - DNA, 23 bp, Homo sapiens
cttttcttctattgcctctgaga

SEQ ID NO: 3532791 - DNA, 14 bp, Homo sapiens
cttttgtgtcccat

SEQ ID NO: 3532792 - DNA, 12 bp, Homo sapiens
cttttgttctga

SEQ ID NO: 3532793 - DNA, 16 bp, Homo sapiens
cttttgttctgagggg

SEQ ID NO: 3532794 - DNA, 17 bp, Homo sapiens
gaaaaatgttataactt

SEQ ID NO: 3532795 - DNA, 14 bp, Homo sapiens
gaaaagaagctgtc

SEQ ID NO: 3532796 - DNA, 22 bp, Homo sapiens
gaaaagaagctgtcagaagttt

SEQ ID NO: 3532797 - DNA, 16 bp, Homo sapiens
gaaaagacaaatgtgc

SEQ ID NO: 3532798 - DNA, 22 bp, Homo sapiens
gaaaaggcagcatttgaatact

SEQ ID NO: 3532799 - DNA, 17 bp, Homo sapiens
gaaaataagacttctgg

SEQ ID NO: 3532800 - DNA, 14 bp, Homo sapiens
gaaaatgtgtatac

SEQ ID NO: 3532801 - DNA, 22 bp, Homo sapiens
gaaaatttgcaacatataaagt

SEQ ID NO: 3532802 - DNA, 14 bp, Homo sapiens
gaaacatgaaacaa

SEQ ID NO: 3532803 - DNA, 15 bp, Homo sapiens
gaaagaagaaggtgg

SEQ ID NO: 3532804 - DNA, 19 bp, Homo sapiens
gaaagtctgaatctcccaa

SEQ ID NO: 3532805 - DNA, 18 bp, Homo sapiens
gaaataaagtaggaaaga

SEQ ID NO: 3532806 - DNA, 16 bp, Homo sapiens
gaaatatattatgaaa

SEQ ID NO: 3532807 - DNA, 19 bp, Homo sapiens
gaaatatattatgaaaatt

SEQ ID NO: 3532808 - DNA, 21 bp, Homo sapiens
gaaatatattatgaaaattaa

SEQ ID NO: 3532809 - DNA, 23 bp, Homo sapiens
gaaatcagtggtgttacattttc

SEQ ID NO: 3532810 - DNA, 20 bp, Homo sapiens
gaaatttttgatgcccagac

SEQ ID NO: 3532811 - DNA, 19 bp, Homo sapiens
gaacaactggaaataaagt

SEQ ID NO: 3532812 - DNA, 16 bp, Homo sapiens
gaacatttaaaattaa

SEQ ID NO: 3532813 - DNA, 20 bp, Homo sapiens
gaaccacggtgaaagtgctg

SEQ ID NO: 3532814 - DNA, 21 bp, Homo sapiens
gaaccacggtgaaagtgctgc

SEQ ID NO: 3532815 - DNA, 23 bp, Homo sapiens
gaaccacggtgaaagtgctgctc

SEQ ID NO: 3532816 - DNA, 15 bp, Homo sapiens
gaagaaaacccgagg

SEQ ID NO: 3532817 - DNA, 15 bp, Homo sapiens
gaagctaatgtgaat

SEQ ID NO: 3532818 - DNA, 19 bp, Homo sapiens
gaagctatgtctctagcag

SEQ ID NO: 3532819 - DNA, 12 bp, Homo sapiens
gaagctgtcaga

SEQ ID NO: 3532820 - DNA, 17 bp, Homo sapiens
gaagctgtcagaagttt

SEQ ID NO: 3532821 - DNA, 19 bp, Homo sapiens
gaagctgtgcgtgtgtgtg

SEQ ID NO: 3532822 - DNA, 18 bp, Homo sapiens
gaagggaattaggcttta

SEQ ID NO: 3532823 - DNA, 11 bp, Homo sapiens
gaagggcaggc

SEQ ID NO: 3532824 - DNA, 14 bp, Homo sapiens
gaaggtgggaggat

SEQ ID NO: 3532825 - DNA, 19 bp, Homo sapiens
gaagtataaacccattttg

SEQ ID NO: 3532826 - DNA, 12 bp, Homo sapiens
gaagtgagacct

SEQ ID NO: 3532827 - DNA, 21 bp, Homo sapiens
gaataggttactttggactga

SEQ ID NO: 3532828 - DNA, 20 bp, Homo sapiens
gaatgatccatactgaaaaa

SEQ ID NO: 3532829 - DNA, 22 bp, Homo sapiens
gaatgatgggcttttgttctga

SEQ ID NO: 3532830 - DNA, 22 bp, Homo sapiens
gaatgggggctttcggggaggg

SEQ ID NO: 3532831 - DNA, 20 bp, Homo sapiens
gaattacagaaaatttgcaa

SEQ ID NO: 3532832 - DNA, 12 bp, Homo sapiens
gacaaaatgtga

SEQ ID NO: 3532833 - DNA, 23 bp, Homo sapiens
gacaagttacacctccactcagc

SEQ ID NO: 3532834 - DNA, 23 bp, Homo sapiens
gacacacagttgttgaatgactg

SEQ ID NO: 3532835 - DNA, 15 bp, Homo sapiens
gacacccacacaggt

SEQ ID NO: 3532836 - DNA, 21 bp, Homo sapiens
gacacccacacaggtggccat

SEQ ID NO: 3532837 - DNA, 18 bp, Homo sapiens
gacacgaaggctgcccct

SEQ ID NO: 3532838 - DNA, 24 bp, Homo sapiens
gacactggatcaagttcagccacc

SEQ ID NO: 3532839 - DNA, 22 bp, Homo sapiens
gacatgagtccaccctttggag

SEQ ID NO: 3532840 - DNA, 23 bp, Homo sapiens
gaccaaaaaaaagcatgaatatt

SEQ ID NO: 3532841 - DNA, 14 bp, Homo sapiens
gaccaaagggggag

SEQ ID NO: 3532842 - DNA, 22 bp, Homo sapiens
gaccaccaagccttgattggtg

SEQ ID NO: 3532843 - DNA, 14 bp, Homo sapiens
gaccagaccaaggc

SEQ ID NO: 3532844 - DNA, 16 bp, Homo sapiens
gaccagatccaagatg

SEQ ID NO: 3532845 - DNA, 23 bp, Homo sapiens
gacccagcgccggggggagggag

SEQ ID NO: 3532846 - DNA, 17 bp, Homo sapiens
gacccttctccaaaggc

SEQ ID NO: 3532847 - DNA, 17 bp, Homo sapiens
gaccgaggccagaaggc

SEQ ID NO: 3532848 - DNA, 18 bp, Homo sapiens
gaccgatggtgtttggga

SEQ ID NO: 3532849 - DNA, 22 bp, Homo sapiens
gactcagcagaggcagtggcca

SEQ ID NO: 3532850 - DNA, 19 bp, Homo sapiens
gactccacgatgcctttga

SEQ ID NO: 3532851 - DNA, 17 bp, Homo sapiens
gactgagatttgtaaat

SEQ ID NO: 3532852 - DNA, 16 bp, Homo sapiens
gagaagaggaggaggt

SEQ ID NO: 3532853 - DNA, 23 bp, Homo sapiens
gagaccagaaaccttccagagaa

SEQ ID NO: 3532854 - DNA, 19 bp, Homo sapiens
gagaccgaggccagaaggc

SEQ ID NO: 3532855 - DNA, 23 bp, Homo sapiens
gagactctccctgacggtggaat

SEQ ID NO: 3532856 - DNA, 13 bp, Homo sapiens
gagacttgggaat

SEQ ID NO: 3532857 - DNA, 12 bp, Homo sapiens
gagaggcctgct

SEQ ID NO: 3532858 - DNA, 12 bp, Homo sapiens
gagaggctggtg

SEQ ID NO: 3532859 - DNA, 13 bp, Homo sapiens
gagaggtggccac

SEQ ID NO: 3532860 - DNA, 21 bp, Homo sapiens
gagaggtggccaccgggggtg

SEQ ID NO: 3532861 - DNA, 18 bp, Homo sapiens
gagatagcccatcttcct

SEQ ID NO: 3532862 - DNA, 15 bp, Homo sapiens
gagatttgtaaatct

SEQ ID NO: 3532863 - DNA, 16 bp, Homo sapiens
gagatttgtaaatctt

SEQ ID NO: 3532864 - DNA, 17 bp, Homo sapiens
gagcaaccctctgaaga

SEQ ID NO: 3532865 - DNA, 19 bp, Homo sapiens
gagcagagaggtggccacc

SEQ ID NO: 3532866 - DNA, 18 bp, Homo sapiens
gagcctgtgaccttggga

SEQ ID NO: 3532867 - DNA, 16 bp, Homo sapiens
gagcgttactgtagac

SEQ ID NO: 3532868 - DNA, 17 bp, Homo sapiens
gagctgagaagaggagg

SEQ ID NO: 3532869 - DNA, 19 bp, Homo sapiens
gaggaccagggtggagctg

SEQ ID NO: 3532870 - DNA, 13 bp, Homo sapiens
gaggaggctgccc

SEQ ID NO: 3532871 - DNA, 22 bp, Homo sapiens
gaggaggctgccctgaggggct

SEQ ID NO: 3532872 - DNA, 15 bp, Homo sapiens
gaggaggtgggggct

SEQ ID NO: 3532873 - DNA, 20 bp, Homo sapiens
gaggaggtgggggctggagg

SEQ ID NO: 3532874 - DNA, 20 bp, Homo sapiens
gaggatttccctgaagctat

SEQ ID NO: 3532875 - DNA, 20 bp, Homo sapiens
gaggcagagcgggagggagt

SEQ ID NO: 3532876 - DNA, 19 bp, Homo sapiens
gaggcctgactgccaagcc

SEQ ID NO: 3532877 - DNA, 20 bp, Homo sapiens
gaggcctgactgccaagcca

SEQ ID NO: 3532878 - DNA, 18 bp, Homo sapiens
gaggctcagcccaccctc

SEQ ID NO: 3532879 - DNA, 14 bp, Homo sapiens
gaggcttttccagt

SEQ ID NO: 3532880 - DNA, 18 bp, Homo sapiens
gagggaagtcctgggagg

SEQ ID NO: 3532881 - DNA, 20 bp, Homo sapiens
gagggacagcagattccaca

SEQ ID NO: 3532882 - DNA, 23 bp, Homo sapiens
gagggacagcagattccacagga

SEQ ID NO: 3532883 - DNA, 14 bp, Homo sapiens
gagggagtctcagg

SEQ ID NO: 3532884 - DNA, 15 bp, Homo sapiens
gagggccagggaggc

SEQ ID NO: 3532885 - DNA, 14 bp, Homo sapiens
gaggggacccagcg

SEQ ID NO: 3532886 - DNA, 15 bp, Homo sapiens
gaggggacgggcaag

SEQ ID NO: 3532887 - DNA, 14 bp, Homo sapiens
gaggggagggaggg

SEQ ID NO: 3532888 - DNA, 17 bp, Homo sapiens
gaggggccggctggcct

SEQ ID NO: 3532889 - DNA, 16 bp, Homo sapiens
gaggggctggggaggg

SEQ ID NO: 3532890 - DNA, 23 bp, Homo sapiens
gaggggctggggagggggtacct

SEQ ID NO: 3532891 - DNA, 13 bp, Homo sapiens
gagggggcggcag

SEQ ID NO: 3532892 - DNA, 23 bp, Homo sapiens
gagggggcggcagggctgggcct

SEQ ID NO: 3532893 - DNA, 18 bp, Homo sapiens
gagggggtacctcatgag

SEQ ID NO: 3532894 - DNA, 11 bp, Homo sapiens
gaggggtgtcc

SEQ ID NO: 3532895 - DNA, 22 bp, Homo sapiens
gagggtttcattgtctgtgaag

SEQ ID NO: 3532896 - DNA, 19 bp, Homo sapiens
gaggtccaagattctggag

SEQ ID NO: 3532897 - DNA, 20 bp, Homo sapiens
gaggtgctggtagctgaggg

SEQ ID NO: 3532898 - DNA, 22 bp, Homo sapiens
gaggtggccaccgggggtggct

SEQ ID NO: 3532899 - DNA, 17 bp, Homo sapiens
gaggtgggggctggagg

SEQ ID NO: 3532900 - DNA, 22 bp, Homo sapiens
gagtactcataaaggacactgg

SEQ ID NO: 3532901 - DNA, 23 bp, Homo sapiens
gatagcaatgttccaggaatgaa

SEQ ID NO: 3532902 - DNA, 17 bp, Homo sapiens
gataggagggggcggca

SEQ ID NO: 3532903 - DNA, 16 bp, Homo sapiens
gatccatactgaaaaa

SEQ ID NO: 3532904 - DNA, 17 bp, Homo sapiens
gatccccacgccacagc

SEQ ID NO: 3532905 - DNA, 13 bp, Homo sapiens
gatcttatttatt

SEQ ID NO: 3532906 - DNA, 16 bp, Homo sapiens
gatgatccccacgcca

SEQ ID NO: 3532907 - DNA, 17 bp, Homo sapiens
gatgatggtgttggtga

SEQ ID NO: 3532908 - DNA, 18 bp, Homo sapiens
gatgatggtgttggtgaa

SEQ ID NO: 3532909 - DNA, 20 bp, Homo sapiens
gatgcattctgataggaggg

SEQ ID NO: 3532910 - DNA, 18 bp, Homo sapiens
gatgggcttttgttctga

SEQ ID NO: 3532911 - DNA, 21 bp, Homo sapiens
gatgtatgctgtttgtacaaa

SEQ ID NO: 3532912 - DNA, 14 bp, Homo sapiens
gattcaggggaagg

SEQ ID NO: 3532913 - DNA, 15 bp, Homo sapiens
gattcaggggaaggg

SEQ ID NO: 3532914 - DNA, 15 bp, Homo sapiens
gattccacaggacac

SEQ ID NO: 3532915 - DNA, 14 bp, Homo sapiens
gattccagccatca

SEQ ID NO: 3532916 - DNA, 13 bp, Homo sapiens
gatttatggctgt

SEQ ID NO: 3532917 - DNA, 17 bp, Homo sapiens
gattttatcccccacca

SEQ ID NO: 3532918 - DNA, 20 bp, Homo sapiens
gattttgcagttctttggct

SEQ ID NO: 3532919 - DNA, 19 bp, Homo sapiens
gatttttcatatgtggaaa

SEQ ID NO: 3532920 - DNA, 22 bp, Homo sapiens
gcaaaagaatgttttggcaaga

SEQ ID NO: 3532921 - DNA, 21 bp, Homo sapiens
gcaaaggtccctgagctcttg

SEQ ID NO: 3532922 - DNA, 15 bp, Homo sapiens
gcaaccctctgaaga

SEQ ID NO: 3532923 - DNA, 19 bp, Homo sapiens
gcaagagcgttactgtaga

SEQ ID NO: 3532924 - DNA, 17 bp, Homo sapiens
gcaaggaatcctctggg

SEQ ID NO: 3532925 - DNA, 18 bp, Homo sapiens
gcaaggaatcctctggga

SEQ ID NO: 3532926 - DNA, 15 bp, Homo sapiens
gcaagtgagagggga

SEQ ID NO: 3532927 - DNA, 17 bp, Homo sapiens
gcaagtgagaggggagg

SEQ ID NO: 3532928 - DNA, 19 bp, Homo sapiens
gcaagtgagaggggaggga

SEQ ID NO: 3532929 - DNA, 14 bp, Homo sapiens
gcaatgttccagga

SEQ ID NO: 3532930 - DNA, 15 bp, Homo sapiens
gcacagaaatctgaa

SEQ ID NO: 3532931 - DNA, 22 bp, Homo sapiens
gcacagccagcccaaaccttgg

SEQ ID NO: 3532932 - DNA, 12 bp, Homo sapiens
gcacatttgaat

SEQ ID NO: 3532933 - DNA, 18 bp, Homo sapiens
gcaccctgccctcatggg

SEQ ID NO: 3532934 - DNA, 14 bp, Homo sapiens
gcaccttaactgga

SEQ ID NO: 3532935 - DNA, 17 bp, Homo sapiens
gcactggagctgggagg

SEQ ID NO: 3532936 - DNA, 15 bp, Homo sapiens
gcagaatgaacccat

SEQ ID NO: 3532937 - DNA, 23 bp, Homo sapiens
gcagaatgaacccatagggagct

SEQ ID NO: 3532938 - DNA, 15 bp, Homo sapiens
gcagagaggtggcca

SEQ ID NO: 3532939 - DNA, 16 bp, Homo sapiens
gcagagaggtggccac

SEQ ID NO: 3532940 - DNA, 16 bp, Homo sapiens
gcagagcgggagggag

SEQ ID NO: 3532941 - DNA, 12 bp, Homo sapiens
gcagaggcagaa

SEQ ID NO: 3532942 - DNA, 13 bp, Homo sapiens
gcagccagaaagg

SEQ ID NO: 3532943 - DNA, 14 bp, Homo sapiens
gcagccaggaggga

SEQ ID NO: 3532944 - DNA, 17 bp, Homo sapiens
gcagccaggagggacct

SEQ ID NO: 3532945 - DNA, 14 bp, Homo sapiens
gcaggagggcactg

SEQ ID NO: 3532946 - DNA, 17 bp, Homo sapiens
gcaggctgcaggagggc

SEQ ID NO: 3532947 - DNA, 19 bp, Homo sapiens
gcaggctgcaggagggcac

SEQ ID NO: 3532948 - DNA, 23 bp, Homo sapiens
gcaggtggggtgatggccagagg

SEQ ID NO: 3532949 - DNA, 15 bp, Homo sapiens
gcagtgccagccaat

SEQ ID NO: 3532950 - DNA, 12 bp, Homo sapiens
gcagtggccacg

SEQ ID NO: 3532951 - DNA, 22 bp, Homo sapiens
gcagtggccacgttcagggagg

SEQ ID NO: 3532952 - DNA, 18 bp, Homo sapiens
gcatacaataaaagagct

SEQ ID NO: 3532953 - DNA, 20 bp, Homo sapiens
gcatacaataaaagagcttt

SEQ ID NO: 3532954 - DNA, 21 bp, Homo sapiens
gcatacaataaaagagcttta

SEQ ID NO: 3532955 - DNA, 18 bp, Homo sapiens
gcatacaccaaacatttc

SEQ ID NO: 3532956 - DNA, 19 bp, Homo sapiens
gcatgcagcgaattcagaa

SEQ ID NO: 3532957 - DNA, 23 bp, Homo sapiens
gcatgtgtaggatgtatgctgtt

SEQ ID NO: 3532958 - DNA, 18 bp, Homo sapiens
gcattctgataggagggg

SEQ ID NO: 3532959 - DNA, 21 bp, Homo sapiens
gcattctgataggagggggcg

SEQ ID NO: 3532960 - DNA, 13 bp, Homo sapiens
gcattgagggctc

SEQ ID NO: 3532961 - DNA, 13 bp, Homo sapiens
gccaatccctggc

SEQ ID NO: 3532962 - DNA, 18 bp, Homo sapiens
gccagcccaaaccttggg

SEQ ID NO: 3532963 - DNA, 22 bp, Homo sapiens
gccagcccaaaccttgggccct

SEQ ID NO: 3532964 - DNA, 18 bp, Homo sapiens
gccaggtgatctcctgtg

SEQ ID NO: 3532965 - DNA, 16 bp, Homo sapiens
gccagttgtcctcctt

SEQ ID NO: 3532966 - DNA, 14 bp, Homo sapiens
gccatcaccttaga

SEQ ID NO: 3532967 - DNA, 12 bp, Homo sapiens
gccatcagccat

SEQ ID NO: 3532968 - DNA, 19 bp, Homo sapiens
gccatgggtagcctgggtg

SEQ ID NO: 3532969 - DNA, 20 bp, Homo sapiens
gccatgggtagcctgggtgt

SEQ ID NO: 3532970 - DNA, 18 bp, Homo sapiens
gccattggtccacccttt

SEQ ID NO: 3532971 - DNA, 15 bp, Homo sapiens
gcccaaaccttgggc

SEQ ID NO: 3532972 - DNA, 20 bp, Homo sapiens
gcccaaaccttgggccctgg

SEQ ID NO: 3532973 - DNA, 18 bp, Homo sapiens
gcccatcttcctgagcta

SEQ ID NO: 3532974 - DNA, 21 bp, Homo sapiens
gcccctaaagatgggaggaga

SEQ ID NO: 3532975 - DNA, 12 bp, Homo sapiens
gcccctgaccct

SEQ ID NO: 3532976 - DNA, 17 bp, Homo sapiens
gccccttcttccaagga

SEQ ID NO: 3532977 - DNA, 20 bp, Homo sapiens
gccccttcttccaaggagca

SEQ ID NO: 3532978 - DNA, 16 bp, Homo sapiens
gcccctttgctgaccc

SEQ ID NO: 3532979 - DNA, 17 bp, Homo sapiens
gcccctttgctgaccct

SEQ ID NO: 3532980 - DNA, 18 bp, Homo sapiens
gcccctttgctgaccctc

SEQ ID NO: 3532981 - DNA, 18 bp, Homo sapiens
gcccgcgggcacagccag

SEQ ID NO: 3532982 - DNA, 19 bp, Homo sapiens
gcccgcgggcacagccagc

SEQ ID NO: 3532983 - DNA, 20 bp, Homo sapiens
gcccgcgggcacagccagcc

SEQ ID NO: 3532984 - DNA, 23 bp, Homo sapiens
gcccgcgggcacagccagcccaa

SEQ ID NO: 3532985 - DNA, 21 bp, Homo sapiens
gccctcatgggacctgccctc

SEQ ID NO: 3532986 - DNA, 14 bp, Homo sapiens
gccctccccctcct

SEQ ID NO: 3532987 - DNA, 13 bp, Homo sapiens
gccctcctggtga

SEQ ID NO: 3532988 - DNA, 20 bp, Homo sapiens
gccctgactgtcagggaggg

SEQ ID NO: 3532989 - DNA, 22 bp, Homo sapiens
gccctgactgtcagggagggcc

SEQ ID NO: 3532990 - DNA, 14 bp, Homo sapiens
gccctgaggggctg

SEQ ID NO: 3532991 - DNA, 23 bp, Homo sapiens
gccctgaggggctggggaggggg

SEQ ID NO: 3532992 - DNA, 13 bp, Homo sapiens
gccctgctgccct

SEQ ID NO: 3532993 - DNA, 17 bp, Homo sapiens
gccctgctgccctcccc

SEQ ID NO: 3532994 - DNA, 21 bp, Homo sapiens
gccctggggcccctcccctcc

SEQ ID NO: 3532995 - DNA, 24 bp, Homo sapiens
gccgtatctgagggctgctcccct

SEQ ID NO: 3532996 - DNA, 16 bp, Homo sapiens
gcctgactgccaagcc

SEQ ID NO: 3532997 - DNA, 18 bp, Homo sapiens
gcctgcttttgtgtccca

SEQ ID NO: 3532998 - DNA, 14 bp, Homo sapiens
gcctggaggctcag

SEQ ID NO: 3532999 - DNA, 19 bp, Homo sapiens
gcctggaggctcagcccac

SEQ ID NO: 3533000 - DNA, 15 bp, Homo sapiens
gcgaattcagaaaga

SEQ ID NO: 3533001 - DNA, 20 bp, Homo sapiens
gcgcagaggcttttccagtg

SEQ ID NO: 3533002 - DNA, 18 bp, Homo sapiens
gcgggagggagtctcagg

SEQ ID NO: 3533003 - DNA, 12 bp, Homo sapiens
gcgggcacagcc

SEQ ID NO: 3533004 - DNA, 14 bp, Homo sapiens
gcgggcacagccag

SEQ ID NO: 3533005 - DNA, 23 bp, Homo sapiens
gcgtgtgggaggctggggaccca

SEQ ID NO: 3533006 - DNA, 13 bp, Homo sapiens
gcgttactgtaga

SEQ ID NO: 3533007 - DNA, 17 bp, Homo sapiens
gctaatatttttaacaa

SEQ ID NO: 3533008 - DNA, 20 bp, Homo sapiens
gctaatgtgaatgtgagtga

SEQ ID NO: 3533009 - DNA, 15 bp, Homo sapiens
gctaccaatctgtga

SEQ ID NO: 3533010 - DNA, 15 bp, Homo sapiens
gctacctgatttcag

SEQ ID NO: 3533011 - DNA, 21 bp, Homo sapiens
gctatctctcaagagtgctga

SEQ ID NO: 3533012 - DNA, 22 bp, Homo sapiens
gctccaggatgcattctgatag

SEQ ID NO: 3533013 - DNA, 16 bp, Homo sapiens
gctcccttcaggcccg

SEQ ID NO: 3533014 - DNA, 19 bp, Homo sapiens
gctcccttcaggcccgctg

SEQ ID NO: 3533015 - DNA, 21 bp, Homo sapiens
gctcgggtctccctcctgcag

SEQ ID NO: 3533016 - DNA, 21 bp, Homo sapiens
gctcggttaagtacccgaggc

SEQ ID NO: 3533017 - DNA, 18 bp, Homo sapiens
gctctaagcagccaggag

SEQ ID NO: 3533018 - DNA, 22 bp, Homo sapiens
gctctaagcagccaggagggac

SEQ ID NO: 3533019 - DNA, 14 bp, Homo sapiens
gctctgaccctggg

SEQ ID NO: 3533020 - DNA, 23 bp, Homo sapiens
gctcttggggttcataggggcag

SEQ ID NO: 3533021 - DNA, 24 bp, Homo sapiens
gctcttggggttcataggggcagg

SEQ ID NO: 3533022 - DNA, 20 bp, Homo sapiens
gctgacttcccaagccctgg

SEQ ID NO: 3533023 - DNA, 16 bp, Homo sapiens
gctgagaagaggagga

SEQ ID NO: 3533024 - DNA, 13 bp, Homo sapiens
gctgatctctgta

SEQ ID NO: 3533025 - DNA, 12 bp, Homo sapiens
gctgcaggaggg

SEQ ID NO: 3533026 - DNA, 15 bp, Homo sapiens
gctgcaggagggcac

SEQ ID NO: 3533027 - DNA, 15 bp, Homo sapiens
gctgcccccagagcc

SEQ ID NO: 3533028 - DNA, 17 bp, Homo sapiens
gctgccctgaggggctg

SEQ ID NO: 3533029 - DNA, 23 bp, Homo sapiens
gctgccctgaggggctggggagg

SEQ ID NO: 3533030 - DNA, 19 bp, Homo sapiens
gctgctctaggcccacaag

SEQ ID NO: 3533031 - DNA, 23 bp, Homo sapiens
gctggagaccgaggccagaaggc

SEQ ID NO: 3533032 - DNA, 14 bp, Homo sapiens
gctggaggtgctgg

SEQ ID NO: 3533033 - DNA, 21 bp, Homo sapiens
gctggcccccccagccccaca

SEQ ID NO: 3533034 - DNA, 13 bp, Homo sapiens
gctggcctggagg

SEQ ID NO: 3533035 - DNA, 15 bp, Homo sapiens
gctggcctggaggct

SEQ ID NO: 3533036 - DNA, 16 bp, Homo sapiens
gctggggacccagact

SEQ ID NO: 3533037 - DNA, 15 bp, Homo sapiens
gctggggagggggta

SEQ ID NO: 3533038 - DNA, 19 bp, Homo sapiens
gctgtctcagacgactagc

SEQ ID NO: 3533039 - DNA, 19 bp, Homo sapiens
gctgttaacagctgtcaat

SEQ ID NO: 3533040 - DNA, 15 bp, Homo sapiens
gctgttagaatatgt

SEQ ID NO: 3533041 - DNA, 17 bp, Homo sapiens
gctgttgttttaacgag

SEQ ID NO: 3533042 - DNA, 18 bp, Homo sapiens
gcttcactctatccaaag

SEQ ID NO: 3533043 - DNA, 22 bp, Homo sapiens
gcttcactctccctgacggctg

SEQ ID NO: 3533044 - DNA, 17 bp, Homo sapiens
gcttcatagagacttgg

SEQ ID NO: 3533045 - DNA, 23 bp, Homo sapiens
gcttgctaccaatctgtgagaag

SEQ ID NO: 3533046 - DNA, 18 bp, Homo sapiens
gctttgccctgctgccct

SEQ ID NO: 3533047 - DNA, 23 bp, Homo sapiens
gctttgccctgctgccctccccc

SEQ ID NO: 3533048 - DNA, 21 bp, Homo sapiens
gcttttatcagtgttaaagtg

SEQ ID NO: 3533049 - DNA, 12 bp, Homo sapiens
gcttttccagtg

SEQ ID NO: 3533050 - DNA, 13 bp, Homo sapiens
gcttttccagtgt

SEQ ID NO: 3533051 - DNA, 15 bp, Homo sapiens
gcttttccagtgtgt

SEQ ID NO: 3533052 - DNA, 15 bp, Homo sapiens
gcttttgtgtcccat

SEQ ID NO: 3533053 - DNA, 16 bp, Homo sapiens
gcttttgttctgaggg

SEQ ID NO: 3533054 - DNA, 18 bp, Homo sapiens
ggaaaagaagctgtcaga

SEQ ID NO: 3533055 - DNA, 16 bp, Homo sapiens
ggaaaccgaaactgac

SEQ ID NO: 3533056 - DNA, 14 bp, Homo sapiens
ggaaagaatttgta

SEQ ID NO: 3533057 - DNA, 15 bp, Homo sapiens
ggaagtcctgggagg

SEQ ID NO: 3533058 - DNA, 17 bp, Homo sapiens
ggaatgagctgaaggtg

SEQ ID NO: 3533059 - DNA, 13 bp, Homo sapiens
ggaatgcttctgc

SEQ ID NO: 3533060 - DNA, 19 bp, Homo sapiens
ggacacgaaggctgcccct

SEQ ID NO: 3533061 - DNA, 17 bp, Homo sapiens
ggaccaaagggggagtc

SEQ ID NO: 3533062 - DNA, 23 bp, Homo sapiens
ggacctgcatctaagcatctggg

SEQ ID NO: 3533063 - DNA, 14 bp, Homo sapiens
ggacgtgggccctg

SEQ ID NO: 3533064 - DNA, 19 bp, Homo sapiens
ggagaaaagacaaatgtgc

SEQ ID NO: 3533065 - DNA, 23 bp, Homo sapiens
ggagagaatgattttgctgactt

SEQ ID NO: 3533066 - DNA, 16 bp, Homo sapiens
ggagcaacaatcagac

SEQ ID NO: 3533067 - DNA, 15 bp, Homo sapiens
ggagcagagaggtgg

SEQ ID NO: 3533068 - DNA, 16 bp, Homo sapiens
ggagcagagaggtggc

SEQ ID NO: 3533069 - DNA, 21 bp, Homo sapiens
ggagctgagaagaggaggagg

SEQ ID NO: 3533070 - DNA, 13 bp, Homo sapiens
ggaggagaccagc

SEQ ID NO: 3533071 - DNA, 21 bp, Homo sapiens
ggaggaggctgccctgagggg

SEQ ID NO: 3533072 - DNA, 19 bp, Homo sapiens
ggaggcagagcgggaggga

SEQ ID NO: 3533073 - DNA, 21 bp, Homo sapiens
ggaggcagagcgggagggagt

SEQ ID NO: 3533074 - DNA, 14 bp, Homo sapiens
ggaggctgccctga

SEQ ID NO: 3533075 - DNA, 17 bp, Homo sapiens
ggaggctgccctgaggg

SEQ ID NO: 3533076 - DNA, 17 bp, Homo sapiens
ggaggctggggacccag

SEQ ID NO: 3533077 - DNA, 17 bp, Homo sapiens
ggagggaggagggcgtg

SEQ ID NO: 3533078 - DNA, 14 bp, Homo sapiens
ggagggcaccatct

SEQ ID NO: 3533079 - DNA, 17 bp, Homo sapiens
ggagggcactggagctg

SEQ ID NO: 3533080 - DNA, 18 bp, Homo sapiens
ggaggggccggctggcct

SEQ ID NO: 3533081 - DNA, 20 bp, Homo sapiens
ggagggtttcattgtctgtg

SEQ ID NO: 3533082 - DNA, 14 bp, Homo sapiens
ggagtctcaggagg

SEQ ID NO: 3533083 - DNA, 18 bp, Homo sapiens
ggagtctcaggaggaggc

SEQ ID NO: 3533084 - DNA, 23 bp, Homo sapiens
ggagtcttctaatgtaaatttta

SEQ ID NO: 3533085 - DNA, 18 bp, Homo sapiens
ggatcaagttcagccacc

SEQ ID NO: 3533086 - DNA, 19 bp, Homo sapiens
ggatcaagttcagccaccg

SEQ ID NO: 3533087 - DNA, 16 bp, Homo sapiens
ggatgatccccacgcc

SEQ ID NO: 3533088 - DNA, 22 bp, Homo sapiens
ggatgatccccacgccacagcc

SEQ ID NO: 3533089 - DNA, 19 bp, Homo sapiens
ggcaagtgagaggggaggg

SEQ ID NO: 3533090 - DNA, 22 bp, Homo sapiens
ggcaagtgagaggggagggagg

SEQ ID NO: 3533091 - DNA, 13 bp, Homo sapiens
ggcacagccagcc

SEQ ID NO: 3533092 - DNA, 16 bp, Homo sapiens
ggcacagccagcccaa

SEQ ID NO: 3533093 - DNA, 20 bp, Homo sapiens
ggcaccatcttacagagact

SEQ ID NO: 3533094 - DNA, 15 bp, Homo sapiens
ggcagggctgggcct

SEQ ID NO: 3533095 - DNA, 14 bp, Homo sapiens
ggcagtgccagcca

SEQ ID NO: 3533096 - DNA, 15 bp, Homo sapiens
ggcagtgccagccaa

SEQ ID NO: 3533097 - DNA, 12 bp, Homo sapiens
ggcagtggccac

SEQ ID NO: 3533098 - DNA, 17 bp, Homo sapiens
ggccagggaggcagagc

SEQ ID NO: 3533099 - DNA, 21 bp, Homo sapiens
ggccagggaggcagagcggga

SEQ ID NO: 3533100 - DNA, 13 bp, Homo sapiens
ggccatgggaggc

SEQ ID NO: 3533101 - DNA, 15 bp, Homo sapiens
ggcccccccagcccc

SEQ ID NO: 3533102 - DNA, 22 bp, Homo sapiens
ggcccccccagccccacaccct

SEQ ID NO: 3533103 - DNA, 18 bp, Homo sapiens
ggcccctttgctgaccct

SEQ ID NO: 3533104 - DNA, 15 bp, Homo sapiens
ggcccgcgggcacag

SEQ ID NO: 3533105 - DNA, 20 bp, Homo sapiens
ggcccgcgggcacagccagc

SEQ ID NO: 3533106 - DNA, 21 bp, Homo sapiens
ggccctgactgtcagggaggg

SEQ ID NO: 3533107 - DNA, 14 bp, Homo sapiens
ggccctgcaggctg

SEQ ID NO: 3533108 - DNA, 13 bp, Homo sapiens
ggccggctggcct

SEQ ID NO: 3533109 - DNA, 21 bp, Homo sapiens
ggccggctggcctggaggctc

SEQ ID NO: 3533110 - DNA, 18 bp, Homo sapiens
ggccgtatctgagggctg

SEQ ID NO: 3533111 - DNA, 13 bp, Homo sapiens
ggcctagaggcct

SEQ ID NO: 3533112 - DNA, 14 bp, Homo sapiens
ggcctagaggcctg

SEQ ID NO: 3533113 - DNA, 17 bp, Homo sapiens
ggcctgactgccaagcc

SEQ ID NO: 3533114 - DNA, 20 bp, Homo sapiens
ggcctgactgccaagccatg

SEQ ID NO: 3533115 - DNA, 13 bp, Homo sapiens
ggcctggaggctc

SEQ ID NO: 3533116 - DNA, 15 bp, Homo sapiens
ggcggcagggctggg

SEQ ID NO: 3533117 - DNA, 16 bp, Homo sapiens
ggctgcaggagggcac

SEQ ID NO: 3533118 - DNA, 20 bp, Homo sapiens
ggctgccattggtccaccct

SEQ ID NO: 3533119 - DNA, 14 bp, Homo sapiens
ggctgccctgaggg

SEQ ID NO: 3533120 - DNA, 13 bp, Homo sapiens
ggctgctcccctt

SEQ ID NO: 3533121 - DNA, 22 bp, Homo sapiens
ggctgctgccctgctgtggaag

SEQ ID NO: 3533122 - DNA, 15 bp, Homo sapiens
ggctggagaccgagg

SEQ ID NO: 3533123 - DNA, 15 bp, Homo sapiens
ggctggcctggaggc

SEQ ID NO: 3533124 - DNA, 12 bp, Homo sapiens
ggctggggaggg

SEQ ID NO: 3533125 - DNA, 19 bp, Homo sapiens
ggctgttggcgtgtcccag

SEQ ID NO: 3533126 - DNA, 19 bp, Homo sapiens
ggcttaattcccccaagca

SEQ ID NO: 3533127 - DNA, 17 bp, Homo sapiens
ggctttcacgggcccca

SEQ ID NO: 3533128 - DNA, 17 bp, Homo sapiens
ggctttccttgttttga

SEQ ID NO: 3533129 - DNA, 14 bp, Homo sapiens
ggctttcggggagg

SEQ ID NO: 3533130 - DNA, 16 bp, Homo sapiens
ggctttcggggagggc

SEQ ID NO: 3533131 - DNA, 12 bp, Homo sapiens
ggcttttccagt

SEQ ID NO: 3533132 - DNA, 19 bp, Homo sapiens
gggaagagggttaggaggg

SEQ ID NO: 3533133 - DNA, 13 bp, Homo sapiens
gggaaggggtgca

SEQ ID NO: 3533134 - DNA, 16 bp, Homo sapiens
gggacaccgtggggaa

SEQ ID NO: 3533135 - DNA, 19 bp, Homo sapiens
gggacaccgtggggaaggg

SEQ ID NO: 3533136 - DNA, 11 bp, Homo sapiens
gggacccagcg

SEQ ID NO: 3533137 - DNA, 19 bp, Homo sapiens
gggacgggcaagtgagagg

SEQ ID NO: 3533138 - DNA, 23 bp, Homo sapiens
gggacgggcaagtgagaggggag

SEQ ID NO: 3533139 - DNA, 24 bp, Homo sapiens
gggacgggcaagtgagaggggagg

SEQ ID NO: 3533140 - DNA, 11 bp, Homo sapiens
gggagggaggg

SEQ ID NO: 3533141 - DNA, 21 bp, Homo sapiens
gggagggccagggaggcagag

SEQ ID NO: 3533142 - DNA, 19 bp, Homo sapiens
gggagtctcaggaggaggc

SEQ ID NO: 3533143 - DNA, 18 bp, Homo sapiens
gggcaagtgagaggggag

SEQ ID NO: 3533144 - DNA, 17 bp, Homo sapiens
gggcacagccagcccaa

SEQ ID NO: 3533145 - DNA, 20 bp, Homo sapiens
gggcactggagctgggaggt

SEQ ID NO: 3533146 - DNA, 22 bp, Homo sapiens
gggcaggtcctagtcgggcagg

SEQ ID NO: 3533147 - DNA, 15 bp, Homo sapiens
gggcatgggcgcaga

SEQ ID NO: 3533148 - DNA, 21 bp, Homo sapiens
gggccagggaggcagagcggg

SEQ ID NO: 3533149 - DNA, 23 bp, Homo sapiens
gggccagggaggcagagcgggag

SEQ ID NO: 3533150 - DNA, 21 bp, Homo sapiens
gggcccagcataattcctcca

SEQ ID NO: 3533151 - DNA, 22 bp, Homo sapiens
gggcccagggacacccacacag

SEQ ID NO: 3533152 - DNA, 22 bp, Homo sapiens
gggccccaggcccgcgggcaca

SEQ ID NO: 3533153 - DNA, 23 bp, Homo sapiens
gggccccaggcccgcgggcacag

SEQ ID NO: 3533154 - DNA, 15 bp, Homo sapiens
gggcccctgaccctc

SEQ ID NO: 3533155 - DNA, 22 bp, Homo sapiens
gggccctgcaggctgcaggagg

SEQ ID NO: 3533156 - DNA, 18 bp, Homo sapiens
gggctttcacgggcccca

SEQ ID NO: 3533157 - DNA, 16 bp, Homo sapiens
gggctttcggggaggg

SEQ ID NO: 3533158 - DNA, 18 bp, Homo sapiens
gggctttcggggagggcg

SEQ ID NO: 3533159 - DNA, 19 bp, Homo sapiens
gggctttcggggagggcgc

SEQ ID NO: 3533160 - DNA, 20 bp, Homo sapiens
gggcttttgttctgaggggt

SEQ ID NO: 3533161 - DNA, 14 bp, Homo sapiens
ggggaagggcaggc

SEQ ID NO: 3533162 - DNA, 11 bp, Homo sapiens
ggggacccagc

SEQ ID NO: 3533163 - DNA, 12 bp, Homo sapiens
ggggacccagcg

SEQ ID NO: 3533164 - DNA, 23 bp, Homo sapiens
ggggacccagcgccggggggagg

SEQ ID NO: 3533165 - DNA, 17 bp, Homo sapiens
ggggacgtgggccctgc

SEQ ID NO: 3533166 - DNA, 11 bp, Homo sapiens
ggggagggagg

SEQ ID NO: 3533167 - DNA, 12 bp, Homo sapiens
ggggagggaggg

SEQ ID NO: 3533168 - DNA, 15 bp, Homo sapiens
ggggcccctcccctc

SEQ ID NO: 3533169 - DNA, 22 bp, Homo sapiens
ggggccggctggcctggaggct

SEQ ID NO: 3533170 - DNA, 10 bp, Homo sapiens
ggggctgctg

SEQ ID NO: 3533171 - DNA, 14 bp, Homo sapiens
ggggctgtctcaga

SEQ ID NO: 3533172 - DNA, 19 bp, Homo sapiens
gggggctttcggggagggc

SEQ ID NO: 3533173 - DNA, 17 bp, Homo sapiens
ggggttcataggggcag

SEQ ID NO: 3533174 - DNA, 12 bp, Homo sapiens
gggtgcaggtgg

SEQ ID NO: 3533175 - DNA, 19 bp, Homo sapiens
gggttctctgctgtcctaa

SEQ ID NO: 3533176 - DNA, 15 bp, Homo sapiens
ggtccaagattctgg

SEQ ID NO: 3533177 - DNA, 23 bp, Homo sapiens
ggtccaccctttcatagagaggc

SEQ ID NO: 3533178 - DNA, 19 bp, Homo sapiens
ggtgaaaataagaaagaat

SEQ ID NO: 3533179 - DNA, 19 bp, Homo sapiens
ggtgaaacattttctccct

SEQ ID NO: 3533180 - DNA, 12 bp, Homo sapiens
ggtgaaaccaaa

SEQ ID NO: 3533181 - DNA, 16 bp, Homo sapiens
ggtgaaagtgctgctc

SEQ ID NO: 3533182 - DNA, 20 bp, Homo sapiens
ggtggccaccgggggtggct

SEQ ID NO: 3533183 - DNA, 11 bp, Homo sapiens
ggtggccctga

SEQ ID NO: 3533184 - DNA, 23 bp, Homo sapiens
ggtggccctgactgtcagggagg

SEQ ID NO: 3533185 - DNA, 15 bp, Homo sapiens
ggtgggggctggagg

SEQ ID NO: 3533186 - DNA, 18 bp, Homo sapiens
ggtggggtgatggccaga

SEQ ID NO: 3533187 - DNA, 22 bp, Homo sapiens
ggttaggagggtttcattgtct

SEQ ID NO: 3533188 - DNA, 21 bp, Homo sapiens
gtaaatctttgtgaacattct

SEQ ID NO: 3533189 - DNA, 12 bp, Homo sapiens
gtaaattttaat

SEQ ID NO: 3533190 - DNA, 17 bp, Homo sapiens
gtaatgtatacttgaaa

SEQ ID NO: 3533191 - DNA, 12 bp, Homo sapiens
gtaattaaattt

SEQ ID NO: 3533192 - DNA, 21 bp, Homo sapiens
gtaatttgggaaaagaagctg

SEQ ID NO: 3533193 - DNA, 22 bp, Homo sapiens
gtactcataaaggacactggat

SEQ ID NO: 3533194 - DNA, 15 bp, Homo sapiens
gtaggaaagaatttg

SEQ ID NO: 3533195 - DNA, 18 bp, Homo sapiens
gtagtggggaagagggtt

SEQ ID NO: 3533196 - DNA, 13 bp, Homo sapiens
gtatgtgtgtgtg

SEQ ID NO: 3533197 - DNA, 17 bp, Homo sapiens
gtcagccatcagccatg

SEQ ID NO: 3533198 - DNA, 12 bp, Homo sapiens
gtcatctgtagg

SEQ ID NO: 3533199 - DNA, 23 bp, Homo sapiens
gtccaccctttcatagagaggcc

SEQ ID NO: 3533200 - DNA, 17 bp, Homo sapiens
gtccatgggtctggcct

SEQ ID NO: 3533201 - DNA, 18 bp, Homo sapiens
gtccatgggtctggcctg

SEQ ID NO: 3533202 - DNA, 23 bp, Homo sapiens
gtccctgagctcttgctatctct

SEQ ID NO: 3533203 - DNA, 16 bp, Homo sapiens
gtcctagtcgggcagg

SEQ ID NO: 3533204 - DNA, 22 bp, Homo sapiens
gtctcagacgactagcccagga

SEQ ID NO: 3533205 - DNA, 14 bp, Homo sapiens
gtctcaggaggagg

SEQ ID NO: 3533206 - DNA, 13 bp, Homo sapiens
gtctctagcagtg

SEQ ID NO: 3533207 - DNA, 20 bp, Homo sapiens
gtctcttgtgactcagcaga

SEQ ID NO: 3533208 - DNA, 23 bp, Homo sapiens
gtctcttgtgactcagcagaggc

SEQ ID NO: 3533209 - DNA, 13 bp, Homo sapiens
gtctgaactgctt

SEQ ID NO: 3533210 - DNA, 14 bp, Homo sapiens
gtctgaatctccca

SEQ ID NO: 3533211 - DNA, 13 bp, Homo sapiens
gtctgaattttag

SEQ ID NO: 3533212 - DNA, 22 bp, Homo sapiens
gtctgtgaagtgagaccttcct

SEQ ID NO: 3533213 - DNA, 17 bp, Homo sapiens
gtcttctaatgtaaatt

SEQ ID NO: 3533214 - DNA, 16 bp, Homo sapiens
gtctttaaaagatata

SEQ ID NO: 3533215 - DNA, 20 bp, Homo sapiens
gtctttattagtaacatcat

SEQ ID NO: 3533216 - DNA, 18 bp, Homo sapiens
gtgaaaataagaaagaat

SEQ ID NO: 3533217 - DNA, 23 bp, Homo sapiens
gtgaaaataagaaagaattgcag

SEQ ID NO: 3533218 - DNA, 15 bp, Homo sapiens
gtgaaacattttctc

SEQ ID NO: 3533219 - DNA, 13 bp, Homo sapiens
gtgaaagtgctgc

SEQ ID NO: 3533220 - DNA, 12 bp, Homo sapiens
gtgaacattctg

SEQ ID NO: 3533221 - DNA, 11 bp, Homo sapiens
gtgaatgtgag

SEQ ID NO: 3533222 - DNA, 16 bp, Homo sapiens
gtgaccagaccaaggc

SEQ ID NO: 3533223 - DNA, 19 bp, Homo sapiens
gtgaccttgggaccaaagg

SEQ ID NO: 3533224 - DNA, 16 bp, Homo sapiens
gtgactcagcagaggc

SEQ ID NO: 3533225 - DNA, 18 bp, Homo sapiens
gtgactcagcagaggcag

SEQ ID NO: 3533226 - DNA, 18 bp, Homo sapiens
gtgagaggggagggaggg

SEQ ID NO: 3533227 - DNA, 23 bp, Homo sapiens
gtgagtctccccttgcagcctgg

SEQ ID NO: 3533228 - DNA, 14 bp, Homo sapiens
gtgcattaaaatta

SEQ ID NO: 3533229 - DNA, 13 bp, Homo sapiens
gtgctctgaccct

SEQ ID NO: 3533230 - DNA, 17 bp, Homo sapiens
gtggacggcgctgcctc

SEQ ID NO: 3533231 - DNA, 20 bp, Homo sapiens
gtggagctgagaagaggagg

SEQ ID NO: 3533232 - DNA, 23 bp, Homo sapiens
gtggatgatccccacgccacagc

SEQ ID NO: 3533233 - DNA, 22 bp, Homo sapiens
gtggccacgttcagggaggggc

SEQ ID NO: 3533234 - DNA, 22 bp, Homo sapiens
gtggccatcacagccccatgga

SEQ ID NO: 3533235 - DNA, 23 bp, Homo sapiens
gtggccatcacagccccatggac

SEQ ID NO: 3533236 - DNA, 16 bp, Homo sapiens
gtggctcatcggtgga

SEQ ID NO: 3533237 - DNA, 20 bp, Homo sapiens
gtgggaggctggggacccag

SEQ ID NO: 3533238 - DNA, 11 bp, Homo sapiens
gtgggcccagg

SEQ ID NO: 3533239 - DNA, 15 bp, Homo sapiens
gtgggccctgcaggc

SEQ ID NO: 3533240 - DNA, 18 bp, Homo sapiens
gtgggccctgcaggctgc

SEQ ID NO: 3533241 - DNA, 23 bp, Homo sapiens
gtggggagaaaagacaaatgtgc

SEQ ID NO: 3533242 - DNA, 13 bp, Homo sapiens
gtggtgttacatt

SEQ ID NO: 3533243 - DNA, 23 bp, Homo sapiens
gtgtaatgactgagatttgtaaa

SEQ ID NO: 3533244 - DNA, 19 bp, Homo sapiens
gtgtatacacttaaacttg

SEQ ID NO: 3533245 - DNA, 14 bp, Homo sapiens
gtgtatctcacact

SEQ ID NO: 3533246 - DNA, 16 bp, Homo sapiens
gtgtatgtgtgtgtgt

SEQ ID NO: 3533247 - DNA, 13 bp, Homo sapiens
gttaactttcaaa

SEQ ID NO: 3533248 - DNA, 12 bp, Homo sapiens
gttacatttatg

SEQ ID NO: 3533249 - DNA, 13 bp, Homo sapiens
gttacttcccttt

SEQ ID NO: 3533250 - DNA, 13 bp, Homo sapiens
gttatttattgac

SEQ ID NO: 3533251 - DNA, 13 bp, Homo sapiens
gttcagggagggg

SEQ ID NO: 3533252 - DNA, 22 bp, Homo sapiens
gttcttagattcaggggaaggg

SEQ ID NO: 3533253 - DNA, 16 bp, Homo sapiens
gttgccagttgtcctc

SEQ ID NO: 3533254 - DNA, 23 bp, Homo sapiens
gttgttaaaacacaaaatgaata

SEQ ID NO: 3533255 - DNA, 19 bp, Homo sapiens
gttgttgacagtgaggaaa

SEQ ID NO: 3533256 - DNA, 23 bp, Homo sapiens
gtttaattagatttctgaatctc

SEQ ID NO: 3533257 - DNA, 22 bp, Homo sapiens
gtttcaatgcatacaataaaag

SEQ ID NO: 3533258 - DNA, 14 bp, Homo sapiens
gtttcttcccccca

SEQ ID NO: 3533259 - DNA, 22 bp, Homo sapiens
gtttgggttctctgctgtccta

SEQ ID NO: 3533260 - DNA, 20 bp, Homo sapiens
gttttcacagtcaccaagtg

SEQ ID NO: 3533261 - DNA, 14 bp, Homo sapiens
taaaaacagaaaat

SEQ ID NO: 3533262 - DNA, 16 bp, Homo sapiens
taaaacacaaaatgaa

SEQ ID NO: 3533263 - DNA, 13 bp, Homo sapiens
taaaacctggaga

SEQ ID NO: 3533264 - DNA, 13 bp, Homo sapiens
taaaagagcttta

SEQ ID NO: 3533265 - DNA, 15 bp, Homo sapiens
taaaattaaatactt

SEQ ID NO: 3533266 - DNA, 14 bp, Homo sapiens
taaagatgggagga

SEQ ID NO: 3533267 - DNA, 17 bp, Homo sapiens
taaagatgggaggagac

SEQ ID NO: 3533268 - DNA, 14 bp, Homo sapiens
taaagtaggaaaga

SEQ ID NO: 3533269 - DNA, 16 bp, Homo sapiens
taaagtggtctgaact

SEQ ID NO: 3533270 - DNA, 19 bp, Homo sapiens
taaatctttgtgaacattc

SEQ ID NO: 3533271 - DNA, 21 bp, Homo sapiens
taaattcaatgcttgatgtta

SEQ ID NO: 3533272 - DNA, 20 bp, Homo sapiens
taaattttaatgttaacttt

SEQ ID NO: 3533273 - DNA, 17 bp, Homo sapiens
taaatttttaaaatctg

SEQ ID NO: 3533274 - DNA, 22 bp, Homo sapiens
taacatatttattgtgcattaa

SEQ ID NO: 3533275 - DNA, 18 bp, Homo sapiens
taacgttttccttgtgac

SEQ ID NO: 3533276 - DNA, 19 bp, Homo sapiens
taacgttttccttgtgact

SEQ ID NO: 3533277 - DNA, 22 bp, Homo sapiens
taactcttagactgagtaaagt

SEQ ID NO: 3533278 - DNA, 15 bp, Homo sapiens
taactgttgttgaca

SEQ ID NO: 3533279 - DNA, 20 bp, Homo sapiens
taacttacaaactggtttga

SEQ ID NO: 3533280 - DNA, 19 bp, Homo sapiens
taagaggattcaacacctt

SEQ ID NO: 3533281 - DNA, 22 bp, Homo sapiens
taagaggattcaacacctttgt

SEQ ID NO: 3533282 - DNA, 20 bp, Homo sapiens
taagattattgtctgattga

SEQ ID NO: 3533283 - DNA, 16 bp, Homo sapiens
taagcagccaggaggg

SEQ ID NO: 3533284 - DNA, 22 bp, Homo sapiens
taagccagctgcccccagagcc

SEQ ID NO: 3533285 - DNA, 23 bp, Homo sapiens
taagtatctcaacaacatgtcaa

SEQ ID NO: 3533286 - DNA, 23 bp, Homo sapiens
taataccatacccagatgtttta

SEQ ID NO: 3533287 - DNA, 23 bp, Homo sapiens
taatataagtgaacaactggaaa

SEQ ID NO: 3533288 - DNA, 15 bp, Homo sapiens
taattaaaaaatcaa

SEQ ID NO: 3533289 - DNA, 17 bp, Homo sapiens
taattaaaaacagaaaa

SEQ ID NO: 3533290 - DNA, 19 bp, Homo sapiens
taattttggttgtaattaa

SEQ ID NO: 3533291 - DNA, 22 bp, Homo sapiens
taattttggttgtaattaaatt

SEQ ID NO: 3533292 - DNA, 22 bp, Homo sapiens
tacaaactatttcagaatattt

SEQ ID NO: 3533293 - DNA, 18 bp, Homo sapiens
tacaaatgaagtatttca

SEQ ID NO: 3533294 - DNA, 14 bp, Homo sapiens
tacaataaaagagc

SEQ ID NO: 3533295 - DNA, 15 bp, Homo sapiens
tacaccaaacatttc

SEQ ID NO: 3533296 - DNA, 23 bp, Homo sapiens
tacacctccactcagcactctgg

SEQ ID NO: 3533297 - DNA, 21 bp, Homo sapiens
tacacttaaacttgcacattt

SEQ ID NO: 3533298 - DNA, 17 bp, Homo sapiens
tacatttatgtgctgtt

SEQ ID NO: 3533299 - DNA, 16 bp, Homo sapiens
tacattttcttgtcca

SEQ ID NO: 3533300 - DNA, 21 bp, Homo sapiens
tacccagatgttttatttatg

SEQ ID NO: 3533301 - DNA, 16 bp, Homo sapiens
tacctctgcttctgac

SEQ ID NO: 3533302 - DNA, 23 bp, Homo sapiens
tacctcttccgttggaaagaaca

SEQ ID NO: 3533303 - DNA, 14 bp, Homo sapiens
tacctgatttcagc

SEQ ID NO: 3533304 - DNA, 22 bp, Homo sapiens
tactcataaaggacactggatc

SEQ ID NO: 3533305 - DNA, 18 bp, Homo sapiens
tactgaaaaaatgctgag

SEQ ID NO: 3533306 - DNA, 12 bp, Homo sapiens
tacttctgctgt

SEQ ID NO: 3533307 - DNA, 21 bp, Homo sapiens
tacttctgctgtgggaaaaat

SEQ ID NO: 3533308 - DNA, 21 bp, Homo sapiens
tacttttcttctattgcctct

SEQ ID NO: 3533309 - DNA, 15 bp, Homo sapiens
tagaccaccaagcct

SEQ ID NO: 3533310 - DNA, 16 bp, Homo sapiens
tagacgatcacagaaa

SEQ ID NO: 3533311 - DNA, 17 bp, Homo sapiens
tagaggcttgatgatga

SEQ ID NO: 3533312 - DNA, 16 bp, Homo sapiens
tagagtgctctgaccc

SEQ ID NO: 3533313 - DNA, 21 bp, Homo sapiens
tagattcaggggaagggcagg

SEQ ID NO: 3533314 - DNA, 18 bp, Homo sapiens
tagcagaaatatattatg

SEQ ID NO: 3533315 - DNA, 18 bp, Homo sapiens
tagcatacaccaaacatt

SEQ ID NO: 3533316 - DNA, 20 bp, Homo sapiens
tagcccatcttcctgagcta

SEQ ID NO: 3533317 - DNA, 18 bp, Homo sapiens
taggcaccttaactggag

SEQ ID NO: 3533318 - DNA, 19 bp, Homo sapiens
taggcaccttaactggaga

SEQ ID NO: 3533319 - DNA, 11 bp, Homo sapiens
taggggcaggt

SEQ ID NO: 3533320 - DNA, 17 bp, Homo sapiens
taggtcactctccagca

SEQ ID NO: 3533321 - DNA, 24 bp, Homo sapiens
tagtagcagaaatatattatgaaa

SEQ ID NO: 3533322 - DNA, 14 bp, Homo sapiens
tataaaatttcagg

SEQ ID NO: 3533323 - DNA, 20 bp, Homo sapiens
tataaacccattttggtgca

SEQ ID NO: 3533324 - DNA, 14 bp, Homo sapiens
tataacatatttat

SEQ ID NO: 3533325 - DNA, 14 bp, Homo sapiens
tataacattcaatt

SEQ ID NO: 3533326 - DNA, 19 bp, Homo sapiens
tataattttggttgtaatt

SEQ ID NO: 3533327 - DNA, 12 bp, Homo sapiens
tatattatgaaa

SEQ ID NO: 3533328 - DNA, 19 bp, Homo sapiens
tatattatgaaaattaaga

SEQ ID NO: 3533329 - DNA, 16 bp, Homo sapiens
tatcacagagccactc

SEQ ID NO: 3533330 - DNA, 18 bp, Homo sapiens
tatcacagagccactctt

SEQ ID NO: 3533331 - DNA, 22 bp, Homo sapiens
tatgtctctagcagtgagtact

SEQ ID NO: 3533332 - DNA, 16 bp, Homo sapiens
tatgttttcacagtca

SEQ ID NO: 3533333 - DNA, 20 bp, Homo sapiens
tattaactaggtatgaagta

SEQ ID NO: 3533334 - DNA, 20 bp, Homo sapiens
tattccaataccctagaaga

SEQ ID NO: 3533335 - DNA, 20 bp, Homo sapiens
tattgacacacccaaggggc

SEQ ID NO: 3533336 - DNA, 22 bp, Homo sapiens
tattgtctgattgaaacatgaa

SEQ ID NO: 3533337 - DNA, 19 bp, Homo sapiens
tatttacaaatgaagtatt

SEQ ID NO: 3533338 - DNA, 13 bp, Homo sapiens
tattttaaacatt

SEQ ID NO: 3533339 - DNA, 18 bp, Homo sapiens
tcaaatccactagtattt

SEQ ID NO: 3533340 - DNA, 23 bp, Homo sapiens
tcaaggagtcttctaatgtaaat

SEQ ID NO: 3533341 - DNA, 15 bp, Homo sapiens
tcaagttcagccacc

SEQ ID NO: 3533342 - DNA, 22 bp, Homo sapiens
tcaatgcatacaataaaagagc

SEQ ID NO: 3533343 - DNA, 14 bp, Homo sapiens
tcaatgcttgatgt

SEQ ID NO: 3533344 - DNA, 15 bp, Homo sapiens
tcaatgcttgatgtt

SEQ ID NO: 3533345 - DNA, 20 bp, Homo sapiens
tgaagtatttcatgtaatat

SEQ ID NO: 3533346 - DNA, 15 bp, Homo sapiens
tgaatactcctgtta

SEQ ID NO: 3533347 - DNA, 22 bp, Homo sapiens
tgaatctcgttgaggccaagga

SEQ ID NO: 3533348 - DNA, 20 bp, Homo sapiens
tgaatgaagctaatgtgaat

SEQ ID NO: 3533349 - DNA, 16 bp, Homo sapiens
tgaatgactgacccaa

SEQ ID NO: 3533350 - DNA, 23 bp, Homo sapiens
tgaatgactgacccaaaatgtga

SEQ ID NO: 3533351 - DNA, 14 bp, Homo sapiens
tgaattcatttgct

SEQ ID NO: 3533352 - DNA, 17 bp, Homo sapiens
tgacacacccaaggggc

SEQ ID NO: 3533353 - DNA, 14 bp, Homo sapiens
tgaccctccccaaa

SEQ ID NO: 3533354 - DNA, 19 bp, Homo sapiens
tgaccgatggtgtttggga

SEQ ID NO: 3533355 - DNA, 21 bp, Homo sapiens
tgaccttgggaccaaaggggg

SEQ ID NO: 3533356 - DNA, 14 bp, Homo sapiens
tgactaagttgcaa

SEQ ID NO: 3533357 - DNA, 16 bp, Homo sapiens
tgactcagcagaggca

SEQ ID NO: 3533358 - DNA, 20 bp, Homo sapiens
tgactgacccaaaatgtgaa

SEQ ID NO: 3533359 - DNA, 16 bp, Homo sapiens
tgactgagatttgtaa

SEQ ID NO: 3533360 - DNA, 23 bp, Homo sapiens
tgacttcccaagccctggtgacc

SEQ ID NO: 3533361 - DNA, 19 bp, Homo sapiens
tgactttggggattctccc

SEQ ID NO: 3533362 - DNA, 17 bp, Homo sapiens
tgagaattacagaaaat

SEQ ID NO: 3533363 - DNA, 20 bp, Homo sapiens
tgagaattacagaaaatttg

SEQ ID NO: 3533364 - DNA, 21 bp, Homo sapiens
tgagagcatcaggcctagagg

SEQ ID NO: 3533365 - DNA, 12 bp, Homo sapiens
tgagaggggagg

SEQ ID NO: 3533366 - DNA, 17 bp, Homo sapiens
tgagatttgtaaatctt

SEQ ID NO: 3533367 - DNA, 15 bp, Homo sapiens
tgagatttttcatgt

SEQ ID NO: 3533368 - DNA, 16 bp, Homo sapiens
tgagatttttcatgta

SEQ ID NO: 3533369 - DNA, 18 bp, Homo sapiens
tgagcctgtgaccttggg

SEQ ID NO: 3533370 - DNA, 13 bp, Homo sapiens
tgaggacaagtta

SEQ ID NO: 3533371 - DNA, 16 bp, Homo sapiens
tgaggaccagggtgga

SEQ ID NO: 3533372 - DNA, 20 bp, Homo sapiens
tgaggaccagggtggagctg

SEQ ID NO: 3533373 - DNA, 16 bp, Homo sapiens
tgaggggacccagcgc

SEQ ID NO: 3533374 - DNA, 17 bp, Homo sapiens
tgaggggctggggaggg

SEQ ID NO: 3533375 - DNA, 22 bp, Homo sapiens
tgaggggtgtccgagaggctgg

SEQ ID NO: 3533376 - DNA, 16 bp, Homo sapiens
tgagtaaagtgttaat

SEQ ID NO: 3533377 - DNA, 23 bp, Homo sapiens
tgagtctgttttcccaacctcct

SEQ ID NO: 3533378 - DNA, 13 bp, Homo sapiens
tgataggaggggg

SEQ ID NO: 3533379 - DNA, 15 bp, Homo sapiens
tgataggagggggcg

SEQ ID NO: 3533380 - DNA, 19 bp, Homo sapiens
tgatagtagtctttaaaag

SEQ ID NO: 3533381 - DNA, 23 bp, Homo sapiens
tgatctcctgtggctcatcggtg

SEQ ID NO: 3533382 - DNA, 17 bp, Homo sapiens
tgatgttacaaggtgtt

SEQ ID NO: 3533383 - DNA, 19 bp, Homo sapiens
tgattccagccatcacctt

SEQ ID NO: 3533384 - DNA, 10 bp, Homo sapiens
tgatttatgg

SEQ ID NO: 3533385 - DNA, 15 bp, Homo sapiens
tgcaatattcttgac

SEQ ID NO: 3533386 - DNA, 17 bp, Homo sapiens
tgcagcagaaaacaaac

SEQ ID NO: 3533387 - DNA, 16 bp, Homo sapiens
tgcaggagggcactgg

SEQ ID NO: 3533388 - DNA, 21 bp, Homo sapiens
tgcaggagggcactggagctg

SEQ ID NO: 3533389 - DNA, 23 bp, Homo sapiens
tgcagtaaagtcttgtctggtga

SEQ ID NO: 3533390 - DNA, 12 bp, Homo sapiens
tgcatacaataa

SEQ ID NO: 3533391 - DNA, 16 bp, Homo sapiens
tgcatacaataaaaga

SEQ ID NO: 3533392 - DNA, 17 bp, Homo sapiens
tgcatacaataaaagag

SEQ ID NO: 3533393 - DNA, 18 bp, Homo sapiens
tgcatacaataaaagagc

SEQ ID NO: 3533394 - DNA, 21 bp, Homo sapiens
tgcatacaataaaagagcttt

SEQ ID NO: 3533395 - DNA, 13 bp, Homo sapiens
tgcatcaaaggag

SEQ ID NO: 3533396 - DNA, 14 bp, Homo sapiens
tgcattaaaattaa

SEQ ID NO: 3533397 - DNA, 16 bp, Homo sapiens
tgcattaaaattaaat

SEQ ID NO: 3533398 - DNA, 20 bp, Homo sapiens
tgcattaaaattaaatactt

SEQ ID NO: 3533399 - DNA, 21 bp, Homo sapiens
tgccaggtgatctcctgtggc

SEQ ID NO: 3533400 - DNA, 15 bp, Homo sapiens
tgccagttgtcctcc

SEQ ID NO: 3533401 - DNA, 19 bp, Homo sapiens
tgccatggcaatggcatgc

SEQ ID NO: 3533402 - DNA, 22 bp, Homo sapiens
tgccctccccctcctctccacc

SEQ ID NO: 3533403 - DNA, 19 bp, Homo sapiens
tgccctgaggggctgggga

SEQ ID NO: 3533404 - DNA, 17 bp, Homo sapiens
tgccctgctgccctccc

SEQ ID NO: 3533405 - DNA, 13 bp, Homo sapiens
tgcctcaggcact

SEQ ID NO: 3533406 - DNA, 16 bp, Homo sapiens
tgcctcaggcactctc

SEQ ID NO: 3533407 - DNA, 20 bp, Homo sapiens
tgcctcaggcactctcctgt

SEQ ID NO: 3533408 - DNA, 15 bp, Homo sapiens
tgcctcggtggccct

SEQ ID NO: 3533409 - DNA, 14 bp, Homo sapiens
tgctaatattttta

SEQ ID NO: 3533410 - DNA, 21 bp, Homo sapiens
tgctaccaatctgtgagaagt

SEQ ID NO: 3533411 - DNA, 19 bp, Homo sapiens
tgctcacctggaacacctg

SEQ ID NO: 3533412 - DNA, 12 bp, Homo sapiens
tgctctgaccct

SEQ ID NO: 3533413 - DNA, 17 bp, Homo sapiens
tgctgagccagccatct

SEQ ID NO: 3533414 - DNA, 14 bp, Homo sapiens
tgctggtagctgag

SEQ ID NO: 3533415 - DNA, 23 bp, Homo sapiens
tgctggtagctgaggggacgggc

SEQ ID NO: 3533416 - DNA, 11 bp, Homo sapiens
tgctgtggaag

SEQ ID NO: 3533417 - DNA, 14 bp, Homo sapiens
tgcttgatgttaca

SEQ ID NO: 3533418 - DNA, 14 bp, Homo sapiens
tggaaagaacattt

SEQ ID NO: 3533419 - DNA, 20 bp, Homo sapiens
tggaaataaagtaggaaaga

SEQ ID NO: 3533420 - DNA, 20 bp, Homo sapiens
tggaaatatacctacctctt

SEQ ID NO: 3533421 - DNA, 17 bp, Homo sapiens
tggacctgggttattta

SEQ ID NO: 3533422 - DNA, 17 bp, Homo sapiens
tggagaccagaaacctt

SEQ ID NO: 3533423 - DNA, 19 bp, Homo sapiens
tggagctgagaagaggagg

SEQ ID NO: 3533424 - DNA, 16 bp, Homo sapiens
tggaggtgctggtagc

SEQ ID NO: 3533425 - DNA, 23 bp, Homo sapiens
tggatctttctccctttctcctc

SEQ ID NO: 3533426 - DNA, 14 bp, Homo sapiens
tggatttttaccag

SEQ ID NO: 3533427 - DNA, 22 bp, Homo sapiens
tggatttttaccagtctcacat

SEQ ID NO: 3533428 - DNA, 21 bp, Homo sapiens
tggccacgttcagggaggggc

SEQ ID NO: 3533429 - DNA, 17 bp, Homo sapiens
tggccagcgtaaatgac

SEQ ID NO: 3533430 - DNA, 14 bp, Homo sapiens
tggccatgggaggc

SEQ ID NO: 3533431 - DNA, 16 bp, Homo sapiens
tggccatgggaggcct

SEQ ID NO: 3533432 - DNA, 15 bp, Homo sapiens
tggccatgttgtctt

SEQ ID NO: 3533433 - DNA, 13 bp, Homo sapiens
tggccccagggga

SEQ ID NO: 3533434 - DNA, 17 bp, Homo sapiens
tggcccccccagcccca

SEQ ID NO: 3533435 - DNA, 21 bp, Homo sapiens
tggcccccccagccccacacc

SEQ ID NO: 3533436 - DNA, 22 bp, Homo sapiens
tggcccccccagccccacaccc

SEQ ID NO: 3533437 - DNA, 22 bp, Homo sapiens
tggccctgactgtcagggaggg

SEQ ID NO: 3533438 - DNA, 16 bp, Homo sapiens
tgggaccaaaggggga

SEQ ID NO: 3533439 - DNA, 20 bp, Homo sapiens
tgggaggcctttccctaagc

SEQ ID NO: 3533440 - DNA, 17 bp, Homo sapiens
tgggcagtgccagccaa

SEQ ID NO: 3533441 - DNA, 12 bp, Homo sapiens
tgggcccaggga

SEQ ID NO: 3533442 - DNA, 13 bp, Homo sapiens
tgggccctgcagg

SEQ ID NO: 3533443 - DNA, 19 bp, Homo sapiens
tgggctttcacgggcccca

SEQ ID NO: 3533444 - DNA, 16 bp, Homo sapiens
tgggcttttgttctga

SEQ ID NO: 3533445 - DNA, 19 bp, Homo sapiens
tgggcttttgttctgaggg

SEQ ID NO: 3533446 - DNA, 20 bp, Homo sapiens
tgggcttttgttctgagggg

SEQ ID NO: 3533447 - DNA, 16 bp, Homo sapiens
tgggggctggaggtgc

SEQ ID NO: 3533448 - DNA, 18 bp, Homo sapiens
tggggttcataggggcag

SEQ ID NO: 3533449 - DNA, 17 bp, Homo sapiens
tgggtagtggggaagag

SEQ ID NO: 3533450 - DNA, 12 bp, Homo sapiens
tggtccaccctt

SEQ ID NO: 3533451 - DNA, 14 bp, Homo sapiens
tggtctgaactgct

SEQ ID NO: 3533452 - DNA, 20 bp, Homo sapiens
tggtgttgccagttgtcctc

SEQ ID NO: 3533453 - DNA, 18 bp, Homo sapiens
tggttgtaattaaatttt

SEQ ID NO: 3533454 - DNA, 22 bp, Homo sapiens
tgtaaatctttgtgaacattct

SEQ ID NO: 3533455 - DNA, 15 bp, Homo sapiens
tgtaaggtttcaatg

SEQ ID NO: 3533456 - DNA, 15 bp, Homo sapiens
tcaatgtgtttaatt

SEQ ID NO: 3533457 - DNA, 18 bp, Homo sapiens
tcaatgtgtttaattttg

SEQ ID NO: 3533458 - DNA, 19 bp, Homo sapiens
tcacatccagttgtctaaa

SEQ ID NO: 3533459 - DNA, 20 bp, Homo sapiens
tcacatgattccagccatca

SEQ ID NO: 3533460 - DNA, 21 bp, Homo sapiens
tcacatgattccagccatcac

SEQ ID NO: 3533461 - DNA, 18 bp, Homo sapiens
tcactgtggggaaacaat

SEQ ID NO: 3533462 - DNA, 16 bp, Homo sapiens
tcagaactataacatt

SEQ ID NO: 3533463 - DNA, 16 bp, Homo sapiens
tcagaagtttctaact

SEQ ID NO: 3533464 - DNA, 14 bp, Homo sapiens
tcagaatgggggct

SEQ ID NO: 3533465 - DNA, 18 bp, Homo sapiens
tcagacgactagcccagg

SEQ ID NO: 3533466 - DNA, 16 bp, Homo sapiens
tcagagtataattttg

SEQ ID NO: 3533467 - DNA, 15 bp, Homo sapiens
tcagcactctggact

SEQ ID NO: 3533468 - DNA, 18 bp, Homo sapiens
tcagcactctggactcca

SEQ ID NO: 3533469 - DNA, 22 bp, Homo sapiens
tcagctcttggtgggcccaggg

SEQ ID NO: 3533470 - DNA, 14 bp, Homo sapiens
tcagctgggcagtg

SEQ ID NO: 3533471 - DNA, 20 bp, Homo sapiens
tcagctgggcagtgccagcc

SEQ ID NO: 3533472 - DNA, 15 bp, Homo sapiens
tcaggaggaggctgc

SEQ ID NO: 3533473 - DNA, 21 bp, Homo sapiens
tcaggctgttggcgtgtccca

SEQ ID NO: 3533474 - DNA, 22 bp, Homo sapiens
tcaggctgttggcgtgtcccag

SEQ ID NO: 3533475 - DNA, 20 bp, Homo sapiens
tcagggagggccagggaggc

SEQ ID NO: 3533476 - DNA, 13 bp, Homo sapiens
tcagggaggggcc

SEQ ID NO: 3533477 - DNA, 12 bp, Homo sapiens
tcaggggaaggg

SEQ ID NO: 3533478 - DNA, 19 bp, Homo sapiens
tcagtggtgttacattttc

SEQ ID NO: 3533479 - DNA, 20 bp, Homo sapiens
tcagtgttaaagtggtctga

SEQ ID NO: 3533480 - DNA, 18 bp, Homo sapiens
tcataaaggacactggat

SEQ ID NO: 3533481 - DNA, 22 bp, Homo sapiens
tcataagatagttacatttatg

SEQ ID NO: 3533482 - DNA, 13 bp, Homo sapiens
tcataggggcagg

SEQ ID NO: 3533483 - DNA, 16 bp, Homo sapiens
tcatgagaattacaga

SEQ ID NO: 3533484 - DNA, 16 bp, Homo sapiens
tcatgcattgtcctct

SEQ ID NO: 3533485 - DNA, 23 bp, Homo sapiens
tcattgtctgtgaagtgagacct

SEQ ID NO: 3533486 - DNA, 19 bp, Homo sapiens
tccaaagctgaaaatgtgt

SEQ ID NO: 3533487 - DNA, 15 bp, Homo sapiens
tccaaaggctctgtt

SEQ ID NO: 3533488 - DNA, 13 bp, Homo sapiens
tccaaagtgtcac

SEQ ID NO: 3533489 - DNA, 18 bp, Homo sapiens
tccaaggagcagagaggt

SEQ ID NO: 3533490 - DNA, 14 bp, Homo sapiens
tccaataccctaga

SEQ ID NO: 3533491 - DNA, 21 bp, Homo sapiens
tccacaggacacgaaggctgc

SEQ ID NO: 3533492 - DNA, 22 bp, Homo sapiens
tccaccctttcatagagaggcc

SEQ ID NO: 3533493 - DNA, 15 bp, Homo sapiens
tccaccctttggaga

SEQ ID NO: 3533494 - DNA, 22 bp, Homo sapiens
tccactagtattttttttgctt

SEQ ID NO: 3533495 - DNA, 18 bp, Homo sapiens
tccactcagcactctgga

SEQ ID NO: 3533496 - DNA, 16 bp, Homo sapiens
tccagcagttaggcac

SEQ ID NO: 3533497 - DNA, 15 bp, Homo sapiens
tccagccatcacctt

SEQ ID NO: 3533498 - DNA, 19 bp, Homo sapiens
tccagcttttcctcagggt

SEQ ID NO: 3533499 - DNA, 16 bp, Homo sapiens
tcccaccctatggcca

SEQ ID NO: 3533500 - DNA, 15 bp, Homo sapiens
tcccagcaccacacc

SEQ ID NO: 3533501 - DNA, 16 bp, Homo sapiens
tccccctgttcacatc

SEQ ID NO: 3533502 - DNA, 12 bp, Homo sapiens
tccctaacttct

SEQ ID NO: 3533503 - DNA, 11 bp, Homo sapiens
tccctaagcca

SEQ ID NO: 3533504 - DNA, 21 bp, Homo sapiens
tccctgctacctgatttcagc

SEQ ID NO: 3533505 - DNA, 18 bp, Homo sapiens
tccgaaagtctgaatctc

SEQ ID NO: 3533506 - DNA, 17 bp, Homo sapiens
tccgttggaaagaacat

SEQ ID NO: 3533507 - DNA, 18 bp, Homo sapiens
tccgttggaaagaacatt

SEQ ID NO: 3533508 - DNA, 20 bp, Homo sapiens
tccgttggaaagaacattta

SEQ ID NO: 3533509 - DNA, 14 bp, Homo sapiens
tcctagtaactctt

SEQ ID NO: 3533510 - DNA, 12 bp, Homo sapiens
tcctccacccca

SEQ ID NO: 3533511 - DNA, 22 bp, Homo sapiens
tcctccttccggggaaggattt

SEQ ID NO: 3533512 - DNA, 13 bp, Homo sapiens
tcctgagctagca

SEQ ID NO: 3533513 - DNA, 17 bp, Homo sapiens
tcctgcagccagaaagg

SEQ ID NO: 3533514 - DNA, 18 bp, Homo sapiens
tcctgcagccagaaagga

SEQ ID NO: 3533515 - DNA, 20 bp, Homo sapiens
tcctgttagtagcagaaata

SEQ ID NO: 3533516 - DNA, 19 bp, Homo sapiens
tccttctctttcaatgtgt

SEQ ID NO: 3533517 - DNA, 22 bp, Homo sapiens
tccttggtgctaaagattgtta

SEQ ID NO: 3533518 - DNA, 13 bp, Homo sapiens
tccttgttttgat

SEQ ID NO: 3533519 - DNA, 19 bp, Homo sapiens
tccttgttttgatttatgg

SEQ ID NO: 3533520 - DNA, 12 bp, Homo sapiens
tcggggctgctg

SEQ ID NO: 3533521 - DNA, 17 bp, Homo sapiens
tcggtgttacttccctt

SEQ ID NO: 3533522 - DNA, 20 bp, Homo sapiens
tcgttcctgcagccagaaag

SEQ ID NO: 3533523 - DNA, 18 bp, Homo sapiens
tctaagaataatggactc

SEQ ID NO: 3533524 - DNA, 15 bp, Homo sapiens
tctaatgtaaatttt

SEQ ID NO: 3533525 - DNA, 17 bp, Homo sapiens
tctatgtcctagtaact

SEQ ID NO: 3533526 - DNA, 19 bp, Homo sapiens
tctattgcctctgagagca

SEQ ID NO: 3533527 - DNA, 21 bp, Homo sapiens
tctattgcctctgagagcatc

SEQ ID NO: 3533528 - DNA, 22 bp, Homo sapiens
tctcacatgattccagccatca

SEQ ID NO: 3533529 - DNA, 19 bp, Homo sapiens
tctcagacgactagcccag

SEQ ID NO: 3533530 - DNA, 20 bp, Homo sapiens
tctcaggaggaggctgccct

SEQ ID NO: 3533531 - DNA, 18 bp, Homo sapiens
tctccagaccccagaact

SEQ ID NO: 3533532 - DNA, 14 bp, Homo sapiens
tctccagcagttag

SEQ ID NO: 3533533 - DNA, 15 bp, Homo sapiens
tctccagcagttagg

SEQ ID NO: 3533534 - DNA, 17 bp, Homo sapiens
tctcccaaggagggcac

SEQ ID NO: 3533535 - DNA, 15 bp, Homo sapiens
tctctagcagtgagt

SEQ ID NO: 3533536 - DNA, 19 bp, Homo sapiens
tctctgcaaactgccttct

SEQ ID NO: 3533537 - DNA, 23 bp, Homo sapiens
tctgaattttagacgatcacaga

SEQ ID NO: 3533538 - DNA, 22 bp, Homo sapiens
tctgaggggtgtccgagaggct

SEQ ID NO: 3533539 - DNA, 14 bp, Homo sapiens
tctgattgaaacat

SEQ ID NO: 3533540 - DNA, 20 bp, Homo sapiens
tctgattgaaacatgaaaca

SEQ ID NO: 3533541 - DNA, 22 bp, Homo sapiens
tctgattgaaacatgaaacaac

SEQ ID NO: 3533542 - DNA, 16 bp, Homo sapiens
tctggaatgcttctgc

SEQ ID NO: 3533543 - DNA, 14 bp, Homo sapiens
tctgggagcttctt

SEQ ID NO: 3533544 - DNA, 14 bp, Homo sapiens
tctggtgctgctgg

SEQ ID NO: 3533545 - DNA, 14 bp, Homo sapiens
tctgtgaaactatc

SEQ ID NO: 3533546 - DNA, 20 bp, Homo sapiens
tctgtgaagtgagaccttcc

SEQ ID NO: 3533547 - DNA, 16 bp, Homo sapiens
tcttaagatgtccagg

SEQ ID NO: 3533548 - DNA, 18 bp, Homo sapiens
tcttccgttggaaagaac

SEQ ID NO: 3533549 - DNA, 21 bp, Homo sapiens
tcttccgttggaaagaacatt

SEQ ID NO: 3533550 - DNA, 22 bp, Homo sapiens
tcttccgttggaaagaacattt

SEQ ID NO: 3533551 - DNA, 16 bp, Homo sapiens
tcttctaatgtaaatt

SEQ ID NO: 3533552 - DNA, 19 bp, Homo sapiens
tcttgactccttggtgcta

SEQ ID NO: 3533553 - DNA, 24 bp, Homo sapiens
tcttgctatctctcaagagtgctg

SEQ ID NO: 3533554 - DNA, 15 bp, Homo sapiens
tcttggggttcatag

SEQ ID NO: 3533555 - DNA, 17 bp, Homo sapiens
tcttgtgactcagcaga

SEQ ID NO: 3533556 - DNA, 21 bp, Homo sapiens
tctttatgaattattttgata

SEQ ID NO: 3533557 - DNA, 11 bp, Homo sapiens
tctttcagaag

SEQ ID NO: 3533558 - DNA, 21 bp, Homo sapiens
tctttcagaaggaaaccgaaa

SEQ ID NO: 3533559 - DNA, 20 bp, Homo sapiens
tgaaaaggcagcatttgaat

SEQ ID NO: 3533560 - DNA, 21 bp, Homo sapiens
tgaaaatgtgtatacacttaa

SEQ ID NO: 3533561 - DNA, 22 bp, Homo sapiens
tgaaacatgaaacaactcatgt

SEQ ID NO: 3533562 - DNA, 15 bp, Homo sapiens
tgaaagtgctgctct

SEQ ID NO: 3533563 - DNA, 16 bp, Homo sapiens
tgaaatttttgatgcc

SEQ ID NO: 3533564 - DNA, 20 bp, Homo sapiens
tgaactgggccttaactgtt

SEQ ID NO: 3533565 - DNA, 21 bp, Homo sapiens
tgaagctatgtctctagcagt

SEQ ID NO: 3533566 - DNA, 15 bp, Homo sapiens
tgaagtatttcatgt

SEQ ID NO: 3533567 - DNA, 21 bp, Homo sapiens
tgtaatgactgagatttgtaa

SEQ ID NO: 3533568 - DNA, 17 bp, Homo sapiens
tgtacaaactatttcag

SEQ ID NO: 3533569 - DNA, 23 bp, Homo sapiens
tgtacaaactatttcagaatatt

SEQ ID NO: 3533570 - DNA, 20 bp, Homo sapiens
tgtagacctttctccctcct

SEQ ID NO: 3533571 - DNA, 15 bp, Homo sapiens
tgtatgcactgctca

SEQ ID NO: 3533572 - DNA, 16 bp, Homo sapiens
tgtcagggagggccag

SEQ ID NO: 3533573 - DNA, 23 bp, Homo sapiens
tgtcagggagggccagggaggca

SEQ ID NO: 3533574 - DNA, 17 bp, Homo sapiens
tgtccaaagctgaaaat

SEQ ID NO: 3533575 - DNA, 14 bp, Homo sapiens
tgtccagggcccca

SEQ ID NO: 3533576 - DNA, 20 bp, Homo sapiens
tgtctctagcagtgagtact

SEQ ID NO: 3533577 - DNA, 18 bp, Homo sapiens
tgtctgtgaagtgagacc

SEQ ID NO: 3533578 - DNA, 20 bp, Homo sapiens
tgtctttattagtaacatca

SEQ ID NO: 3533579 - DNA, 13 bp, Homo sapiens
tgtgaacattctg

SEQ ID NO: 3533580 - DNA, 20 bp, Homo sapiens
tgtgaccagttttgatattt

SEQ ID NO: 3533581 - DNA, 22 bp, Homo sapiens
tgtgactaagttgcaagatctt

SEQ ID NO: 3533582 - DNA, 15 bp, Homo sapiens
tgtgactcagcagag

SEQ ID NO: 3533583 - DNA, 23 bp, Homo sapiens
tgtgagtctccccttgcagcctg

SEQ ID NO: 3533584 - DNA, 17 bp, Homo sapiens
tgtgcattaaaattaaa

SEQ ID NO: 3533585 - DNA, 20 bp, Homo sapiens
tgtgggaggctggggaccca

SEQ ID NO: 3533586 - DNA, 21 bp, Homo sapiens
tgtgggaggctggggacccag

SEQ ID NO: 3533587 - DNA, 17 bp, Homo sapiens
tgtgtaggatgtatgct

SEQ ID NO: 3533588 - DNA, 16 bp, Homo sapiens
tgtgtatgtgtgtgtg

SEQ ID NO: 3533589 - DNA, 14 bp, Homo sapiens
tgttaaaacacaaa

SEQ ID NO: 3533590 - DNA, 20 bp, Homo sapiens
tgttaaaacacaaaatgaat

SEQ ID NO: 3533591 - DNA, 22 bp, Homo sapiens
tgttaaaacacaaaatgaataa

SEQ ID NO: 3533592 - DNA, 16 bp, Homo sapiens
tgttagaatatgttga

SEQ ID NO: 3533593 - DNA, 15 bp, Homo sapiens
tgttagtagcagaaa

SEQ ID NO: 3533594 - DNA, 19 bp, Homo sapiens
tgttatcagctgggcagtg

SEQ ID NO: 3533595 - DNA, 17 bp, Homo sapiens
tgttgacagtgaggaaa

SEQ ID NO: 3533596 - DNA, 23 bp, Homo sapiens
tgttgcaaagggattactagaga

SEQ ID NO: 3533597 - DNA, 23 bp, Homo sapiens
tgttggtgaaaataagaaagaat

SEQ ID NO: 3533598 - DNA, 14 bp, Homo sapiens
tgttttattcagct

SEQ ID NO: 3533599 - DNA, 21 bp, Homo sapiens
tgttttttaacttgcagtata

SEQ ID NO: 3533600 - DNA, 12 bp, Homo sapiens
ttaaaattaaat

SEQ ID NO: 3533601 - DNA, 19 bp, Homo sapiens
ttaaaattaaataaatttt

SEQ ID NO: 3533602 - DNA, 14 bp, Homo sapiens
ttaacactgtcatc

SEQ ID NO: 3533603 - DNA, 14 bp, Homo sapiens
ttaactgttcagta

SEQ ID NO: 3533604 - DNA, 16 bp, Homo sapiens
ttaactgttcagtatt

SEQ ID NO: 3533605 - DNA, 16 bp, Homo sapiens
ttaagatgtccagggc

SEQ ID NO: 3533606 - DNA, 22 bp, Homo sapiens
ttaagggatgttgcaaagggat

SEQ ID NO: 3533607 - DNA, 21 bp, Homo sapiens
ttacacctccactcagcactc

SEQ ID NO: 3533608 - DNA, 17 bp, Homo sapiens
ttacagaaaatttgcaa

SEQ ID NO: 3533609 - DNA, 21 bp, Homo sapiens
ttacatttatgtgctgttaga

SEQ ID NO: 3533610 - DNA, 15 bp, Homo sapiens
ttactagagaaagac

SEQ ID NO: 3533611 - DNA, 14 bp, Homo sapiens
ttactttggactga

SEQ ID NO: 3533612 - DNA, 15 bp, Homo sapiens
ttagacgatcacaga

SEQ ID NO: 3533613 - DNA, 19 bp, Homo sapiens
ttagaggcttgatgatgat

SEQ ID NO: 3533614 - DNA, 17 bp, Homo sapiens
ttatcaggctttccttg

SEQ ID NO: 3533615 - DNA, 21 bp, Homo sapiens
ttatcaggctttccttgtttt

SEQ ID NO: 3533616 - DNA, 17 bp, Homo sapiens
ttatctactgactgaaa

SEQ ID NO: 3533617 - DNA, 14 bp, Homo sapiens
ttatgaaaattaag

SEQ ID NO: 3533618 - DNA, 15 bp, Homo sapiens
ttatgaattattttg

SEQ ID NO: 3533619 - DNA, 21 bp, Homo sapiens
ttcaatgcatacaataaaaga

SEQ ID NO: 3533620 - DNA, 19 bp, Homo sapiens
ttcaatttgctatttacaa

SEQ ID NO: 3533621 - DNA, 23 bp, Homo sapiens
ttcacatgccctcggtcactgag

SEQ ID NO: 3533622 - DNA, 14 bp, Homo sapiens
ttcaggggaagggc

SEQ ID NO: 3533623 - DNA, 18 bp, Homo sapiens
ttcatagagacttgggaa

SEQ ID NO: 3533624 - DNA, 13 bp, Homo sapiens
ttcatagagaggc

SEQ ID NO: 3533625 - DNA, 20 bp, Homo sapiens
ttccaataccctagaagaaa

SEQ ID NO: 3533626 - DNA, 23 bp, Homo sapiens
ttccaataccctagaagaaaacc

SEQ ID NO: 3533627 - DNA, 21 bp, Homo sapiens
ttccacaggacacgaaggctg

SEQ ID NO: 3533628 - DNA, 20 bp, Homo sapiens
ttccgttggaaagaacattt

SEQ ID NO: 3533629 - DNA, 14 bp, Homo sapiens
ttcctgagctagca

SEQ ID NO: 3533630 - DNA, 17 bp, Homo sapiens
ttcggtctgaattttag

SEQ ID NO: 3533631 - DNA, 14 bp, Homo sapiens
ttctattgcctctg

SEQ ID NO: 3533632 - DNA, 17 bp, Homo sapiens
ttctattgcctctgaga

SEQ ID NO: 3533633 - DNA, 20 bp, Homo sapiens
ttctccctggatttttacca

SEQ ID NO: 3533634 - DNA, 14 bp, Homo sapiens
ttctgataggaggg

SEQ ID NO: 3533635 - DNA, 17 bp, Homo sapiens
ttctgatagtagtcttt

SEQ ID NO: 3533636 - DNA, 21 bp, Homo sapiens
ttctggagcaatctgaccctt

SEQ ID NO: 3533637 - DNA, 20 bp, Homo sapiens
ttcttctattgcctctgaga

SEQ ID NO: 3533638 - DNA, 13 bp, Homo sapiens
ttgaatgactgac

SEQ ID NO: 3533639 - DNA, 17 bp, Homo sapiens
ttgaattcatttgctga

SEQ ID NO: 3533640 - DNA, 17 bp, Homo sapiens
ttgaggcacaaatcact

SEQ ID NO: 3533641 - DNA, 12 bp, Homo sapiens
ttgcaacatata

SEQ ID NO: 3533642 - DNA, 19 bp, Homo sapiens
ttgccagttgtcctccttc

SEQ ID NO: 3533643 - DNA, 22 bp, Homo sapiens
ttgctaccaatctgtgagaagt

SEQ ID NO: 3533644 - DNA, 19 bp, Homo sapiens
ttgctatctctcaagagtg

SEQ ID NO: 3533645 - DNA, 21 bp, Homo sapiens
ttgctgaccggaatggtcaaa

SEQ ID NO: 3533646 - DNA, 16 bp, Homo sapiens
ttgcttaatgccagaa

SEQ ID NO: 3533647 - DNA, 13 bp, Homo sapiens
ttgcttttatgac

SEQ ID NO: 3533648 - DNA, 20 bp, Homo sapiens
ttggcaaaggtccctgagct

SEQ ID NO: 3533649 - DNA, 21 bp, Homo sapiens
ttggtgaaaataagaaagaat

SEQ ID NO: 3533650 - DNA, 20 bp, Homo sapiens
ttgtgactcagcagaggcag

SEQ ID NO: 3533651 - DNA, 17 bp, Homo sapiens
ttgtgatgaaaaggcag

SEQ ID NO: 3533652 - DNA, 16 bp, Homo sapiens
ttgtgcattaaaatta

SEQ ID NO: 3533653 - DNA, 22 bp, Homo sapiens
ttgttagtttctgagttttacc

SEQ ID NO: 3533654 - DNA, 20 bp, Homo sapiens
ttgttttgatttatggctgt

SEQ ID NO: 3533655 - DNA, 14 bp, Homo sapiens
tttaacaagtcatt

SEQ ID NO: 3533656 - DNA, 17 bp, Homo sapiens
tttaagggatgttgcaa

SEQ ID NO: 3533657 - DNA, 18 bp, Homo sapiens
tttagacgatcacagaaa

SEQ ID NO: 3533658 - DNA, 13 bp, Homo sapiens
tttatgaattatt

SEQ ID NO: 3533659 - DNA, 13 bp, Homo sapiens
tttatgacaaata

SEQ ID NO: 3533660 - DNA, 22 bp, Homo sapiens
tttatgctaatatttttaacaa

SEQ ID NO: 3533661 - DNA, 17 bp, Homo sapiens
tttatgtgctgttagaa

SEQ ID NO: 3533662 - DNA, 15 bp, Homo sapiens
tttatgttttcacag

SEQ ID NO: 3533663 - DNA, 21 bp, Homo sapiens
tttattaactaggtatgaagt

SEQ ID NO: 3533664 - DNA, 15 bp, Homo sapiens
tttattagtaacatc

SEQ ID NO: 3533665 - DNA, 21 bp, Homo sapiens
tttattagtaacatcataaga

SEQ ID NO: 3533666 - DNA, 18 bp, Homo sapiens
tttattgtgcattaaaat

SEQ ID NO: 3533667 - DNA, 16 bp, Homo sapiens
tttattttaaacattt

SEQ ID NO: 3533668 - DNA, 16 bp, Homo sapiens
tttcaaaatatgtgta

SEQ ID NO: 3533669 - DNA, 19 bp, Homo sapiens
tttcaatgcatacaataaa

SEQ ID NO: 3533670 - DNA, 23 bp, Homo sapiens
tttcaatgcatacaataaaagag

SEQ ID NO: 3533671 - DNA, 14 bp, Homo sapiens
tttcagcacaataa

SEQ ID NO: 3533672 - DNA, 23 bp, Homo sapiens
tttcatatgaggggacccagcgc

SEQ ID NO: 3533673 - DNA, 14 bp, Homo sapiens
tttcatatgtggaa

SEQ ID NO: 3533674 - DNA, 15 bp, Homo sapiens
tttcatatgtggaaa

SEQ ID NO: 3533675 - DNA, 19 bp, Homo sapiens
tttcatatgtggaaatata

SEQ ID NO: 3533676 - DNA, 12 bp, Homo sapiens
tttccagtgtgt

SEQ ID NO: 3533677 - DNA, 20 bp, Homo sapiens
tttccctaagccagctgccc

SEQ ID NO: 3533678 - DNA, 22 bp, Homo sapiens
tttccctaagccagctgccccc

SEQ ID NO: 3533679 - DNA, 12 bp, Homo sapiens
tttctccctgga

SEQ ID NO: 3533680 - DNA, 16 bp, Homo sapiens
tttctgagttttacca

SEQ ID NO: 3533681 - DNA, 14 bp, Homo sapiens
tttgaattcatttg

SEQ ID NO: 3533682 - DNA, 14 bp, Homo sapiens
tttgataaattact

SEQ ID NO: 3533683 - DNA, 12 bp, Homo sapiens
tttgatttatgg

SEQ ID NO: 3533684 - DNA, 18 bp, Homo sapiens
tttgcaacatataaagta

SEQ ID NO: 3533685 - DNA, 17 bp, Homo sapiens
tttgccctgctgccctc

SEQ ID NO: 3533686 - DNA, 21 bp, Homo sapiens
tttgctgaccctccccaaagg

SEQ ID NO: 3533687 - DNA, 22 bp, Homo sapiens
tttggcaagagcgttactgtag

SEQ ID NO: 3533688 - DNA, 18 bp, Homo sapiens
tttgtaaatctttgtgaa

SEQ ID NO: 3533689 - DNA, 21 bp, Homo sapiens
tttgtaagctataacatattt

SEQ ID NO: 3533690 - DNA, 18 bp, Homo sapiens
tttgtacaaactatttca

SEQ ID NO: 3533691 - DNA, 20 bp, Homo sapiens
tttgtacaaactatttcaga

SEQ ID NO: 3533692 - DNA, 21 bp, Homo sapiens
tttgtacaaactatttcagaa

SEQ ID NO: 3533693 - DNA, 13 bp, Homo sapiens
tttgtatcatgtt

SEQ ID NO: 3533694 - DNA, 17 bp, Homo sapiens
ttttaagggatgttgca

SEQ ID NO: 3533695 - DNA, 20 bp, Homo sapiens
ttttaatgttaactttcaaa

SEQ ID NO: 3533696 - DNA, 12 bp, Homo sapiens
ttttatttatga

SEQ ID NO: 3533697 - DNA, 16 bp, Homo sapiens
ttttatttatgaagtt

SEQ ID NO: 3533698 - DNA, 18 bp, Homo sapiens
ttttatttatgaagtttt

SEQ ID NO: 3533699 - DNA, 22 bp, Homo sapiens
ttttccccaaaggcatgcagtc

SEQ ID NO: 3533700 - DNA, 11 bp, Homo sapiens
ttttccttgtg

SEQ ID NO: 3533701 - DNA, 13 bp, Homo sapiens
ttttcttgtccaa

SEQ ID NO: 3533702 - DNA, 16 bp, Homo sapiens
ttttgagagtaatttg

SEQ ID NO: 3533703 - DNA, 10 bp, Homo sapiens
ttttgtctct

SEQ ID NO: 3533704 - DNA, 20 bp, Homo sapiens
tttttaacactgtcatctgt

SEQ ID NO: 3533705 - DNA, 20 bp, Homo sapiens
tttttaagggatgttgcaaa

SEQ ID NO: 3533706 - DNA, 14 bp, Homo sapiens
tttttatatgtgga

SEQ ID NO: 3533707 - DNA, 18 bp, Homo sapiens
aatcaaggagtcttctaa

SEQ ID NO: 3533708 - DNA, 21 bp, Homo sapiens
aatcaaggagtcttctaatgt

SEQ ID NO: 3533709 - DNA, 19 bp, Homo sapiens
aatcagtggtgttacattt

SEQ ID NO: 3533710 - DNA, 20 bp, Homo sapiens
aatcagtggtgttacatttt

SEQ ID NO: 3533711 - DNA, 17 bp, Homo sapiens
aatcattaagtgacttt

SEQ ID NO: 3533712 - DNA, 18 bp, Homo sapiens
aatctgtgagaagttttt

SEQ ID NO: 3533713 - DNA, 19 bp, Homo sapiens
aatctttgtgaacattctg

SEQ ID NO: 3533714 - DNA, 18 bp, Homo sapiens
aatgcatacaataaaaga

SEQ ID NO: 3533715 - DNA, 21 bp, Homo sapiens
aatgcatacaataaaagagct

SEQ ID NO: 3533716 - DNA, 13 bp, Homo sapiens
aatgctgagccag

SEQ ID NO: 3533717 - DNA, 22 bp, Homo sapiens
aatgggggctttcggggagggc

SEQ ID NO: 3533718 - DNA, 16 bp, Homo sapiens
aatggtcaaatctctc

SEQ ID NO: 3533719 - DNA, 21 bp, Homo sapiens
aatgtgaccaaaaaaaagcat

SEQ ID NO: 3533720 - DNA, 14 bp, Homo sapiens
aatgttaactttca

SEQ ID NO: 3533721 - DNA, 16 bp, Homo sapiens
aatgttaactttcaaa

SEQ ID NO: 3533722 - DNA, 13 bp, Homo sapiens
aattaaaaaatca

SEQ ID NO: 3533723 - DNA, 19 bp, Homo sapiens
aattaaaattcatactgta

SEQ ID NO: 3533724 - DNA, 14 bp, Homo sapiens
aattaaatactttt

SEQ ID NO: 3533725 - DNA, 19 bp, Homo sapiens
aattaaatttttaaaatct

SEQ ID NO: 3533726 - DNA, 20 bp, Homo sapiens
aattaaatttttaaaatctg

SEQ ID NO: 3533727 - DNA, 18 bp, Homo sapiens
aattacagaaaatttgca

SEQ ID NO: 3533728 - DNA, 18 bp, Homo sapiens
aatttgctatttacaaat

SEQ ID NO: 3533729 - DNA, 24 bp, Homo sapiens
aatttgctatttacaaatgaagta

SEQ ID NO: 3533730 - DNA, 15 bp, Homo sapiens
aatttttaaaatctg

SEQ ID NO: 3533731 - DNA, 21 bp, Homo sapiens
aattttttaagggatgttgca

SEQ ID NO: 3533732 - DNA, 15 bp, Homo sapiens
aattttttgtgatga

SEQ ID NO: 3533733 - DNA, 23 bp, Homo sapiens
acaaactatttcagaatattttg

SEQ ID NO: 3533734 - DNA, 22 bp, Homo sapiens
acaaatagcatacaccaaacat

SEQ ID NO: 3533735 - DNA, 22 bp, Homo sapiens
acaaatcactgtggggaaacaa

SEQ ID NO: 3533736 - DNA, 18 bp, Homo sapiens
acaaatgtgctctatgtc

SEQ ID NO: 3533737 - DNA, 14 bp, Homo sapiens
acaactggaaataa

SEQ ID NO: 3533738 - DNA, 16 bp, Homo sapiens
acaagtcatttcaaaa

SEQ ID NO: 3533739 - DNA, 11 bp, Homo sapiens
acaataaaaga

SEQ ID NO: 3533740 - DNA, 12 bp, Homo sapiens
acaataaaagag

SEQ ID NO: 3533741 - DNA, 16 bp, Homo sapiens
acaataaaagagcttt

SEQ ID NO: 3533742 - DNA, 14 bp, Homo sapiens
acaataaatatact

SEQ ID NO: 3533743 - DNA, 18 bp, Homo sapiens
acaataaatatacttctg

SEQ ID NO: 3533744 - DNA, 17 bp, Homo sapiens
acacacccaaggggccc

SEQ ID NO: 3533745 - DNA, 15 bp, Homo sapiens
acacaggtggccatc

SEQ ID NO: 3533746 - DNA, 17 bp, Homo sapiens
acacagtgaaaggcctg

SEQ ID NO: 3533747 - DNA, 21 bp, Homo sapiens
acacagttgttgaatgactga

SEQ ID NO: 3533748 - DNA, 22 bp, Homo sapiens
acacagttgttgaatgactgac

SEQ ID NO: 3533749 - DNA, 18 bp, Homo sapiens
acaccaaacatttctgtg

SEQ ID NO: 3533750 - DNA, 16 bp, Homo sapiens
acacccacacaggtgg

SEQ ID NO: 3533751 - DNA, 18 bp, Homo sapiens
acaccgtggggaaggggt

SEQ ID NO: 3533752 - DNA, 17 bp, Homo sapiens
acacctccactcagcac

SEQ ID NO: 3533753 - DNA, 15 bp, Homo sapiens
acacctttgttttgt

SEQ ID NO: 3533754 - DNA, 18 bp, Homo sapiens
acacggatttagtcccac

SEQ ID NO: 3533755 - DNA, 15 bp, Homo sapiens
acactatttctggaa

SEQ ID NO: 3533756 - DNA, 23 bp, Homo sapiens
acactatttctggaatgcttctg

SEQ ID NO: 3533757 - DNA, 16 bp, Homo sapiens
acactggatcaagttc

SEQ ID NO: 3533758 - DNA, 16 bp, Homo sapiens
acagaaaatttgcaac

SEQ ID NO: 3533759 - DNA, 15 bp, Homo sapiens
acagagactctccct

SEQ ID NO: 3533760 - DNA, 15 bp, Homo sapiens
acagagccactcttc

SEQ ID NO: 3533761 - DNA, 19 bp, Homo sapiens
acagcagattccacaggac

SEQ ID NO: 3533762 - DNA, 14 bp, Homo sapiens
acagccccatggac

SEQ ID NO: 3533763 - DNA, 15 bp, Homo sapiens
acaggacacgaaggc

SEQ ID NO: 3533764 - DNA, 17 bp, Homo sapiens
acaggacacgaaggctg

SEQ ID NO: 3533765 - DNA, 18 bp, Homo sapiens
acaggacacgaaggctgc

SEQ ID NO: 3533766 - DNA, 15 bp, Homo sapiens
acagtcaccaagtgt

SEQ ID NO: 3533767 - DNA, 16 bp, Homo sapiens
acagtgaaaggcctgc

SEQ ID NO: 3533768 - DNA, 23 bp, Homo sapiens
acagttgttgaatgactgaccca

SEQ ID NO: 3533769 - DNA, 12 bp, Homo sapiens
acatgaaacaac

SEQ ID NO: 3533770 - DNA, 14 bp, Homo sapiens
acatgaaacaactc

SEQ ID NO: 3533771 - DNA, 19 bp, Homo sapiens
acatgattccagccatcac

SEQ ID NO: 3533772 - DNA, 21 bp, Homo sapiens
acatgtcaaagctgcatgtgt

SEQ ID NO: 3533773 - DNA, 14 bp, Homo sapiens
acattcaatttgct

SEQ ID NO: 3533774 - DNA, 15 bp, Homo sapiens
acatttaaaattaaa

SEQ ID NO: 3533775 - DNA, 14 bp, Homo sapiens
acatttgaattcat

SEQ ID NO: 3533776 - DNA, 13 bp, Homo sapiens
accaaacatttct

SEQ ID NO: 3533777 - DNA, 21 bp, Homo sapiens
accaacaactcagaatggggg

SEQ ID NO: 3533778 - DNA, 15 bp, Homo sapiens
accaaggcagggccc

SEQ ID NO: 3533779 - DNA, 18 bp, Homo sapiens
accaagtgtattgtaatg

SEQ ID NO: 3533780 - DNA, 14 bp, Homo sapiens
accaccaagccttg

SEQ ID NO: 3533781 - DNA, 22 bp, Homo sapiens
accacgggttgaggaagtcagg

SEQ ID NO: 3533782 - DNA, 20 bp, Homo sapiens
accacggtgaaagtgctgct

SEQ ID NO: 3533783 - DNA, 18 bp, Homo sapiens
accagaaaccttccagag

SEQ ID NO: 3533784 - DNA, 22 bp, Homo sapiens
accagaccaaggcagggcccag

SEQ ID NO: 3533785 - DNA, 17 bp, Homo sapiens
accatcttacagagact

SEQ ID NO: 3533786 - DNA, 17 bp, Homo sapiens
acccaaaatgtgaatga

SEQ ID NO: 3533787 - DNA, 18 bp, Homo sapiens
acccaaggggcccgaggg

SEQ ID NO: 3533788 - DNA, 18 bp, Homo sapiens
acccacacaggtggccat

SEQ ID NO: 3533789 - DNA, 19 bp, Homo sapiens
acccacacaggtggccatc

SEQ ID NO: 3533790 - DNA, 19 bp, Homo sapiens
acccgagggacagcagatt

SEQ ID NO: 3533791 - DNA, 17 bp, Homo sapiens
accctagaagaaaaccc

SEQ ID NO: 3533792 - DNA, 17 bp, Homo sapiens
accctatatctccgtgt

SEQ ID NO: 3533793 - DNA, 22 bp, Homo sapiens
accctccccaaaggctttgccc

SEQ ID NO: 3533794 - DNA, 13 bp, Homo sapiens
accctctgaagaa

SEQ ID NO: 3533795 - DNA, 21 bp, Homo sapiens
accctgccctcatgggacctg

SEQ ID NO: 3533796 - DNA, 21 bp, Homo sapiens
acccttctccaaaggctctgt

SEQ ID NO: 3533797 - DNA, 17 bp, Homo sapiens
accgaaactgacttgct

SEQ ID NO: 3533798 - DNA, 20 bp, Homo sapiens
accggaatggtcaaatctct

SEQ ID NO: 3533799 - DNA, 17 bp, Homo sapiens
accgggggtggctctgt

SEQ ID NO: 3533800 - DNA, 15 bp, Homo sapiens
accgtggggaagggg

SEQ ID NO: 3533801 - DNA, 15 bp, Homo sapiens
acctctagtcagagt

SEQ ID NO: 3533802 - DNA, 15 bp, Homo sapiens
acctctgcttctgac

SEQ ID NO: 3533803 - DNA, 17 bp, Homo sapiens
acctgatggtgaaacca

SEQ ID NO: 3533804 - DNA, 15 bp, Homo sapiens
acctgccctccctca

SEQ ID NO: 3533805 - DNA, 16 bp, Homo sapiens
acctggagatggtgga

SEQ ID NO: 3533806 - DNA, 18 bp, Homo sapiens
acctggctggagaccgag

SEQ ID NO: 3533807 - DNA, 18 bp, Homo sapiens
accttagaccaccaagcc

SEQ ID NO: 3533808 - DNA, 19 bp, Homo sapiens
accttagaccaccaagcct

SEQ ID NO: 3533809 - DNA, 13 bp, Homo sapiens
acgatgcctttga

SEQ ID NO: 3533810 - DNA, 22 bp, Homo sapiens
acgccacagcccttttgtctct

SEQ ID NO: 3533811 - DNA, 19 bp, Homo sapiens
acgggcaagtgagagggga

SEQ ID NO: 3533812 - DNA, 21 bp, Homo sapiens
acgggcaagtgagaggggagg

SEQ ID NO: 3533813 - DNA, 18 bp, Homo sapiens
actaagttgcaagatctt

SEQ ID NO: 3533814 - DNA, 17 bp, Homo sapiens
actacataggttaattt

SEQ ID NO: 3533815 - DNA, 15 bp, Homo sapiens
actagagaaagacaa

SEQ ID NO: 3533816 - DNA, 14 bp, Homo sapiens
actagagtgctctg

SEQ ID NO: 3533817 - DNA, 18 bp, Homo sapiens
attgtctgattgaaacat

SEQ ID NO: 3533818 - DNA, 19 bp, Homo sapiens
attgtctgattgaaacatg

SEQ ID NO: 3533819 - DNA, 14 bp, Homo sapiens
attgttaaattcaa

SEQ ID NO: 3533820 - DNA, 14 bp, Homo sapiens
atttacaaatgaag

SEQ ID NO: 3533821 - DNA, 13 bp, Homo sapiens
atttatgaagttt

SEQ ID NO: 3533822 - DNA, 23 bp, Homo sapiens
atttatgtgctgttagaatatgt

SEQ ID NO: 3533823 - DNA, 13 bp, Homo sapiens
atttcagggaaaa

SEQ ID NO: 3533824 - DNA, 19 bp, Homo sapiens
atttctggaatgcttctgc

SEQ ID NO: 3533825 - DNA, 14 bp, Homo sapiens
atttgaattcattt

SEQ ID NO: 3533826 - DNA, 18 bp, Homo sapiens
atttgaattcatttgctg

SEQ ID NO: 3533827 - DNA, 18 bp, Homo sapiens
atttggccccaggggacg

SEQ ID NO: 3533828 - DNA, 19 bp, Homo sapiens
atttggccccaggggacgt

SEQ ID NO: 3533829 - DNA, 17 bp, Homo sapiens
atttgggaaaagaagct

SEQ ID NO: 3533830 - DNA, 15 bp, Homo sapiens
attttaaacattttt

SEQ ID NO: 3533831 - DNA, 18 bp, Homo sapiens
attttctccctggatttt

SEQ ID NO: 3533832 - DNA, 23 bp, Homo sapiens
attttctccctggatttttacca

SEQ ID NO: 3533833 - DNA, 15 bp, Homo sapiens
attttgataaattac

SEQ ID NO: 3533834 - DNA, 16 bp, Homo sapiens
attttgataaattact

SEQ ID NO: 3533835 - DNA, 23 bp, Homo sapiens
attttggtgcaatattcttgact

SEQ ID NO: 3533836 - DNA, 14 bp, Homo sapiens
atttttaacaagtc

SEQ ID NO: 3533837 - DNA, 12 bp, Homo sapiens
atttttaccagt

SEQ ID NO: 3533838 - DNA, 22 bp, Homo sapiens
attttttaagggatgttgcaaa

SEQ ID NO: 3533839 - DNA, 18 bp, Homo sapiens
attttttgtgatgaaaag

SEQ ID NO: 3533840 - DNA, 12 bp, Homo sapiens
caaaatgtgaat

SEQ ID NO: 3533841 - DNA, 14 bp, Homo sapiens
caaactatttcaga

SEQ ID NO: 3533842 - DNA, 16 bp, Homo sapiens
caaactggtttgaaat

SEQ ID NO: 3533843 - DNA, 23 bp, Homo sapiens
caaaggctttgccctgctgccct

SEQ ID NO: 3533844 - DNA, 13 bp, Homo sapiens
caaatgaagtatt

SEQ ID NO: 3533845 - DNA, 18 bp, Homo sapiens
caaatgaagtatttcatg

SEQ ID NO: 3533846 - DNA, 19 bp, Homo sapiens
caactcagaatgggggctt

SEQ ID NO: 3533847 - DNA, 21 bp, Homo sapiens
caactcagaatgggggctttc

SEQ ID NO: 3533848 - DNA, 16 bp, Homo sapiens
caagcagaagaccaga

SEQ ID NO: 3533849 - DNA, 13 bp, Homo sapiens
caaggagcagaga

SEQ ID NO: 3533850 - DNA, 15 bp, Homo sapiens
caagtagattggctg

SEQ ID NO: 3533851 - DNA, 18 bp, Homo sapiens
caagtgagaggggaggga

SEQ ID NO: 3533852 - DNA, 16 bp, Homo sapiens
caataaaagagcttta

SEQ ID NO: 3533853 - DNA, 17 bp, Homo sapiens
caataaaagagctttat

SEQ ID NO: 3533854 - DNA, 14 bp, Homo sapiens
caataaatatactt

SEQ ID NO: 3533855 - DNA, 17 bp, Homo sapiens
caataccctagaagaaa

SEQ ID NO: 3533856 - DNA, 20 bp, Homo sapiens
caataccctagaagaaaacc

SEQ ID NO: 3533857 - DNA, 21 bp, Homo sapiens
caataccctagaagaaaaccc

SEQ ID NO: 3533858 - DNA, 23 bp, Homo sapiens
caataccctagaagaaaacccga

SEQ ID NO: 3533859 - DNA, 13 bp, Homo sapiens
caatctgaccctt

SEQ ID NO: 3533860 - DNA, 16 bp, Homo sapiens
caatgcatacaataaa

SEQ ID NO: 3533861 - DNA, 19 bp, Homo sapiens
caatgcatacaataaaaga

SEQ ID NO: 3533862 - DNA, 22 bp, Homo sapiens
caatgcatacaataaaagagct

SEQ ID NO: 3533863 - DNA, 23 bp, Homo sapiens
caatgcatacaataaaagagctt

SEQ ID NO: 3533864 - DNA, 17 bp, Homo sapiens
caatgtgtttaattttg

SEQ ID NO: 3533865 - DNA, 14 bp, Homo sapiens
caatgttccaggaa

SEQ ID NO: 3533866 - DNA, 14 bp, Homo sapiens
caatttgctattta

SEQ ID NO: 3533867 - DNA, 17 bp, Homo sapiens
caatttgctatttacaa

SEQ ID NO: 3533868 - DNA, 19 bp, Homo sapiens
cacactcatgcattgtcct

SEQ ID NO: 3533869 - DNA, 20 bp, Homo sapiens
cacactcatgcattgtcctc

SEQ ID NO: 3533870 - DNA, 15 bp, Homo sapiens
cacagagccactctt

SEQ ID NO: 3533871 - DNA, 18 bp, Homo sapiens
cacaggacacgaaggctg

SEQ ID NO: 3533872 - DNA, 19 bp, Homo sapiens
cacaggacacgaaggctgc

SEQ ID NO: 3533873 - DNA, 13 bp, Homo sapiens
cacaggtggccat

SEQ ID NO: 3533874 - DNA, 13 bp, Homo sapiens
cacagttccccta

SEQ ID NO: 3533875 - DNA, 18 bp, Homo sapiens
cacagttgttgaatgact

SEQ ID NO: 3533876 - DNA, 19 bp, Homo sapiens
cacagttgttgaatgactg

SEQ ID NO: 3533877 - DNA, 23 bp, Homo sapiens
cacagttgttgaatgactgaccc

SEQ ID NO: 3533878 - DNA, 22 bp, Homo sapiens
cacatctcccccatagcaccct

SEQ ID NO: 3533879 - DNA, 16 bp, Homo sapiens
cacatgattccagcca

SEQ ID NO: 3533880 - DNA, 14 bp, Homo sapiens
cacatttgaattca

SEQ ID NO: 3533881 - DNA, 19 bp, Homo sapiens
caccatgacttgaggcaca

SEQ ID NO: 3533882 - DNA, 21 bp, Homo sapiens
cacccacacaggtggccatca

SEQ ID NO: 3533883 - DNA, 23 bp, Homo sapiens
cacccccgctttggttcttcaga

SEQ ID NO: 3533884 - DNA, 14 bp, Homo sapiens
caccctatggccac

SEQ ID NO: 3533885 - DNA, 15 bp, Homo sapiens
caccctatggccact

SEQ ID NO: 3533886 - DNA, 19 bp, Homo sapiens
caccctttcatagagaggc

SEQ ID NO: 3533887 - DNA, 14 bp, Homo sapiens
caccgggggtggct

SEQ ID NO: 3533888 - DNA, 18 bp, Homo sapiens
caccgggggtggctctgt

SEQ ID NO: 3533889 - DNA, 15 bp, Homo sapiens
caccttaactggaga

SEQ ID NO: 3533890 - DNA, 14 bp, Homo sapiens
caccttagaccacc

SEQ ID NO: 3533891 - DNA, 23 bp, Homo sapiens
caccttagaccaccaagccttga

SEQ ID NO: 3533892 - DNA, 15 bp, Homo sapiens
cacgatgcctttgag

SEQ ID NO: 3533893 - DNA, 13 bp, Homo sapiens
cacgccacagccc

SEQ ID NO: 3533894 - DNA, 16 bp, Homo sapiens
cacggtgaaagtgctg

SEQ ID NO: 3533895 - DNA, 17 bp, Homo sapiens
cacgttcagggaggggc

SEQ ID NO: 3533896 - DNA, 16 bp, Homo sapiens
cactaattgtccacag

SEQ ID NO: 3533897 - DNA, 16 bp, Homo sapiens
cactcagcactctgga

SEQ ID NO: 3533898 - DNA, 21 bp, Homo sapiens
cactcagcactctggactcca

SEQ ID NO: 3533899 - DNA, 18 bp, Homo sapiens
cactcatgcattgtcctc

SEQ ID NO: 3533900 - DNA, 15 bp, Homo sapiens
cactctatccaaagt

SEQ ID NO: 3533901 - DNA, 12 bp, Homo sapiens
cactctccagca

SEQ ID NO: 3533902 - DNA, 14 bp, Homo sapiens
cactgagtctggag

SEQ ID NO: 3533903 - DNA, 14 bp, Homo sapiens
cactgcagcagaaa

SEQ ID NO: 3533904 - DNA, 17 bp, Homo sapiens
cactgcagcagaaaaca

SEQ ID NO: 3533905 - DNA, 20 bp, Homo sapiens
cactgtggggaaacaatttt

SEQ ID NO: 3533906 - DNA, 17 bp, Homo sapiens
cacttaaacttgcacat

SEQ ID NO: 3533907 - DNA, 19 bp, Homo sapiens
cacttaaacttgcacattt

SEQ ID NO: 3533908 - DNA, 21 bp, Homo sapiens
cacttaaacttgcacatttga

SEQ ID NO: 3533909 - DNA, 22 bp, Homo sapiens
cacttggtgcataagcacagaa

SEQ ID NO: 3533910 - DNA, 20 bp, Homo sapiens
cagaaaatttgcaacatata

SEQ ID NO: 3533911 - DNA, 20 bp, Homo sapiens
cagaaagggaacagtccata

SEQ ID NO: 3533912 - DNA, 17 bp, Homo sapiens
cagaaatatattatgaa

SEQ ID NO: 3533913 - DNA, 20 bp, Homo sapiens
cagaaatatattatgaaaat

SEQ ID NO: 3533914 - DNA, 15 bp, Homo sapiens
cagaactataacatt

SEQ ID NO: 3533915 - DNA, 19 bp, Homo sapiens
cagaagaccagatccaaga

SEQ ID NO: 3533916 - DNA, 22 bp, Homo sapiens
cagaatgaacccatagggagct

SEQ ID NO: 3533917 - DNA, 18 bp, Homo sapiens
cagaccccagaactagaa

SEQ ID NO: 3533918 - DNA, 15 bp, Homo sapiens
cagacgttggtccca

SEQ ID NO: 3533919 - DNA, 16 bp, Homo sapiens
cagacgttggtcccaa

SEQ ID NO: 3533920 - DNA, 17 bp, Homo sapiens
cagagaacacagggctg

SEQ ID NO: 3533921 - DNA, 16 bp, Homo sapiens
cagagcgggagggagt

SEQ ID NO: 3533922 - DNA, 20 bp, Homo sapiens
cagaggcttttccagtgtgt

SEQ ID NO: 3533923 - DNA, 20 bp, Homo sapiens
cagatgttttatttatgaag

SEQ ID NO: 3533924 - DNA, 14 bp, Homo sapiens
cagattccacagga

SEQ ID NO: 3533925 - DNA, 15 bp, Homo sapiens
cagcactctggactc

SEQ ID NO: 3533926 - DNA, 21 bp, Homo sapiens
cagcataattcctccagttgg

SEQ ID NO: 3533927 - DNA, 20 bp, Homo sapiens
ctggactccacgatgccttt

SEQ ID NO: 3533928 - DNA, 23 bp, Homo sapiens
ctggactccacgatgcctttgag

SEQ ID NO: 3533929 - DNA, 18 bp, Homo sapiens
ctggagaccagaaacctt

SEQ ID NO: 3533930 - DNA, 17 bp, Homo sapiens
ctggagaccgaggccag

SEQ ID NO: 3533931 - DNA, 18 bp, Homo sapiens
ctggagaccgaggccaga

SEQ ID NO: 3533932 - DNA, 20 bp, Homo sapiens
ctggatcaagttcagccacc

SEQ ID NO: 3533933 - DNA, 16 bp, Homo sapiens
ctggcccccccagccc

SEQ ID NO: 3533934 - DNA, 15 bp, Homo sapiens
ctggcttcactctcc

SEQ ID NO: 3533935 - DNA, 12 bp, Homo sapiens
ctggggacccag

SEQ ID NO: 3533936 - DNA, 15 bp, Homo sapiens
ctggggacccagact

SEQ ID NO: 3533937 - DNA, 13 bp, Homo sapiens
ctggggagggggt

SEQ ID NO: 3533938 - DNA, 23 bp, Homo sapiens
ctggggcccctcccctcccgaac

SEQ ID NO: 3533939 - DNA, 21 bp, Homo sapiens
ctgggtaattaaaaacagaaa

SEQ ID NO: 3533940 - DNA, 19 bp, Homo sapiens
ctgggtgtaaaacctggag

SEQ ID NO: 3533941 - DNA, 16 bp, Homo sapiens
ctggtagctgagggga

SEQ ID NO: 3533942 - DNA, 17 bp, Homo sapiens
ctggtagctgaggggac

SEQ ID NO: 3533943 - DNA, 21 bp, Homo sapiens
ctggtagctgaggggacgggc

SEQ ID NO: 3533944 - DNA, 13 bp, Homo sapiens
ctggtgaccagac

SEQ ID NO: 3533945 - DNA, 12 bp, Homo sapiens
ctggtgctgctg

SEQ ID NO: 3533946 - DNA, 17 bp, Homo sapiens
ctgtaaggtttcaatgc

SEQ ID NO: 3533947 - DNA, 19 bp, Homo sapiens
ctgtcagacgttggtccca

SEQ ID NO: 3533948 - DNA, 15 bp, Homo sapiens
ctgtcagggagggcc

SEQ ID NO: 3533949 - DNA, 13 bp, Homo sapiens
ctgtcctaagaac

SEQ ID NO: 3533950 - DNA, 17 bp, Homo sapiens
ctgtcctaagaacttca

SEQ ID NO: 3533951 - DNA, 17 bp, Homo sapiens
ctgtgaagtgagacctt

SEQ ID NO: 3533952 - DNA, 13 bp, Homo sapiens
ctgtgggaaaaat

SEQ ID NO: 3533953 - DNA, 17 bp, Homo sapiens
ctgttatcagctgggca

SEQ ID NO: 3533954 - DNA, 22 bp, Homo sapiens
ctgttcctgatttttcatatgt

SEQ ID NO: 3533955 - DNA, 14 bp, Homo sapiens
ctgtttgtacaaac

SEQ ID NO: 3533956 - DNA, 18 bp, Homo sapiens
cttaaacttgcacatttg

SEQ ID NO: 3533957 - DNA, 15 bp, Homo sapiens
cttaactgttgttga

SEQ ID NO: 3533958 - DNA, 16 bp, Homo sapiens
cttaactgttgttgac

SEQ ID NO: 3533959 - DNA, 21 bp, Homo sapiens
cttaagatgtccagggcccca

SEQ ID NO: 3533960 - DNA, 17 bp, Homo sapiens
cttacctctgcttctga

SEQ ID NO: 3533961 - DNA, 15 bp, Homo sapiens
cttagattcagggga

SEQ ID NO: 3533962 - DNA, 19 bp, Homo sapiens
cttatagtcactcattctt

SEQ ID NO: 3533963 - DNA, 16 bp, Homo sapiens
cttatctactgactga

SEQ ID NO: 3533964 - DNA, 22 bp, Homo sapiens
cttcaagtagattggctgggca

SEQ ID NO: 3533965 - DNA, 17 bp, Homo sapiens
cttcaggcccgctgccc

SEQ ID NO: 3533966 - DNA, 22 bp, Homo sapiens
cttccggggaaggattttgcag

SEQ ID NO: 3533967 - DNA, 17 bp, Homo sapiens
cttctaatgtaaatttt

SEQ ID NO: 3533968 - DNA, 18 bp, Homo sapiens
cttctattgcctctgaga

SEQ ID NO: 3533969 - DNA, 24 bp, Homo sapiens
cttctattgcctctgagagcatca

SEQ ID NO: 3533970 - DNA, 12 bp, Homo sapiens
cttctctttcaa

SEQ ID NO: 3533971 - DNA, 18 bp, Homo sapiens
cttctctttcaatgtgtt

SEQ ID NO: 3533972 - DNA, 11 bp, Homo sapiens
cttctgcatca

SEQ ID NO: 3533973 - DNA, 17 bp, Homo sapiens
cttgggccctggaagag

SEQ ID NO: 3533974 - DNA, 18 bp, Homo sapiens
cttgtgactcagcagagg

SEQ ID NO: 3533975 - DNA, 15 bp, Homo sapiens
ctttatgaattattt

SEQ ID NO: 3533976 - DNA, 17 bp, Homo sapiens
ctttcacgggccccatt

SEQ ID NO: 3533977 - DNA, 18 bp, Homo sapiens
ctttcatagagaggcctg

SEQ ID NO: 3533978 - DNA, 19 bp, Homo sapiens
ctttcatagagaggcctgc

SEQ ID NO: 3533979 - DNA, 20 bp, Homo sapiens
ctttcatatgaggggaccca

SEQ ID NO: 3533980 - DNA, 21 bp, Homo sapiens
ctttcatatgaggggacccag

SEQ ID NO: 3533981 - DNA, 23 bp, Homo sapiens
ctttctttaggaaagagaagctt

SEQ ID NO: 3533982 - DNA, 15 bp, Homo sapiens
ctttgtgaacattct

SEQ ID NO: 3533983 - DNA, 16 bp, Homo sapiens
ctttgtgaacattctg

SEQ ID NO: 3533984 - DNA, 17 bp, Homo sapiens
ctttgtgaacattctgt

SEQ ID NO: 3533985 - DNA, 23 bp, Homo sapiens
cttttctaagaataatggactct

SEQ ID NO: 3533986 - DNA, 18 bp, Homo sapiens
cttttcttctattgcctc

SEQ ID NO: 3533987 - DNA, 19 bp, Homo sapiens
cttttcttctattgcctct

SEQ ID NO: 3533988 - DNA, 13 bp, Homo sapiens
cttttggccccag

SEQ ID NO: 3533989 - DNA, 17 bp, Homo sapiens
cttttgttctgaggggt

SEQ ID NO: 3533990 - DNA, 14 bp, Homo sapiens
gaaaaaatgctgag

SEQ ID NO: 3533991 - DNA, 18 bp, Homo sapiens
gaaaaactcccatatcat

SEQ ID NO: 3533992 - DNA, 14 bp, Homo sapiens
gaaaaatggccatg

SEQ ID NO: 3533993 - DNA, 14 bp, Homo sapiens
gaaaacagaagcaa

SEQ ID NO: 3533994 - DNA, 13 bp, Homo sapiens
gaaaacccgaggg

SEQ ID NO: 3533995 - DNA, 17 bp, Homo sapiens
gaaaagaagctgtcaga

SEQ ID NO: 3533996 - DNA, 18 bp, Homo sapiens
gaaaaggcagcatttgaa

SEQ ID NO: 3533997 - DNA, 15 bp, Homo sapiens
gaaaataagaaagaa

SEQ ID NO: 3533998 - DNA, 16 bp, Homo sapiens
gaaaataagaaagaat

SEQ ID NO: 3533999 - DNA, 20 bp, Homo sapiens
gaaaataagaaagaattgca

SEQ ID NO: 3534000 - DNA, 16 bp, Homo sapiens
gaaaataagacttctg

SEQ ID NO: 3534001 - DNA, 23 bp, Homo sapiens
gaaaataagacttctggtgctgc

SEQ ID NO: 3534002 - DNA, 15 bp, Homo sapiens
gaaaattaagattat

SEQ ID NO: 3534003 - DNA, 21 bp, Homo sapiens
gaaactatccttctctttcaa

SEQ ID NO: 3534004 - DNA, 23 bp, Homo sapiens
gaaaggcctgcttttgtgtccca

SEQ ID NO: 3534005 - DNA, 19 bp, Homo sapiens
gaaataaagtaggaaagaa

SEQ ID NO: 3534006 - DNA, 15 bp, Homo sapiens
gaaatagtgcactcc

SEQ ID NO: 3534007 - DNA, 22 bp, Homo sapiens
gaaatcagtggtgttacatttt

SEQ ID NO: 3534008 - DNA, 21 bp, Homo sapiens
gaaatctgaaaaatggccatg

SEQ ID NO: 3534009 - DNA, 19 bp, Homo sapiens
gaaatttttgatgcccaga

SEQ ID NO: 3534010 - DNA, 15 bp, Homo sapiens
gaacatttaaaatta

SEQ ID NO: 3534011 - DNA, 13 bp, Homo sapiens
gaacccataggga

SEQ ID NO: 3534012 - DNA, 16 bp, Homo sapiens
gaagaaggtgggagga

SEQ ID NO: 3534013 - DNA, 14 bp, Homo sapiens
gaagaggaggaggt

SEQ ID NO: 3534014 - DNA, 20 bp, Homo sapiens
gaagaggaggaggtgggggc

SEQ ID NO: 3534015 - DNA, 16 bp, Homo sapiens
gaagcagtggggtagg

SEQ ID NO: 3534016 - DNA, 23 bp, Homo sapiens
gaagcagtggggtaggctgctgc

SEQ ID NO: 3534017 - DNA, 14 bp, Homo sapiens
gaagctgtcagaag

SEQ ID NO: 3534018 - DNA, 17 bp, Homo sapiens
gaagctttcaggggaag

SEQ ID NO: 3534019 - DNA, 16 bp, Homo sapiens
gaagtcctgggaggat

SEQ ID NO: 3534020 - DNA, 21 bp, Homo sapiens
gaagtcctgggaggatcctga

SEQ ID NO: 3534021 - DNA, 15 bp, Homo sapiens
gaagttgggggaaag

SEQ ID NO: 3534022 - DNA, 13 bp, Homo sapiens
gaataatggactc

SEQ ID NO: 3534023 - DNA, 14 bp, Homo sapiens
gaataatggactct

SEQ ID NO: 3534024 - DNA, 15 bp, Homo sapiens
gaataggttactttg

SEQ ID NO: 3534025 - DNA, 16 bp, Homo sapiens
gaatatgttgattttt

SEQ ID NO: 3534026 - DNA, 22 bp, Homo sapiens
gaatctcccaaggagggcacca

SEQ ID NO: 3534027 - DNA, 18 bp, Homo sapiens
gaatctcgttgaggccaa

SEQ ID NO: 3534028 - DNA, 19 bp, Homo sapiens
gaatgaaatatagatgtta

SEQ ID NO: 3534029 - DNA, 15 bp, Homo sapiens
gaatgactgacccaa

SEQ ID NO: 3534030 - DNA, 22 bp, Homo sapiens
gaatgactgacccaaaatgtga

SEQ ID NO: 3534031 - DNA, 23 bp, Homo sapiens
gaatgactgacccaaaatgtgaa

SEQ ID NO: 3534032 - DNA, 22 bp, Homo sapiens
gaatgcttctgcatcaaaggag

SEQ ID NO: 3534033 - DNA, 19 bp, Homo sapiens
gaattattttgataaatta

SEQ ID NO: 3534034 - DNA, 13 bp, Homo sapiens
gaattcagaaaga

SEQ ID NO: 3534035 - DNA, 14 bp, Homo sapiens
gaattcatttgctg

SEQ ID NO: 3534036 - DNA, 17 bp, Homo sapiens
gaattgcagtaaagtct

SEQ ID NO: 3534037 - DNA, 19 bp, Homo sapiens
gtgaaacattttctccctg

SEQ ID NO: 3534038 - DNA, 12 bp, Homo sapiens
gtgaaaggcctg

SEQ ID NO: 3534039 - DNA, 16 bp, Homo sapiens
gtgaaagtgctgctct

SEQ ID NO: 3534040 - DNA, 15 bp, Homo sapiens
gtgactcagcagagg

SEQ ID NO: 3534041 - DNA, 17 bp, Homo sapiens
gtgagaggggagggagg

SEQ ID NO: 3534042 - DNA, 17 bp, Homo sapiens
gtgagtgaagctccctt

SEQ ID NO: 3534043 - DNA, 22 bp, Homo sapiens
gtgcaggtggggtgatggccag

SEQ ID NO: 3534044 - DNA, 18 bp, Homo sapiens
gtgcctcctagccccttc

SEQ ID NO: 3534045 - DNA, 20 bp, Homo sapiens
gtgctgctctaggcccacaa

SEQ ID NO: 3534046 - DNA, 13 bp, Homo sapiens
gtggatctccccc

SEQ ID NO: 3534047 - DNA, 20 bp, Homo sapiens
gtggccaccgggggtggctc

SEQ ID NO: 3534048 - DNA, 21 bp, Homo sapiens
gtggccaccgggggtggctct

SEQ ID NO: 3534049 - DNA, 19 bp, Homo sapiens
gtggccacgttcagggagg

SEQ ID NO: 3534050 - DNA, 22 bp, Homo sapiens
gtggccctgactgtcagggagg

SEQ ID NO: 3534051 - DNA, 14 bp, Homo sapiens
gtgggccctgcagg

SEQ ID NO: 3534052 - DNA, 20 bp, Homo sapiens
gtgggccctgcaggctgcag

SEQ ID NO: 3534053 - DNA, 19 bp, Homo sapiens
gtggggtgatggccagagg

SEQ ID NO: 3534054 - DNA, 19 bp, Homo sapiens
gtggtctgaactgcttgct

SEQ ID NO: 3534055 - DNA, 17 bp, Homo sapiens
gtgtattgtaatgtata

SEQ ID NO: 3534056 - DNA, 12 bp, Homo sapiens
gtgtccgagagg

SEQ ID NO: 3534057 - DNA, 15 bp, Homo sapiens
gtgtgtgtgtgtatg

SEQ ID NO: 3534058 - DNA, 15 bp, Homo sapiens
gtgttggtgaaaata

SEQ ID NO: 3534059 - DNA, 16 bp, Homo sapiens
gttaagtacccgaggc

SEQ ID NO: 3534060 - DNA, 13 bp, Homo sapiens
gttacatttatgt

SEQ ID NO: 3534061 - DNA, 15 bp, Homo sapiens
gttacattttcttgt

SEQ ID NO: 3534062 - DNA, 18 bp, Homo sapiens
gttagtagcagaaatata

SEQ ID NO: 3534063 - DNA, 13 bp, Homo sapiens
gttatcagctggg

SEQ ID NO: 3534064 - DNA, 22 bp, Homo sapiens
gttcagggaggggccggctggc

SEQ ID NO: 3534065 - DNA, 16 bp, Homo sapiens
gttcagtattgcaata

SEQ ID NO: 3534066 - DNA, 18 bp, Homo sapiens
gttcctgatttttcatat

SEQ ID NO: 3534067 - DNA, 14 bp, Homo sapiens
gttctctgctgtcc

SEQ ID NO: 3534068 - DNA, 14 bp, Homo sapiens
gttctgaggggtgt

SEQ ID NO: 3534069 - DNA, 13 bp, Homo sapiens
gttgaggaagtca

SEQ ID NO: 3534070 - DNA, 22 bp, Homo sapiens
gttgctccaggatgcattctga

SEQ ID NO: 3534071 - DNA, 14 bp, Homo sapiens
gttggcgtgtccca

SEQ ID NO: 3534072 - DNA, 15 bp, Homo sapiens
gttggcgtgtcccag

SEQ ID NO: 3534073 - DNA, 21 bp, Homo sapiens
gtttcaatgcatacaataaaa

SEQ ID NO: 3534074 - DNA, 17 bp, Homo sapiens
gttttatttatgaagtt

SEQ ID NO: 3534075 - DNA, 19 bp, Homo sapiens
gttttccttgtgactaagt

SEQ ID NO: 3534076 - DNA, 20 bp, Homo sapiens
taaaacacaaaatgaataaa

SEQ ID NO: 3534077 - DNA, 15 bp, Homo sapiens
taaaattaaataaat

SEQ ID NO: 3534078 - DNA, 14 bp, Homo sapiens
taaaattaaatact

SEQ ID NO: 3534079 - DNA, 16 bp, Homo sapiens
taaacttgcacatttg

SEQ ID NO: 3534080 - DNA, 17 bp, Homo sapiens
taaacttgcacatttga

SEQ ID NO: 3534081 - DNA, 14 bp, Homo sapiens
taaagattgttaaa

SEQ ID NO: 3534082 - DNA, 13 bp, Homo sapiens
taaaggacactgg

SEQ ID NO: 3534083 - DNA, 14 bp, Homo sapiens
taaaggacactgga

SEQ ID NO: 3534084 - DNA, 17 bp, Homo sapiens
taaaggacactggatca

SEQ ID NO: 3534085 - DNA, 18 bp, Homo sapiens
taaagtaggaaagaattt

SEQ ID NO: 3534086 - DNA, 14 bp, Homo sapiens
taaatctttgtgaa

SEQ ID NO: 3534087 - DNA, 18 bp, Homo sapiens
taaatctttgtgaacatt

SEQ ID NO: 3534088 - DNA, 15 bp, Homo sapiens
taaattactaattat

SEQ ID NO: 3534089 - DNA, 20 bp, Homo sapiens
taaattactaattatcttat

SEQ ID NO: 3534090 - DNA, 15 bp, Homo sapiens
taaattttaatgtta

SEQ ID NO: 3534091 - DNA, 16 bp, Homo sapiens
taaatttttaaaatct

SEQ ID NO: 3534092 - DNA, 23 bp, Homo sapiens
taactgttcagtattgcaataaa

SEQ ID NO: 3534093 - DNA, 14 bp, Homo sapiens
taactgttgttgac

SEQ ID NO: 3534094 - DNA, 17 bp, Homo sapiens
taagaaagaattgcagt

SEQ ID NO: 3534095 - DNA, 15 bp, Homo sapiens
taagacttaatatgt

SEQ ID NO: 3534096 - DNA, 17 bp, Homo sapiens
taagatagttacattta

SEQ ID NO: 3534097 - DNA, 18 bp, Homo sapiens
taagatagttacatttat

SEQ ID NO: 3534098 - DNA, 12 bp, Homo sapiens
taagcagccagg

SEQ ID NO: 3534099 - DNA, 13 bp, Homo sapiens
taagcagccagga

SEQ ID NO: 3534100 - DNA, 14 bp, Homo sapiens
taagcagccaggag

SEQ ID NO: 3534101 - DNA, 18 bp, Homo sapiens
taagtgaacaactggaaa

SEQ ID NO: 3534102 - DNA, 20 bp, Homo sapiens
taagtgaacaactggaaata

SEQ ID NO: 3534103 - DNA, 22 bp, Homo sapiens
taagtgaacaactggaaataaa

SEQ ID NO: 3534104 - DNA, 19 bp, Homo sapiens
taatgcggacacttttgag

SEQ ID NO: 3534105 - DNA, 22 bp, Homo sapiens
taatgcggacacttttgaggac

SEQ ID NO: 3534106 - DNA, 15 bp, Homo sapiens
taatgtaaattttaa

SEQ ID NO: 3534107 - DNA, 15 bp, Homo sapiens
taatgtgaatgtgag

SEQ ID NO: 3534108 - DNA, 16 bp, Homo sapiens
taatgtgaatgtgagt

SEQ ID NO: 3534109 - DNA, 18 bp, Homo sapiens
taatgttaactttcaaat

SEQ ID NO: 3534110 - DNA, 16 bp, Homo sapiens
taattaaaaacagaaa

SEQ ID NO: 3534111 - DNA, 13 bp, Homo sapiens
taattcctccagt

SEQ ID NO: 3534112 - DNA, 16 bp, Homo sapiens
tacaaactatttcaga

SEQ ID NO: 3534113 - DNA, 22 bp, Homo sapiens
tacaaatgaagtatttcatgta

SEQ ID NO: 3534114 - DNA, 15 bp, Homo sapiens
tacaataaaagagct

SEQ ID NO: 3534115 - DNA, 18 bp, Homo sapiens
tacaataaaagagcttta

SEQ ID NO: 3534116 - DNA, 19 bp, Homo sapiens
tacaataaaagagctttat

SEQ ID NO: 3534117 - DNA, 17 bp, Homo sapiens
tacacctccactcagca

SEQ ID NO: 3534118 - DNA, 19 bp, Homo sapiens
tacagaaaatttgcaacat

SEQ ID NO: 3534119 - DNA, 16 bp, Homo sapiens
tacagagactctccct

SEQ ID NO: 3534120 - DNA, 17 bp, Homo sapiens
tacattttcttgtccaa

SEQ ID NO: 3534121 - DNA, 18 bp, Homo sapiens
tacattttcttgtccaaa

SEQ ID NO: 3534122 - DNA, 14 bp, Homo sapiens
taccagtctcacat

SEQ ID NO: 3534123 - DNA, 16 bp, Homo sapiens
taccctagaagaaaac

SEQ ID NO: 3534124 - DNA, 20 bp, Homo sapiens
tactcataaaggacactgga

SEQ ID NO: 3534125 - DNA, 21 bp, Homo sapiens
tactcataaaggacactggat

SEQ ID NO: 3534126 - DNA, 22 bp, Homo sapiens
tactgaaaaaatgctgagccag

SEQ ID NO: 3534127 - DNA, 17 bp, Homo sapiens
tactgactgaaatcagt

SEQ ID NO: 3534128 - DNA, 15 bp, Homo sapiens
tactttggactgagt

SEQ ID NO: 3534129 - DNA, 22 bp, Homo sapiens
tacttttcttctattgcctctg

SEQ ID NO: 3534130 - DNA, 13 bp, Homo sapiens
tagaagaaaaccc

SEQ ID NO: 3534131 - DNA, 14 bp, Homo sapiens
tagaagaaaacccg

SEQ ID NO: 3534132 - DNA, 16 bp, Homo sapiens
tagaccaccaagcctt

SEQ ID NO: 3534133 - DNA, 17 bp, Homo sapiens
tagaccaccaagccttg

SEQ ID NO: 3534134 - DNA, 20 bp, Homo sapiens
tagagaaagacaaaatgtga

SEQ ID NO: 3534135 - DNA, 12 bp, Homo sapiens
tagagaggcctg

SEQ ID NO: 3534136 - DNA, 21 bp, Homo sapiens
tagattggctgggcaaaagaa

SEQ ID NO: 3534137 - DNA, 16 bp, Homo sapiens
tagcaatgttccagga

SEQ ID NO: 3534138 - DNA, 10 bp, Homo sapiens
tagcaccctg

SEQ ID NO: 3534139 - DNA, 16 bp, Homo sapiens
tagcagaaatatatta

SEQ ID NO: 3534140 - DNA, 23 bp, Homo sapiens
tagcagaaatatattatgaaaat

SEQ ID NO: 3534141 - DNA, 19 bp, Homo sapiens
tagcccatcttcctgagct

SEQ ID NO: 3534142 - DNA, 16 bp, Homo sapiens
tagctgaggggacggg

SEQ ID NO: 3534143 - DNA, 23 bp, Homo sapiens
taggagggggcggcagggctggg

SEQ ID NO: 3534144 - DNA, 23 bp, Homo sapiens
taggatatgccctcctggtgact

SEQ ID NO: 3534145 - DNA, 16 bp, Homo sapiens
taggatgtatgctgtt

SEQ ID NO: 3534146 - DNA, 14 bp, Homo sapiens
taggctgctgccct

SEQ ID NO: 3534147 - DNA, 15 bp, Homo sapiens
ttgaaacatgaaaca

SEQ ID NO: 3534148 - DNA, 18 bp, Homo sapiens
ttgagcctgtgaccttgg

SEQ ID NO: 3534149 - DNA, 21 bp, Homo sapiens
ttgaggaagtcaggctgttgg

SEQ ID NO: 3534150 - DNA, 17 bp, Homo sapiens
ttgcaacatataaagta

SEQ ID NO: 3534151 - DNA, 15 bp, Homo sapiens
ttgcagcctggtcac

SEQ ID NO: 3534152 - DNA, 20 bp, Homo sapiens
ttgccagttgtcctccttcc

SEQ ID NO: 3534153 - DNA, 18 bp, Homo sapiens
ttgccctgctgccctccc

SEQ ID NO: 3534154 - DNA, 19 bp, Homo sapiens
ttgctaccaatctgtgaga

SEQ ID NO: 3534155 - DNA, 22 bp, Homo sapiens
ttgctgacttcccaagccctgg

SEQ ID NO: 3534156 - DNA, 17 bp, Homo sapiens
ttgcttttatcagtgtt

SEQ ID NO: 3534157 - DNA, 11 bp, Homo sapiens
ttggaaagaac

SEQ ID NO: 3534158 - DNA, 14 bp, Homo sapiens
ttggcgtgtcccag

SEQ ID NO: 3534159 - DNA, 17 bp, Homo sapiens
ttgggaaaagaagctgt

SEQ ID NO: 3534160 - DNA, 12 bp, Homo sapiens
ttggtcccaagt

SEQ ID NO: 3534161 - DNA, 20 bp, Homo sapiens
ttggtgaaaataagaaagaa

SEQ ID NO: 3534162 - DNA, 17 bp, Homo sapiens
ttgtaaatctttgtgaa

SEQ ID NO: 3534163 - DNA, 19 bp, Homo sapiens
ttgtaagctataacatatt

SEQ ID NO: 3534164 - DNA, 19 bp, Homo sapiens
ttgtaatgtatacttgaaa

SEQ ID NO: 3534165 - DNA, 18 bp, Homo sapiens
ttgtctgattgaaacatg

SEQ ID NO: 3534166 - DNA, 19 bp, Homo sapiens
ttgtgactaagttgcaaga

SEQ ID NO: 3534167 - DNA, 20 bp, Homo sapiens
ttgttaaaacacaaaatgaa

SEQ ID NO: 3534168 - DNA, 21 bp, Homo sapiens
ttgttaaaacacaaaatgaat

SEQ ID NO: 3534169 - DNA, 20 bp, Homo sapiens
tttaaaagatataagactta

SEQ ID NO: 3534170 - DNA, 20 bp, Homo sapiens
tttaaaattaaataaatttt

SEQ ID NO: 3534171 - DNA, 12 bp, Homo sapiens
tttaaacatttt

SEQ ID NO: 3534172 - DNA, 16 bp, Homo sapiens
tttaatgttaactttc

SEQ ID NO: 3534173 - DNA, 15 bp, Homo sapiens
tttacaaatgaagta

SEQ ID NO: 3534174 - DNA, 18 bp, Homo sapiens
tttacaaatgaagtattt

SEQ ID NO: 3534175 - DNA, 14 bp, Homo sapiens
tttacttttcttct

SEQ ID NO: 3534176 - DNA, 13 bp, Homo sapiens
tttatgaagtttt

SEQ ID NO: 3534177 - DNA, 13 bp, Homo sapiens
tttattagtaaca

SEQ ID NO: 3534178 - DNA, 17 bp, Homo sapiens
tttattagtaacatcat

SEQ ID NO: 3534179 - DNA, 13 bp, Homo sapiens
tttcaaatccact

SEQ ID NO: 3534180 - DNA, 18 bp, Homo sapiens
tttcagggaaaacagaag

SEQ ID NO: 3534181 - DNA, 11 bp, Homo sapiens
tttccctaagc

SEQ ID NO: 3534182 - DNA, 14 bp, Homo sapiens
tttcggggagggcg

SEQ ID NO: 3534183 - DNA, 17 bp, Homo sapiens
tttctccctccttcctt

SEQ ID NO: 3534184 - DNA, 14 bp, Homo sapiens
tttctccctggatt

SEQ ID NO: 3534185 - DNA, 21 bp, Homo sapiens
tttctccctggatttttacca

SEQ ID NO: 3534186 - DNA, 16 bp, Homo sapiens
tttctgatagtagtct

SEQ ID NO: 3534187 - DNA, 17 bp, Homo sapiens
tttcttctattgcctct

SEQ ID NO: 3534188 - DNA, 13 bp, Homo sapiens
tttcttgtccaaa

SEQ ID NO: 3534189 - DNA, 14 bp, Homo sapiens
tttgaggacaagtt

SEQ ID NO: 3534190 - DNA, 12 bp, Homo sapiens
tttgataaatta

SEQ ID NO: 3534191 - DNA, 13 bp, Homo sapiens
tttgatagcaatg

SEQ ID NO: 3534192 - DNA, 21 bp, Homo sapiens
tttgccctgctgccctccccc

SEQ ID NO: 3534193 - DNA, 23 bp, Homo sapiens
tttgccctgctgccctccccctc

SEQ ID NO: 3534194 - DNA, 14 bp, Homo sapiens
tttgctatttacaa

SEQ ID NO: 3534195 - DNA, 15 bp, Homo sapiens
tttgctatttacaaa

SEQ ID NO: 3534196 - DNA, 22 bp, Homo sapiens
tttggagaccaggcctcagctc

SEQ ID NO: 3534197 - DNA, 13 bp, Homo sapiens
tttgtaaatcttt

SEQ ID NO: 3534198 - DNA, 23 bp, Homo sapiens
tttgtctctgcaaactgccttct

SEQ ID NO: 3534199 - DNA, 14 bp, Homo sapiens
tttgtgatgaaaag

SEQ ID NO: 3534200 - DNA, 22 bp, Homo sapiens
tttgtgatgaaaaggcagcatt

SEQ ID NO: 3534201 - DNA, 22 bp, Homo sapiens
tttgtgtcccattcacatgccc

SEQ ID NO: 3534202 - DNA, 17 bp, Homo sapiens
tttgttgctcagtgtgt

SEQ ID NO: 3534203 - DNA, 19 bp, Homo sapiens
ttttaagggatgttgcaaa

SEQ ID NO: 3534204 - DNA, 20 bp, Homo sapiens
ttttaagggatgttgcaaag

SEQ ID NO: 3534205 - DNA, 19 bp, Homo sapiens
ttttagacgatcacagaaa

SEQ ID NO: 3534206 - DNA, 13 bp, Homo sapiens
ttttatatgtgga

SEQ ID NO: 3534207 - DNA, 22 bp, Homo sapiens
ttttctccctggatttttacca

SEQ ID NO: 3534208 - DNA, 16 bp, Homo sapiens
ttttgaggacaagtta

SEQ ID NO: 3534209 - DNA, 13 bp, Homo sapiens
ttttgtgtcccat

SEQ ID NO: 3534210 - DNA, 12 bp, Homo sapiens
ttttttttaaaa

SEQ ID NO: 3534211 - DNA, 15 bp, Homo sapiens
aattaagattattgt

SEQ ID NO: 3534212 - DNA, 13 bp, Homo sapiens
aattacagaaaat

SEQ ID NO: 3534213 - DNA, 22 bp, Homo sapiens
aattacagaaaatttgcaacat

SEQ ID NO: 3534214 - DNA, 14 bp, Homo sapiens
aattagatttctga

SEQ ID NO: 3534215 - DNA, 16 bp, Homo sapiens
aattattttgataaat

SEQ ID NO: 3534216 - DNA, 21 bp, Homo sapiens
aattgcagtaaagtcttgtct

SEQ ID NO: 3534217 - DNA, 23 bp, Homo sapiens
aatttacctcttatgagctccat

SEQ ID NO: 3534218 - DNA, 16 bp, Homo sapiens
aatttgcaacatataa

SEQ ID NO: 3534219 - DNA, 23 bp, Homo sapiens
aattttaatgttaactttcaaat

SEQ ID NO: 3534220 - DNA, 15 bp, Homo sapiens
aattttaattaaaaa

SEQ ID NO: 3534221 - DNA, 17 bp, Homo sapiens
aattttttgtgatgaaa

SEQ ID NO: 3534222 - DNA, 14 bp, Homo sapiens
acaaaactgtgaat

SEQ ID NO: 3534223 - DNA, 15 bp, Homo sapiens
acaaactatttcaga

SEQ ID NO: 3534224 - DNA, 19 bp, Homo sapiens
acaaactatttcagaatat

SEQ ID NO: 3534225 - DNA, 23 bp, Homo sapiens
acaaactggtttgaaatttttga

SEQ ID NO: 3534226 - DNA, 21 bp, Homo sapiens
acaagtcatttcaaaatatgt

SEQ ID NO: 3534227 - DNA, 12 bp, Homo sapiens
acaataaatata

SEQ ID NO: 3534228 - DNA, 21 bp, Homo sapiens
acaattttttgtgatgaaaag

SEQ ID NO: 3534229 - DNA, 12 bp, Homo sapiens
acaccctatatc

SEQ ID NO: 3534230 - DNA, 18 bp, Homo sapiens
acacctccactcagcact

SEQ ID NO: 3534231 - DNA, 16 bp, Homo sapiens
acactaattgtccaca

SEQ ID NO: 3534232 - DNA, 11 bp, Homo sapiens
acactggatca

SEQ ID NO: 3534233 - DNA, 18 bp, Homo sapiens
acagaaaatttgcaacat

SEQ ID NO: 3534234 - DNA, 22 bp, Homo sapiens
acagaaacggtctttatgaatt

SEQ ID NO: 3534235 - DNA, 16 bp, Homo sapiens
acagcccccgggacac

SEQ ID NO: 3534236 - DNA, 16 bp, Homo sapiens
acagcccttttgtctc

SEQ ID NO: 3534237 - DNA, 13 bp, Homo sapiens
acaggttggccgt

SEQ ID NO: 3534238 - DNA, 13 bp, Homo sapiens
acagtgaggaaaa

SEQ ID NO: 3534239 - DNA, 19 bp, Homo sapiens
acagttcccctatgtggaa

SEQ ID NO: 3534240 - DNA, 16 bp, Homo sapiens
acatatttattgtgca

SEQ ID NO: 3534241 - DNA, 23 bp, Homo sapiens
acatatttattgtgcattaaaat

SEQ ID NO: 3534242 - DNA, 20 bp, Homo sapiens
acatttaaaattaaataaat

SEQ ID NO: 3534243 - DNA, 13 bp, Homo sapiens
acatttatgtgct

SEQ ID NO: 3534244 - DNA, 17 bp, Homo sapiens
acatttatgtgctgtta

SEQ ID NO: 3534245 - DNA, 18 bp, Homo sapiens
acatttctgtgaaactat

SEQ ID NO: 3534246 - DNA, 19 bp, Homo sapiens
acatttgaattcatttgct

SEQ ID NO: 3534247 - DNA, 20 bp, Homo sapiens
acattttttttaaaaattag

SEQ ID NO: 3534248 - DNA, 19 bp, Homo sapiens
accaaaaaaaagcatgaat

SEQ ID NO: 3534249 - DNA, 15 bp, Homo sapiens
accaaacatttctgt

SEQ ID NO: 3534250 - DNA, 22 bp, Homo sapiens
accaaacatttctgtgaaacta

SEQ ID NO: 3534251 - DNA, 13 bp, Homo sapiens
accaaagggggag

SEQ ID NO: 3534252 - DNA, 15 bp, Homo sapiens
accaagtgtattgta

SEQ ID NO: 3534253 - DNA, 22 bp, Homo sapiens
accaatctgtgagaagtttttg

SEQ ID NO: 3534254 - DNA, 19 bp, Homo sapiens
accaccaagccttgattgg

SEQ ID NO: 3534255 - DNA, 11 bp, Homo sapiens
accagttttga

SEQ ID NO: 3534256 - DNA, 14 bp, Homo sapiens
accagttttgatat

SEQ ID NO: 3534257 - DNA, 16 bp, Homo sapiens
accagttttgatattt

SEQ ID NO: 3534258 - DNA, 23 bp, Homo sapiens
accatgacaaaatagcccagcct

SEQ ID NO: 3534259 - DNA, 15 bp, Homo sapiens
acccatcttgaaaaa

SEQ ID NO: 3534260 - DNA, 22 bp, Homo sapiens
acccatcttgaaaaacactatt

SEQ ID NO: 3534261 - DNA, 17 bp, Homo sapiens
acccatctttctcacac

SEQ ID NO: 3534262 - DNA, 14 bp, Homo sapiens
accctatggccact

SEQ ID NO: 3534263 - DNA, 15 bp, Homo sapiens
accctatggccactg

SEQ ID NO: 3534264 - DNA, 22 bp, Homo sapiens
accctgtcagacgttggtccca

SEQ ID NO: 3534265 - DNA, 22 bp, Homo sapiens
acctccactcagcactctggac

SEQ ID NO: 3534266 - DNA, 13 bp, Homo sapiens
acctgatttcagc

SEQ ID NO: 3534267 - DNA, 17 bp, Homo sapiens
acctggaacacctgatg

SEQ ID NO: 3534268 - DNA, 20 bp, Homo sapiens
acctgttgctccaggatgca

SEQ ID NO: 3534269 - DNA, 13 bp, Homo sapiens
accttaactggag

SEQ ID NO: 3534270 - DNA, 14 bp, Homo sapiens
accttaactggaga

SEQ ID NO: 3534271 - DNA, 16 bp, Homo sapiens
accttgggaccaaagg

SEQ ID NO: 3534272 - DNA, 15 bp, Homo sapiens
accttgggccctgga

SEQ ID NO: 3534273 - DNA, 16 bp, Homo sapiens
acgactagcccaggac

SEQ ID NO: 3534274 - DNA, 19 bp, Homo sapiens
acgaggatttccctgaagc

SEQ ID NO: 3534275 - DNA, 17 bp, Homo sapiens
acgccacagcccttttg

SEQ ID NO: 3534276 - DNA, 17 bp, Homo sapiens
acggcgctgcctcaggc

SEQ ID NO: 3534277 - DNA, 23 bp, Homo sapiens
acggctgccattggtccaccctt

SEQ ID NO: 3534278 - DNA, 20 bp, Homo sapiens
acgggcaagtgagaggggag

SEQ ID NO: 3534279 - DNA, 15 bp, Homo sapiens
acgttggtcccaagt

SEQ ID NO: 3534280 - DNA, 15 bp, Homo sapiens
actaagttgcaagat

SEQ ID NO: 3534281 - DNA, 16 bp, Homo sapiens
actagagaaagacaaa

SEQ ID NO: 3534282 - DNA, 14 bp, Homo sapiens
actagcccaggacc

SEQ ID NO: 3534283 - DNA, 15 bp, Homo sapiens
actataacattcaat

SEQ ID NO: 3534284 - DNA, 14 bp, Homo sapiens
actcagcactctgg

SEQ ID NO: 3534285 - DNA, 14 bp, Homo sapiens
actcagcagaggca

SEQ ID NO: 3534286 - DNA, 20 bp, Homo sapiens
actcataaaggacactggat

SEQ ID NO: 3534287 - DNA, 17 bp, Homo sapiens
actcatgcattgtcctc

SEQ ID NO: 3534288 - DNA, 21 bp, Homo sapiens
actcccatatcatataaaatt

SEQ ID NO: 3534289 - DNA, 21 bp, Homo sapiens
actctggactccacgatgcct

SEQ ID NO: 3534290 - DNA, 13 bp, Homo sapiens
actgactgaaatc

SEQ ID NO: 3534291 - DNA, 16 bp, Homo sapiens
actgactgaaatcagt

SEQ ID NO: 3534292 - DNA, 15 bp, Homo sapiens
actgacttgctcacc

SEQ ID NO: 3534293 - DNA, 23 bp, Homo sapiens
actgagaaatagtgcactccaag

SEQ ID NO: 3534294 - DNA, 16 bp, Homo sapiens
actgagtaaagtgtta

SEQ ID NO: 3534295 - DNA, 15 bp, Homo sapiens
actgccaagccatgg

SEQ ID NO: 3534296 - DNA, 18 bp, Homo sapiens
actgccaagccatgggta

SEQ ID NO: 3534297 - DNA, 23 bp, Homo sapiens
actggaaataaagtaggaaagaa

SEQ ID NO: 3534298 - DNA, 19 bp, Homo sapiens
actggatcaagttcagcca

SEQ ID NO: 3534299 - DNA, 21 bp, Homo sapiens
actggatcaagttcagccacc

SEQ ID NO: 3534300 - DNA, 16 bp, Homo sapiens
actggccgtatctgag

SEQ ID NO: 3534301 - DNA, 12 bp, Homo sapiens
actgtcagggag

SEQ ID NO: 3534302 - DNA, 15 bp, Homo sapiens
actgtcatctgtagg

SEQ ID NO: 3534303 - DNA, 15 bp, Homo sapiens
actgtggggaaacaa

SEQ ID NO: 3534304 - DNA, 16 bp, Homo sapiens
actgtggggaaacaat

SEQ ID NO: 3534305 - DNA, 20 bp, Homo sapiens
acttaaacttgcacatttga

SEQ ID NO: 3534306 - DNA, 18 bp, Homo sapiens
acttacaaactggtttga

SEQ ID NO: 3534307 - DNA, 18 bp, Homo sapiens
acttcccaagccctggtg

SEQ ID NO: 3534308 - DNA, 20 bp, Homo sapiens
acttttcttctattgcctct

SEQ ID NO: 3534309 - DNA, 18 bp, Homo sapiens
acttttgaggacaagtta

SEQ ID NO: 3534310 - DNA, 13 bp, Homo sapiens
agaaaacccgagg

SEQ ID NO: 3534311 - DNA, 20 bp, Homo sapiens
agaaaccttccagagaacac

SEQ ID NO: 3534312 - DNA, 14 bp, Homo sapiens
agaaatctgaaaaa

SEQ ID NO: 3534313 - DNA, 21 bp, Homo sapiens
agaaatctgaaaaatggccat

SEQ ID NO: 3534314 - DNA, 11 bp, Homo sapiens
agaagaaaacc

SEQ ID NO: 3534315 - DNA, 13 bp, Homo sapiens
agaagaaaacccg

SEQ ID NO: 3534316 - DNA, 18 bp, Homo sapiens
agaagctgtcagaagttt

SEQ ID NO: 3534317 - DNA, 21 bp, Homo sapiens
agaatgaacccatagggagct

SEQ ID NO: 3534318 - DNA, 14 bp, Homo sapiens
agaatgattttgct

SEQ ID NO: 3534319 - DNA, 18 bp, Homo sapiens
agaatgttttggcaagag

SEQ ID NO: 3534320 - DNA, 15 bp, Homo sapiens
agacgactagcccag

SEQ ID NO: 3534321 - DNA, 14 bp, Homo sapiens
cctgcaggctgcag

SEQ ID NO: 3534322 - DNA, 13 bp, Homo sapiens
cctgccctcatgg

SEQ ID NO: 3534323 - DNA, 14 bp, Homo sapiens
cctgccctcatggg

SEQ ID NO: 3534324 - DNA, 14 bp, Homo sapiens
cctgccctccctca

SEQ ID NO: 3534325 - DNA, 18 bp, Homo sapiens
cctgcttttgtgtcccat

SEQ ID NO: 3534326 - DNA, 22 bp, Homo sapiens
cctggaggctcagcccaccctc

SEQ ID NO: 3534327 - DNA, 16 bp, Homo sapiens
cctggatttttaccag

SEQ ID NO: 3534328 - DNA, 20 bp, Homo sapiens
cctggccatttggccccagg

SEQ ID NO: 3534329 - DNA, 15 bp, Homo sapiens
cctggcttcactctc

SEQ ID NO: 3534330 - DNA, 18 bp, Homo sapiens
cctggcttcactctccct

SEQ ID NO: 3534331 - DNA, 23 bp, Homo sapiens
cctggcttcactctccctgacgg

SEQ ID NO: 3534332 - DNA, 13 bp, Homo sapiens
cctggtgaccaga

SEQ ID NO: 3534333 - DNA, 23 bp, Homo sapiens
cctggtgactcgggggctgtctc

SEQ ID NO: 3534334 - DNA, 14 bp, Homo sapiens
cctgtgaccttggg

SEQ ID NO: 3534335 - DNA, 15 bp, Homo sapiens
ccttagaccaccaag

SEQ ID NO: 3534336 - DNA, 16 bp, Homo sapiens
ccttagaccaccaagc

SEQ ID NO: 3534337 - DNA, 18 bp, Homo sapiens
ccttcaggcccgctgccc

SEQ ID NO: 3534338 - DNA, 13 bp, Homo sapiens
ccttctccaaagg

SEQ ID NO: 3534339 - DNA, 19 bp, Homo sapiens
ccttctccaaaggctctgt

SEQ ID NO: 3534340 - DNA, 15 bp, Homo sapiens
ccttgatattctcca

SEQ ID NO: 3534341 - DNA, 18 bp, Homo sapiens
ccttgattggtgttgcca

SEQ ID NO: 3534342 - DNA, 13 bp, Homo sapiens
ccttgcagcctgg

SEQ ID NO: 3534343 - DNA, 16 bp, Homo sapiens
ccttgcagcctggtca

SEQ ID NO: 3534344 - DNA, 21 bp, Homo sapiens
ccttgtgactaagttgcaaga

SEQ ID NO: 3534345 - DNA, 11 bp, Homo sapiens
ccttgttttga

SEQ ID NO: 3534346 - DNA, 19 bp, Homo sapiens
cctttcatagagaggcctg

SEQ ID NO: 3534347 - DNA, 17 bp, Homo sapiens
cctttccctaagccagc

SEQ ID NO: 3534348 - DNA, 21 bp, Homo sapiens
cctttggagaccaggcctcag

SEQ ID NO: 3534349 - DNA, 18 bp, Homo sapiens
cgcagaggcttttccagt

SEQ ID NO: 3534350 - DNA, 14 bp, Homo sapiens
cgccacagcccttt

SEQ ID NO: 3534351 - DNA, 17 bp, Homo sapiens
cgccacagcccttttgt

SEQ ID NO: 3534352 - DNA, 20 bp, Homo sapiens
cgccacagcccttttgtctc

SEQ ID NO: 3534353 - DNA, 13 bp, Homo sapiens
cggcgctgcctca

SEQ ID NO: 3534354 - DNA, 20 bp, Homo sapiens
cggctgccattggtccaccc

SEQ ID NO: 3534355 - DNA, 24 bp, Homo sapiens
cgggagggagtctcaggaggaggc

SEQ ID NO: 3534356 - DNA, 18 bp, Homo sapiens
cgggcaagtgagagggga

SEQ ID NO: 3534357 - DNA, 20 bp, Homo sapiens
cgggcaagtgagaggggagg

SEQ ID NO: 3534358 - DNA, 21 bp, Homo sapiens
cgggcaagtgagaggggaggg

SEQ ID NO: 3534359 - DNA, 22 bp, Homo sapiens
cggggctgctgtgtggacggcg

SEQ ID NO: 3534360 - DNA, 15 bp, Homo sapiens
cgggggtggctctgt

SEQ ID NO: 3534361 - DNA, 17 bp, Homo sapiens
cggtctttatgaattat

SEQ ID NO: 3534362 - DNA, 15 bp, Homo sapiens
cggtgaaagtgctgc

SEQ ID NO: 3534363 - DNA, 21 bp, Homo sapiens
cggtgaaagtgctgctctagg

SEQ ID NO: 3534364 - DNA, 21 bp, Homo sapiens
cggttaagtacccgaggcctc

SEQ ID NO: 3534365 - DNA, 16 bp, Homo sapiens
cgtatctgagggctgc

SEQ ID NO: 3534366 - DNA, 22 bp, Homo sapiens
cgtctcttgtgactcagcagag

SEQ ID NO: 3534367 - DNA, 15 bp, Homo sapiens
cgtgggccctgcagg

SEQ ID NO: 3534368 - DNA, 19 bp, Homo sapiens
cgtgggccctgcaggctgc

SEQ ID NO: 3534369 - DNA, 13 bp, Homo sapiens
cgtggggaagggg

SEQ ID NO: 3534370 - DNA, 16 bp, Homo sapiens
cgtggggaaggggtgc

SEQ ID NO: 3534371 - DNA, 16 bp, Homo sapiens
cgttgaggccaaggaa

SEQ ID NO: 3534372 - DNA, 20 bp, Homo sapiens
ctaacttacaaactggtttg

SEQ ID NO: 3534373 - DNA, 16 bp, Homo sapiens
ctaagcagccaggagg

SEQ ID NO: 3534374 - DNA, 17 bp, Homo sapiens
ctaagcagccaggaggg

SEQ ID NO: 3534375 - DNA, 22 bp, Homo sapiens
ctaagcagccaggagggacctg

SEQ ID NO: 3534376 - DNA, 22 bp, Homo sapiens
ctaagttgcaagatcttattta

SEQ ID NO: 3534377 - DNA, 23 bp, Homo sapiens
ctaagttgcaagatcttatttat

SEQ ID NO: 3534378 - DNA, 18 bp, Homo sapiens
ctaatatttttaacaagt

SEQ ID NO: 3534379 - DNA, 15 bp, Homo sapiens
ctaatgtaaatttta

SEQ ID NO: 3534380 - DNA, 15 bp, Homo sapiens
ctaatgtgaatgtga

SEQ ID NO: 3534381 - DNA, 16 bp, Homo sapiens
ctaatgtgaatgtgag

SEQ ID NO: 3534382 - DNA, 20 bp, Homo sapiens
ctaattatcttatctactga

SEQ ID NO: 3534383 - DNA, 16 bp, Homo sapiens
ctaattgtccacagca

SEQ ID NO: 3534384 - DNA, 17 bp, Homo sapiens
ctacataggttaatttt

SEQ ID NO: 3534385 - DNA, 18 bp, Homo sapiens
ctacataggttaattttt

SEQ ID NO: 3534386 - DNA, 22 bp, Homo sapiens
ctacctcttccgttggaaagaa

SEQ ID NO: 3534387 - DNA, 22 bp, Homo sapiens
ctaggcatcacccccgctttgg

SEQ ID NO: 3534388 - DNA, 19 bp, Homo sapiens
ctagtcagagtataatttt

SEQ ID NO: 3534389 - DNA, 14 bp, Homo sapiens
ctagtcgggcaggg

SEQ ID NO: 3534390 - DNA, 20 bp, Homo sapiens
ctatctctcaagagtgctga

SEQ ID NO: 3534391 - DNA, 20 bp, Homo sapiens
ctatgctgttaacagctgtc

SEQ ID NO: 3534392 - DNA, 15 bp, Homo sapiens
ctatggccactggcc

SEQ ID NO: 3534393 - DNA, 19 bp, Homo sapiens
ctatgtctctagcagtgag

SEQ ID NO: 3534394 - DNA, 14 bp, Homo sapiens
ctcaacaacatgtc

SEQ ID NO: 3534395 - DNA, 17 bp, Homo sapiens
ctcaacaacatgtcaaa

SEQ ID NO: 3534396 - DNA, 15 bp, Homo sapiens
ctcaagagtgctgag

SEQ ID NO: 3534397 - DNA, 16 bp, Homo sapiens
ctcaagagtgctgaga

SEQ ID NO: 3534398 - DNA, 18 bp, Homo sapiens
ctcacatgattccagcca

SEQ ID NO: 3534399 - DNA, 16 bp, Homo sapiens
ctcagacgactagccc

SEQ ID NO: 3534400 - DNA, 17 bp, Homo sapiens
ctcagcactctggactc

SEQ ID NO: 3534401 - DNA, 15 bp, Homo sapiens
ctcagcagaggcagt

SEQ ID NO: 3534402 - DNA, 16 bp, Homo sapiens
ctcagcagaggcagtg

SEQ ID NO: 3534403 - DNA, 21 bp, Homo sapiens
ctcagcagaggcagtggccac

SEQ ID NO: 3534404 - DNA, 15 bp, Homo sapiens
ctcagccgtcagcca

SEQ ID NO: 3534405 - DNA, 21 bp, Homo sapiens
ctcagctcttggtgggcccag

SEQ ID NO: 3534406 - DNA, 17 bp, Homo sapiens
ctcagggtgtcctgagg

SEQ ID NO: 3534407 - DNA, 13 bp, Homo sapiens
ctcagtgtgtaat

SEQ ID NO: 3534408 - DNA, 23 bp, Homo sapiens
ctcatccaactccgaaagtctga

SEQ ID NO: 3534409 - DNA, 15 bp, Homo sapiens
ctcatgaggaccagg

SEQ ID NO: 3534410 - DNA, 20 bp, Homo sapiens
ctcatgaggaccagggtgga

SEQ ID NO: 3534411 - DNA, 18 bp, Homo sapiens
ctcatgggacctgccctc

SEQ ID NO: 3534412 - DNA, 17 bp, Homo sapiens
ctccacgatgcctttga

SEQ ID NO: 3534413 - DNA, 22 bp, Homo sapiens
ctccagttggatgaacattcaa

SEQ ID NO: 3534414 - DNA, 23 bp, Homo sapiens
ctcccaaggagggcaccatctta

SEQ ID NO: 3534415 - DNA, 12 bp, Homo sapiens
ctccccatctcg

SEQ ID NO: 3534416 - DNA, 24 bp, Homo sapiens
ctccctggatttttaccagtctca

SEQ ID NO: 3534417 - DNA, 22 bp, Homo sapiens
ctccgaaagtctgaatctccca

SEQ ID NO: 3534418 - DNA, 14 bp, Homo sapiens
ctcctctccaccat

SEQ ID NO: 3534419 - DNA, 12 bp, Homo sapiens
ctcctggtgact

SEQ ID NO: 3534420 - DNA, 14 bp, Homo sapiens
ctccttccggggaa

SEQ ID NO: 3534421 - DNA, 20 bp, Homo sapiens
ctccttccggggaaggattt

SEQ ID NO: 3534422 - DNA, 12 bp, Homo sapiens
ctccttggtgct

SEQ ID NO: 3534423 - DNA, 23 bp, Homo sapiens
ctcgttcctacctggctggagac

SEQ ID NO: 3534424 - DNA, 15 bp, Homo sapiens
ctctagtcagagtat

SEQ ID NO: 3534425 - DNA, 20 bp, Homo sapiens
ctctcaagagtgctgagaac

SEQ ID NO: 3534426 - DNA, 19 bp, Homo sapiens
ctctgttatcagctgggca

SEQ ID NO: 3534427 - DNA, 21 bp, Homo sapiens
ctcttcacatctcccccatag

SEQ ID NO: 3534428 - DNA, 17 bp, Homo sapiens
ctcttccgttggaaaga

SEQ ID NO: 3534429 - DNA, 23 bp, Homo sapiens
ctcttccgttggaaagaacattt

SEQ ID NO: 3534430 - DNA, 23 bp, Homo sapiens
gctgacttcccaagccctggtga

SEQ ID NO: 3534431 - DNA, 13 bp, Homo sapiens
gctgagaagagga

SEQ ID NO: 3534432 - DNA, 23 bp, Homo sapiens
gctgagaagaggaggaggtgggg

SEQ ID NO: 3534433 - DNA, 14 bp, Homo sapiens
gctgcaggagggca

SEQ ID NO: 3534434 - DNA, 17 bp, Homo sapiens
gctgccattggtccacc

SEQ ID NO: 3534435 - DNA, 20 bp, Homo sapiens
gctgcccccagagccacagt

SEQ ID NO: 3534436 - DNA, 13 bp, Homo sapiens
gctgccctgaggg

SEQ ID NO: 3534437 - DNA, 15 bp, Homo sapiens
gctgccctgaggggc

SEQ ID NO: 3534438 - DNA, 16 bp, Homo sapiens
gctgccctgctgtgga

SEQ ID NO: 3534439 - DNA, 22 bp, Homo sapiens
gctgcctcaggcactctcctgt

SEQ ID NO: 3534440 - DNA, 13 bp, Homo sapiens
gctgcgtgtggga

SEQ ID NO: 3534441 - DNA, 18 bp, Homo sapiens
gctgctggggtatgttct

SEQ ID NO: 3534442 - DNA, 19 bp, Homo sapiens
gctggcctggaggctcagc

SEQ ID NO: 3534443 - DNA, 21 bp, Homo sapiens
gctgggaggtctcgtcccagc

SEQ ID NO: 3534444 - DNA, 20 bp, Homo sapiens
gctgggcagtgccagccaat

SEQ ID NO: 3534445 - DNA, 13 bp, Homo sapiens
gctggggacccag

SEQ ID NO: 3534446 - DNA, 14 bp, Homo sapiens
gctggggacccaga

SEQ ID NO: 3534447 - DNA, 19 bp, Homo sapiens
gctggtagctgaggggacg

SEQ ID NO: 3534448 - DNA, 12 bp, Homo sapiens
gctgtcagaagt

SEQ ID NO: 3534449 - DNA, 23 bp, Homo sapiens
gctgtctcagacgactagcccag

SEQ ID NO: 3534450 - DNA, 16 bp, Homo sapiens
gctgtgcgtgtgtgtg

SEQ ID NO: 3534451 - DNA, 17 bp, Homo sapiens
gctgttggcgtgtccca

SEQ ID NO: 3534452 - DNA, 18 bp, Homo sapiens
gctgttggcgtgtcccag

SEQ ID NO: 3534453 - DNA, 15 bp, Homo sapiens
gcttaaagagcacag

SEQ ID NO: 3534454 - DNA, 14 bp, Homo sapiens
gcttcatagagact

SEQ ID NO: 3534455 - DNA, 22 bp, Homo sapiens
gcttcttccgtttcttcccccc

SEQ ID NO: 3534456 - DNA, 18 bp, Homo sapiens
gcttgctaccaatctgtg

SEQ ID NO: 3534457 - DNA, 22 bp, Homo sapiens
gcttgggggtggggagaaaaga

SEQ ID NO: 3534458 - DNA, 14 bp, Homo sapiens
gctttcggggaggg

SEQ ID NO: 3534459 - DNA, 19 bp, Homo sapiens
gctttgccctgctgccctc

SEQ ID NO: 3534460 - DNA, 13 bp, Homo sapiens
gcttttgttctga

SEQ ID NO: 3534461 - DNA, 14 bp, Homo sapiens
ggaaagaacattta

SEQ ID NO: 3534462 - DNA, 23 bp, Homo sapiens
ggaagcagtggggtaggctgctg

SEQ ID NO: 3534463 - DNA, 14 bp, Homo sapiens
ggaagggcaggcac

SEQ ID NO: 3534464 - DNA, 23 bp, Homo sapiens
ggaataggttactttggactgag

SEQ ID NO: 3534465 - DNA, 12 bp, Homo sapiens
ggaatcctctgg

SEQ ID NO: 3534466 - DNA, 18 bp, Homo sapiens
ggacaccgtggggaaggg

SEQ ID NO: 3534467 - DNA, 22 bp, Homo sapiens
ggacaccgtggggaaggggtgc

SEQ ID NO: 3534468 - DNA, 17 bp, Homo sapiens
ggacagcagattccaca

SEQ ID NO: 3534469 - DNA, 15 bp, Homo sapiens
ggaccaaagggggag

SEQ ID NO: 3534470 - DNA, 13 bp, Homo sapiens
ggaccagggtgga

SEQ ID NO: 3534471 - DNA, 19 bp, Homo sapiens
ggaccagggtggagctgag

SEQ ID NO: 3534472 - DNA, 13 bp, Homo sapiens
ggacccagcgccg

SEQ ID NO: 3534473 - DNA, 20 bp, Homo sapiens
ggaggaataatgcggacact

SEQ ID NO: 3534474 - DNA, 23 bp, Homo sapiens
ggaggaggctgccctgaggggct

SEQ ID NO: 3534475 - DNA, 13 bp, Homo sapiens
ggaggatgtgaat

SEQ ID NO: 3534476 - DNA, 23 bp, Homo sapiens
ggaggcctttccctaagccagct

SEQ ID NO: 3534477 - DNA, 20 bp, Homo sapiens
ggaggctgccctgaggggct

SEQ ID NO: 3534478 - DNA, 18 bp, Homo sapiens
ggaggctggggacccaga

SEQ ID NO: 3534479 - DNA, 19 bp, Homo sapiens
ggagggcactggagctggg

SEQ ID NO: 3534480 - DNA, 23 bp, Homo sapiens
ggagggcactggagctgggaggt

SEQ ID NO: 3534481 - DNA, 18 bp, Homo sapiens
ggagggccagggaggcag

SEQ ID NO: 3534482 - DNA, 21 bp, Homo sapiens
ggagggtttcattgtctgtga

SEQ ID NO: 3534483 - DNA, 14 bp, Homo sapiens
ggaggtgggggctg

SEQ ID NO: 3534484 - DNA, 13 bp, Homo sapiens
ggagttgtgggta

SEQ ID NO: 3534485 - DNA, 17 bp, Homo sapiens
ggatatgccctcctggt

SEQ ID NO: 3534486 - DNA, 20 bp, Homo sapiens
ggatgatccccacgccacag

SEQ ID NO: 3534487 - DNA, 21 bp, Homo sapiens
ggatgatccccacgccacagc

SEQ ID NO: 3534488 - DNA, 21 bp, Homo sapiens
ggatgcattctgataggaggg

SEQ ID NO: 3534489 - DNA, 19 bp, Homo sapiens
ggcaaaggtccctgagctc

SEQ ID NO: 3534490 - DNA, 18 bp, Homo sapiens
ggcaaggaatcctctggg

SEQ ID NO: 3534491 - DNA, 22 bp, Homo sapiens
ggcaaggaatcctctgggagct

SEQ ID NO: 3534492 - DNA, 14 bp, Homo sapiens
ggcacagccagccc

SEQ ID NO: 3534493 - DNA, 19 bp, Homo sapiens
ggcagagcgggagggagtc

SEQ ID NO: 3534494 - DNA, 10 bp, Homo sapiens
ggcaggcacc

SEQ ID NO: 3534495 - DNA, 18 bp, Homo sapiens
ggcagggcccctgaccct

SEQ ID NO: 3534496 - DNA, 21 bp, Homo sapiens
ggcagtgtagggagttgtggg

SEQ ID NO: 3534497 - DNA, 23 bp, Homo sapiens
ggcattgagggctctaaacagga

SEQ ID NO: 3534498 - DNA, 12 bp, Homo sapiens
ggccactggccg

SEQ ID NO: 3534499 - DNA, 20 bp, Homo sapiens
ggcccagcataattcctcca

SEQ ID NO: 3534500 - DNA, 14 bp, Homo sapiens
ggcccccccagccc

SEQ ID NO: 3534501 - DNA, 13 bp, Homo sapiens
ggcccgcgggcac

SEQ ID NO: 3534502 - DNA, 16 bp, Homo sapiens
ggcccgcgggcacagc

SEQ ID NO: 3534503 - DNA, 19 bp, Homo sapiens
ggcccgcgggcacagccag

SEQ ID NO: 3534504 - DNA, 20 bp, Homo sapiens
ggccctgactgtcagggagg

SEQ ID NO: 3534505 - DNA, 17 bp, Homo sapiens
ggccctgcaggctgcag

SEQ ID NO: 3534506 - DNA, 18 bp, Homo sapiens
ggcctgactgccaagcca

SEQ ID NO: 3534507 - DNA, 13 bp, Homo sapiens
ggcctgcttttgt

SEQ ID NO: 3534508 - DNA, 20 bp, Homo sapiens
ggcctgcttttgtgtcccat

SEQ ID NO: 3534509 - DNA, 19 bp, Homo sapiens
ggcctgtgagtctcccctt

SEQ ID NO: 3534510 - DNA, 16 bp, Homo sapiens
ggccttaactgttgtt

SEQ ID NO: 3534511 - DNA, 15 bp, Homo sapiens
ggcctttccctaagc

SEQ ID NO: 3534512 - DNA, 17 bp, Homo sapiens
ggctcatcggtggaagc

SEQ ID NO: 3534513 - DNA, 19 bp, Homo sapiens
ggctctgttatcagctggg

SEQ ID NO: 3534514 - DNA, 21 bp, Homo sapiens
ggctctgttatcagctgggca

SEQ ID NO: 3534515 - DNA, 21 bp, Homo sapiens
ggctgaaaggaagctgtgcgt

SEQ ID NO: 3534516 - DNA, 18 bp, Homo sapiens
ggctgctgccctgctgtg

SEQ ID NO: 3534517 - DNA, 22 bp, Homo sapiens
ggctgctgtgtggacggcgctg

SEQ ID NO: 3534518 - DNA, 13 bp, Homo sapiens
ggctggaggtgct

SEQ ID NO: 3534519 - DNA, 15 bp, Homo sapiens
ggctggaggtgctgg

SEQ ID NO: 3534520 - DNA, 21 bp, Homo sapiens
ggctggaggtgctggtagctg

SEQ ID NO: 3534521 - DNA, 13 bp, Homo sapiens
ggctggcctggag

SEQ ID NO: 3534522 - DNA, 14 bp, Homo sapiens
ggctggggacccag

SEQ ID NO: 3534523 - DNA, 15 bp, Homo sapiens
ggctggggacccaga

SEQ ID NO: 3534524 - DNA, 15 bp, Homo sapiens
ggctggggagggggt

SEQ ID NO: 3534525 - DNA, 21 bp, Homo sapiens
ggcttcactctccctgacggc

SEQ ID NO: 3534526 - DNA, 13 bp, Homo sapiens
ggctttccttgtt

SEQ ID NO: 3534527 - DNA, 13 bp, Homo sapiens
ggcttttccagtg

SEQ ID NO: 3534528 - DNA, 14 bp, Homo sapiens
ggcttttccagtgt

SEQ ID NO: 3534529 - DNA, 18 bp, Homo sapiens
ggcttttgttctgagggg

SEQ ID NO: 3534530 - DNA, 16 bp, Homo sapiens
gggaaaagaagctgtc

SEQ ID NO: 3534531 - DNA, 13 bp, Homo sapiens
gggaagggcaggc

SEQ ID NO: 3534532 - DNA, 14 bp, Homo sapiens
gggaaggggtgcag

SEQ ID NO: 3534533 - DNA, 20 bp, Homo sapiens
gggaggatcctgagctgctg

SEQ ID NO: 3534534 - DNA, 19 bp, Homo sapiens
gggaggcagagcgggaggg

SEQ ID NO: 3534535 - DNA, 19 bp, Homo sapiens
gggaggctggggacccaga

SEQ ID NO: 3534536 - DNA, 18 bp, Homo sapiens
gggagggccagggaggca

SEQ ID NO: 3534537 - DNA, 15 bp, Homo sapiens
gggagtctcaggagg

SEQ ID NO: 3534538 - DNA, 20 bp, Homo sapiens
gggcaaggaatcctctggga

SEQ ID NO: 3534539 - DNA, 16 bp, Homo sapiens
gggcaagtgagagggg

SEQ ID NO: 3534540 - DNA, 16 bp, Homo sapiens
tcaggcccgctgccct

SEQ ID NO: 3534541 - DNA, 18 bp, Homo sapiens
tcaggctgttggcgtgtc

SEQ ID NO: 3534542 - DNA, 12 bp, Homo sapiens
tcagggagggcc

SEQ ID NO: 3534543 - DNA, 15 bp, Homo sapiens
tcagggagggccagg

SEQ ID NO: 3534544 - DNA, 22 bp, Homo sapiens
tcagggaggggccggctggcct

SEQ ID NO: 3534545 - DNA, 23 bp, Homo sapiens
tcagggaggggccggctggcctg

SEQ ID NO: 3534546 - DNA, 15 bp, Homo sapiens
tcagtggtgttacat

SEQ ID NO: 3534547 - DNA, 17 bp, Homo sapiens
tcagtggtgttacattt

SEQ ID NO: 3534548 - DNA, 11 bp, Homo sapiens
tcagtgtgtaa

SEQ ID NO: 3534549 - DNA, 22 bp, Homo sapiens
tcagtgttaaagtggtctgaac

SEQ ID NO: 3534550 - DNA, 13 bp, Homo sapiens
tcatataaaattt

SEQ ID NO: 3534551 - DNA, 14 bp, Homo sapiens
tcatataaaatttc

SEQ ID NO: 3534552 - DNA, 12 bp, Homo sapiens
tcatccaaatgg

SEQ ID NO: 3534553 - DNA, 15 bp, Homo sapiens
tcatgagaattacag

SEQ ID NO: 3534554 - DNA, 21 bp, Homo sapiens
tcatgagaattacagaaaatt

SEQ ID NO: 3534555 - DNA, 20 bp, Homo sapiens
tcatgaggaccagggtggag

SEQ ID NO: 3534556 - DNA, 17 bp, Homo sapiens
tcatgtaatataagtga

SEQ ID NO: 3534557 - DNA, 21 bp, Homo sapiens
tcatgtctttattagtaacat

SEQ ID NO: 3534558 - DNA, 20 bp, Homo sapiens
tcatgttttactacataggt

SEQ ID NO: 3534559 - DNA, 21 bp, Homo sapiens
tcatttgctgaccggaatggt

SEQ ID NO: 3534560 - DNA, 14 bp, Homo sapiens
tccaaaggctctgt

SEQ ID NO: 3534561 - DNA, 19 bp, Homo sapiens
tccaagatgtttggacacc

SEQ ID NO: 3534562 - DNA, 22 bp, Homo sapiens
tccaataccctagaagaaaacc

SEQ ID NO: 3534563 - DNA, 22 bp, Homo sapiens
tccacaggacacgaaggctgcc

SEQ ID NO: 3534564 - DNA, 16 bp, Homo sapiens
tccagagaacacaggg

SEQ ID NO: 3534565 - DNA, 21 bp, Homo sapiens
tccagggccccaggcccgcgg

SEQ ID NO: 3534566 - DNA, 16 bp, Homo sapiens
tcccaacctcctgtgg

SEQ ID NO: 3534567 - DNA, 18 bp, Homo sapiens
tcccaacctcctgtgggc

SEQ ID NO: 3534568 - DNA, 14 bp, Homo sapiens
tcccatatcatata

SEQ ID NO: 3534569 - DNA, 18 bp, Homo sapiens
tcccattcacatgccctc

SEQ ID NO: 3534570 - DNA, 14 bp, Homo sapiens
tccccaaaggcttt

SEQ ID NO: 3534571 - DNA, 16 bp, Homo sapiens
tccccacgccacagcc

SEQ ID NO: 3534572 - DNA, 17 bp, Homo sapiens
tccccacgccacagccc

SEQ ID NO: 3534573 - DNA, 19 bp, Homo sapiens
tccccacgccacagccctt

SEQ ID NO: 3534574 - DNA, 22 bp, Homo sapiens
tccccacgccacagcccttttg

SEQ ID NO: 3534575 - DNA, 17 bp, Homo sapiens
tcccccatagcaccctg

SEQ ID NO: 3534576 - DNA, 18 bp, Homo sapiens
tcccccatagcaccctgc

SEQ ID NO: 3534577 - DNA, 18 bp, Homo sapiens
tccccctcctctccacca

SEQ ID NO: 3534578 - DNA, 23 bp, Homo sapiens
tcccctatgtggaagtggggcgg

SEQ ID NO: 3534579 - DNA, 19 bp, Homo sapiens
tcccgagcaaccctctgaa

SEQ ID NO: 3534580 - DNA, 13 bp, Homo sapiens
tccgagaggctgg

SEQ ID NO: 3534581 - DNA, 19 bp, Homo sapiens
tccgtttcttccccccaga

SEQ ID NO: 3534582 - DNA, 17 bp, Homo sapiens
tcctacctccactctct

SEQ ID NO: 3534583 - DNA, 22 bp, Homo sapiens
tcctacctggctggagaccgag

SEQ ID NO: 3534584 - DNA, 22 bp, Homo sapiens
tcctagtcgggcagggcccctg

SEQ ID NO: 3534585 - DNA, 17 bp, Homo sapiens
tcctcggtgttacttcc

SEQ ID NO: 3534586 - DNA, 22 bp, Homo sapiens
tcctgagctagcaaatacagga

SEQ ID NO: 3534587 - DNA, 14 bp, Homo sapiens
tcctgagctgctgt

SEQ ID NO: 3534588 - DNA, 14 bp, Homo sapiens
tcggggctgctgtg

SEQ ID NO: 3534589 - DNA, 22 bp, Homo sapiens
tcggtggccctgactgtcaggg

SEQ ID NO: 3534590 - DNA, 14 bp, Homo sapiens
tctaagcagccagg

SEQ ID NO: 3534591 - DNA, 16 bp, Homo sapiens
tctatccaaagtgtca

SEQ ID NO: 3534592 - DNA, 18 bp, Homo sapiens
tctcaacaacatgtcaaa

SEQ ID NO: 3534593 - DNA, 20 bp, Homo sapiens
tctcacatgattccagccat

SEQ ID NO: 3534594 - DNA, 20 bp, Homo sapiens
tctcagacgactagcccagg

SEQ ID NO: 3534595 - DNA, 23 bp, Homo sapiens
tctccaccatcgtcttcttggcc

SEQ ID NO: 3534596 - DNA, 19 bp, Homo sapiens
tctcccccatagcaccctg

SEQ ID NO: 3534597 - DNA, 18 bp, Homo sapiens
tctccccttgcagcctgg

SEQ ID NO: 3534598 - DNA, 15 bp, Homo sapiens
tctcgttgaggccaa

SEQ ID NO: 3534599 - DNA, 23 bp, Homo sapiens
tctctgcccctaaagatgggagg

SEQ ID NO: 3534600 - DNA, 15 bp, Homo sapiens
tctcttgtgactcag

SEQ ID NO: 3534601 - DNA, 21 bp, Homo sapiens
tctgaaaaatggccatgttgt

SEQ ID NO: 3534602 - DNA, 23 bp, Homo sapiens
tctgaggggtgtccgagaggctg

SEQ ID NO: 3534603 - DNA, 15 bp, Homo sapiens
tctgataggaggggg

SEQ ID NO: 3534604 - DNA, 23 bp, Homo sapiens
tctgataggagggggcggcaggg

SEQ ID NO: 3534605 - DNA, 20 bp, Homo sapiens
tctgcccctaaagatgggag

SEQ ID NO: 3534606 - DNA, 23 bp, Homo sapiens
tctgcccctaaagatgggaggag

SEQ ID NO: 3534607 - DNA, 15 bp, Homo sapiens
tctgctgtgggaaaa

SEQ ID NO: 3534608 - DNA, 15 bp, Homo sapiens
tctggtgctgctggg

SEQ ID NO: 3534609 - DNA, 19 bp, Homo sapiens
tctgtgaagtgagaccttc

SEQ ID NO: 3534610 - DNA, 13 bp, Homo sapiens
tctgtgagaagtt

SEQ ID NO: 3534611 - DNA, 16 bp, Homo sapiens
tcttagattcagggga

SEQ ID NO: 3534612 - DNA, 15 bp, Homo sapiens
tcttatctactgact

SEQ ID NO: 3534613 - DNA, 14 bp, Homo sapiens
tcttctattgcctc

SEQ ID NO: 3534614 - DNA, 19 bp, Homo sapiens
tcttcttggccatgggagg

SEQ ID NO: 3534615 - DNA, 21 bp, Homo sapiens
tctttaaaagatataagactt

SEQ ID NO: 3534616 - DNA, 17 bp, Homo sapiens
tctttattagtaacatc

SEQ ID NO: 3534617 - DNA, 16 bp, Homo sapiens
tctttgtgaacattct

SEQ ID NO: 3534618 - DNA, 16 bp, Homo sapiens
tgaaaaaatgctgagc

SEQ ID NO: 3534619 - DNA, 23 bp, Homo sapiens
tgaaaaggcagcatttgaatact

SEQ ID NO: 3534620 - DNA, 19 bp, Homo sapiens
tgaaacaactcatgtcttt

SEQ ID NO: 3534621 - DNA, 16 bp, Homo sapiens
tgaaacattttctccc

SEQ ID NO: 3534622 - DNA, 22 bp, Homo sapiens
tgaaactatccttctctttcaa

SEQ ID NO: 3534623 - DNA, 19 bp, Homo sapiens
tgaaatcagtggtgttaca

SEQ ID NO: 3534624 - DNA, 14 bp, Homo sapiens
tgaacaactggaaa

SEQ ID NO: 3534625 - DNA, 15 bp, Homo sapiens
tgaacaactggaaat

SEQ ID NO: 3534626 - DNA, 20 bp, Homo sapiens
tgaacaactggaaataaagt

SEQ ID NO: 3534627 - DNA, 12 bp, Homo sapiens
tgaacattctgt

SEQ ID NO: 3534628 - DNA, 19 bp, Homo sapiens
tgaactgcttgctaccaat

SEQ ID NO: 3534629 - DNA, 17 bp, Homo sapiens
tgaagctcccttcaggc

SEQ ID NO: 3534630 - DNA, 23 bp, Homo sapiens
tgaagtttttattttaaacattt

SEQ ID NO: 3534631 - DNA, 11 bp, Homo sapiens
tgaatatttct

SEQ ID NO: 3534632 - DNA, 13 bp, Homo sapiens
tgaatatttctta

SEQ ID NO: 3534633 - DNA, 14 bp, Homo sapiens
tgaatctcccaagg

SEQ ID NO: 3534634 - DNA, 15 bp, Homo sapiens
tgaatctcccaagga

SEQ ID NO: 3534635 - DNA, 18 bp, Homo sapiens
tgaatgaagctaatgtga

SEQ ID NO: 3534636 - DNA, 12 bp, Homo sapiens
tgaatgactgac

SEQ ID NO: 3534637 - DNA, 13 bp, Homo sapiens
tgaattattttga

SEQ ID NO: 3534638 - DNA, 20 bp, Homo sapiens
tgaattattttgataaatta

SEQ ID NO: 3534639 - DNA, 23 bp, Homo sapiens
tgaccaaaaaaaagcatgaatat

SEQ ID NO: 3534640 - DNA, 15 bp, Homo sapiens
tgaccagaccaaggc

SEQ ID NO: 3534641 - DNA, 22 bp, Homo sapiens
tgaccagaccaaggcagggccc

SEQ ID NO: 3534642 - DNA, 12 bp, Homo sapiens
tgaccagttttg

SEQ ID NO: 3534643 - DNA, 15 bp, Homo sapiens
tgacccaaaatgtga

SEQ ID NO: 3534644 - DNA, 14 bp, Homo sapiens
tgaccttgggacca

SEQ ID NO: 3534645 - DNA, 17 bp, Homo sapiens
tgactaagttgcaagat

SEQ ID NO: 3534646 - DNA, 17 bp, Homo sapiens
tgactcagcagaggcag

SEQ ID NO: 3534647 - DNA, 20 bp, Homo sapiens
tgactcagcagaggcagtgg

SEQ ID NO: 3534648 - DNA, 15 bp, Homo sapiens
tgactccttggtgct

SEQ ID NO: 3534649 - DNA, 16 bp, Homo sapiens
aaacataagagagcct

SEQ ID NO: 3534650 - DNA, 23 bp, Homo sapiens
aaaccatgaagagatttttcatg

SEQ ID NO: 3534651 - DNA, 18 bp, Homo sapiens
aaacctgggattcaggaa

SEQ ID NO: 3534652 - DNA, 12 bp, Homo sapiens
aaactccacagg

SEQ ID NO: 3534653 - DNA, 17 bp, Homo sapiens
aaactggggcctccaga

SEQ ID NO: 3534654 - DNA, 16 bp, Homo sapiens
aaactggggcctccct

SEQ ID NO: 3534655 - DNA, 21 bp, Homo sapiens
aaagagaattgggggcttagg

SEQ ID NO: 3534656 - DNA, 20 bp, Homo sapiens
aaataaagtttgcttagaaa

SEQ ID NO: 3534657 - DNA, 23 bp, Homo sapiens
aaataagacggatttatttttcc

SEQ ID NO: 3534658 - DNA, 16 bp, Homo sapiens
aaatattttgctagtt

SEQ ID NO: 3534659 - DNA, 21 bp, Homo sapiens
aaatattttttcttttctatt

SEQ ID NO: 3534660 - DNA, 21 bp, Homo sapiens
aaattagttagccaatatttt

SEQ ID NO: 3534661 - DNA, 15 bp, Homo sapiens
aaattatatcaattt

SEQ ID NO: 3534662 - DNA, 13 bp, Homo sapiens
aacaagaaaacat

SEQ ID NO: 3534663 - DNA, 24 bp, Homo sapiens
aaccatgaagagatttttcatgat

SEQ ID NO: 3534664 - DNA, 18 bp, Homo sapiens
aacctgaattaaagtcta

SEQ ID NO: 3534665 - DNA, 17 bp, Homo sapiens
aacctgggattcaggaa

SEQ ID NO: 3534666 - DNA, 17 bp, Homo sapiens
aacgatgatgcttgtaa

SEQ ID NO: 3534667 - DNA, 17 bp, Homo sapiens
aacgcctcccctgcccc

SEQ ID NO: 3534668 - DNA, 20 bp, Homo sapiens
aactccacagggactgttct

SEQ ID NO: 3534669 - DNA, 19 bp, Homo sapiens
aagaattcaaactggggcc

SEQ ID NO: 3534670 - DNA, 18 bp, Homo sapiens
aagaccaaaatgacaatg

SEQ ID NO: 3534671 - DNA, 19 bp, Homo sapiens
aagaccaaaatgacaatga

SEQ ID NO: 3534672 - DNA, 13 bp, Homo sapiens
aagaccatttttc

SEQ ID NO: 3534673 - DNA, 19 bp, Homo sapiens
aagacttagatctgagccc

SEQ ID NO: 3534674 - DNA, 22 bp, Homo sapiens
aagagagccttggttcatcagt

SEQ ID NO: 3534675 - DNA, 17 bp, Homo sapiens
aagagatttttcatgat

SEQ ID NO: 3534676 - DNA, 15 bp, Homo sapiens
aagatatttttcatg

SEQ ID NO: 3534677 - DNA, 12 bp, Homo sapiens
aagctgaaaata

SEQ ID NO: 3534678 - DNA, 21 bp, Homo sapiens
aaggccttattctacatttca

SEQ ID NO: 3534679 - DNA, 16 bp, Homo sapiens
aagtctacactgcctt

SEQ ID NO: 3534680 - DNA, 18 bp, Homo sapiens
aagtgattgtatgaattt

SEQ ID NO: 3534681 - DNA, 22 bp, Homo sapiens
aagtgctggcaaccactaagaa

SEQ ID NO: 3534682 - DNA, 23 bp, Homo sapiens
aagtgctggcaaccactaagaat

SEQ ID NO: 3534683 - DNA, 13 bp, Homo sapiens
aagtttgcttaga

SEQ ID NO: 3534684 - DNA, 16 bp, Homo sapiens
aagtttgcttagaaaa

SEQ ID NO: 3534685 - DNA, 15 bp, Homo sapiens
aagtttgtgttctgt

SEQ ID NO: 3534686 - DNA, 19 bp, Homo sapiens
aagtttgtgttctgtttgt

SEQ ID NO: 3534687 - DNA, 14 bp, Homo sapiens
aataaggttgaaca

SEQ ID NO: 3534688 - DNA, 12 bp, Homo sapiens
aatacccacatt

SEQ ID NO: 3534689 - DNA, 21 bp, Homo sapiens
aatagatatccacttgagaca

SEQ ID NO: 3534690 - DNA, 17 bp, Homo sapiens
aatcactaaaaatgatc

SEQ ID NO: 3534691 - DNA, 20 bp, Homo sapiens
aatcatgaagatatttttcc

SEQ ID NO: 3534692 - DNA, 17 bp, Homo sapiens
aatgatgatgataatga

SEQ ID NO: 3534693 - DNA, 12 bp, Homo sapiens
aatgctttcgat

SEQ ID NO: 3534694 - DNA, 16 bp, Homo sapiens
aatgtgatattataca

SEQ ID NO: 3534695 - DNA, 16 bp, Homo sapiens
aatgtgtggcctgcac

SEQ ID NO: 3534696 - DNA, 22 bp, Homo sapiens
aattaaagtctacactgccttt

SEQ ID NO: 3534697 - DNA, 20 bp, Homo sapiens
aattcaaactggggcctcca

SEQ ID NO: 3534698 - DNA, 21 bp, Homo sapiens
aattgtggggatgatgaaata

SEQ ID NO: 3534699 - DNA, 16 bp, Homo sapiens
aattttgatgaacaaa

SEQ ID NO: 3534700 - DNA, 13 bp, Homo sapiens
aatttttgaaaag

SEQ ID NO: 3534701 - DNA, 18 bp, Homo sapiens
acactttcactggggatc

SEQ ID NO: 3534702 - DNA, 20 bp, Homo sapiens
acagtttaataccacagctt

SEQ ID NO: 3534703 - DNA, 20 bp, Homo sapiens
acatccccaccttccaagga

SEQ ID NO: 3534704 - DNA, 12 bp, Homo sapiens
accaaaatgaca

SEQ ID NO: 3534705 - DNA, 14 bp, Homo sapiens
gagcagcagctgag

SEQ ID NO: 3534706 - DNA, 21 bp, Homo sapiens
gagcatctggattctgcctaa

SEQ ID NO: 3534707 - DNA, 13 bp, Homo sapiens
gagccagctccct

SEQ ID NO: 3534708 - DNA, 15 bp, Homo sapiens
gagcccagccctccc

SEQ ID NO: 3534709 - DNA, 18 bp, Homo sapiens
gagcccagccctccccat

SEQ ID NO: 3534710 - DNA, 13 bp, Homo sapiens
gagcgggtggggt

SEQ ID NO: 3534711 - DNA, 14 bp, Homo sapiens
gaggacaaggtaca

SEQ ID NO: 3534712 - DNA, 13 bp, Homo sapiens
gaggaccaaagat

SEQ ID NO: 3534713 - DNA, 15 bp, Homo sapiens
gaggcgtcctggtga

SEQ ID NO: 3534714 - DNA, 15 bp, Homo sapiens
gagtctatcaatcaa

SEQ ID NO: 3534715 - DNA, 17 bp, Homo sapiens
gatatgggacatttttg

SEQ ID NO: 3534716 - DNA, 11 bp, Homo sapiens
gatcctcctgg

SEQ ID NO: 3534717 - DNA, 12 bp, Homo sapiens
gatctgagccct

SEQ ID NO: 3534718 - DNA, 23 bp, Homo sapiens
gatctgagccctccctcttccca

SEQ ID NO: 3534719 - DNA, 19 bp, Homo sapiens
gatgataatgatgatgacg

SEQ ID NO: 3534720 - DNA, 20 bp, Homo sapiens
gatggagccagctctgcatt

SEQ ID NO: 3534721 - DNA, 13 bp, Homo sapiens
gatggggcccaca

SEQ ID NO: 3534722 - DNA, 18 bp, Homo sapiens
gatggttactgaggacca

SEQ ID NO: 3534723 - DNA, 19 bp, Homo sapiens
gatgtttccagacttcctt

SEQ ID NO: 3534724 - DNA, 13 bp, Homo sapiens
gattcaggaatgt

SEQ ID NO: 3534725 - DNA, 23 bp, Homo sapiens
gatttcaaggtccgagctctgtc

SEQ ID NO: 3534726 - DNA, 13 bp, Homo sapiens
gatttgaactgag

SEQ ID NO: 3534727 - DNA, 16 bp, Homo sapiens
gatttgaactgagccg

SEQ ID NO: 3534728 - DNA, 21 bp, Homo sapiens
gattttgaaatcatgaagata

SEQ ID NO: 3534729 - DNA, 17 bp, Homo sapiens
gcaaaggcaggaggtgg

SEQ ID NO: 3534730 - DNA, 19 bp, Homo sapiens
gcacctcatggactccagg

SEQ ID NO: 3534731 - DNA, 21 bp, Homo sapiens
gcacttgtgattatttattat

SEQ ID NO: 3534732 - DNA, 23 bp, Homo sapiens
gcacttgtgattatttattattt

SEQ ID NO: 3534733 - DNA, 12 bp, Homo sapiens
gcagctgaggcc

SEQ ID NO: 3534734 - DNA, 14 bp, Homo sapiens
gcagctgggatttg

SEQ ID NO: 3534735 - DNA, 20 bp, Homo sapiens
gcagctgggatttgaaccag

SEQ ID NO: 3534736 - DNA, 15 bp, Homo sapiens
gcaggaggtgggtga

SEQ ID NO: 3534737 - DNA, 16 bp, Homo sapiens
gcaggaggtgggtgag

SEQ ID NO: 3534738 - DNA, 19 bp, Homo sapiens
gcatctgacacaaaaaaag

SEQ ID NO: 3534739 - DNA, 23 bp, Homo sapiens
gcatctggattctgcctaataaa

SEQ ID NO: 3534740 - DNA, 16 bp, Homo sapiens
gccccagggctgtggg

SEQ ID NO: 3534741 - DNA, 14 bp, Homo sapiens
gccccctggcctct

SEQ ID NO: 3534742 - DNA, 15 bp, Homo sapiens
gccccctggcctctg

SEQ ID NO: 3534743 - DNA, 16 bp, Homo sapiens
gccccctggcctctgt

SEQ ID NO: 3534744 - DNA, 16 bp, Homo sapiens
gccctagaccctcccc

SEQ ID NO: 3534745 - DNA, 21 bp, Homo sapiens
gccctagaccctcccccacca

SEQ ID NO: 3534746 - DNA, 19 bp, Homo sapiens
gccctccccatggagccag

SEQ ID NO: 3534747 - DNA, 19 bp, Homo sapiens
gccctccctcttcccagca

SEQ ID NO: 3534748 - DNA, 20 bp, Homo sapiens
gccctccctcttcccagcac

SEQ ID NO: 3534749 - DNA, 17 bp, Homo sapiens
gcctccagaactcactg

SEQ ID NO: 3534750 - DNA, 19 bp, Homo sapiens
gcctggcttttctggctgg

SEQ ID NO: 3534751 - DNA, 13 bp, Homo sapiens
gccttgagcatct

SEQ ID NO: 3534752 - DNA, 14 bp, Homo sapiens
gccttgagcatctg

SEQ ID NO: 3534753 - DNA, 16 bp, Homo sapiens
gccttggctcagacat

SEQ ID NO: 3534754 - DNA, 22 bp, Homo sapiens
gctgaggccccagggctgtggg

SEQ ID NO: 3534755 - DNA, 17 bp, Homo sapiens
gctgatttggtgaccaa

SEQ ID NO: 3534756 - DNA, 18 bp, Homo sapiens
gctgcagtatgaaaataa

SEQ ID NO: 3534757 - DNA, 12 bp, Homo sapiens
gctgtgggtggg

SEQ ID NO: 3534758 - DNA, 14 bp, Homo sapiens
gctgtgggtgggga

SEQ ID NO: 3534759 - DNA, 12 bp, Homo sapiens
gcttgctgtgtg

SEQ ID NO: 3534760 - DNA, 15 bp, Homo sapiens
gcttgtaacaagaaa

SEQ ID NO: 3534761 - DNA, 18 bp, Homo sapiens
gcttgtaacaagaaaaca

SEQ ID NO: 3534762 - DNA, 21 bp, Homo sapiens
ggaagaccagctttgcagtga

SEQ ID NO: 3534763 - DNA, 21 bp, Homo sapiens
ggaagacttagatctgagccc

SEQ ID NO: 3534764 - DNA, 17 bp, Homo sapiens
ggaagtttgtgttctgt

SEQ ID NO: 3534765 - DNA, 19 bp, Homo sapiens
ggacccaatgtaggagctg

SEQ ID NO: 3534766 - DNA, 18 bp, Homo sapiens
ggaccttaggccttcctc

SEQ ID NO: 3534767 - DNA, 16 bp, Homo sapiens
ggagcagcagctgagg

SEQ ID NO: 3534768 - DNA, 20 bp, Homo sapiens
ggagcctttggttctggcca

SEQ ID NO: 3534769 - DNA, 18 bp, Homo sapiens
ggagctgccttggctcag

SEQ ID NO: 3534770 - DNA, 12 bp, Homo sapiens
ggatcctcctgg

SEQ ID NO: 3534771 - DNA, 16 bp, Homo sapiens
ggatggccgatggggc

SEQ ID NO: 3534772 - DNA, 17 bp, Homo sapiens
ggattctgcctaataaa

SEQ ID NO: 3534773 - DNA, 17 bp, Homo sapiens
ggcatctgacacaaaaa

SEQ ID NO: 3534774 - DNA, 20 bp, Homo sapiens
ggcatctgacacaaaaaaag

SEQ ID NO: 3534775 - DNA, 16 bp, Homo sapiens
ggcctatctaaactgg

SEQ ID NO: 3534776 - DNA, 15 bp, Homo sapiens
ggcctccagaactca

SEQ ID NO: 3534777 - DNA, 20 bp, Homo sapiens
ggcctccagaactcactggg

SEQ ID NO: 3534778 - DNA, 15 bp, Homo sapiens
ggccttgagcatctg

SEQ ID NO: 3534779 - DNA, 18 bp, Homo sapiens
ggcgtcctggtgaggaca

SEQ ID NO: 3534780 - DNA, 15 bp, Homo sapiens
ggctgtgggtgggga

SEQ ID NO: 3534781 - DNA, 22 bp, Homo sapiens
gggagcctttggttctggccag

SEQ ID NO: 3534782 - DNA, 20 bp, Homo sapiens
ggggatcccgtgctggaaga

SEQ ID NO: 3534783 - DNA, 12 bp, Homo sapiens
ggggcctccctg

SEQ ID NO: 3534784 - DNA, 22 bp, Homo sapiens
gggtagaagcaaaggcaggagg

SEQ ID NO: 3534785 - DNA, 20 bp, Homo sapiens
ggtagcctggcttttctggc

SEQ ID NO: 3534786 - DNA, 16 bp, Homo sapiens
ggtccgagctctgtcc

SEQ ID NO: 3534787 - DNA, 17 bp, Homo sapiens
ggtccgagctctgtcct

SEQ ID NO: 3534788 - DNA, 18 bp, Homo sapiens
ggtccgagctctgtcctc

SEQ ID NO: 3534789 - DNA, 17 bp, Homo sapiens
ggtgagcgggtggggtg

SEQ ID NO: 3534790 - DNA, 16 bp, Homo sapiens
ggtggggtgcttgctg

SEQ ID NO: 3534791 - DNA, 14 bp, Homo sapiens
ggttcatcagtgtt

SEQ ID NO: 3534792 - DNA, 19 bp, Homo sapiens
ggttcatcagtgttaaaaa

SEQ ID NO: 3534793 - DNA, 22 bp, Homo sapiens
gtaaagtatcaggatactatat

SEQ ID NO: 3534794 - DNA, 16 bp, Homo sapiens
gtaacaagaaaacata

SEQ ID NO: 3534795 - DNA, 16 bp, Homo sapiens
gtaagtgagagagaca

SEQ ID NO: 3534796 - DNA, 22 bp, Homo sapiens
gtactaactcctaggaaaatac

SEQ ID NO: 3534797 - DNA, 23 bp, Homo sapiens
gtaggagctgccttggctcagac

SEQ ID NO: 3534798 - DNA, 18 bp, Homo sapiens
gtatcctgggggacccaa

SEQ ID NO: 3534799 - DNA, 20 bp, Homo sapiens
gtcaacctgaattaaagtct

SEQ ID NO: 3534800 - DNA, 18 bp, Homo sapiens
gtcacagggcctggggag

SEQ ID NO: 3534801 - DNA, 15 bp, Homo sapiens
gtcacatagctggga

SEQ ID NO: 3534802 - DNA, 21 bp, Homo sapiens
gtcactcattgctgagcctct

SEQ ID NO: 3534803 - DNA, 23 bp, Homo sapiens
gtcactcattgctgagcctctgc

SEQ ID NO: 3534804 - DNA, 24 bp, Homo sapiens
gtcactcattgctgagcctctgct

SEQ ID NO: 3534805 - DNA, 20 bp, Homo sapiens
gtcatgtaagctgaaaatat

SEQ ID NO: 3534806 - DNA, 13 bp, Homo sapiens
gtccaactactaa

SEQ ID NO: 3534807 - DNA, 16 bp, Homo sapiens
gtccactttcccttcc

SEQ ID NO: 3534808 - DNA, 17 bp, Homo sapiens
gtcccttgacctttcca

SEQ ID NO: 3534809 - DNA, 16 bp, Homo sapiens
gtccgagctctgtcct

SEQ ID NO: 3534810 - DNA, 14 bp, Homo sapiens
gtgagcgggtgggg

SEQ ID NO: 3534811 - DNA, 15 bp, Homo sapiens
gtgctggcaaccact

SEQ ID NO: 3534812 - DNA, 13 bp, Homo sapiens
gtgcttgctgtgt

SEQ ID NO: 3534813 - DNA, 17 bp, Homo sapiens
gttagccaatatttttc

SEQ ID NO: 3534814 - DNA, 19 bp, Homo sapiens
gttatttttacattctgaa

SEQ ID NO: 3534815 - DNA, 21 bp, Homo sapiens
gttcatcagtgttaaaaaatt

SEQ ID NO: 3534816 - DNA, 23 bp, Homo sapiens
gttccctaagtccaactactaaa

SEQ ID NO: 3534817 - DNA, 19 bp, Homo sapiens
gttctatagcagtcatcat

SEQ ID NO: 3534818 - DNA, 13 bp, Homo sapiens
gttctggccagaa

SEQ ID NO: 3534819 - DNA, 15 bp, Homo sapiens
gttctgtttgttaaa

SEQ ID NO: 3534820 - DNA, 16 bp, Homo sapiens
gtttcatccttttcat

SEQ ID NO: 3534821 - DNA, 20 bp, Homo sapiens
gtttccagacttccttgaga

SEQ ID NO: 3534822 - DNA, 15 bp, Homo sapiens
gtttgttaaaactgg

SEQ ID NO: 3534823 - DNA, 23 bp, Homo sapiens
gtttgttgcacagtccctcctgt

SEQ ID NO: 3534824 - DNA, 14 bp, Homo sapiens
gttttgacattttt

SEQ ID NO: 3534825 - DNA, 20 bp, Homo sapiens
taaaggttcctttgttccct

SEQ ID NO: 3534826 - DNA, 20 bp, Homo sapiens
taaagtatcaggatactata

SEQ ID NO: 3534827 - DNA, 15 bp, Homo sapiens
taaagtctacactgc

SEQ ID NO: 3534828 - DNA, 18 bp, Homo sapiens
taaagtctacactgcctt

SEQ ID NO: 3534829 - DNA, 16 bp, Homo sapiens
taaagtgatatttccc

SEQ ID NO: 3534830 - DNA, 15 bp, Homo sapiens
taacttaattgctat

SEQ ID NO: 3534831 - DNA, 22 bp, Homo sapiens
taagaattcaaactggggcctc

SEQ ID NO: 3534832 - DNA, 19 bp, Homo sapiens
taagatatgggacattttt

SEQ ID NO: 3534833 - DNA, 13 bp, Homo sapiens
taagctgaaaata

SEQ ID NO: 3534834 - DNA, 19 bp, Homo sapiens
taagtccaactactaaact

SEQ ID NO: 3534835 - DNA, 24 bp, Homo sapiens
taagtgagagagacaagaagcaaa

SEQ ID NO: 3534836 - DNA, 15 bp, Homo sapiens
taatacacacagtta

SEQ ID NO: 3534837 - DNA, 20 bp, Homo sapiens
taatgacatcaccacagttt

SEQ ID NO: 3534838 - DNA, 13 bp, Homo sapiens
tacactatcttaa

SEQ ID NO: 3534839 - DNA, 21 bp, Homo sapiens
tacaggatggttactgaggac

SEQ ID NO: 3534840 - DNA, 13 bp, Homo sapiens
aaaaaagttgaag

SEQ ID NO: 3534841 - DNA, 20 bp, Homo sapiens
aaaaggcggtactagttcag

SEQ ID NO: 3534842 - DNA, 13 bp, Homo sapiens
aaaatgacaatga

SEQ ID NO: 3534843 - DNA, 15 bp, Homo sapiens
aaaggcaggaggtgg

SEQ ID NO: 3534844 - DNA, 23 bp, Homo sapiens
aaagggtagcctggcttttctgg

SEQ ID NO: 3534845 - DNA, 19 bp, Homo sapiens
aaaggttcctttgttccct

SEQ ID NO: 3534846 - DNA, 17 bp, Homo sapiens
aaagtcaatgttttcag

SEQ ID NO: 3534847 - DNA, 17 bp, Homo sapiens
aaagtggcaagaccaaa

SEQ ID NO: 3534848 - DNA, 16 bp, Homo sapiens
aaagtttgcttagaaa

SEQ ID NO: 3534849 - DNA, 14 bp, Homo sapiens
aaatattagaaaca

SEQ ID NO: 3534850 - DNA, 12 bp, Homo sapiens
aaatatttatct

SEQ ID NO: 3534851 - DNA, 15 bp, Homo sapiens
aaatgacaatgatga

SEQ ID NO: 3534852 - DNA, 18 bp, Homo sapiens
aacaataggctgttccca

SEQ ID NO: 3534853 - DNA, 16 bp, Homo sapiens
aacagcttctcaattt

SEQ ID NO: 3534854 - DNA, 17 bp, Homo sapiens
aacatccaaccttccca

SEQ ID NO: 3534855 - DNA, 17 bp, Homo sapiens
aacatttattttcattg

SEQ ID NO: 3534856 - DNA, 15 bp, Homo sapiens
aaccaggccttctga

SEQ ID NO: 3534857 - DNA, 21 bp, Homo sapiens
aaccatgaagagatttttcat

SEQ ID NO: 3534858 - DNA, 23 bp, Homo sapiens
aaccatgaagagatttttcatga

SEQ ID NO: 3534859 - DNA, 17 bp, Homo sapiens
aacctcttctggctcaa

SEQ ID NO: 3534860 - DNA, 16 bp, Homo sapiens
aacctgaattaaagtc

SEQ ID NO: 3534861 - DNA, 17 bp, Homo sapiens
aacctgaattaaagtct

SEQ ID NO: 3534862 - DNA, 20 bp, Homo sapiens
aacctgaattaaagtctaca

SEQ ID NO: 3534863 - DNA, 21 bp, Homo sapiens
aacctgggattcaggaatgtg

SEQ ID NO: 3534864 - DNA, 15 bp, Homo sapiens
aacgtacccaaggtc

SEQ ID NO: 3534865 - DNA, 14 bp, Homo sapiens
aacgttgctcccca

SEQ ID NO: 3534866 - DNA, 19 bp, Homo sapiens
aactgagccgtgcagctgg

SEQ ID NO: 3534867 - DNA, 22 bp, Homo sapiens
aactgagccgtgcagctgggat

SEQ ID NO: 3534868 - DNA, 22 bp, Homo sapiens
aagaaaatctattttgtaactt

SEQ ID NO: 3534869 - DNA, 18 bp, Homo sapiens
aagaccaccacttcgaaa

SEQ ID NO: 3534870 - DNA, 21 bp, Homo sapiens
aagacttagatctgagccctc

SEQ ID NO: 3534871 - DNA, 19 bp, Homo sapiens
aagatatgggacatttttg

SEQ ID NO: 3534872 - DNA, 16 bp, Homo sapiens
aagatttccatataaa

SEQ ID NO: 3534873 - DNA, 13 bp, Homo sapiens
aaggaaggcgtgt

SEQ ID NO: 3534874 - DNA, 21 bp, Homo sapiens
aagggccttgagcatctggat

SEQ ID NO: 3534875 - DNA, 19 bp, Homo sapiens
aaggtcacatagctgggat

SEQ ID NO: 3534876 - DNA, 18 bp, Homo sapiens
aaggtccgagctctgtcc

SEQ ID NO: 3534877 - DNA, 20 bp, Homo sapiens
aagtacccgttcacattttt

SEQ ID NO: 3534878 - DNA, 18 bp, Homo sapiens
aagtctacactgcctttg

SEQ ID NO: 3534879 - DNA, 22 bp, Homo sapiens
aagtggaccttaggccttcctc

SEQ ID NO: 3534880 - DNA, 20 bp, Homo sapiens
aatagttttattaataaaca

SEQ ID NO: 3534881 - DNA, 20 bp, Homo sapiens
aatattttgctagtttttga

SEQ ID NO: 3534882 - DNA, 20 bp, Homo sapiens
aatcataagatatttttcat

SEQ ID NO: 3534883 - DNA, 19 bp, Homo sapiens
aatccctttattaccccct

SEQ ID NO: 3534884 - DNA, 23 bp, Homo sapiens
aatccctttattaccccctcctt

SEQ ID NO: 3534885 - DNA, 14 bp, Homo sapiens
aatctattttgtaa

SEQ ID NO: 3534886 - DNA, 14 bp, Homo sapiens
aatctggagaccag

SEQ ID NO: 3534887 - DNA, 12 bp, Homo sapiens
aatgatgatgac

SEQ ID NO: 3534888 - DNA, 14 bp, Homo sapiens
aatgtatttttcct

SEQ ID NO: 3534889 - DNA, 12 bp, Homo sapiens
aatgttcatcat

SEQ ID NO: 3534890 - DNA, 23 bp, Homo sapiens
aattaaagtctacactgcctttg

SEQ ID NO: 3534891 - DNA, 23 bp, Homo sapiens
aattgctatgttttgacattttt

SEQ ID NO: 3534892 - DNA, 22 bp, Homo sapiens
aattgctttaccttttttctta

SEQ ID NO: 3534893 - DNA, 16 bp, Homo sapiens
aatttctattaaaggt

SEQ ID NO: 3534894 - DNA, 22 bp, Homo sapiens
acacggagcccagccctcccca

SEQ ID NO: 3534895 - DNA, 14 bp, Homo sapiens
acagatgaatgtat

SEQ ID NO: 3534896 - DNA, 17 bp, Homo sapiens
acagatgaatgtattta

SEQ ID NO: 3534897 - DNA, 13 bp, Homo sapiens
acagtccctcctg

SEQ ID NO: 3534898 - DNA, 14 bp, Homo sapiens
acagtccctcctgt

SEQ ID NO: 3534899 - DNA, 18 bp, Homo sapiens
acatgaattgcattttac

SEQ ID NO: 3534900 - DNA, 24 bp, Homo sapiens
acatttcacctactttgtaagtga

SEQ ID NO: 3534901 - DNA, 23 bp, Homo sapiens
accaagtttcaggtattaagaaa

SEQ ID NO: 3534902 - DNA, 13 bp, Homo sapiens
accacttcgaaac

SEQ ID NO: 3534903 - DNA, 21 bp, Homo sapiens
accatgtaaagaacataaata

SEQ ID NO: 3534904 - DNA, 16 bp, Homo sapiens
accccctccttcagac

SEQ ID NO: 3534905 - DNA, 17 bp, Homo sapiens
accccctccttcagaca

SEQ ID NO: 3534906 - DNA, 21 bp, Homo sapiens
accctcaacctcttctggctc

SEQ ID NO: 3534907 - DNA, 14 bp, Homo sapiens
accctcccccacca

SEQ ID NO: 3534908 - DNA, 16 bp, Homo sapiens
acctgaattaaagtct

SEQ ID NO: 3534909 - DNA, 18 bp, Homo sapiens
acctgaattaaagtctac

SEQ ID NO: 3534910 - DNA, 19 bp, Homo sapiens
acctgaattaaagtctaca

SEQ ID NO: 3534911 - DNA, 17 bp, Homo sapiens
accttaggccttcctct

SEQ ID NO: 3534912 - DNA, 20 bp, Homo sapiens
accttaggccttcctctctc

SEQ ID NO: 3534913 - DNA, 21 bp, Homo sapiens
accttcccaaacgcctcccct

SEQ ID NO: 3534914 - DNA, 20 bp, Homo sapiens
accttgagaccctcttctct

SEQ ID NO: 3534915 - DNA, 22 bp, Homo sapiens
accttgagaccctcttctctgg

SEQ ID NO: 3534916 - DNA, 15 bp, Homo sapiens
acggatttatttttc

SEQ ID NO: 3534917 - DNA, 13 bp, Homo sapiens
acgttgctcccca

SEQ ID NO: 3534918 - DNA, 18 bp, Homo sapiens
actaagaattcaaactgg

SEQ ID NO: 3534919 - DNA, 15 bp, Homo sapiens
actcattgctgagcc

SEQ ID NO: 3534920 - DNA, 18 bp, Homo sapiens
actcattgctgagcctct

SEQ ID NO: 3534921 - DNA, 18 bp, Homo sapiens
actccaggatcctcctgg

SEQ ID NO: 3534922 - DNA, 21 bp, Homo sapiens
actccaggatcctcctggagc

SEQ ID NO: 3534923 - DNA, 21 bp, Homo sapiens
actggcatctgacacaaaaaa

SEQ ID NO: 3534924 - DNA, 21 bp, Homo sapiens
actggggcctacagctttgat

SEQ ID NO: 3534925 - DNA, 17 bp, Homo sapiens
actggggcctccagaac

SEQ ID NO: 3534926 - DNA, 15 bp, Homo sapiens
actgtcactcattgc

SEQ ID NO: 3534927 - DNA, 22 bp, Homo sapiens
acttccttgagacacggagccc

SEQ ID NO: 3534928 - DNA, 16 bp, Homo sapiens
acttgtgattatttat

SEQ ID NO: 3534929 - DNA, 17 bp, Homo sapiens
acttgtgattatttatt

SEQ ID NO: 3534930 - DNA, 17 bp, Homo sapiens
actttggaagtttgtgt

SEQ ID NO: 3534931 - DNA, 17 bp, Homo sapiens
agaaaataatcattctt

SEQ ID NO: 3534932 - DNA, 19 bp, Homo sapiens
agaaagtcttatttattca

SEQ ID NO: 3534933 - DNA, 19 bp, Homo sapiens
agaactcactggggcctac

SEQ ID NO: 3534934 - DNA, 22 bp, Homo sapiens
agaatgctgcaggacttgagaa

SEQ ID NO: 3534935 - DNA, 15 bp, Homo sapiens
agacaagaagcaaat

SEQ ID NO: 3534936 - DNA, 19 bp, Homo sapiens
agacaccctcaacctcttc

SEQ ID NO: 3534937 - DNA, 21 bp, Homo sapiens
agacacggagcccagccctcc

SEQ ID NO: 3534938 - DNA, 15 bp, Homo sapiens
agacactttggaagt

SEQ ID NO: 3534939 - DNA, 18 bp, Homo sapiens
agaccaaaatgacaatga

SEQ ID NO: 3534940 - DNA, 15 bp, Homo sapiens
agaccagggagcctt

SEQ ID NO: 3534941 - DNA, 13 bp, Homo sapiens
agaccctcttctc

SEQ ID NO: 3534942 - DNA, 14 bp, Homo sapiens
agacttccttgaga

SEQ ID NO: 3534943 - DNA, 14 bp, Homo sapiens
agagacaagaagca

SEQ ID NO: 3534944 - DNA, 16 bp, Homo sapiens
agagacaagaagcaaa

SEQ ID NO: 3534945 - DNA, 14 bp, Homo sapiens
agagagacaagaag

SEQ ID NO: 3534946 - DNA, 23 bp, Homo sapiens
agagagccttggttcatcagtgt

SEQ ID NO: 3534947 - DNA, 15 bp, Homo sapiens
agagaggcgtcctgg

SEQ ID NO: 3534948 - DNA, 21 bp, Homo sapiens
agaggcgtcctggtgaggaca

SEQ ID NO: 3534949 - DNA, 19 bp, Homo sapiens
agataatgtgatattatac

SEQ ID NO: 3534950 - DNA, 17 bp, Homo sapiens
agatatgggacattttt

SEQ ID NO: 3534951 - DNA, 15 bp, Homo sapiens
agatattaccagttt

SEQ ID NO: 3534952 - DNA, 12 bp, Homo sapiens
agatatttttca

SEQ ID NO: 3534953 - DNA, 19 bp, Homo sapiens
agatatttttcatgatttt

SEQ ID NO: 3534954 - DNA, 19 bp, Homo sapiens
agatatttttccatttttt

SEQ ID NO: 3534955 - DNA, 23 bp, Homo sapiens
agatgtttccagacttccttgag

SEQ ID NO: 3534956 - DNA, 18 bp, Homo sapiens
agatttccatataaatat

SEQ ID NO: 3534957 - DNA, 14 bp, Homo sapiens
agccaatatttttc

SEQ ID NO: 3534958 - DNA, 15 bp, Homo sapiens
agccagctccctcta

SEQ ID NO: 3534959 - DNA, 22 bp, Homo sapiens
agccagctccctctatttatgt

SEQ ID NO: 3534960 - DNA, 17 bp, Homo sapiens
agccctccctcttccca

SEQ ID NO: 3534961 - DNA, 20 bp, Homo sapiens
agccctccctcttcccagca

SEQ ID NO: 3534962 - DNA, 22 bp, Homo sapiens
agccctccctcttcccagcaca

SEQ ID NO: 3534963 - DNA, 19 bp, Homo sapiens
agcctatatttcctcttct

SEQ ID NO: 3534964 - DNA, 20 bp, Homo sapiens
agcctatatttcctcttctg

SEQ ID NO: 3534965 - DNA, 13 bp, Homo sapiens
agcctctgctccc

SEQ ID NO: 3534966 - DNA, 16 bp, Homo sapiens
agcctctgctccccag

SEQ ID NO: 3534967 - DNA, 18 bp, Homo sapiens
agcctggcttttctggct

SEQ ID NO: 3534968 - DNA, 12 bp, Homo sapiens
agcgggtggggt

SEQ ID NO: 3534969 - DNA, 21 bp, Homo sapiens
agctgaacaataggctgttcc

SEQ ID NO: 3534970 - DNA, 22 bp, Homo sapiens
agctgaacaataggctgttccc

SEQ ID NO: 3534971 - DNA, 11 bp, Homo sapiens
agctgaggccc

SEQ ID NO: 3534972 - DNA, 19 bp, Homo sapiens
agctgccttggctcagaca

SEQ ID NO: 3534973 - DNA, 13 bp, Homo sapiens
agctgggatttga

SEQ ID NO: 3534974 - DNA, 16 bp, Homo sapiens
aggaatgtgtggcctg

SEQ ID NO: 3534975 - DNA, 19 bp, Homo sapiens
aggagctgccttggctcag

SEQ ID NO: 3534976 - DNA, 13 bp, Homo sapiens
aggaggtgggtga

SEQ ID NO: 3534977 - DNA, 15 bp, Homo sapiens
aggaggtgggtgagc

SEQ ID NO: 3534978 - DNA, 17 bp, Homo sapiens
aggatggagccagctct

SEQ ID NO: 3534979 - DNA, 20 bp, Homo sapiens
aggatggttactgaggacca

SEQ ID NO: 3534980 - DNA, 18 bp, Homo sapiens
aggcaggaggtgggtgag

SEQ ID NO: 3534981 - DNA, 16 bp, Homo sapiens
aggccttcctctctcc

SEQ ID NO: 3534982 - DNA, 19 bp, Homo sapiens
aggccttcctctctccaga

SEQ ID NO: 3534983 - DNA, 17 bp, Homo sapiens
aggcgtcctggtgagga

SEQ ID NO: 3534984 - DNA, 16 bp, Homo sapiens
agggctgtgggtgggg

SEQ ID NO: 3534985 - DNA, 17 bp, Homo sapiens
agggtcggaacccaagc

SEQ ID NO: 3534986 - DNA, 17 bp, Homo sapiens
aggtcacatagctggga

SEQ ID NO: 3534987 - DNA, 16 bp, Homo sapiens
aggtccgagctctgtc

SEQ ID NO: 3534988 - DNA, 17 bp, Homo sapiens
aggttcctttgttccct

SEQ ID NO: 3534989 - DNA, 18 bp, Homo sapiens
agtagcaccctggattga

SEQ ID NO: 3534990 - DNA, 13 bp, Homo sapiens
agtgagagagaca

SEQ ID NO: 3534991 - DNA, 16 bp, Homo sapiens
agtgattgtatgaatt

SEQ ID NO: 3534992 - DNA, 21 bp, Homo sapiens
agtgttaaaaaatttttgaaa

SEQ ID NO: 3534993 - DNA, 17 bp, Homo sapiens
agttcatccattctatt

SEQ ID NO: 3534994 - DNA, 16 bp, Homo sapiens
ataagatatttttcat

SEQ ID NO: 3534995 - DNA, 12 bp, Homo sapiens
ataagtttattt

SEQ ID NO: 3534996 - DNA, 14 bp, Homo sapiens
ataagtttatttct

SEQ ID NO: 3534997 - DNA, 22 bp, Homo sapiens
ataagtttatttcttaaatcta

SEQ ID NO: 3534998 - DNA, 19 bp, Homo sapiens
atatactcactttctagat

SEQ ID NO: 3534999 - DNA, 17 bp, Homo sapiens
atatgggacatttttga

SEQ ID NO: 3535000 - DNA, 14 bp, Homo sapiens
atattaatattcct

SEQ ID NO: 3535001 - DNA, 12 bp, Homo sapiens
atattttaaata

SEQ ID NO: 3535002 - DNA, 13 bp, Homo sapiens
atcaatcaactta

SEQ ID NO: 3535003 - DNA, 13 bp, Homo sapiens
atcaccacagttt

SEQ ID NO: 3535004 - DNA, 13 bp, Homo sapiens
atcagtgttaaaa

SEQ ID NO: 3535005 - DNA, 12 bp, Homo sapiens
atcccccagcct

SEQ ID NO: 3535006 - DNA, 13 bp, Homo sapiens
atccctttattac

SEQ ID NO: 3535007 - DNA, 17 bp, Homo sapiens
atcgcttcatgtaacta

SEQ ID NO: 3535008 - DNA, 16 bp, Homo sapiens
atcggagcctcctctc

SEQ ID NO: 3535009 - DNA, 21 bp, Homo sapiens
atctggaatctggagaccagg

SEQ ID NO: 3535010 - DNA, 21 bp, Homo sapiens
atctggagaccagggagcctt

SEQ ID NO: 3535011 - DNA, 22 bp, Homo sapiens
atctggagaccagggagccttt

SEQ ID NO: 3535012 - DNA, 20 bp, Homo sapiens
atgaagagatttttcatgat

SEQ ID NO: 3535013 - DNA, 22 bp, Homo sapiens
atgaagatatttttccattttt

SEQ ID NO: 3535014 - DNA, 13 bp, Homo sapiens
atgaattgcattt

SEQ ID NO: 3535015 - DNA, 16 bp, Homo sapiens
atgagatattaaacca

SEQ ID NO: 3535016 - DNA, 17 bp, Homo sapiens
atgataatacccacatt

SEQ ID NO: 3535017 - DNA, 19 bp, Homo sapiens
atgctgcaggacttgagaa

SEQ ID NO: 3535018 - DNA, 22 bp, Homo sapiens
atggactccaggatcctcctgg

SEQ ID NO: 3535019 - DNA, 16 bp, Homo sapiens
atgtaagctgaaaata

SEQ ID NO: 3535020 - DNA, 17 bp, Homo sapiens
atgtaagctgaaaatat

SEQ ID NO: 3535021 - DNA, 18 bp, Homo sapiens
atgtagccccctggcctc

SEQ ID NO: 3535022 - DNA, 19 bp, Homo sapiens
atgtagccccctggcctct

SEQ ID NO: 3535023 - DNA, 21 bp, Homo sapiens
atgtagccccctggcctctgt

SEQ ID NO: 3535024 - DNA, 23 bp, Homo sapiens
atgtagccccctggcctctgtgc

SEQ ID NO: 3535025 - DNA, 18 bp, Homo sapiens
atgtgtattacaaatatt

SEQ ID NO: 3535026 - DNA, 14 bp, Homo sapiens
atgtgtggcctgca

SEQ ID NO: 3535027 - DNA, 14 bp, Homo sapiens
atgttttgacattt

SEQ ID NO: 3535028 - DNA, 21 bp, Homo sapiens
attaaaggttcctttgttccc

SEQ ID NO: 3535029 - DNA, 20 bp, Homo sapiens
attaaagtctacactgcctt

SEQ ID NO: 3535030 - DNA, 15 bp, Homo sapiens
attaagaaaatctat

SEQ ID NO: 3535031 - DNA, 18 bp, Homo sapiens
attaccccctccttcaga

SEQ ID NO: 3535032 - DNA, 22 bp, Homo sapiens
attcaaactggggcctccagaa

SEQ ID NO: 3535033 - DNA, 20 bp, Homo sapiens
attcatattttctttcaaaa

SEQ ID NO: 3535034 - DNA, 16 bp, Homo sapiens
attctgcctaataaaa

SEQ ID NO: 3535035 - DNA, 17 bp, Homo sapiens
attcttatttcatgaaa

SEQ ID NO: 3535036 - DNA, 22 bp, Homo sapiens
attgctatgttttgacattttt

SEQ ID NO: 3535037 - DNA, 22 bp, Homo sapiens
attgctgagcctctgctcccca

SEQ ID NO: 3535038 - DNA, 23 bp, Homo sapiens
attgctgagcctctgctccccag

SEQ ID NO: 3535039 - DNA, 22 bp, Homo sapiens
atttatgtttgcacttgtgatt

SEQ ID NO: 3535040 - DNA, 11 bp, Homo sapiens
atttattattt

SEQ ID NO: 3535041 - DNA, 19 bp, Homo sapiens
atttattatttatttatta

SEQ ID NO: 3535042 - DNA, 13 bp, Homo sapiens
atttatttacaga

SEQ ID NO: 3535043 - DNA, 14 bp, Homo sapiens
atttatttattatt

SEQ ID NO: 3535044 - DNA, 22 bp, Homo sapiens
atttcctcaacgttgctcccca

SEQ ID NO: 3535045 - DNA, 13 bp, Homo sapiens
attttaataatat

SEQ ID NO: 3535046 - DNA, 15 bp, Homo sapiens
attttcattattcct

SEQ ID NO: 3535047 - DNA, 14 bp, Homo sapiens
attttctttcaaaa

SEQ ID NO: 3535048 - DNA, 22 bp, Homo sapiens
attttgagaaagtcttatttat

SEQ ID NO: 3535049 - DNA, 17 bp, Homo sapiens
attttgtaactttctct

SEQ ID NO: 3535050 - DNA, 19 bp, Homo sapiens
atttttaatatatactatg

SEQ ID NO: 3535051 - DNA, 16 bp, Homo sapiens
atttttacattctgaa

SEQ ID NO: 3535052 - DNA, 20 bp, Homo sapiens
atttttcctccactgaacta

SEQ ID NO: 3535053 - DNA, 14 bp, Homo sapiens
caaaatgacaatga

SEQ ID NO: 3535054 - DNA, 15 bp, Homo sapiens
caaaatgacaatgat

SEQ ID NO: 3535055 - DNA, 17 bp, Homo sapiens
caaacgcctcccctgcc

SEQ ID NO: 3535056 - DNA, 17 bp, Homo sapiens
caacctcttctggctca

SEQ ID NO: 3535057 - DNA, 14 bp, Homo sapiens
caacttactactga

SEQ ID NO: 3535058 - DNA, 21 bp, Homo sapiens
caagtggaccttaggccttcc

SEQ ID NO: 3535059 - DNA, 12 bp, Homo sapiens
caatatttttct

SEQ ID NO: 3535060 - DNA, 14 bp, Homo sapiens
caatgctgatttgg

SEQ ID NO: 3535061 - DNA, 16 bp, Homo sapiens
caatgctgatttggtg

SEQ ID NO: 3535062 - DNA, 21 bp, Homo sapiens
caatgctgatttggtgaccaa

SEQ ID NO: 3535063 - DNA, 11 bp, Homo sapiens
cacagggactg

SEQ ID NO: 3535064 - DNA, 15 bp, Homo sapiens
cacagtccctcctgt

SEQ ID NO: 3535065 - DNA, 19 bp, Homo sapiens
cacatccccaccttccaag

SEQ ID NO: 3535066 - DNA, 21 bp, Homo sapiens
cacatccccaccttccaagga

SEQ ID NO: 3535067 - DNA, 14 bp, Homo sapiens
caccattccacatc

SEQ ID NO: 3535068 - DNA, 23 bp, Homo sapiens
caccattccacatccccaccttc

SEQ ID NO: 3535069 - DNA, 18 bp, Homo sapiens
caccctcaacctcttctg

SEQ ID NO: 3535070 - DNA, 16 bp, Homo sapiens
cactcattgctgagcc

SEQ ID NO: 3535071 - DNA, 19 bp, Homo sapiens
cactggggatcccgtgctg

SEQ ID NO: 3535072 - DNA, 21 bp, Homo sapiens
cacttcaagtgaccaccagga

SEQ ID NO: 3535073 - DNA, 15 bp, Homo sapiens
cactttcactgggga

SEQ ID NO: 3535074 - DNA, 15 bp, Homo sapiens
cagaactcactgggg

SEQ ID NO: 3535075 - DNA, 14 bp, Homo sapiens
cagacaccctcaac

SEQ ID NO: 3535076 - DNA, 15 bp, Homo sapiens
cagacactttggaag

SEQ ID NO: 3535077 - DNA, 18 bp, Homo sapiens
cagacatgttttccgtga

SEQ ID NO: 3535078 - DNA, 15 bp, Homo sapiens
cagatgaatgtattt

SEQ ID NO: 3535079 - DNA, 15 bp, Homo sapiens
cagatgtttccagac

SEQ ID NO: 3535080 - DNA, 18 bp, Homo sapiens
cagatgtttccagacttc

SEQ ID NO: 3535081 - DNA, 20 bp, Homo sapiens
cagcagctgaggccccaggg

SEQ ID NO: 3535082 - DNA, 20 bp, Homo sapiens
cagccctccccatggagcca

SEQ ID NO: 3535083 - DNA, 19 bp, Homo sapiens
caggaatgtgtggcctgca

SEQ ID NO: 3535084 - DNA, 16 bp, Homo sapiens
caggaggtgggtgagc

SEQ ID NO: 3535085 - DNA, 17 bp, Homo sapiens
caggatcctcctggagc

SEQ ID NO: 3535086 - DNA, 17 bp, Homo sapiens
caggatggttactgagg

SEQ ID NO: 3535087 - DNA, 17 bp, Homo sapiens
caggcctggcaagtggg

SEQ ID NO: 3535088 - DNA, 20 bp, Homo sapiens
caggcctggcaagtgggtga

SEQ ID NO: 3535089 - DNA, 12 bp, Homo sapiens
caggccttctga

SEQ ID NO: 3535090 - DNA, 22 bp, Homo sapiens
cagggagcctttggttctggcc

SEQ ID NO: 3535091 - DNA, 15 bp, Homo sapiens
cagggctgtgggtgg

SEQ ID NO: 3535092 - DNA, 14 bp, Homo sapiens
cagtatgaaaataa

SEQ ID NO: 3535093 - DNA, 13 bp, Homo sapiens
cagtccctcctgt

SEQ ID NO: 3535094 - DNA, 21 bp, Homo sapiens
cagtctgttccccatggccac

SEQ ID NO: 3535095 - DNA, 14 bp, Homo sapiens
cagtgttaaaaaat

SEQ ID NO: 3535096 - DNA, 16 bp, Homo sapiens
catagctgggatttga

SEQ ID NO: 3535097 - DNA, 20 bp, Homo sapiens
catagctgggatttgaactg

SEQ ID NO: 3535098 - DNA, 17 bp, Homo sapiens
catcagtgttaaaaaat

SEQ ID NO: 3535099 - DNA, 14 bp, Homo sapiens
catccaaccttccc

SEQ ID NO: 3535100 - DNA, 16 bp, Homo sapiens
catctggaatctggag

SEQ ID NO: 3535101 - DNA, 23 bp, Homo sapiens
catctggattctgcctaataaaa

SEQ ID NO: 3535102 - DNA, 18 bp, Homo sapiens
catgtaagctgaaaatat

SEQ ID NO: 3535103 - DNA, 21 bp, Homo sapiens
catgtagccccctggcctctg

SEQ ID NO: 3535104 - DNA, 21 bp, Homo sapiens
cattcttatttcatgaaaatt

SEQ ID NO: 3535105 - DNA, 17 bp, Homo sapiens
cattgctgagcctctgc

SEQ ID NO: 3535106 - DNA, 21 bp, Homo sapiens
cattgctgagcctctgctccc

SEQ ID NO: 3535107 - DNA, 20 bp, Homo sapiens
catttttgtattttgtttaa

SEQ ID NO: 3535108 - DNA, 13 bp, Homo sapiens
ccacaaagggtag

SEQ ID NO: 3535109 - DNA, 18 bp, Homo sapiens
ccacaaagggtagcctgg

SEQ ID NO: 3535110 - DNA, 18 bp, Homo sapiens
ccacatccccaccttcca

SEQ ID NO: 3535111 - DNA, 17 bp, Homo sapiens
ccacttcaagtgaccac

SEQ ID NO: 3535112 - DNA, 14 bp, Homo sapiens
ccactttcccttcc

SEQ ID NO: 3535113 - DNA, 23 bp, Homo sapiens
ccactttcccttcccctgtgact

SEQ ID NO: 3535114 - DNA, 18 bp, Homo sapiens
ccagagagaggcgtcctg

SEQ ID NO: 3535115 - DNA, 17 bp, Homo sapiens
ccagatgtttccagact

SEQ ID NO: 3535116 - DNA, 21 bp, Homo sapiens
ccagccctccccatggagcca

SEQ ID NO: 3535117 - DNA, 16 bp, Homo sapiens
ccagctccctctattt

SEQ ID NO: 3535118 - DNA, 19 bp, Homo sapiens
ccaggccctagaccctccc

SEQ ID NO: 3535119 - DNA, 12 bp, Homo sapiens
ccaggccttctg

SEQ ID NO: 3535120 - DNA, 13 bp, Homo sapiens
ccaggccttctga

SEQ ID NO: 3535121 - DNA, 12 bp, Homo sapiens
ccagggagcctt

SEQ ID NO: 3535122 - DNA, 18 bp, Homo sapiens
ccagggagcctttggttc

SEQ ID NO: 3535123 - DNA, 22 bp, Homo sapiens
ccagggagcctttggttctggc

SEQ ID NO: 3535124 - DNA, 17 bp, Homo sapiens
ccagggctgtgggtggg

SEQ ID NO: 3535125 - DNA, 16 bp, Homo sapiens
ccagtctgttccccat

SEQ ID NO: 3535126 - DNA, 21 bp, Homo sapiens
cccaatccctttattaccccc

SEQ ID NO: 3535127 - DNA, 17 bp, Homo sapiens
cccaccattccacatcc

SEQ ID NO: 3535128 - DNA, 21 bp, Homo sapiens
cccaccattccacatccccac

SEQ ID NO: 3535129 - DNA, 17 bp, Homo sapiens
cccactctgctcccagc

SEQ ID NO: 3535130 - DNA, 21 bp, Homo sapiens
cccactctgctcccagcccct

SEQ ID NO: 3535131 - DNA, 23 bp, Homo sapiens
cccagagagaggcgtcctggtga

SEQ ID NO: 3535132 - DNA, 12 bp, Homo sapiens
cccagcacaggc

SEQ ID NO: 3535133 - DNA, 21 bp, Homo sapiens
cccagcacaggcaggggtaga

SEQ ID NO: 3535134 - DNA, 21 bp, Homo sapiens
cccatgtagccccctggcctc

SEQ ID NO: 3535135 - DNA, 14 bp, Homo sapiens
ccccagggctgtgg

SEQ ID NO: 3535136 - DNA, 20 bp, Homo sapiens
cccccaccattccacatccc

SEQ ID NO: 3535137 - DNA, 19 bp, Homo sapiens
ccccctggcctctgtgcct

SEQ ID NO: 3535138 - DNA, 18 bp, Homo sapiens
cccctgtgactcctccct

SEQ ID NO: 3535139 - DNA, 20 bp, Homo sapiens
ccctaccttgagaccctctt

SEQ ID NO: 3535140 - DNA, 22 bp, Homo sapiens
ccctaccttgagaccctcttct

SEQ ID NO: 3535141 - DNA, 20 bp, Homo sapiens
ccctagaccctcccccacca

SEQ ID NO: 3535142 - DNA, 13 bp, Homo sapiens
ccctcccccacca

SEQ ID NO: 3535143 - DNA, 13 bp, Homo sapiens
ccctccctcttcc

SEQ ID NO: 3535144 - DNA, 18 bp, Homo sapiens
ccgtgaaaacggagctga

SEQ ID NO: 3535145 - DNA, 12 bp, Homo sapiens
ccgtgcagctgg

SEQ ID NO: 3535146 - DNA, 14 bp, Homo sapiens
ccgttcacattttt

SEQ ID NO: 3535147 - DNA, 22 bp, Homo sapiens
cctaccttgagaccctcttctc

SEQ ID NO: 3535148 - DNA, 12 bp, Homo sapiens
cctcaacctctt

SEQ ID NO: 3535149 - DNA, 17 bp, Homo sapiens
cctcaacctcttctggc

SEQ ID NO: 3535150 - DNA, 21 bp, Homo sapiens
cctccagaactcactggggcc

SEQ ID NO: 3535151 - DNA, 12 bp, Homo sapiens
cctcccccacca

SEQ ID NO: 3535152 - DNA, 13 bp, Homo sapiens
cctccctcttccc

SEQ ID NO: 3535153 - DNA, 18 bp, Homo sapiens
cctcctgttgccacactt

SEQ ID NO: 3535154 - DNA, 13 bp, Homo sapiens
cctccttcagaca

SEQ ID NO: 3535155 - DNA, 17 bp, Homo sapiens
cctcttctctgggccca

SEQ ID NO: 3535156 - DNA, 20 bp, Homo sapiens
cctcttctctgggcccagag

SEQ ID NO: 3535157 - DNA, 12 bp, Homo sapiens
cctgaattaaag

SEQ ID NO: 3535158 - DNA, 16 bp, Homo sapiens
cctgaattaaagtcta

SEQ ID NO: 3535159 - DNA, 20 bp, Homo sapiens
cctgaattaaagtctacact

SEQ ID NO: 3535160 - DNA, 13 bp, Homo sapiens
ccttaggccttcc

SEQ ID NO: 3535161 - DNA, 23 bp, Homo sapiens
ccttaggccttcctctctccaga

SEQ ID NO: 3535162 - DNA, 14 bp, Homo sapiens
ccttgacctttcca

SEQ ID NO: 3535163 - DNA, 17 bp, Homo sapiens
ccttgagaccctcttct

SEQ ID NO: 3535164 - DNA, 19 bp, Homo sapiens
ccttgagaccctcttctct

SEQ ID NO: 3535165 - DNA, 21 bp, Homo sapiens
ccttgagaccctcttctctgg

SEQ ID NO: 3535166 - DNA, 15 bp, Homo sapiens
ccttggctcagacat

SEQ ID NO: 3535167 - DNA, 21 bp, Homo sapiens
ccttgggcaagtcccttgacc

SEQ ID NO: 3535168 - DNA, 17 bp, Homo sapiens
ccttggttcatcagtgt

SEQ ID NO: 3535169 - DNA, 15 bp, Homo sapiens
cctttacttgacctc

SEQ ID NO: 3535170 - DNA, 15 bp, Homo sapiens
cctttggttctggcc

SEQ ID NO: 3535171 - DNA, 19 bp, Homo sapiens
cctttgttccctaagtcca

SEQ ID NO: 3535172 - DNA, 20 bp, Homo sapiens
cgagaaataaagtttgctta

SEQ ID NO: 3535173 - DNA, 17 bp, Homo sapiens
cgagctctgtcctctgt

SEQ ID NO: 3535174 - DNA, 16 bp, Homo sapiens
cgcctcccctgcccca

SEQ ID NO: 3535175 - DNA, 15 bp, Homo sapiens
cggggtatcctgggg

SEQ ID NO: 3535176 - DNA, 19 bp, Homo sapiens
cgggtggggtgcttgctgt

SEQ ID NO: 3535177 - DNA, 14 bp, Homo sapiens
cgtacccaaggtca

SEQ ID NO: 3535178 - DNA, 14 bp, Homo sapiens
cgtccactttccct

SEQ ID NO: 3535179 - DNA, 16 bp, Homo sapiens
cgtgaaaacggagctg

SEQ ID NO: 3535180 - DNA, 18 bp, Homo sapiens
cgtgaaaacggagctgaa

SEQ ID NO: 3535181 - DNA, 14 bp, Homo sapiens
ctaacacccagtct

SEQ ID NO: 3535182 - DNA, 17 bp, Homo sapiens
ctaagaattcaaactgg

SEQ ID NO: 3535183 - DNA, 23 bp, Homo sapiens
ctaatagttttattaataaacat

SEQ ID NO: 3535184 - DNA, 19 bp, Homo sapiens
ctacagctttgatccctga

SEQ ID NO: 3535185 - DNA, 21 bp, Homo sapiens
ctatatactcactttctagat

SEQ ID NO: 3535186 - DNA, 23 bp, Homo sapiens
ctatgtaggaaagaccatttttc

SEQ ID NO: 3535187 - DNA, 22 bp, Homo sapiens
ctatttgttgatgcttgtgtca

SEQ ID NO: 3535188 - DNA, 20 bp, Homo sapiens
ctcaacctcttctggctcaa

SEQ ID NO: 3535189 - DNA, 18 bp, Homo sapiens
ctcaacgttgctccccat

SEQ ID NO: 3535190 - DNA, 13 bp, Homo sapiens
ctcactggggcct

SEQ ID NO: 3535191 - DNA, 19 bp, Homo sapiens
ctcagacatgttttccgtg

SEQ ID NO: 3535192 - DNA, 20 bp, Homo sapiens
ctcagacatgttttccgtga

SEQ ID NO: 3535193 - DNA, 20 bp, Homo sapiens
ctcatggactccaggatcct

SEQ ID NO: 3535194 - DNA, 14 bp, Homo sapiens
ctccaggatcctcc

SEQ ID NO: 3535195 - DNA, 16 bp, Homo sapiens
ctccaggatcctcctg

SEQ ID NO: 3535196 - DNA, 22 bp, Homo sapiens
ctccaggatcctcctggagcag

SEQ ID NO: 3535197 - DNA, 16 bp, Homo sapiens
ctccctcttcccagca

SEQ ID NO: 3535198 - DNA, 17 bp, Homo sapiens
ctccctcttcccagcac

SEQ ID NO: 3535199 - DNA, 15 bp, Homo sapiens
ctcctaggaaaatac

SEQ ID NO: 3535200 - DNA, 22 bp, Homo sapiens
ctcctagtactaactcctagga

SEQ ID NO: 3535201 - DNA, 14 bp, Homo sapiens
ctcctcccttcccc

SEQ ID NO: 3535202 - DNA, 15 bp, Homo sapiens
ctcctgttgccacac

SEQ ID NO: 3535203 - DNA, 16 bp, Homo sapiens
ctcctgttgccacact

SEQ ID NO: 3535204 - DNA, 19 bp, Homo sapiens
ctccttcagacaccctcaa

SEQ ID NO: 3535205 - DNA, 20 bp, Homo sapiens
ctctgtcctctgtcagtcat

SEQ ID NO: 3535206 - DNA, 16 bp, Homo sapiens
ctctgtgccttctttt

SEQ ID NO: 3535207 - DNA, 13 bp, Homo sapiens
ctcttgattttca

SEQ ID NO: 3535208 - DNA, 15 bp, Homo sapiens
ctgaaagacaatata

SEQ ID NO: 3535209 - DNA, 14 bp, Homo sapiens
ctgaattaaagtct

SEQ ID NO: 3535210 - DNA, 15 bp, Homo sapiens
ctgaattaaagtcta

SEQ ID NO: 3535211 - DNA, 16 bp, Homo sapiens
ctgacatctggaatct

SEQ ID NO: 3535212 - DNA, 19 bp, Homo sapiens
ctgagccctccctcttccc

SEQ ID NO: 3535213 - DNA, 20 bp, Homo sapiens
ctgagccctccctcttccca

SEQ ID NO: 3535214 - DNA, 22 bp, Homo sapiens
ctgagccgtgcagctgggattt

SEQ ID NO: 3535215 - DNA, 14 bp, Homo sapiens
ctgagcctctgctc

SEQ ID NO: 3535216 - DNA, 16 bp, Homo sapiens
ctgagcctctgctccc

SEQ ID NO: 3535217 - DNA, 18 bp, Homo sapiens
ctgagcctctgctcccca

SEQ ID NO: 3535218 - DNA, 21 bp, Homo sapiens
ctgattaagttgtctaaacaa

SEQ ID NO: 3535219 - DNA, 22 bp, Homo sapiens
ctgatttcaaggtccgagctct

SEQ ID NO: 3535220 - DNA, 19 bp, Homo sapiens
ctgcaggacttgagaagac

SEQ ID NO: 3535221 - DNA, 23 bp, Homo sapiens
ctgcaggacttgagaagacctca

SEQ ID NO: 3535222 - DNA, 16 bp, Homo sapiens
ctgcagtatgaaaata

SEQ ID NO: 3535223 - DNA, 12 bp, Homo sapiens
ctgcctaataaa

SEQ ID NO: 3535224 - DNA, 15 bp, Homo sapiens
ctgccttggctcaga

SEQ ID NO: 3535225 - DNA, 17 bp, Homo sapiens
ctgccttggctcagaca

SEQ ID NO: 3535226 - DNA, 14 bp, Homo sapiens
ctgccttgtgtaca

SEQ ID NO: 3535227 - DNA, 19 bp, Homo sapiens
ctggagcagcagctgaggc

SEQ ID NO: 3535228 - DNA, 20 bp, Homo sapiens
ctggattctgcctaataaaa

SEQ ID NO: 3535229 - DNA, 22 bp, Homo sapiens
ctggattgatcggagcctcctc

SEQ ID NO: 3535230 - DNA, 18 bp, Homo sapiens
ctggcatctgacacaaaa

SEQ ID NO: 3535231 - DNA, 11 bp, Homo sapiens
ctggcctctgt

SEQ ID NO: 3535232 - DNA, 14 bp, Homo sapiens
ctggcctctgtgcc

SEQ ID NO: 3535233 - DNA, 12 bp, Homo sapiens
ctggtgaggaca

SEQ ID NO: 3535234 - DNA, 19 bp, Homo sapiens
ctgtaaaatgggtatattg

SEQ ID NO: 3535235 - DNA, 19 bp, Homo sapiens
ctgtcaacctgaattaaag

SEQ ID NO: 3535236 - DNA, 17 bp, Homo sapiens
ctgtcagtcatgcgtcc

SEQ ID NO: 3535237 - DNA, 19 bp, Homo sapiens
ctgtccaatttctattaaa

SEQ ID NO: 3535238 - DNA, 15 bp, Homo sapiens
ctgtgactcctccct

SEQ ID NO: 3535239 - DNA, 22 bp, Homo sapiens
ctgtgactcctcccttccccac

SEQ ID NO: 3535240 - DNA, 19 bp, Homo sapiens
ctgtgccttcttttgatta

SEQ ID NO: 3535241 - DNA, 16 bp, Homo sapiens
ctgtgggtggggaagg

SEQ ID NO: 3535242 - DNA, 15 bp, Homo sapiens
cttagatctgagccc

SEQ ID NO: 3535243 - DNA, 12 bp, Homo sapiens
cttaggccttcc

SEQ ID NO: 3535244 - DNA, 20 bp, Homo sapiens
cttccccactctgctcccag

SEQ ID NO: 3535245 - DNA, 21 bp, Homo sapiens
cttccccactctgctcccagc

SEQ ID NO: 3535246 - DNA, 22 bp, Homo sapiens
cttccccactctgctcccagcc

SEQ ID NO: 3535247 - DNA, 23 bp, Homo sapiens
cttccttgagacacggagcccag

SEQ ID NO: 3535248 - DNA, 12 bp, Homo sapiens
cttctggctcaa

SEQ ID NO: 3535249 - DNA, 14 bp, Homo sapiens
cttcttttgattat

SEQ ID NO: 3535250 - DNA, 13 bp, Homo sapiens
cttcttttgtgaa

SEQ ID NO: 3535251 - DNA, 15 bp, Homo sapiens
cttgacctttccagc

SEQ ID NO: 3535252 - DNA, 11 bp, Homo sapiens
cttgctgtgtg

SEQ ID NO: 3535253 - DNA, 17 bp, Homo sapiens
cttgtaacaagaaaaca

SEQ ID NO: 3535254 - DNA, 17 bp, Homo sapiens
cttgtatatcttgtttt

SEQ ID NO: 3535255 - DNA, 16 bp, Homo sapiens
ctttaccttttttctt

SEQ ID NO: 3535256 - DNA, 19 bp, Homo sapiens
ctttggttctggccagaat

SEQ ID NO: 3535257 - DNA, 21 bp, Homo sapiens
ctttggttctggccagaatgc

SEQ ID NO: 3535258 - DNA, 18 bp, Homo sapiens
cttttctggctggggatg

SEQ ID NO: 3535259 - DNA, 13 bp, Homo sapiens
gaaaacggagctg

SEQ ID NO: 3535260 - DNA, 14 bp, Homo sapiens
gaaaacggagctga

SEQ ID NO: 3535261 - DNA, 18 bp, Homo sapiens
gaaaagtggcaagaccaa

SEQ ID NO: 3535262 - DNA, 19 bp, Homo sapiens
gaaaagtggcaagaccaaa

SEQ ID NO: 3535263 - DNA, 18 bp, Homo sapiens
gaaaataatcattcttat

SEQ ID NO: 3535264 - DNA, 16 bp, Homo sapiens
gaaacctgggattcag

SEQ ID NO: 3535265 - DNA, 18 bp, Homo sapiens
gaacatccaaccttccca

SEQ ID NO: 3535266 - DNA, 16 bp, Homo sapiens
gaaccaggccttctga

SEQ ID NO: 3535267 - DNA, 14 bp, Homo sapiens
gaactcactggggc

SEQ ID NO: 3535268 - DNA, 16 bp, Homo sapiens
gaactcactggggcct

SEQ ID NO: 3535269 - DNA, 22 bp, Homo sapiens
gaacttgctgctgagtgcacca

SEQ ID NO: 3535270 - DNA, 16 bp, Homo sapiens
gaagcaaaggcaggag

SEQ ID NO: 3535271 - DNA, 20 bp, Homo sapiens
gaagggccttgagcatctgg

SEQ ID NO: 3535272 - DNA, 12 bp, Homo sapiens
gaatctggagac

SEQ ID NO: 3535273 - DNA, 18 bp, Homo sapiens
gaatctggagaccaggga

SEQ ID NO: 3535274 - DNA, 18 bp, Homo sapiens
gaattcaaactggggcct

SEQ ID NO: 3535275 - DNA, 22 bp, Homo sapiens
gaattcaaactggggcctccag

SEQ ID NO: 3535276 - DNA, 13 bp, Homo sapiens
gacaagaagcaaa

SEQ ID NO: 3535277 - DNA, 19 bp, Homo sapiens
gacaagaagcaaatttttt

SEQ ID NO: 3535278 - DNA, 13 bp, Homo sapiens
gacacaaaaaaag

SEQ ID NO: 3535279 - DNA, 14 bp, Homo sapiens
gacatctggaatct

SEQ ID NO: 3535280 - DNA, 22 bp, Homo sapiens
gacatctggaatctggagacca

SEQ ID NO: 3535281 - DNA, 17 bp, Homo sapiens
gaccaaaatgacaatga

SEQ ID NO: 3535282 - DNA, 21 bp, Homo sapiens
gaccaaaatgacaatgatgat

SEQ ID NO: 3535283 - DNA, 14 bp, Homo sapiens
gaccaactgtcact

SEQ ID NO: 3535284 - DNA, 14 bp, Homo sapiens
gaccagggagcctt

SEQ ID NO: 3535285 - DNA, 18 bp, Homo sapiens
gacccaatgtaggagctg

SEQ ID NO: 3535286 - DNA, 14 bp, Homo sapiens
gaccctcttctctg

SEQ ID NO: 3535287 - DNA, 15 bp, Homo sapiens
gaccctcttctctgg

SEQ ID NO: 3535288 - DNA, 20 bp, Homo sapiens
gaccctcttctctgggccca

SEQ ID NO: 3535289 - DNA, 22 bp, Homo sapiens
gaccctcttctctgggcccaga

SEQ ID NO: 3535290 - DNA, 17 bp, Homo sapiens
gacctcctaacaagtag

SEQ ID NO: 3535291 - DNA, 18 bp, Homo sapiens
gaccttaggccttcctct

SEQ ID NO: 3535292 - DNA, 21 bp, Homo sapiens
gacgaacatccaaccttccca

SEQ ID NO: 3535293 - DNA, 19 bp, Homo sapiens
gactccaggatcctcctgg

SEQ ID NO: 3535294 - DNA, 20 bp, Homo sapiens
gactccaggatcctcctgga

SEQ ID NO: 3535295 - DNA, 22 bp, Homo sapiens
gactcctcccttccccactctg

SEQ ID NO: 3535296 - DNA, 17 bp, Homo sapiens
gacttagatctgagccc

SEQ ID NO: 3535297 - DNA, 18 bp, Homo sapiens
gagaccctcttctctggg

SEQ ID NO: 3535298 - DNA, 17 bp, Homo sapiens
gagagacaagaagcaaa

SEQ ID NO: 3535299 - DNA, 16 bp, Homo sapiens
gagagaggcgtcctgg

SEQ ID NO: 3535300 - DNA, 22 bp, Homo sapiens
gagatatttacatgaattgcat

SEQ ID NO: 3535301 - DNA, 12 bp, Homo sapiens
gagatttttcat

SEQ ID NO: 3535302 - DNA, 15 bp, Homo sapiens
gagcagcagctgagg

SEQ ID NO: 3535303 - DNA, 18 bp, Homo sapiens
gagccctccctcttccca

SEQ ID NO: 3535304 - DNA, 22 bp, Homo sapiens
gagccctccctcttcccagcac

SEQ ID NO: 3535305 - DNA, 16 bp, Homo sapiens
gagcctctgctcccca

SEQ ID NO: 3535306 - DNA, 11 bp, Homo sapiens
gagctctgtcc

SEQ ID NO: 3535307 - DNA, 21 bp, Homo sapiens
gagctgccttggctcagacat

SEQ ID NO: 3535308 - DNA, 20 bp, Homo sapiens
gaggcgtcctggtgaggaca

SEQ ID NO: 3535309 - DNA, 16 bp, Homo sapiens
gatatgggacattttt

SEQ ID NO: 3535310 - DNA, 23 bp, Homo sapiens
gatcctcctggagcagcagctga

SEQ ID NO: 3535311 - DNA, 21 bp, Homo sapiens
gatctgagccctccctcttcc

SEQ ID NO: 3535312 - DNA, 22 bp, Homo sapiens
gatgatgcttgtaacaagaaaa

SEQ ID NO: 3535313 - DNA, 12 bp, Homo sapiens
gatgtaaagtga

SEQ ID NO: 3535314 - DNA, 12 bp, Homo sapiens
gatgtttccaga

SEQ ID NO: 3535315 - DNA, 13 bp, Homo sapiens
gatgtttccagac

SEQ ID NO: 3535316 - DNA, 21 bp, Homo sapiens
gatttgaaccaggccttctga

SEQ ID NO: 3535317 - DNA, 12 bp, Homo sapiens
gcacaggcaggg

SEQ ID NO: 3535318 - DNA, 13 bp, Homo sapiens
gcagctgaggccc

SEQ ID NO: 3535319 - DNA, 15 bp, Homo sapiens
gcagctgaggcccca

SEQ ID NO: 3535320 - DNA, 19 bp, Homo sapiens
gcagctgaggccccagggc

SEQ ID NO: 3535321 - DNA, 14 bp, Homo sapiens
gcatctgacacaaa

SEQ ID NO: 3535322 - DNA, 21 bp, Homo sapiens
gccacactttcactggggatc

SEQ ID NO: 3535323 - DNA, 19 bp, Homo sapiens
gcccacattagggggtttg

SEQ ID NO: 3535324 - DNA, 22 bp, Homo sapiens
gcccagagagaggcgtcctggt

SEQ ID NO: 3535325 - DNA, 12 bp, Homo sapiens
gcccagccctcc

SEQ ID NO: 3535326 - DNA, 16 bp, Homo sapiens
gcccagccctccccat

SEQ ID NO: 3535327 - DNA, 18 bp, Homo sapiens
gccccaatccctttatta

SEQ ID NO: 3535328 - DNA, 19 bp, Homo sapiens
gccccaatccctttattac

SEQ ID NO: 3535329 - DNA, 17 bp, Homo sapiens
gccccctggcctctgtg

SEQ ID NO: 3535330 - DNA, 23 bp, Homo sapiens
gcccctaccttgagaccctcttc

SEQ ID NO: 3535331 - DNA, 14 bp, Homo sapiens
gccctactattcag

SEQ ID NO: 3535332 - DNA, 13 bp, Homo sapiens
gccctagaccctc

SEQ ID NO: 3535333 - DNA, 18 bp, Homo sapiens
gccctagaccctccccca

SEQ ID NO: 3535334 - DNA, 22 bp, Homo sapiens
gccctagaccctcccccaccat

SEQ ID NO: 3535335 - DNA, 18 bp, Homo sapiens
gccctccccatggagcca

SEQ ID NO: 3535336 - DNA, 16 bp, Homo sapiens
gccctccctcttccca

SEQ ID NO: 3535337 - DNA, 18 bp, Homo sapiens
gccctccctcttcccagc

SEQ ID NO: 3535338 - DNA, 16 bp, Homo sapiens
gccgatggggcccaca

SEQ ID NO: 3535339 - DNA, 11 bp, Homo sapiens
gcctaataaaa

SEQ ID NO: 3535340 - DNA, 23 bp, Homo sapiens
gcctacagctttgatccctgaca

SEQ ID NO: 3535341 - DNA, 16 bp, Homo sapiens
gcctggcttttctggc

SEQ ID NO: 3535342 - DNA, 15 bp, Homo sapiens
gccttgagcatctgg

SEQ ID NO: 3535343 - DNA, 15 bp, Homo sapiens
gccttggctcagaca

SEQ ID NO: 3535344 - DNA, 13 bp, Homo sapiens
gctcccagcccct

SEQ ID NO: 3535345 - DNA, 18 bp, Homo sapiens
gctcccagcccctacctt

SEQ ID NO: 3535346 - DNA, 15 bp, Homo sapiens
gctgagagaaaataa

SEQ ID NO: 3535347 - DNA, 14 bp, Homo sapiens
gctgccttggctca

SEQ ID NO: 3535348 - DNA, 16 bp, Homo sapiens
gctgccttggctcaga

SEQ ID NO: 3535349 - DNA, 17 bp, Homo sapiens
gctgccttggctcagac

SEQ ID NO: 3535350 - DNA, 21 bp, Homo sapiens
gctgccttggctcagacatgt

SEQ ID NO: 3535351 - DNA, 21 bp, Homo sapiens
gctgggatttgaactgagccg

SEQ ID NO: 3535352 - DNA, 22 bp, Homo sapiens
gctgttcccatgtagccccctg

SEQ ID NO: 3535353 - DNA, 14 bp, Homo sapiens
gcttgtaacaagaa

SEQ ID NO: 3535354 - DNA, 15 bp, Homo sapiens
gctttgatccctgac

SEQ ID NO: 3535355 - DNA, 17 bp, Homo sapiens
gctttgtaaactccaca

SEQ ID NO: 3535356 - DNA, 21 bp, Homo sapiens
ggaccttaggccttcctctct

SEQ ID NO: 3535357 - DNA, 19 bp, Homo sapiens
ggactccaggatcctcctg

SEQ ID NO: 3535358 - DNA, 20 bp, Homo sapiens
ggactccaggatcctcctgg

SEQ ID NO: 3535359 - DNA, 20 bp, Homo sapiens
ggagaccggggtatcctggg

SEQ ID NO: 3535360 - DNA, 21 bp, Homo sapiens
ggagccagctccctctattta

SEQ ID NO: 3535361 - DNA, 16 bp, Homo sapiens
ggatgatccagggatt

SEQ ID NO: 3535362 - DNA, 21 bp, Homo sapiens
ggatttgaaccaggccttctg

SEQ ID NO: 3535363 - DNA, 19 bp, Homo sapiens
ggcaaccactaagaattca

SEQ ID NO: 3535364 - DNA, 15 bp, Homo sapiens
ggcaggaggtgggtg

SEQ ID NO: 3535365 - DNA, 16 bp, Homo sapiens
ggcctctgtgccttct

SEQ ID NO: 3535366 - DNA, 14 bp, Homo sapiens
ggcctgcacagtga

SEQ ID NO: 3535367 - DNA, 16 bp, Homo sapiens
ggcgtcctggtgagga

SEQ ID NO: 3535368 - DNA, 23 bp, Homo sapiens
ggcgtcctggtgaggacaaggta

SEQ ID NO: 3535369 - DNA, 21 bp, Homo sapiens
gggacccaatgtaggagctgc

SEQ ID NO: 3535370 - DNA, 21 bp, Homo sapiens
gggagcctttggttctggcca

SEQ ID NO: 3535371 - DNA, 18 bp, Homo sapiens
gggatggccgatggggcc

SEQ ID NO: 3535372 - DNA, 22 bp, Homo sapiens
gggcaagtcccttgacctttcc

SEQ ID NO: 3535373 - DNA, 17 bp, Homo sapiens
gggccttgagcatctgg

SEQ ID NO: 3535374 - DNA, 17 bp, Homo sapiens
gggctgtgggtggggaa

SEQ ID NO: 3535375 - DNA, 22 bp, Homo sapiens
ggggcttagggtcggaacccaa

SEQ ID NO: 3535376 - DNA, 15 bp, Homo sapiens
ggtcggaacccaagc

SEQ ID NO: 3535377 - DNA, 15 bp, Homo sapiens
ggttcctttgttccc

SEQ ID NO: 3535378 - DNA, 20 bp, Homo sapiens
ggttcctttgttccctaagt

SEQ ID NO: 3535379 - DNA, 12 bp, Homo sapiens
gtaacaagaaaa

SEQ ID NO: 3535380 - DNA, 14 bp, Homo sapiens
gtaacaagaaaaca

SEQ ID NO: 3535381 - DNA, 15 bp, Homo sapiens
gtacccaaggtcaca

SEQ ID NO: 3535382 - DNA, 18 bp, Homo sapiens
gtagccccctggcctctg

SEQ ID NO: 3535383 - DNA, 23 bp, Homo sapiens
gtagccccctggcctctgtgcct

SEQ ID NO: 3535384 - DNA, 22 bp, Homo sapiens
gtagcctggcttttctggctgg

SEQ ID NO: 3535385 - DNA, 14 bp, Homo sapiens
gtcactcattgctg

SEQ ID NO: 3535386 - DNA, 18 bp, Homo sapiens
gtcactcattgctgagcc

SEQ ID NO: 3535387 - DNA, 19 bp, Homo sapiens
gtcactcattgctgagcct

SEQ ID NO: 3535388 - DNA, 22 bp, Homo sapiens
gtcactcattgctgagcctctg

SEQ ID NO: 3535389 - DNA, 15 bp, Homo sapiens
gtcatgcgtccactt

SEQ ID NO: 3535390 - DNA, 15 bp, Homo sapiens
gtccactttcccttc

SEQ ID NO: 3535391 - DNA, 16 bp, Homo sapiens
gtcctctgtcagtcat

SEQ ID NO: 3535392 - DNA, 21 bp, Homo sapiens
gtctaaacaatgctgatttgg

SEQ ID NO: 3535393 - DNA, 15 bp, Homo sapiens
gtgaaaacggagctg

SEQ ID NO: 3535394 - DNA, 18 bp, Homo sapiens
gtgactcctcccttcccc

SEQ ID NO: 3535395 - DNA, 16 bp, Homo sapiens
gtgagcgggtggggtg

SEQ ID NO: 3535396 - DNA, 18 bp, Homo sapiens
gtggaccttaggccttcc

SEQ ID NO: 3535397 - DNA, 15 bp, Homo sapiens
gtggcaagaccaaaa

SEQ ID NO: 3535398 - DNA, 15 bp, Homo sapiens
gttaaagctgccggc

SEQ ID NO: 3535399 - DNA, 19 bp, Homo sapiens
gttactgaggaccaaagat

SEQ ID NO: 3535400 - DNA, 12 bp, Homo sapiens
gttcacattttt

SEQ ID NO: 3535401 - DNA, 12 bp, Homo sapiens
gttcatcagtgt

SEQ ID NO: 3535402 - DNA, 14 bp, Homo sapiens
gttcatcagtgtta

SEQ ID NO: 3535403 - DNA, 19 bp, Homo sapiens
gttcatgggcacctcatgg

SEQ ID NO: 3535404 - DNA, 17 bp, Homo sapiens
gttcccatgtagccccc

SEQ ID NO: 3535405 - DNA, 18 bp, Homo sapiens
gttcccatgtagccccct

SEQ ID NO: 3535406 - DNA, 19 bp, Homo sapiens
gttcccatgtagccccctg

SEQ ID NO: 3535407 - DNA, 15 bp, Homo sapiens
gttcctttgttccct

SEQ ID NO: 3535408 - DNA, 17 bp, Homo sapiens
gttctgtttgttaaaac

SEQ ID NO: 3535409 - DNA, 18 bp, Homo sapiens
gttgcacagtccctcctg

SEQ ID NO: 3535410 - DNA, 14 bp, Homo sapiens
gtttatttcttaaa

SEQ ID NO: 3535411 - DNA, 20 bp, Homo sapiens
gtttgtgttctgtttgttaa

SEQ ID NO: 3535412 - DNA, 22 bp, Homo sapiens
gtttgtgttctgtttgttaaaa

SEQ ID NO: 3535413 - DNA, 14 bp, Homo sapiens
gtttgttaaaactg

SEQ ID NO: 3535414 - DNA, 21 bp, Homo sapiens
gttttttaaaatatttatctg

SEQ ID NO: 3535415 - DNA, 16 bp, Homo sapiens
taaaactggcatctga

SEQ ID NO: 3535416 - DNA, 15 bp, Homo sapiens
taaaatatttatctg

SEQ ID NO: 3535417 - DNA, 15 bp, Homo sapiens
taaaggttcctttgt

SEQ ID NO: 3535418 - DNA, 17 bp, Homo sapiens
taaagtttgcttagaaa

SEQ ID NO: 3535419 - DNA, 22 bp, Homo sapiens
taaatattttttcttttctatt

SEQ ID NO: 3535420 - DNA, 23 bp, Homo sapiens
taactatagtccagctttgttct

SEQ ID NO: 3535421 - DNA, 18 bp, Homo sapiens
taagaattcaaactgggg

SEQ ID NO: 3535422 - DNA, 21 bp, Homo sapiens
taagatatgggacatttttga

SEQ ID NO: 3535423 - DNA, 14 bp, Homo sapiens
taagatatttttca

SEQ ID NO: 3535424 - DNA, 18 bp, Homo sapiens
taagatatttttcatgat

SEQ ID NO: 3535425 - DNA, 19 bp, Homo sapiens
taagatatttttcatgatt

SEQ ID NO: 3535426 - DNA, 19 bp, Homo sapiens
taaggatggagccagctct

SEQ ID NO: 3535427 - DNA, 16 bp, Homo sapiens
taagtccaactactaa

SEQ ID NO: 3535428 - DNA, 17 bp, Homo sapiens
taagtttatttcttaaa

SEQ ID NO: 3535429 - DNA, 22 bp, Homo sapiens
taatcattcttatttcatgaaa

SEQ ID NO: 3535430 - DNA, 13 bp, Homo sapiens
taatgtgatatta

SEQ ID NO: 3535431 - DNA, 19 bp, Homo sapiens
taatgtgtattacaaatat

SEQ ID NO: 3535432 - DNA, 16 bp, Homo sapiens
taccccctccttcaga

SEQ ID NO: 3535433 - DNA, 17 bp, Homo sapiens
taccccctccttcagac

SEQ ID NO: 3535434 - DNA, 16 bp, Homo sapiens
taccttgagaccctct

SEQ ID NO: 3535435 - DNA, 21 bp, Homo sapiens
taccttgagaccctcttctct

SEQ ID NO: 3535436 - DNA, 22 bp, Homo sapiens
taccttgagaccctcttctctg

SEQ ID NO: 3535437 - DNA, 22 bp, Homo sapiens
tactagttcagacactttggaa

SEQ ID NO: 3535438 - DNA, 22 bp, Homo sapiens
tactattcagtggcgagaaata

SEQ ID NO: 3535439 - DNA, 14 bp, Homo sapiens
tacttgacctccta

SEQ ID NO: 3535440 - DNA, 17 bp, Homo sapiens
tagaccctcccccacca

SEQ ID NO: 3535441 - DNA, 18 bp, Homo sapiens
tagaccctcccccaccat

SEQ ID NO: 3535442 - DNA, 19 bp, Homo sapiens
tagatatccacttgagaca

SEQ ID NO: 3535443 - DNA, 22 bp, Homo sapiens
tagatgctctatgtgcttgtaa

SEQ ID NO: 3535444 - DNA, 19 bp, Homo sapiens
tagctgggatttgaactga

SEQ ID NO: 3535445 - DNA, 21 bp, Homo sapiens
taggtcttaatacacacagtt

SEQ ID NO: 3535446 - DNA, 16 bp, Homo sapiens
tatatttcctcttctg

SEQ ID NO: 3535447 - DNA, 18 bp, Homo sapiens
tatcgcttcatgtaacta

SEQ ID NO: 3535448 - DNA, 22 bp, Homo sapiens
tatgttttgacatttttagttt

SEQ ID NO: 3535449 - DNA, 19 bp, Homo sapiens
tattcagctttagtagata

SEQ ID NO: 3535450 - DNA, 21 bp, Homo sapiens
tattcatattttctttcaaaa

SEQ ID NO: 3535451 - DNA, 22 bp, Homo sapiens
tattcctgtggatgtaaagtga

SEQ ID NO: 3535452 - DNA, 14 bp, Homo sapiens
tattctacatttca

SEQ ID NO: 3535453 - DNA, 10 bp, Homo sapiens
tattctagtc

SEQ ID NO: 3535454 - DNA, 15 bp, Homo sapiens
tatttatctgattaa

SEQ ID NO: 3535455 - DNA, 23 bp, Homo sapiens
tcaaactggggcctccagaactc

SEQ ID NO: 3535456 - DNA, 19 bp, Homo sapiens
tcaaactggggcctccctg

SEQ ID NO: 3535457 - DNA, 20 bp, Homo sapiens
tcaacctgaattaaagtcta

SEQ ID NO: 3535458 - DNA, 13 bp, Homo sapiens
tcactcattgctg

SEQ ID NO: 3535459 - DNA, 18 bp, Homo sapiens
tcactcattgctgagcct

SEQ ID NO: 3535460 - DNA, 20 bp, Homo sapiens
tcactcattgctgagcctct

SEQ ID NO: 3535461 - DNA, 22 bp, Homo sapiens
tcactggggatcccgtgctgga

SEQ ID NO: 3535462 - DNA, 15 bp, Homo sapiens
tcaggtattaagaaa

SEQ ID NO: 3535463 - DNA, 17 bp, Homo sapiens
tcagtggcgagaaataa

SEQ ID NO: 3535464 - DNA, 16 bp, Homo sapiens
tcagtgttaaaaaatt

SEQ ID NO: 3535465 - DNA, 21 bp, Homo sapiens
tcataagatatttttcatgat

SEQ ID NO: 3535466 - DNA, 18 bp, Homo sapiens
tcatattttctttcaaaa

SEQ ID NO: 3535467 - DNA, 21 bp, Homo sapiens
tcatgattttgaaatcatgaa

SEQ ID NO: 3535468 - DNA, 14 bp, Homo sapiens
tccaaccttcccaa

SEQ ID NO: 3535469 - DNA, 16 bp, Homo sapiens
tccaaggaaaagcaga

SEQ ID NO: 3535470 - DNA, 15 bp, Homo sapiens
tccacatccccacct

SEQ ID NO: 3535471 - DNA, 14 bp, Homo sapiens
tccagacttccttg

SEQ ID NO: 3535472 - DNA, 19 bp, Homo sapiens
tccagacttccttgagaca

SEQ ID NO: 3535473 - DNA, 20 bp, Homo sapiens
tccagacttccttgagacac

SEQ ID NO: 3535474 - DNA, 19 bp, Homo sapiens
tccagatgtttccagactt

SEQ ID NO: 3535475 - DNA, 15 bp, Homo sapiens
tccaggatcctcctg

SEQ ID NO: 3535476 - DNA, 19 bp, Homo sapiens
tccaggatcctcctggagc

SEQ ID NO: 3535477 - DNA, 15 bp, Homo sapiens
tcccacctgtcaacc

SEQ ID NO: 3535478 - DNA, 14 bp, Homo sapiens
tcccagcccctacc

SEQ ID NO: 3535479 - DNA, 15 bp, Homo sapiens
tcccatgtagccccc

SEQ ID NO: 3535480 - DNA, 22 bp, Homo sapiens
tcccatgtagccccctggcctc

SEQ ID NO: 3535481 - DNA, 16 bp, Homo sapiens
tccccactctgctccc

SEQ ID NO: 3535482 - DNA, 19 bp, Homo sapiens
tccccactctgctcccagc

SEQ ID NO: 3535483 - DNA, 20 bp, Homo sapiens
tccccactctgctcccagcc

SEQ ID NO: 3535484 - DNA, 15 bp, Homo sapiens
tccccatggagccag

SEQ ID NO: 3535485 - DNA, 15 bp, Homo sapiens
tcccgtgctggaaga

SEQ ID NO: 3535486 - DNA, 13 bp, Homo sapiens
tccctctatttat

SEQ ID NO: 3535487 - DNA, 15 bp, Homo sapiens
tccctcttcccagca

SEQ ID NO: 3535488 - DNA, 15 bp, Homo sapiens
tccgagctctgtcct

SEQ ID NO: 3535489 - DNA, 13 bp, Homo sapiens
tcctcccttcccc

SEQ ID NO: 3535490 - DNA, 16 bp, Homo sapiens
tcctgaaagacaatat

SEQ ID NO: 3535491 - DNA, 18 bp, Homo sapiens
tcctggagcagcagctga

SEQ ID NO: 3535492 - DNA, 13 bp, Homo sapiens
tcctggtagaata

SEQ ID NO: 3535493 - DNA, 12 bp, Homo sapiens
tccttcagacac

SEQ ID NO: 3535494 - DNA, 18 bp, Homo sapiens
tcctttgttccctaagtc

SEQ ID NO: 3535495 - DNA, 20 bp, Homo sapiens
tcctttgttccctaagtcca

SEQ ID NO: 3535496 - DNA, 19 bp, Homo sapiens
tcgctttcttgctgtccaa

SEQ ID NO: 3535497 - DNA, 20 bp, Homo sapiens
tcggaacccaagcttagaac

SEQ ID NO: 3535498 - DNA, 20 bp, Homo sapiens
tctaaacaatgctgatttgg

SEQ ID NO: 3535499 - DNA, 21 bp, Homo sapiens
tctaaactggattcacagctc

SEQ ID NO: 3535500 - DNA, 23 bp, Homo sapiens
tctacatttcacctactttgtaa

SEQ ID NO: 3535501 - DNA, 22 bp, Homo sapiens
tctagtttaattaatctgtaat

SEQ ID NO: 3535502 - DNA, 13 bp, Homo sapiens
tctgacacaaaaa

SEQ ID NO: 3535503 - DNA, 14 bp, Homo sapiens
tctgcctaataaaa

SEQ ID NO: 3535504 - DNA, 16 bp, Homo sapiens
tctgctccccagggga

SEQ ID NO: 3535505 - DNA, 19 bp, Homo sapiens
tctgggctgtctattctag

SEQ ID NO: 3535506 - DNA, 19 bp, Homo sapiens
tctgtgagattcattcatg

SEQ ID NO: 3535507 - DNA, 20 bp, Homo sapiens
tctgttccccatggccactt

SEQ ID NO: 3535508 - DNA, 12 bp, Homo sapiens
tctgtttgttaa

SEQ ID NO: 3535509 - DNA, 14 bp, Homo sapiens
tctgtttgttaaaa

SEQ ID NO: 3535510 - DNA, 21 bp, Homo sapiens
tctgtttgttaaaactggcat

SEQ ID NO: 3535511 - DNA, 18 bp, Homo sapiens
tcttcccacctgtcaacc

SEQ ID NO: 3535512 - DNA, 13 bp, Homo sapiens
tcttctggctcaa

SEQ ID NO: 3535513 - DNA, 15 bp, Homo sapiens
tcttcttttgtgaag

SEQ ID NO: 3535514 - DNA, 20 bp, Homo sapiens
tctttaacttaattgctatg

SEQ ID NO: 3535515 - DNA, 16 bp, Homo sapiens
tcttttgattatgttt

SEQ ID NO: 3535516 - DNA, 17 bp, Homo sapiens
tgaaccaggccttctga

SEQ ID NO: 3535517 - DNA, 20 bp, Homo sapiens
tgaacgtacccaaggtcaca

SEQ ID NO: 3535518 - DNA, 19 bp, Homo sapiens
tgaaggccttattctacat

SEQ ID NO: 3535519 - DNA, 21 bp, Homo sapiens
tgaagggccttgagcatctgg

SEQ ID NO: 3535520 - DNA, 18 bp, Homo sapiens
tgaagtacccgttcacat

SEQ ID NO: 3535521 - DNA, 19 bp, Homo sapiens
tgacacaagtggaccttag

SEQ ID NO: 3535522 - DNA, 14 bp, Homo sapiens
tgacatctggaatc

SEQ ID NO: 3535523 - DNA, 22 bp, Homo sapiens
tgacctccatgactgcacagta

SEQ ID NO: 3535524 - DNA, 21 bp, Homo sapiens
tgagaaagtcttatttattca

SEQ ID NO: 3535525 - DNA, 22 bp, Homo sapiens
tgagacacggagcccagccctc

SEQ ID NO: 3535526 - DNA, 14 bp, Homo sapiens
tgagaccctcttct

SEQ ID NO: 3535527 - DNA, 20 bp, Homo sapiens
tgagaccctcttctctgggc

SEQ ID NO: 3535528 - DNA, 22 bp, Homo sapiens
tgagaccctcttctctgggccc

SEQ ID NO: 3535529 - DNA, 13 bp, Homo sapiens
tgagagaaaataa

SEQ ID NO: 3535530 - DNA, 15 bp, Homo sapiens
tgagagagacaagaa

SEQ ID NO: 3535531 - DNA, 17 bp, Homo sapiens
tgagccgtgcagctggg

SEQ ID NO: 3535532 - DNA, 19 bp, Homo sapiens
tgaggaaagcatgtattca

SEQ ID NO: 3535533 - DNA, 23 bp, Homo sapiens
tgaggccccagggctgtgggtgg

SEQ ID NO: 3535534 - DNA, 16 bp, Homo sapiens
tgataatacccacatt

SEQ ID NO: 3535535 - DNA, 18 bp, Homo sapiens
tgataatgatgatgacga

SEQ ID NO: 3535536 - DNA, 19 bp, Homo sapiens
tgatatttccccatggttt

SEQ ID NO: 3535537 - DNA, 14 bp, Homo sapiens
tgatccagggattg

SEQ ID NO: 3535538 - DNA, 18 bp, Homo sapiens
tgatcggagcctcctctc

SEQ ID NO: 3535539 - DNA, 17 bp, Homo sapiens
tgatctagagccagtta

SEQ ID NO: 3535540 - DNA, 15 bp, Homo sapiens
tgattttgaaaccat

SEQ ID NO: 3535541 - DNA, 17 bp, Homo sapiens
tgcacagtccctcctgt

SEQ ID NO: 3535542 - DNA, 21 bp, Homo sapiens
tgcacttgtgattatttatta

SEQ ID NO: 3535543 - DNA, 19 bp, Homo sapiens
tgcagctgagagaaaataa

SEQ ID NO: 3535544 - DNA, 15 bp, Homo sapiens
tgcagtatgaaaata

SEQ ID NO: 3535545 - DNA, 20 bp, Homo sapiens
tgccatgtagggttccctta

SEQ ID NO: 3535546 - DNA, 16 bp, Homo sapiens
tgccttcttttgatta

SEQ ID NO: 3535547 - DNA, 19 bp, Homo sapiens
tgccttggctcagacatgt

SEQ ID NO: 3535548 - DNA, 11 bp, Homo sapiens
tgctcccagcc

SEQ ID NO: 3535549 - DNA, 23 bp, Homo sapiens
tgctcccagcccctaccttgaga

SEQ ID NO: 3535550 - DNA, 16 bp, Homo sapiens
tgctgagcctctgctc

SEQ ID NO: 3535551 - DNA, 21 bp, Homo sapiens
tgcttgtaacaagaaaacata

SEQ ID NO: 3535552 - DNA, 22 bp, Homo sapiens
tggaagacttagatctgagccc

SEQ ID NO: 3535553 - DNA, 20 bp, Homo sapiens
tggactccaggatcctcctg

SEQ ID NO: 3535554 - DNA, 22 bp, Homo sapiens
tggactccaggatcctcctgga

SEQ ID NO: 3535555 - DNA, 18 bp, Homo sapiens
tggagaccagggagcctt

SEQ ID NO: 3535556 - DNA, 19 bp, Homo sapiens
tggagaccagggagccttt

SEQ ID NO: 3535557 - DNA, 18 bp, Homo sapiens
tggctcagacatgttttc

SEQ ID NO: 3535558 - DNA, 18 bp, Homo sapiens
tggggcctacagctttga

SEQ ID NO: 3535559 - DNA, 20 bp, Homo sapiens
tggggcctccagaactcact

SEQ ID NO: 3535560 - DNA, 18 bp, Homo sapiens
tgggtgagcgggtggggt

SEQ ID NO: 3535561 - DNA, 16 bp, Homo sapiens
tggttcatcagtgtta

SEQ ID NO: 3535562 - DNA, 18 bp, Homo sapiens
tggttcatcagtgttaaa

SEQ ID NO: 3535563 - DNA, 23 bp, Homo sapiens
tggttcatcagtgttaaaaaatt

SEQ ID NO: 3535564 - DNA, 19 bp, Homo sapiens
tgtaactatagtccagctt

SEQ ID NO: 3535565 - DNA, 16 bp, Homo sapiens
tgtaagctgaaaatat

SEQ ID NO: 3535566 - DNA, 18 bp, Homo sapiens
tgtaagtgagagagacaa

SEQ ID NO: 3535567 - DNA, 19 bp, Homo sapiens
tgtagccccctggcctctg

SEQ ID NO: 3535568 - DNA, 20 bp, Homo sapiens
tgtagccccctggcctctgt

SEQ ID NO: 3535569 - DNA, 19 bp, Homo sapiens
tgtcaacctgaattaaagt

SEQ ID NO: 3535570 - DNA, 21 bp, Homo sapiens
tgtcactcattgctgagcctc

SEQ ID NO: 3535571 - DNA, 23 bp, Homo sapiens
tgtcactcattgctgagcctctg

SEQ ID NO: 3535572 - DNA, 13 bp, Homo sapiens
tgtgggtggggaa

SEQ ID NO: 3535573 - DNA, 11 bp, Homo sapiens
tgtgtggcctg

SEQ ID NO: 3535574 - DNA, 18 bp, Homo sapiens
tgttaaaaaatttttgaa

SEQ ID NO: 3535575 - DNA, 15 bp, Homo sapiens
tgttctgtttgttaa

SEQ ID NO: 3535576 - DNA, 17 bp, Homo sapiens
tgtttgttaaaactggc

SEQ ID NO: 3535577 - DNA, 16 bp, Homo sapiens
ttaaaaaatttttgaa

SEQ ID NO: 3535578 - DNA, 17 bp, Homo sapiens
ttaaaaaatttttgaaa

SEQ ID NO: 3535579 - DNA, 17 bp, Homo sapiens
ttaaagtctacactgcc

SEQ ID NO: 3535580 - DNA, 18 bp, Homo sapiens
ttaacacctttaaagtgt

SEQ ID NO: 3535581 - DNA, 16 bp, Homo sapiens
ttaatctgtatttccc

SEQ ID NO: 3535582 - DNA, 20 bp, Homo sapiens
ttacagatgaatgtatttat

SEQ ID NO: 3535583 - DNA, 16 bp, Homo sapiens
ttaggccttcctctct

SEQ ID NO: 3535584 - DNA, 15 bp, Homo sapiens
ttatagttgtaacta

SEQ ID NO: 3535585 - DNA, 15 bp, Homo sapiens
ttatttacagatgaa

SEQ ID NO: 3535586 - DNA, 21 bp, Homo sapiens
ttcaaactggggcctccagaa

SEQ ID NO: 3535587 - DNA, 19 bp, Homo sapiens
ttcaggaatgtgtggcctg

SEQ ID NO: 3535588 - DNA, 17 bp, Homo sapiens
ttcatgattttgaaatc

SEQ ID NO: 3535589 - DNA, 13 bp, Homo sapiens
ttccacatcccca

SEQ ID NO: 3535590 - DNA, 16 bp, Homo sapiens
ttccacatccccacct

SEQ ID NO: 3535591 - DNA, 16 bp, Homo sapiens
ttcccagcacaggcag

SEQ ID NO: 3535592 - DNA, 23 bp, Homo sapiens
ttccccatggttttaatctgtat

SEQ ID NO: 3535593 - DNA, 13 bp, Homo sapiens
ttcctaagtgatt

SEQ ID NO: 3535594 - DNA, 14 bp, Homo sapiens
ttcctctctccaga

SEQ ID NO: 3535595 - DNA, 13 bp, Homo sapiens
ttcctttgttccc

SEQ ID NO: 3535596 - DNA, 19 bp, Homo sapiens
ttctatagcagtcatcatt

SEQ ID NO: 3535597 - DNA, 12 bp, Homo sapiens
ttctattaaagg

SEQ ID NO: 3535598 - DNA, 15 bp, Homo sapiens
ttctattgttgtaca

SEQ ID NO: 3535599 - DNA, 17 bp, Homo sapiens
ttcttaaagtcaagatt

SEQ ID NO: 3535600 - DNA, 14 bp, Homo sapiens
ttctttaacttaat

SEQ ID NO: 3535601 - DNA, 14 bp, Homo sapiens
ttgatggagatatt

SEQ ID NO: 3535602 - DNA, 17 bp, Homo sapiens
ttgcacagtccctcctg

SEQ ID NO: 3535603 - DNA, 17 bp, Homo sapiens
ttgcacttgtgattatt

SEQ ID NO: 3535604 - DNA, 19 bp, Homo sapiens
ttgccacactttcactggg

SEQ ID NO: 3535605 - DNA, 14 bp, Homo sapiens
ttggctcagacatg

SEQ ID NO: 3535606 - DNA, 20 bp, Homo sapiens
ttggttcatcagtgttaaaa

SEQ ID NO: 3535607 - DNA, 21 bp, Homo sapiens
ttgtaagtgagagagacaaga

SEQ ID NO: 3535608 - DNA, 22 bp, Homo sapiens
ttgtgaagtacccgttcacatt

SEQ ID NO: 3535609 - DNA, 14 bp, Homo sapiens
ttgttaaaactggc

SEQ ID NO: 3535610 - DNA, 16 bp, Homo sapiens
tttaaaatatttatct

SEQ ID NO: 3535611 - DNA, 18 bp, Homo sapiens
tttacatgaattgcattt

SEQ ID NO: 3535612 - DNA, 20 bp, Homo sapiens
tttcacctactttgtaagtg

SEQ ID NO: 3535613 - DNA, 12 bp, Homo sapiens
tttcactgggga

SEQ ID NO: 3535614 - DNA, 13 bp, Homo sapiens
tttcactggggat

SEQ ID NO: 3535615 - DNA, 16 bp, Homo sapiens
tttcatgattttgaaa

SEQ ID NO: 3535616 - DNA, 18 bp, Homo sapiens
tttccagacttccttgag

SEQ ID NO: 3535617 - DNA, 19 bp, Homo sapiens
tttccagacttccttgaga

SEQ ID NO: 3535618 - DNA, 16 bp, Homo sapiens
tttctagattaagata

SEQ ID NO: 3535619 - DNA, 20 bp, Homo sapiens
tttcttactgatttttaagt

SEQ ID NO: 3535620 - DNA, 16 bp, Homo sapiens
tttgcttagaaaagaa

SEQ ID NO: 3535621 - DNA, 19 bp, Homo sapiens
tttgtgttctgtttgttaa

SEQ ID NO: 3535622 - DNA, 22 bp, Homo sapiens
tttgtgtttcagccatgtattt

SEQ ID NO: 3535623 - DNA, 21 bp, Homo sapiens
ttttcatgattttgaaatcat

SEQ ID NO: 3535624 - DNA, 20 bp, Homo sapiens
ttttcctaagtgattgtatg

SEQ ID NO: 3535625 - DNA, 14 bp, Homo sapiens
ttttctggctgggg

SEQ ID NO: 3535626 - DNA, 23 bp, Homo sapiens
ttttgatgaacaaaatttcctaa

SEQ ID NO: 3535627 - DNA, 12 bp, Homo sapiens
ttttgattatgt

SEQ ID NO: 3535628 - DNA, 23 bp, Homo sapiens
agacactttggaagtttgtgttc

SEQ ID NO: 3535629 - DNA, 18 bp, Homo sapiens
agacatgttttccgtgaa

SEQ ID NO: 3535630 - DNA, 16 bp, Homo sapiens
agaccaccacttcgaa

SEQ ID NO: 3535631 - DNA, 12 bp, Homo sapiens
agaccctcttct

SEQ ID NO: 3535632 - DNA, 14 bp, Homo sapiens
agaccctcttctct

SEQ ID NO: 3535633 - DNA, 15 bp, Homo sapiens
agaccctcttctctg

SEQ ID NO: 3535634 - DNA, 13 bp, Homo sapiens
agacttagatctg

SEQ ID NO: 3535635 - DNA, 17 bp, Homo sapiens
agacttagatctgagcc

SEQ ID NO: 3535636 - DNA, 19 bp, Homo sapiens
agacttagatctgagccct

SEQ ID NO: 3535637 - DNA, 16 bp, Homo sapiens
agagaggcgtcctggt

SEQ ID NO: 3535638 - DNA, 12 bp, Homo sapiens
agatctgagccc

SEQ ID NO: 3535639 - DNA, 19 bp, Homo sapiens
agatctgagccctccctct

SEQ ID NO: 3535640 - DNA, 17 bp, Homo sapiens
agatttttcatgatttt

SEQ ID NO: 3535641 - DNA, 14 bp, Homo sapiens
agccccctggcctc

SEQ ID NO: 3535642 - DNA, 20 bp, Homo sapiens
agccctccccatggagccag

SEQ ID NO: 3535643 - DNA, 21 bp, Homo sapiens
agcctatatttcctcttctgt

SEQ ID NO: 3535644 - DNA, 21 bp, Homo sapiens
agcctcaagtcttatttcctc

SEQ ID NO: 3535645 - DNA, 13 bp, Homo sapiens
agcctcctctctc

SEQ ID NO: 3535646 - DNA, 20 bp, Homo sapiens
agccttggttcatcagtgtt

SEQ ID NO: 3535647 - DNA, 11 bp, Homo sapiens
agcgggtgggg

SEQ ID NO: 3535648 - DNA, 23 bp, Homo sapiens
agctgaacaataggctgttccca

SEQ ID NO: 3535649 - DNA, 16 bp, Homo sapiens
agctgagagaaaataa

SEQ ID NO: 3535650 - DNA, 22 bp, Homo sapiens
agctgaggccccagggctgtgg

SEQ ID NO: 3535651 - DNA, 20 bp, Homo sapiens
agctgccttggctcagacat

SEQ ID NO: 3535652 - DNA, 20 bp, Homo sapiens
aggacgaacatccaaccttc

SEQ ID NO: 3535653 - DNA, 21 bp, Homo sapiens
aggagctgccttggctcagac

SEQ ID NO: 3535654 - DNA, 23 bp, Homo sapiens
aggagctgccttggctcagacat

SEQ ID NO: 3535655 - DNA, 18 bp, Homo sapiens
aggatactatattttagg

SEQ ID NO: 3535656 - DNA, 13 bp, Homo sapiens
aggatcctcctgg

SEQ ID NO: 3535657 - DNA, 15 bp, Homo sapiens
aggatcctcctggag

SEQ ID NO: 3535658 - DNA, 17 bp, Homo sapiens
aggcaggaggtgggtga

SEQ ID NO: 3535659 - DNA, 17 bp, Homo sapiens
aggccccagggctgtgg

SEQ ID NO: 3535660 - DNA, 15 bp, Homo sapiens
aggccttcctctctc

SEQ ID NO: 3535661 - DNA, 20 bp, Homo sapiens
aggctgttcccatgtagccc

SEQ ID NO: 3535662 - DNA, 12 bp, Homo sapiens
agggctgtgggt

SEQ ID NO: 3535663 - DNA, 16 bp, Homo sapiens
aggggagttgtgtctg

SEQ ID NO: 3535664 - DNA, 15 bp, Homo sapiens
agggtagcctggctt

SEQ ID NO: 3535665 - DNA, 17 bp, Homo sapiens
aggtccgagctctgtcc

SEQ ID NO: 3535666 - DNA, 20 bp, Homo sapiens
aggtccgagctctgtcctct

SEQ ID NO: 3535667 - DNA, 19 bp, Homo sapiens
agtacccgttcacattttt

SEQ ID NO: 3535668 - DNA, 23 bp, Homo sapiens
agtatgcttgaaaagataaatta

SEQ ID NO: 3535669 - DNA, 23 bp, Homo sapiens
agtcaatgttttcagttctcttg

SEQ ID NO: 3535670 - DNA, 19 bp, Homo sapiens
agtcatgcgtccactttcc

SEQ ID NO: 3535671 - DNA, 21 bp, Homo sapiens
agtcatgcgtccactttccct

SEQ ID NO: 3535672 - DNA, 12 bp, Homo sapiens
agtctacactgc

SEQ ID NO: 3535673 - DNA, 21 bp, Homo sapiens
agtctgtgagattcattcatg

SEQ ID NO: 3535674 - DNA, 18 bp, Homo sapiens
agtgagagagacaagaag

SEQ ID NO: 3535675 - DNA, 19 bp, Homo sapiens
agtggaccttaggccttcc

SEQ ID NO: 3535676 - DNA, 15 bp, Homo sapiens
ataagatatttttca

SEQ ID NO: 3535677 - DNA, 19 bp, Homo sapiens
ataatatattttaaatatt

SEQ ID NO: 3535678 - DNA, 13 bp, Homo sapiens
atacacacagtta

SEQ ID NO: 3535679 - DNA, 22 bp, Homo sapiens
atataaatattagaaacagctt

SEQ ID NO: 3535680 - DNA, 21 bp, Homo sapiens
atatttttcatgattttgaaa

SEQ ID NO: 3535681 - DNA, 17 bp, Homo sapiens
atcataagatatttttc

SEQ ID NO: 3535682 - DNA, 19 bp, Homo sapiens
atcattcttatttcatgaa

SEQ ID NO: 3535683 - DNA, 14 bp, Homo sapiens
atccctttattacc

SEQ ID NO: 3535684 - DNA, 20 bp, Homo sapiens
atcgatttttaaaaattaaa

SEQ ID NO: 3535685 - DNA, 19 bp, Homo sapiens
atctattcctggtagaata

SEQ ID NO: 3535686 - DNA, 23 bp, Homo sapiens
atctgagccctccctcttcccag

SEQ ID NO: 3535687 - DNA, 20 bp, Homo sapiens
atctggagaccagggagcct

SEQ ID NO: 3535688 - DNA, 16 bp, Homo sapiens
atcttaattattgtac

SEQ ID NO: 3535689 - DNA, 17 bp, Homo sapiens
atgaatgtatttatttg

SEQ ID NO: 3535690 - DNA, 18 bp, Homo sapiens
atgacatcaccacagttt

SEQ ID NO: 3535691 - DNA, 21 bp, Homo sapiens
atgatgcttgtaacaagaaaa

SEQ ID NO: 3535692 - DNA, 15 bp, Homo sapiens
atgcgtccactttcc

SEQ ID NO: 3535693 - DNA, 18 bp, Homo sapiens
atgctgcaggacttgaga

SEQ ID NO: 3535694 - DNA, 20 bp, Homo sapiens
atgcttgtaacaagaaaaca

SEQ ID NO: 3535695 - DNA, 23 bp, Homo sapiens
atggagccagctccctctattta

SEQ ID NO: 3535696 - DNA, 21 bp, Homo sapiens
atggagccagctctgcattat

SEQ ID NO: 3535697 - DNA, 14 bp, Homo sapiens
atggggcccacatt

SEQ ID NO: 3535698 - DNA, 23 bp, Homo sapiens
atgtaggagctgccttggctcag

SEQ ID NO: 3535699 - DNA, 21 bp, Homo sapiens
atgtcatgtgtacaaaagttt

SEQ ID NO: 3535700 - DNA, 14 bp, Homo sapiens
atgtttagtaaact

SEQ ID NO: 3535701 - DNA, 15 bp, Homo sapiens
atgtttccagacttc

SEQ ID NO: 3535702 - DNA, 12 bp, Homo sapiens
attaaagtctac

SEQ ID NO: 3535703 - DNA, 22 bp, Homo sapiens
attaaagtctacactgcctttg

SEQ ID NO: 3535704 - DNA, 21 bp, Homo sapiens
attaagatatgggacattttt

SEQ ID NO: 3535705 - DNA, 15 bp, Homo sapiens
attatttatttattt

SEQ ID NO: 3535706 - DNA, 21 bp, Homo sapiens
attcaggaatgtgtggcctgc

SEQ ID NO: 3535707 - DNA, 19 bp, Homo sapiens
attcagtggcgagaaataa

SEQ ID NO: 3535708 - DNA, 16 bp, Homo sapiens
attcatattttctttc

SEQ ID NO: 3535709 - DNA, 23 bp, Homo sapiens
attgatcggagcctcctctctca

SEQ ID NO: 3535710 - DNA, 16 bp, Homo sapiens
attgctgagcctctgc

SEQ ID NO: 3535711 - DNA, 18 bp, Homo sapiens
atttacatgaattgcatt

SEQ ID NO: 3535712 - DNA, 20 bp, Homo sapiens
atttacatgaattgcatttt

SEQ ID NO: 3535713 - DNA, 20 bp, Homo sapiens
atttatgcctctgtatttaa

SEQ ID NO: 3535714 - DNA, 14 bp, Homo sapiens
atttcatgaaaatt

SEQ ID NO: 3535715 - DNA, 14 bp, Homo sapiens
atttctattaaagg

SEQ ID NO: 3535716 - DNA, 15 bp, Homo sapiens
attttgtttaaatta

SEQ ID NO: 3535717 - DNA, 18 bp, Homo sapiens
atttttaatatatactat

SEQ ID NO: 3535718 - DNA, 15 bp, Homo sapiens
caaactggggcctcc

SEQ ID NO: 3535719 - DNA, 14 bp, Homo sapiens
caaagcaataatag

SEQ ID NO: 3535720 - DNA, 17 bp, Homo sapiens
caacctgaattaaagtc

SEQ ID NO: 3535721 - DNA, 19 bp, Homo sapiens
caacctgaattaaagtcta

SEQ ID NO: 3535722 - DNA, 12 bp, Homo sapiens
caagaaaacata

SEQ ID NO: 3535723 - DNA, 11 bp, Homo sapiens
caagaccaaaa

SEQ ID NO: 3535724 - DNA, 19 bp, Homo sapiens
caagaccaccacttcgaaa

SEQ ID NO: 3535725 - DNA, 14 bp, Homo sapiens
caaggatgatccag

SEQ ID NO: 3535726 - DNA, 14 bp, Homo sapiens
caagtcccttgacc

SEQ ID NO: 3535727 - DNA, 16 bp, Homo sapiens
caagtcccttgacctt

SEQ ID NO: 3535728 - DNA, 20 bp, Homo sapiens
caagtcccttgacctttcca

SEQ ID NO: 3535729 - DNA, 22 bp, Homo sapiens
caagtggaccttaggccttcct

SEQ ID NO: 3535730 - DNA, 23 bp, Homo sapiens
caagtggaccttaggccttcctc

SEQ ID NO: 3535731 - DNA, 20 bp, Homo sapiens
caatttctacaaaatcctga

SEQ ID NO: 3535732 - DNA, 22 bp, Homo sapiens
cacaaaaaaagttgaaggcctt

SEQ ID NO: 3535733 - DNA, 13 bp, Homo sapiens
cacagtccctcct

SEQ ID NO: 3535734 - DNA, 15 bp, Homo sapiens
cacagtgaagtgctg

SEQ ID NO: 3535735 - DNA, 17 bp, Homo sapiens
cacatagctgggatttg

SEQ ID NO: 3535736 - DNA, 21 bp, Homo sapiens
caccctggattgatcggagcc

SEQ ID NO: 3535737 - DNA, 19 bp, Homo sapiens
cacctcatggactccagga

SEQ ID NO: 3535738 - DNA, 21 bp, Homo sapiens
cacctcatggactccaggatc

SEQ ID NO: 3535739 - DNA, 14 bp, Homo sapiens
cacctttaaagtgt

SEQ ID NO: 3535740 - DNA, 23 bp, Homo sapiens
cactcattgctgagcctctgctc

SEQ ID NO: 3535741 - DNA, 13 bp, Homo sapiens
cactctgctccca

SEQ ID NO: 3535742 - DNA, 16 bp, Homo sapiens
cacttgggtcttccct

SEQ ID NO: 3535743 - DNA, 17 bp, Homo sapiens
cacttgtgattatttat

SEQ ID NO: 3535744 - DNA, 18 bp, Homo sapiens
cagaactcactggggcct

SEQ ID NO: 3535745 - DNA, 18 bp, Homo sapiens
cagaatgctgcaggactt

SEQ ID NO: 3535746 - DNA, 15 bp, Homo sapiens
cagacaccctcaacc

SEQ ID NO: 3535747 - DNA, 21 bp, Homo sapiens
cagacaccctcaacctcttct

SEQ ID NO: 3535748 - DNA, 19 bp, Homo sapiens
cagacactttggaagtttg

SEQ ID NO: 3535749 - DNA, 12 bp, Homo sapiens
cagacatgtttt

SEQ ID NO: 3535750 - DNA, 22 bp, Homo sapiens
cagagagaggcgtcctggtgag

SEQ ID NO: 3535751 - DNA, 23 bp, Homo sapiens
cagatgaatgtatttatttggga

SEQ ID NO: 3535752 - DNA, 14 bp, Homo sapiens
cagatgtttccaga

SEQ ID NO: 3535753 - DNA, 16 bp, Homo sapiens
cagatgtttccagact

SEQ ID NO: 3535754 - DNA, 22 bp, Homo sapiens
cagcctatatttcctcttctgt

SEQ ID NO: 3535755 - DNA, 23 bp, Homo sapiens
cagctgggatttgaaccaggcct

SEQ ID NO: 3535756 - DNA, 16 bp, Homo sapiens
cagctttgatccctga

SEQ ID NO: 3535757 - DNA, 17 bp, Homo sapiens
cagctttgatccctgac

SEQ ID NO: 3535758 - DNA, 17 bp, Homo sapiens
cagctttttaccaagtt

SEQ ID NO: 3535759 - DNA, 21 bp, Homo sapiens
caggaatgtgtggcctgcaca

SEQ ID NO: 3535760 - DNA, 15 bp, Homo sapiens
caggaggtgggtgag

SEQ ID NO: 3535761 - DNA, 13 bp, Homo sapiens
caggatcctcctg

SEQ ID NO: 3535762 - DNA, 14 bp, Homo sapiens
tccctggtcccttg

SEQ ID NO: 3535763 - DNA, 19 bp, Homo sapiens
tccctggtcccttggagac

SEQ ID NO: 3535764 - DNA, 14 bp, Homo sapiens
tcccttcccctgtg

SEQ ID NO: 3535765 - DNA, 17 bp, Homo sapiens
tcccttgacctttccag

SEQ ID NO: 3535766 - DNA, 18 bp, Homo sapiens
tcccttgacctttccagc

SEQ ID NO: 3535767 - DNA, 18 bp, Homo sapiens
tccgtgaaaacggagctg

SEQ ID NO: 3535768 - DNA, 16 bp, Homo sapiens
tcctaattttgagaaa

SEQ ID NO: 3535769 - DNA, 20 bp, Homo sapiens
tcctacattaattatctagt

SEQ ID NO: 3535770 - DNA, 13 bp, Homo sapiens
tcctagatgctct

SEQ ID NO: 3535771 - DNA, 14 bp, Homo sapiens
tcctaggaaaatac

SEQ ID NO: 3535772 - DNA, 14 bp, Homo sapiens
tcctcccttcccca

SEQ ID NO: 3535773 - DNA, 17 bp, Homo sapiens
tcctcccttccccactc

SEQ ID NO: 3535774 - DNA, 14 bp, Homo sapiens
tcctctctccagat

SEQ ID NO: 3535775 - DNA, 22 bp, Homo sapiens
tcctcttctgtaaaatgggtat

SEQ ID NO: 3535776 - DNA, 14 bp, Homo sapiens
tcctggagcagcag

SEQ ID NO: 3535777 - DNA, 13 bp, Homo sapiens
tccttcagacacc

SEQ ID NO: 3535778 - DNA, 23 bp, Homo sapiens
tccttcagacaccctcaacctct

SEQ ID NO: 3535779 - DNA, 23 bp, Homo sapiens
tccttgagacacggagcccagcc

SEQ ID NO: 3535780 - DNA, 12 bp, Homo sapiens
tcctttgttccc

SEQ ID NO: 3535781 - DNA, 16 bp, Homo sapiens
tcgcttcatgtaacta

SEQ ID NO: 3535782 - DNA, 18 bp, Homo sapiens
tcgtctgtttataaacat

SEQ ID NO: 3535783 - DNA, 22 bp, Homo sapiens
tctattgttgtacacagaaata

SEQ ID NO: 3535784 - DNA, 23 bp, Homo sapiens
tctattgttgtacacagaaatac

SEQ ID NO: 3535785 - DNA, 15 bp, Homo sapiens
tctatttatgtttgc

SEQ ID NO: 3535786 - DNA, 14 bp, Homo sapiens
tctccagatgtttc

SEQ ID NO: 3535787 - DNA, 19 bp, Homo sapiens
tctccagatgtttccagac

SEQ ID NO: 3535788 - DNA, 13 bp, Homo sapiens
tctctccagatgt

SEQ ID NO: 3535789 - DNA, 16 bp, Homo sapiens
tctctccagatgtttc

SEQ ID NO: 3535790 - DNA, 16 bp, Homo sapiens
tctctgggcccagaga

SEQ ID NO: 3535791 - DNA, 12 bp, Homo sapiens
tctcttgatttt

SEQ ID NO: 3535792 - DNA, 24 bp, Homo sapiens
tctgagccctccctcttcccagca

SEQ ID NO: 3535793 - DNA, 13 bp, Homo sapiens
tctgctcccagcc

SEQ ID NO: 3535794 - DNA, 14 bp, Homo sapiens
tctgctcccagccc

SEQ ID NO: 3535795 - DNA, 15 bp, Homo sapiens
tctgctcccagcccc

SEQ ID NO: 3535796 - DNA, 15 bp, Homo sapiens
tctggagaccaggga

SEQ ID NO: 3535797 - DNA, 13 bp, Homo sapiens
tctgtcacttaat

SEQ ID NO: 3535798 - DNA, 13 bp, Homo sapiens
tctgtcagtcatg

SEQ ID NO: 3535799 - DNA, 13 bp, Homo sapiens
tctgtcctctgtc

SEQ ID NO: 3535800 - DNA, 17 bp, Homo sapiens
tctgtgagattcattca

SEQ ID NO: 3535801 - DNA, 18 bp, Homo sapiens
tctgtgccttcttttgat

SEQ ID NO: 3535802 - DNA, 13 bp, Homo sapiens
tctgtttgttaaa

SEQ ID NO: 3535803 - DNA, 18 bp, Homo sapiens
tcttatttcatgaaaatt

SEQ ID NO: 3535804 - DNA, 15 bp, Homo sapiens
tcttctctgggccca

SEQ ID NO: 3535805 - DNA, 21 bp, Homo sapiens
tcttctggctcaaaaagagaa

SEQ ID NO: 3535806 - DNA, 16 bp, Homo sapiens
tgaaaagataaattat

SEQ ID NO: 3535807 - DNA, 21 bp, Homo sapiens
tgaactgagccgtgcagctgg

SEQ ID NO: 3535808 - DNA, 15 bp, Homo sapiens
tgaagagatttttca

SEQ ID NO: 3535809 - DNA, 23 bp, Homo sapiens
tgaagtacccgttcacatttttg

SEQ ID NO: 3535810 - DNA, 11 bp, Homo sapiens
tgaatgtattt

SEQ ID NO: 3535811 - DNA, 17 bp, Homo sapiens
tgaatgtatttatttgg

SEQ ID NO: 3535812 - DNA, 23 bp, Homo sapiens
tgaatgtatttatttgggagacc

SEQ ID NO: 3535813 - DNA, 12 bp, Homo sapiens
tgaattaaagtc

SEQ ID NO: 3535814 - DNA, 21 bp, Homo sapiens
tgactcctcccttccccactc

SEQ ID NO: 3535815 - DNA, 17 bp, Homo sapiens
tgagacacggagcccag

SEQ ID NO: 3535816 - DNA, 18 bp, Homo sapiens
tgagaccctcttctctgg

SEQ ID NO: 3535817 - DNA, 14 bp, Homo sapiens
tgagagagacaaga

SEQ ID NO: 3535818 - DNA, 22 bp, Homo sapiens
tgagataatgtgatattataca

SEQ ID NO: 3535819 - DNA, 22 bp, Homo sapiens
tgagcgggtggggtgcttgctg

SEQ ID NO: 3535820 - DNA, 21 bp, Homo sapiens
tgaggccccagggctgtgggt

SEQ ID NO: 3535821 - DNA, 14 bp, Homo sapiens
tgataatacccaca

SEQ ID NO: 3535822 - DNA, 14 bp, Homo sapiens
tgatgataatgatg

SEQ ID NO: 3535823 - DNA, 21 bp, Homo sapiens
tgatgcttgtaacaagaaaac

SEQ ID NO: 3535824 - DNA, 22 bp, Homo sapiens
tgatgcttgtaacaagaaaaca

SEQ ID NO: 3535825 - DNA, 16 bp, Homo sapiens
tgattatttattattt

SEQ ID NO: 3535826 - DNA, 13 bp, Homo sapiens
tgatttggtgacc

SEQ ID NO: 3535827 - DNA, 19 bp, Homo sapiens
tgatttggtgaccaactgt

SEQ ID NO: 3535828 - DNA, 20 bp, Homo sapiens
tgatttggtgaccaactgtc

SEQ ID NO: 3535829 - DNA, 16 bp, Homo sapiens
tgattttaataatata

SEQ ID NO: 3535830 - DNA, 15 bp, Homo sapiens
tgattttgaaatcat

SEQ ID NO: 3535831 - DNA, 17 bp, Homo sapiens
tgcacttgtgattattt

SEQ ID NO: 3535832 - DNA, 18 bp, Homo sapiens
tgcaggacttgagaagac

SEQ ID NO: 3535833 - DNA, 13 bp, Homo sapiens
tgccacactttca

SEQ ID NO: 3535834 - DNA, 20 bp, Homo sapiens
tgccacactttcactgggga

SEQ ID NO: 3535835 - DNA, 16 bp, Homo sapiens
tgccttggctcagaca

SEQ ID NO: 3535836 - DNA, 17 bp, Homo sapiens
tgccttggctcagacat

SEQ ID NO: 3535837 - DNA, 15 bp, Homo sapiens
tgcgtccactttccc

SEQ ID NO: 3535838 - DNA, 21 bp, Homo sapiens
tgcgtccactttcccttcccc

SEQ ID NO: 3535839 - DNA, 20 bp, Homo sapiens
tgctctatgtgcttgtaaaa

SEQ ID NO: 3535840 - DNA, 14 bp, Homo sapiens
tgctgagcctctgc

SEQ ID NO: 3535841 - DNA, 17 bp, Homo sapiens
tgctgagcctctgctcc

SEQ ID NO: 3535842 - DNA, 18 bp, Homo sapiens
tgctgatttggtgaccaa

SEQ ID NO: 3535843 - DNA, 21 bp, Homo sapiens
tgctgcaggacttgagaagac

SEQ ID NO: 3535844 - DNA, 12 bp, Homo sapiens
tgctgtccaatt

SEQ ID NO: 3535845 - DNA, 18 bp, Homo sapiens
tgcttgctgtgtgacctt

SEQ ID NO: 3535846 - DNA, 16 bp, Homo sapiens
tggaagtttgtgttct

SEQ ID NO: 3535847 - DNA, 23 bp, Homo sapiens
tggaagtttgtgttctgtttgtt

SEQ ID NO: 3535848 - DNA, 17 bp, Homo sapiens
tggaccttaggccttcc

SEQ ID NO: 3535849 - DNA, 19 bp, Homo sapiens
tggaccttaggccttcctc

SEQ ID NO: 3535850 - DNA, 18 bp, Homo sapiens
tggagcagcagctgaggc

SEQ ID NO: 3535851 - DNA, 18 bp, Homo sapiens
tggattctgcctaataaa

SEQ ID NO: 3535852 - DNA, 15 bp, Homo sapiens
tggccgatggggccc

SEQ ID NO: 3535853 - DNA, 12 bp, Homo sapiens
tggctggggatg

SEQ ID NO: 3535854 - DNA, 19 bp, Homo sapiens
tggcttttctggctgggga

SEQ ID NO: 3535855 - DNA, 13 bp, Homo sapiens
tgggcaagtccct

SEQ ID NO: 3535856 - DNA, 16 bp, Homo sapiens
tgggcaagtcccttga

SEQ ID NO: 3535857 - DNA, 14 bp, Homo sapiens
tggggtgcttgctg

SEQ ID NO: 3535858 - DNA, 17 bp, Homo sapiens
tgtacagttatttatgc

SEQ ID NO: 3535859 - DNA, 18 bp, Homo sapiens
tgtagccccctggcctct

SEQ ID NO: 3535860 - DNA, 12 bp, Homo sapiens
tgtaggagctgc

SEQ ID NO: 3535861 - DNA, 20 bp, Homo sapiens
tgtcaacctgaattaaagtc

SEQ ID NO: 3535862 - DNA, 21 bp, Homo sapiens
tgtcaacctgaattaaagtct

SEQ ID NO: 3535863 - DNA, 23 bp, Homo sapiens
tgtcaacctgaattaaagtctac

SEQ ID NO: 3535864 - DNA, 20 bp, Homo sapiens
tgtctaaacaatgctgattt

SEQ ID NO: 3535865 - DNA, 21 bp, Homo sapiens
tgtctaaacaatgctgatttg

SEQ ID NO: 3535866 - DNA, 22 bp, Homo sapiens
tgtctaaacaatgctgatttgg

SEQ ID NO: 3535867 - DNA, 17 bp, Homo sapiens
tgtgactcctcccttcc

SEQ ID NO: 3535868 - DNA, 22 bp, Homo sapiens
tgtgactcctcccttccccact

SEQ ID NO: 3535869 - DNA, 19 bp, Homo sapiens
tgtgttctgtttgttaaaa

SEQ ID NO: 3535870 - DNA, 21 bp, Homo sapiens
tgtgttctgtttgttaaaact

SEQ ID NO: 3535871 - DNA, 15 bp, Homo sapiens
tgttgcacagtccct

SEQ ID NO: 3535872 - DNA, 20 bp, Homo sapiens
tgttgcacagtccctcctgt

SEQ ID NO: 3535873 - DNA, 16 bp, Homo sapiens
tgtttataaacattgt

SEQ ID NO: 3535874 - DNA, 19 bp, Homo sapiens
tgttttccgtgaaaacgga

SEQ ID NO: 3535875 - DNA, 12 bp, Homo sapiens
ttaaagtctaca

SEQ ID NO: 3535876 - DNA, 14 bp, Homo sapiens
ttacttgacctcct

SEQ ID NO: 3535877 - DNA, 22 bp, Homo sapiens
ttatgttttttaaaatatttat

SEQ ID NO: 3535878 - DNA, 22 bp, Homo sapiens
ttattaccccctccttcagaca

SEQ ID NO: 3535879 - DNA, 15 bp, Homo sapiens
ttatttcatgaaaat

SEQ ID NO: 3535880 - DNA, 16 bp, Homo sapiens
ttcaaactggggcctc

SEQ ID NO: 3535881 - DNA, 15 bp, Homo sapiens
ttcagacactttgga

SEQ ID NO: 3535882 - DNA, 16 bp, Homo sapiens
ttcagacactttggaa

SEQ ID NO: 3535883 - DNA, 16 bp, Homo sapiens
ttcccaaacgcctccc

SEQ ID NO: 3535884 - DNA, 13 bp, Homo sapiens
ttcccaattgctt

SEQ ID NO: 3535885 - DNA, 17 bp, Homo sapiens
ttcccagcacaggcagg

SEQ ID NO: 3535886 - DNA, 22 bp, Homo sapiens
ttcgaaacctgggattcaggaa

SEQ ID NO: 3535887 - DNA, 14 bp, Homo sapiens
ttctaatagtttta

SEQ ID NO: 3535888 - DNA, 18 bp, Homo sapiens
ttctacaaaatcctgatg

SEQ ID NO: 3535889 - DNA, 16 bp, Homo sapiens
ttctatagcagtcatc

SEQ ID NO: 3535890 - DNA, 19 bp, Homo sapiens
ttctgcctaataaaaaaca

SEQ ID NO: 3535891 - DNA, 14 bp, Homo sapiens
ttcttatttcatga

SEQ ID NO: 3535892 - DNA, 16 bp, Homo sapiens
ttcttatttcatgaaa

SEQ ID NO: 3535893 - DNA, 18 bp, Homo sapiens
ttgaattttgatgaacaa

SEQ ID NO: 3535894 - DNA, 17 bp, Homo sapiens
ttgacacaagtggacct

SEQ ID NO: 3535895 - DNA, 18 bp, Homo sapiens
ttgacacaagtggacctt

SEQ ID NO: 3535896 - DNA, 22 bp, Homo sapiens
ttgagaagacctcacctagaaa

SEQ ID NO: 3535897 - DNA, 21 bp, Homo sapiens
tttcgtctgtttataaacatt

SEQ ID NO: 3535898 - DNA, 14 bp, Homo sapiens
tttctaatgagata

SEQ ID NO: 3535899 - DNA, 13 bp, Homo sapiens
tttctattaaagg

SEQ ID NO: 3535900 - DNA, 14 bp, Homo sapiens
tttctggctgggga

SEQ ID NO: 3535901 - DNA, 16 bp, Homo sapiens
tttctggctggggatg

SEQ ID NO: 3535902 - DNA, 14 bp, Homo sapiens
tttctttcaaaatt

SEQ ID NO: 3535903 - DNA, 21 bp, Homo sapiens
tttgcagctgagagaaaataa

SEQ ID NO: 3535904 - DNA, 12 bp, Homo sapiens
tttgcttagaaa

SEQ ID NO: 3535905 - DNA, 21 bp, Homo sapiens
tttgtgtcatgtttaagaaat

SEQ ID NO: 3535906 - DNA, 14 bp, Homo sapiens
tttgtgtgtagtct

SEQ ID NO: 3535907 - DNA, 20 bp, Homo sapiens
ttttagtttaaaaaccttgt

SEQ ID NO: 3535908 - DNA, 13 bp, Homo sapiens
ttttcttttctat

SEQ ID NO: 3535909 - DNA, 21 bp, Homo sapiens
ttttgaaaccatgaagagatt

SEQ ID NO: 3535910 - DNA, 18 bp, Homo sapiens
tttttcatgattttgaaa

SEQ ID NO: 3535911 - DNA, 20 bp, Homo sapiens
ctcttctctgggcccagaga

SEQ ID NO: 3535912 - DNA, 21 bp, Homo sapiens
ctgaacaataggctgttccca

SEQ ID NO: 3535913 - DNA, 22 bp, Homo sapiens
ctgagccctccctcttcccagc

SEQ ID NO: 3535914 - DNA, 18 bp, Homo sapiens
ctgagccgtgcagctggg

SEQ ID NO: 3535915 - DNA, 12 bp, Homo sapiens
ctgagcctctgc

SEQ ID NO: 3535916 - DNA, 20 bp, Homo sapiens
ctgatttcaaggtccgagct

SEQ ID NO: 3535917 - DNA, 22 bp, Homo sapiens
ctgccttggctcagacatgttt

SEQ ID NO: 3535918 - DNA, 18 bp, Homo sapiens
ctggaagacttagatctg

SEQ ID NO: 3535919 - DNA, 17 bp, Homo sapiens
ctggaatctggagacca

SEQ ID NO: 3535920 - DNA, 18 bp, Homo sapiens
ctggaatctggagaccag

SEQ ID NO: 3535921 - DNA, 19 bp, Homo sapiens
ctggaatctggagaccagg

SEQ ID NO: 3535922 - DNA, 24 bp, Homo sapiens
ctggaatctggagaccagggagcc

SEQ ID NO: 3535923 - DNA, 16 bp, Homo sapiens
ctggagcagcagctga

SEQ ID NO: 3535924 - DNA, 20 bp, Homo sapiens
ctggagcagcagctgaggcc

SEQ ID NO: 3535925 - DNA, 13 bp, Homo sapiens
ctggcctctgtgc

SEQ ID NO: 3535926 - DNA, 15 bp, Homo sapiens
ctggcctctgtgcct

SEQ ID NO: 3535927 - DNA, 20 bp, Homo sapiens
ctggcctctgtgccttcttt

SEQ ID NO: 3535928 - DNA, 14 bp, Homo sapiens
ctggctggggatgg

SEQ ID NO: 3535929 - DNA, 22 bp, Homo sapiens
ctggcttttctggctggggatg

SEQ ID NO: 3535930 - DNA, 20 bp, Homo sapiens
ctgggggacccaatgtagga

SEQ ID NO: 3535931 - DNA, 13 bp, Homo sapiens
ctgggggatatta

SEQ ID NO: 3535932 - DNA, 17 bp, Homo sapiens
ctggtgaggacaaggta

SEQ ID NO: 3535933 - DNA, 20 bp, Homo sapiens
ctgtaatcgccctactattc

SEQ ID NO: 3535934 - DNA, 18 bp, Homo sapiens
ctgtcaacctgaattaaa

SEQ ID NO: 3535935 - DNA, 22 bp, Homo sapiens
ctgtcaacctgaattaaagtct

SEQ ID NO: 3535936 - DNA, 12 bp, Homo sapiens
ctgtcagtcatg

SEQ ID NO: 3535937 - DNA, 14 bp, Homo sapiens
ctgtttgttaaaac

SEQ ID NO: 3535938 - DNA, 21 bp, Homo sapiens
cttaaggatggagccagctct

SEQ ID NO: 3535939 - DNA, 18 bp, Homo sapiens
cttagatctgagccctcc

SEQ ID NO: 3535940 - DNA, 23 bp, Homo sapiens
cttaggccttcctctctccagat

SEQ ID NO: 3535941 - DNA, 21 bp, Homo sapiens
cttatattaatattcctcagt

SEQ ID NO: 3535942 - DNA, 21 bp, Homo sapiens
cttatttattcatattttctt

SEQ ID NO: 3535943 - DNA, 15 bp, Homo sapiens
cttcacaaattctca

SEQ ID NO: 3535944 - DNA, 19 bp, Homo sapiens
cttccccactctgctccca

SEQ ID NO: 3535945 - DNA, 23 bp, Homo sapiens
cttccccactctgctcccagccc

SEQ ID NO: 3535946 - DNA, 18 bp, Homo sapiens
cttccttgagacacggag

SEQ ID NO: 3535947 - DNA, 15 bp, Homo sapiens
cttcgaaacctggga

SEQ ID NO: 3535948 - DNA, 16 bp, Homo sapiens
cttcttttgattatgt

SEQ ID NO: 3535949 - DNA, 12 bp, Homo sapiens
cttgacctccta

SEQ ID NO: 3535950 - DNA, 14 bp, Homo sapiens
cttgacctttccag

SEQ ID NO: 3535951 - DNA, 23 bp, Homo sapiens
cttgagaagacctcacctagaaa

SEQ ID NO: 3535952 - DNA, 21 bp, Homo sapiens
cttgagaccctcttctctggg

SEQ ID NO: 3535953 - DNA, 12 bp, Homo sapiens
cttgagcatctg

SEQ ID NO: 3535954 - DNA, 21 bp, Homo sapiens
cttgctgcagtatgaaaataa

SEQ ID NO: 3535955 - DNA, 23 bp, Homo sapiens
cttggaaaagtggcaagaccaaa

SEQ ID NO: 3535956 - DNA, 15 bp, Homo sapiens
cttgtgattatttat

SEQ ID NO: 3535957 - DNA, 19 bp, Homo sapiens
ctttaacttaattgctatg

SEQ ID NO: 3535958 - DNA, 14 bp, Homo sapiens
ctttattaccccct

SEQ ID NO: 3535959 - DNA, 13 bp, Homo sapiens
ctttcactgggga

SEQ ID NO: 3535960 - DNA, 13 bp, Homo sapiens
ctttcccttcccc

SEQ ID NO: 3535961 - DNA, 14 bp, Homo sapiens
ctttggttctggcc

SEQ ID NO: 3535962 - DNA, 20 bp, Homo sapiens
ctttttaccaagtttcaggt

SEQ ID NO: 3535963 - DNA, 16 bp, Homo sapiens
gaaagaccatttttcc

SEQ ID NO: 3535964 - DNA, 21 bp, Homo sapiens
gaaagtgatatcccccagcct

SEQ ID NO: 3535965 - DNA, 21 bp, Homo sapiens
gaaccaggccttctgatttca

SEQ ID NO: 3535966 - DNA, 17 bp, Homo sapiens
gaactgagccgtgcagc

SEQ ID NO: 3535967 - DNA, 20 bp, Homo sapiens
gaagaccagctttgcagtga

SEQ ID NO: 3535968 - DNA, 14 bp, Homo sapiens
gaagatatttttcc

SEQ ID NO: 3535969 - DNA, 22 bp, Homo sapiens
gaatctggagaccagggagcct

SEQ ID NO: 3535970 - DNA, 13 bp, Homo sapiens
gaatgtatttatt

SEQ ID NO: 3535971 - DNA, 23 bp, Homo sapiens
gaatgtatttatttgggagaccg

SEQ ID NO: 3535972 - DNA, 13 bp, Homo sapiens
gaattaaagtcta

SEQ ID NO: 3535973 - DNA, 21 bp, Homo sapiens
gaattcaaactggggcctcca

SEQ ID NO: 3535974 - DNA, 13 bp, Homo sapiens
gacaccctcaacc

SEQ ID NO: 3535975 - DNA, 18 bp, Homo sapiens
gacatctggaatctggag

SEQ ID NO: 3535976 - DNA, 20 bp, Homo sapiens
gacatctggaatctggagac

SEQ ID NO: 3535977 - DNA, 15 bp, Homo sapiens
gaccagggagccttt

SEQ ID NO: 3535978 - DNA, 22 bp, Homo sapiens
gaccagggagcctttggttctg

SEQ ID NO: 3535979 - DNA, 15 bp, Homo sapiens
gaccctcccccacca

SEQ ID NO: 3535980 - DNA, 16 bp, Homo sapiens
gaccctcttctctggg

SEQ ID NO: 3535981 - DNA, 17 bp, Homo sapiens
gaccctcttctctgggc

SEQ ID NO: 3535982 - DNA, 18 bp, Homo sapiens
gaccctcttctctgggcc

SEQ ID NO: 3535983 - DNA, 13 bp, Homo sapiens
gaccttaggcctt

SEQ ID NO: 3535984 - DNA, 14 bp, Homo sapiens
gaccttccacaaag

SEQ ID NO: 3535985 - DNA, 19 bp, Homo sapiens
gaccttgggcaagtccctt

SEQ ID NO: 3535986 - DNA, 13 bp, Homo sapiens
gactcctcccttc

SEQ ID NO: 3535987 - DNA, 13 bp, Homo sapiens
gagaccctcttct

SEQ ID NO: 3535988 - DNA, 21 bp, Homo sapiens
gagaccctcttctctgggccc

SEQ ID NO: 3535989 - DNA, 20 bp, Homo sapiens
gagaccggggtatcctgggg

SEQ ID NO: 3535990 - DNA, 13 bp, Homo sapiens
gagagacaagaag

SEQ ID NO: 3535991 - DNA, 11 bp, Homo sapiens
gagatatttac

SEQ ID NO: 3535992 - DNA, 23 bp, Homo sapiens
gagcagcagctgaggccccaggg

SEQ ID NO: 3535993 - DNA, 18 bp, Homo sapiens
gagccagctccctctatt

SEQ ID NO: 3535994 - DNA, 20 bp, Homo sapiens
gagccctccctcttcccagc

SEQ ID NO: 3535995 - DNA, 21 bp, Homo sapiens
gagccctccctcttcccagca

SEQ ID NO: 3535996 - DNA, 18 bp, Homo sapiens
gagccttggttcatcagt

SEQ ID NO: 3535997 - DNA, 23 bp, Homo sapiens
gagcctttggttctggccagaat

SEQ ID NO: 3535998 - DNA, 15 bp, Homo sapiens
gagctctgtcctctg

SEQ ID NO: 3535999 - DNA, 18 bp, Homo sapiens
gagctgccttggctcaga

SEQ ID NO: 3536000 - DNA, 22 bp, Homo sapiens
gagctgccttggctcagacatg

SEQ ID NO: 3536001 - DNA, 16 bp, Homo sapiens
gaggaccaaagataca

SEQ ID NO: 3536002 - DNA, 18 bp, Homo sapiens
gaggccccagggctgtgg

SEQ ID NO: 3536003 - DNA, 16 bp, Homo sapiens
gaggcgtcctggtgag

SEQ ID NO: 3536004 - DNA, 21 bp, Homo sapiens
gaggtgggtgagcgggtgggg

SEQ ID NO: 3536005 - DNA, 21 bp, Homo sapiens
gataatgtgatattatacata

SEQ ID NO: 3536006 - DNA, 18 bp, Homo sapiens
gatatttttccatttttt

SEQ ID NO: 3536007 - DNA, 17 bp, Homo sapiens
gatcggagcctcctctc

SEQ ID NO: 3536008 - DNA, 20 bp, Homo sapiens
gatcggagcctcctctctca

SEQ ID NO: 3536009 - DNA, 14 bp, Homo sapiens
gatgaatgtattta

SEQ ID NO: 3536010 - DNA, 21 bp, Homo sapiens
gatgacgacgacaacgatgat

SEQ ID NO: 3536011 - DNA, 20 bp, Homo sapiens
gatgcttgtaacaagaaaac

SEQ ID NO: 3536012 - DNA, 17 bp, Homo sapiens
gattctgcctaataaaa

SEQ ID NO: 3536013 - DNA, 21 bp, Homo sapiens
gattttgaaaccatgaagaga

SEQ ID NO: 3536014 - DNA, 21 bp, Homo sapiens
gcaaggatgatccagggattg

SEQ ID NO: 3536015 - DNA, 15 bp, Homo sapiens
gcacagtccctcctg

SEQ ID NO: 3536016 - DNA, 16 bp, Homo sapiens
gcacagtccctcctgt

SEQ ID NO: 3536017 - DNA, 16 bp, Homo sapiens
gcacagtgaagtgctg

SEQ ID NO: 3536018 - DNA, 16 bp, Homo sapiens
gcagcagctgaggccc

SEQ ID NO: 3536019 - DNA, 16 bp, Homo sapiens
gcatctgacacaaaaa

SEQ ID NO: 3536020 - DNA, 17 bp, Homo sapiens
gcatctgacacaaaaaa

SEQ ID NO: 3536021 - DNA, 20 bp, Homo sapiens
gcccagagagaggcgtcctg

SEQ ID NO: 3536022 - DNA, 19 bp, Homo sapiens
gccctagaccctcccccac

SEQ ID NO: 3536023 - DNA, 14 bp, Homo sapiens
gccctccctcttcc

SEQ ID NO: 3536024 - DNA, 13 bp, Homo sapiens
gccgtgcagctgg

SEQ ID NO: 3536025 - DNA, 22 bp, Homo sapiens
gcctacagctttgatccctgac

SEQ ID NO: 3536026 - DNA, 18 bp, Homo sapiens
gcctatatttcctcttct

SEQ ID NO: 3536027 - DNA, 12 bp, Homo sapiens
gcctccagaact

SEQ ID NO: 3536028 - DNA, 16 bp, Homo sapiens
gcctccctggtccctt

SEQ ID NO: 3536029 - DNA, 13 bp, Homo sapiens
gccttcctctctc

SEQ ID NO: 3536030 - DNA, 17 bp, Homo sapiens
gccttcctctctccaga

SEQ ID NO: 3536031 - DNA, 18 bp, Homo sapiens
gccttcctctctccagat

SEQ ID NO: 3536032 - DNA, 12 bp, Homo sapiens
cagtccctcctg

SEQ ID NO: 3536033 - DNA, 17 bp, Homo sapiens
ggatttgaactgagccg

SEQ ID NO: 3536034 - DNA, 16 bp, Homo sapiens
ggcatctgacacaaaa

SEQ ID NO: 3536035 - DNA, 16 bp, Homo sapiens
ggccttgagcatctgg

SEQ ID NO: 3536036 - DNA, 11 bp, Homo sapiens
ggctggggatg

SEQ ID NO: 3536037 - DNA, 12 bp, Homo sapiens
ggctgtgggtgg

SEQ ID NO: 3536038 - DNA, 20 bp, Homo sapiens
ggctttgtaaactccacagg

SEQ ID NO: 3536039 - DNA, 19 bp, Homo sapiens
gggatttgaaccaggcctt

SEQ ID NO: 3536040 - DNA, 18 bp, Homo sapiens
gggatttgaactgagccg

SEQ ID NO: 3536041 - DNA, 19 bp, Homo sapiens
gggcacctcatggactcca

SEQ ID NO: 3536042 - DNA, 20 bp, Homo sapiens
gggcacctcatggactccag

SEQ ID NO: 3536043 - DNA, 11 bp, Homo sapiens
gggcccagaga

SEQ ID NO: 3536044 - DNA, 22 bp, Homo sapiens
gggcccagagagaggcgtcctg

SEQ ID NO: 3536045 - DNA, 20 bp, Homo sapiens
gggcccaggccctagaccct

SEQ ID NO: 3536046 - DNA, 16 bp, Homo sapiens
gggccttgagcatctg

SEQ ID NO: 3536047 - DNA, 21 bp, Homo sapiens
ggggacccaatgtaggagctg

SEQ ID NO: 3536048 - DNA, 15 bp, Homo sapiens
gggggatattatgaa

SEQ ID NO: 3536049 - DNA, 14 bp, Homo sapiens
ggggtgcttgctgt

SEQ ID NO: 3536050 - DNA, 23 bp, Homo sapiens
gggtcggaacccaagcttagaac

SEQ ID NO: 3536051 - DNA, 13 bp, Homo sapiens
ggtgcttgctgtg

SEQ ID NO: 3536052 - DNA, 16 bp, Homo sapiens
ggttcctttgttccct

SEQ ID NO: 3536053 - DNA, 21 bp, Homo sapiens
gtacagttatttatgcctctg

SEQ ID NO: 3536054 - DNA, 18 bp, Homo sapiens
gtagaagcaaaggcagga

SEQ ID NO: 3536055 - DNA, 16 bp, Homo sapiens
gtagccccctggcctc

SEQ ID NO: 3536056 - DNA, 19 bp, Homo sapiens
gtagccccctggcctctgt

SEQ ID NO: 3536057 - DNA, 18 bp, Homo sapiens
gtattaagaaaatctatt

SEQ ID NO: 3536058 - DNA, 12 bp, Homo sapiens
gtcaacctgaat

SEQ ID NO: 3536059 - DNA, 14 bp, Homo sapiens
gtcaacctgaatta

SEQ ID NO: 3536060 - DNA, 17 bp, Homo sapiens
gtcaacctgaattaaag

SEQ ID NO: 3536061 - DNA, 15 bp, Homo sapiens
gtcaatgttttcagt

SEQ ID NO: 3536062 - DNA, 20 bp, Homo sapiens
gtcactcattgctgagcctc

SEQ ID NO: 3536063 - DNA, 15 bp, Homo sapiens
gtccaactactaaac

SEQ ID NO: 3536064 - DNA, 17 bp, Homo sapiens
gtccaatttctattaaa

SEQ ID NO: 3536065 - DNA, 17 bp, Homo sapiens
gtccaggagaccttcca

SEQ ID NO: 3536066 - DNA, 15 bp, Homo sapiens
gtcctggtgaggaca

SEQ ID NO: 3536067 - DNA, 16 bp, Homo sapiens
gtctaaacaatgctga

SEQ ID NO: 3536068 - DNA, 13 bp, Homo sapiens
gtctattctagtc

SEQ ID NO: 3536069 - DNA, 23 bp, Homo sapiens
gtgactcctcccttccccactct

SEQ ID NO: 3536070 - DNA, 17 bp, Homo sapiens
gtggaccttaggccttc

SEQ ID NO: 3536071 - DNA, 21 bp, Homo sapiens
gtggaccttaggccttcctct

SEQ ID NO: 3536072 - DNA, 15 bp, Homo sapiens
gtgggtggggaagga

SEQ ID NO: 3536073 - DNA, 17 bp, Homo sapiens
gtgttctgtttgttaaa

SEQ ID NO: 3536074 - DNA, 13 bp, Homo sapiens
gttactgaggacc

SEQ ID NO: 3536075 - DNA, 20 bp, Homo sapiens
gttatttttacattctgaat

SEQ ID NO: 3536076 - DNA, 13 bp, Homo sapiens
gttcatcagtgtt

SEQ ID NO: 3536077 - DNA, 14 bp, Homo sapiens
gttccctaagtcca

SEQ ID NO: 3536078 - DNA, 22 bp, Homo sapiens
gttctgtttgttaaaactggca

SEQ ID NO: 3536079 - DNA, 19 bp, Homo sapiens
gttgcacagtccctcctgt

SEQ ID NO: 3536080 - DNA, 18 bp, Homo sapiens
gtttgttgcacagtccct

SEQ ID NO: 3536081 - DNA, 17 bp, Homo sapiens
gttttgacatttttagt

SEQ ID NO: 3536082 - DNA, 14 bp, Homo sapiens
taaaaaacatttat

SEQ ID NO: 3536083 - DNA, 19 bp, Homo sapiens
taaaactggcatctgacac

SEQ ID NO: 3536084 - DNA, 21 bp, Homo sapiens
taaacaatgctgatttggtga

SEQ ID NO: 3536085 - DNA, 16 bp, Homo sapiens
taaagtctacactgcc

SEQ ID NO: 3536086 - DNA, 15 bp, Homo sapiens
taaagtgatatttcc

SEQ ID NO: 3536087 - DNA, 15 bp, Homo sapiens
taacaagaaaacata

SEQ ID NO: 3536088 - DNA, 15 bp, Homo sapiens
taactttctctatga

SEQ ID NO: 3536089 - DNA, 20 bp, Homo sapiens
taagacggatttatttttcc

SEQ ID NO: 3536090 - DNA, 15 bp, Homo sapiens
taagatatttttcat

SEQ ID NO: 3536091 - DNA, 17 bp, Homo sapiens
taagatatttttcatga

SEQ ID NO: 3536092 - DNA, 20 bp, Homo sapiens
taaggatggagccagctctg

SEQ ID NO: 3536093 - DNA, 23 bp, Homo sapiens
taagtccaactactaaactgggg

SEQ ID NO: 3536094 - DNA, 16 bp, Homo sapiens
taagtgattgtatgaa

SEQ ID NO: 3536095 - DNA, 20 bp, Homo sapiens
taagttatttttacattctg

SEQ ID NO: 3536096 - DNA, 13 bp, Homo sapiens
taataaacattct

SEQ ID NO: 3536097 - DNA, 15 bp, Homo sapiens
taataaggttgaaca

SEQ ID NO: 3536098 - DNA, 16 bp, Homo sapiens
taataccacagctttt

SEQ ID NO: 3536099 - DNA, 21 bp, Homo sapiens
taatgttgtatgtcttgttta

SEQ ID NO: 3536100 - DNA, 18 bp, Homo sapiens
tacacagaaatacagtta

SEQ ID NO: 3536101 - DNA, 18 bp, Homo sapiens
tacagatgaatgtattta

SEQ ID NO: 3536102 - DNA, 19 bp, Homo sapiens
tacagctttgatccctgac

SEQ ID NO: 3536103 - DNA, 15 bp, Homo sapiens
tacattaattatcta

SEQ ID NO: 3536104 - DNA, 18 bp, Homo sapiens
taccccctccttcagaca

SEQ ID NO: 3536105 - DNA, 16 bp, Homo sapiens
tactactgaatctcta

SEQ ID NO: 3536106 - DNA, 19 bp, Homo sapiens
tagaactttaagcaacaag

SEQ ID NO: 3536107 - DNA, 22 bp, Homo sapiens
tagaagccccgttataactcct

SEQ ID NO: 3536108 - DNA, 14 bp, Homo sapiens
tagatctgagccct

SEQ ID NO: 3536109 - DNA, 18 bp, Homo sapiens
tagccaatatttttctta

SEQ ID NO: 3536110 - DNA, 23 bp, Homo sapiens
tagctgggatttgaactgagccg

SEQ ID NO: 3536111 - DNA, 19 bp, Homo sapiens
taggaaagaccatttttcc

SEQ ID NO: 3536112 - DNA, 21 bp, Homo sapiens
taggccttcctctctccagat

SEQ ID NO: 3536113 - DNA, 15 bp, Homo sapiens
tagggtcggaaccca

SEQ ID NO: 3536114 - DNA, 15 bp, Homo sapiens
tagttcagacacttt

SEQ ID NO: 3536115 - DNA, 20 bp, Homo sapiens
tatcgcaccactgtgtattt

SEQ ID NO: 3536116 - DNA, 23 bp, Homo sapiens
tatctaaactggattcacagctc

SEQ ID NO: 3536117 - DNA, 17 bp, Homo sapiens
tatctagtttaattaat

SEQ ID NO: 3536118 - DNA, 13 bp, Homo sapiens
tatctgaggtcac

SEQ ID NO: 3536119 - DNA, 21 bp, Homo sapiens
tatgaagggccttgagcatct

SEQ ID NO: 3536120 - DNA, 22 bp, Homo sapiens
tatgaagggccttgagcatctg

SEQ ID NO: 3536121 - DNA, 17 bp, Homo sapiens
tatgttttttaaaatat

SEQ ID NO: 3536122 - DNA, 19 bp, Homo sapiens
tattaataaacattctatc

SEQ ID NO: 3536123 - DNA, 21 bp, Homo sapiens
tattgatgataatacccacat

SEQ ID NO: 3536124 - DNA, 21 bp, Homo sapiens
tatttaactgccttgtgtaca

SEQ ID NO: 3536125 - DNA, 19 bp, Homo sapiens
tatttcttaaatctagtaa

SEQ ID NO: 3536126 - DNA, 21 bp, Homo sapiens
tatttttaatatatactatga

SEQ ID NO: 3536127 - DNA, 18 bp, Homo sapiens
tatttttacattctgaat

SEQ ID NO: 3536128 - DNA, 12 bp, Homo sapiens
tatttttcatga

SEQ ID NO: 3536129 - DNA, 16 bp, Homo sapiens
tcaaactggggcctcc

SEQ ID NO: 3536130 - DNA, 22 bp, Homo sapiens
tcaaactggggcctccagaact

SEQ ID NO: 3536131 - DNA, 17 bp, Homo sapiens
tcaacctgaattaaagt

SEQ ID NO: 3536132 - DNA, 18 bp, Homo sapiens
tcaacctgaattaaagtc

SEQ ID NO: 3536133 - DNA, 19 bp, Homo sapiens
tcactcattgctgagcctc

SEQ ID NO: 3536134 - DNA, 14 bp, Homo sapiens
tcactttctagatt

SEQ ID NO: 3536135 - DNA, 15 bp, Homo sapiens
tcagacaccctcaac

SEQ ID NO: 3536136 - DNA, 17 bp, Homo sapiens
tcagacaccctcaacct

SEQ ID NO: 3536137 - DNA, 14 bp, Homo sapiens
tcagacatgttttc

SEQ ID NO: 3536138 - DNA, 20 bp, Homo sapiens
tcagacatgttttccgtgaa

SEQ ID NO: 3536139 - DNA, 14 bp, Homo sapiens
tcagccatgtattt

SEQ ID NO: 3536140 - DNA, 17 bp, Homo sapiens
tcaggtattaagaaaat

SEQ ID NO: 3536141 - DNA, 15 bp, Homo sapiens
tcagtcatgcgtcca

SEQ ID NO: 3536142 - DNA, 13 bp, Homo sapiens
tcagtgttaaaaa

SEQ ID NO: 3536143 - DNA, 15 bp, Homo sapiens
tcagtgttaaaaaat

SEQ ID NO: 3536144 - DNA, 23 bp, Homo sapiens
tcagtgttaaaaaatttttgaaa

SEQ ID NO: 3536145 - DNA, 19 bp, Homo sapiens
tcagttctcttgattttca

SEQ ID NO: 3536146 - DNA, 15 bp, Homo sapiens
tcatattttctttca

SEQ ID NO: 3536147 - DNA, 12 bp, Homo sapiens
tcatcagtgtta

SEQ ID NO: 3536148 - DNA, 19 bp, Homo sapiens
tcatcagtgttaaaaaatt

SEQ ID NO: 3536149 - DNA, 22 bp, Homo sapiens
tcatgcgtccactttcccttcc

SEQ ID NO: 3536150 - DNA, 14 bp, Homo sapiens
tcatgtttaagaaa

SEQ ID NO: 3536151 - DNA, 16 bp, Homo sapiens
tcattgctgagcctct

SEQ ID NO: 3536152 - DNA, 23 bp, Homo sapiens
tcattgctgagcctctgctcccc

SEQ ID NO: 3536153 - DNA, 13 bp, Homo sapiens
tccaaccttccca

SEQ ID NO: 3536154 - DNA, 18 bp, Homo sapiens
tccaatttctattaaagg

SEQ ID NO: 3536155 - DNA, 17 bp, Homo sapiens
tccacatccccaccttc

SEQ ID NO: 3536156 - DNA, 14 bp, Homo sapiens
tccaggatcctcct

SEQ ID NO: 3536157 - DNA, 20 bp, Homo sapiens
tccaggatcctcctggagca

SEQ ID NO: 3536158 - DNA, 13 bp, Homo sapiens
tccatataaatat

SEQ ID NO: 3536159 - DNA, 15 bp, Homo sapiens
tcccaaacgcctccc

SEQ ID NO: 3536160 - DNA, 21 bp, Homo sapiens
tcccatgtagccccctggcct

SEQ ID NO: 3536161 - DNA, 17 bp, Homo sapiens
tccccaccttccaagga

SEQ ID NO: 3536162 - DNA, 14 bp, Homo sapiens
tccccactctgctc

SEQ ID NO: 3536163 - DNA, 18 bp, Homo sapiens
tccccactctgctcccag

SEQ ID NO: 3536164 - DNA, 17 bp, Homo sapiens
tccctcctgttgccaca

SEQ ID NO: 3536165 - DNA, 19 bp, Homo sapiens
tccctctatttatgtttgc

SEQ ID NO: 3536166 - DNA, 19 bp, Homo sapiens
tcccttccccactctgctc

SEQ ID NO: 3536167 - DNA, 16 bp, Homo sapiens
tccgagctctgtcctc

SEQ ID NO: 3536168 - DNA, 19 bp, Homo sapiens
tcctctctccagatgtttc

SEQ ID NO: 3536169 - DNA, 13 bp, Homo sapiens
tcctgttgccaca

SEQ ID NO: 3536170 - DNA, 21 bp, Homo sapiens
tccttgagacacggagcccag

SEQ ID NO: 3536171 - DNA, 19 bp, Homo sapiens
tcgaaacctgggattcagg

SEQ ID NO: 3536172 - DNA, 21 bp, Homo sapiens
tcgcaccactgtgtatttaac

SEQ ID NO: 3536173 - DNA, 17 bp, Homo sapiens
tctatagcagtcatcat

SEQ ID NO: 3536174 - DNA, 18 bp, Homo sapiens
tctatagcagtcatcatt

SEQ ID NO: 3536175 - DNA, 12 bp, Homo sapiens
tctcaatttcta

SEQ ID NO: 3536176 - DNA, 15 bp, Homo sapiens
tctccagatgtttcc

SEQ ID NO: 3536177 - DNA, 18 bp, Homo sapiens
tctccagatgtttccaga

SEQ ID NO: 3536178 - DNA, 14 bp, Homo sapiens
tctgacacaaaaaa

SEQ ID NO: 3536179 - DNA, 17 bp, Homo sapiens
tctgagccctccctctt

SEQ ID NO: 3536180 - DNA, 19 bp, Homo sapiens
tctgagccctccctcttcc

SEQ ID NO: 3536181 - DNA, 20 bp, Homo sapiens
tctgctcccagcccctacct

SEQ ID NO: 3536182 - DNA, 19 bp, Homo sapiens
tctggaatctggagaccag

SEQ ID NO: 3536183 - DNA, 20 bp, Homo sapiens
tctggattctgcctaataaa

SEQ ID NO: 3536184 - DNA, 12 bp, Homo sapiens
tctggctgggga

SEQ ID NO: 3536185 - DNA, 20 bp, Homo sapiens
tctgtatttccccaacatgt

SEQ ID NO: 3536186 - DNA, 23 bp, Homo sapiens
tctgtatttccccaacatgtaat

SEQ ID NO: 3536187 - DNA, 14 bp, Homo sapiens
tcttatttcatgaa

SEQ ID NO: 3536188 - DNA, 16 bp, Homo sapiens
tcttatttcatgaaaa

SEQ ID NO: 3536189 - DNA, 12 bp, Homo sapiens
tcttctggctca

SEQ ID NO: 3536190 - DNA, 18 bp, Homo sapiens
tcttctggctcaaaaaga

SEQ ID NO: 3536191 - DNA, 22 bp, Homo sapiens
tcttctgtaaaatgggtatatt

SEQ ID NO: 3536192 - DNA, 13 bp, Homo sapiens
tcttgctgtccaa

SEQ ID NO: 3536193 - DNA, 18 bp, Homo sapiens
tctttgaacgtacccaag

SEQ ID NO: 3536194 - DNA, 16 bp, Homo sapiens
tgaaccaggccttctg

SEQ ID NO: 3536195 - DNA, 21 bp, Homo sapiens
tgaacgtacccaaggtcacat

SEQ ID NO: 3536196 - DNA, 16 bp, Homo sapiens
tgaagagatttttcat

SEQ ID NO: 3536197 - DNA, 20 bp, Homo sapiens
tgaagggccttgagcatctg

SEQ ID NO: 3536198 - DNA, 23 bp, Homo sapiens
tgaagggccttgagcatctggat

SEQ ID NO: 3536199 - DNA, 14 bp, Homo sapiens
tgaattaaagtcta

SEQ ID NO: 3536200 - DNA, 20 bp, Homo sapiens
tgaattaaagtctacactgc

SEQ ID NO: 3536201 - DNA, 17 bp, Homo sapiens
tgacatcaccacagttt

SEQ ID NO: 3536202 - DNA, 24 bp, Homo sapiens
tgactcctcccttccccactctgc

SEQ ID NO: 3536203 - DNA, 21 bp, Homo sapiens
tgagacacggagcccagccct

SEQ ID NO: 3536204 - DNA, 21 bp, Homo sapiens
tgagaccctcttctctgggcc

SEQ ID NO: 3536205 - DNA, 18 bp, Homo sapiens
tgagccctccctcttccc

SEQ ID NO: 3536206 - DNA, 23 bp, Homo sapiens
tgagccctccctcttcccagcac

SEQ ID NO: 3536207 - DNA, 12 bp, Homo sapiens
tgagcctctgct

SEQ ID NO: 3536208 - DNA, 14 bp, Homo sapiens
tgagcctctgctcc

SEQ ID NO: 3536209 - DNA, 17 bp, Homo sapiens
tgagcctctgctcccca

SEQ ID NO: 3536210 - DNA, 14 bp, Homo sapiens
tgagcgggtggggt

SEQ ID NO: 3536211 - DNA, 15 bp, Homo sapiens
tgagcgggtggggtg

SEQ ID NO: 3536212 - DNA, 13 bp, Homo sapiens
tgataatacccac

SEQ ID NO: 3536213 - DNA, 18 bp, Homo sapiens
tgatgataatacccacat

SEQ ID NO: 3536214 - DNA, 20 bp, Homo sapiens
tgatttcaaggtccgagctc

SEQ ID NO: 3536215 - DNA, 13 bp, Homo sapiens
tgatttttttcca

SEQ ID NO: 3536216 - DNA, 20 bp, Homo sapiens
tgcacttgtgattatttatt

SEQ ID NO: 3536217 - DNA, 13 bp, Homo sapiens
tgcaggacttgag

SEQ ID NO: 3536218 - DNA, 15 bp, Homo sapiens
tgcaggacttgagaa

SEQ ID NO: 3536219 - DNA, 16 bp, Homo sapiens
tgcagtatgaaaataa

SEQ ID NO: 3536220 - DNA, 17 bp, Homo sapiens
tgccacactttcactgg

SEQ ID NO: 3536221 - DNA, 21 bp, Homo sapiens
tgccacactttcactggggat

SEQ ID NO: 3536222 - DNA, 12 bp, Homo sapiens
tgcctaataaaa

SEQ ID NO: 3536223 - DNA, 13 bp, Homo sapiens
tgccttggctcag

SEQ ID NO: 3536224 - DNA, 19 bp, Homo sapiens
tgccttgtgtacagttatt

SEQ ID NO: 3536225 - DNA, 20 bp, Homo sapiens
tgctatgttttgacattttt

SEQ ID NO: 3536226 - DNA, 12 bp, Homo sapiens
tgctgagcctct

SEQ ID NO: 3536227 - DNA, 14 bp, Homo sapiens
tgcttagaaaagaa

SEQ ID NO: 3536228 - DNA, 18 bp, Homo sapiens
tgcttgtaacaagaaaac

SEQ ID NO: 3536229 - DNA, 23 bp, Homo sapiens
tgcttgtaacaagaaaacataag

SEQ ID NO: 3536230 - DNA, 17 bp, Homo sapiens
tggaatctggagaccag

SEQ ID NO: 3536231 - DNA, 15 bp, Homo sapiens
tggaccttaggcctt

SEQ ID NO: 3536232 - DNA, 16 bp, Homo sapiens
tggaccttaggccttc

SEQ ID NO: 3536233 - DNA, 21 bp, Homo sapiens
tggaccttaggccttcctctc

SEQ ID NO: 3536234 - DNA, 17 bp, Homo sapiens
tggagcagcagctgagg

SEQ ID NO: 3536235 - DNA, 13 bp, Homo sapiens
tggagccagctcc

SEQ ID NO: 3536236 - DNA, 21 bp, Homo sapiens
tggccacttgggtcttccctg

SEQ ID NO: 3536237 - DNA, 17 bp, Homo sapiens
tggcttttctggctggg

SEQ ID NO: 3536238 - DNA, 23 bp, Homo sapiens
tgggaagaccagctttgcagtga

SEQ ID NO: 3536239 - DNA, 17 bp, Homo sapiens
tgggattcaggaatgtg

SEQ ID NO: 3536240 - DNA, 19 bp, Homo sapiens
tgggatttgaactgagccg

SEQ ID NO: 3536241 - DNA, 24 bp, Homo sapiens
tgggcccagagagaggcgtcctgg

SEQ ID NO: 3536242 - DNA, 17 bp, Homo sapiens
tgggtgagcgggtgggg

SEQ ID NO: 3536243 - DNA, 12 bp, Homo sapiens
tggttctggcca

SEQ ID NO: 3536244 - DNA, 15 bp, Homo sapiens
tgtaacaagaaaaca

SEQ ID NO: 3536245 - DNA, 17 bp, Homo sapiens
tgtaactttctctatga

SEQ ID NO: 3536246 - DNA, 16 bp, Homo sapiens
tgtagccccctggcct

SEQ ID NO: 3536247 - DNA, 14 bp, Homo sapiens
tgtattcagcttta

SEQ ID NO: 3536248 - DNA, 16 bp, Homo sapiens
tgtcaacctgaattaa

SEQ ID NO: 3536249 - DNA, 18 bp, Homo sapiens
tgtcaacctgaattaaag

SEQ ID NO: 3536250 - DNA, 15 bp, Homo sapiens
tgtcactcattgctg

SEQ ID NO: 3536251 - DNA, 21 bp, Homo sapiens
tgtccaatttctattaaaggt

SEQ ID NO: 3536252 - DNA, 18 bp, Homo sapiens
tgtccaggagaccttcca

SEQ ID NO: 3536253 - DNA, 17 bp, Homo sapiens
tgtcctctgtcagtcat

SEQ ID NO: 3536254 - DNA, 16 bp, Homo sapiens
tgtctaaacaatgctg

SEQ ID NO: 3536255 - DNA, 17 bp, Homo sapiens
tgtggcctgcacagtga

SEQ ID NO: 3536256 - DNA, 18 bp, Homo sapiens
tgtgttctgtttgttaaa

SEQ ID NO: 3536257 - DNA, 20 bp, Homo sapiens
tgttctatagcagtcatcat

SEQ ID NO: 3536258 - DNA, 16 bp, Homo sapiens
tgttctgtttgttaaa

SEQ ID NO: 3536259 - DNA, 20 bp, Homo sapiens
tgttctgtttgttaaaactg

SEQ ID NO: 3536260 - DNA, 19 bp, Homo sapiens
tgtttagtaaactcaataa

SEQ ID NO: 3536261 - DNA, 16 bp, Homo sapiens
tgttttccgtgaaaac

SEQ ID NO: 3536262 - DNA, 20 bp, Homo sapiens
ttaaaggttcctttgttccc

SEQ ID NO: 3536263 - DNA, 16 bp, Homo sapiens
ttaaagtctacactgc

SEQ ID NO: 3536264 - DNA, 19 bp, Homo sapiens
ttaaagtctacactgcctt

SEQ ID NO: 3536265 - DNA, 21 bp, Homo sapiens
ttaaagtctacactgcctttg

SEQ ID NO: 3536266 - DNA, 15 bp, Homo sapiens
ttaataccacagctt

SEQ ID NO: 3536267 - DNA, 13 bp, Homo sapiens
ttaatgtgtatta

SEQ ID NO: 3536268 - DNA, 17 bp, Homo sapiens
ttacatgaattgcattt

SEQ ID NO: 3536269 - DNA, 15 bp, Homo sapiens
ttaccttattgcact

SEQ ID NO: 3536270 - DNA, 22 bp, Homo sapiens
ttatgaagggccttgagcatct

SEQ ID NO: 3536271 - DNA, 23 bp, Homo sapiens
ttatgaagggccttgagcatctg

SEQ ID NO: 3536272 - DNA, 14 bp, Homo sapiens
ttattaataaacat

SEQ ID NO: 3536273 - DNA, 15 bp, Homo sapiens
ttattaataaacatt

SEQ ID NO: 3536274 - DNA, 19 bp, Homo sapiens
ttattaccccctccttcag

SEQ ID NO: 3536275 - DNA, 20 bp, Homo sapiens
ttatttacagatgaatgtat

SEQ ID NO: 3536276 - DNA, 14 bp, Homo sapiens
ttatttatgcctct

SEQ ID NO: 3536277 - DNA, 20 bp, Homo sapiens
ttatttatgcctctgtattt

SEQ ID NO: 3536278 - DNA, 15 bp, Homo sapiens
ttcaaactggggcct

SEQ ID NO: 3536279 - DNA, 23 bp, Homo sapiens
ttcaaggtccgagctctgtcctc

SEQ ID NO: 3536280 - DNA, 17 bp, Homo sapiens
ttcacatttttgtattt

SEQ ID NO: 3536281 - DNA, 15 bp, Homo sapiens
ttcatgattttgaaa

SEQ ID NO: 3536282 - DNA, 13 bp, Homo sapiens
ttcatgggcacct

SEQ ID NO: 3536283 - DNA, 22 bp, Homo sapiens
ttccacatccccaccttccaag

SEQ ID NO: 3536284 - DNA, 20 bp, Homo sapiens
ttccagacttccttgagaca

SEQ ID NO: 3536285 - DNA, 15 bp, Homo sapiens
ttccccactctgctc

SEQ ID NO: 3536286 - DNA, 19 bp, Homo sapiens
ttccccactctgctcccag

SEQ ID NO: 3536287 - DNA, 17 bp, Homo sapiens
ttccgtgaaaacggagc

SEQ ID NO: 3536288 - DNA, 22 bp, Homo sapiens
ttccttgagacacggagcccag

SEQ ID NO: 3536289 - DNA, 24 bp, Homo sapiens
ttccttgagacacggagcccagcc

SEQ ID NO: 3536290 - DNA, 18 bp, Homo sapiens
ttcctttgttccctaagt

SEQ ID NO: 3536291 - DNA, 19 bp, Homo sapiens
ttcgtctgtttataaacat

SEQ ID NO: 3536292 - DNA, 14 bp, Homo sapiens
ttctacatttcacc

SEQ ID NO: 3536293 - DNA, 10 bp, Homo sapiens
ttctggctca

SEQ ID NO: 3536294 - DNA, 13 bp, Homo sapiens
ttctggctgggga

SEQ ID NO: 3536295 - DNA, 14 bp, Homo sapiens
ttctgtttgttaaa

SEQ ID NO: 3536296 - DNA, 20 bp, Homo sapiens
ttgcacttgtgattatttat

SEQ ID NO: 3536297 - DNA, 15 bp, Homo sapiens
ttgctgagcctctgc

SEQ ID NO: 3536298 - DNA, 19 bp, Homo sapiens
ttggaagtttgtgttctgt

SEQ ID NO: 3536299 - DNA, 17 bp, Homo sapiens
ttggttcatcagtgtta

SEQ ID NO: 3536300 - DNA, 16 bp, Homo sapiens
ttgtaacaagaaaaca

SEQ ID NO: 3536301 - DNA, 15 bp, Homo sapiens
ttgtgtacagttatt

SEQ ID NO: 3536302 - DNA, 14 bp, Homo sapiens
tttaactgccttgt

SEQ ID NO: 3536303 - DNA, 12 bp, Homo sapiens
tttaccaagttt

SEQ ID NO: 3536304 - DNA, 21 bp, Homo sapiens
tttagtagatattaccagttt

SEQ ID NO: 3536305 - DNA, 16 bp, Homo sapiens
tttattaataaacatt

SEQ ID NO: 3536306 - DNA, 23 bp, Homo sapiens
tttattaccccctccttcagaca

SEQ ID NO: 3536307 - DNA, 20 bp, Homo sapiens
tttatttacagatgaatgta

SEQ ID NO: 3536308 - DNA, 22 bp, Homo sapiens
tttatttttccatttacaacaa

SEQ ID NO: 3536309 - DNA, 16 bp, Homo sapiens
tttcacctactttgta

SEQ ID NO: 3536310 - DNA, 14 bp, Homo sapiens
tttcactggggatc

SEQ ID NO: 3536311 - DNA, 13 bp, Homo sapiens
aaaaaacatttat

SEQ ID NO: 3536312 - DNA, 22 bp, Homo sapiens
aaaaaccttgtatatcttgttt

SEQ ID NO: 3536313 - DNA, 20 bp, Homo sapiens
aaaatctattttgtaacttt

SEQ ID NO: 3536314 - DNA, 12 bp, Homo sapiens
aaacattctatc

SEQ ID NO: 3536315 - DNA, 17 bp, Homo sapiens
aaactccacagggactg

SEQ ID NO: 3536316 - DNA, 18 bp, Homo sapiens
aaactggggcctccagaa

SEQ ID NO: 3536317 - DNA, 20 bp, Homo sapiens
aaactggggcctccagaact

SEQ ID NO: 3536318 - DNA, 15 bp, Homo sapiens
aaagaccatttttcc

SEQ ID NO: 3536319 - DNA, 21 bp, Homo sapiens
aaagataaattatatcaattt

SEQ ID NO: 3536320 - DNA, 18 bp, Homo sapiens
aaaggttcctttgttccc

SEQ ID NO: 3536321 - DNA, 22 bp, Homo sapiens
aaatcataagatatttttcatg

SEQ ID NO: 3536322 - DNA, 12 bp, Homo sapiens
aacaagaaaaca

SEQ ID NO: 3536323 - DNA, 14 bp, Homo sapiens
aacaagaaaacata

SEQ ID NO: 3536324 - DNA, 20 bp, Homo sapiens
aacacccagtctgttcccca

SEQ ID NO: 3536325 - DNA, 16 bp, Homo sapiens
aacccaagcttagaac

SEQ ID NO: 3536326 - DNA, 18 bp, Homo sapiens
aacgcctcccctgcccca

SEQ ID NO: 3536327 - DNA, 10 bp, Homo sapiens
aactgagccg

SEQ ID NO: 3536328 - DNA, 20 bp, Homo sapiens
aacttgctgcagtatgaaaa

SEQ ID NO: 3536329 - DNA, 22 bp, Homo sapiens
aacttgctgcagtatgaaaata

SEQ ID NO: 3536330 - DNA, 14 bp, Homo sapiens
aagaagcaaatttt

SEQ ID NO: 3536331 - DNA, 13 bp, Homo sapiens
aagacaatataat

SEQ ID NO: 3536332 - DNA, 16 bp, Homo sapiens
aagacctcacctagaa

SEQ ID NO: 3536333 - DNA, 17 bp, Homo sapiens
aagacctcacctagaaa

SEQ ID NO: 3536334 - DNA, 13 bp, Homo sapiens
aagagatttttca

SEQ ID NO: 3536335 - DNA, 15 bp, Homo sapiens
aagagatttttcatg

SEQ ID NO: 3536336 - DNA, 13 bp, Homo sapiens
aagatatttttcc

SEQ ID NO: 3536337 - DNA, 18 bp, Homo sapiens
aagcatgtattcagcttt

SEQ ID NO: 3536338 - DNA, 11 bp, Homo sapiens
aagcttagaac

SEQ ID NO: 3536339 - DNA, 19 bp, Homo sapiens
aagggccttgagcatctgg

SEQ ID NO: 3536340 - DNA, 18 bp, Homo sapiens
aaggttcctttgttccct

SEQ ID NO: 3536341 - DNA, 18 bp, Homo sapiens
aagtacccgttcacattt

SEQ ID NO: 3536342 - DNA, 18 bp, Homo sapiens
aagtcaatgttttcagtt

SEQ ID NO: 3536343 - DNA, 16 bp, Homo sapiens
aagtccaactactaaa

SEQ ID NO: 3536344 - DNA, 21 bp, Homo sapiens
aagttcatgggcacctcatgg

SEQ ID NO: 3536345 - DNA, 21 bp, Homo sapiens
aagtttgtgttctgtttgtta

SEQ ID NO: 3536346 - DNA, 22 bp, Homo sapiens
aagtttgtgttctgtttgttaa

SEQ ID NO: 3536347 - DNA, 19 bp, Homo sapiens
aataaagtttgcttagaaa

SEQ ID NO: 3536348 - DNA, 17 bp, Homo sapiens
aataatatattttaaat

SEQ ID NO: 3536349 - DNA, 21 bp, Homo sapiens
aatagttttattaataaacat

SEQ ID NO: 3536350 - DNA, 22 bp, Homo sapiens
aatagttttattaataaacatt

SEQ ID NO: 3536351 - DNA, 17 bp, Homo sapiens
aatatttttaatatata

SEQ ID NO: 3536352 - DNA, 13 bp, Homo sapiens
aatatttttctta

SEQ ID NO: 3536353 - DNA, 18 bp, Homo sapiens
aatattttttcttttcta

SEQ ID NO: 3536354 - DNA, 23 bp, Homo sapiens
aatcataagatatttttcatgat

SEQ ID NO: 3536355 - DNA, 17 bp, Homo sapiens
aatctattttgtaactt

SEQ ID NO: 3536356 - DNA, 18 bp, Homo sapiens
aatgacatcaccacagtt

SEQ ID NO: 3536357 - DNA, 18 bp, Homo sapiens
aatgatgatgataatgat

SEQ ID NO: 3536358 - DNA, 22 bp, Homo sapiens
aatgtgtattacaaatattttg

SEQ ID NO: 3536359 - DNA, 14 bp, Homo sapiens
aatgttgaattttg

SEQ ID NO: 3536360 - DNA, 11 bp, Homo sapiens
aattaaagtct

SEQ ID NO: 3536361 - DNA, 12 bp, Homo sapiens
aattaaagtcta

SEQ ID NO: 3536362 - DNA, 15 bp, Homo sapiens
aattaaagtctacac

SEQ ID NO: 3536363 - DNA, 18 bp, Homo sapiens
aattaaagtctacactgc

SEQ ID NO: 3536364 - DNA, 12 bp, Homo sapiens
aattattgtaca

SEQ ID NO: 3536365 - DNA, 15 bp, Homo sapiens
aatttctattaaagg

SEQ ID NO: 3536366 - DNA, 21 bp, Homo sapiens
acaaaccgagtgcaatgaatg

SEQ ID NO: 3536367 - DNA, 21 bp, Homo sapiens
acaaatctcaagcaaacagct

SEQ ID NO: 3536368 - DNA, 12 bp, Homo sapiens
acaagaaaacat

SEQ ID NO: 3536369 - DNA, 19 bp, Homo sapiens
acaatgatgatgataatga

SEQ ID NO: 3536370 - DNA, 17 bp, Homo sapiens
acaatgctgatttggtg

SEQ ID NO: 3536371 - DNA, 18 bp, Homo sapiens
acaccctcaacctcttct

SEQ ID NO: 3536372 - DNA, 18 bp, Homo sapiens
acacggagcccagccctc

SEQ ID NO: 3536373 - DNA, 19 bp, Homo sapiens
acaggcaaggatgatccag

SEQ ID NO: 3536374 - DNA, 15 bp, Homo sapiens
acatttattttcatt

SEQ ID NO: 3536375 - DNA, 23 bp, Homo sapiens
accaactgtcactcattgctgag

SEQ ID NO: 3536376 - DNA, 16 bp, Homo sapiens
accactgtgtatttaa

SEQ ID NO: 3536377 - DNA, 24 bp, Homo sapiens
accatgaagagatttttcatgatt

SEQ ID NO: 3536378 - DNA, 16 bp, Homo sapiens
acccagtctgttcccc

SEQ ID NO: 3536379 - DNA, 19 bp, Homo sapiens
accccctccttcagacacc

SEQ ID NO: 3536380 - DNA, 16 bp, Homo sapiens
acccgttcacattttt

SEQ ID NO: 3536381 - DNA, 18 bp, Homo sapiens
accctcccccaccattcc

SEQ ID NO: 3536382 - DNA, 22 bp, Homo sapiens
acctagaaattgacacaagtgg

SEQ ID NO: 3536383 - DNA, 14 bp, Homo sapiens
acctcacctagaaa

SEQ ID NO: 3536384 - DNA, 14 bp, Homo sapiens
acctgaattaaagt

SEQ ID NO: 3536385 - DNA, 22 bp, Homo sapiens
acctgtcaacctgaattaaagt

SEQ ID NO: 3536386 - DNA, 23 bp, Homo sapiens
acctgtcaacctgaattaaagtc

SEQ ID NO: 3536387 - DNA, 13 bp, Homo sapiens
accttaggccttc

SEQ ID NO: 3536388 - DNA, 19 bp, Homo sapiens
accttcccaaacgcctccc

SEQ ID NO: 3536389 - DNA, 17 bp, Homo sapiens
accttgagaccctcttc

SEQ ID NO: 3536390 - DNA, 15 bp, Homo sapiens
acggagcccagccct

SEQ ID NO: 3536391 - DNA, 21 bp, Homo sapiens
acgtacccaaggtcacatagc

SEQ ID NO: 3536392 - DNA, 14 bp, Homo sapiens
actactaaactggg

SEQ ID NO: 3536393 - DNA, 22 bp, Homo sapiens
actcattgctgagcctctgctc

SEQ ID NO: 3536394 - DNA, 23 bp, Homo sapiens
actcattgctgagcctctgctcc

SEQ ID NO: 3536395 - DNA, 17 bp, Homo sapiens
actccaggatcctcctg

SEQ ID NO: 3536396 - DNA, 16 bp, Homo sapiens
actcctaggaaaatac

SEQ ID NO: 3536397 - DNA, 13 bp, Homo sapiens
actcctcccttcc

SEQ ID NO: 3536398 - DNA, 22 bp, Homo sapiens
actcctcccttccccactctgc

SEQ ID NO: 3536399 - DNA, 19 bp, Homo sapiens
actggggatcccgtgctgg

SEQ ID NO: 3536400 - DNA, 23 bp, Homo sapiens
actggggatcccgtgctggaaga

SEQ ID NO: 3536401 - DNA, 13 bp, Homo sapiens
actggggcctcca

SEQ ID NO: 3536402 - DNA, 14 bp, Homo sapiens
acttaattgctaca

SEQ ID NO: 3536403 - DNA, 16 bp, Homo sapiens
acttagatctgagccc

SEQ ID NO: 3536404 - DNA, 22 bp, Homo sapiens
acttgctgcagtatgaaaataa

SEQ ID NO: 3536405 - DNA, 15 bp, Homo sapiens
acttgggtcttccct

SEQ ID NO: 3536406 - DNA, 20 bp, Homo sapiens
acttgtgattatttattatt

SEQ ID NO: 3536407 - DNA, 14 bp, Homo sapiens
actttcccttcccc

SEQ ID NO: 3536408 - DNA, 15 bp, Homo sapiens
actttctagattaag

SEQ ID NO: 3536409 - DNA, 18 bp, Homo sapiens
actttggaagtttgtgtt

SEQ ID NO: 3536410 - DNA, 21 bp, Homo sapiens
actttggaagtttgtgttctg

SEQ ID NO: 3536411 - DNA, 14 bp, Homo sapiens
agaactcactgggg

SEQ ID NO: 3536412 - DNA, 19 bp, Homo sapiens
agaagcaaaggcaggaggt

SEQ ID NO: 3536413 - DNA, 15 bp, Homo sapiens
ggcatctgacacaaa

SEQ ID NO: 3536414 - DNA, 20 bp, Homo sapiens
ggcctacagctttgatccct

SEQ ID NO: 3536415 - DNA, 23 bp, Homo sapiens
ggcctacagctttgatccctgac

SEQ ID NO: 3536416 - DNA, 16 bp, Homo sapiens
ggctggggatggccga

SEQ ID NO: 3536417 - DNA, 14 bp, Homo sapiens
ggctgtgggtgggg

SEQ ID NO: 3536418 - DNA, 13 bp, Homo sapiens
gggcccagagaga

SEQ ID NO: 3536419 - DNA, 14 bp, Homo sapiens
gggcctccagaact

SEQ ID NO: 3536420 - DNA, 23 bp, Homo sapiens
ggggcctacagctttgatccctg

SEQ ID NO: 3536421 - DNA, 22 bp, Homo sapiens
gggggtttgttgcacagtccct

SEQ ID NO: 3536422 - DNA, 17 bp, Homo sapiens
ggtagaggatgaggaaa

SEQ ID NO: 3536423 - DNA, 16 bp, Homo sapiens
ggtgcttgctgtgtga

SEQ ID NO: 3536424 - DNA, 15 bp, Homo sapiens
ggttcatcagtgtta

SEQ ID NO: 3536425 - DNA, 22 bp, Homo sapiens
ggttcatcagtgttaaaaaatt

SEQ ID NO: 3536426 - DNA, 15 bp, Homo sapiens
gtaacaagaaaacat

SEQ ID NO: 3536427 - DNA, 17 bp, Homo sapiens
gtagccccctggcctct

SEQ ID NO: 3536428 - DNA, 14 bp, Homo sapiens
gtaggagctgcctt

SEQ ID NO: 3536429 - DNA, 22 bp, Homo sapiens
gtaggagctgccttggctcaga

SEQ ID NO: 3536430 - DNA, 16 bp, Homo sapiens
gtatagactcctgaaa

SEQ ID NO: 3536431 - DNA, 15 bp, Homo sapiens
gtatgaatgcagtgg

SEQ ID NO: 3536432 - DNA, 16 bp, Homo sapiens
gtcaacctgaattaaa

SEQ ID NO: 3536433 - DNA, 18 bp, Homo sapiens
gtcaacctgaattaaagt

SEQ ID NO: 3536434 - DNA, 20 bp, Homo sapiens
gtcatgcgtccactttccct

SEQ ID NO: 3536435 - DNA, 15 bp, Homo sapiens
gtcatgtttaagaaa

SEQ ID NO: 3536436 - DNA, 14 bp, Homo sapiens
gtccaactactaaa

SEQ ID NO: 3536437 - DNA, 14 bp, Homo sapiens
gtccaatttctatt

SEQ ID NO: 3536438 - DNA, 19 bp, Homo sapiens
gtccaatttctattaaagg

SEQ ID NO: 3536439 - DNA, 22 bp, Homo sapiens
gtccaatttctattaaaggttc

SEQ ID NO: 3536440 - DNA, 15 bp, Homo sapiens
gtccctcctgttgcc

SEQ ID NO: 3536441 - DNA, 19 bp, Homo sapiens
gtccctcctgttgccacac

SEQ ID NO: 3536442 - DNA, 15 bp, Homo sapiens
gtctacactgccttt

SEQ ID NO: 3536443 - DNA, 21 bp, Homo sapiens
gtctgttccccatggccactt

SEQ ID NO: 3536444 - DNA, 17 bp, Homo sapiens
gtctgtttataaacatt

SEQ ID NO: 3536445 - DNA, 14 bp, Homo sapiens
gtcttatttcctca

SEQ ID NO: 3536446 - DNA, 10 bp, Homo sapiens
gtgactcctc

SEQ ID NO: 3536447 - DNA, 13 bp, Homo sapiens
gtgactcctccct

SEQ ID NO: 3536448 - DNA, 23 bp, Homo sapiens
gtgaggacaaggtacaggcaagg

SEQ ID NO: 3536449 - DNA, 12 bp, Homo sapiens
gtgcagctggga

SEQ ID NO: 3536450 - DNA, 14 bp, Homo sapiens
gtgcttgctgtgtg

SEQ ID NO: 3536451 - DNA, 16 bp, Homo sapiens
gttcatcagtgttaaa

SEQ ID NO: 3536452 - DNA, 16 bp, Homo sapiens
gttcatccattctatt

SEQ ID NO: 3536453 - DNA, 14 bp, Homo sapiens
gttcctttgttccc

SEQ ID NO: 3536454 - DNA, 12 bp, Homo sapiens
gttctggccaga

SEQ ID NO: 3536455 - DNA, 16 bp, Homo sapiens
gttctggccagaatgc

SEQ ID NO: 3536456 - DNA, 15 bp, Homo sapiens
gttgcacagtccctc

SEQ ID NO: 3536457 - DNA, 19 bp, Homo sapiens
gtttccagacttccttgag

SEQ ID NO: 3536458 - DNA, 13 bp, Homo sapiens
gtttgttaaaact

SEQ ID NO: 3536459 - DNA, 17 bp, Homo sapiens
gtttgttaaaactggca

SEQ ID NO: 3536460 - DNA, 17 bp, Homo sapiens
gttttggtggttttagt

SEQ ID NO: 3536461 - DNA, 16 bp, Homo sapiens
taaaaagtcaatgttt

SEQ ID NO: 3536462 - DNA, 15 bp, Homo sapiens
taaagaacataaata

SEQ ID NO: 3536463 - DNA, 16 bp, Homo sapiens
taaaggttcctttgtt

SEQ ID NO: 3536464 - DNA, 19 bp, Homo sapiens
taaaggttcctttgttccc

SEQ ID NO: 3536465 - DNA, 14 bp, Homo sapiens
taaagtttgcttag

SEQ ID NO: 3536466 - DNA, 14 bp, Homo sapiens
taagaattcaaact

SEQ ID NO: 3536467 - DNA, 14 bp, Homo sapiens
taagctgaaaatat

SEQ ID NO: 3536468 - DNA, 17 bp, Homo sapiens
taagtccaactactaaa

SEQ ID NO: 3536469 - DNA, 15 bp, Homo sapiens
taagtgagagagaca

SEQ ID NO: 3536470 - DNA, 23 bp, Homo sapiens
taataaaaaacatttattttcat

SEQ ID NO: 3536471 - DNA, 16 bp, Homo sapiens
taatattcctcagttc

SEQ ID NO: 3536472 - DNA, 20 bp, Homo sapiens
taatcattcttatttcatga

SEQ ID NO: 3536473 - DNA, 20 bp, Homo sapiens
taatgttgtatgtcttgttt

SEQ ID NO: 3536474 - DNA, 22 bp, Homo sapiens
tacagatgaatgtatttatttg

SEQ ID NO: 3536475 - DNA, 13 bp, Homo sapiens
tacagttaagttt

SEQ ID NO: 3536476 - DNA, 18 bp, Homo sapiens
tacatgaattgcatttta

SEQ ID NO: 3536477 - DNA, 20 bp, Homo sapiens
tacatttatagttgtaacta

SEQ ID NO: 3536478 - DNA, 21 bp, Homo sapiens
tacatttcacctactttgtaa

SEQ ID NO: 3536479 - DNA, 21 bp, Homo sapiens
taccaagtttcaggtattaag

SEQ ID NO: 3536480 - DNA, 22 bp, Homo sapiens
tacccaaggtcacatagctggg

SEQ ID NO: 3536481 - DNA, 18 bp, Homo sapiens
taccttgagaccctcttc

SEQ ID NO: 3536482 - DNA, 20 bp, Homo sapiens
taccttgagaccctcttctc

SEQ ID NO: 3536483 - DNA, 17 bp, Homo sapiens
tactactgaatctctaa

SEQ ID NO: 3536484 - DNA, 20 bp, Homo sapiens
tactcactttctagattaag

SEQ ID NO: 3536485 - DNA, 14 bp, Homo sapiens
tactcagaattaag

SEQ ID NO: 3536486 - DNA, 22 bp, Homo sapiens
tactttgtaagtgagagagaca

SEQ ID NO: 3536487 - DNA, 13 bp, Homo sapiens
tagatctgagccc

SEQ ID NO: 3536488 - DNA, 18 bp, Homo sapiens
tagatctgagccctccct

SEQ ID NO: 3536489 - DNA, 16 bp, Homo sapiens
tagccccctggcctct

SEQ ID NO: 3536490 - DNA, 18 bp, Homo sapiens
taggagctgccttggctc

SEQ ID NO: 3536491 - DNA, 23 bp, Homo sapiens
taggagctgccttggctcagaca

SEQ ID NO: 3536492 - DNA, 22 bp, Homo sapiens
tagggctttgtaaactccacag

SEQ ID NO: 3536493 - DNA, 23 bp, Homo sapiens
tagtccagctttgttcttcttaa

SEQ ID NO: 3536494 - DNA, 22 bp, Homo sapiens
tagttagccaatatttttctta

SEQ ID NO: 3536495 - DNA, 19 bp, Homo sapiens
tagttcagacactttggaa

SEQ ID NO: 3536496 - DNA, 17 bp, Homo sapiens
tatactcactttctaga

SEQ ID NO: 3536497 - DNA, 12 bp, Homo sapiens
tatatcttgttt

SEQ ID NO: 3536498 - DNA, 22 bp, Homo sapiens
tatcctgggggacccaatgtag

SEQ ID NO: 3536499 - DNA, 22 bp, Homo sapiens
tatctagtttaattaatctgta

SEQ ID NO: 3536500 - DNA, 16 bp, Homo sapiens
tatgcctctgtattta

SEQ ID NO: 3536501 - DNA, 15 bp, Homo sapiens
tattctacatttcac

SEQ ID NO: 3536502 - DNA, 21 bp, Homo sapiens
tatttatctgattaagttgtc

SEQ ID NO: 3536503 - DNA, 14 bp, Homo sapiens
tatttattatttat

SEQ ID NO: 3536504 - DNA, 17 bp, Homo sapiens
tatttcatgaaaattgt

SEQ ID NO: 3536505 - DNA, 20 bp, Homo sapiens
tatttttcatgattttgaaa

SEQ ID NO: 3536506 - DNA, 24 bp, Homo sapiens
tcaaaattagtgctttttgtgtca

SEQ ID NO: 3536507 - DNA, 22 bp, Homo sapiens
tcaaacagtacactatcttaat

SEQ ID NO: 3536508 - DNA, 14 bp, Homo sapiens
tcaaactggggcct

SEQ ID NO: 3536509 - DNA, 17 bp, Homo sapiens
tcaacctcttctggctc

SEQ ID NO: 3536510 - DNA, 19 bp, Homo sapiens
tcaacctcttctggctcaa

SEQ ID NO: 3536511 - DNA, 16 bp, Homo sapiens
tcaacctgaattaaag

SEQ ID NO: 3536512 - DNA, 19 bp, Homo sapiens
tcaacctgaattaaagtct

SEQ ID NO: 3536513 - DNA, 15 bp, Homo sapiens
tcaatgttttcagtt

SEQ ID NO: 3536514 - DNA, 22 bp, Homo sapiens
tcacaagggcaaactttttcct

SEQ ID NO: 3536515 - DNA, 14 bp, Homo sapiens
tcacatagctggga

SEQ ID NO: 3536516 - DNA, 15 bp, Homo sapiens
tcactcattgctgag

SEQ ID NO: 3536517 - DNA, 17 bp, Homo sapiens
tcactcattgctgagcc

SEQ ID NO: 3536518 - DNA, 22 bp, Homo sapiens
tcactcattgctgagcctctgc

SEQ ID NO: 3536519 - DNA, 16 bp, Homo sapiens
tcacttaattgctaca

SEQ ID NO: 3536520 - DNA, 22 bp, Homo sapiens
tcagacaccctcaacctcttct

SEQ ID NO: 3536521 - DNA, 18 bp, Homo sapiens
tcataagatatttttcat

SEQ ID NO: 3536522 - DNA, 22 bp, Homo sapiens
tcatcatgtatcgcttcatgta

SEQ ID NO: 3536523 - DNA, 11 bp, Homo sapiens
tcatgaaaatt

SEQ ID NO: 3536524 - DNA, 18 bp, Homo sapiens
tcatgtaagctgaaaata

SEQ ID NO: 3536525 - DNA, 19 bp, Homo sapiens
tcatgtaagctgaaaatat

SEQ ID NO: 3536526 - DNA, 20 bp, Homo sapiens
tcatgtgtacaaaagtttca

SEQ ID NO: 3536527 - DNA, 16 bp, Homo sapiens
tcatgtttaagaaatt

SEQ ID NO: 3536528 - DNA, 14 bp, Homo sapiens
tcattcttatttca

SEQ ID NO: 3536529 - DNA, 18 bp, Homo sapiens
tcattcttatttcatgaa

SEQ ID NO: 3536530 - DNA, 17 bp, Homo sapiens
tcattgctgagcctctg

SEQ ID NO: 3536531 - DNA, 22 bp, Homo sapiens
tcattgctgagcctctgctccc

SEQ ID NO: 3536532 - DNA, 13 bp, Homo sapiens
tccaactactaaa

SEQ ID NO: 3536533 - DNA, 18 bp, Homo sapiens
tccactttcccttcccct

SEQ ID NO: 3536534 - DNA, 21 bp, Homo sapiens
tccagctttgttcttcttaaa

SEQ ID NO: 3536535 - DNA, 23 bp, Homo sapiens
tccaggatcctcctggagcagca

SEQ ID NO: 3536536 - DNA, 12 bp, Homo sapiens
tccatataaata

SEQ ID NO: 3536537 - DNA, 16 bp, Homo sapiens
tcccacctgtcaacct

SEQ ID NO: 3536538 - DNA, 18 bp, Homo sapiens
tccccaacatgtaataag

SEQ ID NO: 3536539 - DNA, 16 bp, Homo sapiens
tccccaccttccaagg

SEQ ID NO: 3536540 - DNA, 16 bp, Homo sapiens
tccccatggagccagc

SEQ ID NO: 3536541 - DNA, 17 bp, Homo sapiens
tcccccaccattccaca

SEQ ID NO: 3536542 - DNA, 12 bp, Homo sapiens
tcccccagcctc

SEQ ID NO: 3536543 - DNA, 14 bp, Homo sapiens
tcccgtgctggaag

SEQ ID NO: 3536544 - DNA, 21 bp, Homo sapiens
tccctaagtccaactactaaa

SEQ ID NO: 3536545 - DNA, 13 bp, Homo sapiens
tccctcttcccag

SEQ ID NO: 3536546 - DNA, 14 bp, Homo sapiens
tccctcttcccagc

SEQ ID NO: 3536547 - DNA, 16 bp, Homo sapiens
tccctcttcccagcac

SEQ ID NO: 3536548 - DNA, 16 bp, Homo sapiens
atgtttgcacttgtga

SEQ ID NO: 3536549 - DNA, 16 bp, Homo sapiens
atgttttgacattttt

SEQ ID NO: 3536550 - DNA, 22 bp, Homo sapiens
atgttttttaaaatatttatct

SEQ ID NO: 3536551 - DNA, 17 bp, Homo sapiens
attaaaggttcctttgt

SEQ ID NO: 3536552 - DNA, 17 bp, Homo sapiens
attaaagtctacactgc

SEQ ID NO: 3536553 - DNA, 24 bp, Homo sapiens
attaagtctgtgagattcattcat

SEQ ID NO: 3536554 - DNA, 13 bp, Homo sapiens
attaccccctcct

SEQ ID NO: 3536555 - DNA, 17 bp, Homo sapiens
attcaaactggggcctc

SEQ ID NO: 3536556 - DNA, 19 bp, Homo sapiens
attcaaactggggcctcca

SEQ ID NO: 3536557 - DNA, 22 bp, Homo sapiens
attcctgtggatgtaaagtgat

SEQ ID NO: 3536558 - DNA, 14 bp, Homo sapiens
attctgcctaataa

SEQ ID NO: 3536559 - DNA, 19 bp, Homo sapiens
attgatcggagcctcctct

SEQ ID NO: 3536560 - DNA, 21 bp, Homo sapiens
attgatgataatacccacatt

SEQ ID NO: 3536561 - DNA, 14 bp, Homo sapiens
attgctgagcctct

SEQ ID NO: 3536562 - DNA, 20 bp, Homo sapiens
attgtggggatgatgaaata

SEQ ID NO: 3536563 - DNA, 13 bp, Homo sapiens
atttaactgcctt

SEQ ID NO: 3536564 - DNA, 21 bp, Homo sapiens
atttacatgaattgcatttta

SEQ ID NO: 3536565 - DNA, 13 bp, Homo sapiens
atttatgtttgca

SEQ ID NO: 3536566 - DNA, 13 bp, Homo sapiens
atttattatttat

SEQ ID NO: 3536567 - DNA, 23 bp, Homo sapiens
atttatttacagatgaatgtatt

SEQ ID NO: 3536568 - DNA, 17 bp, Homo sapiens
atttcaaggtccgagct

SEQ ID NO: 3536569 - DNA, 21 bp, Homo sapiens
atttcgtctgtttataaacat

SEQ ID NO: 3536570 - DNA, 20 bp, Homo sapiens
atttgaaccaggccttctga

SEQ ID NO: 3536571 - DNA, 22 bp, Homo sapiens
atttgcagctgagagaaaataa

SEQ ID NO: 3536572 - DNA, 19 bp, Homo sapiens
atttttcatgattttgaaa

SEQ ID NO: 3536573 - DNA, 20 bp, Homo sapiens
caaaaaaagttgaaggcctt

SEQ ID NO: 3536574 - DNA, 14 bp, Homo sapiens
caaacgcctcccct

SEQ ID NO: 3536575 - DNA, 16 bp, Homo sapiens
caaactggggcctcca

SEQ ID NO: 3536576 - DNA, 19 bp, Homo sapiens
caaactggggcctccagaa

SEQ ID NO: 3536577 - DNA, 16 bp, Homo sapiens
caaagcaataatagta

SEQ ID NO: 3536578 - DNA, 21 bp, Homo sapiens
caaccactaagaattcaaact

SEQ ID NO: 3536579 - DNA, 18 bp, Homo sapiens
caacctcttctggctcaa

SEQ ID NO: 3536580 - DNA, 15 bp, Homo sapiens
caacctgaattaaag

SEQ ID NO: 3536581 - DNA, 16 bp, Homo sapiens
caacctgaattaaagt

SEQ ID NO: 3536582 - DNA, 20 bp, Homo sapiens
caacctgaattaaagtctac

SEQ ID NO: 3536583 - DNA, 18 bp, Homo sapiens
caagaccaaaatgacaat

SEQ ID NO: 3536584 - DNA, 17 bp, Homo sapiens
caaggtcacatagctgg

SEQ ID NO: 3536585 - DNA, 22 bp, Homo sapiens
caagtcccttgacctttccagc

SEQ ID NO: 3536586 - DNA, 12 bp, Homo sapiens
caagtggacctt

SEQ ID NO: 3536587 - DNA, 13 bp, Homo sapiens
caatgttcatcat

SEQ ID NO: 3536588 - DNA, 16 bp, Homo sapiens
caatttctattaaagg

SEQ ID NO: 3536589 - DNA, 14 bp, Homo sapiens
cacagtccctcctg

SEQ ID NO: 3536590 - DNA, 17 bp, Homo sapiens
cacagtccctcctgttg

SEQ ID NO: 3536591 - DNA, 21 bp, Homo sapiens
caccattccacatccccacct

SEQ ID NO: 3536592 - DNA, 13 bp, Homo sapiens
caccttccaagga

SEQ ID NO: 3536593 - DNA, 19 bp, Homo sapiens
cacggagcccagccctccc

SEQ ID NO: 3536594 - DNA, 19 bp, Homo sapiens
cactcattgctgagcctct

SEQ ID NO: 3536595 - DNA, 22 bp, Homo sapiens
cactctgctcccagcccctacc

SEQ ID NO: 3536596 - DNA, 20 bp, Homo sapiens
cactggggatcccgtgctgg

SEQ ID NO: 3536597 - DNA, 15 bp, Homo sapiens
cactttcccttcccc

SEQ ID NO: 3536598 - DNA, 20 bp, Homo sapiens
cactttggaagtttgtgttc

SEQ ID NO: 3536599 - DNA, 14 bp, Homo sapiens
cagacactttggaa

SEQ ID NO: 3536600 - DNA, 22 bp, Homo sapiens
cagacatgttttccgtgaaaac

SEQ ID NO: 3536601 - DNA, 19 bp, Homo sapiens
cagatgaatgtatttattt

SEQ ID NO: 3536602 - DNA, 17 bp, Homo sapiens
cagcctatatttcctct

SEQ ID NO: 3536603 - DNA, 15 bp, Homo sapiens
cagctgaggccccag

SEQ ID NO: 3536604 - DNA, 20 bp, Homo sapiens
cagctttgatccctgacatc

SEQ ID NO: 3536605 - DNA, 16 bp, Homo sapiens
caggaatgtgtggcct

SEQ ID NO: 3536606 - DNA, 17 bp, Homo sapiens
caggaatgtgtggcctg

SEQ ID NO: 3536607 - DNA, 15 bp, Homo sapiens
caggatcctcctgga

SEQ ID NO: 3536608 - DNA, 12 bp, Homo sapiens
cagggctgtggg

SEQ ID NO: 3536609 - DNA, 17 bp, Homo sapiens
cagggctgtgggtgggg

SEQ ID NO: 3536610 - DNA, 21 bp, Homo sapiens
cagtcatgcgtccactttccc

SEQ ID NO: 3536611 - DNA, 17 bp, Homo sapiens
cataagatatttttcat

SEQ ID NO: 3536612 - DNA, 14 bp, Homo sapiens
catattgtgtgtaa

SEQ ID NO: 3536613 - DNA, 16 bp, Homo sapiens
catccaaccttcccaa

SEQ ID NO: 3536614 - DNA, 15 bp, Homo sapiens
catctgacacaaaaa

SEQ ID NO: 3536615 - DNA, 16 bp, Homo sapiens
catctgacacaaaaaa

SEQ ID NO: 3536616 - DNA, 17 bp, Homo sapiens
catctggattctgccta

SEQ ID NO: 3536617 - DNA, 18 bp, Homo sapiens
catgaagagatttttcat

SEQ ID NO: 3536618 - DNA, 23 bp, Homo sapiens
catgcgtccactttcccttcccc

SEQ ID NO: 3536619 - DNA, 20 bp, Homo sapiens
catgtagccccctggcctct

SEQ ID NO: 3536620 - DNA, 14 bp, Homo sapiens
catgttttccgtga

SEQ ID NO: 3536621 - DNA, 16 bp, Homo sapiens
cattgctgagcctctg

SEQ ID NO: 3536622 - DNA, 18 bp, Homo sapiens
cattgctgagcctctgct

SEQ ID NO: 3536623 - DNA, 12 bp, Homo sapiens
ccaaccttccca

SEQ ID NO: 3536624 - DNA, 17 bp, Homo sapiens
ccaatgtaggagctgcc

SEQ ID NO: 3536625 - DNA, 20 bp, Homo sapiens
ccaatttctattaaaggttc

SEQ ID NO: 3536626 - DNA, 18 bp, Homo sapiens
ccacactttcactgggga

SEQ ID NO: 3536627 - DNA, 23 bp, Homo sapiens
ccacatccccaccttccaaggaa

SEQ ID NO: 3536628 - DNA, 17 bp, Homo sapiens
ccaccattccacatccc

SEQ ID NO: 3536629 - DNA, 21 bp, Homo sapiens
ccactaagaattcaaactggg

SEQ ID NO: 3536630 - DNA, 20 bp, Homo sapiens
ccactttcccttcccctgtg

SEQ ID NO: 3536631 - DNA, 19 bp, Homo sapiens
ccagaactcactggggcct

SEQ ID NO: 3536632 - DNA, 13 bp, Homo sapiens
ccagacttccttg

SEQ ID NO: 3536633 - DNA, 19 bp, Homo sapiens
ccagagagaggcgtcctgg

SEQ ID NO: 3536634 - DNA, 14 bp, Homo sapiens
ccagccctccccat

SEQ ID NO: 3536635 - DNA, 14 bp, Homo sapiens
ccagctccctctat

SEQ ID NO: 3536636 - DNA, 16 bp, Homo sapiens
ccaggccctagaccct

SEQ ID NO: 3536637 - DNA, 14 bp, Homo sapiens
ccagggctgtgggt

SEQ ID NO: 3536638 - DNA, 18 bp, Homo sapiens
ccatgaagagatttttca

SEQ ID NO: 3536639 - DNA, 14 bp, Homo sapiens
ccatggagccagct

SEQ ID NO: 3536640 - DNA, 22 bp, Homo sapiens
ccatgtagccccctggcctctg

SEQ ID NO: 3536641 - DNA, 15 bp, Homo sapiens
ccattccacatcccc

SEQ ID NO: 3536642 - DNA, 11 bp, Homo sapiens
ccatttttcct

SEQ ID NO: 3536643 - DNA, 18 bp, Homo sapiens
cccaccattccacatccc

SEQ ID NO: 3536644 - DNA, 14 bp, Homo sapiens
cccacctgtcaacc

SEQ ID NO: 3536645 - DNA, 13 bp, Homo sapiens
cccactctgctcc

SEQ ID NO: 3536646 - DNA, 18 bp, Homo sapiens
cccactctgctcccagcc

SEQ ID NO: 3536647 - DNA, 19 bp, Homo sapiens
cccagggctgtgggtgggg

SEQ ID NO: 3536648 - DNA, 15 bp, Homo sapiens
cccatgtagccccct

SEQ ID NO: 3536649 - DNA, 14 bp, Homo sapiens
ccccaccttccaag

SEQ ID NO: 3536650 - DNA, 16 bp, Homo sapiens
ccccagggctgtgggt

SEQ ID NO: 3536651 - DNA, 16 bp, Homo sapiens
cccccaccattccaca

SEQ ID NO: 3536652 - DNA, 22 bp, Homo sapiens
ccccctggcctctgtgccttct

SEQ ID NO: 3536653 - DNA, 13 bp, Homo sapiens
cccctccttcaga

SEQ ID NO: 3536654 - DNA, 12 bp, Homo sapiens
cccctggcctct

SEQ ID NO: 3536655 - DNA, 19 bp, Homo sapiens
cccctgtgactcctccctt

SEQ ID NO: 3536656 - DNA, 14 bp, Homo sapiens
ccctaagtccaact

SEQ ID NO: 3536657 - DNA, 14 bp, Homo sapiens
ccctccctcttccc

SEQ ID NO: 3536658 - DNA, 19 bp, Homo sapiens
ccctcctgttgccacactt

SEQ ID NO: 3536659 - DNA, 12 bp, Homo sapiens
ccctccttcaga

SEQ ID NO: 3536660 - DNA, 12 bp, Homo sapiens
ccctcttcccag

SEQ ID NO: 3536661 - DNA, 13 bp, Homo sapiens
ccctcttctctgg

SEQ ID NO: 3536662 - DNA, 13 bp, Homo sapiens
ccctggcctctgt

SEQ ID NO: 3536663 - DNA, 15 bp, Homo sapiens
ccctggcctctgtgc

SEQ ID NO: 3536664 - DNA, 15 bp, Homo sapiens
ccctgtgactcctcc

SEQ ID NO: 3536665 - DNA, 19 bp, Homo sapiens
cccttcccctgtgactcct

SEQ ID NO: 3536666 - DNA, 19 bp, Homo sapiens
ccgagctctgtcctctgtc

SEQ ID NO: 3536667 - DNA, 13 bp, Homo sapiens
cctaagtccaact

SEQ ID NO: 3536668 - DNA, 17 bp, Homo sapiens
cctatatttcctcttct

SEQ ID NO: 3536669 - DNA, 20 bp, Homo sapiens
cctcaacctcttctggctca

SEQ ID NO: 3536670 - DNA, 16 bp, Homo sapiens
cctccccatggagcca

SEQ ID NO: 3536671 - DNA, 16 bp, Homo sapiens
cctcccccaccattcc

SEQ ID NO: 3536672 - DNA, 14 bp, Homo sapiens
cctccctcttccca

SEQ ID NO: 3536673 - DNA, 22 bp, Homo sapiens
cctccctcttcccagcacaggc

SEQ ID NO: 3536674 - DNA, 17 bp, Homo sapiens
cctcccttccccactct

SEQ ID NO: 3536675 - DNA, 22 bp, Homo sapiens
cctcctggagcagcagctgagg

SEQ ID NO: 3536676 - DNA, 17 bp, Homo sapiens
cctcctgttgccacact

SEQ ID NO: 3536677 - DNA, 12 bp, Homo sapiens
cctccttcagac

SEQ ID NO: 3536678 - DNA, 15 bp, Homo sapiens
cctccttcagacacc

SEQ ID NO: 3536679 - DNA, 22 bp, Homo sapiens
cctccttcagacaccctcaacc

SEQ ID NO: 3536680 - DNA, 21 bp, Homo sapiens
cctctatttatgtttgcactt

SEQ ID NO: 3536681 - DNA, 13 bp, Homo sapiens
cctctgctcccca

SEQ ID NO: 3536682 - DNA, 13 bp, Homo sapiens
cctgaattaaagt

SEQ ID NO: 3536683 - DNA, 18 bp, Homo sapiens
tgtaactttctctatgaa

SEQ ID NO: 3536684 - DNA, 14 bp, Homo sapiens
tgtaagctgaaaat

SEQ ID NO: 3536685 - DNA, 17 bp, Homo sapiens
tgtagccccctggcctc

SEQ ID NO: 3536686 - DNA, 15 bp, Homo sapiens
tgtaggagctgcctt

SEQ ID NO: 3536687 - DNA, 22 bp, Homo sapiens
tgtaggagctgccttggctcag

SEQ ID NO: 3536688 - DNA, 23 bp, Homo sapiens
tgtatttccccaacatgtaataa

SEQ ID NO: 3536689 - DNA, 22 bp, Homo sapiens
tgtcaacctgaattaaagtcta

SEQ ID NO: 3536690 - DNA, 16 bp, Homo sapiens
tgtcactcattgctga

SEQ ID NO: 3536691 - DNA, 22 bp, Homo sapiens
tgtcactcattgctgagcctct

SEQ ID NO: 3536692 - DNA, 17 bp, Homo sapiens
tgtctaaacaatgctga

SEQ ID NO: 3536693 - DNA, 16 bp, Homo sapiens
tgtgccttcttttgat

SEQ ID NO: 3536694 - DNA, 11 bp, Homo sapiens
tgtggcctgca

SEQ ID NO: 3536695 - DNA, 12 bp, Homo sapiens
tgtgggtgggga

SEQ ID NO: 3536696 - DNA, 19 bp, Homo sapiens
tgttaaaaaatttttgaaa

SEQ ID NO: 3536697 - DNA, 19 bp, Homo sapiens
tgttaaaactggcatctga

SEQ ID NO: 3536698 - DNA, 20 bp, Homo sapiens
tgttcccatgtagccccctg

SEQ ID NO: 3536699 - DNA, 18 bp, Homo sapiens
tgttccccatggccactt

SEQ ID NO: 3536700 - DNA, 17 bp, Homo sapiens
tgttctgtttgttaaaa

SEQ ID NO: 3536701 - DNA, 21 bp, Homo sapiens
tgttctgtttgttaaaactgg

SEQ ID NO: 3536702 - DNA, 17 bp, Homo sapiens
tgttgccacactttcac

SEQ ID NO: 3536703 - DNA, 20 bp, Homo sapiens
tgtttccagacttccttgag

SEQ ID NO: 3536704 - DNA, 23 bp, Homo sapiens
tgtttccagacttccttgagaca

SEQ ID NO: 3536705 - DNA, 21 bp, Homo sapiens
tgtttgttaaaactggcatct

SEQ ID NO: 3536706 - DNA, 14 bp, Homo sapiens
ttaattattgtaca

SEQ ID NO: 3536707 - DNA, 13 bp, Homo sapiens
ttacattctgaat

SEQ ID NO: 3536708 - DNA, 14 bp, Homo sapiens
ttagatctgagccc

SEQ ID NO: 3536709 - DNA, 20 bp, Homo sapiens
ttattaccccctccttcaga

SEQ ID NO: 3536710 - DNA, 18 bp, Homo sapiens
ttatttttacattctgaa

SEQ ID NO: 3536711 - DNA, 15 bp, Homo sapiens
ttcatcagtgttaaa

SEQ ID NO: 3536712 - DNA, 16 bp, Homo sapiens
ttcatcagtgttaaaa

SEQ ID NO: 3536713 - DNA, 22 bp, Homo sapiens
ttcattcatgtcatgtgtacaa

SEQ ID NO: 3536714 - DNA, 15 bp, Homo sapiens
ttccacatccccacc

SEQ ID NO: 3536715 - DNA, 17 bp, Homo sapiens
ttcccatgtagccccct

SEQ ID NO: 3536716 - DNA, 20 bp, Homo sapiens
ttccccactctgctcccagc

SEQ ID NO: 3536717 - DNA, 22 bp, Homo sapiens
ttccccactctgctcccagccc

SEQ ID NO: 3536718 - DNA, 23 bp, Homo sapiens
ttcctcagttcatccattctatt

SEQ ID NO: 3536719 - DNA, 15 bp, Homo sapiens
ttcctctctccagat

SEQ ID NO: 3536720 - DNA, 21 bp, Homo sapiens
ttcctgtggatgtaaagtgat

SEQ ID NO: 3536721 - DNA, 11 bp, Homo sapiens
ttcctttgttc

SEQ ID NO: 3536722 - DNA, 22 bp, Homo sapiens
ttctacatttcacctactttgt

SEQ ID NO: 3536723 - DNA, 13 bp, Homo sapiens
ttctattaaaggt

SEQ ID NO: 3536724 - DNA, 14 bp, Homo sapiens
ttctgcctaataaa

SEQ ID NO: 3536725 - DNA, 17 bp, Homo sapiens
ttgaaccaggccttctg

SEQ ID NO: 3536726 - DNA, 13 bp, Homo sapiens
ttgaactgagccg

SEQ ID NO: 3536727 - DNA, 14 bp, Homo sapiens
ttgacacaagtgga

SEQ ID NO: 3536728 - DNA, 12 bp, Homo sapiens
ttgagcatctgg

SEQ ID NO: 3536729 - DNA, 18 bp, Homo sapiens
ttgcacagtccctcctgt

SEQ ID NO: 3536730 - DNA, 14 bp, Homo sapiens
ttgctgagcctctg

SEQ ID NO: 3536731 - DNA, 22 bp, Homo sapiens
ttgctgagcctctgctccccag

SEQ ID NO: 3536732 - DNA, 18 bp, Homo sapiens
ttgctgcagtatgaaaat

SEQ ID NO: 3536733 - DNA, 18 bp, Homo sapiens
ttggttcatcagtgttaa

SEQ ID NO: 3536734 - DNA, 17 bp, Homo sapiens
ttgtaacaagaaaacat

SEQ ID NO: 3536735 - DNA, 20 bp, Homo sapiens
ttgtgttctgtttgttaaaa

SEQ ID NO: 3536736 - DNA, 22 bp, Homo sapiens
ttgtgttctgtttgttaaaact

SEQ ID NO: 3536737 - DNA, 14 bp, Homo sapiens
ttgttcttcttaaa

SEQ ID NO: 3536738 - DNA, 13 bp, Homo sapiens
tttatctgattaa

SEQ ID NO: 3536739 - DNA, 23 bp, Homo sapiens
tttatgtttgcacttgtgattat

SEQ ID NO: 3536740 - DNA, 12 bp, Homo sapiens
tttattaccccc

SEQ ID NO: 3536741 - DNA, 14 bp, Homo sapiens
tttatttatttaca

SEQ ID NO: 3536742 - DNA, 17 bp, Homo sapiens
tttcacctactttgtaa

SEQ ID NO: 3536743 - DNA, 12 bp, Homo sapiens
tttcctcttctg

SEQ ID NO: 3536744 - DNA, 21 bp, Homo sapiens
tttctgggctgtctattctag

SEQ ID NO: 3536745 - DNA, 21 bp, Homo sapiens
tttgcacttgtgattatttat

SEQ ID NO: 3536746 - DNA, 13 bp, Homo sapiens
tttgctagttttt

SEQ ID NO: 3536747 - DNA, 15 bp, Homo sapiens
tttgttcttcttaaa

SEQ ID NO: 3536748 - DNA, 22 bp, Homo sapiens
tttgttgcacagtccctcctgt

SEQ ID NO: 3536749 - DNA, 18 bp, Homo sapiens
ttttaaatattttttctt

SEQ ID NO: 3536750 - DNA, 15 bp, Homo sapiens
ttttacattctgaat

SEQ ID NO: 3536751 - DNA, 18 bp, Homo sapiens
ttttagtgattttaataa

SEQ ID NO: 3536752 - DNA, 12 bp, Homo sapiens
ttttattaataa

SEQ ID NO: 3536753 - DNA, 19 bp, Homo sapiens
ttttattaataaacattct

SEQ ID NO: 3536754 - DNA, 12 bp, Homo sapiens
ttttgaaaaggc

SEQ ID NO: 3536755 - DNA, 11 bp, Homo sapiens
ttttgagaaag

SEQ ID NO: 3536756 - DNA, 16 bp, Homo sapiens
tttttaaaatatttat

SEQ ID NO: 3536757 - DNA, 15 bp, Homo sapiens
gccttcttttgatta

SEQ ID NO: 3536758 - DNA, 12 bp, Homo sapiens
gccttggctcag

SEQ ID NO: 3536759 - DNA, 19 bp, Homo sapiens
gccttggttcatcagtgtt

SEQ ID NO: 3536760 - DNA, 12 bp, Homo sapiens
gccttgtgtaca

SEQ ID NO: 3536761 - DNA, 18 bp, Homo sapiens
gcgtccactttcccttcc

SEQ ID NO: 3536762 - DNA, 19 bp, Homo sapiens
gctatgttttgacattttt

SEQ ID NO: 3536763 - DNA, 21 bp, Homo sapiens
gctcagacatgttttccgtga

SEQ ID NO: 3536764 - DNA, 15 bp, Homo sapiens
gctctgtcctctgtc

SEQ ID NO: 3536765 - DNA, 11 bp, Homo sapiens
gctgaaaatat

SEQ ID NO: 3536766 - DNA, 19 bp, Homo sapiens
gctgccttggctcagacat

SEQ ID NO: 3536767 - DNA, 18 bp, Homo sapiens
gctggaagacttagatct

SEQ ID NO: 3536768 - DNA, 14 bp, Homo sapiens
gctttgatccctga

SEQ ID NO: 3536769 - DNA, 15 bp, Homo sapiens
ggaatgtgtggcctg

SEQ ID NO: 3536770 - DNA, 19 bp, Homo sapiens
ggagatggaggaaagtgat

SEQ ID NO: 3536771 - DNA, 19 bp, Homo sapiens
ggagcccagccctccccat

SEQ ID NO: 3536772 - DNA, 17 bp, Homo sapiens
ggagctgccttggctca

SEQ ID NO: 3536773 - DNA, 18 bp, Homo sapiens
ggattctgcctaataaaa

SEQ ID NO: 3536774 - DNA, 14 bp, Homo sapiens
ggatttatttttcc

SEQ ID NO: 3536775 - DNA, 16 bp, Homo sapiens
agcctatatttcctct

SEQ ID NO: 3536776 - DNA, 18 bp, Homo sapiens
agcctatatttcctcttc

SEQ ID NO: 3536777 - DNA, 13 bp, Homo sapiens
agctctgcattat

SEQ ID NO: 3536778 - DNA, 16 bp, Homo sapiens
agctctgtcctctgtc

SEQ ID NO: 3536779 - DNA, 17 bp, Homo sapiens
agctgccttggctcaga

SEQ ID NO: 3536780 - DNA, 20 bp, Homo sapiens
aggaaggcgtgtccaggaga

SEQ ID NO: 3536781 - DNA, 21 bp, Homo sapiens
aggaaggcgtgtccaggagac

SEQ ID NO: 3536782 - DNA, 14 bp, Homo sapiens
aggacaaggtacag

SEQ ID NO: 3536783 - DNA, 18 bp, Homo sapiens
aggatcctcctggagcag

SEQ ID NO: 3536784 - DNA, 18 bp, Homo sapiens
aggccttcctctctccag

SEQ ID NO: 3536785 - DNA, 22 bp, Homo sapiens
agggtcggaacccaagcttaga

SEQ ID NO: 3536786 - DNA, 19 bp, Homo sapiens
aggtgggtgagcgggtggg

SEQ ID NO: 3536787 - DNA, 15 bp, Homo sapiens
agtaatttgtagatt

SEQ ID NO: 3536788 - DNA, 12 bp, Homo sapiens
agtatgaaaata

SEQ ID NO: 3536789 - DNA, 20 bp, Homo sapiens
agtcatgtaagctgaaaata

SEQ ID NO: 3536790 - DNA, 18 bp, Homo sapiens
agtctatcaatcaactta

SEQ ID NO: 3536791 - DNA, 18 bp, Homo sapiens
agtctgtgagattcattc

SEQ ID NO: 3536792 - DNA, 20 bp, Homo sapiens
agtggaccttaggccttcct

SEQ ID NO: 3536793 - DNA, 23 bp, Homo sapiens
agtggcaagaccaaaatgacaat

SEQ ID NO: 3536794 - DNA, 20 bp, Homo sapiens
agttaacacctttaaagtgt

SEQ ID NO: 3536795 - DNA, 19 bp, Homo sapiens
agttatgccgctagataca

SEQ ID NO: 3536796 - DNA, 13 bp, Homo sapiens
agttgtctaaaca

SEQ ID NO: 3536797 - DNA, 11 bp, Homo sapiens
agtttgcttag

SEQ ID NO: 3536798 - DNA, 13 bp, Homo sapiens
agtttgcttagaa

SEQ ID NO: 3536799 - DNA, 15 bp, Homo sapiens
ataaaaaacatttat

SEQ ID NO: 3536800 - DNA, 13 bp, Homo sapiens
ataaacattgtat

SEQ ID NO: 3536801 - DNA, 17 bp, Homo sapiens
ataagacggatttattt

SEQ ID NO: 3536802 - DNA, 19 bp, Homo sapiens
ataagagagccttggttca

SEQ ID NO: 3536803 - DNA, 18 bp, Homo sapiens
ataagatatttttcatga

SEQ ID NO: 3536804 - DNA, 18 bp, Homo sapiens
ataatatttttaatatat

SEQ ID NO: 3536805 - DNA, 22 bp, Homo sapiens
atagtcatgtaagctgaaaata

SEQ ID NO: 3536806 - DNA, 13 bp, Homo sapiens
atagttgtaacta

SEQ ID NO: 3536807 - DNA, 16 bp, Homo sapiens
atagttttattaataa

SEQ ID NO: 3536808 - DNA, 16 bp, Homo sapiens
atataaatattagaaa

SEQ ID NO: 3536809 - DNA, 15 bp, Homo sapiens
atatgggacattttt

SEQ ID NO: 3536810 - DNA, 21 bp, Homo sapiens
atatttacatgaattgcattt

SEQ ID NO: 3536811 - DNA, 17 bp, Homo sapiens
atatttcctcttctgta

SEQ ID NO: 3536812 - DNA, 19 bp, Homo sapiens
atcagtgttaaaaaatttt

SEQ ID NO: 3536813 - DNA, 18 bp, Homo sapiens
atcatgaagatatttttc

SEQ ID NO: 3536814 - DNA, 22 bp, Homo sapiens
atccctttattaccccctcctt

SEQ ID NO: 3536815 - DNA, 21 bp, Homo sapiens
atcctgggggacccaatgtag

SEQ ID NO: 3536816 - DNA, 15 bp, Homo sapiens
atcggagcctcctct

SEQ ID NO: 3536817 - DNA, 13 bp, Homo sapiens
atctgacacaaaa

SEQ ID NO: 3536818 - DNA, 20 bp, Homo sapiens
atctgagccctccctcttcc

SEQ ID NO: 3536819 - DNA, 22 bp, Homo sapiens
atctgagccctccctcttccca

SEQ ID NO: 3536820 - DNA, 16 bp, Homo sapiens
atgaagagatttttca

SEQ ID NO: 3536821 - DNA, 21 bp, Homo sapiens
atgaagggccttgagcatctg

SEQ ID NO: 3536822 - DNA, 15 bp, Homo sapiens
atgaatgtatttatt

SEQ ID NO: 3536823 - DNA, 20 bp, Homo sapiens
atgaatgtatttatttggga

SEQ ID NO: 3536824 - DNA, 14 bp, Homo sapiens
atgacaatgatgat

SEQ ID NO: 3536825 - DNA, 19 bp, Homo sapiens
atgacgacgacaacgatga

SEQ ID NO: 3536826 - DNA, 17 bp, Homo sapiens
atgatgacgacgacaac

SEQ ID NO: 3536827 - DNA, 17 bp, Homo sapiens
atgcttgtaacaagaaa

SEQ ID NO: 3536828 - DNA, 21 bp, Homo sapiens
atgcttgtaacaagaaaacat

SEQ ID NO: 3536829 - DNA, 11 bp, Homo sapiens
atggagccagc

SEQ ID NO: 3536830 - DNA, 15 bp, Homo sapiens
atggagccagctccc

SEQ ID NO: 3536831 - DNA, 15 bp, Homo sapiens
atgggcacctcatgg

SEQ ID NO: 3536832 - DNA, 19 bp, Homo sapiens
atgtaaagaacataaataa

SEQ ID NO: 3536833 - DNA, 14 bp, Homo sapiens
atgtaactagaatt

SEQ ID NO: 3536834 - DNA, 22 bp, Homo sapiens
atgtaataaggttgaacacttt

SEQ ID NO: 3536835 - DNA, 24 bp, Homo sapiens
atgtattcagctttagtagatatt

SEQ ID NO: 3536836 - DNA, 22 bp, Homo sapiens
attaaaggttcctttgttccct

SEQ ID NO: 3536837 - DNA, 16 bp, Homo sapiens
attaaagtctacactg

SEQ ID NO: 3536838 - DNA, 17 bp, Homo sapiens
attaatattcctcagtt

SEQ ID NO: 3536839 - DNA, 19 bp, Homo sapiens
attaccccctccttcagac

SEQ ID NO: 3536840 - DNA, 20 bp, Homo sapiens
attaccccctccttcagaca

SEQ ID NO: 3536841 - DNA, 21 bp, Homo sapiens
attaccccctccttcagacac

SEQ ID NO: 3536842 - DNA, 19 bp, Homo sapiens
attatatcaatttcctcat

SEQ ID NO: 3536843 - DNA, 16 bp, Homo sapiens
attatgttttttaaaa

SEQ ID NO: 3536844 - DNA, 20 bp, Homo sapiens
attatgttttttaaaatatt

SEQ ID NO: 3536845 - DNA, 13 bp, Homo sapiens
attatttattatt

SEQ ID NO: 3536846 - DNA, 15 bp, Homo sapiens
attctatctattcct

SEQ ID NO: 3536847 - DNA, 15 bp, Homo sapiens
attctgcctaataaa

SEQ ID NO: 3536848 - DNA, 21 bp, Homo sapiens
attgtggggatgatgaaataa

SEQ ID NO: 3536849 - DNA, 21 bp, Homo sapiens
attgttgtacacagaaataca

SEQ ID NO: 3536850 - DNA, 19 bp, Homo sapiens
atttacagatgaatgtatt

SEQ ID NO: 3536851 - DNA, 17 bp, Homo sapiens
atttattcatattttct

SEQ ID NO: 3536852 - DNA, 13 bp, Homo sapiens
atttatttattat

SEQ ID NO: 3536853 - DNA, 23 bp, Homo sapiens
atttcaaggtccgagctctgtcc

SEQ ID NO: 3536854 - DNA, 22 bp, Homo sapiens
atttccatataaatattagaaa

SEQ ID NO: 3536855 - DNA, 19 bp, Homo sapiens
atttcctaattttgagaaa

SEQ ID NO: 3536856 - DNA, 24 bp, Homo sapiens
atttcctcaacgttgctccccatc

SEQ ID NO: 3536857 - DNA, 15 bp, Homo sapiens
atttctattaaaggt

SEQ ID NO: 3536858 - DNA, 15 bp, Homo sapiens
atttgaactgagccg

SEQ ID NO: 3536859 - DNA, 21 bp, Homo sapiens
atttgcagctgagagaaaata

SEQ ID NO: 3536860 - DNA, 20 bp, Homo sapiens
attttgaaatcatgaagata

SEQ ID NO: 3536861 - DNA, 14 bp, Homo sapiens
attttgatgaacaa

SEQ ID NO: 3536862 - DNA, 17 bp, Homo sapiens
atttttacattctgaat

SEQ ID NO: 3536863 - DNA, 14 bp, Homo sapiens
atttttgaaaaggc

SEQ ID NO: 3536864 - DNA, 18 bp, Homo sapiens
caaaagtttcatcctttt

SEQ ID NO: 3536865 - DNA, 21 bp, Homo sapiens
caaactggggcctccagaact

SEQ ID NO: 3536866 - DNA, 17 bp, Homo sapiens
caaactggggcctccct

SEQ ID NO: 3536867 - DNA, 20 bp, Homo sapiens
caaaggcaggaggtgggtga

SEQ ID NO: 3536868 - DNA, 16 bp, Homo sapiens
caacctcttctggctc

SEQ ID NO: 3536869 - DNA, 18 bp, Homo sapiens
caacctgaattaaagtct

SEQ ID NO: 3536870 - DNA, 21 bp, Homo sapiens
caacctgaattaaagtctaca

SEQ ID NO: 3536871 - DNA, 11 bp, Homo sapiens
caactactaaa

SEQ ID NO: 3536872 - DNA, 15 bp, Homo sapiens
caaggtccgagctct

SEQ ID NO: 3536873 - DNA, 15 bp, Homo sapiens
caataggctgttccc

SEQ ID NO: 3536874 - DNA, 20 bp, Homo sapiens
caatccctttattaccccct

SEQ ID NO: 3536875 - DNA, 19 bp, Homo sapiens
caatgatgatgataatgat

SEQ ID NO: 3536876 - DNA, 19 bp, Homo sapiens
caatttctattaaaggttc

SEQ ID NO: 3536877 - DNA, 14 bp, Homo sapiens
cacactttcactgg

SEQ ID NO: 3536878 - DNA, 15 bp, Homo sapiens
cacaggcaggggtag

SEQ ID NO: 3536879 - DNA, 16 bp, Homo sapiens
cacaggcaggggtaga

SEQ ID NO: 3536880 - DNA, 22 bp, Homo sapiens
cacatagctgggatttgaactg

SEQ ID NO: 3536881 - DNA, 13 bp, Homo sapiens
cacatccccacct

SEQ ID NO: 3536882 - DNA, 14 bp, Homo sapiens
cacatccccacctt

SEQ ID NO: 3536883 - DNA, 17 bp, Homo sapiens
cacccagtctgttcccc

SEQ ID NO: 3536884 - DNA, 21 bp, Homo sapiens
cactcattgctgagcctctgc

SEQ ID NO: 3536885 - DNA, 16 bp, Homo sapiens
cactctgctcccagcc

SEQ ID NO: 3536886 - DNA, 17 bp, Homo sapiens
cactctgctcccagccc

SEQ ID NO: 3536887 - DNA, 14 bp, Homo sapiens
cactggggcctaca

SEQ ID NO: 3536888 - DNA, 16 bp, Homo sapiens
cactggggcctacagc

SEQ ID NO: 3536889 - DNA, 15 bp, Homo sapiens
cactgtgtatttaac

SEQ ID NO: 3536890 - DNA, 19 bp, Homo sapiens
cactttcccttcccctgtg

SEQ ID NO: 3536891 - DNA, 24 bp, Homo sapiens
cagacttccttgagacacggagcc

SEQ ID NO: 3536892 - DNA, 16 bp, Homo sapiens
cagagagaggcgtcct

SEQ ID NO: 3536893 - DNA, 20 bp, Homo sapiens
cagagagaggcgtcctggtg

SEQ ID NO: 3536894 - DNA, 21 bp, Homo sapiens
cagagagaggcgtcctggtga

SEQ ID NO: 3536895 - DNA, 23 bp, Homo sapiens
cagatgtttccagacttccttga

SEQ ID NO: 3536896 - DNA, 14 bp, Homo sapiens
cagcagctgaggcc

SEQ ID NO: 3536897 - DNA, 23 bp, Homo sapiens
cagcccctaccttgagaccctct

SEQ ID NO: 3536898 - DNA, 21 bp, Homo sapiens
cagccctccccatggagccag

SEQ ID NO: 3536899 - DNA, 18 bp, Homo sapiens
cagcctatatttcctctt

SEQ ID NO: 3536900 - DNA, 17 bp, Homo sapiens
cagctgagagaaaataa

SEQ ID NO: 3536901 - DNA, 16 bp, Homo sapiens
cagctgaggccccagg

SEQ ID NO: 3536902 - DNA, 17 bp, Homo sapiens
cagctgaggccccaggg

SEQ ID NO: 3536903 - DNA, 23 bp, Homo sapiens
caggaatgtgtggcctgcacagt

SEQ ID NO: 3536904 - DNA, 18 bp, Homo sapiens
caggatcctcctggagca

SEQ ID NO: 3536905 - DNA, 18 bp, Homo sapiens
caggatggttactgagga

SEQ ID NO: 3536906 - DNA, 13 bp, Homo sapiens
caggcccacagta

SEQ ID NO: 3536907 - DNA, 22 bp, Homo sapiens
cagggcctggggagatggagga

SEQ ID NO: 3536908 - DNA, 19 bp, Homo sapiens
cagggctgtgggtggggaa

SEQ ID NO: 3536909 - DNA, 17 bp, Homo sapiens
caggtatagactcctga

SEQ ID NO: 3536910 - DNA, 13 bp, Homo sapiens
cagtatgaaaata

SEQ ID NO: 3536911 - DNA, 20 bp, Homo sapiens
cagtcatgcgtccactttcc

SEQ ID NO: 3536912 - DNA, 17 bp, Homo sapiens
ctcctcccttccccact

SEQ ID NO: 3536913 - DNA, 13 bp, Homo sapiens
ctccttcagacac

SEQ ID NO: 3536914 - DNA, 14 bp, Homo sapiens
ctccttcagacacc

SEQ ID NO: 3536915 - DNA, 17 bp, Homo sapiens
ctctatttatgtttgca

SEQ ID NO: 3536916 - DNA, 20 bp, Homo sapiens
ctctccagatgtttccagac

SEQ ID NO: 3536917 - DNA, 14 bp, Homo sapiens
ctctctccagatgt

SEQ ID NO: 3536918 - DNA, 13 bp, Homo sapiens
ctctgctcccagc

SEQ ID NO: 3536919 - DNA, 14 bp, Homo sapiens
ctctgctcccagcc

SEQ ID NO: 3536920 - DNA, 12 bp, Homo sapiens
ctctgggcccag

SEQ ID NO: 3536921 - DNA, 20 bp, Homo sapiens
ctctgggcccagagagaggc

SEQ ID NO: 3536922 - DNA, 14 bp, Homo sapiens
caggatcctcctgg

SEQ ID NO: 3536923 - DNA, 21 bp, Homo sapiens
caggatggttactgaggacca

SEQ ID NO: 3536924 - DNA, 17 bp, Homo sapiens
caggccctagaccctcc

SEQ ID NO: 3536925 - DNA, 21 bp, Homo sapiens
caggccctagaccctccccca

SEQ ID NO: 3536926 - DNA, 22 bp, Homo sapiens
caggccttctgatttcaaggtc

SEQ ID NO: 3536927 - DNA, 14 bp, Homo sapiens
cagtccctcctgtt

SEQ ID NO: 3536928 - DNA, 23 bp, Homo sapiens
catagtcatgtaagctgaaaata

SEQ ID NO: 3536929 - DNA, 18 bp, Homo sapiens
catcagtgttaaaaaatt

SEQ ID NO: 3536930 - DNA, 22 bp, Homo sapiens
catcagtgttaaaaaatttttg

SEQ ID NO: 3536931 - DNA, 23 bp, Homo sapiens
catcccaaaatcataagatattt

SEQ ID NO: 3536932 - DNA, 11 bp, Homo sapiens
catccccacct

SEQ ID NO: 3536933 - DNA, 17 bp, Homo sapiens
catgaagatatttttcc

SEQ ID NO: 3536934 - DNA, 14 bp, Homo sapiens
catgctaattatat

SEQ ID NO: 3536935 - DNA, 18 bp, Homo sapiens
catggactccaggatcct

SEQ ID NO: 3536936 - DNA, 23 bp, Homo sapiens
catggactccaggatcctcctgg

SEQ ID NO: 3536937 - DNA, 10 bp, Homo sapiens
catggagcca

SEQ ID NO: 3536938 - DNA, 14 bp, Homo sapiens
catggagccagctc

SEQ ID NO: 3536939 - DNA, 17 bp, Homo sapiens
catggagccagctccct

SEQ ID NO: 3536940 - DNA, 22 bp, Homo sapiens
catggccacttgggtcttccct

SEQ ID NO: 3536941 - DNA, 17 bp, Homo sapiens
catgggcacctcatgga

SEQ ID NO: 3536942 - DNA, 17 bp, Homo sapiens
catgtaagctgaaaata

SEQ ID NO: 3536943 - DNA, 23 bp, Homo sapiens
catgtaagctgaaaatatggcaa

SEQ ID NO: 3536944 - DNA, 13 bp, Homo sapiens
catgtagccccct

SEQ ID NO: 3536945 - DNA, 17 bp, Homo sapiens
catgtagccccctggcc

SEQ ID NO: 3536946 - DNA, 18 bp, Homo sapiens
catgtagccccctggcct

SEQ ID NO: 3536947 - DNA, 22 bp, Homo sapiens
catgtagccccctggcctctgt

SEQ ID NO: 3536948 - DNA, 14 bp, Homo sapiens
cattgctgagcctc

SEQ ID NO: 3536949 - DNA, 13 bp, Homo sapiens
catttttgtattt

SEQ ID NO: 3536950 - DNA, 13 bp, Homo sapiens
ccaaacgcctccc

SEQ ID NO: 3536951 - DNA, 17 bp, Homo sapiens
ccaactactaaactggg

SEQ ID NO: 3536952 - DNA, 15 bp, Homo sapiens
ccaatgtaggagctg

SEQ ID NO: 3536953 - DNA, 20 bp, Homo sapiens
ccaatgtaggagctgccttg

SEQ ID NO: 3536954 - DNA, 18 bp, Homo sapiens
ccaatttctattaaaggt

SEQ ID NO: 3536955 - DNA, 22 bp, Homo sapiens
ccacagctttttaccaagtttc

SEQ ID NO: 3536956 - DNA, 17 bp, Homo sapiens
ccacatccccaccttcc

SEQ ID NO: 3536957 - DNA, 17 bp, Homo sapiens
ccacctgtcaacctgaa

SEQ ID NO: 3536958 - DNA, 13 bp, Homo sapiens
ccactctgctccc

SEQ ID NO: 3536959 - DNA, 15 bp, Homo sapiens
ccactctgctcccag

SEQ ID NO: 3536960 - DNA, 14 bp, Homo sapiens
ccagacttccttga

SEQ ID NO: 3536961 - DNA, 15 bp, Homo sapiens
ccagacttccttgag

SEQ ID NO: 3536962 - DNA, 22 bp, Homo sapiens
ccagagagaggcgtcctggtga

SEQ ID NO: 3536963 - DNA, 22 bp, Homo sapiens
ccagcccctaccttgagaccct

SEQ ID NO: 3536964 - DNA, 20 bp, Homo sapiens
ccagccctccccatggagcc

SEQ ID NO: 3536965 - DNA, 17 bp, Homo sapiens
ccagcctatatttcctc

SEQ ID NO: 3536966 - DNA, 15 bp, Homo sapiens
ccaggagaccttcca

SEQ ID NO: 3536967 - DNA, 15 bp, Homo sapiens
ccaggatcctcctgg

SEQ ID NO: 3536968 - DNA, 18 bp, Homo sapiens
ccaggccctagaccctcc

SEQ ID NO: 3536969 - DNA, 13 bp, Homo sapiens
ccagggagccttt

SEQ ID NO: 3536970 - DNA, 16 bp, Homo sapiens
ccaggggagttgtgtc

SEQ ID NO: 3536971 - DNA, 22 bp, Homo sapiens
ccatgaagagatttttcatgat

SEQ ID NO: 3536972 - DNA, 17 bp, Homo sapiens
ccatggagccagctccc

SEQ ID NO: 3536973 - DNA, 23 bp, Homo sapiens
ccatgtagccccctggcctctgt

SEQ ID NO: 3536974 - DNA, 16 bp, Homo sapiens
cccaaggtcacatagc

SEQ ID NO: 3536975 - DNA, 17 bp, Homo sapiens
cccaatccctttattac

SEQ ID NO: 3536976 - DNA, 16 bp, Homo sapiens
cccaatgtaggagctg

SEQ ID NO: 3536977 - DNA, 15 bp, Homo sapiens
cccacctgtcaacct

SEQ ID NO: 3536978 - DNA, 19 bp, Homo sapiens
cccacctgtcaacctgaat

SEQ ID NO: 3536979 - DNA, 19 bp, Homo sapiens
cccactctgctcccagccc

SEQ ID NO: 3536980 - DNA, 19 bp, Homo sapiens
cccagcccctaccttgaga

SEQ ID NO: 3536981 - DNA, 17 bp, Homo sapiens
cccaggccctagaccct

SEQ ID NO: 3536982 - DNA, 23 bp, Homo sapiens
cccaggccctagaccctccccca

SEQ ID NO: 3536983 - DNA, 13 bp, Homo sapiens
cccatggagccag

SEQ ID NO: 3536984 - DNA, 19 bp, Homo sapiens
cccatggagccagctccct

SEQ ID NO: 3536985 - DNA, 22 bp, Homo sapiens
cccatgtagccccctggcctct

SEQ ID NO: 3536986 - DNA, 19 bp, Homo sapiens
ccccaccattccacatccc

SEQ ID NO: 3536987 - DNA, 23 bp, Homo sapiens
cccctaatgacatcaccacagtt

SEQ ID NO: 3536988 - DNA, 14 bp, Homo sapiens
cccgtgctggaaga

SEQ ID NO: 3536989 - DNA, 20 bp, Homo sapiens
ccctaagtccaactactaaa

SEQ ID NO: 3536990 - DNA, 14 bp, Homo sapiens
ccctccccatggag

SEQ ID NO: 3536991 - DNA, 13 bp, Homo sapiens
ccctcctgttgcc

SEQ ID NO: 3536992 - DNA, 17 bp, Homo sapiens
ccctcctgttgccacac

SEQ ID NO: 3536993 - DNA, 18 bp, Homo sapiens
ccctcctgttgccacact

SEQ ID NO: 3536994 - DNA, 18 bp, Homo sapiens
ccctggcctctgtgcctt

SEQ ID NO: 3536995 - DNA, 17 bp, Homo sapiens
cccttccccactctgct

SEQ ID NO: 3536996 - DNA, 16 bp, Homo sapiens
cccttcccctgtgact

SEQ ID NO: 3536997 - DNA, 14 bp, Homo sapiens
ccgtgcagctggga

SEQ ID NO: 3536998 - DNA, 20 bp, Homo sapiens
cctacagctttgatccctga

SEQ ID NO: 3536999 - DNA, 21 bp, Homo sapiens
cctacagctttgatccctgac

SEQ ID NO: 3537000 - DNA, 19 bp, Homo sapiens
cctaccttgagaccctctt

SEQ ID NO: 3537001 - DNA, 15 bp, Homo sapiens
cctatatttcctctt

SEQ ID NO: 3537002 - DNA, 16 bp, Homo sapiens
cctatatttcctcttc

SEQ ID NO: 3537003 - DNA, 22 bp, Homo sapiens
cctccagaactcactggggcct

SEQ ID NO: 3537004 - DNA, 22 bp, Homo sapiens
cctcccccaccattccacatcc

SEQ ID NO: 3537005 - DNA, 15 bp, Homo sapiens
cctccctcttcccag

SEQ ID NO: 3537006 - DNA, 14 bp, Homo sapiens
cctctgctccccag

SEQ ID NO: 3537007 - DNA, 14 bp, Homo sapiens
cctctgtgccttct

SEQ ID NO: 3537008 - DNA, 21 bp, Homo sapiens
cctctgtgccttcttttgatt

SEQ ID NO: 3537009 - DNA, 22 bp, Homo sapiens
cctgaattaaagtctacactgc

SEQ ID NO: 3537010 - DNA, 14 bp, Homo sapiens
cctggagcagcagc

SEQ ID NO: 3537011 - DNA, 19 bp, Homo sapiens
cctggcttttctggctggg

SEQ ID NO: 3537012 - DNA, 21 bp, Homo sapiens
cctggcttttctggctgggga

SEQ ID NO: 3537013 - DNA, 20 bp, Homo sapiens
cctgtcaacctgaattaaag

SEQ ID NO: 3537014 - DNA, 13 bp, Homo sapiens
cctgtgactcctc

SEQ ID NO: 3537015 - DNA, 14 bp, Homo sapiens
ccttaggccttcct

SEQ ID NO: 3537016 - DNA, 10 bp, Homo sapiens
ccttcagaca

SEQ ID NO: 3537017 - DNA, 15 bp, Homo sapiens
ccttcccctgtgact

SEQ ID NO: 3537018 - DNA, 13 bp, Homo sapiens
ccttgagcatctg

SEQ ID NO: 3537019 - DNA, 14 bp, Homo sapiens
ccttgagcatctgg

SEQ ID NO: 3537020 - DNA, 19 bp, Homo sapiens
ccttgatggagatatttac

SEQ ID NO: 3537021 - DNA, 12 bp, Homo sapiens
ccttggctcaga

SEQ ID NO: 3537022 - DNA, 20 bp, Homo sapiens
cctttggttctggccagaat

SEQ ID NO: 3537023 - DNA, 20 bp, Homo sapiens
cgatgatgcttgtaacaaga

SEQ ID NO: 3537024 - DNA, 22 bp, Homo sapiens
cgatgatgcttgtaacaagaaa

SEQ ID NO: 3537025 - DNA, 15 bp, Homo sapiens
cgatggggcccacat

SEQ ID NO: 3537026 - DNA, 16 bp, Homo sapiens
cggatttatttttcca

SEQ ID NO: 3537027 - DNA, 20 bp, Homo sapiens
cgtccactttcccttcccct

SEQ ID NO: 3537028 - DNA, 22 bp, Homo sapiens
cgtccactttcccttcccctgt

SEQ ID NO: 3537029 - DNA, 19 bp, Homo sapiens
ctaagtccaactactaaac

SEQ ID NO: 3537030 - DNA, 21 bp, Homo sapiens
ctaccttgagaccctcttctc

SEQ ID NO: 3537031 - DNA, 14 bp, Homo sapiens
ctagaatttcttta

SEQ ID NO: 3537032 - DNA, 14 bp, Homo sapiens
ctagtgaatgaatc

SEQ ID NO: 3537033 - DNA, 21 bp, Homo sapiens
ctatagtccagctttgttctt

SEQ ID NO: 3537034 - DNA, 22 bp, Homo sapiens
ctatgtaggaaagaccattttt

SEQ ID NO: 3537035 - DNA, 19 bp, Homo sapiens
ctatgttttgacattttta

SEQ ID NO: 3537036 - DNA, 18 bp, Homo sapiens
ctcaacctcttctggctc

SEQ ID NO: 3537037 - DNA, 16 bp, Homo sapiens
ctcactggggcctaca

SEQ ID NO: 3537038 - DNA, 18 bp, Homo sapiens
ctcactggggcctacagc

SEQ ID NO: 3537039 - DNA, 14 bp, Homo sapiens
ctcatggactccag

SEQ ID NO: 3537040 - DNA, 23 bp, Homo sapiens
ctcatggactccaggatcctcct

SEQ ID NO: 3537041 - DNA, 18 bp, Homo sapiens
ctcattgctgagcctctg

SEQ ID NO: 3537042 - DNA, 19 bp, Homo sapiens
ctcattgctgagcctctgc

SEQ ID NO: 3537043 - DNA, 17 bp, Homo sapiens
ctccagatgtttccaga

SEQ ID NO: 3537044 - DNA, 12 bp, Homo sapiens
ctccccatggag

SEQ ID NO: 3537045 - DNA, 11 bp, Homo sapiens
ctcccccacca

SEQ ID NO: 3537046 - DNA, 18 bp, Homo sapiens
ctcccccaccattccaca

SEQ ID NO: 3537047 - DNA, 12 bp, Homo sapiens
ctcccttcccca

SEQ ID NO: 3537048 - DNA, 14 bp, Homo sapiens
ctcccttccccact

SEQ ID NO: 3537049 - DNA, 19 bp, Homo sapiens
ctcctcccttccccactct

SEQ ID NO: 3537050 - DNA, 14 bp, Homo sapiens
ctcctgttgccaca

SEQ ID NO: 3537051 - DNA, 16 bp, Homo sapiens
ctctatttatgtttgc

SEQ ID NO: 3537052 - DNA, 16 bp, Homo sapiens
ctctgctcccagcccc

SEQ ID NO: 3537053 - DNA, 16 bp, Homo sapiens
ctctgggcccagagag

SEQ ID NO: 3537054 - DNA, 13 bp, Homo sapiens
ctctgtcctctgt

SEQ ID NO: 3537055 - DNA, 14 bp, Homo sapiens
ctctgtcctctgtc

SEQ ID NO: 3537056 - DNA, 19 bp, Homo sapiens
ctctgtcctctgtcagtca

SEQ ID NO: 3537057 - DNA, 22 bp, Homo sapiens
ttgagacacggagcccagccct

SEQ ID NO: 3537058 - DNA, 16 bp, Homo sapiens
ttgagaccctcttctc

SEQ ID NO: 3537059 - DNA, 20 bp, Homo sapiens
ttgagaccctcttctctggg

SEQ ID NO: 3537060 - DNA, 19 bp, Homo sapiens
ttgatgataatacccacat

SEQ ID NO: 3537061 - DNA, 17 bp, Homo sapiens
ttgctcctaatgttgaa

SEQ ID NO: 3537062 - DNA, 13 bp, Homo sapiens
ttgctgtccaatt

SEQ ID NO: 3537063 - DNA, 22 bp, Homo sapiens
ttgctgtccaatttctattaaa

SEQ ID NO: 3537064 - DNA, 13 bp, Homo sapiens
ttggctcagacat

SEQ ID NO: 3537065 - DNA, 14 bp, Homo sapiens
ttgtctttgaacgt

SEQ ID NO: 3537066 - DNA, 17 bp, Homo sapiens
ttgtggggatgatgaaa

SEQ ID NO: 3537067 - DNA, 19 bp, Homo sapiens
ttgtgtcatgtttaagaaa

SEQ ID NO: 3537068 - DNA, 20 bp, Homo sapiens
ttgttaaaactggcatctga

SEQ ID NO: 3537069 - DNA, 15 bp, Homo sapiens
tttaaaaaccttgta

SEQ ID NO: 3537070 - DNA, 14 bp, Homo sapiens
tttaatgagataat

SEQ ID NO: 3537071 - DNA, 17 bp, Homo sapiens
tttacagatgaatgtat

SEQ ID NO: 3537072 - DNA, 23 bp, Homo sapiens
tttagtagatattaccagttttc

SEQ ID NO: 3537073 - DNA, 21 bp, Homo sapiens
tttattaataaacattctatc

SEQ ID NO: 3537074 - DNA, 17 bp, Homo sapiens
tttattaccccctcctt

SEQ ID NO: 3537075 - DNA, 16 bp, Homo sapiens
tttattatttatttat

SEQ ID NO: 3537076 - DNA, 19 bp, Homo sapiens
tttcctaagtgattgtatg

SEQ ID NO: 3537077 - DNA, 14 bp, Homo sapiens
tttctattaaaggt

SEQ ID NO: 3537078 - DNA, 16 bp, Homo sapiens
tttctattaaaggttc

SEQ ID NO: 3537079 - DNA, 15 bp, Homo sapiens
tttctggctggggat

SEQ ID NO: 3537080 - DNA, 19 bp, Homo sapiens
tttctgggctgtctattct

SEQ ID NO: 3537081 - DNA, 20 bp, Homo sapiens
tttgaaaaggcggtactagt

SEQ ID NO: 3537082 - DNA, 14 bp, Homo sapiens
tttgaactgagccg

SEQ ID NO: 3537083 - DNA, 18 bp, Homo sapiens
tttggaagtttgtgttct

SEQ ID NO: 3537084 - DNA, 22 bp, Homo sapiens
tttgtaagttaggtaactgtat

SEQ ID NO: 3537085 - DNA, 17 bp, Homo sapiens
tttgtattttgtttaaa

SEQ ID NO: 3537086 - DNA, 12 bp, Homo sapiens
tttgtgttctgt

SEQ ID NO: 3537087 - DNA, 21 bp, Homo sapiens
tttgttaaaactggcatctga

SEQ ID NO: 3537088 - DNA, 22 bp, Homo sapiens
ttttaaaaattaaatcaacctt

SEQ ID NO: 3537089 - DNA, 13 bp, Homo sapiens
ttttaccaagttt

SEQ ID NO: 3537090 - DNA, 22 bp, Homo sapiens
ttttattaataaacattctatc

SEQ ID NO: 3537091 - DNA, 21 bp, Homo sapiens
ttttcatgattttgaaaccat

SEQ ID NO: 3537092 - DNA, 13 bp, Homo sapiens
ttttcctaagtga

SEQ ID NO: 3537093 - DNA, 20 bp, Homo sapiens
ttttggtggttttagtgatt

SEQ ID NO: 3537094 - DNA, 11 bp, Homo sapiens
tttttcatgat

SEQ ID NO: 3537095 - DNA, 16 bp, Homo sapiens
accaaaatgacaatga

SEQ ID NO: 3537096 - DNA, 20 bp, Homo sapiens
accatgaagagatttttcat

SEQ ID NO: 3537097 - DNA, 13 bp, Homo sapiens
accattccacatc

SEQ ID NO: 3537098 - DNA, 15 bp, Homo sapiens
acccaagcttagaac

SEQ ID NO: 3537099 - DNA, 18 bp, Homo sapiens
acccacaggcccacagta

SEQ ID NO: 3537100 - DNA, 11 bp, Homo sapiens
accccctcctt

SEQ ID NO: 3537101 - DNA, 12 bp, Homo sapiens
accccctccttc

SEQ ID NO: 3537102 - DNA, 21 bp, Homo sapiens
accctcccccaccattccaca

SEQ ID NO: 3537103 - DNA, 19 bp, Homo sapiens
accctcttctctgggccca

SEQ ID NO: 3537104 - DNA, 20 bp, Homo sapiens
accctcttctctgggcccag

SEQ ID NO: 3537105 - DNA, 15 bp, Homo sapiens
acctcacctagaaat

SEQ ID NO: 3537106 - DNA, 12 bp, Homo sapiens
acctgaattaaa

SEQ ID NO: 3537107 - DNA, 13 bp, Homo sapiens
acctgaattaaag

SEQ ID NO: 3537108 - DNA, 15 bp, Homo sapiens
acctgaattaaagtc

SEQ ID NO: 3537109 - DNA, 17 bp, Homo sapiens
acctgaattaaagtcta

SEQ ID NO: 3537110 - DNA, 18 bp, Homo sapiens
acctgggattcaggaatg

SEQ ID NO: 3537111 - DNA, 11 bp, Homo sapiens
acctgtcaacc

SEQ ID NO: 3537112 - DNA, 21 bp, Homo sapiens
acctgtcaacctgaattaaag

SEQ ID NO: 3537113 - DNA, 14 bp, Homo sapiens
accttaggccttcc

SEQ ID NO: 3537114 - DNA, 18 bp, Homo sapiens
accttgagaccctcttct

SEQ ID NO: 3537115 - DNA, 19 bp, Homo sapiens
accttgagaccctcttctc

SEQ ID NO: 3537116 - DNA, 23 bp, Homo sapiens
accttgagaccctcttctctggg

SEQ ID NO: 3537117 - DNA, 20 bp, Homo sapiens
actaactcctaggaaaatac

SEQ ID NO: 3537118 - DNA, 21 bp, Homo sapiens
actcattgctgagcctctgct

SEQ ID NO: 3537119 - DNA, 19 bp, Homo sapiens
actccacagggactgttct

SEQ ID NO: 3537120 - DNA, 16 bp, Homo sapiens
actcctcccttcccca

SEQ ID NO: 3537121 - DNA, 9 bp, Homo sapiens
actctgctc

SEQ ID NO: 3537122 - DNA, 15 bp, Homo sapiens
actctgctcccagcc

SEQ ID NO: 3537123 - DNA, 18 bp, Homo sapiens
actctgctcccagcccct

SEQ ID NO: 3537124 - DNA, 19 bp, Homo sapiens
actgagccgtgcagctggg

SEQ ID NO: 3537125 - DNA, 20 bp, Homo sapiens
actggcatctgacacaaaaa

SEQ ID NO: 3537126 - DNA, 24 bp, Homo sapiens
actgtcactcattgctgagcctct

SEQ ID NO: 3537127 - DNA, 19 bp, Homo sapiens
actgttctatagcagtcat

SEQ ID NO: 3537128 - DNA, 15 bp, Homo sapiens
acttagatctgagcc

SEQ ID NO: 3537129 - DNA, 17 bp, Homo sapiens
acttagatctgagccct

SEQ ID NO: 3537130 - DNA, 22 bp, Homo sapiens
acttagatctgagccctccctc

SEQ ID NO: 3537131 - DNA, 14 bp, Homo sapiens
acttccttgagaca

SEQ ID NO: 3537132 - DNA, 15 bp, Homo sapiens
actttcccttcccct

SEQ ID NO: 3537133 - DNA, 22 bp, Homo sapiens
agaaagtcttatttattcatat

SEQ ID NO: 3537134 - DNA, 16 bp, Homo sapiens
agaactcactggggcc

SEQ ID NO: 3537135 - DNA, 18 bp, Homo sapiens
agaagcaaaggcaggagg

SEQ ID NO: 3537136 - DNA, 20 bp, Homo sapiens
agaattcaaactggggcctc

SEQ ID NO: 3537137 - DNA, 15 bp, Homo sapiens
agaccttccacaaag

SEQ ID NO: 3537138 - DNA, 16 bp, Homo sapiens
agacttccttgagaca

SEQ ID NO: 3537139 - DNA, 13 bp, Homo sapiens
agagatttttcat

SEQ ID NO: 3537140 - DNA, 16 bp, Homo sapiens
agaggcgtcctggtga

SEQ ID NO: 3537141 - DNA, 17 bp, Homo sapiens
agaggcgtcctggtgag

SEQ ID NO: 3537142 - DNA, 23 bp, Homo sapiens
agatatttacatgaattgcattt

SEQ ID NO: 3537143 - DNA, 14 bp, Homo sapiens
agatgtttccagac

SEQ ID NO: 3537144 - DNA, 22 bp, Homo sapiens
agcaaaggcaggaggtgggtga

SEQ ID NO: 3537145 - DNA, 16 bp, Homo sapiens
agcagcagctgaggcc

SEQ ID NO: 3537146 - DNA, 14 bp, Homo sapiens
agccagctccctct

SEQ ID NO: 3537147 - DNA, 13 bp, Homo sapiens
agcccagccctcc

SEQ ID NO: 3537148 - DNA, 15 bp, Homo sapiens
agccccctggcctct

SEQ ID NO: 3537149 - DNA, 17 bp, Homo sapiens
agccccctggcctctgt

SEQ ID NO: 3537150 - DNA, 19 bp, Homo sapiens
agccccctggcctctgtgc

SEQ ID NO: 3537151 - DNA, 21 bp, Homo sapiens
agcccctaccttgagaccctc

SEQ ID NO: 3537152 - DNA, 12 bp, Homo sapiens
agccctccccat

SEQ ID NO: 3537153 - DNA, 14 bp, Homo sapiens
agccctccctcttc

SEQ ID NO: 3537154 - DNA, 15 bp, Homo sapiens
agccctccctcttcc

SEQ ID NO: 3537155 - DNA, 21 bp, Homo sapiens
agccctttacttgacctccta

SEQ ID NO: 3537156 - DNA, 15 bp, Homo sapiens
agcctctgctcccca

SEQ ID NO: 3537157 - DNA, 16 bp, Homo sapiens
agcctggcttttctgg

SEQ ID NO: 3537158 - DNA, 20 bp, Homo sapiens
agcctggcttttctggctgg

SEQ ID NO: 3537159 - DNA, 22 bp, Homo sapiens
agcctggcttttctggctgggg

SEQ ID NO: 3537160 - DNA, 18 bp, Homo sapiens
agcctttggttctggcca

SEQ ID NO: 3537161 - DNA, 19 bp, Homo sapiens
agcctttggttctggccag

SEQ ID NO: 3537162 - DNA, 12 bp, Homo sapiens
agctctgcatta

SEQ ID NO: 3537163 - DNA, 15 bp, Homo sapiens
agctctgtcctctgt

SEQ ID NO: 3537164 - DNA, 12 bp, Homo sapiens
agctgaaaatat

SEQ ID NO: 3537165 - DNA, 14 bp, Homo sapiens
agctgaggccccag

SEQ ID NO: 3537166 - DNA, 17 bp, Homo sapiens
agctgaggccccagggc

SEQ ID NO: 3537167 - DNA, 23 bp, Homo sapiens
agctgaggccccagggctgtggg

SEQ ID NO: 3537168 - DNA, 14 bp, Homo sapiens
agctgccttggctc

SEQ ID NO: 3537169 - DNA, 16 bp, Homo sapiens
agctgccttggctcag

SEQ ID NO: 3537170 - DNA, 22 bp, Homo sapiens
agctgggatttgaactgagccg

SEQ ID NO: 3537171 - DNA, 23 bp, Homo sapiens
agctgggatttgaactgagccgt

SEQ ID NO: 3537172 - DNA, 10 bp, Homo sapiens
agcttagaac

SEQ ID NO: 3537173 - DNA, 12 bp, Homo sapiens
agctttgttctt

SEQ ID NO: 3537174 - DNA, 18 bp, Homo sapiens
agctttgttcttcttaaa

SEQ ID NO: 3537175 - DNA, 18 bp, Homo sapiens
aggaaggcgtgtccagga

SEQ ID NO: 3537176 - DNA, 18 bp, Homo sapiens
aggagctgccttggctca

SEQ ID NO: 3537177 - DNA, 22 bp, Homo sapiens
aggagctgccttggctcagaca

SEQ ID NO: 3537178 - DNA, 15 bp, Homo sapiens
aggccctagaccctc

SEQ ID NO: 3537179 - DNA, 18 bp, Homo sapiens
aggccttctgatttcaag

SEQ ID NO: 3537180 - DNA, 15 bp, Homo sapiens
aggcgtcctggtgag

SEQ ID NO: 3537181 - DNA, 18 bp, Homo sapiens
agggagcctttggttctg

SEQ ID NO: 3537182 - DNA, 17 bp, Homo sapiens
agggccttgagcatctg

SEQ ID NO: 3537183 - DNA, 18 bp, Homo sapiens
agggccttgagcatctgg

SEQ ID NO: 3537184 - DNA, 13 bp, Homo sapiens
agggctgtgggtg

SEQ ID NO: 3537185 - DNA, 14 bp, Homo sapiens
agggctgtgggtgg

SEQ ID NO: 3537186 - DNA, 17 bp, Homo sapiens
agggctgtgggtgggga

SEQ ID NO: 3537187 - DNA, 21 bp, Homo sapiens
agggtagcctggcttttctgg

SEQ ID NO: 3537188 - DNA, 22 bp, Homo sapiens
agggtcatatcactcaggccct

SEQ ID NO: 3537189 - DNA, 15 bp, Homo sapiens
aggtccgagctctgt

SEQ ID NO: 3537190 - DNA, 18 bp, Homo sapiens
aggtccgagctctgtcct

SEQ ID NO: 3537191 - DNA, 23 bp, Homo sapiens
agtactaactcctaggaaaatac

SEQ ID NO: 3537192 - DNA, 13 bp, Homo sapiens
agtatgaaaataa

SEQ ID NO: 3537193 - DNA, 15 bp, Homo sapiens
agtccaactactaaa

SEQ ID NO: 3537194 - DNA, 12 bp, Homo sapiens
agtccctcctgt

SEQ ID NO: 3537195 - DNA, 17 bp, Homo sapiens
agtggaccttaggcctt

SEQ ID NO: 3537196 - DNA, 23 bp, Homo sapiens
agtggaccttaggccttcctctc

SEQ ID NO: 3537197 - DNA, 21 bp, Homo sapiens
agtggcaagaccaaaatgaca

SEQ ID NO: 3537198 - DNA, 22 bp, Homo sapiens
agttatttatgcctctgtattt

SEQ ID NO: 3537199 - DNA, 14 bp, Homo sapiens
agtttgcttagaaa

SEQ ID NO: 3537200 - DNA, 23 bp, Homo sapiens
agttttattaataaacattctat

SEQ ID NO: 3537201 - DNA, 22 bp, Homo sapiens
agttttcctaagtgattgtatg

SEQ ID NO: 3537202 - DNA, 20 bp, Homo sapiens
ataaaaaacatttattttca

SEQ ID NO: 3537203 - DNA, 12 bp, Homo sapiens
ataaagtttgct

SEQ ID NO: 3537204 - DNA, 19 bp, Homo sapiens
ataaagtttgcttagaaaa

SEQ ID NO: 3537205 - DNA, 21 bp, Homo sapiens
ataagacggatttatttttcc

SEQ ID NO: 3537206 - DNA, 18 bp, Homo sapiens
ataagtttatttcttaaa

SEQ ID NO: 3537207 - DNA, 15 bp, Homo sapiens
atactatattttagg

SEQ ID NO: 3537208 - DNA, 17 bp, Homo sapiens
atagtccagctttgttc

SEQ ID NO: 3537209 - DNA, 13 bp, Homo sapiens
atcaagcccttta

SEQ ID NO: 3537210 - DNA, 12 bp, Homo sapiens
atcagtgttaaa

SEQ ID NO: 3537211 - DNA, 14 bp, Homo sapiens
atcagtgttaaaaa

SEQ ID NO: 3537212 - DNA, 20 bp, Homo sapiens
atcattcttatttcatgaaa

SEQ ID NO: 3537213 - DNA, 23 bp, Homo sapiens
atcattcttatttcatgaaaatt

SEQ ID NO: 3537214 - DNA, 19 bp, Homo sapiens
atcctgatgaggtttctac

SEQ ID NO: 3537215 - DNA, 20 bp, Homo sapiens
atcgcaccactgtgtattta

SEQ ID NO: 3537216 - DNA, 22 bp, Homo sapiens
atctaaactggattcacagctc

SEQ ID NO: 3537217 - DNA, 13 bp, Homo sapiens
atctgagccctcc

SEQ ID NO: 3537218 - DNA, 21 bp, Homo sapiens
atctgagccctccctcttccc

SEQ ID NO: 3537219 - DNA, 22 bp, Homo sapiens
atgaagggccttgagcatctgg

SEQ ID NO: 3537220 - DNA, 15 bp, Homo sapiens
atgatccagggattg

SEQ ID NO: 3537221 - DNA, 22 bp, Homo sapiens
atgatgacgacgacaacgatga

SEQ ID NO: 3537222 - DNA, 22 bp, Homo sapiens
atgattccttgatggagatatt

SEQ ID NO: 3537223 - DNA, 18 bp, Homo sapiens
atgcttgtaacaagaaaa

SEQ ID NO: 3537224 - DNA, 18 bp, Homo sapiens
atggagccagctccctct

SEQ ID NO: 3537225 - DNA, 21 bp, Homo sapiens
atggccgatggggcccacatt

SEQ ID NO: 3537226 - DNA, 13 bp, Homo sapiens
atgggacattttt

SEQ ID NO: 3537227 - DNA, 16 bp, Homo sapiens
atgtaaagtgatattt

SEQ ID NO: 3537228 - DNA, 22 bp, Homo sapiens
atgtaggaaagaccatttttcc

SEQ ID NO: 3537229 - DNA, 22 bp, Homo sapiens
atgtgtacaaaagtttcatcct

SEQ ID NO: 3537230 - DNA, 22 bp, Homo sapiens
tacaggatggttactgaggacc

SEQ ID NO: 3537231 - DNA, 16 bp, Homo sapiens
taccaagtttcaggta

SEQ ID NO: 3537232 - DNA, 13 bp, Homo sapiens
taccccctccttc

SEQ ID NO: 3537233 - DNA, 17 bp, Homo sapiens
tacccgttcacattttt

SEQ ID NO: 3537234 - DNA, 23 bp, Homo sapiens
taccttgagaccctcttctctgg

SEQ ID NO: 3537235 - DNA, 18 bp, Homo sapiens
tagatacatgctttttaa

SEQ ID NO: 3537236 - DNA, 15 bp, Homo sapiens
tagccccctggcctc

SEQ ID NO: 3537237 - DNA, 17 bp, Homo sapiens
tagccccctggcctctg

SEQ ID NO: 3537238 - DNA, 18 bp, Homo sapiens
tagccccctggcctctgt

SEQ ID NO: 3537239 - DNA, 16 bp, Homo sapiens
tagctgggatttgaac

SEQ ID NO: 3537240 - DNA, 23 bp, Homo sapiens
taggccttcctctctccagatgt

SEQ ID NO: 3537241 - DNA, 14 bp, Homo sapiens
tagtactaactcct

SEQ ID NO: 3537242 - DNA, 22 bp, Homo sapiens
tagtccagctttgttcttctta

SEQ ID NO: 3537243 - DNA, 13 bp, Homo sapiens
tatagtccagctt

SEQ ID NO: 3537244 - DNA, 23 bp, Homo sapiens
tatgaagggccttgagcatctgg

SEQ ID NO: 3537245 - DNA, 22 bp, Homo sapiens
tattaaaggttcctttgttccc

SEQ ID NO: 3537246 - DNA, 21 bp, Homo sapiens
tattaccccctccttcagaca

SEQ ID NO: 3537247 - DNA, 22 bp, Homo sapiens
tattaccccctccttcagacac

SEQ ID NO: 3537248 - DNA, 21 bp, Homo sapiens
tatttacatgaattgcatttt

SEQ ID NO: 3537249 - DNA, 16 bp, Homo sapiens
tatttatctgattaag

SEQ ID NO: 3537250 - DNA, 20 bp, Homo sapiens
tatttatgcctctgtattta

SEQ ID NO: 3537251 - DNA, 13 bp, Homo sapiens
tatttatgtttgc

SEQ ID NO: 3537252 - DNA, 11 bp, Homo sapiens
tatttatttac

SEQ ID NO: 3537253 - DNA, 21 bp, Homo sapiens
tatttccccaacatgtaataa

SEQ ID NO: 3537254 - DNA, 19 bp, Homo sapiens
tcaaactggggcctccaga

SEQ ID NO: 3537255 - DNA, 20 bp, Homo sapiens
tcaaactggggcctccagaa

SEQ ID NO: 3537256 - DNA, 18 bp, Homo sapiens
tcaacctcttctggctca

SEQ ID NO: 3537257 - DNA, 21 bp, Homo sapiens
tcaagcaaacagcttcacaaa

SEQ ID NO: 3537258 - DNA, 15 bp, Homo sapiens
tcacctactttgtaa

SEQ ID NO: 3537259 - DNA, 15 bp, Homo sapiens
tcacctagaaattga

SEQ ID NO: 3537260 - DNA, 17 bp, Homo sapiens
tcactggggcctacagc

SEQ ID NO: 3537261 - DNA, 23 bp, Homo sapiens
tcagacaccctcaacctcttctg

SEQ ID NO: 3537262 - DNA, 14 bp, Homo sapiens
tcagacactttgga

SEQ ID NO: 3537263 - DNA, 15 bp, Homo sapiens
tcagacatgttttcc

SEQ ID NO: 3537264 - DNA, 22 bp, Homo sapiens
tcagtcatgcgtccactttccc

SEQ ID NO: 3537265 - DNA, 16 bp, Homo sapiens
tcatcagtgttaaaaa

SEQ ID NO: 3537266 - DNA, 14 bp, Homo sapiens
tcatccattctatt

SEQ ID NO: 3537267 - DNA, 19 bp, Homo sapiens
tcatccattctattgttaa

SEQ ID NO: 3537268 - DNA, 19 bp, Homo sapiens
tcatgaagatatttttcca

SEQ ID NO: 3537269 - DNA, 14 bp, Homo sapiens
tcatgattttgaaa

SEQ ID NO: 3537270 - DNA, 22 bp, Homo sapiens
tcatgctaattatataatattt

SEQ ID NO: 3537271 - DNA, 15 bp, Homo sapiens
tcattgctgagcctc

SEQ ID NO: 3537272 - DNA, 19 bp, Homo sapiens
tccacatccccaccttcca

SEQ ID NO: 3537273 - DNA, 17 bp, Homo sapiens
tccactttcccttcccc

SEQ ID NO: 3537274 - DNA, 22 bp, Homo sapiens
tccagaactcactggggcctac

SEQ ID NO: 3537275 - DNA, 18 bp, Homo sapiens
tccagatgtttccagact

SEQ ID NO: 3537276 - DNA, 18 bp, Homo sapiens
tccaggagaccttccaca

SEQ ID NO: 3537277 - DNA, 16 bp, Homo sapiens
tccaggatcctcctgg

SEQ ID NO: 3537278 - DNA, 20 bp, Homo sapiens
tccagtcaggcctatctaaa

SEQ ID NO: 3537279 - DNA, 19 bp, Homo sapiens
tccatataaatattagaaa

SEQ ID NO: 3537280 - DNA, 21 bp, Homo sapiens
tcccaaacgcctcccctgccc

SEQ ID NO: 3537281 - DNA, 16 bp, Homo sapiens
tcccagcccctacctt

SEQ ID NO: 3537282 - DNA, 13 bp, Homo sapiens
tcccatgtagccc

SEQ ID NO: 3537283 - DNA, 15 bp, Homo sapiens
tccccaggggagttg

SEQ ID NO: 3537284 - DNA, 13 bp, Homo sapiens
tccccatggagcc

SEQ ID NO: 3537285 - DNA, 21 bp, Homo sapiens
tcccctgtgactcctcccttc

SEQ ID NO: 3537286 - DNA, 14 bp, Homo sapiens
tccctcctgttgcc

SEQ ID NO: 3537287 - DNA, 18 bp, Homo sapiens
tccctcctgttgccacac

SEQ ID NO: 3537288 - DNA, 13 bp, Homo sapiens
tccctggtccctt

SEQ ID NO: 3537289 - DNA, 16 bp, Homo sapiens
tcccttgacctttcca

SEQ ID NO: 3537290 - DNA, 14 bp, Homo sapiens
tcctcctggagcag

SEQ ID NO: 3537291 - DNA, 15 bp, Homo sapiens
tcctctgtcagtcat

SEQ ID NO: 3537292 - DNA, 14 bp, Homo sapiens
tcctggtgaggaca

SEQ ID NO: 3537293 - DNA, 23 bp, Homo sapiens
tcctgttgccacactttcactgg

SEQ ID NO: 3537294 - DNA, 17 bp, Homo sapiens
tccttgagacacggagc

SEQ ID NO: 3537295 - DNA, 13 bp, Homo sapiens
tcctttgttccct

SEQ ID NO: 3537296 - DNA, 19 bp, Homo sapiens
tcggaacccaagcttagaa

SEQ ID NO: 3537297 - DNA, 18 bp, Homo sapiens
tctacaaaatcctgatga

SEQ ID NO: 3537298 - DNA, 14 bp, Homo sapiens
tctatagcagtcat

SEQ ID NO: 3537299 - DNA, 23 bp, Homo sapiens
tctatgaactctgttttctttct

SEQ ID NO: 3537300 - DNA, 17 bp, Homo sapiens
tctatgtgcttgtaaaa

SEQ ID NO: 3537301 - DNA, 11 bp, Homo sapiens
tctattaaagg

SEQ ID NO: 3537302 - DNA, 12 bp, Homo sapiens
tctattaaaggt

SEQ ID NO: 3537303 - DNA, 14 bp, Homo sapiens
tctattaaaggttc

SEQ ID NO: 3537304 - DNA, 13 bp, Homo sapiens
tctatttatgttt

SEQ ID NO: 3537305 - DNA, 24 bp, Homo sapiens
tctattttgtaactttctctatga

SEQ ID NO: 3537306 - DNA, 14 bp, Homo sapiens
tctcaaactggggc

SEQ ID NO: 3537307 - DNA, 20 bp, Homo sapiens
tctcttcccacctgtcaacc

SEQ ID NO: 3537308 - DNA, 14 bp, Homo sapiens
tctgacctccatga

SEQ ID NO: 3537309 - DNA, 15 bp, Homo sapiens
tctgagccctccctc

SEQ ID NO: 3537310 - DNA, 21 bp, Homo sapiens
tctgagccctccctcttccca

SEQ ID NO: 3537311 - DNA, 13 bp, Homo sapiens
tctgcctaataaa

SEQ ID NO: 3537312 - DNA, 19 bp, Homo sapiens
tctggagaccagggagcct

SEQ ID NO: 3537313 - DNA, 20 bp, Homo sapiens
tctggagaccagggagcctt

SEQ ID NO: 3537314 - DNA, 21 bp, Homo sapiens
tctggagaccagggagccttt

SEQ ID NO: 3537315 - DNA, 22 bp, Homo sapiens
tctgtgccttcttttgattatg

SEQ ID NO: 3537316 - DNA, 23 bp, Homo sapiens
tctgttttctttctaatgagata

SEQ ID NO: 3537317 - DNA, 19 bp, Homo sapiens
tcttctctgggcccagaga

SEQ ID NO: 3537318 - DNA, 19 bp, Homo sapiens
tcttgctgtccaatttcta

SEQ ID NO: 3537319 - DNA, 20 bp, Homo sapiens
tgaaaacggagctgaacaat

SEQ ID NO: 3537320 - DNA, 23 bp, Homo sapiens
tgaactagggtggtgcatttttg

SEQ ID NO: 3537321 - DNA, 12 bp, Homo sapiens
tgaactgagccg

SEQ ID NO: 3537322 - DNA, 15 bp, Homo sapiens
tgaagatatttttcc

SEQ ID NO: 3537323 - DNA, 19 bp, Homo sapiens
tgaagggccttgagcatct

SEQ ID NO: 3537324 - DNA, 15 bp, Homo sapiens
tgaatgtatttattt

SEQ ID NO: 3537325 - DNA, 19 bp, Homo sapiens
tgaatgtatttatttggga

SEQ ID NO: 3537326 - DNA, 13 bp, Homo sapiens
tgaattaaagtct

SEQ ID NO: 3537327 - DNA, 13 bp, Homo sapiens
tgacaatgatgat

SEQ ID NO: 3537328 - DNA, 17 bp, Homo sapiens
tgacacaaaaaaagttg

SEQ ID NO: 3537329 - DNA, 16 bp, Homo sapiens
tgacacaagtggacct

SEQ ID NO: 3537330 - DNA, 17 bp, Homo sapiens
tgacacaagtggacctt

SEQ ID NO: 3537331 - DNA, 14 bp, Homo sapiens
tgacctttccagcc

SEQ ID NO: 3537332 - DNA, 19 bp, Homo sapiens
tgagaccctcttctctggg

SEQ ID NO: 3537333 - DNA, 18 bp, Homo sapiens
tgagccgtgcagctggga

SEQ ID NO: 3537334 - DNA, 16 bp, Homo sapiens
tgagcctctgctcccc

SEQ ID NO: 3537335 - DNA, 18 bp, Homo sapiens
tgagcctctgctccccag

SEQ ID NO: 3537336 - DNA, 13 bp, Homo sapiens
tgagcgggtgggg

SEQ ID NO: 3537337 - DNA, 16 bp, Homo sapiens
tgatatcccccagcct

SEQ ID NO: 3537338 - DNA, 15 bp, Homo sapiens
tgatgatgataatga

SEQ ID NO: 3537339 - DNA, 23 bp, Homo sapiens
tgatgcttgtaacaagaaaacat

SEQ ID NO: 3537340 - DNA, 22 bp, Homo sapiens
tgattccttgatggagatattt

SEQ ID NO: 3537341 - DNA, 16 bp, Homo sapiens
tgcacagtccctcctg

SEQ ID NO: 3537342 - DNA, 20 bp, Homo sapiens
tgcacagtccctcctgttgc

SEQ ID NO: 3537343 - DNA, 16 bp, Homo sapiens
tgcagctgggatttga

SEQ ID NO: 3537344 - DNA, 22 bp, Homo sapiens
tgccacactttcactggggatc

SEQ ID NO: 3537345 - DNA, 22 bp, Homo sapiens
tgctatcgcaccactgtgtatt

SEQ ID NO: 3537346 - DNA, 20 bp, Homo sapiens
tgctgagcctctgctcccca

SEQ ID NO: 3537347 - DNA, 23 bp, Homo sapiens
tgctgtccaatttctattaaagg

SEQ ID NO: 3537348 - DNA, 14 bp, Homo sapiens
tgcttgctgtgtga

SEQ ID NO: 3537349 - DNA, 19 bp, Homo sapiens
tgcttgtaacaagaaaaca

SEQ ID NO: 3537350 - DNA, 20 bp, Homo sapiens
tgcttgtaacaagaaaacat

SEQ ID NO: 3537351 - DNA, 19 bp, Homo sapiens
tggaagtttgtgttctgtt

SEQ ID NO: 3537352 - DNA, 18 bp, Homo sapiens
tggaatctggagaccagg

SEQ ID NO: 3537353 - DNA, 21 bp, Homo sapiens
tggactccaggatcctcctgg

SEQ ID NO: 3537354 - DNA, 15 bp, Homo sapiens
tggcatctgacacaa

SEQ ID NO: 3537355 - DNA, 18 bp, Homo sapiens
tggcatctgacacaaaaa

SEQ ID NO: 3537356 - DNA, 19 bp, Homo sapiens
tggccgatggggcccacat

SEQ ID NO: 3537357 - DNA, 20 bp, Homo sapiens
tggccgatggggcccacatt

SEQ ID NO: 3537358 - DNA, 12 bp, Homo sapiens
tgggatttgaac

SEQ ID NO: 3537359 - DNA, 19 bp, Homo sapiens
tgggcaagtcccttgacct

SEQ ID NO: 3537360 - DNA, 23 bp, Homo sapiens
tgggcacctcatggactccagga

SEQ ID NO: 3537361 - DNA, 20 bp, Homo sapiens
tggggatcccgtgctggaag

SEQ ID NO: 3537362 - DNA, 14 bp, Homo sapiens
tggggcctccagaa

SEQ ID NO: 3537363 - DNA, 21 bp, Homo sapiens
tgtaactatagtccagctttg

SEQ ID NO: 3537364 - DNA, 18 bp, Homo sapiens
catatccagtattgttcc

SEQ ID NO: 3537365 - DNA, 13 bp, Homo sapiens
catcaccacagtt

SEQ ID NO: 3537366 - DNA, 15 bp, Homo sapiens
catcagtgttaaaaa

SEQ ID NO: 3537367 - DNA, 15 bp, Homo sapiens
catccccaccttcca

SEQ ID NO: 3537368 - DNA, 14 bp, Homo sapiens
catctgacacaaaa

SEQ ID NO: 3537369 - DNA, 21 bp, Homo sapiens
catctggaatctggagaccag

SEQ ID NO: 3537370 - DNA, 24 bp, Homo sapiens
catgattttgaaatcatgaagata

SEQ ID NO: 3537371 - DNA, 21 bp, Homo sapiens
catgcgtccactttcccttcc

SEQ ID NO: 3537372 - DNA, 20 bp, Homo sapiens
catggactccaggatcctcc

SEQ ID NO: 3537373 - DNA, 22 bp, Homo sapiens
cattccacatccccaccttcca

SEQ ID NO: 3537374 - DNA, 14 bp, Homo sapiens
cattctattgttaa

SEQ ID NO: 3537375 - DNA, 15 bp, Homo sapiens
cattgctgagcctct

SEQ ID NO: 3537376 - DNA, 22 bp, Homo sapiens
cattgtatagttggaatcatat

SEQ ID NO: 3537377 - DNA, 20 bp, Homo sapiens
ccaaaatcataagatatttt

SEQ ID NO: 3537378 - DNA, 14 bp, Homo sapiens
ccacaaagggtagc

SEQ ID NO: 3537379 - DNA, 16 bp, Homo sapiens
ccacaggcccacagta

SEQ ID NO: 3537380 - DNA, 12 bp, Homo sapiens
ccactctgctcc

SEQ ID NO: 3537381 - DNA, 14 bp, Homo sapiens
ccactctgctccca

SEQ ID NO: 3537382 - DNA, 16 bp, Homo sapiens
ccactctgctcccagc

SEQ ID NO: 3537383 - DNA, 19 bp, Homo sapiens
ccactctgctcccagcccc

SEQ ID NO: 3537384 - DNA, 16 bp, Homo sapiens
ccacttgggtcttccc

SEQ ID NO: 3537385 - DNA, 17 bp, Homo sapiens
ccacttgggtcttccct

SEQ ID NO: 3537386 - DNA, 16 bp, Homo sapiens
ccactttcccttcccc

SEQ ID NO: 3537387 - DNA, 21 bp, Homo sapiens
ccagagagaggcgtcctggtg

SEQ ID NO: 3537388 - DNA, 23 bp, Homo sapiens
ccagatgtttccagacttccttg

SEQ ID NO: 3537389 - DNA, 19 bp, Homo sapiens
ccagcctatatttcctctt

SEQ ID NO: 3537390 - DNA, 14 bp, Homo sapiens
ccaggatcctcctg

SEQ ID NO: 3537391 - DNA, 14 bp, Homo sapiens
ccagggagcctttg

SEQ ID NO: 3537392 - DNA, 18 bp, Homo sapiens
ccatggagccagctccct

SEQ ID NO: 3537393 - DNA, 22 bp, Homo sapiens
ccatggagccagctccctctat

SEQ ID NO: 3537394 - DNA, 14 bp, Homo sapiens
ccatgtagccccct

SEQ ID NO: 3537395 - DNA, 20 bp, Homo sapiens
ccatgtagccccctggcctc

SEQ ID NO: 3537396 - DNA, 14 bp, Homo sapiens
cccaagcttagaac

SEQ ID NO: 3537397 - DNA, 12 bp, Homo sapiens
cccaccattcca

SEQ ID NO: 3537398 - DNA, 14 bp, Homo sapiens
cccaccattccaca

SEQ ID NO: 3537399 - DNA, 15 bp, Homo sapiens
cccagcccctacctt

SEQ ID NO: 3537400 - DNA, 17 bp, Homo sapiens
cccagggctgtgggtgg

SEQ ID NO: 3537401 - DNA, 18 bp, Homo sapiens
cccagggctgtgggtggg

SEQ ID NO: 3537402 - DNA, 17 bp, Homo sapiens
cccagtctgttccccat

SEQ ID NO: 3537403 - DNA, 14 bp, Homo sapiens
cccatgtagccccc

SEQ ID NO: 3537404 - DNA, 23 bp, Homo sapiens
cccatgtagccccctggcctctg

SEQ ID NO: 3537405 - DNA, 17 bp, Homo sapiens
ccccactctgctcccag

SEQ ID NO: 3537406 - DNA, 20 bp, Homo sapiens
ccccactctgctcccagccc

SEQ ID NO: 3537407 - DNA, 20 bp, Homo sapiens
ccccagggctgtgggtgggg

SEQ ID NO: 3537408 - DNA, 15 bp, Homo sapiens
ccccctggcctctgt

SEQ ID NO: 3537409 - DNA, 14 bp, Homo sapiens
cccctggcctctgt

SEQ ID NO: 3537410 - DNA, 16 bp, Homo sapiens
cccctgtgactcctcc

SEQ ID NO: 3537411 - DNA, 17 bp, Homo sapiens
cccctgtgactcctccc

SEQ ID NO: 3537412 - DNA, 23 bp, Homo sapiens
ccctactattcagtggcgagaaa

SEQ ID NO: 3537413 - DNA, 16 bp, Homo sapiens
ccctcaacctcttctg

SEQ ID NO: 3537414 - DNA, 13 bp, Homo sapiens
ccctcttcccagc

SEQ ID NO: 3537415 - DNA, 14 bp, Homo sapiens
ccctcttctctggg

SEQ ID NO: 3537416 - DNA, 21 bp, Homo sapiens
ccctcttctctgggcccagag

SEQ ID NO: 3537417 - DNA, 19 bp, Homo sapiens
ccctggcctctgtgccttc

SEQ ID NO: 3537418 - DNA, 21 bp, Homo sapiens
ccctggcctctgtgccttctt

SEQ ID NO: 3537419 - DNA, 14 bp, Homo sapiens
ccctgtgactcctc

SEQ ID NO: 3537420 - DNA, 15 bp, Homo sapiens
cccttccccactctg

SEQ ID NO: 3537421 - DNA, 23 bp, Homo sapiens
cccttcccctgtgactcctccct

SEQ ID NO: 3537422 - DNA, 13 bp, Homo sapiens
ccgagctctgtcc

SEQ ID NO: 3537423 - DNA, 12 bp, Homo sapiens
ccgatggggccc

SEQ ID NO: 3537424 - DNA, 17 bp, Homo sapiens
ccgatggggcccacatt

SEQ ID NO: 3537425 - DNA, 17 bp, Homo sapiens
ccgtgaaaacggagctg

SEQ ID NO: 3537426 - DNA, 22 bp, Homo sapiens
cctaatgacatcaccacagttt

SEQ ID NO: 3537427 - DNA, 17 bp, Homo sapiens
cctacagctttgatccc

SEQ ID NO: 3537428 - DNA, 14 bp, Homo sapiens
cctatatttcctct

SEQ ID NO: 3537429 - DNA, 19 bp, Homo sapiens
cctcaacgttgctccccat

SEQ ID NO: 3537430 - DNA, 17 bp, Homo sapiens
cctcatggactccagga

SEQ ID NO: 3537431 - DNA, 19 bp, Homo sapiens
cctccatgactgcacagta

SEQ ID NO: 3537432 - DNA, 12 bp, Homo sapiens
cctccctcttcc

SEQ ID NO: 3537433 - DNA, 19 bp, Homo sapiens
cctccctcttcccagcaca

SEQ ID NO: 3537434 - DNA, 13 bp, Homo sapiens
cctcccttcccca

SEQ ID NO: 3537435 - DNA, 18 bp, Homo sapiens
cctcctggagcagcagct

SEQ ID NO: 3537436 - DNA, 20 bp, Homo sapiens
cctcctggagcagcagctga

SEQ ID NO: 3537437 - DNA, 21 bp, Homo sapiens
cctcctggagcagcagctgag

SEQ ID NO: 3537438 - DNA, 15 bp, Homo sapiens
cctcctgttgccaca

SEQ ID NO: 3537439 - DNA, 16 bp, Homo sapiens
cctcctgttgccacac

SEQ ID NO: 3537440 - DNA, 14 bp, Homo sapiens
cctccttcagacac

SEQ ID NO: 3537441 - DNA, 17 bp, Homo sapiens
cctctatttatgtttgc

SEQ ID NO: 3537442 - DNA, 21 bp, Homo sapiens
cctctgtcagtcatgcgtcca

SEQ ID NO: 3537443 - DNA, 21 bp, Homo sapiens
cctcttctctgggcccagaga

SEQ ID NO: 3537444 - DNA, 15 bp, Homo sapiens
cctcttctggctcaa

SEQ ID NO: 3537445 - DNA, 14 bp, Homo sapiens
cctgaattaaagtc

SEQ ID NO: 3537446 - DNA, 18 bp, Homo sapiens
cctgaattaaagtctaca

SEQ ID NO: 3537447 - DNA, 20 bp, Homo sapiens
cctgccccaatccctttatt

SEQ ID NO: 3537448 - DNA, 23 bp, Homo sapiens
cctggagcagcagctgaggcccc

SEQ ID NO: 3537449 - DNA, 14 bp, Homo sapiens
cctggcctctgtgc

SEQ ID NO: 3537450 - DNA, 18 bp, Homo sapiens
cctggcttttctggctgg

SEQ ID NO: 3537451 - DNA, 12 bp, Homo sapiens
cctgtcaacctg

SEQ ID NO: 3537452 - DNA, 15 bp, Homo sapiens
cctgtcaacctgaat

SEQ ID NO: 3537453 - DNA, 22 bp, Homo sapiens
cctgttgccacactttcactgg

SEQ ID NO: 3537454 - DNA, 15 bp, Homo sapiens
ccttaggccttcctc

SEQ ID NO: 3537455 - DNA, 11 bp, Homo sapiens
ccttcagacac

SEQ ID NO: 3537456 - DNA, 20 bp, Homo sapiens
ccttcagacaccctcaacct

SEQ ID NO: 3537457 - DNA, 13 bp, Homo sapiens
ccttccccactct

SEQ ID NO: 3537458 - DNA, 14 bp, Homo sapiens
ccttgagaccctct

SEQ ID NO: 3537459 - DNA, 20 bp, Homo sapiens
ccttgagaccctcttctctg

SEQ ID NO: 3537460 - DNA, 12 bp, Homo sapiens
ccttgagcatct

SEQ ID NO: 3537461 - DNA, 18 bp, Homo sapiens
ccttggttcatcagtgtt

SEQ ID NO: 3537462 - DNA, 13 bp, Homo sapiens
cctttccagccta

SEQ ID NO: 3537463 - DNA, 14 bp, Homo sapiens
cctttggttctggc

SEQ ID NO: 3537464 - DNA, 11 bp, Homo sapiens
cctttgttccc

SEQ ID NO: 3537465 - DNA, 12 bp, Homo sapiens
cctttgttccct

SEQ ID NO: 3537466 - DNA, 18 bp, Homo sapiens
cgaaacctgggattcagg

SEQ ID NO: 3537467 - DNA, 18 bp, Homo sapiens
cgagctctgtcctctgtc

SEQ ID NO: 3537468 - DNA, 21 bp, Homo sapiens
cgatgatgcttgtaacaagaa

SEQ ID NO: 3537469 - DNA, 17 bp, Homo sapiens
cggaacccaagcttaga

SEQ ID NO: 3537470 - DNA, 17 bp, Homo sapiens
cgggtggggtgcttgct

SEQ ID NO: 3537471 - DNA, 17 bp, Homo sapiens
cgtctgtttataaacat

SEQ ID NO: 3537472 - DNA, 22 bp, Homo sapiens
cgtgtccaggagaccttccaca

SEQ ID NO: 3537473 - DNA, 20 bp, Homo sapiens
ctaagtccaactactaaact

SEQ ID NO: 3537474 - DNA, 15 bp, Homo sapiens
ctaataaaaaacatt

SEQ ID NO: 3537475 - DNA, 23 bp, Homo sapiens
ctacatttcacctactttgtaag

SEQ ID NO: 3537476 - DNA, 22 bp, Homo sapiens
ctaccttgagaccctcttctct

SEQ ID NO: 3537477 - DNA, 16 bp, Homo sapiens
ctagaccctcccccac

SEQ ID NO: 3537478 - DNA, 12 bp, Homo sapiens
ctaggaaaatac

SEQ ID NO: 3537479 - DNA, 15 bp, Homo sapiens
ctatagcagtcatca

SEQ ID NO: 3537480 - DNA, 23 bp, Homo sapiens
ctattaaaggttcctttgttccc

SEQ ID NO: 3537481 - DNA, 21 bp, Homo sapiens
ctcaacctcttctggctcaaa

SEQ ID NO: 3537482 - DNA, 18 bp, Homo sapiens
ctcagttcatccattcta

SEQ ID NO: 3537483 - DNA, 22 bp, Homo sapiens
ctcatggactccaggatcctcc

SEQ ID NO: 3537484 - DNA, 15 bp, Homo sapiens
ctcattgctgagcct

SEQ ID NO: 3537485 - DNA, 16 bp, Homo sapiens
ctcattgctgagcctc

SEQ ID NO: 3537486 - DNA, 20 bp, Homo sapiens
ctcattgctgagcctctgct

SEQ ID NO: 3537487 - DNA, 19 bp, Homo sapiens
ctccagatgtttccagact

SEQ ID NO: 3537488 - DNA, 17 bp, Homo sapiens
ctccaggatcctcctgg

SEQ ID NO: 3537489 - DNA, 21 bp, Homo sapiens
ctccaggatcctcctggagca

SEQ ID NO: 3537490 - DNA, 14 bp, Homo sapiens
ctccctctatttat

SEQ ID NO: 3537491 - DNA, 12 bp, Homo sapiens
ctccctcttccc

SEQ ID NO: 3537492 - DNA, 14 bp, Homo sapiens
ctccctcttcccag

SEQ ID NO: 3537493 - DNA, 15 bp, Homo sapiens
ctccctcttcccagc

SEQ ID NO: 3537494 - DNA, 15 bp, Homo sapiens
aaaaacatttatttt

SEQ ID NO: 3537495 - DNA, 13 bp, Homo sapiens
aaaaagttgaagg

SEQ ID NO: 3537496 - DNA, 19 bp, Homo sapiens
aaaagtggcaagaccaaaa

SEQ ID NO: 3537497 - DNA, 15 bp, Homo sapiens
aaaatactattctga

SEQ ID NO: 3537498 - DNA, 17 bp, Homo sapiens
aaaattaaatcaacctt

SEQ ID NO: 3537499 - DNA, 21 bp, Homo sapiens
aaacctgggattcaggaatgt

SEQ ID NO: 3537500 - DNA, 20 bp, Homo sapiens
aaactggcatctgacacaaa

SEQ ID NO: 3537501 - DNA, 21 bp, Homo sapiens
aaactggcatctgacacaaaa

SEQ ID NO: 3537502 - DNA, 15 bp, Homo sapiens
aaaggttcctttgtt

SEQ ID NO: 3537503 - DNA, 21 bp, Homo sapiens
aaaggttcctttgttccctaa

SEQ ID NO: 3537504 - DNA, 18 bp, Homo sapiens
aaagtcaatgttttcagt

SEQ ID NO: 3537505 - DNA, 19 bp, Homo sapiens
aaagtggcaagaccaaaat

SEQ ID NO: 3537506 - DNA, 15 bp, Homo sapiens
aaagtttgcttagaa

SEQ ID NO: 3537507 - DNA, 23 bp, Homo sapiens
aaataacaaatctcaagcaaaca

SEQ ID NO: 3537508 - DNA, 14 bp, Homo sapiens
aaataatcattctt

SEQ ID NO: 3537509 - DNA, 17 bp, Homo sapiens
aaatattagaaacagct

SEQ ID NO: 3537510 - DNA, 21 bp, Homo sapiens
aaatcatgaagatatttttcc

SEQ ID NO: 3537511 - DNA, 20 bp, Homo sapiens
aaattgacacaagtggacct

SEQ ID NO: 3537512 - DNA, 13 bp, Homo sapiens
aaatttttgaaaa

SEQ ID NO: 3537513 - DNA, 22 bp, Homo sapiens
aacaagaccaccacttcgaaac

SEQ ID NO: 3537514 - DNA, 16 bp, Homo sapiens
aacatccaaccttccc

SEQ ID NO: 3537515 - DNA, 20 bp, Homo sapiens
aaccatgtaaagaacataaa

SEQ ID NO: 3537516 - DNA, 15 bp, Homo sapiens
aacccaagcttagaa

SEQ ID NO: 3537517 - DNA, 19 bp, Homo sapiens
aacccacaggcccacagta

SEQ ID NO: 3537518 - DNA, 20 bp, Homo sapiens
aacctgggattcaggaatgt

SEQ ID NO: 3537519 - DNA, 22 bp, Homo sapiens
aacgatgatgcttgtaacaaga

SEQ ID NO: 3537520 - DNA, 21 bp, Homo sapiens
aactgagccgtgcagctggga

SEQ ID NO: 3537521 - DNA, 20 bp, Homo sapiens
aactggcatctgacacaaaa

SEQ ID NO: 3537522 - DNA, 20 bp, Homo sapiens
aagacttagatctgagccct

SEQ ID NO: 3537523 - DNA, 20 bp, Homo sapiens
aagagaacccacgaacattc

SEQ ID NO: 3537524 - DNA, 16 bp, Homo sapiens
aagagagccttggttc

SEQ ID NO: 3537525 - DNA, 14 bp, Homo sapiens
aagagatttttcat

SEQ ID NO: 3537526 - DNA, 16 bp, Homo sapiens
aagatatgggacattt

SEQ ID NO: 3537527 - DNA, 17 bp, Homo sapiens
aagatatttttcatgat

SEQ ID NO: 3537528 - DNA, 10 bp, Homo sapiens
aagcttagaa

SEQ ID NO: 3537529 - DNA, 18 bp, Homo sapiens
aagggccttgagcatctg

SEQ ID NO: 3537530 - DNA, 17 bp, Homo sapiens
aagtcaatgttttcagt

SEQ ID NO: 3537531 - DNA, 22 bp, Homo sapiens
aagtctgtgagattcattcatg

SEQ ID NO: 3537532 - DNA, 17 bp, Homo sapiens
aagtgagagagacaaga

SEQ ID NO: 3537533 - DNA, 13 bp, Homo sapiens
aagtgattgtatg

SEQ ID NO: 3537534 - DNA, 15 bp, Homo sapiens
aagtttgcttagaaa

SEQ ID NO: 3537535 - DNA, 22 bp, Homo sapiens
aataaaaaacatttattttcat

SEQ ID NO: 3537536 - DNA, 13 bp, Homo sapiens
aatattagaaaca

SEQ ID NO: 3537537 - DNA, 15 bp, Homo sapiens
aatctggagaccagg

SEQ ID NO: 3537538 - DNA, 23 bp, Homo sapiens
aatgatgatgacgacgacaacga

SEQ ID NO: 3537539 - DNA, 13 bp, Homo sapiens
aattaaagtctac

SEQ ID NO: 3537540 - DNA, 21 bp, Homo sapiens
aattaaagtctacactgcctt

SEQ ID NO: 3537541 - DNA, 21 bp, Homo sapiens
aattattgtacatttatagtt

SEQ ID NO: 3537542 - DNA, 14 bp, Homo sapiens
aattttgatgaaca

SEQ ID NO: 3537543 - DNA, 19 bp, Homo sapiens
acaaaaaaagttgaaggcc

SEQ ID NO: 3537544 - DNA, 22 bp, Homo sapiens
acaaaagtttcatccttttcat

SEQ ID NO: 3537545 - DNA, 19 bp, Homo sapiens
acaagaccaccacttcgaa

SEQ ID NO: 3537546 - DNA, 16 bp, Homo sapiens
acaatgatgatgataa

SEQ ID NO: 3537547 - DNA, 17 bp, Homo sapiens
acaatgatgatgataat

SEQ ID NO: 3537548 - DNA, 21 bp, Homo sapiens
acaatgatgatgataatgatg

SEQ ID NO: 3537549 - DNA, 17 bp, Homo sapiens
acaccctcaacctcttc

SEQ ID NO: 3537550 - DNA, 13 bp, Homo sapiens
acactttcactgg

SEQ ID NO: 3537551 - DNA, 22 bp, Homo sapiens
acactttggaagtttgtgttct

SEQ ID NO: 3537552 - DNA, 16 bp, Homo sapiens
acatcaccacagttta

SEQ ID NO: 3537553 - DNA, 12 bp, Homo sapiens
acatccccacct

SEQ ID NO: 3537554 - DNA, 18 bp, Homo sapiens
acatccccaccttccaag

SEQ ID NO: 3537555 - DNA, 20 bp, Homo sapiens
acatttcacctactttgtaa

SEQ ID NO: 3537556 - DNA, 19 bp, Homo sapiens
accatgaagagatttttca

SEQ ID NO: 3537557 - DNA, 15 bp, Homo sapiens
accccctccttcaga

SEQ ID NO: 3537558 - DNA, 14 bp, Homo sapiens
accctcttctctgg

SEQ ID NO: 3537559 - DNA, 16 bp, Homo sapiens
accctcttctctgggc

SEQ ID NO: 3537560 - DNA, 18 bp, Homo sapiens
accctcttctctgggccc

SEQ ID NO: 3537561 - DNA, 22 bp, Homo sapiens
accctcttctctgggcccagag

SEQ ID NO: 3537562 - DNA, 14 bp, Homo sapiens
acctcttctggctc

SEQ ID NO: 3537563 - DNA, 16 bp, Homo sapiens
acctcttctggctcaa

SEQ ID NO: 3537564 - DNA, 23 bp, Homo sapiens
acctgaattaaagtctacactgc

SEQ ID NO: 3537565 - DNA, 15 bp, Homo sapiens
accttaggccttcct

SEQ ID NO: 3537566 - DNA, 16 bp, Homo sapiens
accttaggccttcctc

SEQ ID NO: 3537567 - DNA, 18 bp, Homo sapiens
accttaggccttcctctc

SEQ ID NO: 3537568 - DNA, 21 bp, Homo sapiens
accttaggccttcctctctcc

SEQ ID NO: 3537569 - DNA, 14 bp, Homo sapiens
accttcccaaacgc

SEQ ID NO: 3537570 - DNA, 22 bp, Homo sapiens
accttcccaaacgcctcccctg

SEQ ID NO: 3537571 - DNA, 19 bp, Homo sapiens
accttgctttgatggaata

SEQ ID NO: 3537572 - DNA, 18 bp, Homo sapiens
accttgggcaagtccctt

SEQ ID NO: 3537573 - DNA, 20 bp, Homo sapiens
acgacaacgatgatgcttgt

SEQ ID NO: 3537574 - DNA, 20 bp, Homo sapiens
acggagcccagccctcccca

SEQ ID NO: 3537575 - DNA, 16 bp, Homo sapiens
actaagaattcaaact

SEQ ID NO: 3537576 - DNA, 21 bp, Homo sapiens
actatagtccagctttgttct

SEQ ID NO: 3537577 - DNA, 22 bp, Homo sapiens
actcactggggcctacagcttt

SEQ ID NO: 3537578 - DNA, 15 bp, Homo sapiens
actcactttctagat

SEQ ID NO: 3537579 - DNA, 20 bp, Homo sapiens
actcattgctgagcctctgc

SEQ ID NO: 3537580 - DNA, 20 bp, Homo sapiens
actcctcccttccccactct

SEQ ID NO: 3537581 - DNA, 18 bp, Homo sapiens
actgagccgtgcagctgg

SEQ ID NO: 3537582 - DNA, 22 bp, Homo sapiens
actggggatcccgtgctggaag

SEQ ID NO: 3537583 - DNA, 12 bp, Homo sapiens
actggggcctcc

SEQ ID NO: 3537584 - DNA, 16 bp, Homo sapiens
actggggcctccagaa

SEQ ID NO: 3537585 - DNA, 14 bp, Homo sapiens
actgtcactcattg

SEQ ID NO: 3537586 - DNA, 23 bp, Homo sapiens
actgtcactcattgctgagcctc

SEQ ID NO: 3537587 - DNA, 21 bp, Homo sapiens
acttagatctgagccctccct

SEQ ID NO: 3537588 - DNA, 21 bp, Homo sapiens
acttgctgcagtatgaaaata

SEQ ID NO: 3537589 - DNA, 18 bp, Homo sapiens
agaaataaagtttgctta

SEQ ID NO: 3537590 - DNA, 21 bp, Homo sapiens
agaaataaagtttgcttagaa

SEQ ID NO: 3537591 - DNA, 19 bp, Homo sapiens
agaagttcatgggcacctc

SEQ ID NO: 3537592 - DNA, 23 bp, Homo sapiens
agaagttcatgggcacctcatgg

SEQ ID NO: 3537593 - DNA, 21 bp, Homo sapiens
agacaccctcaacctcttctg

SEQ ID NO: 3537594 - DNA, 17 bp, Homo sapiens
agaccaaaatgacaatg

SEQ ID NO: 3537595 - DNA, 16 bp, Homo sapiens
agaccctcccccacca

SEQ ID NO: 3537596 - DNA, 16 bp, Homo sapiens
agaccctcttctctgg

SEQ ID NO: 3537597 - DNA, 18 bp, Homo sapiens
agaccctcttctctgggc

SEQ ID NO: 3537598 - DNA, 19 bp, Homo sapiens
agaccctcttctctgggcc

SEQ ID NO: 3537599 - DNA, 18 bp, Homo sapiens
agacttagatctgagccc

SEQ ID NO: 3537600 - DNA, 22 bp, Homo sapiens
agacttagatctgagccctccc

SEQ ID NO: 3537601 - DNA, 13 bp, Homo sapiens
agatatttttcat

SEQ ID NO: 3537602 - DNA, 16 bp, Homo sapiens
agatatttttcatgat

SEQ ID NO: 3537603 - DNA, 13 bp, Homo sapiens
agatctgagccct

SEQ ID NO: 3537604 - DNA, 21 bp, Homo sapiens
agatgtttccagacttccttg

SEQ ID NO: 3537605 - DNA, 19 bp, Homo sapiens
agcatctggattctgccta

SEQ ID NO: 3537606 - DNA, 17 bp, Homo sapiens
agccagctccctctatt

SEQ ID NO: 3537607 - DNA, 19 bp, Homo sapiens
agccagctccctctattta

SEQ ID NO: 3537608 - DNA, 16 bp, Homo sapiens
agccagctctgcatta

SEQ ID NO: 3537609 - DNA, 16 bp, Homo sapiens
agccccctggcctctg

SEQ ID NO: 3537610 - DNA, 19 bp, Homo sapiens
agccctccccatggagcca

SEQ ID NO: 3537611 - DNA, 21 bp, Homo sapiens
agccctccccatggagccagc

SEQ ID NO: 3537612 - DNA, 16 bp, Homo sapiens
agccctccctcttccc

SEQ ID NO: 3537613 - DNA, 21 bp, Homo sapiens
agccctccctcttcccagcac

SEQ ID NO: 3537614 - DNA, 13 bp, Homo sapiens
ctcttctctgggc

SEQ ID NO: 3537615 - DNA, 15 bp, Homo sapiens
ctcttctctgggccc

SEQ ID NO: 3537616 - DNA, 16 bp, Homo sapiens
ctcttctctgggccca

SEQ ID NO: 3537617 - DNA, 13 bp, Homo sapiens
ctgaattaaagtc

SEQ ID NO: 3537618 - DNA, 21 bp, Homo sapiens
ctgaattaaagtctacactgc

SEQ ID NO: 3537619 - DNA, 18 bp, Homo sapiens
ctgacacaaaaaaagttg

SEQ ID NO: 3537620 - DNA, 23 bp, Homo sapiens
ctgagccctccctcttcccagca

SEQ ID NO: 3537621 - DNA, 13 bp, Homo sapiens
ctgaggccccagg

SEQ ID NO: 3537622 - DNA, 22 bp, Homo sapiens
ctgaggccccagggctgtgggt

SEQ ID NO: 3537623 - DNA, 14 bp, Homo sapiens
ctgccttggctcag

SEQ ID NO: 3537624 - DNA, 12 bp, Homo sapiens
ctgctcccagcc

SEQ ID NO: 3537625 - DNA, 16 bp, Homo sapiens
ctgctccccaggggag

SEQ ID NO: 3537626 - DNA, 19 bp, Homo sapiens
ctggagaccagggagcctt

SEQ ID NO: 3537627 - DNA, 17 bp, Homo sapiens
ctggcatctgacacaaa

SEQ ID NO: 3537628 - DNA, 19 bp, Homo sapiens
ctggcatctgacacaaaaa

SEQ ID NO: 3537629 - DNA, 13 bp, Homo sapiens
ctggctggggatg

SEQ ID NO: 3537630 - DNA, 17 bp, Homo sapiens
ctggcttttctggctgg

SEQ ID NO: 3537631 - DNA, 19 bp, Homo sapiens
ctggggatcccgtgctgga

SEQ ID NO: 3537632 - DNA, 15 bp, Homo sapiens
ctggggcctccagaa

SEQ ID NO: 3537633 - DNA, 17 bp, Homo sapiens
ctgtcaacctgaattaa

SEQ ID NO: 3537634 - DNA, 21 bp, Homo sapiens
ctgtcaacctgaattaaagtc

SEQ ID NO: 3537635 - DNA, 14 bp, Homo sapiens
ctgtcactcattgc

SEQ ID NO: 3537636 - DNA, 23 bp, Homo sapiens
ctgtcactcattgctgagcctct

SEQ ID NO: 3537637 - DNA, 22 bp, Homo sapiens
ctgtccaatttctattaaaggt

SEQ ID NO: 3537638 - DNA, 13 bp, Homo sapiens
ctgtgggtgggga

SEQ ID NO: 3537639 - DNA, 21 bp, Homo sapiens
ctgtgggtggggaaggaaggc

SEQ ID NO: 3537640 - DNA, 23 bp, Homo sapiens
ctgttgccacactttcactgggg

SEQ ID NO: 3537641 - DNA, 21 bp, Homo sapiens
cttactgatttttaagttatt

SEQ ID NO: 3537642 - DNA, 16 bp, Homo sapiens
cttagatctgagccct

SEQ ID NO: 3537643 - DNA, 20 bp, Homo sapiens
cttagatctgagccctccct

SEQ ID NO: 3537644 - DNA, 15 bp, Homo sapiens
cttaggccttcctct

SEQ ID NO: 3537645 - DNA, 15 bp, Homo sapiens
cttcctctctccaga

SEQ ID NO: 3537646 - DNA, 16 bp, Homo sapiens
cttcctctctccagat

SEQ ID NO: 3537647 - DNA, 20 bp, Homo sapiens
cttccttgagacacggagcc

SEQ ID NO: 3537648 - DNA, 13 bp, Homo sapiens
cttcttttgatta

SEQ ID NO: 3537649 - DNA, 17 bp, Homo sapiens
cttgagacacggagccc

SEQ ID NO: 3537650 - DNA, 22 bp, Homo sapiens
cttgagacacggagcccagccc

SEQ ID NO: 3537651 - DNA, 18 bp, Homo sapiens
cttgagaccctcttctct

SEQ ID NO: 3537652 - DNA, 23 bp, Homo sapiens
cttgagaccctcttctctgggcc

SEQ ID NO: 3537653 - DNA, 12 bp, Homo sapiens
cttggctcagac

SEQ ID NO: 3537654 - DNA, 14 bp, Homo sapiens
cttggctcagacat

SEQ ID NO: 3537655 - DNA, 17 bp, Homo sapiens
cttggttcatcagtgtt

SEQ ID NO: 3537656 - DNA, 20 bp, Homo sapiens
ctttattaccccctccttca

SEQ ID NO: 3537657 - DNA, 22 bp, Homo sapiens
ctttccagcctatatttcctct

SEQ ID NO: 3537658 - DNA, 21 bp, Homo sapiens
gaaattgacacaagtggacct

SEQ ID NO: 3537659 - DNA, 17 bp, Homo sapiens
gaacatccaaccttccc

SEQ ID NO: 3537660 - DNA, 15 bp, Homo sapiens
gaaccaggccttctg

SEQ ID NO: 3537661 - DNA, 11 bp, Homo sapiens
gaactgagccg

SEQ ID NO: 3537662 - DNA, 20 bp, Homo sapiens
gaagacctcacctagaaatt

SEQ ID NO: 3537663 - DNA, 19 bp, Homo sapiens
gaagacttagatctgagcc

SEQ ID NO: 3537664 - DNA, 20 bp, Homo sapiens
gaagacttagatctgagccc

SEQ ID NO: 3537665 - DNA, 15 bp, Homo sapiens
gaagagatttttcat

SEQ ID NO: 3537666 - DNA, 19 bp, Homo sapiens
gaagggccttgagcatctg

SEQ ID NO: 3537667 - DNA, 21 bp, Homo sapiens
gaagtacccgttcacattttt

SEQ ID NO: 3537668 - DNA, 21 bp, Homo sapiens
gaagtttgtgttctgtttgtt

SEQ ID NO: 3537669 - DNA, 16 bp, Homo sapiens
gaatctggagaccagg

SEQ ID NO: 3537670 - DNA, 21 bp, Homo sapiens
gaatgctgcaggacttgagaa

SEQ ID NO: 3537671 - DNA, 14 bp, Homo sapiens
gaattaaagtctac

SEQ ID NO: 3537672 - DNA, 16 bp, Homo sapiens
gaattcaaactggggc

SEQ ID NO: 3537673 - DNA, 23 bp, Homo sapiens
gaattcaaactggggcctccaga

SEQ ID NO: 3537674 - DNA, 20 bp, Homo sapiens
gacaatgatgatgataatga

SEQ ID NO: 3537675 - DNA, 15 bp, Homo sapiens
gacacggagcccagc

SEQ ID NO: 3537676 - DNA, 17 bp, Homo sapiens
gacatgttttccgtgaa

SEQ ID NO: 3537677 - DNA, 18 bp, Homo sapiens
gactccaggatcctcctg

SEQ ID NO: 3537678 - DNA, 11 bp, Homo sapiens
gactcctccct

SEQ ID NO: 3537679 - DNA, 14 bp, Homo sapiens
gacttagatctgag

SEQ ID NO: 3537680 - DNA, 16 bp, Homo sapiens
gacttagatctgagcc

SEQ ID NO: 3537681 - DNA, 14 bp, Homo sapiens
gacttccttgagac

SEQ ID NO: 3537682 - DNA, 15 bp, Homo sapiens
gacttccttgagaca

SEQ ID NO: 3537683 - DNA, 20 bp, Homo sapiens
gacttccttgagacacggag

SEQ ID NO: 3537684 - DNA, 23 bp, Homo sapiens
gagaaataaagtttgcttagaaa

SEQ ID NO: 3537685 - DNA, 14 bp, Homo sapiens
gagaattgggggct

SEQ ID NO: 3537686 - DNA, 16 bp, Homo sapiens
gagacacggagcccag

SEQ ID NO: 3537687 - DNA, 19 bp, Homo sapiens
gagagaggcgtcctggtga

SEQ ID NO: 3537688 - DNA, 19 bp, Homo sapiens
gagaggcgtcctggtgagg

SEQ ID NO: 3537689 - DNA, 17 bp, Homo sapiens
gagcagcagctgaggcc

SEQ ID NO: 3537690 - DNA, 13 bp, Homo sapiens
gagccctccctct

SEQ ID NO: 3537691 - DNA, 15 bp, Homo sapiens
gagccctccctcttc

SEQ ID NO: 3537692 - DNA, 15 bp, Homo sapiens
gagccgtgcagctgg

SEQ ID NO: 3537693 - DNA, 22 bp, Homo sapiens
gagcctcctctctcaaactggg

SEQ ID NO: 3537694 - DNA, 17 bp, Homo sapiens
gagcctctgctccccag

SEQ ID NO: 3537695 - DNA, 18 bp, Homo sapiens
gagcctttggttctggcc

SEQ ID NO: 3537696 - DNA, 15 bp, Homo sapiens
gagctgccttggctc

SEQ ID NO: 3537697 - DNA, 14 bp, Homo sapiens
gaggcgtcctggtg

SEQ ID NO: 3537698 - DNA, 23 bp, Homo sapiens
gatgatgacgacgacaacgatga

SEQ ID NO: 3537699 - DNA, 23 bp, Homo sapiens
gatgatgataatgatgatgacga

SEQ ID NO: 3537700 - DNA, 18 bp, Homo sapiens
gatgcttgtaacaagaaa

SEQ ID NO: 3537701 - DNA, 21 bp, Homo sapiens
gatgcttgtaacaagaaaaca

SEQ ID NO: 3537702 - DNA, 16 bp, Homo sapiens
gattctgcctaataaa

SEQ ID NO: 3537703 - DNA, 22 bp, Homo sapiens
gattgatcggagcctcctctct

SEQ ID NO: 3537704 - DNA, 22 bp, Homo sapiens
gcaacaagaccaccacttcgaa

SEQ ID NO: 3537705 - DNA, 14 bp, Homo sapiens
gcaaccactaagaa

SEQ ID NO: 3537706 - DNA, 18 bp, Homo sapiens
gcaccactgtgtatttaa

SEQ ID NO: 3537707 - DNA, 17 bp, Homo sapiens
gcacttgtgattattta

SEQ ID NO: 3537708 - DNA, 20 bp, Homo sapiens
gcacttgtgattatttatta

SEQ ID NO: 3537709 - DNA, 20 bp, Homo sapiens
gcagcagctgaggccccagg

SEQ ID NO: 3537710 - DNA, 15 bp, Homo sapiens
gcagtatgaaaataa

SEQ ID NO: 3537711 - DNA, 13 bp, Homo sapiens
gccagctccctct

SEQ ID NO: 3537712 - DNA, 21 bp, Homo sapiens
gcccagagagaggcgtcctgg

SEQ ID NO: 3537713 - DNA, 14 bp, Homo sapiens
gcccaggccctaga

SEQ ID NO: 3537714 - DNA, 17 bp, Homo sapiens
gccccagggctgtgggt

SEQ ID NO: 3537715 - DNA, 13 bp, Homo sapiens
gccccctggcctc

SEQ ID NO: 3537716 - DNA, 19 bp, Homo sapiens
gccccctggcctctgtgcc

SEQ ID NO: 3537717 - DNA, 15 bp, Homo sapiens
gccctagaccctccc

SEQ ID NO: 3537718 - DNA, 19 bp, Homo sapiens
gcctccagaactcactggg

SEQ ID NO: 3537719 - DNA, 12 bp, Homo sapiens
gcctctgtgcct

SEQ ID NO: 3537720 - DNA, 18 bp, Homo sapiens
gcctggcaagtgggtgaa

SEQ ID NO: 3537721 - DNA, 15 bp, Homo sapiens
gcctggcttttctgg

SEQ ID NO: 3537722 - DNA, 16 bp, Homo sapiens
gccttcctctctccag

SEQ ID NO: 3537723 - DNA, 22 bp, Homo sapiens
gccttcttttgattatgttttt

SEQ ID NO: 3537724 - DNA, 14 bp, Homo sapiens
gccttggctcagac

SEQ ID NO: 3537725 - DNA, 22 bp, Homo sapiens
gcgtccactttcccttcccctg

SEQ ID NO: 3537726 - DNA, 16 bp, Homo sapiens
gctcagacatgttttc

SEQ ID NO: 3537727 - DNA, 13 bp, Homo sapiens
gctgagcctctgc

SEQ ID NO: 3537728 - DNA, 19 bp, Homo sapiens
gctgagcctctgctcccca

SEQ ID NO: 3537729 - DNA, 20 bp, Homo sapiens
gctgagcctctgctccccag

SEQ ID NO: 3537730 - DNA, 17 bp, Homo sapiens
gctgcaggacttgagaa

SEQ ID NO: 3537731 - DNA, 23 bp, Homo sapiens
gctgccttggctcagacatgttt

SEQ ID NO: 3537732 - DNA, 23 bp, Homo sapiens
gctgtccaatttctattaaaggt

SEQ ID NO: 3537733 - DNA, 13 bp, Homo sapiens
gctgtgggtgggg

SEQ ID NO: 3537734 - DNA, 16 bp, Homo sapiens
gcttgtaacaagaaaa

SEQ ID NO: 3537735 - DNA, 17 bp, Homo sapiens
gcttgtaacaagaaaac

SEQ ID NO: 3537736 - DNA, 12 bp, Homo sapiens
gctttgcagtga

SEQ ID NO: 3537737 - DNA, 18 bp, Homo sapiens
ggagcagcagctgaggcc

SEQ ID NO: 3537738 - DNA, 12 bp, Homo sapiens
ggagccagctct

SEQ ID NO: 3537739 - DNA, 16 bp, Homo sapiens
ggagcccagccctccc

SEQ ID NO: 3537740 - DNA, 21 bp, Homo sapiens
ggagctgccttggctcagaca

SEQ ID NO: 3537741 - DNA, 23 bp, Homo sapiens
ggaggtgggtgagcgggtggggt

SEQ ID NO: 3537742 - DNA, 17 bp, Homo sapiens
ggatcccgtgctggaag

SEQ ID NO: 3537743 - DNA, 21 bp, Homo sapiens
ggattcaggaatgtgtggcct

SEQ ID NO: 3537744 - DNA, 20 bp, Homo sapiens
ggattgatcggagcctcctc

SEQ ID NO: 3537745 - DNA, 16 bp, Homo sapiens
ggcaaccactaagaat

SEQ ID NO: 3537746 - DNA, 15 bp, Homo sapiens
ggcaaggatgatcca

SEQ ID NO: 3537747 - DNA, 16 bp, Homo sapiens
ggcaggaggtgggtga

SEQ ID NO: 3537748 - DNA, 19 bp, Homo sapiens
cctggagcagcagctgagg

SEQ ID NO: 3537749 - DNA, 13 bp, Homo sapiens
cctggcctctgtg

SEQ ID NO: 3537750 - DNA, 14 bp, Homo sapiens
cctggcttttctgg

SEQ ID NO: 3537751 - DNA, 17 bp, Homo sapiens
cctggtagaatagatat

SEQ ID NO: 3537752 - DNA, 18 bp, Homo sapiens
cctgtcaacctgaattaa

SEQ ID NO: 3537753 - DNA, 22 bp, Homo sapiens
cctgtgactcctcccttcccca

SEQ ID NO: 3537754 - DNA, 18 bp, Homo sapiens
cctgtggatgtaaagtga

SEQ ID NO: 3537755 - DNA, 17 bp, Homo sapiens
ccttcagacaccctcaa

SEQ ID NO: 3537756 - DNA, 18 bp, Homo sapiens
ccttccccactctgctcc

SEQ ID NO: 3537757 - DNA, 15 bp, Homo sapiens
ccttcctctctccag

SEQ ID NO: 3537758 - DNA, 17 bp, Homo sapiens
ccttcctctctccagat

SEQ ID NO: 3537759 - DNA, 23 bp, Homo sapiens
cctttattaccccctccttcaga

SEQ ID NO: 3537760 - DNA, 19 bp, Homo sapiens
cgaacatccaaccttccca

SEQ ID NO: 3537761 - DNA, 19 bp, Homo sapiens
cggaacccaagcttagaac

SEQ ID NO: 3537762 - DNA, 21 bp, Homo sapiens
cggggtatcctgggggaccca

SEQ ID NO: 3537763 - DNA, 13 bp, Homo sapiens
cgtccactttccc

SEQ ID NO: 3537764 - DNA, 15 bp, Homo sapiens
cgtgaaaacggagct

SEQ ID NO: 3537765 - DNA, 17 bp, Homo sapiens
cgtgaaaacggagctga

SEQ ID NO: 3537766 - DNA, 13 bp, Homo sapiens
cgtgtccaggaga

SEQ ID NO: 3537767 - DNA, 19 bp, Homo sapiens
ctaaacaatgctgatttgg

SEQ ID NO: 3537768 - DNA, 18 bp, Homo sapiens
ctaagtccaactactaaa

SEQ ID NO: 3537769 - DNA, 19 bp, Homo sapiens
ctaataaaaaacatttatt

SEQ ID NO: 3537770 - DNA, 22 bp, Homo sapiens
ctaatgacatcaccacagttta

SEQ ID NO: 3537771 - DNA, 16 bp, Homo sapiens
ctaattatataatatt

SEQ ID NO: 3537772 - DNA, 18 bp, Homo sapiens
ctaattatataatatttt

SEQ ID NO: 3537773 - DNA, 22 bp, Homo sapiens
ctacatgatctagagccagtta

SEQ ID NO: 3537774 - DNA, 16 bp, Homo sapiens
ctagaaattgacacaa

SEQ ID NO: 3537775 - DNA, 20 bp, Homo sapiens
ctagaaattgacacaagtgg

SEQ ID NO: 3537776 - DNA, 15 bp, Homo sapiens
ctagaccctccccca

SEQ ID NO: 3537777 - DNA, 18 bp, Homo sapiens
ctagaccctcccccacca

SEQ ID NO: 3537778 - DNA, 16 bp, Homo sapiens
ctagtactaactccta

SEQ ID NO: 3537779 - DNA, 20 bp, Homo sapiens
ctagttcagacactttggaa

SEQ ID NO: 3537780 - DNA, 14 bp, Homo sapiens
ctatagcagtcatc

SEQ ID NO: 3537781 - DNA, 19 bp, Homo sapiens
ctatgaactctgttttctt

SEQ ID NO: 3537782 - DNA, 18 bp, Homo sapiens
ctatgttttgacattttt

SEQ ID NO: 3537783 - DNA, 13 bp, Homo sapiens
ctattaaaggttc

SEQ ID NO: 3537784 - DNA, 19 bp, Homo sapiens
ctattcagtggcgagaaat

SEQ ID NO: 3537785 - DNA, 12 bp, Homo sapiens
ctcaacctcttc

SEQ ID NO: 3537786 - DNA, 13 bp, Homo sapiens
ctcaacctcttct

SEQ ID NO: 3537787 - DNA, 17 bp, Homo sapiens
ctcagattatttttcct

SEQ ID NO: 3537788 - DNA, 20 bp, Homo sapiens
ctcagttcatccattctatt

SEQ ID NO: 3537789 - DNA, 21 bp, Homo sapiens
ctcatatccagtattgttcct

SEQ ID NO: 3537790 - DNA, 15 bp, Homo sapiens
ctccacagggactgt

SEQ ID NO: 3537791 - DNA, 18 bp, Homo sapiens
ctccaggatcctcctgga

SEQ ID NO: 3537792 - DNA, 17 bp, Homo sapiens
ctccccatggagccagc

SEQ ID NO: 3537793 - DNA, 13 bp, Homo sapiens
ctccctcttccca

SEQ ID NO: 3537794 - DNA, 19 bp, Homo sapiens
ctcccttccccactctgct

SEQ ID NO: 3537795 - DNA, 19 bp, Homo sapiens
ctcctggagcagcagctga

SEQ ID NO: 3537796 - DNA, 22 bp, Homo sapiens
ctcctggagcagcagctgaggc

SEQ ID NO: 3537797 - DNA, 12 bp, Homo sapiens
ctccttcagaca

SEQ ID NO: 3537798 - DNA, 20 bp, Homo sapiens
ctctatgaactctgttttct

SEQ ID NO: 3537799 - DNA, 12 bp, Homo sapiens
ctctctccagat

SEQ ID NO: 3537800 - DNA, 17 bp, Homo sapiens
ctctctccagatgtttc

SEQ ID NO: 3537801 - DNA, 12 bp, Homo sapiens
ctctgctcccag

SEQ ID NO: 3537802 - DNA, 13 bp, Homo sapiens
ctctgctccccag

SEQ ID NO: 3537803 - DNA, 22 bp, Homo sapiens
ctctgtcagtcatgcgtccact

SEQ ID NO: 3537804 - DNA, 15 bp, Homo sapiens
ctctgtgccttcttt

SEQ ID NO: 3537805 - DNA, 14 bp, Homo sapiens
ctcttcccagcaca

SEQ ID NO: 3537806 - DNA, 11 bp, Homo sapiens
ctcttctggct

SEQ ID NO: 3537807 - DNA, 14 bp, Homo sapiens
ctcttctggctcaa

SEQ ID NO: 3537808 - DNA, 20 bp, Homo sapiens
ctgaaaatcgagtttttcct

SEQ ID NO: 3537809 - DNA, 19 bp, Homo sapiens
ctgaacaataggctgttcc

SEQ ID NO: 3537810 - DNA, 12 bp, Homo sapiens
ctgaattaaagt

SEQ ID NO: 3537811 - DNA, 14 bp, Homo sapiens
ctgagagaaaataa

SEQ ID NO: 3537812 - DNA, 18 bp, Homo sapiens
ctgagccctccctcttcc

SEQ ID NO: 3537813 - DNA, 19 bp, Homo sapiens
ctgagccgtgcagctggga

SEQ ID NO: 3537814 - DNA, 15 bp, Homo sapiens
ctgagcctctgctcc

SEQ ID NO: 3537815 - DNA, 15 bp, Homo sapiens
ctgatttcaaggtcc

SEQ ID NO: 3537816 - DNA, 17 bp, Homo sapiens
ctgcagtatgaaaataa

SEQ ID NO: 3537817 - DNA, 18 bp, Homo sapiens
ctgccttggctcagacat

SEQ ID NO: 3537818 - DNA, 22 bp, Homo sapiens
ctggaagacttagatctgagcc

SEQ ID NO: 3537819 - DNA, 23 bp, Homo sapiens
ctggaagacttagatctgagccc

SEQ ID NO: 3537820 - DNA, 17 bp, Homo sapiens
ctggagaccagggagcc

SEQ ID NO: 3537821 - DNA, 18 bp, Homo sapiens
ctggagaccagggagcct

SEQ ID NO: 3537822 - DNA, 13 bp, Homo sapiens
ctggccagaatgc

SEQ ID NO: 3537823 - DNA, 16 bp, Homo sapiens
ctggcctctgtgcctt

SEQ ID NO: 3537824 - DNA, 14 bp, Homo sapiens
ctggcttttctggc

SEQ ID NO: 3537825 - DNA, 16 bp, Homo sapiens
ctgggatttgaaccag

SEQ ID NO: 3537826 - DNA, 20 bp, Homo sapiens
ctgggatttgaactgagccg

SEQ ID NO: 3537827 - DNA, 21 bp, Homo sapiens
ctggggatcccgtgctggaag

SEQ ID NO: 3537828 - DNA, 11 bp, Homo sapiens
ctggggcctcc

SEQ ID NO: 3537829 - DNA, 12 bp, Homo sapiens
ctggggcctcca

SEQ ID NO: 3537830 - DNA, 17 bp, Homo sapiens
ctggggcctccagaact

SEQ ID NO: 3537831 - DNA, 13 bp, Homo sapiens
ctggtgaggacaa

SEQ ID NO: 3537832 - DNA, 21 bp, Homo sapiens
ctgtcactcattgctgagcct

SEQ ID NO: 3537833 - DNA, 22 bp, Homo sapiens
ctgtcactcattgctgagcctc

SEQ ID NO: 3537834 - DNA, 13 bp, Homo sapiens
ctgtctattctag

SEQ ID NO: 3537835 - DNA, 12 bp, Homo sapiens
ctgtgggtgggg

SEQ ID NO: 3537836 - DNA, 15 bp, Homo sapiens
ctgtgggtggggaag

SEQ ID NO: 3537837 - DNA, 16 bp, Homo sapiens
ctgtgtgaccttgggc

SEQ ID NO: 3537838 - DNA, 20 bp, Homo sapiens
ctgttcccatgtagccccct

SEQ ID NO: 3537839 - DNA, 17 bp, Homo sapiens
cttaatacacacagtta

SEQ ID NO: 3537840 - DNA, 21 bp, Homo sapiens
cttagatctgagccctccctc

SEQ ID NO: 3537841 - DNA, 13 bp, Homo sapiens
cttaggccttcct

SEQ ID NO: 3537842 - DNA, 17 bp, Homo sapiens
cttaggccttcctctct

SEQ ID NO: 3537843 - DNA, 17 bp, Homo sapiens
cttatttcatgaaaatt

SEQ ID NO: 3537844 - DNA, 17 bp, Homo sapiens
cttcccacctgtcaacc

SEQ ID NO: 3537845 - DNA, 16 bp, Homo sapiens
cttccccactctgctc

SEQ ID NO: 3537846 - DNA, 17 bp, Homo sapiens
cttccccactctgctcc

SEQ ID NO: 3537847 - DNA, 18 bp, Homo sapiens
cttccccactctgctccc

SEQ ID NO: 3537848 - DNA, 22 bp, Homo sapiens
cttccctgtatgattccttgat

SEQ ID NO: 3537849 - DNA, 18 bp, Homo sapiens
cttctctgggcccagaga

SEQ ID NO: 3537850 - DNA, 17 bp, Homo sapiens
cttgagaccctcttctc

SEQ ID NO: 3537851 - DNA, 13 bp, Homo sapiens
cttgagcatctgg

SEQ ID NO: 3537852 - DNA, 12 bp, Homo sapiens
cttgctgtccaa

SEQ ID NO: 3537853 - DNA, 16 bp, Homo sapiens
cttgctgtgtgacctt

SEQ ID NO: 3537854 - DNA, 16 bp, Homo sapiens
cttggctcagacatgt

SEQ ID NO: 3537855 - DNA, 17 bp, Homo sapiens
cttgtgattatttatta

SEQ ID NO: 3537856 - DNA, 16 bp, Homo sapiens
cttgtgtcaaacagta

SEQ ID NO: 3537857 - DNA, 22 bp, Homo sapiens
ctttattaccccctccttcaga

SEQ ID NO: 3537858 - DNA, 15 bp, Homo sapiens
ctttcactggggatc

SEQ ID NO: 3537859 - DNA, 16 bp, Homo sapiens
ctttcccttcccctgt

SEQ ID NO: 3537860 - DNA, 16 bp, Homo sapiens
ctttcttgctgtccaa

SEQ ID NO: 3537861 - DNA, 17 bp, Homo sapiens
ctttggaagtttgtgtt

SEQ ID NO: 3537862 - DNA, 11 bp, Homo sapiens
ctttgttccct

SEQ ID NO: 3537863 - DNA, 17 bp, Homo sapiens
gaaataaagtttgctta

SEQ ID NO: 3537864 - DNA, 19 bp, Homo sapiens
gaagacctcacctagaaat

SEQ ID NO: 3537865 - DNA, 18 bp, Homo sapiens
gaagagatttttcatgat

SEQ ID NO: 3537866 - DNA, 18 bp, Homo sapiens
gaagggccttgagcatct

SEQ ID NO: 3537867 - DNA, 22 bp, Homo sapiens
gaagggccttgagcatctggat

SEQ ID NO: 3537868 - DNA, 20 bp, Homo sapiens
gaagtgctggcaaccactaa

SEQ ID NO: 3537869 - DNA, 16 bp, Homo sapiens
gaatgtatttatttgg

SEQ ID NO: 3537870 - DNA, 11 bp, Homo sapiens
gaattaaagtc

SEQ ID NO: 3537871 - DNA, 12 bp, Homo sapiens
gaattaaagtct

SEQ ID NO: 3537872 - DNA, 22 bp, Homo sapiens
gacacaagtggaccttaggcct

SEQ ID NO: 3537873 - DNA, 19 bp, Homo sapiens
gacccaatgtaggagctgc

SEQ ID NO: 3537874 - DNA, 12 bp, Homo sapiens
gaccctccccca

SEQ ID NO: 3537875 - DNA, 15 bp, Homo sapiens
gaccttaggccttcc

SEQ ID NO: 3537876 - DNA, 16 bp, Homo sapiens
gaccttaggccttcct

SEQ ID NO: 3537877 - DNA, 21 bp, Homo sapiens
gaccttaggccttcctctctc

SEQ ID NO: 3537878 - DNA, 14 bp, Homo sapiens
gactcctcccttcc

SEQ ID NO: 3537879 - DNA, 18 bp, Homo sapiens
gactcctcccttccccac

SEQ ID NO: 3537880 - DNA, 19 bp, Homo sapiens
gactcctcccttccccact

SEQ ID NO: 3537881 - DNA, 16 bp, Homo sapiens
gacttccttgagacac

SEQ ID NO: 3537882 - DNA, 16 bp, Homo sapiens
gagaccagggagcctt

SEQ ID NO: 3537883 - DNA, 15 bp, Homo sapiens
gagaggcgtcctggt

SEQ ID NO: 3537884 - DNA, 17 bp, Homo sapiens
actgaagcgaacatctt

SEQ ID NO: 3537885 - DNA, 16 bp, Homo sapiens
actgatcatatttgtg

SEQ ID NO: 3537886 - DNA, 13 bp, Homo sapiens
actgtaaacagtt

SEQ ID NO: 3537887 - DNA, 20 bp, Homo sapiens
actttctcctggtgtttttc

SEQ ID NO: 3537888 - DNA, 18 bp, Homo sapiens
agaacagtctctggaaga

SEQ ID NO: 3537889 - DNA, 12 bp, Homo sapiens
agacacacacac

SEQ ID NO: 3537890 - DNA, 19 bp, Homo sapiens
agaccggacaagagcctgc

SEQ ID NO: 3537891 - DNA, 18 bp, Homo sapiens
agcaacaaaactatggaa

SEQ ID NO: 3537892 - DNA, 20 bp, Homo sapiens
agcaacaaaactatggaaat

SEQ ID NO: 3537893 - DNA, 23 bp, Homo sapiens
agcacggagtgttggggctgggg

SEQ ID NO: 3537894 - DNA, 13 bp, Homo sapiens
agcaggcaggcag

SEQ ID NO: 3537895 - DNA, 20 bp, Homo sapiens
agcaggcaggcagcctgaga

SEQ ID NO: 3537896 - DNA, 12 bp, Homo sapiens
agcagtgtctct

SEQ ID NO: 3537897 - DNA, 14 bp, Homo sapiens
agcagtgtctctca

SEQ ID NO: 3537898 - DNA, 12 bp, Homo sapiens
agcctgagagct

SEQ ID NO: 3537899 - DNA, 16 bp, Homo sapiens
agcctgagagctggcc

SEQ ID NO: 3537900 - DNA, 17 bp, Homo sapiens
agcctgagagctggccc

SEQ ID NO: 3537901 - DNA, 22 bp, Homo sapiens
agcgaaaatgtattattgtaaa

SEQ ID NO: 3537902 - DNA, 16 bp, Homo sapiens
agcgaacatcttcata

SEQ ID NO: 3537903 - DNA, 17 bp, Homo sapiens
agcgaacatcttcatat

SEQ ID NO: 3537904 - DNA, 18 bp, Homo sapiens
agcggaagggactctggg

SEQ ID NO: 3537905 - DNA, 12 bp, Homo sapiens
agcggggctggc

SEQ ID NO: 3537906 - DNA, 16 bp, Homo sapiens
agctacgcagacaaga

SEQ ID NO: 3537907 - DNA, 20 bp, Homo sapiens
agctcagttgagaaacagtt

SEQ ID NO: 3537908 - DNA, 18 bp, Homo sapiens
agcttctttctcggtggc

SEQ ID NO: 3537909 - DNA, 22 bp, Homo sapiens
aggacattggccccgcagtgcc

SEQ ID NO: 3537910 - DNA, 21 bp, Homo sapiens
aggaggcacaagccaaggaag

SEQ ID NO: 3537911 - DNA, 17 bp, Homo sapiens
aggagggcttgagagct

SEQ ID NO: 3537912 - DNA, 12 bp, Homo sapiens
aggcagcctgag

SEQ ID NO: 3537913 - DNA, 12 bp, Homo sapiens
aggctggctggg

SEQ ID NO: 3537914 - DNA, 18 bp, Homo sapiens
aggctttgggatatgctg

SEQ ID NO: 3537915 - DNA, 14 bp, Homo sapiens
agggactctgggct

SEQ ID NO: 3537916 - DNA, 19 bp, Homo sapiens
agggactctgggctgtgcc

SEQ ID NO: 3537917 - DNA, 19 bp, Homo sapiens
agggcacgaggctctagaa

SEQ ID NO: 3537918 - DNA, 23 bp, Homo sapiens
agggcacgaggctctagaaatgc

SEQ ID NO: 3537919 - DNA, 23 bp, Homo sapiens
agggcttgagagctcagcctgcc

SEQ ID NO: 3537920 - DNA, 22 bp, Homo sapiens
agggggttcgcaccgtgctggg

SEQ ID NO: 3537921 - DNA, 14 bp, Homo sapiens
aggtttcttctctg

SEQ ID NO: 3537922 - DNA, 15 bp, Homo sapiens
aggtttcttctctgg

SEQ ID NO: 3537923 - DNA, 16 bp, Homo sapiens
aggtttcttctctgga

SEQ ID NO: 3537924 - DNA, 18 bp, Homo sapiens
agtcagcctggctgggct

SEQ ID NO: 3537925 - DNA, 23 bp, Homo sapiens
agtgggctttgtggaaacagctg

SEQ ID NO: 3537926 - DNA, 17 bp, Homo sapiens
agtgttggggctggggg

SEQ ID NO: 3537927 - DNA, 11 bp, Homo sapiens
agttaattttt

SEQ ID NO: 3537928 - DNA, 13 bp, Homo sapiens
agttaatttttgt

SEQ ID NO: 3537929 - DNA, 22 bp, Homo sapiens
agttaatttttgtataaggtga

SEQ ID NO: 3537930 - DNA, 21 bp, Homo sapiens
ataaatttcagcctacattga

SEQ ID NO: 3537931 - DNA, 21 bp, Homo sapiens
atacaatatggacatgtaaaa

SEQ ID NO: 3537932 - DNA, 12 bp, Homo sapiens
atactctgttgc

SEQ ID NO: 3537933 - DNA, 16 bp, Homo sapiens
atactctgttgcctcc

SEQ ID NO: 3537934 - DNA, 17 bp, Homo sapiens
atactctgttgcctcct

SEQ ID NO: 3537935 - DNA, 22 bp, Homo sapiens
atactctgttgcctcctctctc

SEQ ID NO: 3537936 - DNA, 17 bp, Homo sapiens
atagctgaaattccagt

SEQ ID NO: 3537937 - DNA, 18 bp, Homo sapiens
atatatgtatatacacat

SEQ ID NO: 3537938 - DNA, 18 bp, Homo sapiens
atatctcctttaatgaca

SEQ ID NO: 3537939 - DNA, 19 bp, Homo sapiens
atatctcctttaatgacat

SEQ ID NO: 3537940 - DNA, 16 bp, Homo sapiens
atatgagagctctagt

SEQ ID NO: 3537941 - DNA, 19 bp, Homo sapiens
atcagtgtgttactatcta

SEQ ID NO: 3537942 - DNA, 21 bp, Homo sapiens
atccaagcttaaccaaggctc

SEQ ID NO: 3537943 - DNA, 21 bp, Homo sapiens
atccttgactgaagcgaacat

SEQ ID NO: 3537944 - DNA, 22 bp, Homo sapiens
atctattttaccatatgtttat

SEQ ID NO: 3537945 - DNA, 13 bp, Homo sapiens
atctattttgagt

SEQ ID NO: 3537946 - DNA, 21 bp, Homo sapiens
atctattttgagttaattttt

SEQ ID NO: 3537947 - DNA, 22 bp, Homo sapiens
atctattttgagttaatttttg

SEQ ID NO: 3537948 - DNA, 17 bp, Homo sapiens
atctgtttcctgttctc

SEQ ID NO: 3537949 - DNA, 22 bp, Homo sapiens
atctgtttcctgttctcttgta

SEQ ID NO: 3537950 - DNA, 12 bp, Homo sapiens
atcttcatataa

SEQ ID NO: 3537951 - DNA, 15 bp, Homo sapiens
atcttcatataaact

SEQ ID NO: 3537952 - DNA, 23 bp, Homo sapiens
atcttctgctaaatttttgttgg

SEQ ID NO: 3537953 - DNA, 23 bp, Homo sapiens
atgaattcatactctgttgcctc

SEQ ID NO: 3537954 - DNA, 14 bp, Homo sapiens
atgactccaggaag

SEQ ID NO: 3537955 - DNA, 17 bp, Homo sapiens
atgcccttcactttctc

SEQ ID NO: 3537956 - DNA, 18 bp, Homo sapiens
atgcccttcactttctcc

SEQ ID NO: 3537957 - DNA, 21 bp, Homo sapiens
atgcccttcactttctcctgg

SEQ ID NO: 3537958 - DNA, 18 bp, Homo sapiens
atgtaaaaagacaaaaac

SEQ ID NO: 3537959 - DNA, 17 bp, Homo sapiens
atgtactgtaaacagtt

SEQ ID NO: 3537960 - DNA, 14 bp, Homo sapiens
atgtatatacacat

SEQ ID NO: 3537961 - DNA, 19 bp, Homo sapiens
atgtttatgtactgtaaac

SEQ ID NO: 3537962 - DNA, 13 bp, Homo sapiens
attaaaacttggg

SEQ ID NO: 3537963 - DNA, 14 bp, Homo sapiens
attcactcagaaga

SEQ ID NO: 3537964 - DNA, 19 bp, Homo sapiens
attcatactctgttgcctc

SEQ ID NO: 3537965 - DNA, 22 bp, Homo sapiens
attcatactctgttgcctcctc

SEQ ID NO: 3537966 - DNA, 17 bp, Homo sapiens
attctatactttcttgt

SEQ ID NO: 3537967 - DNA, 18 bp, Homo sapiens
attgaagggtctgtttaa

SEQ ID NO: 3537968 - DNA, 12 bp, Homo sapiens
attgatttgacc

SEQ ID NO: 3537969 - DNA, 23 bp, Homo sapiens
attgtttcagtgccatttgttaa

SEQ ID NO: 3537970 - DNA, 15 bp, Homo sapiens
atttggaaagtgtgt

SEQ ID NO: 3537971 - DNA, 22 bp, Homo sapiens
atttgttaaaaagactgttatt

SEQ ID NO: 3537972 - DNA, 15 bp, Homo sapiens
attttgaagtcagag

SEQ ID NO: 3537973 - DNA, 21 bp, Homo sapiens
caaaaaaaaaattgtttttcc

SEQ ID NO: 3537974 - DNA, 15 bp, Homo sapiens
caaaactatggaaat

SEQ ID NO: 3537975 - DNA, 14 bp, Homo sapiens
caaacagacaagca

SEQ ID NO: 3537976 - DNA, 13 bp, Homo sapiens
caaactggggctg

SEQ ID NO: 3537977 - DNA, 14 bp, Homo sapiens
caaagtttgtggta

SEQ ID NO: 3537978 - DNA, 18 bp, Homo sapiens
caacattgttcattcttg

SEQ ID NO: 3537979 - DNA, 22 bp, Homo sapiens
cacaagccaaggaagtctgtgt

SEQ ID NO: 3537980 - DNA, 19 bp, Homo sapiens
cacagacacacacacacct

SEQ ID NO: 3537981 - DNA, 22 bp, Homo sapiens
gattagtgtagtgttaaagtga

SEQ ID NO: 3537982 - DNA, 15 bp, Homo sapiens
gattcactcagaaga

SEQ ID NO: 3537983 - DNA, 18 bp, Homo sapiens
gcaccgtgctgggctccc

SEQ ID NO: 3537984 - DNA, 21 bp, Homo sapiens
gcacggagtgttggggctggg

SEQ ID NO: 3537985 - DNA, 23 bp, Homo sapiens
gcacggagtgttggggctggggg

SEQ ID NO: 3537986 - DNA, 16 bp, Homo sapiens
gcagcctgagagctgg

SEQ ID NO: 3537987 - DNA, 12 bp, Homo sapiens
gcagctggtgtg

SEQ ID NO: 3537988 - DNA, 21 bp, Homo sapiens
gcaggcagcctgagagctggc

SEQ ID NO: 3537989 - DNA, 16 bp, Homo sapiens
gcaggggaaactctgg

SEQ ID NO: 3537990 - DNA, 17 bp, Homo sapiens
gcaggggaaactctggt

SEQ ID NO: 3537991 - DNA, 23 bp, Homo sapiens
gcagtgccctgccccagtcagcc

SEQ ID NO: 3537992 - DNA, 23 bp, Homo sapiens
gccaaggaagtctgtgtctacca

SEQ ID NO: 3537993 - DNA, 12 bp, Homo sapiens
gcccaggggtcc

SEQ ID NO: 3537994 - DNA, 22 bp, Homo sapiens
gccccagtcagcctggctgggc

SEQ ID NO: 3537995 - DNA, 15 bp, Homo sapiens
gccctcgggtggggc

SEQ ID NO: 3537996 - DNA, 18 bp, Homo sapiens
gcccttcactttctcctg

SEQ ID NO: 3537997 - DNA, 14 bp, Homo sapiens
gccctttggcttca

SEQ ID NO: 3537998 - DNA, 14 bp, Homo sapiens
gcctcacatctccc

SEQ ID NO: 3537999 - DNA, 15 bp, Homo sapiens
gcctcacatctccct

SEQ ID NO: 3538000 - DNA, 13 bp, Homo sapiens
gcctcctctctcc

SEQ ID NO: 3538001 - DNA, 15 bp, Homo sapiens
gcctcctctctccct

SEQ ID NO: 3538002 - DNA, 19 bp, Homo sapiens
gcctcctctctccctgcct

SEQ ID NO: 3538003 - DNA, 13 bp, Homo sapiens
gcctgagagctgg

SEQ ID NO: 3538004 - DNA, 16 bp, Homo sapiens
gcctgagagctggccc

SEQ ID NO: 3538005 - DNA, 18 bp, Homo sapiens
gcctgagagctggcccag

SEQ ID NO: 3538006 - DNA, 19 bp, Homo sapiens
gcctgagagctggcccagg

SEQ ID NO: 3538007 - DNA, 20 bp, Homo sapiens
gcctttcctagctagagaag

SEQ ID NO: 3538008 - DNA, 20 bp, Homo sapiens
gcgaggcattaaaacttggg

SEQ ID NO: 3538009 - DNA, 17 bp, Homo sapiens
gcggaagggactctggg

SEQ ID NO: 3538010 - DNA, 14 bp, Homo sapiens
gctccaggagggct

SEQ ID NO: 3538011 - DNA, 22 bp, Homo sapiens
gctctagaaatgcccttcactt

SEQ ID NO: 3538012 - DNA, 15 bp, Homo sapiens
gctgaacctgtctcc

SEQ ID NO: 3538013 - DNA, 13 bp, Homo sapiens
gctgatgtttatg

SEQ ID NO: 3538014 - DNA, 22 bp, Homo sapiens
gctgatgtttatgtactgtaaa

SEQ ID NO: 3538015 - DNA, 15 bp, Homo sapiens
gctgcccactctggg

SEQ ID NO: 3538016 - DNA, 21 bp, Homo sapiens
gctgcccactctggggacccg

SEQ ID NO: 3538017 - DNA, 17 bp, Homo sapiens
gctggctgggggcagga

SEQ ID NO: 3538018 - DNA, 17 bp, Homo sapiens
gctgggctccccctgac

SEQ ID NO: 3538019 - DNA, 15 bp, Homo sapiens
gctgggggccagctc

SEQ ID NO: 3538020 - DNA, 18 bp, Homo sapiens
gctgggggccagctccag

SEQ ID NO: 3538021 - DNA, 12 bp, Homo sapiens
gctgggggctgg

SEQ ID NO: 3538022 - DNA, 19 bp, Homo sapiens
gctggtgggtctgcagctg

SEQ ID NO: 3538023 - DNA, 20 bp, Homo sapiens
gctggtggtcatgaattcat

SEQ ID NO: 3538024 - DNA, 20 bp, Homo sapiens
gctgtgcctgaggctggctg

SEQ ID NO: 3538025 - DNA, 23 bp, Homo sapiens
gctgtgcctgaggctggctgggg

SEQ ID NO: 3538026 - DNA, 20 bp, Homo sapiens
gctgtgttttcgatgatgat

SEQ ID NO: 3538027 - DNA, 14 bp, Homo sapiens
gcttgagagctcag

SEQ ID NO: 3538028 - DNA, 13 bp, Homo sapiens
gctttcctgctgt

SEQ ID NO: 3538029 - DNA, 20 bp, Homo sapiens
gctttcctgctgtcttctcc

SEQ ID NO: 3538030 - DNA, 21 bp, Homo sapiens
ggaaacacacacagacacaca

SEQ ID NO: 3538031 - DNA, 13 bp, Homo sapiens
ggaaacagctggt

SEQ ID NO: 3538032 - DNA, 23 bp, Homo sapiens
ggaacattttttttttttccttt

SEQ ID NO: 3538033 - DNA, 13 bp, Homo sapiens
ggaagtctgtgtc

SEQ ID NO: 3538034 - DNA, 12 bp, Homo sapiens
ggacatgtaaaa

SEQ ID NO: 3538035 - DNA, 14 bp, Homo sapiens
ggacccgctggggg

SEQ ID NO: 3538036 - DNA, 17 bp, Homo sapiens
ggacccgctgggggctg

SEQ ID NO: 3538037 - DNA, 13 bp, Homo sapiens
ggactctgggctg

SEQ ID NO: 3538038 - DNA, 18 bp, Homo sapiens
ggactctgggctgtgcct

SEQ ID NO: 3538039 - DNA, 10 bp, Homo sapiens
ggagaagttt

SEQ ID NO: 3538040 - DNA, 15 bp, Homo sapiens
catatattgtgtggt

SEQ ID NO: 3538041 - DNA, 15 bp, Homo sapiens
catctcccttccacc

SEQ ID NO: 3538042 - DNA, 16 bp, Homo sapiens
catctcccttccacct

SEQ ID NO: 3538043 - DNA, 17 bp, Homo sapiens
catctcccttccacctc

SEQ ID NO: 3538044 - DNA, 20 bp, Homo sapiens
catctcccttccacctcaca

SEQ ID NO: 3538045 - DNA, 11 bp, Homo sapiens
catcttcatat

SEQ ID NO: 3538046 - DNA, 13 bp, Homo sapiens
catcttcatataa

SEQ ID NO: 3538047 - DNA, 17 bp, Homo sapiens
catgaattcatactctg

SEQ ID NO: 3538048 - DNA, 23 bp, Homo sapiens
catgaattcatactctgttgcct

SEQ ID NO: 3538049 - DNA, 14 bp, Homo sapiens
catgatgatgatga

SEQ ID NO: 3538050 - DNA, 22 bp, Homo sapiens
catgtaaaaagacaaaaaccaa

SEQ ID NO: 3538051 - DNA, 14 bp, Homo sapiens
cattcttgttcaaa

SEQ ID NO: 3538052 - DNA, 15 bp, Homo sapiens
cattgatttctaatg

SEQ ID NO: 3538053 - DNA, 16 bp, Homo sapiens
cattgctgttttaatt

SEQ ID NO: 3538054 - DNA, 18 bp, Homo sapiens
cattgctgttttaatttg

SEQ ID NO: 3538055 - DNA, 21 bp, Homo sapiens
cattgctgttttaatttgtat

SEQ ID NO: 3538056 - DNA, 19 bp, Homo sapiens
cattttttttttttccttt

SEQ ID NO: 3538057 - DNA, 18 bp, Homo sapiens
ccaagttatctgtttcct

SEQ ID NO: 3538058 - DNA, 15 bp, Homo sapiens
ccacagccgggtgtg

SEQ ID NO: 3538059 - DNA, 18 bp, Homo sapiens
ccacctcacaactccttc

SEQ ID NO: 3538060 - DNA, 23 bp, Homo sapiens
ccactctggggacccgctggggg

SEQ ID NO: 3538061 - DNA, 13 bp, Homo sapiens
ccaggctgcccac

SEQ ID NO: 3538062 - DNA, 22 bp, Homo sapiens
ccaggggtcccctggcagggga

SEQ ID NO: 3538063 - DNA, 17 bp, Homo sapiens
ccaggtttcttctctgg

SEQ ID NO: 3538064 - DNA, 14 bp, Homo sapiens
ccagtcagcctggc

SEQ ID NO: 3538065 - DNA, 19 bp, Homo sapiens
ccagtcagcctggctgggc

SEQ ID NO: 3538066 - DNA, 22 bp, Homo sapiens
cccaggctgcccactctgggga

SEQ ID NO: 3538067 - DNA, 16 bp, Homo sapiens
cccaggtttcttctct

SEQ ID NO: 3538068 - DNA, 19 bp, Homo sapiens
cccaggtttcttctctgga

SEQ ID NO: 3538069 - DNA, 19 bp, Homo sapiens
cccagtcagcctggctggg

SEQ ID NO: 3538070 - DNA, 15 bp, Homo sapiens
ccccaggctgcccac

SEQ ID NO: 3538071 - DNA, 12 bp, Homo sapiens
cccctggcaggg

SEQ ID NO: 3538072 - DNA, 11 bp, Homo sapiens
cccgctggggg

SEQ ID NO: 3538073 - DNA, 15 bp, Homo sapiens
cccgctgggggctgg

SEQ ID NO: 3538074 - DNA, 13 bp, Homo sapiens
ccctccctctctg

SEQ ID NO: 3538075 - DNA, 21 bp, Homo sapiens
ccctcgggtggggctggtggg

SEQ ID NO: 3538076 - DNA, 18 bp, Homo sapiens
ccctgcctcacatctccc

SEQ ID NO: 3538077 - DNA, 22 bp, Homo sapiens
ccctggcaggggaaactctggt

SEQ ID NO: 3538078 - DNA, 12 bp, Homo sapiens
cccttccacctc

SEQ ID NO: 3538079 - DNA, 21 bp, Homo sapiens
cccttccacctcacaactcct

SEQ ID NO: 3538080 - DNA, 17 bp, Homo sapiens
ccgctgggggctggcag

SEQ ID NO: 3538081 - DNA, 16 bp, Homo sapiens
ccggacaagagcctgc

SEQ ID NO: 3538082 - DNA, 20 bp, Homo sapiens
cctcaagctttcctgctgtc

SEQ ID NO: 3538083 - DNA, 15 bp, Homo sapiens
cctcacaactccttc

SEQ ID NO: 3538084 - DNA, 23 bp, Homo sapiens
cctcccaggtttcttctctggag

SEQ ID NO: 3538085 - DNA, 16 bp, Homo sapiens
cctccctttggggaga

SEQ ID NO: 3538086 - DNA, 14 bp, Homo sapiens
cctcgggtggggct

SEQ ID NO: 3538087 - DNA, 17 bp, Homo sapiens
cctcgggtggggctggt

SEQ ID NO: 3538088 - DNA, 14 bp, Homo sapiens
cctctctccctgcc

SEQ ID NO: 3538089 - DNA, 15 bp, Homo sapiens
cctctctccctgcct

SEQ ID NO: 3538090 - DNA, 17 bp, Homo sapiens
cctctctccctgcctca

SEQ ID NO: 3538091 - DNA, 19 bp, Homo sapiens
cctctctccctgcctcaca

SEQ ID NO: 3538092 - DNA, 22 bp, Homo sapiens
cctctctccctgcctcacatct

SEQ ID NO: 3538093 - DNA, 23 bp, Homo sapiens
cctctctccctgcctcacatctc

SEQ ID NO: 3538094 - DNA, 16 bp, Homo sapiens
cctgaggctggctggg

SEQ ID NO: 3538095 - DNA, 17 bp, Homo sapiens
cctgaggctggctgggg

SEQ ID NO: 3538096 - DNA, 22 bp, Homo sapiens
cctgcagcggaagggactctgg

SEQ ID NO: 3538097 - DNA, 9 bp, Homo sapiens
cctgcctca

SEQ ID NO: 3538098 - DNA, 19 bp, Homo sapiens
cctgcctcacatctccctt

SEQ ID NO: 3538099 - DNA, 23 bp, Homo sapiens
cctggcaggggaaactctggtgc

SEQ ID NO: 3538100 - DNA, 12 bp, Homo sapiens
cctggctgggct

SEQ ID NO: 3538101 - DNA, 14 bp, Homo sapiens
cctggctgggctct

SEQ ID NO: 3538102 - DNA, 15 bp, Homo sapiens
cctggtgtttttctc

SEQ ID NO: 3538103 - DNA, 19 bp, Homo sapiens
cctggtgtttttctctctg

SEQ ID NO: 3538104 - DNA, 20 bp, Homo sapiens
cctggtgtttttctctctgg

SEQ ID NO: 3538105 - DNA, 13 bp, Homo sapiens
cctgttctcttgt

SEQ ID NO: 3538106 - DNA, 17 bp, Homo sapiens
ctttgtggaaacagctg

SEQ ID NO: 3538107 - DNA, 22 bp, Homo sapiens
cttttaagaaagcttcttgtga

SEQ ID NO: 3538108 - DNA, 23 bp, Homo sapiens
gaaaaaggacattggccccgcag

SEQ ID NO: 3538109 - DNA, 19 bp, Homo sapiens
gaaatggaaacacacacag

SEQ ID NO: 3538110 - DNA, 18 bp, Homo sapiens
gaaattccagtttaggag

SEQ ID NO: 3538111 - DNA, 19 bp, Homo sapiens
gaacagtctctggaagaag

SEQ ID NO: 3538112 - DNA, 22 bp, Homo sapiens
gaagcagagaccggacaagagc

SEQ ID NO: 3538113 - DNA, 13 bp, Homo sapiens
gaagcgaacatct

SEQ ID NO: 3538114 - DNA, 15 bp, Homo sapiens
gaagcgaacatcttc

SEQ ID NO: 3538115 - DNA, 16 bp, Homo sapiens
gaagcgaacatcttca

SEQ ID NO: 3538116 - DNA, 17 bp, Homo sapiens
gaagcgaacatcttcat

SEQ ID NO: 3538117 - DNA, 20 bp, Homo sapiens
gaagcgaacatcttcatata

SEQ ID NO: 3538118 - DNA, 22 bp, Homo sapiens
gaagcgaacatcttcatataaa

SEQ ID NO: 3538119 - DNA, 14 bp, Homo sapiens
gaagggactctggg

SEQ ID NO: 3538120 - DNA, 19 bp, Homo sapiens
gaagggactctgggctgtg

SEQ ID NO: 3538121 - DNA, 21 bp, Homo sapiens
gaagggactctgggctgtgcc

SEQ ID NO: 3538122 - DNA, 16 bp, Homo sapiens
gaagggtctgtttaaa

SEQ ID NO: 3538123 - DNA, 13 bp, Homo sapiens
gaagtcagagaga

SEQ ID NO: 3538124 - DNA, 15 bp, Homo sapiens
gaagtttttgtaaac

SEQ ID NO: 3538125 - DNA, 15 bp, Homo sapiens
gacaaaaaccaagtt

SEQ ID NO: 3538126 - DNA, 11 bp, Homo sapiens
gacacacacac

SEQ ID NO: 3538127 - DNA, 17 bp, Homo sapiens
gaccacagccgggtgtg

SEQ ID NO: 3538128 - DNA, 18 bp, Homo sapiens
gacccgctgggggctggc

SEQ ID NO: 3538129 - DNA, 14 bp, Homo sapiens
gacgaaatggaaac

SEQ ID NO: 3538130 - DNA, 21 bp, Homo sapiens
gacgaaatggaaacacacaca

SEQ ID NO: 3538131 - DNA, 14 bp, Homo sapiens
gactctgggctgtg

SEQ ID NO: 3538132 - DNA, 18 bp, Homo sapiens
gactctgggctgtgcctg

SEQ ID NO: 3538133 - DNA, 15 bp, Homo sapiens
gagaataatttctgt

SEQ ID NO: 3538134 - DNA, 16 bp, Homo sapiens
gagagctcagcctgcc

SEQ ID NO: 3538135 - DNA, 19 bp, Homo sapiens
gaggcacaagccaaggaag

SEQ ID NO: 3538136 - DNA, 22 bp, Homo sapiens
gagggggttcgcaccgtgctgg

SEQ ID NO: 3538137 - DNA, 18 bp, Homo sapiens
gagtgttggggctggggg

SEQ ID NO: 3538138 - DNA, 19 bp, Homo sapiens
gatatgctgtattttaaag

SEQ ID NO: 3538139 - DNA, 12 bp, Homo sapiens
gatcatgatgat

SEQ ID NO: 3538140 - DNA, 20 bp, Homo sapiens
gatcctttggggcttctgtg

SEQ ID NO: 3538141 - DNA, 16 bp, Homo sapiens
gatgatcatgatgatg

SEQ ID NO: 3538142 - DNA, 23 bp, Homo sapiens
gatggttttgccctccctctctg

SEQ ID NO: 3538143 - DNA, 23 bp, Homo sapiens
gatgttcacctttatatatgtac

SEQ ID NO: 3538144 - DNA, 14 bp, Homo sapiens
ggtttcttctctgg

SEQ ID NO: 3538145 - DNA, 13 bp, Homo sapiens
gtaaaaagacaaa

SEQ ID NO: 3538146 - DNA, 20 bp, Homo sapiens
gtaactcccatatctccttt

SEQ ID NO: 3538147 - DNA, 21 bp, Homo sapiens
gtactagcattttccacgctg

SEQ ID NO: 3538148 - DNA, 14 bp, Homo sapiens
gtattattgtaaag

SEQ ID NO: 3538149 - DNA, 17 bp, Homo sapiens
gtcagcctggctgggct

SEQ ID NO: 3538150 - DNA, 15 bp, Homo sapiens
gtcagcggggcagcg

SEQ ID NO: 3538151 - DNA, 19 bp, Homo sapiens
gtcagcggggcagcggggc

SEQ ID NO: 3538152 - DNA, 16 bp, Homo sapiens
gtcctttggcaggcct

SEQ ID NO: 3538153 - DNA, 16 bp, Homo sapiens
gtcctttgttggcttc

SEQ ID NO: 3538154 - DNA, 16 bp, Homo sapiens
gtctaccagaagccag

SEQ ID NO: 3538155 - DNA, 15 bp, Homo sapiens
gtctgcagctggtgt

SEQ ID NO: 3538156 - DNA, 18 bp, Homo sapiens
gtgcctgaggctggctgg

SEQ ID NO: 3538157 - DNA, 13 bp, Homo sapiens
gtggaaacagctg

SEQ ID NO: 3538158 - DNA, 20 bp, Homo sapiens
gtggggctggtgggtctgca

SEQ ID NO: 3538159 - DNA, 21 bp, Homo sapiens
gtggtttcccctttctttcct

SEQ ID NO: 3538160 - DNA, 14 bp, Homo sapiens
gtgtatttaactct

SEQ ID NO: 3538161 - DNA, 17 bp, Homo sapiens
gtgtttttctctctgga

SEQ ID NO: 3538162 - DNA, 21 bp, Homo sapiens
gtgtttttctctctggaccct

SEQ ID NO: 3538163 - DNA, 19 bp, Homo sapiens
gttcatgtctaagaactct

SEQ ID NO: 3538164 - DNA, 20 bp, Homo sapiens
gttcgcaccgtgctgggctc

SEQ ID NO: 3538165 - DNA, 18 bp, Homo sapiens
gttctcttgtatagctga

SEQ ID NO: 3538166 - DNA, 12 bp, Homo sapiens
gttgcctcctct

SEQ ID NO: 3538167 - DNA, 18 bp, Homo sapiens
gttgcctcctctctccct

SEQ ID NO: 3538168 - DNA, 21 bp, Homo sapiens
gttgcctcctctctccctgcc

SEQ ID NO: 3538169 - DNA, 19 bp, Homo sapiens
gttggcttctttgctttct

SEQ ID NO: 3538170 - DNA, 21 bp, Homo sapiens
gttggcttctttgctttctcg

SEQ ID NO: 3538171 - DNA, 14 bp, Homo sapiens
gttgtaatttgaat

SEQ ID NO: 3538172 - DNA, 12 bp, Homo sapiens
gtttcttctctg

SEQ ID NO: 3538173 - DNA, 15 bp, Homo sapiens
gtttcttctctggag

SEQ ID NO: 3538174 - DNA, 21 bp, Homo sapiens
gtttgtaacttgggctgtaaa

SEQ ID NO: 3538175 - DNA, 20 bp, Homo sapiens
gttttgccctccctctctgc

SEQ ID NO: 3538176 - DNA, 15 bp, Homo sapiens
gtttttctctctgga

SEQ ID NO: 3538177 - DNA, 14 bp, Homo sapiens
taaagggacagttt

SEQ ID NO: 3538178 - DNA, 18 bp, Homo sapiens
taacttgggctgtaaagc

SEQ ID NO: 3538179 - DNA, 22 bp, Homo sapiens
taagcaacaaaactatggaaat

SEQ ID NO: 3538180 - DNA, 15 bp, Homo sapiens
taatttctgttgttt

SEQ ID NO: 3538181 - DNA, 13 bp, Homo sapiens
tacatgttttcac

SEQ ID NO: 3538182 - DNA, 21 bp, Homo sapiens
tacgtcaactgtatgtacata

SEQ ID NO: 3538183 - DNA, 23 bp, Homo sapiens
tactctgttgcctcctctctccc

SEQ ID NO: 3538184 - DNA, 15 bp, Homo sapiens
tactgtaaacagttc

SEQ ID NO: 3538185 - DNA, 22 bp, Homo sapiens
tagacgtacgtcaactgtatgt

SEQ ID NO: 3538186 - DNA, 21 bp, Homo sapiens
tagcacggagtgttggggctg

SEQ ID NO: 3538187 - DNA, 21 bp, Homo sapiens
taggagctcagttgagaaaca

SEQ ID NO: 3538188 - DNA, 20 bp, Homo sapiens
tatacacatccatatacata

SEQ ID NO: 3538189 - DNA, 20 bp, Homo sapiens
tatggacatgtaaaaagaca

SEQ ID NO: 3538190 - DNA, 14 bp, Homo sapiens
tatgtactgtaaac

SEQ ID NO: 3538191 - DNA, 15 bp, Homo sapiens
tatgtactgtaaaca

SEQ ID NO: 3538192 - DNA, 16 bp, Homo sapiens
tatgtactgtaaacag

SEQ ID NO: 3538193 - DNA, 21 bp, Homo sapiens
tattgtgtggtttcccctttc

SEQ ID NO: 3538194 - DNA, 17 bp, Homo sapiens
tatttcaccatttaatt

SEQ ID NO: 3538195 - DNA, 13 bp, Homo sapiens
tatttccacaaat

SEQ ID NO: 3538196 - DNA, 17 bp, Homo sapiens
tcaaaaccaggtaatgt

SEQ ID NO: 3538197 - DNA, 21 bp, Homo sapiens
tcaagctttcctgctgtcttc

SEQ ID NO: 3538198 - DNA, 12 bp, Homo sapiens
tcacaactcctt

SEQ ID NO: 3538199 - DNA, 22 bp, Homo sapiens
tctgccctcgggtggggctggt

SEQ ID NO: 3538200 - DNA, 20 bp, Homo sapiens
tctggggacccgctgggggc

SEQ ID NO: 3538201 - DNA, 14 bp, Homo sapiens
tctgtaagaaactg

SEQ ID NO: 3538202 - DNA, 12 bp, Homo sapiens
tctgttgcctcc

SEQ ID NO: 3538203 - DNA, 15 bp, Homo sapiens
tctgttgcctcctct

SEQ ID NO: 3538204 - DNA, 19 bp, Homo sapiens
tctgttgcctcctctctcc

SEQ ID NO: 3538205 - DNA, 23 bp, Homo sapiens
tctgttgcctcctctctccctgc

SEQ ID NO: 3538206 - DNA, 17 bp, Homo sapiens
tctgtttcctgttctct

SEQ ID NO: 3538207 - DNA, 19 bp, Homo sapiens
tcttaccaagagtgggctt

SEQ ID NO: 3538208 - DNA, 12 bp, Homo sapiens
tcttcatataaa

SEQ ID NO: 3538209 - DNA, 14 bp, Homo sapiens
tcttcatataaact

SEQ ID NO: 3538210 - DNA, 14 bp, Homo sapiens
tcttgagaatgatt

SEQ ID NO: 3538211 - DNA, 13 bp, Homo sapiens
tgaaattccagtt

SEQ ID NO: 3538212 - DNA, 15 bp, Homo sapiens
tgaacctgtctcctc

SEQ ID NO: 3538213 - DNA, 19 bp, Homo sapiens
tgaagcgaacatcttcata

SEQ ID NO: 3538214 - DNA, 19 bp, Homo sapiens
tgaatgactccaggaagaa

SEQ ID NO: 3538215 - DNA, 18 bp, Homo sapiens
tgaattcatactctgttg

SEQ ID NO: 3538216 - DNA, 15 bp, Homo sapiens
tgacgaaatggaaac

SEQ ID NO: 3538217 - DNA, 15 bp, Homo sapiens
tgactccaggaagaa

SEQ ID NO: 3538218 - DNA, 21 bp, Homo sapiens
tgactgaagcgaacatcttca

SEQ ID NO: 3538219 - DNA, 23 bp, Homo sapiens
tgactgaagcgaacatcttcata

SEQ ID NO: 3538220 - DNA, 12 bp, Homo sapiens
tgagaaacagtt

SEQ ID NO: 3538221 - DNA, 18 bp, Homo sapiens
tgagagaataatttctgt

SEQ ID NO: 3538222 - DNA, 20 bp, Homo sapiens
tgagagaataatttctgttg

SEQ ID NO: 3538223 - DNA, 19 bp, Homo sapiens
tgagaggtgtaggttgaaa

SEQ ID NO: 3538224 - DNA, 14 bp, Homo sapiens
tgatcatatttgtg

SEQ ID NO: 3538225 - DNA, 14 bp, Homo sapiens
tgatcatgatgatg

SEQ ID NO: 3538226 - DNA, 15 bp, Homo sapiens
tgatgattttaacag

SEQ ID NO: 3538227 - DNA, 14 bp, Homo sapiens
tgattttaacagtt

SEQ ID NO: 3538228 - DNA, 17 bp, Homo sapiens
tgattttaacagtttta

SEQ ID NO: 3538229 - DNA, 19 bp, Homo sapiens
tgcactcttgtacaaaaga

SEQ ID NO: 3538230 - DNA, 16 bp, Homo sapiens
tgcccactctggggac

SEQ ID NO: 3538231 - DNA, 20 bp, Homo sapiens
tgccctcgggtggggctggt

SEQ ID NO: 3538232 - DNA, 23 bp, Homo sapiens
tgccctcgggtggggctggtggg

SEQ ID NO: 3538233 - DNA, 17 bp, Homo sapiens
tgcccttcactttctcc

SEQ ID NO: 3538234 - DNA, 21 bp, Homo sapiens
tgcccttcactttctcctggt

SEQ ID NO: 3538235 - DNA, 15 bp, Homo sapiens
tgcctcctctctccc

SEQ ID NO: 3538236 - DNA, 18 bp, Homo sapiens
tgcctcctctctccctgc

SEQ ID NO: 3538237 - DNA, 14 bp, Homo sapiens
tgctgtcttctccc

SEQ ID NO: 3538238 - DNA, 19 bp, Homo sapiens
tgcttccccaggctgccca

SEQ ID NO: 3538239 - DNA, 22 bp, Homo sapiens
tgctttctcgtgggtcctttgg

SEQ ID NO: 3538240 - DNA, 23 bp, Homo sapiens
tggaacattttttttttttcctt

SEQ ID NO: 3538241 - DNA, 13 bp, Homo sapiens
tggacatgtaaaa

SEQ ID NO: 3538242 - DNA, 18 bp, Homo sapiens
tggacatgtaaaaagaca

SEQ ID NO: 3538243 - DNA, 12 bp, Homo sapiens
tggacccttctg

SEQ ID NO: 3538244 - DNA, 23 bp, Homo sapiens
tggcaggcctccctttggggaga

SEQ ID NO: 3538245 - DNA, 21 bp, Homo sapiens
tggcaggggaaactctggtgc

SEQ ID NO: 3538246 - DNA, 20 bp, Homo sapiens
ttggcttctttgctttctcg

SEQ ID NO: 3538247 - DNA, 12 bp, Homo sapiens
ttggggctgggg

SEQ ID NO: 3538248 - DNA, 19 bp, Homo sapiens
ttgtaacttgggctgtaaa

SEQ ID NO: 3538249 - DNA, 17 bp, Homo sapiens
ttgtcaaaaagcaactg

SEQ ID NO: 3538250 - DNA, 23 bp, Homo sapiens
ttgtgatcctttggggcttctgt

SEQ ID NO: 3538251 - DNA, 23 bp, Homo sapiens
ttgtggaaacagctggtactgat

SEQ ID NO: 3538252 - DNA, 18 bp, Homo sapiens
ttgttcattcttgttcaa

SEQ ID NO: 3538253 - DNA, 22 bp, Homo sapiens
tttaagccacaaagtttgtggt

SEQ ID NO: 3538254 - DNA, 13 bp, Homo sapiens
tttacttctggcc

SEQ ID NO: 3538255 - DNA, 18 bp, Homo sapiens
tttcagcctacattgatg

SEQ ID NO: 3538256 - DNA, 16 bp, Homo sapiens
tttcctgctgtcttct

SEQ ID NO: 3538257 - DNA, 18 bp, Homo sapiens
tttcctgctgtcttctcc

SEQ ID NO: 3538258 - DNA, 14 bp, Homo sapiens
tttctcctggtgtt

SEQ ID NO: 3538259 - DNA, 23 bp, Homo sapiens
tttctcctggtgtttttctctct

SEQ ID NO: 3538260 - DNA, 13 bp, Homo sapiens
tttcttctctgga

SEQ ID NO: 3538261 - DNA, 14 bp, Homo sapiens
tttcttctctggag

SEQ ID NO: 3538262 - DNA, 18 bp, Homo sapiens
tttgccacaaagaagatt

SEQ ID NO: 3538263 - DNA, 15 bp, Homo sapiens
tttgctttctcgtgg

SEQ ID NO: 3538264 - DNA, 16 bp, Homo sapiens
tttggggcttctgtga

SEQ ID NO: 3538265 - DNA, 21 bp, Homo sapiens
tttgtaacttgggctgtaaag

SEQ ID NO: 3538266 - DNA, 20 bp, Homo sapiens
ttttaacagttttacttctg

SEQ ID NO: 3538267 - DNA, 13 bp, Homo sapiens
ttttaatttgtat

SEQ ID NO: 3538268 - DNA, 17 bp, Homo sapiens
ttttaccatatgtttat

SEQ ID NO: 3538269 - DNA, 14 bp, Homo sapiens
ttttcgatgatgat

SEQ ID NO: 3538270 - DNA, 23 bp, Homo sapiens
ttttctacatcttttatacattt

SEQ ID NO: 3538271 - DNA, 13 bp, Homo sapiens
ttttctctctgga

SEQ ID NO: 3538272 - DNA, 18 bp, Homo sapiens
tttttaagcaacaaaact

SEQ ID NO: 3538273 - DNA, 18 bp, Homo sapiens
ttttttgccacaaagaag

SEQ ID NO: 3538274 - DNA, 11 bp, Homo sapiens
acatcttcata

SEQ ID NO: 3538275 - DNA, 15 bp, Homo sapiens
acatgtaaaaagaca

SEQ ID NO: 3538276 - DNA, 16 bp, Homo sapiens
accagcttctttctcg

SEQ ID NO: 3538277 - DNA, 12 bp, Homo sapiens
acccgctggggg

SEQ ID NO: 3538278 - DNA, 14 bp, Homo sapiens
acctcacaactcct

SEQ ID NO: 3538279 - DNA, 16 bp, Homo sapiens
acctcacaactccttc

SEQ ID NO: 3538280 - DNA, 17 bp, Homo sapiens
acctcacaactccttcc

SEQ ID NO: 3538281 - DNA, 16 bp, Homo sapiens
accttattctatactt

SEQ ID NO: 3538282 - DNA, 15 bp, Homo sapiens
acctttgtcaaaaag

SEQ ID NO: 3538283 - DNA, 20 bp, Homo sapiens
acgaaatggaaacacacaca

SEQ ID NO: 3538284 - DNA, 18 bp, Homo sapiens
acggagtgttggggctgg

SEQ ID NO: 3538285 - DNA, 14 bp, Homo sapiens
actccttccatcct

SEQ ID NO: 3538286 - DNA, 21 bp, Homo sapiens
actctggggacccgctggggg

SEQ ID NO: 3538287 - DNA, 14 bp, Homo sapiens
actctgttgcctcc

SEQ ID NO: 3538288 - DNA, 15 bp, Homo sapiens
actctgttgcctcct

SEQ ID NO: 3538289 - DNA, 18 bp, Homo sapiens
actctgttgcctcctctc

SEQ ID NO: 3538290 - DNA, 20 bp, Homo sapiens
actctgttgcctcctctctc

SEQ ID NO: 3538291 - DNA, 21 bp, Homo sapiens
actctgttgcctcctctctcc

SEQ ID NO: 3538292 - DNA, 17 bp, Homo sapiens
actcttgtacaaaagaa

SEQ ID NO: 3538293 - DNA, 20 bp, Homo sapiens
actgaagcgaacatcttcat

SEQ ID NO: 3538294 - DNA, 23 bp, Homo sapiens
actgaagcgaacatcttcatata

SEQ ID NO: 3538295 - DNA, 18 bp, Homo sapiens
actgccttgattagtgta

SEQ ID NO: 3538296 - DNA, 12 bp, Homo sapiens
actgtaaacagt

SEQ ID NO: 3538297 - DNA, 14 bp, Homo sapiens
actgtatgtacata

SEQ ID NO: 3538298 - DNA, 20 bp, Homo sapiens
acttccccacggatggcggt

SEQ ID NO: 3538299 - DNA, 14 bp, Homo sapiens
acttgggctgtaaa

SEQ ID NO: 3538300 - DNA, 16 bp, Homo sapiens
actttctcctggtgtt

SEQ ID NO: 3538301 - DNA, 22 bp, Homo sapiens
actttctcctggtgtttttctc

SEQ ID NO: 3538302 - DNA, 15 bp, Homo sapiens
agaaacagttccatt

SEQ ID NO: 3538303 - DNA, 24 bp, Homo sapiens
agaaatgcccttcactttctcctg

SEQ ID NO: 3538304 - DNA, 19 bp, Homo sapiens
agaaattttgaagtcagag

SEQ ID NO: 3538305 - DNA, 21 bp, Homo sapiens
agaagattcttaccaagagtg

SEQ ID NO: 3538306 - DNA, 20 bp, Homo sapiens
agacacacacacaccttgca

SEQ ID NO: 3538307 - DNA, 21 bp, Homo sapiens
agagagaaacggtcctttgtt

SEQ ID NO: 3538308 - DNA, 17 bp, Homo sapiens
agagctcagcctgcctg

SEQ ID NO: 3538309 - DNA, 16 bp, Homo sapiens
agatgagcgaaaatgt

SEQ ID NO: 3538310 - DNA, 16 bp, Homo sapiens
agattcactcagaaga

SEQ ID NO: 3538311 - DNA, 16 bp, Homo sapiens
agcaacaaaactatgg

SEQ ID NO: 3538312 - DNA, 19 bp, Homo sapiens
agcaacaaaactatggaaa

SEQ ID NO: 3538313 - DNA, 21 bp, Homo sapiens
agcacggagtgttggggctgg

SEQ ID NO: 3538314 - DNA, 22 bp, Homo sapiens
agcagagaccggacaagagcct

SEQ ID NO: 3538315 - DNA, 12 bp, Homo sapiens
agcagtatctca

SEQ ID NO: 3538316 - DNA, 22 bp, Homo sapiens
agcattttccacgctgatgttt

SEQ ID NO: 3538317 - DNA, 14 bp, Homo sapiens
agcctgagagctgg

SEQ ID NO: 3538318 - DNA, 17 bp, Homo sapiens
agcctggctgggctctg

SEQ ID NO: 3538319 - DNA, 15 bp, Homo sapiens
agcgaacatcttcat

SEQ ID NO: 3538320 - DNA, 20 bp, Homo sapiens
agcggaagggactctgggct

SEQ ID NO: 3538321 - DNA, 20 bp, Homo sapiens
agcggggcagcggggctggc

SEQ ID NO: 3538322 - DNA, 14 bp, Homo sapiens
agcggggctggcca

SEQ ID NO: 3538323 - DNA, 18 bp, Homo sapiens
agctccaggagggcttga

SEQ ID NO: 3538324 - DNA, 16 bp, Homo sapiens
agctctttatatgttg

SEQ ID NO: 3538325 - DNA, 22 bp, Homo sapiens
agctgcttccccaggctgccca

SEQ ID NO: 3538326 - DNA, 11 bp, Homo sapiens
agcttctttct

SEQ ID NO: 3538327 - DNA, 14 bp, Homo sapiens
aggaagtctgtgtc

SEQ ID NO: 3538328 - DNA, 22 bp, Homo sapiens
aggagggcttgagagctcagcc

SEQ ID NO: 3538329 - DNA, 21 bp, Homo sapiens
aggcagcctgagagctggccc

SEQ ID NO: 3538330 - DNA, 20 bp, Homo sapiens
aggcaggcagcctgagagct

SEQ ID NO: 3538331 - DNA, 23 bp, Homo sapiens
aggcaggcagcctgagagctggc

SEQ ID NO: 3538332 - DNA, 17 bp, Homo sapiens
aggctgcccactctggg

SEQ ID NO: 3538333 - DNA, 15 bp, Homo sapiens
agggacagtttgtaa

SEQ ID NO: 3538334 - DNA, 21 bp, Homo sapiens
agggactctgggctgtgcctg

SEQ ID NO: 3538335 - DNA, 19 bp, Homo sapiens
agggaggggagagaccaca

SEQ ID NO: 3538336 - DNA, 13 bp, Homo sapiens
aggtttcttctct

SEQ ID NO: 3538337 - DNA, 15 bp, Homo sapiens
agtcagcctggctgg

SEQ ID NO: 3538338 - DNA, 20 bp, Homo sapiens
agtgccctgccccagtcagc

SEQ ID NO: 3538339 - DNA, 13 bp, Homo sapiens
agtgttggggctg

SEQ ID NO: 3538340 - DNA, 17 bp, Homo sapiens
agttatctgtttcctgt

SEQ ID NO: 3538341 - DNA, 17 bp, Homo sapiens
agtttgtggtaatttgt

SEQ ID NO: 3538342 - DNA, 13 bp, Homo sapiens
atactctgttgcc

SEQ ID NO: 3538343 - DNA, 18 bp, Homo sapiens
atactctgttgcctcctc

SEQ ID NO: 3538344 - DNA, 19 bp, Homo sapiens
atactctgttgcctcctct

SEQ ID NO: 3538345 - DNA, 20 bp, Homo sapiens
atactctgttgcctcctctc

SEQ ID NO: 3538346 - DNA, 21 bp, Homo sapiens
atactctgttgcctcctctct

SEQ ID NO: 3538347 - DNA, 23 bp, Homo sapiens
atagctgaaattccagtttagga

SEQ ID NO: 3538348 - DNA, 17 bp, Homo sapiens
atatccttataagagat

SEQ ID NO: 3538349 - DNA, 18 bp, Homo sapiens
atatgctgtattttaaag

SEQ ID NO: 3538350 - DNA, 14 bp, Homo sapiens
atcagtgtgttact

SEQ ID NO: 3538351 - DNA, 22 bp, Homo sapiens
atcctttggggcttctgtgaaa

SEQ ID NO: 3538352 - DNA, 19 bp, Homo sapiens
atctcccttccacctcaca

SEQ ID NO: 3538353 - DNA, 22 bp, Homo sapiens
atctcccttccacctcacaact

SEQ ID NO: 3538354 - DNA, 21 bp, Homo sapiens
atctgtttcctgttctcttgt

SEQ ID NO: 3538355 - DNA, 19 bp, Homo sapiens
atcttctgctaaatttttg

SEQ ID NO: 3538356 - DNA, 14 bp, Homo sapiens
atgacagaggcaag

SEQ ID NO: 3538357 - DNA, 16 bp, Homo sapiens
atgatgattttaacag

SEQ ID NO: 3538358 - DNA, 18 bp, Homo sapiens
atgatgattttaacagtt

SEQ ID NO: 3538359 - DNA, 13 bp, Homo sapiens
atggaaacacaca

SEQ ID NO: 3538360 - DNA, 20 bp, Homo sapiens
atggacatgtaaaaagacaa

SEQ ID NO: 3538361 - DNA, 23 bp, Homo sapiens
atggttttgccctccctctctgc

SEQ ID NO: 3538362 - DNA, 14 bp, Homo sapiens
atgtaaaaagacaa

SEQ ID NO: 3538363 - DNA, 18 bp, Homo sapiens
atgtactgtaaacagttc

SEQ ID NO: 3538364 - DNA, 20 bp, Homo sapiens
atgtactgtaaacagttctg

SEQ ID NO: 3538365 - DNA, 16 bp, Homo sapiens
atgtagattagtgatc

SEQ ID NO: 3538366 - DNA, 16 bp, Homo sapiens
atgtatatacacatcc

SEQ ID NO: 3538367 - DNA, 18 bp, Homo sapiens
atgtctaagaactctttg

SEQ ID NO: 3538368 - DNA, 14 bp, Homo sapiens
attcatactctgtt

SEQ ID NO: 3538369 - DNA, 17 bp, Homo sapiens
attgtgtggtttcccct

SEQ ID NO: 3538370 - DNA, 15 bp, Homo sapiens
atttcagcctacatt

SEQ ID NO: 3538371 - DNA, 14 bp, Homo sapiens
caaaaccaggtaat

SEQ ID NO: 3538372 - DNA, 17 bp, Homo sapiens
caaagtttgtggtaatt

SEQ ID NO: 3538373 - DNA, 15 bp, Homo sapiens
caacagatgagcgaa

SEQ ID NO: 3538374 - DNA, 17 bp, Homo sapiens
ttcatactctgttgcct

SEQ ID NO: 3538375 - DNA, 19 bp, Homo sapiens
ttcatactctgttgcctcc

SEQ ID NO: 3538376 - DNA, 16 bp, Homo sapiens
ttccagcttccagaac

SEQ ID NO: 3538377 - DNA, 23 bp, Homo sapiens
ttccccaggctgcccactctggg

SEQ ID NO: 3538378 - DNA, 15 bp, Homo sapiens
ttcctgctgtcttct

SEQ ID NO: 3538379 - DNA, 17 bp, Homo sapiens
ttcctgttctcttgtat

SEQ ID NO: 3538380 - DNA, 12 bp, Homo sapiens
ttctcctggtgt

SEQ ID NO: 3538381 - DNA, 12 bp, Homo sapiens
ttctctctggac

SEQ ID NO: 3538382 - DNA, 14 bp, Homo sapiens
ttctctttcctcat

SEQ ID NO: 3538383 - DNA, 12 bp, Homo sapiens
ttcttctctgga

SEQ ID NO: 3538384 - DNA, 17 bp, Homo sapiens
ttcttgtgatcctttgg

SEQ ID NO: 3538385 - DNA, 19 bp, Homo sapiens
ttgattagtgtagtgttaa

SEQ ID NO: 3538386 - DNA, 16 bp, Homo sapiens
ttgcctcctctctccc

SEQ ID NO: 3538387 - DNA, 19 bp, Homo sapiens
ttgcctcctctctccctgc

SEQ ID NO: 3538388 - DNA, 20 bp, Homo sapiens
ttgcctcctctctccctgcc

SEQ ID NO: 3538389 - DNA, 20 bp, Homo sapiens
ttggcttcaaggatggagat

SEQ ID NO: 3538390 - DNA, 22 bp, Homo sapiens
ttgggcaccagcttctttctcg

SEQ ID NO: 3538391 - DNA, 14 bp, Homo sapiens
ttgggctgtaaagc

SEQ ID NO: 3538392 - DNA, 12 bp, Homo sapiens
ttgtacaaaaga

SEQ ID NO: 3538393 - DNA, 22 bp, Homo sapiens
ttgtcgctgaacctgtctcctc

SEQ ID NO: 3538394 - DNA, 19 bp, Homo sapiens
ttgtgtggtttcccctttc

SEQ ID NO: 3538395 - DNA, 21 bp, Homo sapiens
ttgtgtggtttcccctttctt

SEQ ID NO: 3538396 - DNA, 11 bp, Homo sapiens
ttgtttttccc

SEQ ID NO: 3538397 - DNA, 12 bp, Homo sapiens
tttaacagtttt

SEQ ID NO: 3538398 - DNA, 18 bp, Homo sapiens
tttaactctgtaagaaac

SEQ ID NO: 3538399 - DNA, 12 bp, Homo sapiens
tttaagaaagct

SEQ ID NO: 3538400 - DNA, 16 bp, Homo sapiens
tttaccatatgtttat

SEQ ID NO: 3538401 - DNA, 13 bp, Homo sapiens
tttatgtactgta

SEQ ID NO: 3538402 - DNA, 16 bp, Homo sapiens
tttatgtactgtaaac

SEQ ID NO: 3538403 - DNA, 18 bp, Homo sapiens
tttatgtactgtaaacag

SEQ ID NO: 3538404 - DNA, 13 bp, Homo sapiens
tttcccctttctc

SEQ ID NO: 3538405 - DNA, 13 bp, Homo sapiens
tttcctgctgtct

SEQ ID NO: 3538406 - DNA, 12 bp, Homo sapiens
tttccttttaag

SEQ ID NO: 3538407 - DNA, 15 bp, Homo sapiens
tttccttttaagaaa

SEQ ID NO: 3538408 - DNA, 17 bp, Homo sapiens
tttccttttaagaaagc

SEQ ID NO: 3538409 - DNA, 21 bp, Homo sapiens
tttctaatgatataaatttca

SEQ ID NO: 3538410 - DNA, 12 bp, Homo sapiens
tttctctctgga

SEQ ID NO: 3538411 - DNA, 15 bp, Homo sapiens
tttcttctctggaga

SEQ ID NO: 3538412 - DNA, 20 bp, Homo sapiens
tttgtaacttgggctgtaaa

SEQ ID NO: 3538413 - DNA, 12 bp, Homo sapiens
ttttctctctgg

SEQ ID NO: 3538414 - DNA, 22 bp, Homo sapiens
ttttgtaaaccaaacagacaag

SEQ ID NO: 3538415 - DNA, 22 bp, Homo sapiens
ttttgttggcttgcttgcttta

SEQ ID NO: 3538416 - DNA, 15 bp, Homo sapiens
tttttgccacaaaga

SEQ ID NO: 3538417 - DNA, 16 bp, Homo sapiens
actctgttgcctcctc

SEQ ID NO: 3538418 - DNA, 17 bp, Homo sapiens
actctgttgcctcctct

SEQ ID NO: 3538419 - DNA, 23 bp, Homo sapiens
actctgttgcctcctctctccct

SEQ ID NO: 3538420 - DNA, 23 bp, Homo sapiens
actgatgttcacctttatatatg

SEQ ID NO: 3538421 - DNA, 14 bp, Homo sapiens
actgttatttcacc

SEQ ID NO: 3538422 - DNA, 17 bp, Homo sapiens
acttgggcaccagcttc

SEQ ID NO: 3538423 - DNA, 12 bp, Homo sapiens
agaaagcttctt

SEQ ID NO: 3538424 - DNA, 22 bp, Homo sapiens
agaaatgcccttcactttctcc

SEQ ID NO: 3538425 - DNA, 13 bp, Homo sapiens
agaacagccgcct

SEQ ID NO: 3538426 - DNA, 16 bp, Homo sapiens
agaagccagaatcaca

SEQ ID NO: 3538427 - DNA, 13 bp, Homo sapiens
agagattcactca

SEQ ID NO: 3538428 - DNA, 21 bp, Homo sapiens
agagcctgcagcggaagggac

SEQ ID NO: 3538429 - DNA, 16 bp, Homo sapiens
agagctcagcctgcct

SEQ ID NO: 3538430 - DNA, 18 bp, Homo sapiens
agagctcagcctgcctgg

SEQ ID NO: 3538431 - DNA, 13 bp, Homo sapiens
agattgttttcag

SEQ ID NO: 3538432 - DNA, 17 bp, Homo sapiens
agcaacaaaactatgga

SEQ ID NO: 3538433 - DNA, 18 bp, Homo sapiens
agcaactgatcatatttg

SEQ ID NO: 3538434 - DNA, 22 bp, Homo sapiens
agcacggagtgttggggctggg

SEQ ID NO: 3538435 - DNA, 22 bp, Homo sapiens
agccgcctgacgaaatggaaac

SEQ ID NO: 3538436 - DNA, 14 bp, Homo sapiens
agcctgcctgggag

SEQ ID NO: 3538437 - DNA, 16 bp, Homo sapiens
agcctgcctgggagag

SEQ ID NO: 3538438 - DNA, 14 bp, Homo sapiens
agcctggctgggct

SEQ ID NO: 3538439 - DNA, 19 bp, Homo sapiens
agcctggctgggctctggt

SEQ ID NO: 3538440 - DNA, 22 bp, Homo sapiens
agcctggctgggctctggtggg

SEQ ID NO: 3538441 - DNA, 12 bp, Homo sapiens
agcgaacatctt

SEQ ID NO: 3538442 - DNA, 19 bp, Homo sapiens
agcggaagggactctgggc

SEQ ID NO: 3538443 - DNA, 23 bp, Homo sapiens
agcggaagggactctgggctgtg

SEQ ID NO: 3538444 - DNA, 17 bp, Homo sapiens
agcggggcagcggggct

SEQ ID NO: 3538445 - DNA, 13 bp, Homo sapiens
agctcagcctgcc

SEQ ID NO: 3538446 - DNA, 18 bp, Homo sapiens
agctcagcctgcctggga

SEQ ID NO: 3538447 - DNA, 21 bp, Homo sapiens
agctcagttgagaaacagttc

SEQ ID NO: 3538448 - DNA, 22 bp, Homo sapiens
agctcagttgagaaacagttcc

SEQ ID NO: 3538449 - DNA, 17 bp, Homo sapiens
agctgaaattccagttt

SEQ ID NO: 3538450 - DNA, 18 bp, Homo sapiens
agctgcttccccaggctg

SEQ ID NO: 3538451 - DNA, 12 bp, Homo sapiens
agctggtactga

SEQ ID NO: 3538452 - DNA, 19 bp, Homo sapiens
agcttccagaactgtgaga

SEQ ID NO: 3538453 - DNA, 23 bp, Homo sapiens
agcttcttgtgatcctttggggc

SEQ ID NO: 3538454 - DNA, 13 bp, Homo sapiens
agcttctttctcg

SEQ ID NO: 3538455 - DNA, 12 bp, Homo sapiens
aggaagaaggtg

SEQ ID NO: 3538456 - DNA, 17 bp, Homo sapiens
aggacaacacagctgct

SEQ ID NO: 3538457 - DNA, 19 bp, Homo sapiens
aggcagcctgagagctggc

SEQ ID NO: 3538458 - DNA, 14 bp, Homo sapiens
aggcaggcagcctg

SEQ ID NO: 3538459 - DNA, 19 bp, Homo sapiens
aggcctccctttggggaga

SEQ ID NO: 3538460 - DNA, 18 bp, Homo sapiens
aggctgcccactctgggg

SEQ ID NO: 3538461 - DNA, 13 bp, Homo sapiens
aggctggctgggg

SEQ ID NO: 3538462 - DNA, 14 bp, Homo sapiens
aggctggctggggg

SEQ ID NO: 3538463 - DNA, 16 bp, Homo sapiens
agggactctgggctgt

SEQ ID NO: 3538464 - DNA, 17 bp, Homo sapiens
agggactctgggctgtg

SEQ ID NO: 3538465 - DNA, 18 bp, Homo sapiens
agggactctgggctgtgc

SEQ ID NO: 3538466 - DNA, 21 bp, Homo sapiens
agggcatcggtcagcggggca

SEQ ID NO: 3538467 - DNA, 14 bp, Homo sapiens
agggcttgagagct

SEQ ID NO: 3538468 - DNA, 14 bp, Homo sapiens
aggggaaactctgg

SEQ ID NO: 3538469 - DNA, 15 bp, Homo sapiens
aggggaaactctggt

SEQ ID NO: 3538470 - DNA, 22 bp, Homo sapiens
agggtccaccttcagccctttg

SEQ ID NO: 3538471 - DNA, 16 bp, Homo sapiens
agtcagcctggctggg

SEQ ID NO: 3538472 - DNA, 19 bp, Homo sapiens
agtgtgtatttaactctgt

SEQ ID NO: 3538473 - DNA, 13 bp, Homo sapiens
agtgttaaagtga

SEQ ID NO: 3538474 - DNA, 13 bp, Homo sapiens
agttctgcactct

SEQ ID NO: 3538475 - DNA, 15 bp, Homo sapiens
agttgagaaacagtt

SEQ ID NO: 3538476 - DNA, 21 bp, Homo sapiens
ataataccccaacagatgagc

SEQ ID NO: 3538477 - DNA, 15 bp, Homo sapiens
atactctgttgcctc

SEQ ID NO: 3538478 - DNA, 18 bp, Homo sapiens
atatatgtactagcattt

SEQ ID NO: 3538479 - DNA, 22 bp, Homo sapiens
atatctcctttaatgacattga

SEQ ID NO: 3538480 - DNA, 17 bp, Homo sapiens
atatgtttatcaccttt

SEQ ID NO: 3538481 - DNA, 19 bp, Homo sapiens
atattctacacatatcttg

SEQ ID NO: 3538482 - DNA, 22 bp, Homo sapiens
atccaaactcagaaggctttgg

SEQ ID NO: 3538483 - DNA, 16 bp, Homo sapiens
atccaattcatctttt

SEQ ID NO: 3538484 - DNA, 13 bp, Homo sapiens
atccttgactgaa

SEQ ID NO: 3538485 - DNA, 18 bp, Homo sapiens
atcctttggggcttctgt

SEQ ID NO: 3538486 - DNA, 15 bp, Homo sapiens
atcggtcagcggggc

SEQ ID NO: 3538487 - DNA, 18 bp, Homo sapiens
atctcccttccacctcac

SEQ ID NO: 3538488 - DNA, 14 bp, Homo sapiens
atctgtttcctgtt

SEQ ID NO: 3538489 - DNA, 14 bp, Homo sapiens
atcttcatataaac

SEQ ID NO: 3538490 - DNA, 13 bp, Homo sapiens
atgaattcatact

SEQ ID NO: 3538491 - DNA, 14 bp, Homo sapiens
atgaattcatactc

SEQ ID NO: 3538492 - DNA, 15 bp, Homo sapiens
atgatcatgatgatg

SEQ ID NO: 3538493 - DNA, 16 bp, Homo sapiens
atgatgatgattttaa

SEQ ID NO: 3538494 - DNA, 19 bp, Homo sapiens
atgatgattttaacagttt

SEQ ID NO: 3538495 - DNA, 17 bp, Homo sapiens
atgcaagattgttttca

SEQ ID NO: 3538496 - DNA, 20 bp, Homo sapiens
atggtacttaaacatttttg

SEQ ID NO: 3538497 - DNA, 13 bp, Homo sapiens
atgtaaaaagaca

SEQ ID NO: 3538498 - DNA, 15 bp, Homo sapiens
atgtaaaaagacaaa

SEQ ID NO: 3538499 - DNA, 23 bp, Homo sapiens
atgtacataccggggctcctctc

SEQ ID NO: 3538500 - DNA, 13 bp, Homo sapiens
atgtactgtaaac

SEQ ID NO: 3538501 - DNA, 15 bp, Homo sapiens
atgtactgtaaacag

SEQ ID NO: 3538502 - DNA, 14 bp, Homo sapiens
atgtggagaaggtg

SEQ ID NO: 3538503 - DNA, 14 bp, Homo sapiens
attattgtaaagtt

SEQ ID NO: 3538504 - DNA, 17 bp, Homo sapiens
attcatactctgttgcc

SEQ ID NO: 3538505 - DNA, 20 bp, Homo sapiens
attcatactctgttgcctcc

SEQ ID NO: 3538506 - DNA, 21 bp, Homo sapiens
attcatactctgttgcctcct

SEQ ID NO: 3538507 - DNA, 20 bp, Homo sapiens
attgctgttttaatttgtat

SEQ ID NO: 3538508 - DNA, 17 bp, Homo sapiens
attggccccgcagtgcc

SEQ ID NO: 3538509 - DNA, 22 bp, Homo sapiens
attgtgtggtttcccctttctt

SEQ ID NO: 3538510 - DNA, 17 bp, Homo sapiens
atttaggttttctctgt

SEQ ID NO: 3538511 - DNA, 22 bp, Homo sapiens
atttgaataagatccaattcat

SEQ ID NO: 3538512 - DNA, 15 bp, Homo sapiens
atttgaccattcttt

SEQ ID NO: 3538513 - DNA, 20 bp, Homo sapiens
attttaaagggacagtttgt

SEQ ID NO: 3538514 - DNA, 22 bp, Homo sapiens
attttaacagttttacttctgg

SEQ ID NO: 3538515 - DNA, 21 bp, Homo sapiens
attttgagttaatttttgtat

SEQ ID NO: 3538516 - DNA, 18 bp, Homo sapiens
caaaatttctgatgagat

SEQ ID NO: 3538517 - DNA, 20 bp, Homo sapiens
tgtgtggtttcccctttctt

SEQ ID NO: 3538518 - DNA, 23 bp, Homo sapiens
tgttatgacagccctaggaaact

SEQ ID NO: 3538519 - DNA, 16 bp, Homo sapiens
tgttctcagttttcaa

SEQ ID NO: 3538520 - DNA, 22 bp, Homo sapiens
tgttctcttgtatagctgaaat

SEQ ID NO: 3538521 - DNA, 17 bp, Homo sapiens
tgttgcctcctctctcc

SEQ ID NO: 3538522 - DNA, 23 bp, Homo sapiens
tgttgcctcctctctccctgcct

SEQ ID NO: 3538523 - DNA, 12 bp, Homo sapiens
tgttggggctgg

SEQ ID NO: 3538524 - DNA, 16 bp, Homo sapiens
tgttggggctgggggc

SEQ ID NO: 3538525 - DNA, 19 bp, Homo sapiens
tgtttatcacctttattga

SEQ ID NO: 3538526 - DNA, 22 bp, Homo sapiens
tgtttatgtactgtaaacagtt

SEQ ID NO: 3538527 - DNA, 17 bp, Homo sapiens
tgttttaagccacaaag

SEQ ID NO: 3538528 - DNA, 16 bp, Homo sapiens
tgtttttctctctgga

SEQ ID NO: 3538529 - DNA, 19 bp, Homo sapiens
ttaagaaagcttcttgtga

SEQ ID NO: 3538530 - DNA, 12 bp, Homo sapiens
ttcaactggaac

SEQ ID NO: 3538531 - DNA, 22 bp, Homo sapiens
ttcatactctgttgcctcctct

SEQ ID NO: 3538532 - DNA, 15 bp, Homo sapiens
ttccacctcacaact

SEQ ID NO: 3538533 - DNA, 18 bp, Homo sapiens
ttccacctcacaactcct

SEQ ID NO: 3538534 - DNA, 18 bp, Homo sapiens
ttccagcttccagaactg

SEQ ID NO: 3538535 - DNA, 12 bp, Homo sapiens
ttcccctttctc

SEQ ID NO: 3538536 - DNA, 14 bp, Homo sapiens
ttcccctttctctt

SEQ ID NO: 3538537 - DNA, 17 bp, Homo sapiens
ttcccctttctttcctt

SEQ ID NO: 3538538 - DNA, 14 bp, Homo sapiens
ttcctagctagaga

SEQ ID NO: 3538539 - DNA, 17 bp, Homo sapiens
ttccttttaagaaagct

SEQ ID NO: 3538540 - DNA, 18 bp, Homo sapiens
ttctcctggtgtttttct

SEQ ID NO: 3538541 - DNA, 11 bp, Homo sapiens
ttctctctgga

SEQ ID NO: 3538542 - DNA, 15 bp, Homo sapiens
ttctgcactcttgta

SEQ ID NO: 3538543 - DNA, 20 bp, Homo sapiens
ttctgggttctcaattctgt

SEQ ID NO: 3538544 - DNA, 17 bp, Homo sapiens
ttctgtgaaaaacctga

SEQ ID NO: 3538545 - DNA, 15 bp, Homo sapiens
ttctttgctttctcg

SEQ ID NO: 3538546 - DNA, 23 bp, Homo sapiens
ttgactgaagcgaacatcttcat

SEQ ID NO: 3538547 - DNA, 12 bp, Homo sapiens
ttgagaaacagt

SEQ ID NO: 3538548 - DNA, 13 bp, Homo sapiens
ttgagaaacagtt

SEQ ID NO: 3538549 - DNA, 14 bp, Homo sapiens
ttgatttctaatga

SEQ ID NO: 3538550 - DNA, 15 bp, Homo sapiens
ttgcctcctctctcc

SEQ ID NO: 3538551 - DNA, 22 bp, Homo sapiens
ttgcctcctctctccctgcctc

SEQ ID NO: 3538552 - DNA, 23 bp, Homo sapiens
ttgcctcctctctccctgcctca

SEQ ID NO: 3538553 - DNA, 19 bp, Homo sapiens
ttggcttctttgctttctc

SEQ ID NO: 3538554 - DNA, 14 bp, Homo sapiens
ttgtaacttgggct

SEQ ID NO: 3538555 - DNA, 21 bp, Homo sapiens
ttgtatagctgaaattccagt

SEQ ID NO: 3538556 - DNA, 14 bp, Homo sapiens
ttgtggaaacagct

SEQ ID NO: 3538557 - DNA, 15 bp, Homo sapiens
ttgtggaaacagctg

SEQ ID NO: 3538558 - DNA, 17 bp, Homo sapiens
ttgtggtaatttgttat

SEQ ID NO: 3538559 - DNA, 21 bp, Homo sapiens
tttaatgacattgatttctaa

SEQ ID NO: 3538560 - DNA, 17 bp, Homo sapiens
tttcctgttctcttgta

SEQ ID NO: 3538561 - DNA, 14 bp, Homo sapiens
tttccttttaagaa

SEQ ID NO: 3538562 - DNA, 19 bp, Homo sapiens
tttccttttaagaaagctt

SEQ ID NO: 3538563 - DNA, 13 bp, Homo sapiens
tttcgatgatgat

SEQ ID NO: 3538564 - DNA, 19 bp, Homo sapiens
tttcttctctggagaagtt

SEQ ID NO: 3538565 - DNA, 14 bp, Homo sapiens
tttgccacaaagaa

SEQ ID NO: 3538566 - DNA, 18 bp, Homo sapiens
tttggggcttctgtgaaa

SEQ ID NO: 3538567 - DNA, 14 bp, Homo sapiens
tttgtggaaacagc

SEQ ID NO: 3538568 - DNA, 22 bp, Homo sapiens
ttttaattgttcattgctagta

SEQ ID NO: 3538569 - DNA, 20 bp, Homo sapiens
ttttacttctggcctttcct

SEQ ID NO: 3538570 - DNA, 23 bp, Homo sapiens
ttttgccacaaagaagattctta

SEQ ID NO: 3538571 - DNA, 19 bp, Homo sapiens
ttttgccctccctctctgc

SEQ ID NO: 3538572 - DNA, 23 bp, Homo sapiens
tttttgaaagctacgcagacaag

SEQ ID NO: 3538573 - DNA, 20 bp, Homo sapiens
cctgttctcttgtatagctg

SEQ ID NO: 3538574 - DNA, 23 bp, Homo sapiens
cctgttctcttgtatagctgaaa

SEQ ID NO: 3538575 - DNA, 14 bp, Homo sapiens
ccttcactttctcc

SEQ ID NO: 3538576 - DNA, 16 bp, Homo sapiens
ccttcactttctcctg

SEQ ID NO: 3538577 - DNA, 13 bp, Homo sapiens
ccttccacctcac

SEQ ID NO: 3538578 - DNA, 14 bp, Homo sapiens
ccttccacctcaca

SEQ ID NO: 3538579 - DNA, 20 bp, Homo sapiens
ccttccacctcacaactcct

SEQ ID NO: 3538580 - DNA, 15 bp, Homo sapiens
cctttcccctttctc

SEQ ID NO: 3538581 - DNA, 16 bp, Homo sapiens
cctttcccctttctct

SEQ ID NO: 3538582 - DNA, 17 bp, Homo sapiens
cctttcccctttctctt

SEQ ID NO: 3538583 - DNA, 16 bp, Homo sapiens
cctttggggcttctgt

SEQ ID NO: 3538584 - DNA, 12 bp, Homo sapiens
ccttttaagaaa

SEQ ID NO: 3538585 - DNA, 12 bp, Homo sapiens
cgaaatggaaac

SEQ ID NO: 3538586 - DNA, 13 bp, Homo sapiens
cgctgggggctgg

SEQ ID NO: 3538587 - DNA, 14 bp, Homo sapiens
cgctgggggctggc

SEQ ID NO: 3538588 - DNA, 16 bp, Homo sapiens
cggagtgttggggctg

SEQ ID NO: 3538589 - DNA, 18 bp, Homo sapiens
cggagtgttggggctggg

SEQ ID NO: 3538590 - DNA, 21 bp, Homo sapiens
cggagtgttggggctgggggc

SEQ ID NO: 3538591 - DNA, 13 bp, Homo sapiens
cggatggcggtgg

SEQ ID NO: 3538592 - DNA, 21 bp, Homo sapiens
cggggcagcggggctggccat

SEQ ID NO: 3538593 - DNA, 23 bp, Homo sapiens
ctaaggtaactcccatatctcct

SEQ ID NO: 3538594 - DNA, 16 bp, Homo sapiens
ctacatcttttataca

SEQ ID NO: 3538595 - DNA, 13 bp, Homo sapiens
ctagctagagaag

SEQ ID NO: 3538596 - DNA, 23 bp, Homo sapiens
ctattttaccatatgtttatcac

SEQ ID NO: 3538597 - DNA, 17 bp, Homo sapiens
ctattttgagttaattt

SEQ ID NO: 3538598 - DNA, 22 bp, Homo sapiens
ctattttgagttaatttttgta

SEQ ID NO: 3538599 - DNA, 22 bp, Homo sapiens
ctcaagctttcctgctgtcttc

SEQ ID NO: 3538600 - DNA, 11 bp, Homo sapiens
ctcaattctgt

SEQ ID NO: 3538601 - DNA, 19 bp, Homo sapiens
ctcacaactccttccatcc

SEQ ID NO: 3538602 - DNA, 15 bp, Homo sapiens
ctcagaaggctttgg

SEQ ID NO: 3538603 - DNA, 21 bp, Homo sapiens
ctcagaaggctttgggatatg

SEQ ID NO: 3538604 - DNA, 16 bp, Homo sapiens
ctcagcctgcctggga

SEQ ID NO: 3538605 - DNA, 15 bp, Homo sapiens
ctcagttgagaaaca

SEQ ID NO: 3538606 - DNA, 20 bp, Homo sapiens
ctcagttgagaaacagttcc

SEQ ID NO: 3538607 - DNA, 13 bp, Homo sapiens
ctccaggaagaag

SEQ ID NO: 3538608 - DNA, 12 bp, Homo sapiens
cacatctccctt

SEQ ID NO: 3538609 - DNA, 22 bp, Homo sapiens
cacatctcccttccacctcaca

SEQ ID NO: 3538610 - DNA, 14 bp, Homo sapiens
caccgtgctgggct

SEQ ID NO: 3538611 - DNA, 19 bp, Homo sapiens
cacggagtgttggggctgg

SEQ ID NO: 3538612 - DNA, 20 bp, Homo sapiens
cacggagtgttggggctggg

SEQ ID NO: 3538613 - DNA, 21 bp, Homo sapiens
cacggagtgttggggctgggg

SEQ ID NO: 3538614 - DNA, 23 bp, Homo sapiens
cacggagtgttggggctgggggc

SEQ ID NO: 3538615 - DNA, 16 bp, Homo sapiens
cacggatggcggtgga

SEQ ID NO: 3538616 - DNA, 19 bp, Homo sapiens
cagaacagtctctggaaga

SEQ ID NO: 3538617 - DNA, 23 bp, Homo sapiens
cagaaggctttgggatatgctgt

SEQ ID NO: 3538618 - DNA, 14 bp, Homo sapiens
cagacacacacaca

SEQ ID NO: 3538619 - DNA, 19 bp, Homo sapiens
cagccgggtgtgtgtctgc

SEQ ID NO: 3538620 - DNA, 15 bp, Homo sapiens
cagcctgcctgggag

SEQ ID NO: 3538621 - DNA, 20 bp, Homo sapiens
cagcctggctgggctctggt

SEQ ID NO: 3538622 - DNA, 22 bp, Homo sapiens
cagcctggctgggctctggtgg

SEQ ID NO: 3538623 - DNA, 23 bp, Homo sapiens
cagcctggctgggctctggtggg

SEQ ID NO: 3538624 - DNA, 13 bp, Homo sapiens
cagcggggctggc

SEQ ID NO: 3538625 - DNA, 15 bp, Homo sapiens
cagcggggctggcca

SEQ ID NO: 3538626 - DNA, 18 bp, Homo sapiens
cagctggtactgatgttc

SEQ ID NO: 3538627 - DNA, 11 bp, Homo sapiens
cagctggtgtg

SEQ ID NO: 3538628 - DNA, 14 bp, Homo sapiens
cagcttctttctcg

SEQ ID NO: 3538629 - DNA, 18 bp, Homo sapiens
cagcttctttctcggtgg

SEQ ID NO: 3538630 - DNA, 14 bp, Homo sapiens
caggcagcctgaga

SEQ ID NO: 3538631 - DNA, 19 bp, Homo sapiens
caggctgcccactctgggg

SEQ ID NO: 3538632 - DNA, 20 bp, Homo sapiens
caggctgcccactctgggga

SEQ ID NO: 3538633 - DNA, 18 bp, Homo sapiens
caggggaaactctggtgc

SEQ ID NO: 3538634 - DNA, 12 bp, Homo sapiens
caggtttcttct

SEQ ID NO: 3538635 - DNA, 16 bp, Homo sapiens
cagtcagcctggctgg

SEQ ID NO: 3538636 - DNA, 17 bp, Homo sapiens
cagttgagaaacagttc

SEQ ID NO: 3538637 - DNA, 19 bp, Homo sapiens
catacctgtgaatatagat

SEQ ID NO: 3538638 - DNA, 20 bp, Homo sapiens
catactctgttgcctcctct

SEQ ID NO: 3538639 - DNA, 14 bp, Homo sapiens
catatatgtatata

SEQ ID NO: 3538640 - DNA, 17 bp, Homo sapiens
ctcccaggtttcttctc

SEQ ID NO: 3538641 - DNA, 20 bp, Homo sapiens
ctcccaggtttcttctctgg

SEQ ID NO: 3538642 - DNA, 22 bp, Homo sapiens
ctcccaggtttcttctctggag

SEQ ID NO: 3538643 - DNA, 24 bp, Homo sapiens
ctcccaggtttcttctctggagaa

SEQ ID NO: 3538644 - DNA, 15 bp, Homo sapiens
ctccctctctgccct

SEQ ID NO: 3538645 - DNA, 12 bp, Homo sapiens
ctccctgcctca

SEQ ID NO: 3538646 - DNA, 13 bp, Homo sapiens
ctccctgcctcac

SEQ ID NO: 3538647 - DNA, 18 bp, Homo sapiens
ctccctgcctcacatctc

SEQ ID NO: 3538648 - DNA, 23 bp, Homo sapiens
ctcctggtgtttttctctctgga

SEQ ID NO: 3538649 - DNA, 13 bp, Homo sapiens
ctccttccatcct

SEQ ID NO: 3538650 - DNA, 13 bp, Homo sapiens
ctcgggtggggct

SEQ ID NO: 3538651 - DNA, 11 bp, Homo sapiens
ctcgtgggtcc

SEQ ID NO: 3538652 - DNA, 15 bp, Homo sapiens
ctctccctgcctcac

SEQ ID NO: 3538653 - DNA, 22 bp, Homo sapiens
ctctcctaacatatatgtatat

SEQ ID NO: 3538654 - DNA, 10 bp, Homo sapiens
ctctctggac

SEQ ID NO: 3538655 - DNA, 22 bp, Homo sapiens
ctctgccctcgggtggggctgg

SEQ ID NO: 3538656 - DNA, 10 bp, Homo sapiens
ctctggtgcc

SEQ ID NO: 3538657 - DNA, 20 bp, Homo sapiens
ctctgtaagaaactgccaaa

SEQ ID NO: 3538658 - DNA, 12 bp, Homo sapiens
ctctgttgcctc

SEQ ID NO: 3538659 - DNA, 13 bp, Homo sapiens
ctctgttgcctcc

SEQ ID NO: 3538660 - DNA, 14 bp, Homo sapiens
ctctgttgcctcct

SEQ ID NO: 3538661 - DNA, 17 bp, Homo sapiens
ctctgttgcctcctctc

SEQ ID NO: 3538662 - DNA, 22 bp, Homo sapiens
ctctgttgcctcctctctccct

SEQ ID NO: 3538663 - DNA, 19 bp, Homo sapiens
ctgaaattccagtttagga

SEQ ID NO: 3538664 - DNA, 16 bp, Homo sapiens
ctgaagcgaacatctt

SEQ ID NO: 3538665 - DNA, 17 bp, Homo sapiens
ctgacgaaatggaaaca

SEQ ID NO: 3538666 - DNA, 22 bp, Homo sapiens
ctgacgaaatggaaacacacac

SEQ ID NO: 3538667 - DNA, 20 bp, Homo sapiens
ctgaggctggctgggggcag

SEQ ID NO: 3538668 - DNA, 13 bp, Homo sapiens
ctgcactcttgta

SEQ ID NO: 3538669 - DNA, 21 bp, Homo sapiens
ctgcagcggaagggactctgg

SEQ ID NO: 3538670 - DNA, 15 bp, Homo sapiens
ctgcccactctgggg

SEQ ID NO: 3538671 - DNA, 21 bp, Homo sapiens
ctggcaggggaaactctggtg

SEQ ID NO: 3538672 - DNA, 21 bp, Homo sapiens
ctggcctttcctagctagaga

SEQ ID NO: 3538673 - DNA, 23 bp, Homo sapiens
ctgggctccccctgactgtagca

SEQ ID NO: 3538674 - DNA, 15 bp, Homo sapiens
ctgggctctggtggg

SEQ ID NO: 3538675 - DNA, 15 bp, Homo sapiens
ctgggctgtgcctga

SEQ ID NO: 3538676 - DNA, 13 bp, Homo sapiens
ctggggacccgct

SEQ ID NO: 3538677 - DNA, 17 bp, Homo sapiens
ctggggacccgctgggg

SEQ ID NO: 3538678 - DNA, 23 bp, Homo sapiens
ctggggacccgctgggggctggc

SEQ ID NO: 3538679 - DNA, 17 bp, Homo sapiens
ctgggggccagctccag

SEQ ID NO: 3538680 - DNA, 13 bp, Homo sapiens
ctggtgtttttct

SEQ ID NO: 3538681 - DNA, 13 bp, Homo sapiens
ctgtatgtacata

SEQ ID NO: 3538682 - DNA, 21 bp, Homo sapiens
ctgtgagagaataatttctgt

SEQ ID NO: 3538683 - DNA, 17 bp, Homo sapiens
ctgtgcctgaggctggc

SEQ ID NO: 3538684 - DNA, 17 bp, Homo sapiens
ctgttctcttgtatagc

SEQ ID NO: 3538685 - DNA, 12 bp, Homo sapiens
ctgttgcctcct

SEQ ID NO: 3538686 - DNA, 13 bp, Homo sapiens
ctgttgcctcctc

SEQ ID NO: 3538687 - DNA, 15 bp, Homo sapiens
ctgtttcctgttctc

SEQ ID NO: 3538688 - DNA, 22 bp, Homo sapiens
cttccccacggatggcggtgga

SEQ ID NO: 3538689 - DNA, 20 bp, Homo sapiens
cttctccctcctcctccttt

SEQ ID NO: 3538690 - DNA, 11 bp, Homo sapiens
cttctctggag

SEQ ID NO: 3538691 - DNA, 13 bp, Homo sapiens
cttctctggagaa

SEQ ID NO: 3538692 - DNA, 18 bp, Homo sapiens
cttgactgaagcgaacat

SEQ ID NO: 3538693 - DNA, 21 bp, Homo sapiens
cttgggcaccagcttctttct

SEQ ID NO: 3538694 - DNA, 23 bp, Homo sapiens
cttgggcaccagcttctttctcg

SEQ ID NO: 3538695 - DNA, 14 bp, Homo sapiens
cttgggctgtaaag

SEQ ID NO: 3538696 - DNA, 16 bp, Homo sapiens
cttgtatagctgaaat

SEQ ID NO: 3538697 - DNA, 22 bp, Homo sapiens
cttgtatagctgaaattccagt

SEQ ID NO: 3538698 - DNA, 16 bp, Homo sapiens
cttgttagatttttaa

SEQ ID NO: 3538699 - DNA, 23 bp, Homo sapiens
ctttattgaagggtctgtttaaa

SEQ ID NO: 3538700 - DNA, 12 bp, Homo sapiens
ctttcctgctgt

SEQ ID NO: 3538701 - DNA, 16 bp, Homo sapiens
ctttctctttcctcat

SEQ ID NO: 3538702 - DNA, 16 bp, Homo sapiens
ctttgtggaaacagct

SEQ ID NO: 3538703 - DNA, 18 bp, Homo sapiens
ggagaagtttttgtaaac

SEQ ID NO: 3538704 - DNA, 14 bp, Homo sapiens
ggagggcacgaggc

SEQ ID NO: 3538705 - DNA, 13 bp, Homo sapiens
ggaggggagagac

SEQ ID NO: 3538706 - DNA, 20 bp, Homo sapiens
ggagtgttggggctgggggc

SEQ ID NO: 3538707 - DNA, 15 bp, Homo sapiens
ggcagcctgagagct

SEQ ID NO: 3538708 - DNA, 17 bp, Homo sapiens
ggcagcctgagagctgg

SEQ ID NO: 3538709 - DNA, 14 bp, Homo sapiens
ggcagcggggctgg

SEQ ID NO: 3538710 - DNA, 14 bp, Homo sapiens
ggcaggcagcctga

SEQ ID NO: 3538711 - DNA, 17 bp, Homo sapiens
ggcaggggaaactctgg

SEQ ID NO: 3538712 - DNA, 21 bp, Homo sapiens
ggccagctccaggagggcttg

SEQ ID NO: 3538713 - DNA, 15 bp, Homo sapiens
ggctgcccactctgg

SEQ ID NO: 3538714 - DNA, 20 bp, Homo sapiens
ggctgcccactctggggacc

SEQ ID NO: 3538715 - DNA, 16 bp, Homo sapiens
ggctgggctctggtgg

SEQ ID NO: 3538716 - DNA, 20 bp, Homo sapiens
ggctggtgggtctgcagctg

SEQ ID NO: 3538717 - DNA, 21 bp, Homo sapiens
ggctgtaaagcaaactggggc

SEQ ID NO: 3538718 - DNA, 13 bp, Homo sapiens
ggcttctgtgaaa

SEQ ID NO: 3538719 - DNA, 19 bp, Homo sapiens
ggcttctttgctttctcgt

SEQ ID NO: 3538720 - DNA, 20 bp, Homo sapiens
gggacccgctgggggctggc

SEQ ID NO: 3538721 - DNA, 19 bp, Homo sapiens
gggcaccagcttctttctc

SEQ ID NO: 3538722 - DNA, 16 bp, Homo sapiens
gggcagcggggctggc

SEQ ID NO: 3538723 - DNA, 21 bp, Homo sapiens
gggccagctccaggagggctt

SEQ ID NO: 3538724 - DNA, 13 bp, Homo sapiens
gggctctggtggg

SEQ ID NO: 3538725 - DNA, 22 bp, Homo sapiens
gggctctggtgggggctcctga

SEQ ID NO: 3538726 - DNA, 17 bp, Homo sapiens
gggctggccatgagggt

SEQ ID NO: 3538727 - DNA, 17 bp, Homo sapiens
gggctgtgcctgaggct

SEQ ID NO: 3538728 - DNA, 20 bp, Homo sapiens
ggggacccgctgggggctgg

SEQ ID NO: 3538729 - DNA, 19 bp, Homo sapiens
ggggagggcacgaggctct

SEQ ID NO: 3538730 - DNA, 19 bp, Homo sapiens
ggggcagcggggctggcca

SEQ ID NO: 3538731 - DNA, 19 bp, Homo sapiens
ggggcaggacaacacagct

SEQ ID NO: 3538732 - DNA, 18 bp, Homo sapiens
ggggccagctccaggagg

SEQ ID NO: 3538733 - DNA, 12 bp, Homo sapiens
ggggctgggggc

SEQ ID NO: 3538734 - DNA, 11 bp, Homo sapiens
gggtggggctg

SEQ ID NO: 3538735 - DNA, 14 bp, Homo sapiens
gggtggggctggtg

SEQ ID NO: 3538736 - DNA, 21 bp, Homo sapiens
gggttcgcaccgtgctgggct

SEQ ID NO: 3538737 - DNA, 13 bp, Homo sapiens
ggtatatttctgg

SEQ ID NO: 3538738 - DNA, 18 bp, Homo sapiens
ggtcagcggggcagcggg

SEQ ID NO: 3538739 - DNA, 17 bp, Homo sapiens
ggtcccctggcagggga

SEQ ID NO: 3538740 - DNA, 17 bp, Homo sapiens
ggtctgcagctggtgtg

SEQ ID NO: 3538741 - DNA, 14 bp, Homo sapiens
ggtgtttttctctc

SEQ ID NO: 3538742 - DNA, 17 bp, Homo sapiens
ggtgtttttctctctgg

SEQ ID NO: 3538743 - DNA, 19 bp, Homo sapiens
ggtgtttttctctctggac

SEQ ID NO: 3538744 - DNA, 15 bp, Homo sapiens
ggttctcaattctgt

SEQ ID NO: 3538745 - DNA, 21 bp, Homo sapiens
tcacatctcccttccacctca

SEQ ID NO: 3538746 - DNA, 19 bp, Homo sapiens
tcacctttatatatgtact

SEQ ID NO: 3538747 - DNA, 18 bp, Homo sapiens
tcactttctcctggtgtt

SEQ ID NO: 3538748 - DNA, 16 bp, Homo sapiens
tcagcctgcctgggag

SEQ ID NO: 3538749 - DNA, 23 bp, Homo sapiens
tcagcggggcagcggggctggcc

SEQ ID NO: 3538750 - DNA, 18 bp, Homo sapiens
tcagtgccatttgttaaa

SEQ ID NO: 3538751 - DNA, 17 bp, Homo sapiens
tcagttgagaaacagtt

SEQ ID NO: 3538752 - DNA, 15 bp, Homo sapiens
tcatactctgttgcc

SEQ ID NO: 3538753 - DNA, 19 bp, Homo sapiens
tcatactctgttgcctcct

SEQ ID NO: 3538754 - DNA, 23 bp, Homo sapiens
tcatactctgttgcctcctctct

SEQ ID NO: 3538755 - DNA, 20 bp, Homo sapiens
tcatgatgatgatgatttta

SEQ ID NO: 3538756 - DNA, 17 bp, Homo sapiens
tccacctcacaactcct

SEQ ID NO: 3538757 - DNA, 16 bp, Homo sapiens
tccatccttgactgaa

SEQ ID NO: 3538758 - DNA, 22 bp, Homo sapiens
tccccaggctgcccactctggg

SEQ ID NO: 3538759 - DNA, 12 bp, Homo sapiens
tcccctttctct

SEQ ID NO: 3538760 - DNA, 12 bp, Homo sapiens
tccctgcctcac

SEQ ID NO: 3538761 - DNA, 13 bp, Homo sapiens
tccctgcctcaca

SEQ ID NO: 3538762 - DNA, 16 bp, Homo sapiens
tccctgcctcacatct

SEQ ID NO: 3538763 - DNA, 17 bp, Homo sapiens
tccctgcctcacatctc

SEQ ID NO: 3538764 - DNA, 21 bp, Homo sapiens
tcccttccacctcacaactcc

SEQ ID NO: 3538765 - DNA, 20 bp, Homo sapiens
tcctcctttcccctttctct

SEQ ID NO: 3538766 - DNA, 19 bp, Homo sapiens
tcctctctccctgcctcac

SEQ ID NO: 3538767 - DNA, 21 bp, Homo sapiens
tcctggtgtttttctctctgg

SEQ ID NO: 3538768 - DNA, 15 bp, Homo sapiens
tcctgttctcttgta

SEQ ID NO: 3538769 - DNA, 22 bp, Homo sapiens
tcctttaatgacattgatttct

SEQ ID NO: 3538770 - DNA, 16 bp, Homo sapiens
tcctttcccctttctc

SEQ ID NO: 3538771 - DNA, 18 bp, Homo sapiens
tcctttcccctttctctt

SEQ ID NO: 3538772 - DNA, 13 bp, Homo sapiens
tcctttggcaggc

SEQ ID NO: 3538773 - DNA, 17 bp, Homo sapiens
tcctttgttggcttctt

SEQ ID NO: 3538774 - DNA, 16 bp, Homo sapiens
tccttttaagaaagct

SEQ ID NO: 3538775 - DNA, 13 bp, Homo sapiens
tcgggtggggctg

SEQ ID NO: 3538776 - DNA, 17 bp, Homo sapiens
tcgggtggggctggtgg

SEQ ID NO: 3538777 - DNA, 18 bp, Homo sapiens
tcgggtggggctggtggg

SEQ ID NO: 3538778 - DNA, 19 bp, Homo sapiens
tcgggtggggctggtgggt

SEQ ID NO: 3538779 - DNA, 12 bp, Homo sapiens
tctcaattctgt

SEQ ID NO: 3538780 - DNA, 13 bp, Homo sapiens
tctcaattctgtc

SEQ ID NO: 3538781 - DNA, 14 bp, Homo sapiens
tctccctgcctcac

SEQ ID NO: 3538782 - DNA, 17 bp, Homo sapiens
tctccctgcctcacatc

SEQ ID NO: 3538783 - DNA, 15 bp, Homo sapiens
tctcccttccacctc

SEQ ID NO: 3538784 - DNA, 13 bp, Homo sapiens
tctctccctgcct

SEQ ID NO: 3538785 - DNA, 16 bp, Homo sapiens
tctctccctgcctcac

SEQ ID NO: 3538786 - DNA, 18 bp, Homo sapiens
tctcttgtatagctgaaa

SEQ ID NO: 3538787 - DNA, 14 bp, Homo sapiens
tctgcactcttgta

SEQ ID NO: 3538788 - DNA, 19 bp, Homo sapiens
tctgcagcaccgtgggccc

SEQ ID NO: 3538789 - DNA, 17 bp, Homo sapiens
tctgcagctggtgtggg

SEQ ID NO: 3538790 - DNA, 23 bp, Homo sapiens
tggcctttcctagctagagaagg

SEQ ID NO: 3538791 - DNA, 23 bp, Homo sapiens
tggctgggggcaggacaacacag

SEQ ID NO: 3538792 - DNA, 18 bp, Homo sapiens
tggcttctttgctttctc

SEQ ID NO: 3538793 - DNA, 14 bp, Homo sapiens
tgggcaccagcttc

SEQ ID NO: 3538794 - DNA, 15 bp, Homo sapiens
tgggcaccagcttct

SEQ ID NO: 3538795 - DNA, 12 bp, Homo sapiens
tgggctctggtg

SEQ ID NO: 3538796 - DNA, 16 bp, Homo sapiens
tgggctctggtggggg

SEQ ID NO: 3538797 - DNA, 21 bp, Homo sapiens
tgggctttgtggaaacagctg

SEQ ID NO: 3538798 - DNA, 19 bp, Homo sapiens
tggggacccgctgggggct

SEQ ID NO: 3538799 - DNA, 21 bp, Homo sapiens
tggggacccgctgggggctgg

SEQ ID NO: 3538800 - DNA, 21 bp, Homo sapiens
tggggagagggaggggagaga

SEQ ID NO: 3538801 - DNA, 20 bp, Homo sapiens
tggggctgggggccagctcc

SEQ ID NO: 3538802 - DNA, 13 bp, Homo sapiens
tggggctggtggg

SEQ ID NO: 3538803 - DNA, 12 bp, Homo sapiens
tggtgtttttct

SEQ ID NO: 3538804 - DNA, 14 bp, Homo sapiens
tggtgtttttctct

SEQ ID NO: 3538805 - DNA, 15 bp, Homo sapiens
tggtgtttttctctc

SEQ ID NO: 3538806 - DNA, 19 bp, Homo sapiens
tggtgtttttctctctgga

SEQ ID NO: 3538807 - DNA, 12 bp, Homo sapiens
tgtaaaaagaca

SEQ ID NO: 3538808 - DNA, 22 bp, Homo sapiens
tgtagcacggagtgttggggct

SEQ ID NO: 3538809 - DNA, 16 bp, Homo sapiens
tgtattattgtaaagt

SEQ ID NO: 3538810 - DNA, 23 bp, Homo sapiens
tgtattttaaagggacagtttgt

SEQ ID NO: 3538811 - DNA, 15 bp, Homo sapiens
tgtcttctccctcct

SEQ ID NO: 3538812 - DNA, 18 bp, Homo sapiens
tgtgatcctttggggctt

SEQ ID NO: 3538813 - DNA, 14 bp, Homo sapiens
tgtggaaacagctg

SEQ ID NO: 3538814 - DNA, 14 bp, Homo sapiens
tgtggtttcccctt

SEQ ID NO: 3538815 - DNA, 22 bp, Homo sapiens
tgttatgacagccctaggaaac

SEQ ID NO: 3538816 - DNA, 15 bp, Homo sapiens
tgttgcctcctctct

SEQ ID NO: 3538817 - DNA, 19 bp, Homo sapiens
tgttgcctcctctctccct

SEQ ID NO: 3538818 - DNA, 22 bp, Homo sapiens
tgttgcctcctctctccctgcc

SEQ ID NO: 3538819 - DNA, 15 bp, Homo sapiens
tgttggggctggggg

SEQ ID NO: 3538820 - DNA, 23 bp, Homo sapiens
tgtttatgtactgtaaacagttc

SEQ ID NO: 3538821 - DNA, 12 bp, Homo sapiens
tgtttttctctc

SEQ ID NO: 3538822 - DNA, 19 bp, Homo sapiens
ttaaagtgaatctcaaaac

SEQ ID NO: 3538823 - DNA, 16 bp, Homo sapiens
ttaatttgtatttccc

SEQ ID NO: 3538824 - DNA, 14 bp, Homo sapiens
ttacttctggcctt

SEQ ID NO: 3538825 - DNA, 22 bp, Homo sapiens
ttaggagctcagttgagaaaca

SEQ ID NO: 3538826 - DNA, 15 bp, Homo sapiens
ttatgtactgtaaac

SEQ ID NO: 3538827 - DNA, 13 bp, Homo sapiens
ttcaactggaaca

SEQ ID NO: 3538828 - DNA, 14 bp, Homo sapiens
ttcactttctcctg

SEQ ID NO: 3538829 - DNA, 20 bp, Homo sapiens
ttcatactctgttgcctcct

SEQ ID NO: 3538830 - DNA, 23 bp, Homo sapiens
ttcatactctgttgcctcctctc

SEQ ID NO: 3538831 - DNA, 17 bp, Homo sapiens
ttccatccttgactgaa

SEQ ID NO: 3538832 - DNA, 13 bp, Homo sapiens
ttcccctttctct

SEQ ID NO: 3538833 - DNA, 12 bp, Homo sapiens
ttcccctttctt

SEQ ID NO: 3538834 - DNA, 17 bp, Homo sapiens
ttcctgctgtcttctcc

SEQ ID NO: 3538835 - DNA, 13 bp, Homo sapiens
ttctcctggtgtt

SEQ ID NO: 3538836 - DNA, 12 bp, Homo sapiens
ttctctttcctc

SEQ ID NO: 3538837 - DNA, 14 bp, Homo sapiens
ttcttgtgatcctt

SEQ ID NO: 3538838 - DNA, 21 bp, Homo sapiens
ttgactgaagcgaacatcttc

SEQ ID NO: 3538839 - DNA, 18 bp, Homo sapiens
ttgagaaacagttccatt

SEQ ID NO: 3538840 - DNA, 13 bp, Homo sapiens
ttgagttaatttt

SEQ ID NO: 3538841 - DNA, 17 bp, Homo sapiens
ttgcctcctctctccct

SEQ ID NO: 3538842 - DNA, 13 bp, Homo sapiens
ttgctgttttaat

SEQ ID NO: 3538843 - DNA, 21 bp, Homo sapiens
ttggcttcaaggatggagatg

SEQ ID NO: 3538844 - DNA, 14 bp, Homo sapiens
cctgttctcttgta

SEQ ID NO: 3538845 - DNA, 15 bp, Homo sapiens
cctgttctcttgtat

SEQ ID NO: 3538846 - DNA, 18 bp, Homo sapiens
ccttcactttctcctggt

SEQ ID NO: 3538847 - DNA, 12 bp, Homo sapiens
ccttccacctca

SEQ ID NO: 3538848 - DNA, 13 bp, Homo sapiens
ccttgactgaagc

SEQ ID NO: 3538849 - DNA, 22 bp, Homo sapiens
ccttgactgaagcgaacatctt

SEQ ID NO: 3538850 - DNA, 10 bp, Homo sapiens
cctttctctt

SEQ ID NO: 3538851 - DNA, 12 bp, Homo sapiens
cctttggggaga

SEQ ID NO: 3538852 - DNA, 19 bp, Homo sapiens
cctttggggcttctgtgaa

SEQ ID NO: 3538853 - DNA, 14 bp, Homo sapiens
ccttttaagaaagc

SEQ ID NO: 3538854 - DNA, 19 bp, Homo sapiens
cgaaaatgtattattgtaa

SEQ ID NO: 3538855 - DNA, 22 bp, Homo sapiens
cgaaatggaaacacacacagac

SEQ ID NO: 3538856 - DNA, 14 bp, Homo sapiens
cgaacatcttcata

SEQ ID NO: 3538857 - DNA, 15 bp, Homo sapiens
cgaacatcttcatat

SEQ ID NO: 3538858 - DNA, 16 bp, Homo sapiens
cgaacatcttcatata

SEQ ID NO: 3538859 - DNA, 20 bp, Homo sapiens
cgaacatcttcatataaact

SEQ ID NO: 3538860 - DNA, 18 bp, Homo sapiens
cgaggctctagaaatgcc

SEQ ID NO: 3538861 - DNA, 18 bp, Homo sapiens
cgctgggggctggcagag

SEQ ID NO: 3538862 - DNA, 14 bp, Homo sapiens
cggatggcggtgga

SEQ ID NO: 3538863 - DNA, 12 bp, Homo sapiens
cgggtggggctg

SEQ ID NO: 3538864 - DNA, 14 bp, Homo sapiens
cgggtggggctggt

SEQ ID NO: 3538865 - DNA, 16 bp, Homo sapiens
cgggtggggctggtgg

SEQ ID NO: 3538866 - DNA, 20 bp, Homo sapiens
cgtgggccctcaagctttcc

SEQ ID NO: 3538867 - DNA, 10 bp, Homo sapiens
ctatggaaat

SEQ ID NO: 3538868 - DNA, 16 bp, Homo sapiens
ctattttctgaagtga

SEQ ID NO: 3538869 - DNA, 13 bp, Homo sapiens
ctcaagctttcct

SEQ ID NO: 3538870 - DNA, 19 bp, Homo sapiens
ctcaagctttcctgctgtc

SEQ ID NO: 3538871 - DNA, 20 bp, Homo sapiens
ctcaagctttcctgctgtct

SEQ ID NO: 3538872 - DNA, 17 bp, Homo sapiens
ctcacatctcccttcca

SEQ ID NO: 3538873 - DNA, 14 bp, Homo sapiens
ctcagaaggctttg

SEQ ID NO: 3538874 - DNA, 16 bp, Homo sapiens
ctccaggagggcttga

SEQ ID NO: 3538875 - DNA, 21 bp, Homo sapiens
ctcccaggtttcttctctgga

SEQ ID NO: 3538876 - DNA, 23 bp, Homo sapiens
ctcccaggtttcttctctggaga

SEQ ID NO: 3538877 - DNA, 16 bp, Homo sapiens
ctccctgcctcacatc

SEQ ID NO: 3538878 - DNA, 20 bp, Homo sapiens
ctccctgcctcacatctccc

SEQ ID NO: 3538879 - DNA, 21 bp, Homo sapiens
ctcctcccaggtttcttctct

SEQ ID NO: 3538880 - DNA, 19 bp, Homo sapiens
ctcctgatccgcatccaag

SEQ ID NO: 3538881 - DNA, 19 bp, Homo sapiens
ctcctggtgtttttctctc

SEQ ID NO: 3538882 - DNA, 20 bp, Homo sapiens
ctcctggtgtttttctctct

SEQ ID NO: 3538883 - DNA, 22 bp, Homo sapiens
ctcctggtgtttttctctctgg

SEQ ID NO: 3538884 - DNA, 16 bp, Homo sapiens
ctccttccatccttga

SEQ ID NO: 3538885 - DNA, 22 bp, Homo sapiens
ctcctttaatgacattgatttc

SEQ ID NO: 3538886 - DNA, 20 bp, Homo sapiens
ctcctttcccctttctcttt

SEQ ID NO: 3538887 - DNA, 14 bp, Homo sapiens
ctctagtatttcca

SEQ ID NO: 3538888 - DNA, 13 bp, Homo sapiens
ctctccctgcctc

SEQ ID NO: 3538889 - DNA, 14 bp, Homo sapiens
ctctctccctgcct

SEQ ID NO: 3538890 - DNA, 20 bp, Homo sapiens
ctctggacccttctgaagca

SEQ ID NO: 3538891 - DNA, 16 bp, Homo sapiens
ctctgttgcctcctct

SEQ ID NO: 3538892 - DNA, 16 bp, Homo sapiens
ctgaacctgtctcctc

SEQ ID NO: 3538893 - DNA, 20 bp, Homo sapiens
ctgaacctgtctcctcccag

SEQ ID NO: 3538894 - DNA, 16 bp, Homo sapiens
ctgacgaaatggaaac

SEQ ID NO: 3538895 - DNA, 14 bp, Homo sapiens
ctgaggctggctgg

SEQ ID NO: 3538896 - DNA, 18 bp, Homo sapiens
ctgaggctggctgggggc

SEQ ID NO: 3538897 - DNA, 16 bp, Homo sapiens
ctgatccgcatccaag

SEQ ID NO: 3538898 - DNA, 21 bp, Homo sapiens
ctgcactcttgtacaaaagaa

SEQ ID NO: 3538899 - DNA, 22 bp, Homo sapiens
ctgcagcggaagggactctggg

SEQ ID NO: 3538900 - DNA, 16 bp, Homo sapiens
ctgcccactctgggga

SEQ ID NO: 3538901 - DNA, 19 bp, Homo sapiens
ctgcctcacatctcccttc

SEQ ID NO: 3538902 - DNA, 22 bp, Homo sapiens
ctgcctgggagagcccttgtgg

SEQ ID NO: 3538903 - DNA, 16 bp, Homo sapiens
ctgctgtcttctccct

SEQ ID NO: 3538904 - DNA, 20 bp, Homo sapiens
ctgcttccccaggctgccca

SEQ ID NO: 3538905 - DNA, 11 bp, Homo sapiens
ctggctgggct

SEQ ID NO: 3538906 - DNA, 18 bp, Homo sapiens
ctgggctctggtgggggc

SEQ ID NO: 3538907 - DNA, 17 bp, Homo sapiens
ctgggctgtgcctgagg

SEQ ID NO: 3538908 - DNA, 18 bp, Homo sapiens
ctggggacccgctggggg

SEQ ID NO: 3538909 - DNA, 19 bp, Homo sapiens
ctggggacccgctgggggc

SEQ ID NO: 3538910 - DNA, 17 bp, Homo sapiens
ctgggggcaggacaaca

SEQ ID NO: 3538911 - DNA, 15 bp, Homo sapiens
ctgggggccagctcc

SEQ ID NO: 3538912 - DNA, 13 bp, Homo sapiens
ctgggggctggca

SEQ ID NO: 3538913 - DNA, 16 bp, Homo sapiens
ctggtgtttttctctc

SEQ ID NO: 3538914 - DNA, 17 bp, Homo sapiens
ctggtgtttttctctct

SEQ ID NO: 3538915 - DNA, 20 bp, Homo sapiens
ctggtgtttttctctctgga

SEQ ID NO: 3538916 - DNA, 22 bp, Homo sapiens
ctgtagcacggagtgttggggc

SEQ ID NO: 3538917 - DNA, 20 bp, Homo sapiens
ctgtgcctgaggctggctgg

SEQ ID NO: 3538918 - DNA, 23 bp, Homo sapiens
ctgtgcctgaggctggctggggg

SEQ ID NO: 3538919 - DNA, 14 bp, Homo sapiens
ctgtgttttcgatg

SEQ ID NO: 3538920 - DNA, 18 bp, Homo sapiens
ctgtgttttcgatgatga

SEQ ID NO: 3538921 - DNA, 20 bp, Homo sapiens
ctgtgttttcgatgatgatg

SEQ ID NO: 3538922 - DNA, 19 bp, Homo sapiens
ctgttgcctcctctctccc

SEQ ID NO: 3538923 - DNA, 21 bp, Homo sapiens
ctgttgcctcctctctccctg

SEQ ID NO: 3538924 - DNA, 23 bp, Homo sapiens
ctgttgcctcctctctccctgcc

SEQ ID NO: 3538925 - DNA, 21 bp, Homo sapiens
cttattctatactttcttgta

SEQ ID NO: 3538926 - DNA, 13 bp, Homo sapiens
cttcatataaact

SEQ ID NO: 3538927 - DNA, 21 bp, Homo sapiens
cttctccctcctcctcctttc

SEQ ID NO: 3538928 - DNA, 17 bp, Homo sapiens
cttctgtgaaaaacctg

SEQ ID NO: 3538929 - DNA, 16 bp, Homo sapiens
cttcttgtgatccttt

SEQ ID NO: 3538930 - DNA, 15 bp, Homo sapiens
cttctttgctttctc

SEQ ID NO: 3538931 - DNA, 11 bp, Homo sapiens
cttgactgaag

SEQ ID NO: 3538932 - DNA, 13 bp, Homo sapiens
cttgagagctcag

SEQ ID NO: 3538933 - DNA, 17 bp, Homo sapiens
cttgggcaccagcttct

SEQ ID NO: 3538934 - DNA, 13 bp, Homo sapiens
cttgtacaaaaga

SEQ ID NO: 3538935 - DNA, 19 bp, Homo sapiens
cttgtgatcctttggggct

SEQ ID NO: 3538936 - DNA, 14 bp, Homo sapiens
ctttcccctttctc

SEQ ID NO: 3538937 - DNA, 15 bp, Homo sapiens
ctttcccctttctct

SEQ ID NO: 3538938 - DNA, 17 bp, Homo sapiens
ctttcctgctgtcttct

SEQ ID NO: 3538939 - DNA, 9 bp, Homo sapiens
ctttctctt

SEQ ID NO: 3538940 - DNA, 14 bp, Homo sapiens
ctttggggcttctg

SEQ ID NO: 3538941 - DNA, 15 bp, Homo sapiens
ctttggggcttctgt

SEQ ID NO: 3538942 - DNA, 16 bp, Homo sapiens
ctttggggcttctgtg

SEQ ID NO: 3538943 - DNA, 19 bp, Homo sapiens
ctttggggcttctgtgaaa

SEQ ID NO: 3538944 - DNA, 20 bp, Homo sapiens
tcctctctccctgcctcaca

SEQ ID NO: 3538945 - DNA, 21 bp, Homo sapiens
tcctctctccctgcctcacat

SEQ ID NO: 3538946 - DNA, 22 bp, Homo sapiens
tcctggtgtttttctctctgga

SEQ ID NO: 3538947 - DNA, 22 bp, Homo sapiens
tccttgactgaagcgaacatct

SEQ ID NO: 3538948 - DNA, 20 bp, Homo sapiens
tcctttggggcttctgtgaa

SEQ ID NO: 3538949 - DNA, 16 bp, Homo sapiens
tcctttgttggcttct

SEQ ID NO: 3538950 - DNA, 18 bp, Homo sapiens
tcctttgttggcttcttt

SEQ ID NO: 3538951 - DNA, 21 bp, Homo sapiens
tccttttaagaaagcttcttg

SEQ ID NO: 3538952 - DNA, 14 bp, Homo sapiens
tcgggtggggctgg

SEQ ID NO: 3538953 - DNA, 16 bp, Homo sapiens
tcggtcagcggggcag

SEQ ID NO: 3538954 - DNA, 13 bp, Homo sapiens
tctccctgcctca

SEQ ID NO: 3538955 - DNA, 18 bp, Homo sapiens
tctccctgcctcacatct

SEQ ID NO: 3538956 - DNA, 16 bp, Homo sapiens
tctcccttccacctca

SEQ ID NO: 3538957 - DNA, 17 bp, Homo sapiens
tctcccttccacctcac

SEQ ID NO: 3538958 - DNA, 20 bp, Homo sapiens
tctcctcccaggtttcttct

SEQ ID NO: 3538959 - DNA, 22 bp, Homo sapiens
tctcctcccaggtttcttctct

SEQ ID NO: 3538960 - DNA, 23 bp, Homo sapiens
tctcctggtgtttttctctctgg

SEQ ID NO: 3538961 - DNA, 13 bp, Homo sapiens
tctctggaagaag

SEQ ID NO: 3538962 - DNA, 14 bp, Homo sapiens
tctgcagctggtgt

SEQ ID NO: 3538963 - DNA, 20 bp, Homo sapiens
tctgccctcgggtggggctg

SEQ ID NO: 3538964 - DNA, 15 bp, Homo sapiens
tctggagaagttttt

SEQ ID NO: 3538965 - DNA, 22 bp, Homo sapiens
tctggggacccgctgggggctg

SEQ ID NO: 3538966 - DNA, 22 bp, Homo sapiens
tctgttgcctcctctctccctg

SEQ ID NO: 3538967 - DNA, 14 bp, Homo sapiens
tctttcctcatttc

SEQ ID NO: 3538968 - DNA, 16 bp, Homo sapiens
tgaagcgaacatcttc

SEQ ID NO: 3538969 - DNA, 16 bp, Homo sapiens
tgaattcatactctgt

SEQ ID NO: 3538970 - DNA, 20 bp, Homo sapiens
tgacacctagagtttggact

SEQ ID NO: 3538971 - DNA, 19 bp, Homo sapiens
tgactgaagcgaacatctt

SEQ ID NO: 3538972 - DNA, 20 bp, Homo sapiens
tgactgaagcgaacatcttc

SEQ ID NO: 3538973 - DNA, 22 bp, Homo sapiens
tgactgaagcgaacatcttcat

SEQ ID NO: 3538974 - DNA, 17 bp, Homo sapiens
tgagagctcagcctgcc

SEQ ID NO: 3538975 - DNA, 14 bp, Homo sapiens
tgagagctggccca

SEQ ID NO: 3538976 - DNA, 18 bp, Homo sapiens
tgaggctggctgggggca

SEQ ID NO: 3538977 - DNA, 22 bp, Homo sapiens
tgatcctttggggcttctgtga

SEQ ID NO: 3538978 - DNA, 14 bp, Homo sapiens
tgatgatgatgatt

SEQ ID NO: 3538979 - DNA, 12 bp, Homo sapiens
tgatgtttatgt

SEQ ID NO: 3538980 - DNA, 12 bp, Homo sapiens
tgattttaacag

SEQ ID NO: 3538981 - DNA, 13 bp, Homo sapiens
tgcactcttgtac

SEQ ID NO: 3538982 - DNA, 13 bp, Homo sapiens
tgcccactctggg

SEQ ID NO: 3538983 - DNA, 18 bp, Homo sapiens
tgccccagtcagcctggc

SEQ ID NO: 3538984 - DNA, 17 bp, Homo sapiens
tgccctcgggtggggct

SEQ ID NO: 3538985 - DNA, 19 bp, Homo sapiens
tgccctcgggtggggctgg

SEQ ID NO: 3538986 - DNA, 14 bp, Homo sapiens
tgcctcacatctcc

SEQ ID NO: 3538987 - DNA, 16 bp, Homo sapiens
tgcctcctctctccct

SEQ ID NO: 3538988 - DNA, 21 bp, Homo sapiens
tgcctcctctctccctgcctc

SEQ ID NO: 3538989 - DNA, 21 bp, Homo sapiens
tgcctgaggctggctgggggc

SEQ ID NO: 3538990 - DNA, 22 bp, Homo sapiens
tgcctgggagagcccttgtggc

SEQ ID NO: 3538991 - DNA, 15 bp, Homo sapiens
tgctgtattttaaag

SEQ ID NO: 3538992 - DNA, 13 bp, Homo sapiens
tgctgtcttctcc

SEQ ID NO: 3538993 - DNA, 14 bp, Homo sapiens
tgcttgctttatta

SEQ ID NO: 3538994 - DNA, 17 bp, Homo sapiens
tgctttctcgtgggtcc

SEQ ID NO: 3538995 - DNA, 19 bp, Homo sapiens
tggacatgtaaaaagacaa

SEQ ID NO: 3538996 - DNA, 22 bp, Homo sapiens
tggacccttctgaagcagagac

SEQ ID NO: 3538997 - DNA, 19 bp, Homo sapiens
tggcccaggggtcccctgg

SEQ ID NO: 3538998 - DNA, 18 bp, Homo sapiens
tggctgggctctggtggg

SEQ ID NO: 3538999 - DNA, 21 bp, Homo sapiens
tggcttcaaggatggagatgg

SEQ ID NO: 3539000 - DNA, 20 bp, Homo sapiens
tgggagagcccttgtggcga

SEQ ID NO: 3539001 - DNA, 17 bp, Homo sapiens
tgggcaccagcttcttt

SEQ ID NO: 3539002 - DNA, 15 bp, Homo sapiens
tgggctctggtgggg

SEQ ID NO: 3539003 - DNA, 17 bp, Homo sapiens
tgggctctggtgggggc

SEQ ID NO: 3539004 - DNA, 22 bp, Homo sapiens
tggggacccgctgggggctggc

SEQ ID NO: 3539005 - DNA, 13 bp, Homo sapiens
tggggctgggggc

SEQ ID NO: 3539006 - DNA, 18 bp, Homo sapiens
tggggctggtgggtctgc

SEQ ID NO: 3539007 - DNA, 13 bp, Homo sapiens
tggggcttctgtg

SEQ ID NO: 3539008 - DNA, 20 bp, Homo sapiens
tgggggccagctccaggagg

SEQ ID NO: 3539009 - DNA, 20 bp, Homo sapiens
tggtcatgaattcatactct

SEQ ID NO: 3539010 - DNA, 22 bp, Homo sapiens
tggtgggtctgcagctggtgtg

SEQ ID NO: 3539011 - DNA, 17 bp, Homo sapiens
tggtgtttttctctctg

SEQ ID NO: 3539012 - DNA, 23 bp, Homo sapiens
tggtttcccctttctttcctttt

SEQ ID NO: 3539013 - DNA, 22 bp, Homo sapiens
tggttttgccctccctctctgc

SEQ ID NO: 3539014 - DNA, 23 bp, Homo sapiens
tgtaatttgaataagatccaatt

SEQ ID NO: 3539015 - DNA, 12 bp, Homo sapiens
tgtacaaaagaa

SEQ ID NO: 3539016 - DNA, 21 bp, Homo sapiens
tgtacataccggggctcctct

SEQ ID NO: 3539017 - DNA, 22 bp, Homo sapiens
tgtacataccggggctcctctc

SEQ ID NO: 3539018 - DNA, 16 bp, Homo sapiens
tgtactgtaaacagtt

SEQ ID NO: 3539019 - DNA, 13 bp, Homo sapiens
tgtatgtacatac

SEQ ID NO: 3539020 - DNA, 23 bp, Homo sapiens
tgtattattgtaaagtttatttt

SEQ ID NO: 3539021 - DNA, 10 bp, Homo sapiens
tgtcttctcc

SEQ ID NO: 3539022 - DNA, 22 bp, Homo sapiens
tgtgatcctttggggcttctgt

SEQ ID NO: 3539023 - DNA, 15 bp, Homo sapiens
tgtggaaacagctgg

SEQ ID NO: 3539024 - DNA, 19 bp, Homo sapiens
tgtggtttcccctttcttt

SEQ ID NO: 3539025 - DNA, 12 bp, Homo sapiens
tgtgtgtctgca

SEQ ID NO: 3539026 - DNA, 14 bp, Homo sapiens
tgtgttttcgatga

SEQ ID NO: 3539027 - DNA, 13 bp, Homo sapiens
tgttagattttta

SEQ ID NO: 3539028 - DNA, 14 bp, Homo sapiens
tgttcattcttgtt

SEQ ID NO: 3539029 - DNA, 13 bp, Homo sapiens
tgttctcttgtat

SEQ ID NO: 3539030 - DNA, 12 bp, Homo sapiens
tgttgcctcctc

SEQ ID NO: 3539031 - DNA, 13 bp, Homo sapiens
tgttgcctcctct

SEQ ID NO: 3539032 - DNA, 14 bp, Homo sapiens
tgttgcctcctctc

SEQ ID NO: 3539033 - DNA, 20 bp, Homo sapiens
tgttgcctcctctctccctg

SEQ ID NO: 3539034 - DNA, 22 bp, Homo sapiens
tgttggcttctttgctttctcg

SEQ ID NO: 3539035 - DNA, 13 bp, Homo sapiens
tgttggggctggg

SEQ ID NO: 3539036 - DNA, 14 bp, Homo sapiens
tgttggggctgggg

SEQ ID NO: 3539037 - DNA, 19 bp, Homo sapiens
tgttgtctataatggggaa

SEQ ID NO: 3539038 - DNA, 23 bp, Homo sapiens
ttaagcaacaaaactatggaaat

SEQ ID NO: 3539039 - DNA, 14 bp, Homo sapiens
ttagaatcagtgtg

SEQ ID NO: 3539040 - DNA, 24 bp, Homo sapiens
ttaggagctcagttgagaaacagt

SEQ ID NO: 3539041 - DNA, 22 bp, Homo sapiens
ttataagagattcactcagaag

SEQ ID NO: 3539042 - DNA, 14 bp, Homo sapiens
ttatgtactgtaaa

SEQ ID NO: 3539043 - DNA, 18 bp, Homo sapiens
ttatgtactgtaaacagt

SEQ ID NO: 3539044 - DNA, 15 bp, Homo sapiens
aaaaagactgttatt

SEQ ID NO: 3539045 - DNA, 15 bp, Homo sapiens
aaaaattgtttttcc

SEQ ID NO: 3539046 - DNA, 17 bp, Homo sapiens
aaaaccaagttatctgt

SEQ ID NO: 3539047 - DNA, 10 bp, Homo sapiens
aaactctggt

SEQ ID NO: 3539048 - DNA, 13 bp, Homo sapiens
aaagactgttatt

SEQ ID NO: 3539049 - DNA, 22 bp, Homo sapiens
aaagcaactgatcatatttgtg

SEQ ID NO: 3539050 - DNA, 14 bp, Homo sapiens
aaatacaatatgga

SEQ ID NO: 3539051 - DNA, 19 bp, Homo sapiens
aaatgcccttcactttctc

SEQ ID NO: 3539052 - DNA, 24 bp, Homo sapiens
aaatgcccttcactttctcctggt

SEQ ID NO: 3539053 - DNA, 22 bp, Homo sapiens
aaatggtacttaaacatttttg

SEQ ID NO: 3539054 - DNA, 16 bp, Homo sapiens
aaatgtattattgtaa

SEQ ID NO: 3539055 - DNA, 16 bp, Homo sapiens
aacaaaactatggaaa

SEQ ID NO: 3539056 - DNA, 18 bp, Homo sapiens
aacaaaactatggaaata

SEQ ID NO: 3539057 - DNA, 16 bp, Homo sapiens
aacagtctctggaaga

SEQ ID NO: 3539058 - DNA, 18 bp, Homo sapiens
aacagtctctggaagaag

SEQ ID NO: 3539059 - DNA, 12 bp, Homo sapiens
aacagttccatt

SEQ ID NO: 3539060 - DNA, 13 bp, Homo sapiens
aacagttctgcac

SEQ ID NO: 3539061 - DNA, 20 bp, Homo sapiens
aacagttttacttctggcct

SEQ ID NO: 3539062 - DNA, 17 bp, Homo sapiens
aacatcttcatataaac

SEQ ID NO: 3539063 - DNA, 13 bp, Homo sapiens
aaccgagtcagaa

SEQ ID NO: 3539064 - DNA, 13 bp, Homo sapiens
aactcagaaggct

SEQ ID NO: 3539065 - DNA, 19 bp, Homo sapiens
aactccttccatccttgac

SEQ ID NO: 3539066 - DNA, 20 bp, Homo sapiens
aactccttccatccttgact

SEQ ID NO: 3539067 - DNA, 12 bp, Homo sapiens
aactctgtaaga

SEQ ID NO: 3539068 - DNA, 14 bp, Homo sapiens
aactctgtaagaaa

SEQ ID NO: 3539069 - DNA, 13 bp, Homo sapiens
aactggaacattt

SEQ ID NO: 3539070 - DNA, 16 bp, Homo sapiens
aacttgggctgtaaag

SEQ ID NO: 3539071 - DNA, 17 bp, Homo sapiens
aacttgggctgtaaagc

SEQ ID NO: 3539072 - DNA, 18 bp, Homo sapiens
aacttgggctgtaaagca

SEQ ID NO: 3539073 - DNA, 23 bp, Homo sapiens
aagagattcactcagaagacaca

SEQ ID NO: 3539074 - DNA, 15 bp, Homo sapiens
aagagtgggctttgt

SEQ ID NO: 3539075 - DNA, 16 bp, Homo sapiens
aagcgaacatcttcat

SEQ ID NO: 3539076 - DNA, 22 bp, Homo sapiens
aagcgaacatcttcatataaac

SEQ ID NO: 3539077 - DNA, 20 bp, Homo sapiens
aaggctttgggatatgctgt

SEQ ID NO: 3539078 - DNA, 18 bp, Homo sapiens
aagggactctgggctgtg

SEQ ID NO: 3539079 - DNA, 20 bp, Homo sapiens
aagggactctgggctgtgcc

SEQ ID NO: 3539080 - DNA, 12 bp, Homo sapiens
aagtcagagaga

SEQ ID NO: 3539081 - DNA, 18 bp, Homo sapiens
aataaacgtgctaggaag

SEQ ID NO: 3539082 - DNA, 21 bp, Homo sapiens
aatacaatatggacatgtaaa

SEQ ID NO: 3539083 - DNA, 21 bp, Homo sapiens
aatattctacacatatcttgt

SEQ ID NO: 3539084 - DNA, 22 bp, Homo sapiens
aatattctacacatatcttgtt

SEQ ID NO: 3539085 - DNA, 21 bp, Homo sapiens
aatcttctgctaaatttttgt

SEQ ID NO: 3539086 - DNA, 16 bp, Homo sapiens
aatgactccaggaaga

SEQ ID NO: 3539087 - DNA, 18 bp, Homo sapiens
aatgcccttcactttctc

SEQ ID NO: 3539088 - DNA, 16 bp, Homo sapiens
aatggaaacacacaca

SEQ ID NO: 3539089 - DNA, 22 bp, Homo sapiens
aatggtacttaaacatttttgt

SEQ ID NO: 3539090 - DNA, 23 bp, Homo sapiens
aattcatactctgttgcctcctc

SEQ ID NO: 3539091 - DNA, 14 bp, Homo sapiens
aattcatctttttt

SEQ ID NO: 3539092 - DNA, 13 bp, Homo sapiens
aattgtttttccc

SEQ ID NO: 3539093 - DNA, 18 bp, Homo sapiens
aatttttgtataaggtga

SEQ ID NO: 3539094 - DNA, 14 bp, Homo sapiens
acaaaaaccaagtt

SEQ ID NO: 3539095 - DNA, 22 bp, Homo sapiens
acaaagaagattcttaccaaga

SEQ ID NO: 3539096 - DNA, 14 bp, Homo sapiens
acaaataggtatgt

SEQ ID NO: 3539097 - DNA, 14 bp, Homo sapiens
acagctgcttcccc

SEQ ID NO: 3539098 - DNA, 16 bp, Homo sapiens
acatcttcatataaac

SEQ ID NO: 3539099 - DNA, 20 bp, Homo sapiens
acatgtaaaaagacaaaaac

SEQ ID NO: 3539100 - DNA, 17 bp, Homo sapiens
acatttttgtttttaat

SEQ ID NO: 3539101 - DNA, 15 bp, Homo sapiens
accaaacagacaagc

SEQ ID NO: 3539102 - DNA, 13 bp, Homo sapiens
accaagttatctg

SEQ ID NO: 3539103 - DNA, 14 bp, Homo sapiens
acccaattgtttca

SEQ ID NO: 3539104 - DNA, 17 bp, Homo sapiens
acccgctgggggctggc

SEQ ID NO: 3539105 - DNA, 17 bp, Homo sapiens
accggacaagagcctgc

SEQ ID NO: 3539106 - DNA, 13 bp, Homo sapiens
acctgtctcctcc

SEQ ID NO: 3539107 - DNA, 21 bp, Homo sapiens
accttcagccctttggcttca

SEQ ID NO: 3539108 - DNA, 13 bp, Homo sapiens
acgaaatggaaac

SEQ ID NO: 3539109 - DNA, 18 bp, Homo sapiens
acgaggctctagaaatgc

SEQ ID NO: 3539110 - DNA, 16 bp, Homo sapiens
acgctgatgtttatgt

SEQ ID NO: 3539111 - DNA, 19 bp, Homo sapiens
acggagtgttggggctggg

SEQ ID NO: 3539112 - DNA, 21 bp, Homo sapiens
acggagtgttggggctggggg

SEQ ID NO: 3539113 - DNA, 20 bp, Homo sapiens
actatctacaaaatttctga

SEQ ID NO: 3539114 - DNA, 12 bp, Homo sapiens
actctgttgcct

SEQ ID NO: 3539115 - DNA, 13 bp, Homo sapiens
actctgttgcctc

SEQ ID NO: 3539116 - DNA, 19 bp, Homo sapiens
caaactcagaaggctttgg

SEQ ID NO: 3539117 - DNA, 17 bp, Homo sapiens
caaactggggctgtgtt

SEQ ID NO: 3539118 - DNA, 16 bp, Homo sapiens
caaagaagattcttac

SEQ ID NO: 3539119 - DNA, 21 bp, Homo sapiens
caaagaagattcttaccaaga

SEQ ID NO: 3539120 - DNA, 15 bp, Homo sapiens
caacaaaactatgga

SEQ ID NO: 3539121 - DNA, 15 bp, Homo sapiens
caacacagctgcttc

SEQ ID NO: 3539122 - DNA, 15 bp, Homo sapiens
caactgatcatattt

SEQ ID NO: 3539123 - DNA, 22 bp, Homo sapiens
caagctttcctgctgtcttctc

SEQ ID NO: 3539124 - DNA, 16 bp, Homo sapiens
caaggaagtctgtgtc

SEQ ID NO: 3539125 - DNA, 19 bp, Homo sapiens
caaggaagtctgtgtctac

SEQ ID NO: 3539126 - DNA, 21 bp, Homo sapiens
caagttatctgtttcctgttc

SEQ ID NO: 3539127 - DNA, 19 bp, Homo sapiens
caatatggacatgtaaaaa

SEQ ID NO: 3539128 - DNA, 21 bp, Homo sapiens
caatatggacatgtaaaaaga

SEQ ID NO: 3539129 - DNA, 22 bp, Homo sapiens
cacaaagtttgtggtaatttgt

SEQ ID NO: 3539130 - DNA, 16 bp, Homo sapiens
cacacaccttgcaaaa

SEQ ID NO: 3539131 - DNA, 15 bp, Homo sapiens
cacagacacacacac

SEQ ID NO: 3539132 - DNA, 19 bp, Homo sapiens
caccagcttctttctcggt

SEQ ID NO: 3539133 - DNA, 22 bp, Homo sapiens
caccagcttctttctcggtggc

SEQ ID NO: 3539134 - DNA, 14 bp, Homo sapiens
cacctcacaactcc

SEQ ID NO: 3539135 - DNA, 15 bp, Homo sapiens
cacctcacaactcct

SEQ ID NO: 3539136 - DNA, 15 bp, Homo sapiens
caccttgtcgctgaa

SEQ ID NO: 3539137 - DNA, 17 bp, Homo sapiens
cacggagtgttggggct

SEQ ID NO: 3539138 - DNA, 18 bp, Homo sapiens
cacggagtgttggggctg

SEQ ID NO: 3539139 - DNA, 21 bp, Homo sapiens
cactcttgtacaaaagaaaaa

SEQ ID NO: 3539140 - DNA, 13 bp, Homo sapiens
cactttctcctgg

SEQ ID NO: 3539141 - DNA, 20 bp, Homo sapiens
cagaaatattctacacatat

SEQ ID NO: 3539142 - DNA, 19 bp, Homo sapiens
cagaagacacatgtggaga

SEQ ID NO: 3539143 - DNA, 13 bp, Homo sapiens
cagaaggctttgg

SEQ ID NO: 3539144 - DNA, 12 bp, Homo sapiens
cagacacacaca

SEQ ID NO: 3539145 - DNA, 16 bp, Homo sapiens
cagacacacacacacc

SEQ ID NO: 3539146 - DNA, 13 bp, Homo sapiens
cagccctttggct

SEQ ID NO: 3539147 - DNA, 15 bp, Homo sapiens
cagccctttggcttc

SEQ ID NO: 3539148 - DNA, 18 bp, Homo sapiens
cagcctgagagctggccc

SEQ ID NO: 3539149 - DNA, 13 bp, Homo sapiens
caggaagaaggtg

SEQ ID NO: 3539150 - DNA, 20 bp, Homo sapiens
caggacaacacagctgcttc

SEQ ID NO: 3539151 - DNA, 16 bp, Homo sapiens
caggcagcctgagagc

SEQ ID NO: 3539152 - DNA, 24 bp, Homo sapiens
caggcagcctgagagctggcccag

SEQ ID NO: 3539153 - DNA, 17 bp, Homo sapiens
caggctgcccactctgg

SEQ ID NO: 3539154 - DNA, 18 bp, Homo sapiens
caggctgcccactctggg

SEQ ID NO: 3539155 - DNA, 16 bp, Homo sapiens
caggggaaactctggt

SEQ ID NO: 3539156 - DNA, 13 bp, Homo sapiens
cagtcagcctggc

SEQ ID NO: 3539157 - DNA, 15 bp, Homo sapiens
cagtctctggaagaa

SEQ ID NO: 3539158 - DNA, 14 bp, Homo sapiens
cagtgggttaattt

SEQ ID NO: 3539159 - DNA, 18 bp, Homo sapiens
cagttctgcactcttgta

SEQ ID NO: 3539160 - DNA, 20 bp, Homo sapiens
cagttctgcactcttgtaca

SEQ ID NO: 3539161 - DNA, 13 bp, Homo sapiens
cagttgagaaaca

SEQ ID NO: 3539162 - DNA, 23 bp, Homo sapiens
cagtttgtaacttgggctgtaaa

SEQ ID NO: 3539163 - DNA, 12 bp, Homo sapiens
catactctgttg

SEQ ID NO: 3539164 - DNA, 13 bp, Homo sapiens
catactctgttgc

SEQ ID NO: 3539165 - DNA, 16 bp, Homo sapiens
catactctgttgcctc

SEQ ID NO: 3539166 - DNA, 17 bp, Homo sapiens
catactctgttgcctcc

SEQ ID NO: 3539167 - DNA, 19 bp, Homo sapiens
catatattgtgtggtttcc

SEQ ID NO: 3539168 - DNA, 20 bp, Homo sapiens
catatctcctttaatgacat

SEQ ID NO: 3539169 - DNA, 16 bp, Homo sapiens
catatcttgttagatt

SEQ ID NO: 3539170 - DNA, 19 bp, Homo sapiens
catcatgattaagatgatt

SEQ ID NO: 3539171 - DNA, 15 bp, Homo sapiens
catccaaactcagaa

SEQ ID NO: 3539172 - DNA, 14 bp, Homo sapiens
catcttcatataaa

SEQ ID NO: 3539173 - DNA, 14 bp, Homo sapiens
catgaattcatact

SEQ ID NO: 3539174 - DNA, 15 bp, Homo sapiens
catgtaaaaagacaa

SEQ ID NO: 3539175 - DNA, 18 bp, Homo sapiens
catgtaaaaagacaaaaa

SEQ ID NO: 3539176 - DNA, 16 bp, Homo sapiens
cattgttcattcttgt

SEQ ID NO: 3539177 - DNA, 18 bp, Homo sapiens
cattttttttttttcctt

SEQ ID NO: 3539178 - DNA, 18 bp, Homo sapiens
ccaaacagacaagcaggc

SEQ ID NO: 3539179 - DNA, 19 bp, Homo sapiens
ccaagagtgggctttgtgg

SEQ ID NO: 3539180 - DNA, 17 bp, Homo sapiens
ccaagttatctgtttcc

SEQ ID NO: 3539181 - DNA, 17 bp, Homo sapiens
ccacaaagaagattctt

SEQ ID NO: 3539182 - DNA, 16 bp, Homo sapiens
ccacctcacaactcct

SEQ ID NO: 3539183 - DNA, 11 bp, Homo sapiens
ccaggaagaag

SEQ ID NO: 3539184 - DNA, 18 bp, Homo sapiens
ccaggctgcccactctgg

SEQ ID NO: 3539185 - DNA, 20 bp, Homo sapiens
ccaggctgcccactctgggg

SEQ ID NO: 3539186 - DNA, 21 bp, Homo sapiens
ccaggctgcccactctgggga

SEQ ID NO: 3539187 - DNA, 21 bp, Homo sapiens
ccaggtttcttctctggagaa

SEQ ID NO: 3539188 - DNA, 15 bp, Homo sapiens
ccagtcagcctggct

SEQ ID NO: 3539189 - DNA, 17 bp, Homo sapiens
ccagtcagcctggctgg

SEQ ID NO: 3539190 - DNA, 11 bp, Homo sapiens
cccactctggg

SEQ ID NO: 3539191 - DNA, 18 bp, Homo sapiens
cccaggtttcttctctgg

SEQ ID NO: 3539192 - DNA, 21 bp, Homo sapiens
cccagtcagcctggctgggct

SEQ ID NO: 3539193 - DNA, 22 bp, Homo sapiens
cccagtcagcctggctgggctc

SEQ ID NO: 3539194 - DNA, 22 bp, Homo sapiens
cccatatctcctttaatgacat

SEQ ID NO: 3539195 - DNA, 10 bp, Homo sapiens
cccctttctc

SEQ ID NO: 3539196 - DNA, 14 bp, Homo sapiens
ccctccctctctgc

SEQ ID NO: 3539197 - DNA, 12 bp, Homo sapiens
ccctcgggtggg

SEQ ID NO: 3539198 - DNA, 18 bp, Homo sapiens
ccctcgggtggggctggt

SEQ ID NO: 3539199 - DNA, 17 bp, Homo sapiens
cccttcactttctcctg

SEQ ID NO: 3539200 - DNA, 14 bp, Homo sapiens
cccttccacctcac

SEQ ID NO: 3539201 - DNA, 11 bp, Homo sapiens
ccctttctctt

SEQ ID NO: 3539202 - DNA, 15 bp, Homo sapiens
ccgcatccaagctta

SEQ ID NO: 3539203 - DNA, 12 bp, Homo sapiens
ccgtgctgggct

SEQ ID NO: 3539204 - DNA, 19 bp, Homo sapiens
ccgtgggccctcaagcttt

SEQ ID NO: 3539205 - DNA, 12 bp, Homo sapiens
cctcacaactcc

SEQ ID NO: 3539206 - DNA, 16 bp, Homo sapiens
cctcacatctcccttc

SEQ ID NO: 3539207 - DNA, 18 bp, Homo sapiens
cctcccaggtttcttctc

SEQ ID NO: 3539208 - DNA, 20 bp, Homo sapiens
cctcccaggtttcttctctg

SEQ ID NO: 3539209 - DNA, 14 bp, Homo sapiens
cctccctctctgcc

SEQ ID NO: 3539210 - DNA, 15 bp, Homo sapiens
cctccctttggggag

SEQ ID NO: 3539211 - DNA, 16 bp, Homo sapiens
cctcctctctccctgc

SEQ ID NO: 3539212 - DNA, 19 bp, Homo sapiens
cctcctctctccctgcctc

SEQ ID NO: 3539213 - DNA, 20 bp, Homo sapiens
cctcctctctccctgcctca

SEQ ID NO: 3539214 - DNA, 21 bp, Homo sapiens
cctcctctctccctgcctcac

SEQ ID NO: 3539215 - DNA, 20 bp, Homo sapiens
cctcctttcccctttctctt

SEQ ID NO: 3539216 - DNA, 23 bp, Homo sapiens
cctcgggtggggctggtgggtct

SEQ ID NO: 3539217 - DNA, 13 bp, Homo sapiens
ggagctcagttga

SEQ ID NO: 3539218 - DNA, 15 bp, Homo sapiens
ggaggggagagacca

SEQ ID NO: 3539219 - DNA, 16 bp, Homo sapiens
ggagtgttggggctgg

SEQ ID NO: 3539220 - DNA, 18 bp, Homo sapiens
ggagtgttggggctgggg

SEQ ID NO: 3539221 - DNA, 13 bp, Homo sapiens
ggatggcggtgga

SEQ ID NO: 3539222 - DNA, 17 bp, Homo sapiens
ggcagcggggctggcca

SEQ ID NO: 3539223 - DNA, 19 bp, Homo sapiens
ggcaggcagcctgagagct

SEQ ID NO: 3539224 - DNA, 18 bp, Homo sapiens
ggcaggcctccctttggg

SEQ ID NO: 3539225 - DNA, 20 bp, Homo sapiens
ggcaggggaaactctggtgc

SEQ ID NO: 3539226 - DNA, 20 bp, Homo sapiens
ggctcctctcctaacatata

SEQ ID NO: 3539227 - DNA, 21 bp, Homo sapiens
ggctgggctctggtgggggct

SEQ ID NO: 3539228 - DNA, 10 bp, Homo sapiens
ggctggtggg

SEQ ID NO: 3539229 - DNA, 20 bp, Homo sapiens
ggctgtgcctgaggctggct

SEQ ID NO: 3539230 - DNA, 18 bp, Homo sapiens
ggcttcaaggatggagat

SEQ ID NO: 3539231 - DNA, 18 bp, Homo sapiens
ggcttctttgctttctcg

SEQ ID NO: 3539232 - DNA, 19 bp, Homo sapiens
gggacccgctgggggctgg

SEQ ID NO: 3539233 - DNA, 21 bp, Homo sapiens
gggcaccagcttctttctcgg

SEQ ID NO: 3539234 - DNA, 23 bp, Homo sapiens
gggccagctccaggagggcttga

SEQ ID NO: 3539235 - DNA, 11 bp, Homo sapiens
gggctggtggg

SEQ ID NO: 3539236 - DNA, 13 bp, Homo sapiens
gggctgtgcctga

SEQ ID NO: 3539237 - DNA, 22 bp, Homo sapiens
gggcttgagagctcagcctgcc

SEQ ID NO: 3539238 - DNA, 15 bp, Homo sapiens
ggggcagcggggctg

SEQ ID NO: 3539239 - DNA, 12 bp, Homo sapiens
gggtggggctgg

SEQ ID NO: 3539240 - DNA, 15 bp, Homo sapiens
ggtcccctggcaggg

SEQ ID NO: 3539241 - DNA, 24 bp, Homo sapiens
ggtcctttggcaggcctccctttg

SEQ ID NO: 3539242 - DNA, 12 bp, Homo sapiens
ggtggggctggt

SEQ ID NO: 3539243 - DNA, 16 bp, Homo sapiens
ggtgtttttctctctg

SEQ ID NO: 3539244 - DNA, 18 bp, Homo sapiens
ggtgtttttctctctgga

SEQ ID NO: 3539245 - DNA, 18 bp, Homo sapiens
ggttcgcaccgtgctggg

SEQ ID NO: 3539246 - DNA, 14 bp, Homo sapiens
ggtttcccctttct

SEQ ID NO: 3539247 - DNA, 12 bp, Homo sapiens
ggtttcttctct

SEQ ID NO: 3539248 - DNA, 16 bp, Homo sapiens
ggtttcttctctggag

SEQ ID NO: 3539249 - DNA, 19 bp, Homo sapiens
ggttttgccctccctctct

SEQ ID NO: 3539250 - DNA, 13 bp, Homo sapiens
gtaaacagttctg

SEQ ID NO: 3539251 - DNA, 21 bp, Homo sapiens
gtacataccggggctcctctc

SEQ ID NO: 3539252 - DNA, 18 bp, Homo sapiens
gtactagcattttccacg

SEQ ID NO: 3539253 - DNA, 23 bp, Homo sapiens
gtagcacggagtgttggggctgg

SEQ ID NO: 3539254 - DNA, 14 bp, Homo sapiens
gtatttaactctgt

SEQ ID NO: 3539255 - DNA, 18 bp, Homo sapiens
gtcagcctggctgggctc

SEQ ID NO: 3539256 - DNA, 21 bp, Homo sapiens
gtcagcctggctgggctctgg

SEQ ID NO: 3539257 - DNA, 23 bp, Homo sapiens
gtcagcggggcagcggggctggc

SEQ ID NO: 3539258 - DNA, 20 bp, Homo sapiens
gtcatgaattcatactctgt

SEQ ID NO: 3539259 - DNA, 22 bp, Homo sapiens
gtcatgaattcatactctgttg

SEQ ID NO: 3539260 - DNA, 19 bp, Homo sapiens
gtctctggaagaagagcag

SEQ ID NO: 3539261 - DNA, 21 bp, Homo sapiens
gtgagagaataatttctgttg

SEQ ID NO: 3539262 - DNA, 23 bp, Homo sapiens
gtgatcctttggggcttctgtga

SEQ ID NO: 3539263 - DNA, 11 bp, Homo sapiens
gtggggctggt

SEQ ID NO: 3539264 - DNA, 14 bp, Homo sapiens
gtggggctggtggg

SEQ ID NO: 3539265 - DNA, 15 bp, Homo sapiens
gtggggctggtgggt

SEQ ID NO: 3539266 - DNA, 23 bp, Homo sapiens
gtggtcatgaattcatactctgt

SEQ ID NO: 3539267 - DNA, 14 bp, Homo sapiens
gtgttggggctggg

SEQ ID NO: 3539268 - DNA, 16 bp, Homo sapiens
gtgttggggctggggg

SEQ ID NO: 3539269 - DNA, 13 bp, Homo sapiens
gtgtttttctctc

SEQ ID NO: 3539270 - DNA, 13 bp, Homo sapiens
gttcattcttgtt

SEQ ID NO: 3539271 - DNA, 12 bp, Homo sapiens
gttctcttgtat

SEQ ID NO: 3539272 - DNA, 15 bp, Homo sapiens
gttctgcactcttgt

SEQ ID NO: 3539273 - DNA, 15 bp, Homo sapiens
gttgagaaacagttc

SEQ ID NO: 3539274 - DNA, 15 bp, Homo sapiens
gttggcttctttgct

SEQ ID NO: 3539275 - DNA, 14 bp, Homo sapiens
gtttcccctttctt

SEQ ID NO: 3539276 - DNA, 14 bp, Homo sapiens
gtttcctgttctct

SEQ ID NO: 3539277 - DNA, 17 bp, Homo sapiens
gtttcctgttctcttgt

SEQ ID NO: 3539278 - DNA, 18 bp, Homo sapiens
gtttcctgttctcttgta

SEQ ID NO: 3539279 - DNA, 19 bp, Homo sapiens
gtttcctgttctcttgtat

SEQ ID NO: 3539280 - DNA, 11 bp, Homo sapiens
gtttcttctct

SEQ ID NO: 3539281 - DNA, 17 bp, Homo sapiens
gtttcttctctggagaa

SEQ ID NO: 3539282 - DNA, 23 bp, Homo sapiens
gtttgtaacttgggctgtaaagc

SEQ ID NO: 3539283 - DNA, 14 bp, Homo sapiens
gttttcgatgatga

SEQ ID NO: 3539284 - DNA, 14 bp, Homo sapiens
gtttttctctctgg

SEQ ID NO: 3539285 - DNA, 17 bp, Homo sapiens
taaccaaggctccaata

SEQ ID NO: 3539286 - DNA, 23 bp, Homo sapiens
taacttgggctgtaaagcaaact

SEQ ID NO: 3539287 - DNA, 20 bp, Homo sapiens
taagcaacaaaactatggaa

SEQ ID NO: 3539288 - DNA, 19 bp, Homo sapiens
tacaatatggacatgtaaa

SEQ ID NO: 3539289 - DNA, 18 bp, Homo sapiens
tacacatccatatacata

SEQ ID NO: 3539290 - DNA, 22 bp, Homo sapiens
tacgcagacaagaacagccgcc

SEQ ID NO: 3539291 - DNA, 13 bp, Homo sapiens
tactctgttgcct

SEQ ID NO: 3539292 - DNA, 14 bp, Homo sapiens
tactctgttgcctc

SEQ ID NO: 3539293 - DNA, 16 bp, Homo sapiens
tactctgttgcctcct

SEQ ID NO: 3539294 - DNA, 19 bp, Homo sapiens
tactctgttgcctcctctc

SEQ ID NO: 3539295 - DNA, 21 bp, Homo sapiens
tactctgttgcctcctctctc

SEQ ID NO: 3539296 - DNA, 19 bp, Homo sapiens
tacttaaacatttttgttt

SEQ ID NO: 3539297 - DNA, 10 bp, Homo sapiens
tacttctggc

SEQ ID NO: 3539298 - DNA, 15 bp, Homo sapiens
taggagctcagttga

SEQ ID NO: 3539299 - DNA, 12 bp, Homo sapiens
tatagctgaaat

SEQ ID NO: 3539300 - DNA, 16 bp, Homo sapiens
tatggaaataataccc

SEQ ID NO: 3539301 - DNA, 14 bp, Homo sapiens
tatggacatgtaaa

SEQ ID NO: 3539302 - DNA, 16 bp, Homo sapiens
tatggacatgtaaaaa

SEQ ID NO: 3539303 - DNA, 23 bp, Homo sapiens
tatttctgggttctcaattctgt

SEQ ID NO: 3539304 - DNA, 19 bp, Homo sapiens
tcaactgtatgtacatacc

SEQ ID NO: 3539305 - DNA, 13 bp, Homo sapiens
tcaagctttcctg

SEQ ID NO: 3539306 - DNA, 18 bp, Homo sapiens
tcaagctttcctgctgtc

SEQ ID NO: 3539307 - DNA, 19 bp, Homo sapiens
tcacaactccttccatcct

SEQ ID NO: 3539308 - DNA, 19 bp, Homo sapiens
tcacatctcccttccacct

SEQ ID NO: 3539309 - DNA, 21 bp, Homo sapiens
tcacctttatatatgtactag

SEQ ID NO: 3539310 - DNA, 13 bp, Homo sapiens
tcagcctggctgg

SEQ ID NO: 3539311 - DNA, 15 bp, Homo sapiens
tcagcctggctgggc

SEQ ID NO: 3539312 - DNA, 22 bp, Homo sapiens
tcagcctggctgggctctggtg

SEQ ID NO: 3539313 - DNA, 14 bp, Homo sapiens
tcagcggggcagcg

SEQ ID NO: 3539314 - DNA, 16 bp, Homo sapiens
tcagttgagaaacagt

SEQ ID NO: 3539315 - DNA, 18 bp, Homo sapiens
tcatactctgttgcctcc

SEQ ID NO: 3539316 - DNA, 21 bp, Homo sapiens
tcatactctgttgcctcctct

SEQ ID NO: 3539317 - DNA, 17 bp, Homo sapiens
aaaaacctgatgcagtg

SEQ ID NO: 3539318 - DNA, 13 bp, Homo sapiens
aaaaagacaaaaa

SEQ ID NO: 3539319 - DNA, 21 bp, Homo sapiens
aaaacttgggcaccagcttct

SEQ ID NO: 3539320 - DNA, 22 bp, Homo sapiens
aaaatgtattattgtaaagttt

SEQ ID NO: 3539321 - DNA, 15 bp, Homo sapiens
aaacctgatgcagtg

SEQ ID NO: 3539322 - DNA, 17 bp, Homo sapiens
aaacctgatgcagtgct

SEQ ID NO: 3539323 - DNA, 13 bp, Homo sapiens
aaactatggaaat

SEQ ID NO: 3539324 - DNA, 14 bp, Homo sapiens
aaactcagaaggct

SEQ ID NO: 3539325 - DNA, 15 bp, Homo sapiens
aaactctggtgccgg

SEQ ID NO: 3539326 - DNA, 12 bp, Homo sapiens
aaactggggctg

SEQ ID NO: 3539327 - DNA, 10 bp, Homo sapiens
aaatggaaac

SEQ ID NO: 3539328 - DNA, 21 bp, Homo sapiens
aaatttttgttggcttgcttg

SEQ ID NO: 3539329 - DNA, 13 bp, Homo sapiens
aacagctggtact

SEQ ID NO: 3539330 - DNA, 24 bp, Homo sapiens
aacatatatgtatatacacatcca

SEQ ID NO: 3539331 - DNA, 15 bp, Homo sapiens
aacatcttcatataa

SEQ ID NO: 3539332 - DNA, 16 bp, Homo sapiens
aacatcttcatataaa

SEQ ID NO: 3539333 - DNA, 20 bp, Homo sapiens
aaccaaggctccaataaacg

SEQ ID NO: 3539334 - DNA, 22 bp, Homo sapiens
aaccaagttatctgtttcctgt

SEQ ID NO: 3539335 - DNA, 13 bp, Homo sapiens
aacctgtctcctc

SEQ ID NO: 3539336 - DNA, 17 bp, Homo sapiens
aactcagaaggctttgg

SEQ ID NO: 3539337 - DNA, 18 bp, Homo sapiens
aactccttccatccttga

SEQ ID NO: 3539338 - DNA, 17 bp, Homo sapiens
aagaaagcttcttgtga

SEQ ID NO: 3539339 - DNA, 18 bp, Homo sapiens
aagatccaattcatcttt

SEQ ID NO: 3539340 - DNA, 23 bp, Homo sapiens
aagcaggcaggcagcctgagagc

SEQ ID NO: 3539341 - DNA, 18 bp, Homo sapiens
aagcgaacatcttcatat

SEQ ID NO: 3539342 - DNA, 14 bp, Homo sapiens
aagctttcctgctg

SEQ ID NO: 3539343 - DNA, 22 bp, Homo sapiens
aagctttcctgctgtcttctcc

SEQ ID NO: 3539344 - DNA, 15 bp, Homo sapiens
aaggagttaatattt

SEQ ID NO: 3539345 - DNA, 14 bp, Homo sapiens
aagggactctgggc

SEQ ID NO: 3539346 - DNA, 19 bp, Homo sapiens
aagggactctgggctgtgc

SEQ ID NO: 3539347 - DNA, 23 bp, Homo sapiens
aaggtgagaggtgtaggttgaaa

SEQ ID NO: 3539348 - DNA, 21 bp, Homo sapiens
aataataccccaacagatgag

SEQ ID NO: 3539349 - DNA, 20 bp, Homo sapiens
aatatggacatgtaaaaaga

SEQ ID NO: 3539350 - DNA, 14 bp, Homo sapiens
aatgactccaggaa

SEQ ID NO: 3539351 - DNA, 19 bp, Homo sapiens
aatgcccttcactttctcc

SEQ ID NO: 3539352 - DNA, 15 bp, Homo sapiens
aatggaaacacacac

SEQ ID NO: 3539353 - DNA, 16 bp, Homo sapiens
aatgtaaatggtactt

SEQ ID NO: 3539354 - DNA, 16 bp, Homo sapiens
aattagcatattaata

SEQ ID NO: 3539355 - DNA, 15 bp, Homo sapiens
aattcatactctgtt

SEQ ID NO: 3539356 - DNA, 19 bp, Homo sapiens
aattcatactctgttgcct

SEQ ID NO: 3539357 - DNA, 18 bp, Homo sapiens
aattgcccctgcaccttt

SEQ ID NO: 3539358 - DNA, 17 bp, Homo sapiens
aatttctgttgttttaa

SEQ ID NO: 3539359 - DNA, 15 bp, Homo sapiens
acaagcaggcaggca

SEQ ID NO: 3539360 - DNA, 15 bp, Homo sapiens
acacacaccttgcaa

SEQ ID NO: 3539361 - DNA, 15 bp, Homo sapiens
acacatgtggagaag

SEQ ID NO: 3539362 - DNA, 14 bp, Homo sapiens
acagacacacacac

SEQ ID NO: 3539363 - DNA, 20 bp, Homo sapiens
acagttctgcactcttgtac

SEQ ID NO: 3539364 - DNA, 17 bp, Homo sapiens
acagtttgtaacttggg

SEQ ID NO: 3539365 - DNA, 19 bp, Homo sapiens
acataccggggctcctctc

SEQ ID NO: 3539366 - DNA, 20 bp, Homo sapiens
acataccggggctcctctcc

SEQ ID NO: 3539367 - DNA, 18 bp, Homo sapiens
acatctcccttccacctc

SEQ ID NO: 3539368 - DNA, 14 bp, Homo sapiens
acatcttcatataa

SEQ ID NO: 3539369 - DNA, 21 bp, Homo sapiens
accaagttatctgtttcctgt

SEQ ID NO: 3539370 - DNA, 13 bp, Homo sapiens
accagcttctttc

SEQ ID NO: 3539371 - DNA, 13 bp, Homo sapiens
accgtgctgggct

SEQ ID NO: 3539372 - DNA, 18 bp, Homo sapiens
acgaaatggaaacacaca

SEQ ID NO: 3539373 - DNA, 16 bp, Homo sapiens
actctgggctgtgcct

SEQ ID NO: 3539374 - DNA, 17 bp, Homo sapiens
actctgggctgtgcctg

SEQ ID NO: 3539375 - DNA, 15 bp, Homo sapiens
actcttgtacaaaag

SEQ ID NO: 3539376 - DNA, 16 bp, Homo sapiens
actcttgtacaaaaga

SEQ ID NO: 3539377 - DNA, 15 bp, Homo sapiens
actgaagcgaacatc

SEQ ID NO: 3539378 - DNA, 16 bp, Homo sapiens
actgaagcgaacatct

SEQ ID NO: 3539379 - DNA, 22 bp, Homo sapiens
aaaaagttgtaatttgaataag

SEQ ID NO: 3539380 - DNA, 14 bp, Homo sapiens
aaaactatggaaat

SEQ ID NO: 3539381 - DNA, 13 bp, Homo sapiens
aaaaggacattgg

SEQ ID NO: 3539382 - DNA, 21 bp, Homo sapiens
aaactgccaaactattttctg

SEQ ID NO: 3539383 - DNA, 23 bp, Homo sapiens
aaacttgggcaccagcttctttc

SEQ ID NO: 3539384 - DNA, 16 bp, Homo sapiens
aaagctacgcagacaa

SEQ ID NO: 3539385 - DNA, 17 bp, Homo sapiens
aaagctacgcagacaag

SEQ ID NO: 3539386 - DNA, 14 bp, Homo sapiens
aaagggacagtttg

SEQ ID NO: 3539387 - DNA, 19 bp, Homo sapiens
aaagtttgtggtaatttgt

SEQ ID NO: 3539388 - DNA, 17 bp, Homo sapiens
aacaaaactatggaaat

SEQ ID NO: 3539389 - DNA, 20 bp, Homo sapiens
aacaaaactatggaaataat

SEQ ID NO: 3539390 - DNA, 12 bp, Homo sapiens
aacacacacaga

SEQ ID NO: 3539391 - DNA, 21 bp, Homo sapiens
aacagatgagcgaaaatgtat

SEQ ID NO: 3539392 - DNA, 14 bp, Homo sapiens
aacagttctgcact

SEQ ID NO: 3539393 - DNA, 13 bp, Homo sapiens
aacatcttcatat

SEQ ID NO: 3539394 - DNA, 14 bp, Homo sapiens
aacatcttcatata

SEQ ID NO: 3539395 - DNA, 12 bp, Homo sapiens
aactatggaaat

SEQ ID NO: 3539396 - DNA, 19 bp, Homo sapiens
aactctggtgccggggagg

SEQ ID NO: 3539397 - DNA, 19 bp, Homo sapiens
aactggggctgtgttttcg

SEQ ID NO: 3539398 - DNA, 14 bp, Homo sapiens
aagaaagcttcttg

SEQ ID NO: 3539399 - DNA, 19 bp, Homo sapiens
aagcaacaaaactatggaa

SEQ ID NO: 3539400 - DNA, 14 bp, Homo sapiens
aagcgaacatcttc

SEQ ID NO: 3539401 - DNA, 21 bp, Homo sapiens
aagcgaacatcttcatataaa

SEQ ID NO: 3539402 - DNA, 19 bp, Homo sapiens
aagctttcctgctgtcttc

SEQ ID NO: 3539403 - DNA, 13 bp, Homo sapiens
aagggactctggg

SEQ ID NO: 3539404 - DNA, 20 bp, Homo sapiens
aataaccttattctatactt

SEQ ID NO: 3539405 - DNA, 22 bp, Homo sapiens
aataataccccaacagatgagc

SEQ ID NO: 3539406 - DNA, 20 bp, Homo sapiens
aatcagtgggttaattttgg

SEQ ID NO: 3539407 - DNA, 14 bp, Homo sapiens
aatcagtgtgttac

SEQ ID NO: 3539408 - DNA, 21 bp, Homo sapiens
aatgactccaggaagaaggtg

SEQ ID NO: 3539409 - DNA, 15 bp, Homo sapiens
aatgggattgtgtta

SEQ ID NO: 3539410 - DNA, 13 bp, Homo sapiens
aattcatactctg

SEQ ID NO: 3539411 - DNA, 22 bp, Homo sapiens
aattcatactctgttgcctcct

SEQ ID NO: 3539412 - DNA, 16 bp, Homo sapiens
aattccagtttaggag

SEQ ID NO: 3539413 - DNA, 16 bp, Homo sapiens
acaaaactatggaaat

SEQ ID NO: 3539414 - DNA, 18 bp, Homo sapiens
acaaagtttgtggtaatt

SEQ ID NO: 3539415 - DNA, 15 bp, Homo sapiens
acaactccttccatc

SEQ ID NO: 3539416 - DNA, 16 bp, Homo sapiens
acaataaccttattct

SEQ ID NO: 3539417 - DNA, 18 bp, Homo sapiens
acacaatacatgttttca

SEQ ID NO: 3539418 - DNA, 11 bp, Homo sapiens
acacacacaca

SEQ ID NO: 3539419 - DNA, 14 bp, Homo sapiens
acacacacacacct

SEQ ID NO: 3539420 - DNA, 17 bp, Homo sapiens
acacacaccttgcaaaa

SEQ ID NO: 3539421 - DNA, 17 bp, Homo sapiens
acacatccatatacata

SEQ ID NO: 3539422 - DNA, 19 bp, Homo sapiens
acagttccattcaactgga

SEQ ID NO: 3539423 - DNA, 15 bp, Homo sapiens
acatatatgtatata

SEQ ID NO: 3539424 - DNA, 15 bp, Homo sapiens
acatccatatacata

SEQ ID NO: 3539425 - DNA, 14 bp, Homo sapiens
ctttgttggcttct

SEQ ID NO: 3539426 - DNA, 18 bp, Homo sapiens
cttttttgccacaaagaa

SEQ ID NO: 3539427 - DNA, 21 bp, Homo sapiens
gaaaatgtattattgtaaagt

SEQ ID NO: 3539428 - DNA, 16 bp, Homo sapiens
gaaagcttcttgtgat

SEQ ID NO: 3539429 - DNA, 24 bp, Homo sapiens
gaaataataccccaacagatgagc

SEQ ID NO: 3539430 - DNA, 14 bp, Homo sapiens
gaaattccagttta

SEQ ID NO: 3539431 - DNA, 23 bp, Homo sapiens
gaacacaatacatgttttcactt

SEQ ID NO: 3539432 - DNA, 20 bp, Homo sapiens
gaagattcttaccaagagtg

SEQ ID NO: 3539433 - DNA, 13 bp, Homo sapiens
gaagggactctgg

SEQ ID NO: 3539434 - DNA, 17 bp, Homo sapiens
gaatgactccaggaaga

SEQ ID NO: 3539435 - DNA, 15 bp, Homo sapiens
gaattcatactctgt

SEQ ID NO: 3539436 - DNA, 22 bp, Homo sapiens
gaattcatactctgttgcctcc

SEQ ID NO: 3539437 - DNA, 16 bp, Homo sapiens
gacaagaacagccgcc

SEQ ID NO: 3539438 - DNA, 16 bp, Homo sapiens
gacacatgtggagaag

SEQ ID NO: 3539439 - DNA, 15 bp, Homo sapiens
gacccgctgggggct

SEQ ID NO: 3539440 - DNA, 15 bp, Homo sapiens
gactccaggaagaag

SEQ ID NO: 3539441 - DNA, 17 bp, Homo sapiens
gactctgggctgtgcct

SEQ ID NO: 3539442 - DNA, 21 bp, Homo sapiens
gactgaagcgaacatcttcat

SEQ ID NO: 3539443 - DNA, 18 bp, Homo sapiens
gagatggttttgccctcc

SEQ ID NO: 3539444 - DNA, 17 bp, Homo sapiens
gagctcagcctgcctgg

SEQ ID NO: 3539445 - DNA, 21 bp, Homo sapiens
gagctcagttgagaaacagtt

SEQ ID NO: 3539446 - DNA, 15 bp, Homo sapiens
gaggctggctggggg

SEQ ID NO: 3539447 - DNA, 17 bp, Homo sapiens
gaggctggctgggggca

SEQ ID NO: 3539448 - DNA, 21 bp, Homo sapiens
gagtgggctttgtggaaacag

SEQ ID NO: 3539449 - DNA, 15 bp, Homo sapiens
gagtgttggggctgg

SEQ ID NO: 3539450 - DNA, 12 bp, Homo sapiens
gatgccaagctt

SEQ ID NO: 3539451 - DNA, 13 bp, Homo sapiens
gcaccgtgctggg

SEQ ID NO: 3539452 - DNA, 19 bp, Homo sapiens
gcactcttgtacaaaagaa

SEQ ID NO: 3539453 - DNA, 19 bp, Homo sapiens
gcagcggaagggactctgg

SEQ ID NO: 3539454 - DNA, 15 bp, Homo sapiens
gcagcggggctggcc

SEQ ID NO: 3539455 - DNA, 22 bp, Homo sapiens
gcaggggaaactctggtgccgg

SEQ ID NO: 3539456 - DNA, 19 bp, Homo sapiens
gcatccaagcttaaccaag

SEQ ID NO: 3539457 - DNA, 21 bp, Homo sapiens
gcatccaagcttaaccaaggc

SEQ ID NO: 3539458 - DNA, 17 bp, Homo sapiens
gcattaaaacttgggca

SEQ ID NO: 3539459 - DNA, 15 bp, Homo sapiens
gcccactctggggac

SEQ ID NO: 3539460 - DNA, 17 bp, Homo sapiens
gccccgcagtgccctgc

SEQ ID NO: 3539461 - DNA, 14 bp, Homo sapiens
gccctccctctctg

SEQ ID NO: 3539462 - DNA, 18 bp, Homo sapiens
gccctcgggtggggctgg

SEQ ID NO: 3539463 - DNA, 22 bp, Homo sapiens
gccctcgggtggggctggtggg

SEQ ID NO: 3539464 - DNA, 16 bp, Homo sapiens
gcccttcactttctcc

SEQ ID NO: 3539465 - DNA, 16 bp, Homo sapiens
gcctccctttggggag

SEQ ID NO: 3539466 - DNA, 14 bp, Homo sapiens
gcctcctctctccc

SEQ ID NO: 3539467 - DNA, 17 bp, Homo sapiens
gcctgaggctggctggg

SEQ ID NO: 3539468 - DNA, 16 bp, Homo sapiens
gccttcttgccagcca

SEQ ID NO: 3539469 - DNA, 16 bp, Homo sapiens
gctccaggagggcttg

SEQ ID NO: 3539470 - DNA, 22 bp, Homo sapiens
gctggcccaggggtcccctggc

SEQ ID NO: 3539471 - DNA, 12 bp, Homo sapiens
gctggctggggg

SEQ ID NO: 3539472 - DNA, 17 bp, Homo sapiens
gctgggctctggtgggg

SEQ ID NO: 3539473 - DNA, 17 bp, Homo sapiens
gctgggggctggcagag

SEQ ID NO: 3539474 - DNA, 17 bp, Homo sapiens
gctgtaaagcaaactgg

SEQ ID NO: 3539475 - DNA, 14 bp, Homo sapiens
gctgtattttaaag

SEQ ID NO: 3539476 - DNA, 17 bp, Homo sapiens
gctgtgcctgaggctgg

SEQ ID NO: 3539477 - DNA, 17 bp, Homo sapiens
gcttctttctcggtggc

SEQ ID NO: 3539478 - DNA, 17 bp, Homo sapiens
gcttctttgctttctcg

SEQ ID NO: 3539479 - DNA, 23 bp, Homo sapiens
gcttgagagctcagcctgcctgg

SEQ ID NO: 3539480 - DNA, 14 bp, Homo sapiens
gctttcctgctgtc

SEQ ID NO: 3539481 - DNA, 19 bp, Homo sapiens
gctttcctgctgtcttctc

SEQ ID NO: 3539482 - DNA, 21 bp, Homo sapiens
gctttcctgctgtcttctccc

SEQ ID NO: 3539483 - DNA, 14 bp, Homo sapiens
ggaaactctggtgc

SEQ ID NO: 3539484 - DNA, 15 bp, Homo sapiens
ggaagggactctggg

SEQ ID NO: 3539485 - DNA, 21 bp, Homo sapiens
ggaagggactctgggctgtgc

SEQ ID NO: 3539486 - DNA, 13 bp, Homo sapiens
ggacagtttgtaa

SEQ ID NO: 3539487 - DNA, 21 bp, Homo sapiens
ggacagtttgtaacttgggct

SEQ ID NO: 3539488 - DNA, 17 bp, Homo sapiens
ggacttccagcttccag

SEQ ID NO: 3539489 - DNA, 18 bp, Homo sapiens
ggagagaccacagccggg

SEQ ID NO: 3539490 - DNA, 16 bp, Homo sapiens
ggagggcttgagagct

SEQ ID NO: 3539491 - DNA, 14 bp, Homo sapiens
ggagggggttcgca

SEQ ID NO: 3539492 - DNA, 15 bp, Homo sapiens
ggagtgttggggctg

SEQ ID NO: 3539493 - DNA, 13 bp, Homo sapiens
ggcagcctgagag

SEQ ID NO: 3539494 - DNA, 20 bp, Homo sapiens
ggcagcctgagagctggccc

SEQ ID NO: 3539495 - DNA, 15 bp, Homo sapiens
ggcagcggggctggc

SEQ ID NO: 3539496 - DNA, 18 bp, Homo sapiens
ggcagcggggctggccat

SEQ ID NO: 3539497 - DNA, 22 bp, Homo sapiens
ggcaggcctccctttggggaga

SEQ ID NO: 3539498 - DNA, 19 bp, Homo sapiens
ggcattaaaacttgggcac

SEQ ID NO: 3539499 - DNA, 13 bp, Homo sapiens
ggcccaggggtcc

SEQ ID NO: 3539500 - DNA, 17 bp, Homo sapiens
ggccccgcagtgccctg

SEQ ID NO: 3539501 - DNA, 16 bp, Homo sapiens
ggctctggtgggggct

SEQ ID NO: 3539502 - DNA, 13 bp, Homo sapiens
ggctggctggggg

SEQ ID NO: 3539503 - DNA, 14 bp, Homo sapiens
ggctggctgggggc

SEQ ID NO: 3539504 - DNA, 18 bp, Homo sapiens
ggctgggctctggtgggg

SEQ ID NO: 3539505 - DNA, 14 bp, Homo sapiens
ggctgggggcagga

SEQ ID NO: 3539506 - DNA, 18 bp, Homo sapiens
ggctgggggccagctcca

SEQ ID NO: 3539507 - DNA, 13 bp, Homo sapiens
ggctggtgggtct

SEQ ID NO: 3539508 - DNA, 17 bp, Homo sapiens
ggctggtggtcatgaat

SEQ ID NO: 3539509 - DNA, 18 bp, Homo sapiens
ggctgtgcctgaggctgg

SEQ ID NO: 3539510 - DNA, 18 bp, Homo sapiens
ggctgtgttttcgatgat

SEQ ID NO: 3539511 - DNA, 13 bp, Homo sapiens
ggcttctttgctt

SEQ ID NO: 3539512 - DNA, 19 bp, Homo sapiens
ggctttgtggaaacagctg

SEQ ID NO: 3539513 - DNA, 15 bp, Homo sapiens
gggacccgctggggg

SEQ ID NO: 3539514 - DNA, 24 bp, Homo sapiens
gggacccgctgggggctggcagag

SEQ ID NO: 3539515 - DNA, 11 bp, Homo sapiens
gggactctggg

SEQ ID NO: 3539516 - DNA, 22 bp, Homo sapiens
gggactctgggctgtgcctgag

SEQ ID NO: 3539517 - DNA, 18 bp, Homo sapiens
gggcacgaggctctagaa

SEQ ID NO: 3539518 - DNA, 14 bp, Homo sapiens
gggcagcggggctg

SEQ ID NO: 3539519 - DNA, 22 bp, Homo sapiens
gggccagctccaggagggcttg

SEQ ID NO: 3539520 - DNA, 12 bp, Homo sapiens
gggctggtgggt

SEQ ID NO: 3539521 - DNA, 19 bp, Homo sapiens
gggctgtgcctgaggctgg

SEQ ID NO: 3539522 - DNA, 23 bp, Homo sapiens
gggctgtgcctgaggctggctgg

SEQ ID NO: 3539523 - DNA, 14 bp, Homo sapiens
ggggacccgctggg

SEQ ID NO: 3539524 - DNA, 21 bp, Homo sapiens
ggggacccgctgggggctggc

SEQ ID NO: 3539525 - DNA, 22 bp, Homo sapiens
cttgggcaccagcttctttctc

SEQ ID NO: 3539526 - DNA, 15 bp, Homo sapiens
cttgggctgtaaagc

SEQ ID NO: 3539527 - DNA, 17 bp, Homo sapiens
ctttcccctttctcttt

SEQ ID NO: 3539528 - DNA, 14 bp, Homo sapiens
ctttctcctggtgt

SEQ ID NO: 3539529 - DNA, 18 bp, Homo sapiens
ctttctctttcctcattt

SEQ ID NO: 3539530 - DNA, 14 bp, Homo sapiens
ctttgctttctcgt

SEQ ID NO: 3539531 - DNA, 13 bp, Homo sapiens
ctttggcaggcct

SEQ ID NO: 3539532 - DNA, 17 bp, Homo sapiens
ctttggggcttctgtga

SEQ ID NO: 3539533 - DNA, 15 bp, Homo sapiens
ctttgtggaaacagc

SEQ ID NO: 3539534 - DNA, 17 bp, Homo sapiens
ctttgttggcttctttg

SEQ ID NO: 3539535 - DNA, 10 bp, Homo sapiens
cttttaagaa

SEQ ID NO: 3539536 - DNA, 11 bp, Homo sapiens
ctttttttaag

SEQ ID NO: 3539537 - DNA, 11 bp, Homo sapiens
gaaactctggt

SEQ ID NO: 3539538 - DNA, 12 bp, Homo sapiens
gaaactctggtg

SEQ ID NO: 3539539 - DNA, 20 bp, Homo sapiens
gaaatgcccttcactttctc

SEQ ID NO: 3539540 - DNA, 11 bp, Homo sapiens
gaaatggaaac

SEQ ID NO: 3539541 - DNA, 12 bp, Homo sapiens
gaacatcttcat

SEQ ID NO: 3539542 - DNA, 13 bp, Homo sapiens
gaacatcttcata

SEQ ID NO: 3539543 - DNA, 18 bp, Homo sapiens
gaacatcttcatataaac

SEQ ID NO: 3539544 - DNA, 21 bp, Homo sapiens
gaacattttttttttttcctt

SEQ ID NO: 3539545 - DNA, 18 bp, Homo sapiens
gaacctgtctcctcccag

SEQ ID NO: 3539546 - DNA, 17 bp, Homo sapiens
gaacttccccacggatg

SEQ ID NO: 3539547 - DNA, 14 bp, Homo sapiens
gaagcgaacatctt

SEQ ID NO: 3539548 - DNA, 20 bp, Homo sapiens
gaagggactctgggctgtgc

SEQ ID NO: 3539549 - DNA, 12 bp, Homo sapiens
gaagtctgtgtc

SEQ ID NO: 3539550 - DNA, 12 bp, Homo sapiens
gacaaaaaccaa

SEQ ID NO: 3539551 - DNA, 23 bp, Homo sapiens
gacacctagagtttggacttcca

SEQ ID NO: 3539552 - DNA, 16 bp, Homo sapiens
gacatgtaaaaagaca

SEQ ID NO: 3539553 - DNA, 20 bp, Homo sapiens
gacgaaatggaaacacacac

SEQ ID NO: 3539554 - DNA, 13 bp, Homo sapiens
gactccaggaaga

SEQ ID NO: 3539555 - DNA, 19 bp, Homo sapiens
gactctgggctgtgcctga

SEQ ID NO: 3539556 - DNA, 19 bp, Homo sapiens
gactgaagcgaacatcttc

SEQ ID NO: 3539557 - DNA, 18 bp, Homo sapiens
gagaaacggtcctttgtt

SEQ ID NO: 3539558 - DNA, 12 bp, Homo sapiens
gagagctggccc

SEQ ID NO: 3539559 - DNA, 22 bp, Homo sapiens
gagctcagttgagaaacagttc

SEQ ID NO: 3539560 - DNA, 19 bp, Homo sapiens
gaggctggctgggggcagg

SEQ ID NO: 3539561 - DNA, 22 bp, Homo sapiens
gagtgggctttgtggaaacagc

SEQ ID NO: 3539562 - DNA, 14 bp, Homo sapiens
gagtgttggggctg

SEQ ID NO: 3539563 - DNA, 20 bp, Homo sapiens
gatatgctgtattttaaagg

SEQ ID NO: 3539564 - DNA, 22 bp, Homo sapiens
gatgatgattttaacagtttta

SEQ ID NO: 3539565 - DNA, 22 bp, Homo sapiens
gcaaaaaaaaaattgtttttcc

SEQ ID NO: 3539566 - DNA, 19 bp, Homo sapiens
gcaacaaaactatggaaat

SEQ ID NO: 3539567 - DNA, 12 bp, Homo sapiens
gcaccagcttct

SEQ ID NO: 3539568 - DNA, 12 bp, Homo sapiens
gcaccgtgctgg

SEQ ID NO: 3539569 - DNA, 15 bp, Homo sapiens
gcaccgtgctgggct

SEQ ID NO: 3539570 - DNA, 20 bp, Homo sapiens
gcacggagtgttggggctgg

SEQ ID NO: 3539571 - DNA, 22 bp, Homo sapiens
gcactcttgtacaaaagaaaaa

SEQ ID NO: 3539572 - DNA, 17 bp, Homo sapiens
gcagcctgagagctggc

SEQ ID NO: 3539573 - DNA, 20 bp, Homo sapiens
gcagcggaagggactctggg

SEQ ID NO: 3539574 - DNA, 22 bp, Homo sapiens
gcagcggaagggactctgggct

SEQ ID NO: 3539575 - DNA, 13 bp, Homo sapiens
gcagcggggctgg

SEQ ID NO: 3539576 - DNA, 16 bp, Homo sapiens
gcagcggggctggcca

SEQ ID NO: 3539577 - DNA, 17 bp, Homo sapiens
gcagcggggctggccat

SEQ ID NO: 3539578 - DNA, 16 bp, Homo sapiens
gcaggcagcctgagag

SEQ ID NO: 3539579 - DNA, 22 bp, Homo sapiens
gcaggcagcctgagagctggcc

SEQ ID NO: 3539580 - DNA, 22 bp, Homo sapiens
gcagtgccctgccccagtcagc

SEQ ID NO: 3539581 - DNA, 17 bp, Homo sapiens
gcatcggtcagcggggc

SEQ ID NO: 3539582 - DNA, 18 bp, Homo sapiens
gcattaaaacttgggcac

SEQ ID NO: 3539583 - DNA, 18 bp, Homo sapiens
gccaaggaagtctgtgtc

SEQ ID NO: 3539584 - DNA, 20 bp, Homo sapiens
gccatgagggtccaccttca

SEQ ID NO: 3539585 - DNA, 12 bp, Homo sapiens
gcccactctggg

SEQ ID NO: 3539586 - DNA, 15 bp, Homo sapiens
gccctccctctctgc

SEQ ID NO: 3539587 - DNA, 19 bp, Homo sapiens
gccctcgggtggggctggt

SEQ ID NO: 3539588 - DNA, 13 bp, Homo sapiens
gcctccctttggg

SEQ ID NO: 3539589 - DNA, 17 bp, Homo sapiens
gcctcctctctccctgc

SEQ ID NO: 3539590 - DNA, 21 bp, Homo sapiens
gcctcctctctccctgcctca

SEQ ID NO: 3539591 - DNA, 18 bp, Homo sapiens
gcctgacgaaatggaaac

SEQ ID NO: 3539592 - DNA, 19 bp, Homo sapiens
gcctgaggctggctggggg

SEQ ID NO: 3539593 - DNA, 14 bp, Homo sapiens
gcctgcctgggaga

SEQ ID NO: 3539594 - DNA, 21 bp, Homo sapiens
gcctggctgggctctggtggg

SEQ ID NO: 3539595 - DNA, 14 bp, Homo sapiens
gcgaacatcttcat

SEQ ID NO: 3539596 - DNA, 11 bp, Homo sapiens
gcggggctggc

SEQ ID NO: 3539597 - DNA, 19 bp, Homo sapiens
gctcagttgagaaacagtt

SEQ ID NO: 3539598 - DNA, 15 bp, Homo sapiens
gctccatccaaactc

SEQ ID NO: 3539599 - DNA, 23 bp, Homo sapiens
gctccatccaaactcagaaggct

SEQ ID NO: 3539600 - DNA, 17 bp, Homo sapiens
gctgaaattccagttta

SEQ ID NO: 3539601 - DNA, 21 bp, Homo sapiens
gctgaaattccagtttaggag

SEQ ID NO: 3539602 - DNA, 21 bp, Homo sapiens
gctgcttccccaggctgccca

SEQ ID NO: 3539603 - DNA, 22 bp, Homo sapiens
gctgcttccccaggctgcccac

SEQ ID NO: 3539604 - DNA, 13 bp, Homo sapiens
gctggctgggggc

SEQ ID NO: 3539605 - DNA, 14 bp, Homo sapiens
gctgggctctggtg

SEQ ID NO: 3539606 - DNA, 16 bp, Homo sapiens
gctgggctctggtggg

SEQ ID NO: 3539607 - DNA, 20 bp, Homo sapiens
gctgggggcaggacaacaca

SEQ ID NO: 3539608 - DNA, 13 bp, Homo sapiens
gctggtgggtctg

SEQ ID NO: 3539609 - DNA, 13 bp, Homo sapiens
gctgtaaagcaaa

SEQ ID NO: 3539610 - DNA, 16 bp, Homo sapiens
gctgtgcctgaggctg

SEQ ID NO: 3539611 - DNA, 22 bp, Homo sapiens
gctgtgcctgaggctggctggg

SEQ ID NO: 3539612 - DNA, 19 bp, Homo sapiens
gcttcaaggatggagatgg

SEQ ID NO: 3539613 - DNA, 12 bp, Homo sapiens
gcttctgtgaaa

SEQ ID NO: 3539614 - DNA, 21 bp, Homo sapiens
gcttctttgctttctcgtggg

SEQ ID NO: 3539615 - DNA, 16 bp, Homo sapiens
gctttctcgtgggtcc

SEQ ID NO: 3539616 - DNA, 11 bp, Homo sapiens
ggaaacagctg

SEQ ID NO: 3539617 - DNA, 12 bp, Homo sapiens
ggaaactctggt

SEQ ID NO: 3539618 - DNA, 20 bp, Homo sapiens
ggaaactctggtgccgggga

SEQ ID NO: 3539619 - DNA, 19 bp, Homo sapiens
ggaaagtgtgtatttaact

SEQ ID NO: 3539620 - DNA, 19 bp, Homo sapiens
ggaaataataccccaacag

SEQ ID NO: 3539621 - DNA, 14 bp, Homo sapiens
ggacaagagcctgc

SEQ ID NO: 3539622 - DNA, 20 bp, Homo sapiens
ggacaagagcctgcagcgga

SEQ ID NO: 3539623 - DNA, 16 bp, Homo sapiens
ggacccgctgggggct

SEQ ID NO: 3539624 - DNA, 18 bp, Homo sapiens
ggacccgctgggggctgg

SEQ ID NO: 3539625 - DNA, 19 bp, Homo sapiens
ggacccgctgggggctggc

SEQ ID NO: 3539626 - DNA, 16 bp, Homo sapiens
aaaaaattgtttttcc

SEQ ID NO: 3539627 - DNA, 16 bp, Homo sapiens
aaacagacaagcaggc

SEQ ID NO: 3539628 - DNA, 19 bp, Homo sapiens
aaactatggaaataatacc

SEQ ID NO: 3539629 - DNA, 18 bp, Homo sapiens
aaatcagtgggttaattt

SEQ ID NO: 3539630 - DNA, 21 bp, Homo sapiens
aaatcagtgggttaattttgg

SEQ ID NO: 3539631 - DNA, 21 bp, Homo sapiens
aaatcttctgctaaatttttg

SEQ ID NO: 3539632 - DNA, 15 bp, Homo sapiens
aacaaaactatggaa

SEQ ID NO: 3539633 - DNA, 17 bp, Homo sapiens
aacagctggtactgatg

SEQ ID NO: 3539634 - DNA, 24 bp, Homo sapiens
aacagctggtactgatgttcacct

SEQ ID NO: 3539635 - DNA, 18 bp, Homo sapiens
aacagtgttctcagtttt

SEQ ID NO: 3539636 - DNA, 20 bp, Homo sapiens
aacagttctgcactcttgta

SEQ ID NO: 3539637 - DNA, 19 bp, Homo sapiens
aacagttttacttctggcc

SEQ ID NO: 3539638 - DNA, 12 bp, Homo sapiens
aacatcttcata

SEQ ID NO: 3539639 - DNA, 18 bp, Homo sapiens
aacatcttcatataaact

SEQ ID NO: 3539640 - DNA, 20 bp, Homo sapiens
aaccaagttatctgtttcct

SEQ ID NO: 3539641 - DNA, 14 bp, Homo sapiens
aacctgtctcctcc

SEQ ID NO: 3539642 - DNA, 19 bp, Homo sapiens
aactcccatatctccttta

SEQ ID NO: 3539643 - DNA, 15 bp, Homo sapiens
aactgtatgtacata

SEQ ID NO: 3539644 - DNA, 13 bp, Homo sapiens
aactgtgagagaa

SEQ ID NO: 3539645 - DNA, 22 bp, Homo sapiens
aacttgggcaccagcttctttc

SEQ ID NO: 3539646 - DNA, 18 bp, Homo sapiens
aagacacatgtggagaag

SEQ ID NO: 3539647 - DNA, 11 bp, Homo sapiens
aagagcctgca

SEQ ID NO: 3539648 - DNA, 19 bp, Homo sapiens
aagagtgggctttgtggaa

SEQ ID NO: 3539649 - DNA, 21 bp, Homo sapiens
aagcaaactggggctgtgttt

SEQ ID NO: 3539650 - DNA, 18 bp, Homo sapiens
aagcaacaaaactatgga

SEQ ID NO: 3539651 - DNA, 16 bp, Homo sapiens
aagcaggcaggcagcc

SEQ ID NO: 3539652 - DNA, 13 bp, Homo sapiens
aagcgaacatctt

SEQ ID NO: 3539653 - DNA, 15 bp, Homo sapiens
aagcgaacatcttca

SEQ ID NO: 3539654 - DNA, 19 bp, Homo sapiens
aagcgaacatcttcatata

SEQ ID NO: 3539655 - DNA, 14 bp, Homo sapiens
aagggacagtttgt

SEQ ID NO: 3539656 - DNA, 18 bp, Homo sapiens
aagttatctgtttcctgt

SEQ ID NO: 3539657 - DNA, 15 bp, Homo sapiens
aatatggacatgtaa

SEQ ID NO: 3539658 - DNA, 17 bp, Homo sapiens
aatatggacatgtaaaa

SEQ ID NO: 3539659 - DNA, 18 bp, Homo sapiens
aatattttctacatcttt

SEQ ID NO: 3539660 - DNA, 19 bp, Homo sapiens
aatattttctacatctttt

SEQ ID NO: 3539661 - DNA, 16 bp, Homo sapiens
aatcagtgtgttacta

SEQ ID NO: 3539662 - DNA, 20 bp, Homo sapiens
aatgacattgatttctaatg

SEQ ID NO: 3539663 - DNA, 18 bp, Homo sapiens
aattcatacctgtgaata

SEQ ID NO: 3539664 - DNA, 14 bp, Homo sapiens
aattcatactctgt

SEQ ID NO: 3539665 - DNA, 19 bp, Homo sapiens
aattcatctttttttttct

SEQ ID NO: 3539666 - DNA, 19 bp, Homo sapiens
acaactccttccatccttg

SEQ ID NO: 3539667 - DNA, 20 bp, Homo sapiens
acaactccttccatccttga

SEQ ID NO: 3539668 - DNA, 18 bp, Homo sapiens
acaatacatgttttcact

SEQ ID NO: 3539669 - DNA, 15 bp, Homo sapiens
acacacacagacaca

SEQ ID NO: 3539670 - DNA, 18 bp, Homo sapiens
acagatgagcgaaaatgt

SEQ ID NO: 3539671 - DNA, 15 bp, Homo sapiens
acatcttcatataaa

SEQ ID NO: 3539672 - DNA, 17 bp, Homo sapiens
acatcttcatataaact

SEQ ID NO: 3539673 - DNA, 18 bp, Homo sapiens
acattgttcattcttgtt

SEQ ID NO: 3539674 - DNA, 18 bp, Homo sapiens
accaacattgttcattct

SEQ ID NO: 3539675 - DNA, 11 bp, Homo sapiens
accaaggctcc

SEQ ID NO: 3539676 - DNA, 23 bp, Homo sapiens
accacagccgggtgtgtgtctgc

SEQ ID NO: 3539677 - DNA, 16 bp, Homo sapiens
acccgctgggggctgg

SEQ ID NO: 3539678 - DNA, 15 bp, Homo sapiens
accggggctcctctc

SEQ ID NO: 3539679 - DNA, 19 bp, Homo sapiens
accgtgctgggctccccct

SEQ ID NO: 3539680 - DNA, 20 bp, Homo sapiens
acctcacaactccttccatc

SEQ ID NO: 3539681 - DNA, 14 bp, Homo sapiens
acctgtctcctccc

SEQ ID NO: 3539682 - DNA, 22 bp, Homo sapiens
acctttattgaagggtctgttt

SEQ ID NO: 3539683 - DNA, 14 bp, Homo sapiens
acgaaatggaaaca

SEQ ID NO: 3539684 - DNA, 20 bp, Homo sapiens
acgctgatgtttatgtactg

SEQ ID NO: 3539685 - DNA, 11 bp, Homo sapiens
actatggaaat

SEQ ID NO: 3539686 - DNA, 14 bp, Homo sapiens
actccaggaagaag

SEQ ID NO: 3539687 - DNA, 18 bp, Homo sapiens
actctgggctgtgcctga

SEQ ID NO: 3539688 - DNA, 19 bp, Homo sapiens
actctgttgcctcctctct

SEQ ID NO: 3539689 - DNA, 16 bp, Homo sapiens
actctttgcctaacta

SEQ ID NO: 3539690 - DNA, 19 bp, Homo sapiens
actgaagcgaacatcttca

SEQ ID NO: 3539691 - DNA, 15 bp, Homo sapiens
actgtaaacagttct

SEQ ID NO: 3539692 - DNA, 22 bp, Homo sapiens
actgtagcacggagtgttgggg

SEQ ID NO: 3539693 - DNA, 16 bp, Homo sapiens
acttaaacatttttgt

SEQ ID NO: 3539694 - DNA, 21 bp, Homo sapiens
acttccccacggatggcggtg

SEQ ID NO: 3539695 - DNA, 21 bp, Homo sapiens
acttgggcaccagcttctttc

SEQ ID NO: 3539696 - DNA, 16 bp, Homo sapiens
acttgggctgtaaagc

SEQ ID NO: 3539697 - DNA, 14 bp, Homo sapiens
agaacagccgcctg

SEQ ID NO: 3539698 - DNA, 17 bp, Homo sapiens
agaatcagtgtgttact

SEQ ID NO: 3539699 - DNA, 17 bp, Homo sapiens
agacaagaacagccgcc

SEQ ID NO: 3539700 - DNA, 20 bp, Homo sapiens
agacacatgtggagaaggtg

SEQ ID NO: 3539701 - DNA, 16 bp, Homo sapiens
agagaataatttctgt

SEQ ID NO: 3539702 - DNA, 13 bp, Homo sapiens
agagaccacagcc

SEQ ID NO: 3539703 - DNA, 20 bp, Homo sapiens
agagaccacagccgggtgtg

SEQ ID NO: 3539704 - DNA, 22 bp, Homo sapiens
agagaccggacaagagcctgca

SEQ ID NO: 3539705 - DNA, 23 bp, Homo sapiens
agagtgggctttgtggaaacagc

SEQ ID NO: 3539706 - DNA, 22 bp, Homo sapiens
agatggttttgccctccctctc

SEQ ID NO: 3539707 - DNA, 18 bp, Homo sapiens
agattcttaccaagagtg

SEQ ID NO: 3539708 - DNA, 20 bp, Homo sapiens
agcacggagtgttggggctg

SEQ ID NO: 3539709 - DNA, 18 bp, Homo sapiens
agccgggtgtgtgtctgc

SEQ ID NO: 3539710 - DNA, 20 bp, Homo sapiens
agcctacattgatgccaagc

SEQ ID NO: 3539711 - DNA, 13 bp, Homo sapiens
agcctggctgggc

SEQ ID NO: 3539712 - DNA, 13 bp, Homo sapiens
agcgaacatcttc

SEQ ID NO: 3539713 - DNA, 19 bp, Homo sapiens
agcggggcagcggggctgg

SEQ ID NO: 3539714 - DNA, 23 bp, Homo sapiens
agctctagtatttccacaaatag

SEQ ID NO: 3539715 - DNA, 14 bp, Homo sapiens
agcttcttgtgatc

SEQ ID NO: 3539716 - DNA, 16 bp, Homo sapiens
aggacaacacagctgc

SEQ ID NO: 3539717 - DNA, 20 bp, Homo sapiens
aggcagcctgagagctggcc

SEQ ID NO: 3539718 - DNA, 22 bp, Homo sapiens
aggcagcctgagagctggccca

SEQ ID NO: 3539719 - DNA, 20 bp, Homo sapiens
aggcctccctttggggagag

SEQ ID NO: 3539720 - DNA, 20 bp, Homo sapiens
aggctgcccactctggggac

SEQ ID NO: 3539721 - DNA, 19 bp, Homo sapiens
aggctggctgggggcagga

SEQ ID NO: 3539722 - DNA, 20 bp, Homo sapiens
aggctggctgggggcaggac

SEQ ID NO: 3539723 - DNA, 14 bp, Homo sapiens
agggacagtttgta

SEQ ID NO: 3539724 - DNA, 16 bp, Homo sapiens
agggacagtttgtaac

SEQ ID NO: 3539725 - DNA, 12 bp, Homo sapiens
agggactctggg

SEQ ID NO: 3539726 - DNA, 15 bp, Homo sapiens
agggactctgggctg

SEQ ID NO: 3539727 - DNA, 15 bp, Homo sapiens
agggcacgaggctct

SEQ ID NO: 3539728 - DNA, 11 bp, Homo sapiens
aggtttcttct

SEQ ID NO: 3539729 - DNA, 12 bp, Homo sapiens
aggtttcttctc

SEQ ID NO: 3539730 - DNA, 17 bp, Homo sapiens
aggtttcttctctggag

SEQ ID NO: 3539731 - DNA, 18 bp, Homo sapiens
agtcagaatatttttgaa

SEQ ID NO: 3539732 - DNA, 17 bp, Homo sapiens
agtcagcctggctgggc

SEQ ID NO: 3539733 - DNA, 15 bp, Homo sapiens
agtctctggaagaag

SEQ ID NO: 3539734 - DNA, 20 bp, Homo sapiens
agtgatctattttgagttaa

SEQ ID NO: 3539735 - DNA, 21 bp, Homo sapiens
agtgccctgccccagtcagcc

SEQ ID NO: 3539736 - DNA, 13 bp, Homo sapiens
agtgggctttgtg

SEQ ID NO: 3539737 - DNA, 15 bp, Homo sapiens
agtgttggggctggg

SEQ ID NO: 3539738 - DNA, 18 bp, Homo sapiens
agttctgcactcttgtac

SEQ ID NO: 3539739 - DNA, 20 bp, Homo sapiens
agttgagaaacagttccatt

SEQ ID NO: 3539740 - DNA, 19 bp, Homo sapiens
agtttaggagctcagttga

SEQ ID NO: 3539741 - DNA, 17 bp, Homo sapiens
agtttattttttttaat

SEQ ID NO: 3539742 - DNA, 23 bp, Homo sapiens
agtttgtaacttgggctgtaaag

SEQ ID NO: 3539743 - DNA, 14 bp, Homo sapiens
atactctgttgcct

SEQ ID NO: 3539744 - DNA, 23 bp, Homo sapiens
atactctgttgcctcctctctcc

SEQ ID NO: 3539745 - DNA, 22 bp, Homo sapiens
atagatacccaattgtttcagt

SEQ ID NO: 3539746 - DNA, 19 bp, Homo sapiens
atatagatacccaattgtt

SEQ ID NO: 3539747 - DNA, 17 bp, Homo sapiens
atatatgtactagcatt

SEQ ID NO: 3539748 - DNA, 18 bp, Homo sapiens
atccaaactcagaaggct

SEQ ID NO: 3539749 - DNA, 15 bp, Homo sapiens
atcctttggggcttc

SEQ ID NO: 3539750 - DNA, 22 bp, Homo sapiens
atctcattgctgttttaatttg

SEQ ID NO: 3539751 - DNA, 16 bp, Homo sapiens
atctgtttcctgttct

SEQ ID NO: 3539752 - DNA, 16 bp, Homo sapiens
atgaattcatactctg

SEQ ID NO: 3539753 - DNA, 18 bp, Homo sapiens
atgagcgaaaatgtatta

SEQ ID NO: 3539754 - DNA, 16 bp, Homo sapiens
atgatcatgatgatga

SEQ ID NO: 3539755 - DNA, 14 bp, Homo sapiens
atgatgatgatgat

SEQ ID NO: 3539756 - DNA, 14 bp, Homo sapiens
atgatgattttaac

SEQ ID NO: 3539757 - DNA, 21 bp, Homo sapiens
atgatgattttaacagtttta

SEQ ID NO: 3539758 - DNA, 17 bp, Homo sapiens
atgattttaacagtttt

SEQ ID NO: 3539759 - DNA, 19 bp, Homo sapiens
atgattttaacagttttac

SEQ ID NO: 3539760 - DNA, 15 bp, Homo sapiens
atggcggtggagggg

SEQ ID NO: 3539761 - DNA, 16 bp, Homo sapiens
atgggattgtgttaaa

SEQ ID NO: 3539762 - DNA, 20 bp, Homo sapiens
atggttttgccctccctctc

SEQ ID NO: 3539763 - DNA, 15 bp, Homo sapiens
atgtttatgtactgt

SEQ ID NO: 3539764 - DNA, 17 bp, Homo sapiens
attagtgtagtgttaaa

SEQ ID NO: 3539765 - DNA, 13 bp, Homo sapiens
attcatactctgt

SEQ ID NO: 3539766 - DNA, 13 bp, Homo sapiens
attccagtttagg

SEQ ID NO: 3539767 - DNA, 16 bp, Homo sapiens
attgatgccaagcttt

SEQ ID NO: 3539768 - DNA, 14 bp, Homo sapiens
attgctagtagata

SEQ ID NO: 3539769 - DNA, 14 bp, Homo sapiens
attttaacagtttt

SEQ ID NO: 3539770 - DNA, 22 bp, Homo sapiens
attttccacgctgatgtttatg

SEQ ID NO: 3539771 - DNA, 18 bp, Homo sapiens
attttgaagtcagagaga

SEQ ID NO: 3539772 - DNA, 13 bp, Homo sapiens
caaaaaccaagtt

SEQ ID NO: 3539773 - DNA, 19 bp, Homo sapiens
caaaaaccaagttatctgt

SEQ ID NO: 3539774 - DNA, 13 bp, Homo sapiens
caaaactatggaa

SEQ ID NO: 3539775 - DNA, 13 bp, Homo sapiens
caaagaagattct

SEQ ID NO: 3539776 - DNA, 17 bp, Homo sapiens
caacattgttcattctt

SEQ ID NO: 3539777 - DNA, 15 bp, Homo sapiens
caagagtgggctttg

SEQ ID NO: 3539778 - DNA, 17 bp, Homo sapiens
caagagtgggctttgtg

SEQ ID NO: 3539779 - DNA, 18 bp, Homo sapiens
caagagtgggctttgtgg

SEQ ID NO: 3539780 - DNA, 22 bp, Homo sapiens
caagcttaaccaaggctccaat

SEQ ID NO: 3539781 - DNA, 17 bp, Homo sapiens
caagttatctgtttcct

SEQ ID NO: 3539782 - DNA, 18 bp, Homo sapiens
caatatggacatgtaaaa

SEQ ID NO: 3539783 - DNA, 18 bp, Homo sapiens
cacaaagtttgtggtaat

SEQ ID NO: 3539784 - DNA, 13 bp, Homo sapiens
cacaaataggtat

SEQ ID NO: 3539785 - DNA, 21 bp, Homo sapiens
cacaactccttccatccttga

SEQ ID NO: 3539786 - DNA, 12 bp, Homo sapiens
cacacacacacc

SEQ ID NO: 3539787 - DNA, 13 bp, Homo sapiens
cacacacagacac

SEQ ID NO: 3539788 - DNA, 21 bp, Homo sapiens
cacagagaaaaagttgtaatt

SEQ ID NO: 3539789 - DNA, 18 bp, Homo sapiens
cacatgtggagaaggtga

SEQ ID NO: 3539790 - DNA, 13 bp, Homo sapiens
caccagcttcttt

SEQ ID NO: 3539791 - DNA, 17 bp, Homo sapiens
caccagcttctttctcg

SEQ ID NO: 3539792 - DNA, 18 bp, Homo sapiens
cacctcacaactccttcc

SEQ ID NO: 3539793 - DNA, 22 bp, Homo sapiens
cacggagtgttggggctggggg

SEQ ID NO: 3539794 - DNA, 22 bp, Homo sapiens
cactctggggacccgctggggg

SEQ ID NO: 3539795 - DNA, 17 bp, Homo sapiens
cactcttgtacaaaaga

SEQ ID NO: 3539796 - DNA, 17 bp, Homo sapiens
cactttctcctggtgtt

SEQ ID NO: 3539797 - DNA, 23 bp, Homo sapiens
cagaaattttgaagtcagagaga

SEQ ID NO: 3539798 - DNA, 13 bp, Homo sapiens
cagacacacacac

SEQ ID NO: 3539799 - DNA, 17 bp, Homo sapiens
cagacacacacacacct

SEQ ID NO: 3539800 - DNA, 19 bp, Homo sapiens
cagatgaatgactccagga

SEQ ID NO: 3539801 - DNA, 17 bp, Homo sapiens
cagatgagcgaaaatgt

SEQ ID NO: 3539802 - DNA, 11 bp, Homo sapiens
cagccacatat

SEQ ID NO: 3539803 - DNA, 18 bp, Homo sapiens
cagccctttggcttcaag

SEQ ID NO: 3539804 - DNA, 15 bp, Homo sapiens
cagcctggctgggct

SEQ ID NO: 3539805 - DNA, 20 bp, Homo sapiens
cagcggaagggactctgggc

SEQ ID NO: 3539806 - DNA, 12 bp, Homo sapiens
cagcggggctgg

SEQ ID NO: 3539807 - DNA, 21 bp, Homo sapiens
cagctgcttccccaggctgcc

SEQ ID NO: 3539808 - DNA, 23 bp, Homo sapiens
cagctgcttccccaggctgccca

SEQ ID NO: 3539809 - DNA, 16 bp, Homo sapiens
cagcttctttctcggt

SEQ ID NO: 3539810 - DNA, 13 bp, Homo sapiens
caggagggcttga

SEQ ID NO: 3539811 - DNA, 14 bp, Homo sapiens
caggagggcttgag

SEQ ID NO: 3539812 - DNA, 16 bp, Homo sapiens
caggcaggcagcctga

SEQ ID NO: 3539813 - DNA, 20 bp, Homo sapiens
caggcctccctttggggaga

SEQ ID NO: 3539814 - DNA, 17 bp, Homo sapiens
caggggtcccctggcag

SEQ ID NO: 3539815 - DNA, 21 bp, Homo sapiens
caggggtcccctggcagggga

SEQ ID NO: 3539816 - DNA, 15 bp, Homo sapiens
caggtttcttctctg

SEQ ID NO: 3539817 - DNA, 17 bp, Homo sapiens
caggtttcttctctgga

SEQ ID NO: 3539818 - DNA, 20 bp, Homo sapiens
cagtcagcctggctgggctc

SEQ ID NO: 3539819 - DNA, 16 bp, Homo sapiens
cagttccattcaactg

SEQ ID NO: 3539820 - DNA, 12 bp, Homo sapiens
cagtttgtaact

SEQ ID NO: 3539821 - DNA, 18 bp, Homo sapiens
catactctgttgcctcct

SEQ ID NO: 3539822 - DNA, 21 bp, Homo sapiens
catactctgttgcctcctctc

SEQ ID NO: 3539823 - DNA, 15 bp, Homo sapiens
catatcttgttagat

SEQ ID NO: 3539824 - DNA, 19 bp, Homo sapiens
catccaaactcagaaggct

SEQ ID NO: 3539825 - DNA, 19 bp, Homo sapiens
catctcccttccacctcac

SEQ ID NO: 3539826 - DNA, 15 bp, Homo sapiens
catcttcatataaac

SEQ ID NO: 3539827 - DNA, 16 bp, Homo sapiens
catgaattcatactct

SEQ ID NO: 3539828 - DNA, 20 bp, Homo sapiens
catgaattcatactctgttg

SEQ ID NO: 3539829 - DNA, 22 bp, Homo sapiens
catgatgatgatgattttaaca

SEQ ID NO: 3539830 - DNA, 15 bp, Homo sapiens
cattgatgccaagct

SEQ ID NO: 3539831 - DNA, 23 bp, Homo sapiens
ccaacagatgagcgaaaatgtat

SEQ ID NO: 3539832 - DNA, 14 bp, Homo sapiens
ccaagagtgggctt

SEQ ID NO: 3539833 - DNA, 14 bp, Homo sapiens
ccaaggaagtctgt

SEQ ID NO: 3539834 - DNA, 19 bp, Homo sapiens
ccaagttatctgtttcctg

SEQ ID NO: 3539835 - DNA, 12 bp, Homo sapiens
ccactctgggga

SEQ ID NO: 3539836 - DNA, 15 bp, Homo sapiens
ccagcttctttctcg

SEQ ID NO: 3539837 - DNA, 20 bp, Homo sapiens
ccagcttctttctcggtggc

SEQ ID NO: 3539838 - DNA, 19 bp, Homo sapiens
ccaggaagaaggtgtgtcc

SEQ ID NO: 3539839 - DNA, 22 bp, Homo sapiens
ccaggctgcccactctggggac

SEQ ID NO: 3539840 - DNA, 21 bp, Homo sapiens
ccaggtaatgtgggtctacca

SEQ ID NO: 3539841 - DNA, 16 bp, Homo sapiens
ccaggtttcttctctg

SEQ ID NO: 3539842 - DNA, 18 bp, Homo sapiens
ccaggtttcttctctgga

SEQ ID NO: 3539843 - DNA, 19 bp, Homo sapiens
ccaggtttcttctctggag

SEQ ID NO: 3539844 - DNA, 18 bp, Homo sapiens
ccagtcagcctggctggg

SEQ ID NO: 3539845 - DNA, 14 bp, Homo sapiens
ccattcaactggaa

SEQ ID NO: 3539846 - DNA, 14 bp, Homo sapiens
cccctggcagggga

SEQ ID NO: 3539847 - DNA, 10 bp, Homo sapiens
cccctttctt

SEQ ID NO: 3539848 - DNA, 18 bp, Homo sapiens
cccgcagtgccctgcccc

SEQ ID NO: 3539849 - DNA, 16 bp, Homo sapiens
ccctcaagctttcctg

SEQ ID NO: 3539850 - DNA, 10 bp, Homo sapiens
ccctgcctca

SEQ ID NO: 3539851 - DNA, 20 bp, Homo sapiens
ccctgcctcacatctccctt

SEQ ID NO: 3539852 - DNA, 15 bp, Homo sapiens
cccttctgaagcaga

SEQ ID NO: 3539853 - DNA, 14 bp, Homo sapiens
ccggggctcctctc

SEQ ID NO: 3539854 - DNA, 22 bp, Homo sapiens
ccgtgggccctcaagctttcct

SEQ ID NO: 3539855 - DNA, 14 bp, Homo sapiens
cctagctagagaag

SEQ ID NO: 3539856 - DNA, 15 bp, Homo sapiens
cctcaagctttcctg

SEQ ID NO: 3539857 - DNA, 13 bp, Homo sapiens
cctcacaactcct

SEQ ID NO: 3539858 - DNA, 14 bp, Homo sapiens
cctcacaactcctt

SEQ ID NO: 3539859 - DNA, 14 bp, Homo sapiens
cctcacatctccct

SEQ ID NO: 3539860 - DNA, 15 bp, Homo sapiens
cctcccaggtttctt

SEQ ID NO: 3539861 - DNA, 15 bp, Homo sapiens
cctcctctctccctg

SEQ ID NO: 3539862 - DNA, 19 bp, Homo sapiens
cctcctttcccctttctct

SEQ ID NO: 3539863 - DNA, 16 bp, Homo sapiens
cctcgggtggggctgg

SEQ ID NO: 3539864 - DNA, 21 bp, Homo sapiens
cctctctccctgcctcacatc

SEQ ID NO: 3539865 - DNA, 22 bp, Homo sapiens
cctgacgaaatggaaacacaca

SEQ ID NO: 3539866 - DNA, 13 bp, Homo sapiens
cctgagagctggc

SEQ ID NO: 3539867 - DNA, 17 bp, Homo sapiens
cctgagagctggcccag

SEQ ID NO: 3539868 - DNA, 19 bp, Homo sapiens
cctgaggctggctgggggc

SEQ ID NO: 3539869 - DNA, 14 bp, Homo sapiens
cctgctgtcttctc

SEQ ID NO: 3539870 - DNA, 20 bp, Homo sapiens
cctggcaggggaaactctgg

SEQ ID NO: 3539871 - DNA, 20 bp, Homo sapiens
cctgggagagcccttgtggc

SEQ ID NO: 3539872 - DNA, 17 bp, Homo sapiens
cctggtgtttttctctc

SEQ ID NO: 3539873 - DNA, 22 bp, Homo sapiens
cctggtgtttttctctctggac

SEQ ID NO: 3539874 - DNA, 15 bp, Homo sapiens
ccttcactttctcct

SEQ ID NO: 3539875 - DNA, 21 bp, Homo sapiens
ccttcactttctcctggtgtt

SEQ ID NO: 3539876 - DNA, 23 bp, Homo sapiens
ccttccatccttgactgaagcga

SEQ ID NO: 3539877 - DNA, 15 bp, Homo sapiens
ccttgtcgctgaacc

SEQ ID NO: 3539878 - DNA, 19 bp, Homo sapiens
cctttatatatgtactagc

SEQ ID NO: 3539879 - DNA, 19 bp, Homo sapiens
cctttcccctttctctttc

SEQ ID NO: 3539880 - DNA, 22 bp, Homo sapiens
cgaaaatgtattattgtaaagt

SEQ ID NO: 3539881 - DNA, 19 bp, Homo sapiens
cgaaatggaaacacacaca

SEQ ID NO: 3539882 - DNA, 17 bp, Homo sapiens
cgaggctctagaaatgc

SEQ ID NO: 3539883 - DNA, 22 bp, Homo sapiens
cgctgaacctgtctcctcccag

SEQ ID NO: 3539884 - DNA, 19 bp, Homo sapiens
cggagtgttggggctgggg

SEQ ID NO: 3539885 - DNA, 20 bp, Homo sapiens
cggagtgttggggctggggg

SEQ ID NO: 3539886 - DNA, 15 bp, Homo sapiens
cggggcagcggggct

SEQ ID NO: 3539887 - DNA, 17 bp, Homo sapiens
cggggcagcggggctgg

SEQ ID NO: 3539888 - DNA, 18 bp, Homo sapiens
cggggcagcggggctggc

SEQ ID NO: 3539889 - DNA, 17 bp, Homo sapiens
cgggtggggctggtggg

SEQ ID NO: 3539890 - DNA, 19 bp, Homo sapiens
cgggtgtgtgtctgcagca

SEQ ID NO: 3539891 - DNA, 13 bp, Homo sapiens
cggtcagcggggc

SEQ ID NO: 3539892 - DNA, 11 bp, Homo sapiens
cgtgctgggct

SEQ ID NO: 3539893 - DNA, 12 bp, Homo sapiens
ctcaattctgtc

SEQ ID NO: 3539894 - DNA, 13 bp, Homo sapiens
ctcacaactcctt

SEQ ID NO: 3539895 - DNA, 14 bp, Homo sapiens
ctcacaactccttc

SEQ ID NO: 3539896 - DNA, 21 bp, Homo sapiens
ctcagaagacacatgtggaga

SEQ ID NO: 3539897 - DNA, 16 bp, Homo sapiens
ctcagttgagaaacag

SEQ ID NO: 3539898 - DNA, 18 bp, Homo sapiens
ctcagttgagaaacagtt

SEQ ID NO: 3539899 - DNA, 19 bp, Homo sapiens
ctcagttgagaaacagttc

SEQ ID NO: 3539900 - DNA, 14 bp, Homo sapiens
ctccaggaagaagg

SEQ ID NO: 3539901 - DNA, 19 bp, Homo sapiens
ctccaggagggcttgagag

SEQ ID NO: 3539902 - DNA, 15 bp, Homo sapiens
ctcccaggtttcttc

SEQ ID NO: 3539903 - DNA, 12 bp, Homo sapiens
ctccctctctgc

SEQ ID NO: 3539904 - DNA, 10 bp, Homo sapiens
ctccctgcct

SEQ ID NO: 3539905 - DNA, 17 bp, Homo sapiens
ctccctgcctcacatct

SEQ ID NO: 3539906 - DNA, 14 bp, Homo sapiens
ctcccttccacctc

SEQ ID NO: 3539907 - DNA, 15 bp, Homo sapiens
ctcccttccacctca

SEQ ID NO: 3539908 - DNA, 18 bp, Homo sapiens
ctcctcccaggtttcttc

SEQ ID NO: 3539909 - DNA, 14 bp, Homo sapiens
ctcctctctccctg

SEQ ID NO: 3539910 - DNA, 16 bp, Homo sapiens
ctcctctctccctgcc

SEQ ID NO: 3539911 - DNA, 17 bp, Homo sapiens
ctcctctctccctgcct

SEQ ID NO: 3539912 - DNA, 19 bp, Homo sapiens
ctcctctctccctgcctca

SEQ ID NO: 3539913 - DNA, 22 bp, Homo sapiens
ctcctctctccctgcctcacat

SEQ ID NO: 3539914 - DNA, 15 bp, Homo sapiens
ctccttccatccttg

SEQ ID NO: 3539915 - DNA, 19 bp, Homo sapiens
ctcctttcccctttctctt

SEQ ID NO: 3539916 - DNA, 14 bp, Homo sapiens
ctcgggtggggctg

SEQ ID NO: 3539917 - DNA, 19 bp, Homo sapiens
ctcgggtggggctggtggg

SEQ ID NO: 3539918 - DNA, 16 bp, Homo sapiens
ctctctccctgcctca

SEQ ID NO: 3539919 - DNA, 17 bp, Homo sapiens
ctctctccctgcctcac

SEQ ID NO: 3539920 - DNA, 21 bp, Homo sapiens
ctctctccctgcctcacatct

SEQ ID NO: 3539921 - DNA, 23 bp, Homo sapiens
ctctgccctcgggtggggctggt

SEQ ID NO: 3539922 - DNA, 12 bp, Homo sapiens
ctctggaagaag

SEQ ID NO: 3539923 - DNA, 22 bp, Homo sapiens
ctctggacccttctgaagcaga

SEQ ID NO: 3539924 - DNA, 21 bp, Homo sapiens
ctctggggacccgctgggggc

SEQ ID NO: 3539925 - DNA, 19 bp, Homo sapiens
ctctggtgggggctcctga

SEQ ID NO: 3539926 - DNA, 11 bp, Homo sapiens
ctctgttgcct

SEQ ID NO: 3539927 - DNA, 20 bp, Homo sapiens
ctctgttgcctcctctctcc

SEQ ID NO: 3539928 - DNA, 23 bp, Homo sapiens
ctctgttgcctcctctctccctg

SEQ ID NO: 3539929 - DNA, 15 bp, Homo sapiens
ctctttcctcatttc

SEQ ID NO: 3539930 - DNA, 20 bp, Homo sapiens
ctctttcctcatttcctaga

SEQ ID NO: 3539931 - DNA, 16 bp, Homo sapiens
ctgaaattccagttta

SEQ ID NO: 3539932 - DNA, 17 bp, Homo sapiens
ctgaagcgaacatcttc

SEQ ID NO: 3539933 - DNA, 19 bp, Homo sapiens
ctgaagcgaacatcttcat

SEQ ID NO: 3539934 - DNA, 20 bp, Homo sapiens
gtgggtctgcagctggtgtg

SEQ ID NO: 3539935 - DNA, 17 bp, Homo sapiens
gtggtttcccctttctt

SEQ ID NO: 3539936 - DNA, 18 bp, Homo sapiens
gtggtttcccctttcttt

SEQ ID NO: 3539937 - DNA, 17 bp, Homo sapiens
gtgtggtttcccctttc

SEQ ID NO: 3539938 - DNA, 19 bp, Homo sapiens
gtgtggtttcccctttctt

SEQ ID NO: 3539939 - DNA, 17 bp, Homo sapiens
gtgttttcgatgatgat

SEQ ID NO: 3539940 - DNA, 14 bp, Homo sapiens
gtgtttttctctct

SEQ ID NO: 3539941 - DNA, 16 bp, Homo sapiens
gtgtttttctctctgg

SEQ ID NO: 3539942 - DNA, 15 bp, Homo sapiens
gttatctgtttcctg

SEQ ID NO: 3539943 - DNA, 16 bp, Homo sapiens
gttatctgtttcctgt

SEQ ID NO: 3539944 - DNA, 19 bp, Homo sapiens
gttcgcaccgtgctgggct

SEQ ID NO: 3539945 - DNA, 17 bp, Homo sapiens
gttctgcactcttgtac

SEQ ID NO: 3539946 - DNA, 11 bp, Homo sapiens
gttgcctcctc

SEQ ID NO: 3539947 - DNA, 13 bp, Homo sapiens
gttgcctcctctc

SEQ ID NO: 3539948 - DNA, 19 bp, Homo sapiens
gttgcctcctctctccctg

SEQ ID NO: 3539949 - DNA, 22 bp, Homo sapiens
gtttaggagctcagttgagaaa

SEQ ID NO: 3539950 - DNA, 17 bp, Homo sapiens
gtttatgtactgtaaac

SEQ ID NO: 3539951 - DNA, 17 bp, Homo sapiens
gtttcccctttctttcc

SEQ ID NO: 3539952 - DNA, 16 bp, Homo sapiens
gtttttctctctggac

SEQ ID NO: 3539953 - DNA, 15 bp, Homo sapiens
taactctgtaagaaa

SEQ ID NO: 3539954 - DNA, 23 bp, Homo sapiens
taatgacattgatttctaatgat

SEQ ID NO: 3539955 - DNA, 17 bp, Homo sapiens
taatttctgttgtttta

SEQ ID NO: 3539956 - DNA, 20 bp, Homo sapiens
tactctgttgcctcctctct

SEQ ID NO: 3539957 - DNA, 13 bp, Homo sapiens
tactgatgttcac

SEQ ID NO: 3539958 - DNA, 18 bp, Homo sapiens
tactgatgttcaccttta

SEQ ID NO: 3539959 - DNA, 13 bp, Homo sapiens
tactgtaaacagt

SEQ ID NO: 3539960 - DNA, 14 bp, Homo sapiens
tactgtaaacagtt

SEQ ID NO: 3539961 - DNA, 21 bp, Homo sapiens
tactgtaaacagttctgcact

SEQ ID NO: 3539962 - DNA, 23 bp, Homo sapiens
tagaaatgcccttcactttctcc

SEQ ID NO: 3539963 - DNA, 23 bp, Homo sapiens
tagcacggagtgttggggctggg

SEQ ID NO: 3539964 - DNA, 17 bp, Homo sapiens
tagtgatctattttgag

SEQ ID NO: 3539965 - DNA, 14 bp, Homo sapiens
tatctgtttcctgt

SEQ ID NO: 3539966 - DNA, 23 bp, Homo sapiens
tatctgtttcctgttctcttgta

SEQ ID NO: 3539967 - DNA, 20 bp, Homo sapiens
tattgaagggtctgtttaaa

SEQ ID NO: 3539968 - DNA, 13 bp, Homo sapiens
tatttcaccattt

SEQ ID NO: 3539969 - DNA, 17 bp, Homo sapiens
tcaactgtatgtacata

SEQ ID NO: 3539970 - DNA, 14 bp, Homo sapiens
tcactttctcctgg

SEQ ID NO: 3539971 - DNA, 17 bp, Homo sapiens
tcagaaggctttgggat

SEQ ID NO: 3539972 - DNA, 20 bp, Homo sapiens
tcagcctggctgggctctgg

SEQ ID NO: 3539973 - DNA, 19 bp, Homo sapiens
tcagcggggcagcggggct

SEQ ID NO: 3539974 - DNA, 16 bp, Homo sapiens
tcagtgggttaatttt

SEQ ID NO: 3539975 - DNA, 16 bp, Homo sapiens
tcatactctgttgcct

SEQ ID NO: 3539976 - DNA, 21 bp, Homo sapiens
tcatgaattcatactctgttg

SEQ ID NO: 3539977 - DNA, 19 bp, Homo sapiens
tcattgctagtagatagaa

SEQ ID NO: 3539978 - DNA, 17 bp, Homo sapiens
tcattgctgttttaatt

SEQ ID NO: 3539979 - DNA, 15 bp, Homo sapiens
tccatatacatatat

SEQ ID NO: 3539980 - DNA, 19 bp, Homo sapiens
tcccaggtttcttctctgg

SEQ ID NO: 3539981 - DNA, 16 bp, Homo sapiens
tccccaggctgcccac

SEQ ID NO: 3539982 - DNA, 23 bp, Homo sapiens
tccccaggctgcccactctgggg

SEQ ID NO: 3539983 - DNA, 11 bp, Homo sapiens
tcccctttctt

SEQ ID NO: 3539984 - DNA, 13 bp, Homo sapiens
tccctctctgccc

SEQ ID NO: 3539985 - DNA, 18 bp, Homo sapiens
tccctgcctcacatctcc

SEQ ID NO: 3539986 - DNA, 22 bp, Homo sapiens
tcccttccacctcacaactcct

SEQ ID NO: 3539987 - DNA, 18 bp, Homo sapiens
tcctcccaggtttcttct

SEQ ID NO: 3539988 - DNA, 15 bp, Homo sapiens
tcctctctccctgcc

SEQ ID NO: 3539989 - DNA, 13 bp, Homo sapiens
tcctgctgtcttc

SEQ ID NO: 3539990 - DNA, 16 bp, Homo sapiens
tcctgctgtcttctcc

SEQ ID NO: 3539991 - DNA, 14 bp, Homo sapiens
tcctgttctcttgt

SEQ ID NO: 3539992 - DNA, 20 bp, Homo sapiens
tccttgactgaagcgaacat

SEQ ID NO: 3539993 - DNA, 18 bp, Homo sapiens
tcctttggggcttctgtg

SEQ ID NO: 3539994 - DNA, 15 bp, Homo sapiens
tccttttaagaaagc

SEQ ID NO: 3539995 - DNA, 16 bp, Homo sapiens
tcgcaccgtgctgggc

SEQ ID NO: 3539996 - DNA, 16 bp, Homo sapiens
tcgctgaacctgtctc

SEQ ID NO: 3539997 - DNA, 23 bp, Homo sapiens
tcgctgaacctgtctcctcccag

SEQ ID NO: 3539998 - DNA, 17 bp, Homo sapiens
tctacacatatcttgtt

SEQ ID NO: 3539999 - DNA, 12 bp, Homo sapiens
tctacatctttt

SEQ ID NO: 3540000 - DNA, 17 bp, Homo sapiens
tctccctcctcctcctt

SEQ ID NO: 3540001 - DNA, 12 bp, Homo sapiens
tctccctgcctc

SEQ ID NO: 3540002 - DNA, 21 bp, Homo sapiens
tctccctgcctcacatctccc

SEQ ID NO: 3540003 - DNA, 19 bp, Homo sapiens
tctcctggtgtttttctct

SEQ ID NO: 3540004 - DNA, 14 bp, Homo sapiens
tctctccctgcctc

SEQ ID NO: 3540005 - DNA, 15 bp, Homo sapiens
tctctccctgcctca

SEQ ID NO: 3540006 - DNA, 11 bp, Homo sapiens
tctctctggac

SEQ ID NO: 3540007 - DNA, 13 bp, Homo sapiens
tctcttgtatagc

SEQ ID NO: 3540008 - DNA, 13 bp, Homo sapiens
tctctttcctcat

SEQ ID NO: 3540009 - DNA, 16 bp, Homo sapiens
tctgaagcagagaccg

SEQ ID NO: 3540010 - DNA, 18 bp, Homo sapiens
tctggacccttctgaagc

SEQ ID NO: 3540011 - DNA, 11 bp, Homo sapiens
tctggagaagt

SEQ ID NO: 3540012 - DNA, 12 bp, Homo sapiens
tctggtgggggc

SEQ ID NO: 3540013 - DNA, 14 bp, Homo sapiens
tctgttgcctcctc

SEQ ID NO: 3540014 - DNA, 20 bp, Homo sapiens
tctgtttttttttttttaac

SEQ ID NO: 3540015 - DNA, 11 bp, Homo sapiens
tcttctctgga

SEQ ID NO: 3540016 - DNA, 12 bp, Homo sapiens
tcttctctggag

SEQ ID NO: 3540017 - DNA, 13 bp, Homo sapiens
tcttctctggaga

SEQ ID NO: 3540018 - DNA, 14 bp, Homo sapiens
tcttgccagccaca

SEQ ID NO: 3540019 - DNA, 18 bp, Homo sapiens
tcttgttagatttttaac

SEQ ID NO: 3540020 - DNA, 12 bp, Homo sapiens
tctttctcggtg

SEQ ID NO: 3540021 - DNA, 14 bp, Homo sapiens
tctttgctttctcg

SEQ ID NO: 3540022 - DNA, 18 bp, Homo sapiens
tctttgctttctcgtggg

SEQ ID NO: 3540023 - DNA, 16 bp, Homo sapiens
tgaaagctacgcagac

SEQ ID NO: 3540024 - DNA, 15 bp, Homo sapiens
tgaaattccagttta

SEQ ID NO: 3540025 - DNA, 23 bp, Homo sapiens
tgaacacaatacatgttttcact

SEQ ID NO: 3540026 - DNA, 17 bp, Homo sapiens
tgaacctgtctcctccc

SEQ ID NO: 3540027 - DNA, 15 bp, Homo sapiens
tgaagcgaacatctt

SEQ ID NO: 3540028 - DNA, 23 bp, Homo sapiens
tgaagcgaacatcttcatataaa

SEQ ID NO: 3540029 - DNA, 15 bp, Homo sapiens
tgaagtcagagagaa

SEQ ID NO: 3540030 - DNA, 20 bp, Homo sapiens
tgaatgactccaggaagaag

SEQ ID NO: 3540031 - DNA, 17 bp, Homo sapiens
tgacattgatttctaat

SEQ ID NO: 3540032 - DNA, 19 bp, Homo sapiens
tgacattgatttctaatga

SEQ ID NO: 3540033 - DNA, 21 bp, Homo sapiens
tgacgaaatggaaacacacac

SEQ ID NO: 3540034 - DNA, 17 bp, Homo sapiens
tgactgaagcgaacatc

SEQ ID NO: 3540035 - DNA, 23 bp, Homo sapiens
ctgaagcgaacatcttcatataa

SEQ ID NO: 3540036 - DNA, 13 bp, Homo sapiens
ctgagagctggcc

SEQ ID NO: 3540037 - DNA, 14 bp, Homo sapiens
ctgagagctggccc

SEQ ID NO: 3540038 - DNA, 22 bp, Homo sapiens
ctgaggctggctgggggcagga

SEQ ID NO: 3540039 - DNA, 22 bp, Homo sapiens
ctgatgttcacctttatatatg

SEQ ID NO: 3540040 - DNA, 14 bp, Homo sapiens
ctgatgtttatgta

SEQ ID NO: 3540041 - DNA, 23 bp, Homo sapiens
ctgatgtttatgtactgtaaaca

SEQ ID NO: 3540042 - DNA, 14 bp, Homo sapiens
ctgcactcttgtac

SEQ ID NO: 3540043 - DNA, 16 bp, Homo sapiens
ctgcactcttgtacaa

SEQ ID NO: 3540044 - DNA, 15 bp, Homo sapiens
ctgcagcaccgtggg

SEQ ID NO: 3540045 - DNA, 23 bp, Homo sapiens
ctgcagcggaagggactctgggc

SEQ ID NO: 3540046 - DNA, 14 bp, Homo sapiens
ctgcagctggtgtg

SEQ ID NO: 3540047 - DNA, 13 bp, Homo sapiens
ctgcccactctgg

SEQ ID NO: 3540048 - DNA, 14 bp, Homo sapiens
ctgcccactctggg

SEQ ID NO: 3540049 - DNA, 22 bp, Homo sapiens
ctgccccagtcagcctggctgg

SEQ ID NO: 3540050 - DNA, 20 bp, Homo sapiens
ctgccctcgggtggggctgg

SEQ ID NO: 3540051 - DNA, 16 bp, Homo sapiens
ctgcctcacatctccc

SEQ ID NO: 3540052 - DNA, 12 bp, Homo sapiens
ctgccttgatta

SEQ ID NO: 3540053 - DNA, 14 bp, Homo sapiens
ctgctgtcttctcc

SEQ ID NO: 3540054 - DNA, 21 bp, Homo sapiens
ctgcttccccaggctgcccac

SEQ ID NO: 3540055 - DNA, 20 bp, Homo sapiens
ctggcaggggaaactctggt

SEQ ID NO: 3540056 - DNA, 16 bp, Homo sapiens
ctggctgggctctggt

SEQ ID NO: 3540057 - DNA, 19 bp, Homo sapiens
ctggctgggctctggtggg

SEQ ID NO: 3540058 - DNA, 16 bp, Homo sapiens
ctggctgggggcagga

SEQ ID NO: 3540059 - DNA, 22 bp, Homo sapiens
ctggggacccgctgggggctgg

SEQ ID NO: 3540060 - DNA, 16 bp, Homo sapiens
ctggtactgatgttca

SEQ ID NO: 3540061 - DNA, 20 bp, Homo sapiens
ctggtactgatgttcacctt

SEQ ID NO: 3540062 - DNA, 21 bp, Homo sapiens
ctggtgtttttctctctggac

SEQ ID NO: 3540063 - DNA, 22 bp, Homo sapiens
ctggtgtttttctctctggacc

SEQ ID NO: 3540064 - DNA, 14 bp, Homo sapiens
ctgtcttctccctc

SEQ ID NO: 3540065 - DNA, 16 bp, Homo sapiens
ctgtcttctccctcct

SEQ ID NO: 3540066 - DNA, 11 bp, Homo sapiens
ctgtgttttcg

SEQ ID NO: 3540067 - DNA, 14 bp, Homo sapiens
ctgttgcctcctct

SEQ ID NO: 3540068 - DNA, 15 bp, Homo sapiens
ctgttgcctcctctc

SEQ ID NO: 3540069 - DNA, 20 bp, Homo sapiens
ctgttgcctcctctctccct

SEQ ID NO: 3540070 - DNA, 20 bp, Homo sapiens
ctgtttcctgttctcttgta

SEQ ID NO: 3540071 - DNA, 18 bp, Homo sapiens
ctgttttaatttgtattt

SEQ ID NO: 3540072 - DNA, 13 bp, Homo sapiens
cttcactttctcc

SEQ ID NO: 3540073 - DNA, 20 bp, Homo sapiens
cttcactttctcctggtgtt

SEQ ID NO: 3540074 - DNA, 20 bp, Homo sapiens
cttcagccctttggcttcaa

SEQ ID NO: 3540075 - DNA, 19 bp, Homo sapiens
cttccacctcacaactcct

SEQ ID NO: 3540076 - DNA, 22 bp, Homo sapiens
cttccacctcacaactccttcc

SEQ ID NO: 3540077 - DNA, 18 bp, Homo sapiens
cttccccaggctgcccac

SEQ ID NO: 3540078 - DNA, 12 bp, Homo sapiens
cttctggccttt

SEQ ID NO: 3540079 - DNA, 21 bp, Homo sapiens
cttgactgaagcgaacatctt

SEQ ID NO: 3540080 - DNA, 14 bp, Homo sapiens
cttgggcaccagct

SEQ ID NO: 3540081 - DNA, 15 bp, Homo sapiens
cttgggcaccagctt

SEQ ID NO: 3540082 - DNA, 20 bp, Homo sapiens
cttgggcaccagcttctttc

SEQ ID NO: 3540083 - DNA, 20 bp, Homo sapiens
cttgtgatcctttggggctt

SEQ ID NO: 3540084 - DNA, 16 bp, Homo sapiens
ctttcccctttctctt

SEQ ID NO: 3540085 - DNA, 18 bp, Homo sapiens
ctttcctgctgtcttctc

SEQ ID NO: 3540086 - DNA, 15 bp, Homo sapiens
ctttctcctggtgtt

SEQ ID NO: 3540087 - DNA, 23 bp, Homo sapiens
ctttctcgtgggtcctttggcag

SEQ ID NO: 3540088 - DNA, 13 bp, Homo sapiens
ctttgctttctcg

SEQ ID NO: 3540089 - DNA, 21 bp, Homo sapiens
ctttgggatatgctgtatttt

SEQ ID NO: 3540090 - DNA, 12 bp, Homo sapiens
cttttaagaaag

SEQ ID NO: 3540091 - DNA, 14 bp, Homo sapiens
cttttaagaaagct

SEQ ID NO: 3540092 - DNA, 22 bp, Homo sapiens
gaaacagttccattcaactgga

SEQ ID NO: 3540093 - DNA, 16 bp, Homo sapiens
gaaactctggtgccgg

SEQ ID NO: 3540094 - DNA, 21 bp, Homo sapiens
gaaatgcccttcactttctcc

SEQ ID NO: 3540095 - DNA, 22 bp, Homo sapiens
gaaatgcccttcactttctcct

SEQ ID NO: 3540096 - DNA, 16 bp, Homo sapiens
gaaatggaaacacaca

SEQ ID NO: 3540097 - DNA, 17 bp, Homo sapiens
gaacagtctctggaaga

SEQ ID NO: 3540098 - DNA, 16 bp, Homo sapiens
gaacatcttcatataa

SEQ ID NO: 3540099 - DNA, 14 bp, Homo sapiens
gaaccgagtcagaa

SEQ ID NO: 3540100 - DNA, 18 bp, Homo sapiens
gaagtgactgtaccactt

SEQ ID NO: 3540101 - DNA, 17 bp, Homo sapiens
gaataatttctgttgtt

SEQ ID NO: 3540102 - DNA, 17 bp, Homo sapiens
gaattcatactctgttg

SEQ ID NO: 3540103 - DNA, 20 bp, Homo sapiens
gaattcatactctgttgcct

SEQ ID NO: 3540104 - DNA, 23 bp, Homo sapiens
gaattcatactctgttgcctcct

SEQ ID NO: 3540105 - DNA, 11 bp, Homo sapiens
gacaagcaggc

SEQ ID NO: 3540106 - DNA, 18 bp, Homo sapiens
gacaagcaggcaggcagc

SEQ ID NO: 3540107 - DNA, 12 bp, Homo sapiens
gacacacacaca

SEQ ID NO: 3540108 - DNA, 13 bp, Homo sapiens
gacacacacacac

SEQ ID NO: 3540109 - DNA, 14 bp, Homo sapiens
gacatgtaaaaaga

SEQ ID NO: 3540110 - DNA, 17 bp, Homo sapiens
gacatgtaaaaagacaa

SEQ ID NO: 3540111 - DNA, 13 bp, Homo sapiens
gacccgctggggg

SEQ ID NO: 3540112 - DNA, 17 bp, Homo sapiens
gacccgctgggggctgg

SEQ ID NO: 3540113 - DNA, 16 bp, Homo sapiens
gactccaggaagaagg

SEQ ID NO: 3540114 - DNA, 16 bp, Homo sapiens
gactgaagcgaacatc

SEQ ID NO: 3540115 - DNA, 18 bp, Homo sapiens
gactgaagcgaacatctt

SEQ ID NO: 3540116 - DNA, 21 bp, Homo sapiens
gagaccggacaagagcctgca

SEQ ID NO: 3540117 - DNA, 11 bp, Homo sapiens
gagatttttaa

SEQ ID NO: 3540118 - DNA, 21 bp, Homo sapiens
gagctcagcctgcctgggaga

SEQ ID NO: 3540119 - DNA, 19 bp, Homo sapiens
gagctcagttgagaaacag

SEQ ID NO: 3540120 - DNA, 13 bp, Homo sapiens
gagggaggggaga

SEQ ID NO: 3540121 - DNA, 19 bp, Homo sapiens
gaggggagagaccacagcc

SEQ ID NO: 3540122 - DNA, 23 bp, Homo sapiens
gagggggttcgcaccgtgctggg

SEQ ID NO: 3540123 - DNA, 16 bp, Homo sapiens
gagtgttggggctggg

SEQ ID NO: 3540124 - DNA, 19 bp, Homo sapiens
gatcctttggggcttctgt

SEQ ID NO: 3540125 - DNA, 18 bp, Homo sapiens
gatgattttaacagtttt

SEQ ID NO: 3540126 - DNA, 14 bp, Homo sapiens
gattcttaccaaga

SEQ ID NO: 3540127 - DNA, 18 bp, Homo sapiens
gcaccagcttctttctcg

SEQ ID NO: 3540128 - DNA, 14 bp, Homo sapiens
gcaccgtgctgggc

SEQ ID NO: 3540129 - DNA, 16 bp, Homo sapiens
gcaccgtgctgggctc

SEQ ID NO: 3540130 - DNA, 12 bp, Homo sapiens
gcactcttgtac

SEQ ID NO: 3540131 - DNA, 19 bp, Homo sapiens
gcagcctgagagctggccc

SEQ ID NO: 3540132 - DNA, 21 bp, Homo sapiens
gcagcggaagggactctgggc

SEQ ID NO: 3540133 - DNA, 23 bp, Homo sapiens
gcagcggaagggactctgggctg

SEQ ID NO: 3540134 - DNA, 14 bp, Homo sapiens
gcagcggggctggc

SEQ ID NO: 3540135 - DNA, 14 bp, Homo sapiens
gcagctggtgtggg

SEQ ID NO: 3540136 - DNA, 18 bp, Homo sapiens
gcagctggtgtgggaact

SEQ ID NO: 3540137 - DNA, 20 bp, Homo sapiens
gcaggcagcctgagagctgg

SEQ ID NO: 3540138 - DNA, 14 bp, Homo sapiens
gcaggcaggcagcc

SEQ ID NO: 3540139 - DNA, 16 bp, Homo sapiens
gcaggcaggcagcctg

SEQ ID NO: 3540140 - DNA, 13 bp, Homo sapiens
gcccactctgggg

SEQ ID NO: 3540141 - DNA, 16 bp, Homo sapiens
gccctcgggtggggct

SEQ ID NO: 3540142 - DNA, 17 bp, Homo sapiens
gccctcgggtggggctg

SEQ ID NO: 3540143 - DNA, 20 bp, Homo sapiens
gccctcgggtggggctggtg

SEQ ID NO: 3540144 - DNA, 22 bp, Homo sapiens
gcccttcactttctcctggtgt

SEQ ID NO: 3540145 - DNA, 23 bp, Homo sapiens
gcccttcactttctcctggtgtt

SEQ ID NO: 3540146 - DNA, 17 bp, Homo sapiens
gcctcacatctcccttc

SEQ ID NO: 3540147 - DNA, 16 bp, Homo sapiens
gcctcctctctccctg

SEQ ID NO: 3540148 - DNA, 18 bp, Homo sapiens
gcctcctctctccctgcc

SEQ ID NO: 3540149 - DNA, 22 bp, Homo sapiens
gcctcctctctccctgcctcac

SEQ ID NO: 3540150 - DNA, 23 bp, Homo sapiens
gcctcctctctccctgcctcaca

SEQ ID NO: 3540151 - DNA, 12 bp, Homo sapiens
gcctgaggctgg

SEQ ID NO: 3540152 - DNA, 13 bp, Homo sapiens
gcctggctgggct

SEQ ID NO: 3540153 - DNA, 19 bp, Homo sapiens
gcgaacatcttcatataaa

SEQ ID NO: 3540154 - DNA, 22 bp, Homo sapiens
gcggaagggactctgggctgtg

SEQ ID NO: 3540155 - DNA, 12 bp, Homo sapiens
gcggggctggcc

SEQ ID NO: 3540156 - DNA, 16 bp, Homo sapiens
gctcagttgagaaaca

SEQ ID NO: 3540157 - DNA, 20 bp, Homo sapiens
gctcagttgagaaacagttc

SEQ ID NO: 3540158 - DNA, 20 bp, Homo sapiens
gctccaggagggcttgagag

SEQ ID NO: 3540159 - DNA, 16 bp, Homo sapiens
gctgcccactctgggg

SEQ ID NO: 3540160 - DNA, 17 bp, Homo sapiens
gctgcccactctgggga

SEQ ID NO: 3540161 - DNA, 18 bp, Homo sapiens
gctgcccactctggggac

SEQ ID NO: 3540162 - DNA, 23 bp, Homo sapiens
gctggcagagggcatcggtcagc

SEQ ID NO: 3540163 - DNA, 13 bp, Homo sapiens
gctgggctctggt

SEQ ID NO: 3540164 - DNA, 13 bp, Homo sapiens
gctgggggctggc

SEQ ID NO: 3540165 - DNA, 15 bp, Homo sapiens
gctgttttaatttgt

SEQ ID NO: 3540166 - DNA, 18 bp, Homo sapiens
gcttccccaggctgccca

SEQ ID NO: 3540167 - DNA, 19 bp, Homo sapiens
gcttctgtgaaaaacctga

SEQ ID NO: 3540168 - DNA, 23 bp, Homo sapiens
ggaagggactctgggctgtgcct

SEQ ID NO: 3540169 - DNA, 19 bp, Homo sapiens
ggaagtctgtgtctaccag

SEQ ID NO: 3540170 - DNA, 20 bp, Homo sapiens
ggacccgctgggggctggca

SEQ ID NO: 3540171 - DNA, 23 bp, Homo sapiens
ggagctcagttgagaaacagttc

SEQ ID NO: 3540172 - DNA, 14 bp, Homo sapiens
ggagtgttggggct

SEQ ID NO: 3540173 - DNA, 18 bp, Homo sapiens
ggcaccagcttctttctc

SEQ ID NO: 3540174 - DNA, 17 bp, Homo sapiens
ggcacgaggctctagaa

SEQ ID NO: 3540175 - DNA, 18 bp, Homo sapiens
ggcagcctgagagctggc

SEQ ID NO: 3540176 - DNA, 19 bp, Homo sapiens
ggcagcctgagagctggcc

SEQ ID NO: 3540177 - DNA, 21 bp, Homo sapiens
ggcagcctgagagctggccca

SEQ ID NO: 3540178 - DNA, 16 bp, Homo sapiens
ggcagcggggctggcc

SEQ ID NO: 3540179 - DNA, 18 bp, Homo sapiens
ggcaggggaaactctggt

SEQ ID NO: 3540180 - DNA, 22 bp, Homo sapiens
ggcatcggtcagcggggcagcg

SEQ ID NO: 3540181 - DNA, 11 bp, Homo sapiens
ggccagctcca

SEQ ID NO: 3540182 - DNA, 23 bp, Homo sapiens
ggccagctccaggagggcttgag

SEQ ID NO: 3540183 - DNA, 20 bp, Homo sapiens
ggcccaggggtcccctggca

SEQ ID NO: 3540184 - DNA, 23 bp, Homo sapiens
ggctctagaaatgcccttcactt

SEQ ID NO: 3540185 - DNA, 16 bp, Homo sapiens
ggctgcccactctggg

SEQ ID NO: 3540186 - DNA, 17 bp, Homo sapiens
ggctgcccactctgggg

SEQ ID NO: 3540187 - DNA, 19 bp, Homo sapiens
ggctgcccactctggggac

SEQ ID NO: 3540188 - DNA, 11 bp, Homo sapiens
ggctggtgggt

SEQ ID NO: 3540189 - DNA, 22 bp, Homo sapiens
ggctgtgcctgaggctggctgg

SEQ ID NO: 3540190 - DNA, 22 bp, Homo sapiens
ggcttctttgctttctcgtggg

SEQ ID NO: 3540191 - DNA, 18 bp, Homo sapiens
ggctttgtggaaacagct

SEQ ID NO: 3540192 - DNA, 11 bp, Homo sapiens
gggacagtttg

SEQ ID NO: 3540193 - DNA, 21 bp, Homo sapiens
gggacccgctgggggctggca

SEQ ID NO: 3540194 - DNA, 20 bp, Homo sapiens
gggactctgggctgtgcctg

SEQ ID NO: 3540195 - DNA, 21 bp, Homo sapiens
gggactctgggctgtgcctga

SEQ ID NO: 3540196 - DNA, 15 bp, Homo sapiens
gggcagcggggctgg

SEQ ID NO: 3540197 - DNA, 18 bp, Homo sapiens
gggcagcggggctggcca

SEQ ID NO: 3540198 - DNA, 22 bp, Homo sapiens
gggcagcggggctggccatgag

SEQ ID NO: 3540199 - DNA, 20 bp, Homo sapiens
gggcaggacaacacagctgc

SEQ ID NO: 3540200 - DNA, 24 bp, Homo sapiens
gggccagctccaggagggcttgag

SEQ ID NO: 3540201 - DNA, 11 bp, Homo sapiens
gggctggccat

SEQ ID NO: 3540202 - DNA, 13 bp, Homo sapiens
gggcttgagagct

SEQ ID NO: 3540203 - DNA, 15 bp, Homo sapiens
ggggaaactctggtg

SEQ ID NO: 3540204 - DNA, 17 bp, Homo sapiens
ggggacccgctgggggc

SEQ ID NO: 3540205 - DNA, 14 bp, Homo sapiens
ggggccagctccag

SEQ ID NO: 3540206 - DNA, 13 bp, Homo sapiens
gggtggggctggt

SEQ ID NO: 3540207 - DNA, 20 bp, Homo sapiens
ggtcagcggggcagcggggc

SEQ ID NO: 3540208 - DNA, 23 bp, Homo sapiens
ggtcagcggggcagcggggctgg

SEQ ID NO: 3540209 - DNA, 22 bp, Homo sapiens
ggtcatgaattcatactctgtt

SEQ ID NO: 3540210 - DNA, 23 bp, Homo sapiens
ggtccaccttcagccctttggct

SEQ ID NO: 3540211 - DNA, 16 bp, Homo sapiens
ggtctgcagctggtgt

SEQ ID NO: 3540212 - DNA, 13 bp, Homo sapiens
ggtctgtttaaat

SEQ ID NO: 3540213 - DNA, 17 bp, Homo sapiens
ggtgggtctgcagctgg

SEQ ID NO: 3540214 - DNA, 15 bp, Homo sapiens
ggtttcccctttctt

SEQ ID NO: 3540215 - DNA, 13 bp, Homo sapiens
ggtttcttctctg

SEQ ID NO: 3540216 - DNA, 13 bp, Homo sapiens
gtaaagcaaactg

SEQ ID NO: 3540217 - DNA, 18 bp, Homo sapiens
gtaaagcaaactggggct

SEQ ID NO: 3540218 - DNA, 22 bp, Homo sapiens
gtaaagcaaactggggctgtgt

SEQ ID NO: 3540219 - DNA, 19 bp, Homo sapiens
gtaacttgggctgtaaagc

SEQ ID NO: 3540220 - DNA, 22 bp, Homo sapiens
gtacataccggggctcctctcc

SEQ ID NO: 3540221 - DNA, 11 bp, Homo sapiens
gtactgtaaac

SEQ ID NO: 3540222 - DNA, 16 bp, Homo sapiens
gtactgtaaacagttc

SEQ ID NO: 3540223 - DNA, 17 bp, Homo sapiens
gtactgtaaacagttct

SEQ ID NO: 3540224 - DNA, 15 bp, Homo sapiens
gtatatttctgggtt

SEQ ID NO: 3540225 - DNA, 18 bp, Homo sapiens
gtcaactgtatgtacata

SEQ ID NO: 3540226 - DNA, 15 bp, Homo sapiens
gtcagcctggctggg

SEQ ID NO: 3540227 - DNA, 22 bp, Homo sapiens
gtcagcctggctgggctctggt

SEQ ID NO: 3540228 - DNA, 20 bp, Homo sapiens
gtcagcggggcagcggggct

SEQ ID NO: 3540229 - DNA, 14 bp, Homo sapiens
gtcctttggcaggc

SEQ ID NO: 3540230 - DNA, 14 bp, Homo sapiens
gtcgttcaattcat

SEQ ID NO: 3540231 - DNA, 13 bp, Homo sapiens
gtctcctcccagg

SEQ ID NO: 3540232 - DNA, 19 bp, Homo sapiens
gtgcctgaggctggctggg

SEQ ID NO: 3540233 - DNA, 16 bp, Homo sapiens
gtgctgggctccccct

SEQ ID NO: 3540234 - DNA, 19 bp, Homo sapiens
gtggctggtggtcatgaat

SEQ ID NO: 3540235 - DNA, 13 bp, Homo sapiens
tgagaaacagttc

SEQ ID NO: 3540236 - DNA, 15 bp, Homo sapiens
tgagaaacagttcca

SEQ ID NO: 3540237 - DNA, 18 bp, Homo sapiens
tgagaaacagttccattc

SEQ ID NO: 3540238 - DNA, 21 bp, Homo sapiens
tgagagctcagcctgcctggg

SEQ ID NO: 3540239 - DNA, 13 bp, Homo sapiens
tgagagctggccc

SEQ ID NO: 3540240 - DNA, 16 bp, Homo sapiens
tgaggctggctggggg

SEQ ID NO: 3540241 - DNA, 20 bp, Homo sapiens
tgaggctggctgggggcagg

SEQ ID NO: 3540242 - DNA, 21 bp, Homo sapiens
tgaggctggctgggggcagga

SEQ ID NO: 3540243 - DNA, 16 bp, Homo sapiens
tgatcatatttgtgtg

SEQ ID NO: 3540244 - DNA, 17 bp, Homo sapiens
tgatcatgatgatgatg

SEQ ID NO: 3540245 - DNA, 18 bp, Homo sapiens
tgatgatcatgatgatga

SEQ ID NO: 3540246 - DNA, 17 bp, Homo sapiens
tgatgattttaacagtt

SEQ ID NO: 3540247 - DNA, 22 bp, Homo sapiens
tgcagcggaagggactctgggc

SEQ ID NO: 3540248 - DNA, 13 bp, Homo sapiens
tgcagctggtgtg

SEQ ID NO: 3540249 - DNA, 14 bp, Homo sapiens
tgcccactctgggg

SEQ ID NO: 3540250 - DNA, 16 bp, Homo sapiens
tgccctccctctctgc

SEQ ID NO: 3540251 - DNA, 16 bp, Homo sapiens
tgcctcacatctccct

SEQ ID NO: 3540252 - DNA, 22 bp, Homo sapiens
tgcctcctctctccctgcctca

SEQ ID NO: 3540253 - DNA, 14 bp, Homo sapiens
tgcctgaggctggc

SEQ ID NO: 3540254 - DNA, 17 bp, Homo sapiens
tgcctgaggctggctgg

SEQ ID NO: 3540255 - DNA, 23 bp, Homo sapiens
tggacatgtaaaaagacaaaaac

SEQ ID NO: 3540256 - DNA, 16 bp, Homo sapiens
tggcaggcctcccttt

SEQ ID NO: 3540257 - DNA, 18 bp, Homo sapiens
tggcaggggaaactctgg

SEQ ID NO: 3540258 - DNA, 14 bp, Homo sapiens
tggctgggggcagg

SEQ ID NO: 3540259 - DNA, 15 bp, Homo sapiens
tggctgggggcagga

SEQ ID NO: 3540260 - DNA, 14 bp, Homo sapiens
tggcttctttgctt

SEQ ID NO: 3540261 - DNA, 19 bp, Homo sapiens
tggcttctttgctttctcg

SEQ ID NO: 3540262 - DNA, 15 bp, Homo sapiens
tgggattgtgttaaa

SEQ ID NO: 3540263 - DNA, 19 bp, Homo sapiens
tgggcaccagcttctttct

SEQ ID NO: 3540264 - DNA, 21 bp, Homo sapiens
tgggcaccagcttctttctcg

SEQ ID NO: 3540265 - DNA, 20 bp, Homo sapiens
tgggccctcaagctttcctg

SEQ ID NO: 3540266 - DNA, 20 bp, Homo sapiens
tgggctgtgcctgaggctgg

SEQ ID NO: 3540267 - DNA, 17 bp, Homo sapiens
tggggacccgctggggg

SEQ ID NO: 3540268 - DNA, 14 bp, Homo sapiens
tggggctggtgggt

SEQ ID NO: 3540269 - DNA, 16 bp, Homo sapiens
tggggctggtgggtct

SEQ ID NO: 3540270 - DNA, 14 bp, Homo sapiens
tgggggccagctcc

SEQ ID NO: 3540271 - DNA, 11 bp, Homo sapiens
tgggggctggc

SEQ ID NO: 3540272 - DNA, 17 bp, Homo sapiens
tgggggctggcagaggg

SEQ ID NO: 3540273 - DNA, 14 bp, Homo sapiens
tgggtctgcagctg

SEQ ID NO: 3540274 - DNA, 22 bp, Homo sapiens
tggtcatgaattcatactctgt

SEQ ID NO: 3540275 - DNA, 16 bp, Homo sapiens
tggtttcccctttctt

SEQ ID NO: 3540276 - DNA, 21 bp, Homo sapiens
tggttttgccctccctctctg

SEQ ID NO: 3540277 - DNA, 23 bp, Homo sapiens
tgtaacttgggctgtaaagcaaa

SEQ ID NO: 3540278 - DNA, 11 bp, Homo sapiens
tgtacaaaaga

SEQ ID NO: 3540279 - DNA, 15 bp, Homo sapiens
tgtacataccggggc

SEQ ID NO: 3540280 - DNA, 23 bp, Homo sapiens
tgtagcacggagtgttggggctg

SEQ ID NO: 3540281 - DNA, 22 bp, Homo sapiens
tgtatagctgaaattccagttt

SEQ ID NO: 3540282 - DNA, 14 bp, Homo sapiens
tgtatatacacatc

SEQ ID NO: 3540283 - DNA, 24 bp, Homo sapiens
tgtattttaaagggacagtttgta

SEQ ID NO: 3540284 - DNA, 17 bp, Homo sapiens
tgtcaaaaagcaactga

SEQ ID NO: 3540285 - DNA, 20 bp, Homo sapiens
tgtctcctcccaggtttctt

SEQ ID NO: 3540286 - DNA, 22 bp, Homo sapiens
tgtctcctcccaggtttcttct

SEQ ID NO: 3540287 - DNA, 22 bp, Homo sapiens
tgtctgcagcaccgtgggccct

SEQ ID NO: 3540288 - DNA, 19 bp, Homo sapiens
tgtgcctgaggctggctgg

SEQ ID NO: 3540289 - DNA, 12 bp, Homo sapiens
tgtggaaacagc

SEQ ID NO: 3540290 - DNA, 19 bp, Homo sapiens
tgtggaaacagctggtact

SEQ ID NO: 3540291 - DNA, 18 bp, Homo sapiens
tgtggtttcccctttctt

SEQ ID NO: 3540292 - DNA, 23 bp, Homo sapiens
tgtggtttcccctttctttcctt

SEQ ID NO: 3540293 - DNA, 21 bp, Homo sapiens
tgttgcctcctctctccctgc

SEQ ID NO: 3540294 - DNA, 20 bp, Homo sapiens
tgtttatcacctttattgaa

SEQ ID NO: 3540295 - DNA, 17 bp, Homo sapiens
tgtttatgtactgtaaa

SEQ ID NO: 3540296 - DNA, 20 bp, Homo sapiens
tgtttcagtgccatttgtta

SEQ ID NO: 3540297 - DNA, 21 bp, Homo sapiens
tgtttcagtgccatttgttaa

SEQ ID NO: 3540298 - DNA, 13 bp, Homo sapiens
tgtttcctgttct

SEQ ID NO: 3540299 - DNA, 16 bp, Homo sapiens
tgttttcgatgatgat

SEQ ID NO: 3540300 - DNA, 15 bp, Homo sapiens
tgtttttctctctgg

SEQ ID NO: 3540301 - DNA, 16 bp, Homo sapiens
ttaaagggacagtttg

SEQ ID NO: 3540302 - DNA, 17 bp, Homo sapiens
ttaagaaagcttcttgt

SEQ ID NO: 3540303 - DNA, 18 bp, Homo sapiens
ttaagccacaaagtttgt

SEQ ID NO: 3540304 - DNA, 13 bp, Homo sapiens
ttaatatttctaa

SEQ ID NO: 3540305 - DNA, 20 bp, Homo sapiens
ttaatgacattgatttctaa

SEQ ID NO: 3540306 - DNA, 22 bp, Homo sapiens
ttatgacagccctaggaaacta

SEQ ID NO: 3540307 - DNA, 15 bp, Homo sapiens
ttattgtaaagttta

SEQ ID NO: 3540308 - DNA, 17 bp, Homo sapiens
ttcagccctttggcttc

SEQ ID NO: 3540309 - DNA, 18 bp, Homo sapiens
ttcagccctttggcttca

SEQ ID NO: 3540310 - DNA, 16 bp, Homo sapiens
ttcatacctgtgaata

SEQ ID NO: 3540311 - DNA, 21 bp, Homo sapiens
ttcatactctgttgcctcctc

SEQ ID NO: 3540312 - DNA, 15 bp, Homo sapiens
ttcatgtctaagaac

SEQ ID NO: 3540313 - DNA, 18 bp, Homo sapiens
ttccacgctgatgtttat

SEQ ID NO: 3540314 - DNA, 18 bp, Homo sapiens
ttccatccttgactgaag

SEQ ID NO: 3540315 - DNA, 19 bp, Homo sapiens
ttcccaccttgtcgctgaa

SEQ ID NO: 3540316 - DNA, 18 bp, Homo sapiens
ttcctgctgtcttctccc

SEQ ID NO: 3540317 - DNA, 23 bp, Homo sapiens
ttcctgttctcttgtatagctga

SEQ ID NO: 3540318 - DNA, 13 bp, Homo sapiens
ttcgatgatgatg

SEQ ID NO: 3540319 - DNA, 19 bp, Homo sapiens
ttcgcaccgtgctgggctc

SEQ ID NO: 3540320 - DNA, 23 bp, Homo sapiens
ttctcctggtgtttttctctctg

SEQ ID NO: 3540321 - DNA, 21 bp, Homo sapiens
ttctctctggacccttctgaa

SEQ ID NO: 3540322 - DNA, 23 bp, Homo sapiens
ttctgggttctcaattctgtctc

SEQ ID NO: 3540323 - DNA, 13 bp, Homo sapiens
ttcttctctggag

SEQ ID NO: 3540324 - DNA, 19 bp, Homo sapiens
ttcttctctggagaagttt

SEQ ID NO: 3540325 - DNA, 13 bp, Homo sapiens
ttctttgctttct

SEQ ID NO: 3540326 - DNA, 19 bp, Homo sapiens
ttgactgaagcgaacatct

SEQ ID NO: 3540327 - DNA, 20 bp, Homo sapiens
ttgactgaagcgaacatctt

SEQ ID NO: 3540328 - DNA, 11 bp, Homo sapiens
ttggggctggg

SEQ ID NO: 3540329 - DNA, 15 bp, Homo sapiens
ttggggctgggggcc

SEQ ID NO: 3540330 - DNA, 13 bp, Homo sapiens
ttgtacaaaagaa

SEQ ID NO: 3540331 - DNA, 16 bp, Homo sapiens
ttgtgtggtttcccct

SEQ ID NO: 3540332 - DNA, 22 bp, Homo sapiens
ttgtgtggtttcccctttcttt

SEQ ID NO: 3540333 - DNA, 21 bp, Homo sapiens
tttaaagggacagtttgtaac

SEQ ID NO: 3540334 - DNA, 20 bp, Homo sapiens
tttaagaaagcttcttgtga

SEQ ID NO: 3540335 - DNA, 19 bp, Homo sapiens
tttaagcaacaaaactatg

SEQ ID NO: 3540336 - DNA, 15 bp, Homo sapiens
tttaatactgttgtc

SEQ ID NO: 3540337 - DNA, 20 bp, Homo sapiens
tttaatgggattgtgttaaa

SEQ ID NO: 3540338 - DNA, 19 bp, Homo sapiens
tttccacgctgatgtttat

SEQ ID NO: 3540339 - DNA, 14 bp, Homo sapiens
tttcccctttctct

SEQ ID NO: 3540340 - DNA, 13 bp, Homo sapiens
tttcccctttctt

SEQ ID NO: 3540341 - DNA, 21 bp, Homo sapiens
tttctcctggtgtttttctct

SEQ ID NO: 3540342 - DNA, 13 bp, Homo sapiens
tttctctctggac

SEQ ID NO: 3540343 - DNA, 22 bp, Homo sapiens
tttctctttcctcatttcctag

SEQ ID NO: 3540344 - DNA, 12 bp, Homo sapiens
tttcttctctgg

SEQ ID NO: 3540345 - DNA, 14 bp, Homo sapiens
tttgaagtcagaga

SEQ ID NO: 3540346 - DNA, 17 bp, Homo sapiens
tttgccctccctctctg

SEQ ID NO: 3540347 - DNA, 18 bp, Homo sapiens
tttgccctccctctctgc

SEQ ID NO: 3540348 - DNA, 21 bp, Homo sapiens
tttggcttcaaggatggagat

SEQ ID NO: 3540349 - DNA, 14 bp, Homo sapiens
ttttaacagtttta

SEQ ID NO: 3540350 - DNA, 13 bp, Homo sapiens
ttttaagaaagct

SEQ ID NO: 3540351 - DNA, 20 bp, Homo sapiens
ttttatgtattgtgctttta

SEQ ID NO: 3540352 - DNA, 18 bp, Homo sapiens
ttttcccaccttgtcgct

SEQ ID NO: 3540353 - DNA, 10 bp, Homo sapiens
ttttctctct

SEQ ID NO: 3540354 - DNA, 13 bp, Homo sapiens
tttttctctctgg

SEQ ID NO: 3540355 - DNA, 15 bp, Homo sapiens
tttttctctctggac

SEQ ID NO: 3540356 - DNA, 19 bp, Homo sapiens
tttttgccacaaagaagat

SEQ ID NO: 3540357 - DNA, 17 bp, Homo sapiens
caagctttcctgctgtc

SEQ ID NO: 3540358 - DNA, 22 bp, Homo sapiens
caagcttttttgccacaaagaa

SEQ ID NO: 3540359 - DNA, 21 bp, Homo sapiens
caaggaagtctgtgtctacca

SEQ ID NO: 3540360 - DNA, 22 bp, Homo sapiens
caattctgtctcattgattgat

SEQ ID NO: 3540361 - DNA, 20 bp, Homo sapiens
cacaagccaaggaagtctgt

SEQ ID NO: 3540362 - DNA, 21 bp, Homo sapiens
cacaagccaaggaagtctgtg

SEQ ID NO: 3540363 - DNA, 13 bp, Homo sapiens
cacatctcccttc

SEQ ID NO: 3540364 - DNA, 17 bp, Homo sapiens
caccgtgggccctcaag

SEQ ID NO: 3540365 - DNA, 21 bp, Homo sapiens
caccgtgggccctcaagcttt

SEQ ID NO: 3540366 - DNA, 22 bp, Homo sapiens
cacgctgatgtttatgtactgt

SEQ ID NO: 3540367 - DNA, 12 bp, Homo sapiens
cactctggggac

SEQ ID NO: 3540368 - DNA, 23 bp, Homo sapiens
cactttctcctggtgtttttctc

SEQ ID NO: 3540369 - DNA, 16 bp, Homo sapiens
cagaactgtgagagaa

SEQ ID NO: 3540370 - DNA, 19 bp, Homo sapiens
cagaatatttttgaaagct

SEQ ID NO: 3540371 - DNA, 20 bp, Homo sapiens
cagcaccgtgggccctcaag

SEQ ID NO: 3540372 - DNA, 17 bp, Homo sapiens
cagccctttggcttcaa

SEQ ID NO: 3540373 - DNA, 16 bp, Homo sapiens
cagcctgcctgggaga

SEQ ID NO: 3540374 - DNA, 19 bp, Homo sapiens
cagcggaagggactctggg

SEQ ID NO: 3540375 - DNA, 21 bp, Homo sapiens
cagcggaagggactctgggct

SEQ ID NO: 3540376 - DNA, 21 bp, Homo sapiens
cagcggggcagcggggctggc

SEQ ID NO: 3540377 - DNA, 20 bp, Homo sapiens
cagctggtactgatgttcac

SEQ ID NO: 3540378 - DNA, 13 bp, Homo sapiens
cagcttctttctc

SEQ ID NO: 3540379 - DNA, 15 bp, Homo sapiens
caggacaacacagct

SEQ ID NO: 3540380 - DNA, 21 bp, Homo sapiens
caggcagcctgagagctggcc

SEQ ID NO: 3540381 - DNA, 17 bp, Homo sapiens
caggggaaactctggtg

SEQ ID NO: 3540382 - DNA, 18 bp, Homo sapiens
caggtttcttctctggag

SEQ ID NO: 3540383 - DNA, 17 bp, Homo sapiens
cagtcagcctggctggg

SEQ ID NO: 3540384 - DNA, 18 bp, Homo sapiens
cagtcagcctggctgggc

SEQ ID NO: 3540385 - DNA, 19 bp, Homo sapiens
cagtcagcctggctgggct

SEQ ID NO: 3540386 - DNA, 23 bp, Homo sapiens
cagtgctccatccaaactcagaa

SEQ ID NO: 3540387 - DNA, 16 bp, Homo sapiens
cagtgggttaattttg

SEQ ID NO: 3540388 - DNA, 20 bp, Homo sapiens
cagttccattcaactggaac

SEQ ID NO: 3540389 - DNA, 22 bp, Homo sapiens
cagttccattcaactggaacat

SEQ ID NO: 3540390 - DNA, 19 bp, Homo sapiens
cagttctgcactcttgtac

SEQ ID NO: 3540391 - DNA, 14 bp, Homo sapiens
catactctgttgcc

SEQ ID NO: 3540392 - DNA, 22 bp, Homo sapiens
catactctgttgcctcctctct

SEQ ID NO: 3540393 - DNA, 13 bp, Homo sapiens
catatctccttta

SEQ ID NO: 3540394 - DNA, 12 bp, Homo sapiens
catccaagctta

SEQ ID NO: 3540395 - DNA, 16 bp, Homo sapiens
catccttgactgaagc

SEQ ID NO: 3540396 - DNA, 23 bp, Homo sapiens
catctattttaccatatgtttat

SEQ ID NO: 3540397 - DNA, 15 bp, Homo sapiens
catgaattcatactc

SEQ ID NO: 3540398 - DNA, 18 bp, Homo sapiens
catgaattcatactctgt

SEQ ID NO: 3540399 - DNA, 19 bp, Homo sapiens
catgaattcatactctgtt

SEQ ID NO: 3540400 - DNA, 16 bp, Homo sapiens
catgatgatgatgatt

SEQ ID NO: 3540401 - DNA, 21 bp, Homo sapiens
catgatgatgatgattttaac

SEQ ID NO: 3540402 - DNA, 14 bp, Homo sapiens
catgtaaaaagaca

SEQ ID NO: 3540403 - DNA, 16 bp, Homo sapiens
catgtaaaaagacaaa

SEQ ID NO: 3540404 - DNA, 15 bp, Homo sapiens
catgtggagaaggtg

SEQ ID NO: 3540405 - DNA, 20 bp, Homo sapiens
cattgatgccaagctttttt

SEQ ID NO: 3540406 - DNA, 15 bp, Homo sapiens
cattgttcattcttg

SEQ ID NO: 3540407 - DNA, 16 bp, Homo sapiens
ccaacattgttcattc

SEQ ID NO: 3540408 - DNA, 18 bp, Homo sapiens
ccaagagtgggctttgtg

SEQ ID NO: 3540409 - DNA, 17 bp, Homo sapiens
ccaaggaagtctgtgtc

SEQ ID NO: 3540410 - DNA, 14 bp, Homo sapiens
ccagcttctttctc

SEQ ID NO: 3540411 - DNA, 16 bp, Homo sapiens
ccagcttctttctcgg

SEQ ID NO: 3540412 - DNA, 17 bp, Homo sapiens
ccagcttctttctcggt

SEQ ID NO: 3540413 - DNA, 15 bp, Homo sapiens
ccaggaagaaggtgt

SEQ ID NO: 3540414 - DNA, 19 bp, Homo sapiens
ccaggctgcccactctggg

SEQ ID NO: 3540415 - DNA, 17 bp, Homo sapiens
ccaggggtcccctggca

SEQ ID NO: 3540416 - DNA, 18 bp, Homo sapiens
ccaggggtcccctggcag

SEQ ID NO: 3540417 - DNA, 14 bp, Homo sapiens
ccaggtttcttctc

SEQ ID NO: 3540418 - DNA, 20 bp, Homo sapiens
ccatccttgactgaagcgaa

SEQ ID NO: 3540419 - DNA, 17 bp, Homo sapiens
cccaccttgtcgctgaa

SEQ ID NO: 3540420 - DNA, 15 bp, Homo sapiens
cccaggggtcccctg

SEQ ID NO: 3540421 - DNA, 20 bp, Homo sapiens
cccaggtttcttctctggag

SEQ ID NO: 3540422 - DNA, 21 bp, Homo sapiens
cccaggtttcttctctggaga

SEQ ID NO: 3540423 - DNA, 14 bp, Homo sapiens
cccatatctccttt

SEQ ID NO: 3540424 - DNA, 20 bp, Homo sapiens
ccccagtcagcctggctggg

SEQ ID NO: 3540425 - DNA, 16 bp, Homo sapiens
ccccgcagtgccctgc

SEQ ID NO: 3540426 - DNA, 23 bp, Homo sapiens
cccctggcaggggaaactctggt

SEQ ID NO: 3540427 - DNA, 12 bp, Homo sapiens
cccctttctctt

SEQ ID NO: 3540428 - DNA, 15 bp, Homo sapiens
ccctcctcctccttt

SEQ ID NO: 3540429 - DNA, 13 bp, Homo sapiens
ccctctctgccct

SEQ ID NO: 3540430 - DNA, 11 bp, Homo sapiens
ccctgcctcac

SEQ ID NO: 3540431 - DNA, 14 bp, Homo sapiens
ccctgcctcacatc

SEQ ID NO: 3540432 - DNA, 17 bp, Homo sapiens
ccctgcctcacatctcc

SEQ ID NO: 3540433 - DNA, 17 bp, Homo sapiens
cccttctgaagcagaga

SEQ ID NO: 3540434 - DNA, 9 bp, Homo sapiens
ccctttctc

SEQ ID NO: 3540435 - DNA, 15 bp, Homo sapiens
ccgctgggggctggc

SEQ ID NO: 3540436 - DNA, 21 bp, Homo sapiens
ccgctgggggctggcagaggg

SEQ ID NO: 3540437 - DNA, 20 bp, Homo sapiens
cctcacaactccttccatcc

SEQ ID NO: 3540438 - DNA, 21 bp, Homo sapiens
cctcacaactccttccatcct

SEQ ID NO: 3540439 - DNA, 22 bp, Homo sapiens
cctcccaggtttcttctctgga

SEQ ID NO: 3540440 - DNA, 13 bp, Homo sapiens
cctccctctctgc

SEQ ID NO: 3540441 - DNA, 12 bp, Homo sapiens
cctcctcctttc

SEQ ID NO: 3540442 - DNA, 17 bp, Homo sapiens
cctcctctctccctgcc

SEQ ID NO: 3540443 - DNA, 22 bp, Homo sapiens
cctcctctctccctgcctcaca

SEQ ID NO: 3540444 - DNA, 18 bp, Homo sapiens
cctcctttcccctttctc

SEQ ID NO: 3540445 - DNA, 20 bp, Homo sapiens
cctcgggtggggctggtggg

SEQ ID NO: 3540446 - DNA, 18 bp, Homo sapiens
cctctctccctgcctcac

SEQ ID NO: 3540447 - DNA, 13 bp, Homo sapiens
cctgaggctggct

SEQ ID NO: 3540448 - DNA, 18 bp, Homo sapiens
cctgaggctggctggggg

SEQ ID NO: 3540449 - DNA, 19 bp, Homo sapiens
cctgccccagtcagcctgg

SEQ ID NO: 3540450 - DNA, 13 bp, Homo sapiens
cctgcctcacatc

SEQ ID NO: 3540451 - DNA, 15 bp, Homo sapiens
cctgcctgggagagc

SEQ ID NO: 3540452 - DNA, 15 bp, Homo sapiens
cctgctgtcttctcc

SEQ ID NO: 3540453 - DNA, 17 bp, Homo sapiens
cctggctgggctctggt

SEQ ID NO: 3540454 - DNA, 18 bp, Homo sapiens
cctggctgggctctggtg

SEQ ID NO: 3540455 - DNA, 20 bp, Homo sapiens
cctggctgggctctggtggg

SEQ ID NO: 3540456 - DNA, 22 bp, Homo sapiens
cctgtctcctcccaggtttctt

SEQ ID NO: 3540457 - DNA, 16 bp, Homo sapiens
ggggcagcggggctgg

SEQ ID NO: 3540458 - DNA, 17 bp, Homo sapiens
ggggcagcggggctggc

SEQ ID NO: 3540459 - DNA, 22 bp, Homo sapiens
ggggccagctccaggagggctt

SEQ ID NO: 3540460 - DNA, 15 bp, Homo sapiens
ggggctggcagaggg

SEQ ID NO: 3540461 - DNA, 20 bp, Homo sapiens
gggggttcgcaccgtgctgg

SEQ ID NO: 3540462 - DNA, 16 bp, Homo sapiens
gggtggggctggtggg

SEQ ID NO: 3540463 - DNA, 16 bp, Homo sapiens
gggttctcaattctgt

SEQ ID NO: 3540464 - DNA, 21 bp, Homo sapiens
ggtcagcggggcagcggggct

SEQ ID NO: 3540465 - DNA, 17 bp, Homo sapiens
ggtcctttggcaggcct

SEQ ID NO: 3540466 - DNA, 21 bp, Homo sapiens
ggtcctttgttggcttctttg

SEQ ID NO: 3540467 - DNA, 11 bp, Homo sapiens
ggtggggctgg

SEQ ID NO: 3540468 - DNA, 20 bp, Homo sapiens
ggttcgcaccgtgctgggct

SEQ ID NO: 3540469 - DNA, 15 bp, Homo sapiens
ggtttcttctctgga

SEQ ID NO: 3540470 - DNA, 17 bp, Homo sapiens
ggtttcttctctggaga

SEQ ID NO: 3540471 - DNA, 18 bp, Homo sapiens
ggttttgccctccctctc

SEQ ID NO: 3540472 - DNA, 20 bp, Homo sapiens
ggttttgccctccctctctg

SEQ ID NO: 3540473 - DNA, 16 bp, Homo sapiens
gtaaaagttttatagt

SEQ ID NO: 3540474 - DNA, 18 bp, Homo sapiens
gtagcacggagtgttggg

SEQ ID NO: 3540475 - DNA, 20 bp, Homo sapiens
gtagcacggagtgttggggc

SEQ ID NO: 3540476 - DNA, 22 bp, Homo sapiens
gtatagctgaaattccagttta

SEQ ID NO: 3540477 - DNA, 20 bp, Homo sapiens
gtatgtacataccggggctc

SEQ ID NO: 3540478 - DNA, 14 bp, Homo sapiens
gtcagcctggctgg

SEQ ID NO: 3540479 - DNA, 16 bp, Homo sapiens
gtcagcctggctgggc

SEQ ID NO: 3540480 - DNA, 21 bp, Homo sapiens
gtcagcggggcagcggggctg

SEQ ID NO: 3540481 - DNA, 22 bp, Homo sapiens
gtccaccttcagccctttggct

SEQ ID NO: 3540482 - DNA, 17 bp, Homo sapiens
gtcctttgttggcttct

SEQ ID NO: 3540483 - DNA, 18 bp, Homo sapiens
gtcgctgaacctgtctcc

SEQ ID NO: 3540484 - DNA, 16 bp, Homo sapiens
gtctgcagctggtgtg

SEQ ID NO: 3540485 - DNA, 21 bp, Homo sapiens
gtgatcctttggggcttctgt

SEQ ID NO: 3540486 - DNA, 14 bp, Homo sapiens
gtgcctgaggctgg

SEQ ID NO: 3540487 - DNA, 16 bp, Homo sapiens
gtgcctgaggctggct

SEQ ID NO: 3540488 - DNA, 21 bp, Homo sapiens
gtggtcatgaattcatactct

SEQ ID NO: 3540489 - DNA, 21 bp, Homo sapiens
gtgtagtgttaaagtgaatct

SEQ ID NO: 3540490 - DNA, 15 bp, Homo sapiens
gtgtttttctctctg

SEQ ID NO: 3540491 - DNA, 18 bp, Homo sapiens
gtgtttttctctctggac

SEQ ID NO: 3540492 - DNA, 11 bp, Homo sapiens
gttaattttgg

SEQ ID NO: 3540493 - DNA, 18 bp, Homo sapiens
gttcgcaccgtgctgggc

SEQ ID NO: 3540494 - DNA, 15 bp, Homo sapiens
gttctcttgtatagc

SEQ ID NO: 3540495 - DNA, 16 bp, Homo sapiens
gttctgcactcttgta

SEQ ID NO: 3540496 - DNA, 23 bp, Homo sapiens
gttctgcactcttgtacaaaaga

SEQ ID NO: 3540497 - DNA, 14 bp, Homo sapiens
gttgcctcctctct

SEQ ID NO: 3540498 - DNA, 16 bp, Homo sapiens
gttgcctcctctctcc

SEQ ID NO: 3540499 - DNA, 20 bp, Homo sapiens
gttgcctcctctctccctgc

SEQ ID NO: 3540500 - DNA, 22 bp, Homo sapiens
gttgcctcctctctccctgcct

SEQ ID NO: 3540501 - DNA, 23 bp, Homo sapiens
gttgcctcctctctccctgcctc

SEQ ID NO: 3540502 - DNA, 20 bp, Homo sapiens
gttggcttctttgctttctc

SEQ ID NO: 3540503 - DNA, 14 bp, Homo sapiens
gttggggctggggg

SEQ ID NO: 3540504 - DNA, 16 bp, Homo sapiens
gtttatgtactgtaaa

SEQ ID NO: 3540505 - DNA, 14 bp, Homo sapiens
gtttcttctctgga

SEQ ID NO: 3540506 - DNA, 16 bp, Homo sapiens
gtttgtggtaatttgt

SEQ ID NO: 3540507 - DNA, 22 bp, Homo sapiens
gttttacttctggcctttccta

SEQ ID NO: 3540508 - DNA, 17 bp, Homo sapiens
taaacagttctgcactc

SEQ ID NO: 3540509 - DNA, 16 bp, Homo sapiens
taaagggacagtttgt

SEQ ID NO: 3540510 - DNA, 16 bp, Homo sapiens
taacatatatgtatat

SEQ ID NO: 3540511 - DNA, 18 bp, Homo sapiens
taaccaaggctccaataa

SEQ ID NO: 3540512 - DNA, 18 bp, Homo sapiens
taactattttattttttg

SEQ ID NO: 3540513 - DNA, 16 bp, Homo sapiens
taacttgggctgtaaa

SEQ ID NO: 3540514 - DNA, 17 bp, Homo sapiens
taacttgggctgtaaag

SEQ ID NO: 3540515 - DNA, 19 bp, Homo sapiens
taacttgggctgtaaagca

SEQ ID NO: 3540516 - DNA, 16 bp, Homo sapiens
taagaaagcttcttgt

SEQ ID NO: 3540517 - DNA, 18 bp, Homo sapiens
taagccacaaagtttgtg

SEQ ID NO: 3540518 - DNA, 13 bp, Homo sapiens
taatatttctaag

SEQ ID NO: 3540519 - DNA, 21 bp, Homo sapiens
tacataccggggctcctctcc

SEQ ID NO: 3540520 - DNA, 15 bp, Homo sapiens
tactctgttgcctcc

SEQ ID NO: 3540521 - DNA, 17 bp, Homo sapiens
tactctgttgcctcctc

SEQ ID NO: 3540522 - DNA, 18 bp, Homo sapiens
tactctgttgcctcctct

SEQ ID NO: 3540523 - DNA, 22 bp, Homo sapiens
tactctgttgcctcctctctcc

SEQ ID NO: 3540524 - DNA, 17 bp, Homo sapiens
tactgtaaacagttctg

SEQ ID NO: 3540525 - DNA, 14 bp, Homo sapiens
tagctagagaagga

SEQ ID NO: 3540526 - DNA, 16 bp, Homo sapiens
tagctgaaattccagt

SEQ ID NO: 3540527 - DNA, 19 bp, Homo sapiens
tagctgaaattccagttta

SEQ ID NO: 3540528 - DNA, 15 bp, Homo sapiens
tagtgtagtgttaaa

SEQ ID NO: 3540529 - DNA, 17 bp, Homo sapiens
tatgctgtattttaaag

SEQ ID NO: 3540530 - DNA, 13 bp, Homo sapiens
tatggacatgtaa

SEQ ID NO: 3540531 - DNA, 20 bp, Homo sapiens
tatgtactgtaaacagttct

SEQ ID NO: 3540532 - DNA, 20 bp, Homo sapiens
tatttaactctgtaagaaac

SEQ ID NO: 3540533 - DNA, 11 bp, Homo sapiens
tcacaactcct

SEQ ID NO: 3540534 - DNA, 20 bp, Homo sapiens
tcacaactccttccatcctt

SEQ ID NO: 3540535 - DNA, 22 bp, Homo sapiens
tcacaactccttccatccttga

SEQ ID NO: 3540536 - DNA, 13 bp, Homo sapiens
tcacagagaaaaa

SEQ ID NO: 3540537 - DNA, 14 bp, Homo sapiens
tcacatctcccttc

SEQ ID NO: 3540538 - DNA, 22 bp, Homo sapiens
tcacatctcccttccacctcac

SEQ ID NO: 3540539 - DNA, 16 bp, Homo sapiens
tcactttctcctggtg

SEQ ID NO: 3540540 - DNA, 17 bp, Homo sapiens
tcactttctcctggtgt

SEQ ID NO: 3540541 - DNA, 14 bp, Homo sapiens
tcagaaggctttgg

SEQ ID NO: 3540542 - DNA, 14 bp, Homo sapiens
tcagcctgcctggg

SEQ ID NO: 3540543 - DNA, 16 bp, Homo sapiens
tcagcctggctgggct

SEQ ID NO: 3540544 - DNA, 22 bp, Homo sapiens
tcagcggggcagcggggctggc

SEQ ID NO: 3540545 - DNA, 13 bp, Homo sapiens
tcatactctgttg

SEQ ID NO: 3540546 - DNA, 20 bp, Homo sapiens
tcatactctgttgcctcctc

SEQ ID NO: 3540547 - DNA, 20 bp, Homo sapiens
tcccaggtttcttctctgga

SEQ ID NO: 3540548 - DNA, 16 bp, Homo sapiens
tcccatatctccttta

SEQ ID NO: 3540549 - DNA, 21 bp, Homo sapiens
tccccaggctgcccactctgg

SEQ ID NO: 3540550 - DNA, 11 bp, Homo sapiens
tcccctttctc

SEQ ID NO: 3540551 - DNA, 15 bp, Homo sapiens
tcccctttctctttc

SEQ ID NO: 3540552 - DNA, 17 bp, Homo sapiens
tcccttccacctcacaa

SEQ ID NO: 3540553 - DNA, 23 bp, Homo sapiens
tcctaacatatatgtatatacac

SEQ ID NO: 3540554 - DNA, 22 bp, Homo sapiens
tcctcccaggtttcttctctgg

SEQ ID NO: 3540555 - DNA, 23 bp, Homo sapiens
tcctcccaggtttcttctctgga

SEQ ID NO: 3540556 - DNA, 17 bp, Homo sapiens
tcctctctccctgcctc

SEQ ID NO: 3540557 - DNA, 14 bp, Homo sapiens
cctctcctaacata

SEQ ID NO: 3540558 - DNA, 13 bp, Homo sapiens
cctctctccctgc

SEQ ID NO: 3540559 - DNA, 16 bp, Homo sapiens
cctctctccctgcctc

SEQ ID NO: 3540560 - DNA, 20 bp, Homo sapiens
cctctctccctgcctcacat

SEQ ID NO: 3540561 - DNA, 17 bp, Homo sapiens
cctgacgaaatggaaac

SEQ ID NO: 3540562 - DNA, 15 bp, Homo sapiens
cctgagagctggccc

SEQ ID NO: 3540563 - DNA, 14 bp, Homo sapiens
cctgatgcagtgct

SEQ ID NO: 3540564 - DNA, 10 bp, Homo sapiens
cctgcctcac

SEQ ID NO: 3540565 - DNA, 17 bp, Homo sapiens
cctgcctcacatctccc

SEQ ID NO: 3540566 - DNA, 23 bp, Homo sapiens
cctgctgtcttctccctcctcct

SEQ ID NO: 3540567 - DNA, 21 bp, Homo sapiens
cctggcaggggaaactctggt

SEQ ID NO: 3540568 - DNA, 19 bp, Homo sapiens
cctggctgggctctggtgg

SEQ ID NO: 3540569 - DNA, 14 bp, Homo sapiens
cctggtgtttttct

SEQ ID NO: 3540570 - DNA, 21 bp, Homo sapiens
cctggtgtttttctctctgga

SEQ ID NO: 3540571 - DNA, 18 bp, Homo sapiens
cctgttctcttgtatagc

SEQ ID NO: 3540572 - DNA, 21 bp, Homo sapiens
ccttccacctcacaactcctt

SEQ ID NO: 3540573 - DNA, 21 bp, Homo sapiens
ccttgactgaagcgaacatct

SEQ ID NO: 3540574 - DNA, 14 bp, Homo sapiens
cctttatatatgta

SEQ ID NO: 3540575 - DNA, 12 bp, Homo sapiens
cctttggcaggc

SEQ ID NO: 3540576 - DNA, 12 bp, Homo sapiens
cctttggcttca

SEQ ID NO: 3540577 - DNA, 15 bp, Homo sapiens
cctttggggcttctg

SEQ ID NO: 3540578 - DNA, 18 bp, Homo sapiens
cctttggggcttctgtga

SEQ ID NO: 3540579 - DNA, 23 bp, Homo sapiens
cctttggggcttctgtgaaaaac

SEQ ID NO: 3540580 - DNA, 19 bp, Homo sapiens
cgaacatcttcatataaac

SEQ ID NO: 3540581 - DNA, 16 bp, Homo sapiens
cgcaccgtgctgggct

SEQ ID NO: 3540582 - DNA, 15 bp, Homo sapiens
cgctgaacctgtctc

SEQ ID NO: 3540583 - DNA, 16 bp, Homo sapiens
cgctgatgtttatgta

SEQ ID NO: 3540584 - DNA, 16 bp, Homo sapiens
cggaagggactctggg

SEQ ID NO: 3540585 - DNA, 17 bp, Homo sapiens
cggaagggactctgggc

SEQ ID NO: 3540586 - DNA, 23 bp, Homo sapiens
cggaagggactctgggctgtgcc

SEQ ID NO: 3540587 - DNA, 16 bp, Homo sapiens
cggacaagagcctgca

SEQ ID NO: 3540588 - DNA, 11 bp, Homo sapiens
cgggtggggct

SEQ ID NO: 3540589 - DNA, 21 bp, Homo sapiens
cggtcctttgttggcttcttt

SEQ ID NO: 3540590 - DNA, 23 bp, Homo sapiens
ctagaaatgcccttcactttctc

SEQ ID NO: 3540591 - DNA, 13 bp, Homo sapiens
ctataatggggaa

SEQ ID NO: 3540592 - DNA, 16 bp, Homo sapiens
ctcacagagaaaaagt

SEQ ID NO: 3540593 - DNA, 14 bp, Homo sapiens
ctcacatctccctt

SEQ ID NO: 3540594 - DNA, 17 bp, Homo sapiens
ctcagcctgcctgggag

SEQ ID NO: 3540595 - DNA, 20 bp, Homo sapiens
ctcattgctgttttaatttg

SEQ ID NO: 3540596 - DNA, 14 bp, Homo sapiens
ctcctaacatatat

SEQ ID NO: 3540597 - DNA, 14 bp, Homo sapiens
ctcctcctcctttc

SEQ ID NO: 3540598 - DNA, 11 bp, Homo sapiens
ctcctcctttc

SEQ ID NO: 3540599 - DNA, 13 bp, Homo sapiens
ctcctctctccct

SEQ ID NO: 3540600 - DNA, 15 bp, Homo sapiens
ctcctctctccctgc

SEQ ID NO: 3540601 - DNA, 18 bp, Homo sapiens
ctcctctctccctgcctc

SEQ ID NO: 3540602 - DNA, 16 bp, Homo sapiens
ctcctggtgtttttct

SEQ ID NO: 3540603 - DNA, 14 bp, Homo sapiens
ctcctttaatgaca

SEQ ID NO: 3540604 - DNA, 18 bp, Homo sapiens
ctcctttcccctttctct

SEQ ID NO: 3540605 - DNA, 23 bp, Homo sapiens
ctcctttcccctttctctttcct

SEQ ID NO: 3540606 - DNA, 16 bp, Homo sapiens
ctcgggtggggctggt

SEQ ID NO: 3540607 - DNA, 14 bp, Homo sapiens
ctctccctgcctca

SEQ ID NO: 3540608 - DNA, 16 bp, Homo sapiens
ctctccctgcctcaca

SEQ ID NO: 3540609 - DNA, 13 bp, Homo sapiens
ctctctccctgcc

SEQ ID NO: 3540610 - DNA, 18 bp, Homo sapiens
ctctctccctgcctcaca

SEQ ID NO: 3540611 - DNA, 23 bp, Homo sapiens
ctctctgccctcgggtggggctg

SEQ ID NO: 3540612 - DNA, 13 bp, Homo sapiens
ctctggaagaaga

SEQ ID NO: 3540613 - DNA, 15 bp, Homo sapiens
ctctgggctgtgcct

SEQ ID NO: 3540614 - DNA, 22 bp, Homo sapiens
ctctggggacccgctgggggct

SEQ ID NO: 3540615 - DNA, 15 bp, Homo sapiens
ctctggtgccgggga

SEQ ID NO: 3540616 - DNA, 15 bp, Homo sapiens
ctctgttgcctcctc

SEQ ID NO: 3540617 - DNA, 18 bp, Homo sapiens
ctctgttgcctcctctct

SEQ ID NO: 3540618 - DNA, 19 bp, Homo sapiens
ctctgttgcctcctctctc

SEQ ID NO: 3540619 - DNA, 21 bp, Homo sapiens
ctctgttgcctcctctctccc

SEQ ID NO: 3540620 - DNA, 18 bp, Homo sapiens
ctgaagcgaacatcttca

SEQ ID NO: 3540621 - DNA, 14 bp, Homo sapiens
ctgacgaaatggaa

SEQ ID NO: 3540622 - DNA, 23 bp, Homo sapiens
ctgacgaaatggaaacacacaca

SEQ ID NO: 3540623 - DNA, 17 bp, Homo sapiens
ctgactgtagcacggag

SEQ ID NO: 3540624 - DNA, 16 bp, Homo sapiens
ctgaggctggctgggg

SEQ ID NO: 3540625 - DNA, 17 bp, Homo sapiens
ctgaggctggctggggg

SEQ ID NO: 3540626 - DNA, 22 bp, Homo sapiens
ctgatgtttatgtactgtaaac

SEQ ID NO: 3540627 - DNA, 14 bp, Homo sapiens
ctgccccagtcagc

SEQ ID NO: 3540628 - DNA, 24 bp, Homo sapiens
ctgcctcacatctcccttccacct

SEQ ID NO: 3540629 - DNA, 23 bp, Homo sapiens
ctgcggattgctttttcattttc

SEQ ID NO: 3540630 - DNA, 18 bp, Homo sapiens
ctgctaaatttttgttgg

SEQ ID NO: 3540631 - DNA, 19 bp, Homo sapiens
ctgctgtcttctccctcct

SEQ ID NO: 3540632 - DNA, 22 bp, Homo sapiens
ctggcaggggaaactctggtgc

SEQ ID NO: 3540633 - DNA, 13 bp, Homo sapiens
ctggcctttccta

SEQ ID NO: 3540634 - DNA, 12 bp, Homo sapiens
ctggctgggctc

SEQ ID NO: 3540635 - DNA, 17 bp, Homo sapiens
ctggctgggctctggtg

SEQ ID NO: 3540636 - DNA, 14 bp, Homo sapiens
ctgggctctggtgg

SEQ ID NO: 3540637 - DNA, 14 bp, Homo sapiens
ctgggctgtgcctg

SEQ ID NO: 3540638 - DNA, 21 bp, Homo sapiens
ctggggacccgctgggggctg

SEQ ID NO: 3540639 - DNA, 12 bp, Homo sapiens
ctgggggctggc

SEQ ID NO: 3540640 - DNA, 15 bp, Homo sapiens
ctggtactgatgttc

SEQ ID NO: 3540641 - DNA, 17 bp, Homo sapiens
ctggtactgatgttcac

SEQ ID NO: 3540642 - DNA, 15 bp, Homo sapiens
ctggtgtttttctct

SEQ ID NO: 3540643 - DNA, 20 bp, Homo sapiens
ctgtagcacggagtgttggg

SEQ ID NO: 3540644 - DNA, 14 bp, Homo sapiens
ctgtgaaaaacctg

SEQ ID NO: 3540645 - DNA, 15 bp, Homo sapiens
ctgtgcctgaggctg

SEQ ID NO: 3540646 - DNA, 13 bp, Homo sapiens
ctgttctcttgta

SEQ ID NO: 3540647 - DNA, 14 bp, Homo sapiens
ctgttctcttgtat

SEQ ID NO: 3540648 - DNA, 22 bp, Homo sapiens
ctgttgcctcctctctccctgc

SEQ ID NO: 3540649 - DNA, 11 bp, Homo sapiens
ctgtttcctgt

SEQ ID NO: 3540650 - DNA, 16 bp, Homo sapiens
cttccacctcacaact

SEQ ID NO: 3540651 - DNA, 18 bp, Homo sapiens
cttccacctcacaactcc

SEQ ID NO: 3540652 - DNA, 17 bp, Homo sapiens
cttccagaactgtgaga

SEQ ID NO: 3540653 - DNA, 12 bp, Homo sapiens
cttctctggaga

SEQ ID NO: 3540654 - DNA, 14 bp, Homo sapiens
cttctttgctttct

SEQ ID NO: 3540655 - DNA, 16 bp, Homo sapiens
cttctttgctttctcg

SEQ ID NO: 3540656 - DNA, 22 bp, Homo sapiens
cttgactgaagcgaacatcttc

SEQ ID NO: 3540657 - DNA, 19 bp, Homo sapiens
cttgagagctcagcctgcc

SEQ ID NO: 3540658 - DNA, 19 bp, Homo sapiens
tcatgaattcatactctgt

SEQ ID NO: 3540659 - DNA, 22 bp, Homo sapiens
tcatgaattcatactctgttgc

SEQ ID NO: 3540660 - DNA, 15 bp, Homo sapiens
tcatgatgatgatga

SEQ ID NO: 3540661 - DNA, 16 bp, Homo sapiens
tccacctcacaactcc

SEQ ID NO: 3540662 - DNA, 18 bp, Homo sapiens
tccacctcacaactcctt

SEQ ID NO: 3540663 - DNA, 22 bp, Homo sapiens
tccacgctgatgtttatgtact

SEQ ID NO: 3540664 - DNA, 13 bp, Homo sapiens
tccaggagggctt

SEQ ID NO: 3540665 - DNA, 22 bp, Homo sapiens
tccagtttaggagctcagttga

SEQ ID NO: 3540666 - DNA, 15 bp, Homo sapiens
tccattcaactggaa

SEQ ID NO: 3540667 - DNA, 16 bp, Homo sapiens
tcccaccttgtcgctg

SEQ ID NO: 3540668 - DNA, 18 bp, Homo sapiens
tcccaggtttcttctctg

SEQ ID NO: 3540669 - DNA, 21 bp, Homo sapiens
tcccaggtttcttctctggag

SEQ ID NO: 3540670 - DNA, 13 bp, Homo sapiens
tcccctggcaggg

SEQ ID NO: 3540671 - DNA, 13 bp, Homo sapiens
tcccctttctctt

SEQ ID NO: 3540672 - DNA, 15 bp, Homo sapiens
tccctctctgccctc

SEQ ID NO: 3540673 - DNA, 19 bp, Homo sapiens
tccctgcctcacatctccc

SEQ ID NO: 3540674 - DNA, 21 bp, Homo sapiens
tcctcccaggtttcttctctg

SEQ ID NO: 3540675 - DNA, 13 bp, Homo sapiens
tcctcctcctttc

SEQ ID NO: 3540676 - DNA, 14 bp, Homo sapiens
tcctctctccctgc

SEQ ID NO: 3540677 - DNA, 16 bp, Homo sapiens
tcctctctccctgcct

SEQ ID NO: 3540678 - DNA, 18 bp, Homo sapiens
tcctctctccctgcctca

SEQ ID NO: 3540679 - DNA, 22 bp, Homo sapiens
tcctctctccctgcctcacatc

SEQ ID NO: 3540680 - DNA, 14 bp, Homo sapiens
tcctgctgtcttct

SEQ ID NO: 3540681 - DNA, 23 bp, Homo sapiens
tcctggtgtttttctctctggac

SEQ ID NO: 3540682 - DNA, 15 bp, Homo sapiens
tccttccatccttga

SEQ ID NO: 3540683 - DNA, 23 bp, Homo sapiens
tccttgactgaagcgaacatctt

SEQ ID NO: 3540684 - DNA, 15 bp, Homo sapiens
tcctttcccctttct

SEQ ID NO: 3540685 - DNA, 17 bp, Homo sapiens
tcctttcccctttctct

SEQ ID NO: 3540686 - DNA, 16 bp, Homo sapiens
tcctttggggcttctg

SEQ ID NO: 3540687 - DNA, 12 bp, Homo sapiens
tccttttaagaa

SEQ ID NO: 3540688 - DNA, 23 bp, Homo sapiens
tccttttaagaaagcttcttgtg

SEQ ID NO: 3540689 - DNA, 17 bp, Homo sapiens
tcgcaccgtgctgggct

SEQ ID NO: 3540690 - DNA, 15 bp, Homo sapiens
tcgggtggggctggt

SEQ ID NO: 3540691 - DNA, 18 bp, Homo sapiens
tctaagaactctttgcct

SEQ ID NO: 3540692 - DNA, 22 bp, Homo sapiens
tctcattgctgttttaatttgt

SEQ ID NO: 3540693 - DNA, 16 bp, Homo sapiens
tctccctgcctcacat

SEQ ID NO: 3540694 - DNA, 20 bp, Homo sapiens
tctccctgcctcacatctcc

SEQ ID NO: 3540695 - DNA, 14 bp, Homo sapiens
tctcccttccacct

SEQ ID NO: 3540696 - DNA, 20 bp, Homo sapiens
tctcctggtgtttttctctc

SEQ ID NO: 3540697 - DNA, 22 bp, Homo sapiens
tctcctggtgtttttctctctg

SEQ ID NO: 3540698 - DNA, 12 bp, Homo sapiens
tctctccctgcc

SEQ ID NO: 3540699 - DNA, 16 bp, Homo sapiens
tctctgccctcgggtg

SEQ ID NO: 3540700 - DNA, 22 bp, Homo sapiens
tctgcactcttgtacaaaagaa

SEQ ID NO: 3540701 - DNA, 15 bp, Homo sapiens
tctgcagctggtgtg

SEQ ID NO: 3540702 - DNA, 14 bp, Homo sapiens
tctggcctttccta

SEQ ID NO: 3540703 - DNA, 15 bp, Homo sapiens
tctgtaagaaactgc

SEQ ID NO: 3540704 - DNA, 13 bp, Homo sapiens
tctgttgcctcct

SEQ ID NO: 3540705 - DNA, 16 bp, Homo sapiens
tctgttgcctcctctc

SEQ ID NO: 3540706 - DNA, 21 bp, Homo sapiens
tctgttgcctcctctctccct

SEQ ID NO: 3540707 - DNA, 12 bp, Homo sapiens
tctgtttcctgt

SEQ ID NO: 3540708 - DNA, 22 bp, Homo sapiens
tcttctccctcctcctcctttc

SEQ ID NO: 3540709 - DNA, 14 bp, Homo sapiens
tcttgtatagctga

SEQ ID NO: 3540710 - DNA, 14 bp, Homo sapiens
tcttgttcaaaaag

SEQ ID NO: 3540711 - DNA, 19 bp, Homo sapiens
tgaaattccagtttaggag

SEQ ID NO: 3540712 - DNA, 18 bp, Homo sapiens
tgaagcgaacatcttcat

SEQ ID NO: 3540713 - DNA, 15 bp, Homo sapiens
tgaatgactccagga

SEQ ID NO: 3540714 - DNA, 13 bp, Homo sapiens
tgaccattctttt

SEQ ID NO: 3540715 - DNA, 22 bp, Homo sapiens
tgacgaaatggaaacacacaca

SEQ ID NO: 3540716 - DNA, 13 bp, Homo sapiens
tgactccaggaag

SEQ ID NO: 3540717 - DNA, 19 bp, Homo sapiens
tgagagctcagcctgcctg

SEQ ID NO: 3540718 - DNA, 15 bp, Homo sapiens
tgaggctggctgggg

SEQ ID NO: 3540719 - DNA, 14 bp, Homo sapiens
tgatgagattttta

SEQ ID NO: 3540720 - DNA, 18 bp, Homo sapiens
tgatgattttaacagttt

SEQ ID NO: 3540721 - DNA, 20 bp, Homo sapiens
tgatgattttaacagtttta

SEQ ID NO: 3540722 - DNA, 14 bp, Homo sapiens
tgatgccaagcttt

SEQ ID NO: 3540723 - DNA, 21 bp, Homo sapiens
tgatgtttatgtactgtaaac

SEQ ID NO: 3540724 - DNA, 16 bp, Homo sapiens
tgatttctaatgatat

SEQ ID NO: 3540725 - DNA, 20 bp, Homo sapiens
tgcagcggaagggactctgg

SEQ ID NO: 3540726 - DNA, 21 bp, Homo sapiens
tgcagcggaagggactctggg

SEQ ID NO: 3540727 - DNA, 16 bp, Homo sapiens
tgccctcgggtggggc

SEQ ID NO: 3540728 - DNA, 14 bp, Homo sapiens
tgcctcctctctcc

SEQ ID NO: 3540729 - DNA, 19 bp, Homo sapiens
tgcctcctctctccctgcc

SEQ ID NO: 3540730 - DNA, 23 bp, Homo sapiens
tgcctcctctctccctgcctcac

SEQ ID NO: 3540731 - DNA, 15 bp, Homo sapiens
tgcctgaggctggct

SEQ ID NO: 3540732 - DNA, 15 bp, Homo sapiens
tgctgtcttctccct

SEQ ID NO: 3540733 - DNA, 21 bp, Homo sapiens
tgctgtcttctccctcctcct

SEQ ID NO: 3540734 - DNA, 12 bp, Homo sapiens
tggaaacagctg

SEQ ID NO: 3540735 - DNA, 19 bp, Homo sapiens
tggcaggggaaactctggt

SEQ ID NO: 3540736 - DNA, 22 bp, Homo sapiens
tggccccgcagtgccctgcccc

SEQ ID NO: 3540737 - DNA, 23 bp, Homo sapiens
tggcttctttgctttctcgtggg

SEQ ID NO: 3540738 - DNA, 11 bp, Homo sapiens
tgggagagccc

SEQ ID NO: 3540739 - DNA, 14 bp, Homo sapiens
tgggctctggtggg

SEQ ID NO: 3540740 - DNA, 18 bp, Homo sapiens
tgggctctggtgggggct

SEQ ID NO: 3540741 - DNA, 19 bp, Homo sapiens
tgggctctggtgggggctc

SEQ ID NO: 3540742 - DNA, 19 bp, Homo sapiens
tgggctgtgcctgaggctg

SEQ ID NO: 3540743 - DNA, 20 bp, Homo sapiens
tggggacccgctgggggctg

SEQ ID NO: 3540744 - DNA, 12 bp, Homo sapiens
tggggctggggg

SEQ ID NO: 3540745 - DNA, 14 bp, Homo sapiens
tggggctgggggcc

SEQ ID NO: 3540746 - DNA, 23 bp, Homo sapiens
tggggctgtgttttcgatgatga

SEQ ID NO: 3540747 - DNA, 12 bp, Homo sapiens
tggggcttctgt

SEQ ID NO: 3540748 - DNA, 20 bp, Homo sapiens
tggtgtttttctctctggac

SEQ ID NO: 3540749 - DNA, 14 bp, Homo sapiens
tgtaaacagttctg

SEQ ID NO: 3540750 - DNA, 19 bp, Homo sapiens
tgtaaaccaaacagacaag

SEQ ID NO: 3540751 - DNA, 18 bp, Homo sapiens
tgtaacttgggctgtaaa

SEQ ID NO: 3540752 - DNA, 22 bp, Homo sapiens
tgtaacttgggctgtaaagcaa

SEQ ID NO: 3540753 - DNA, 20 bp, Homo sapiens
tgtactgtaaacagttctgc

SEQ ID NO: 3540754 - DNA, 22 bp, Homo sapiens
tgtactgtaaacagttctgcac

SEQ ID NO: 3540755 - DNA, 23 bp, Homo sapiens
tgtatttaactctgtaagaaact

SEQ ID NO: 3540756 - DNA, 21 bp, Homo sapiens
tgtattttaaagggacagttt

SEQ ID NO: 3540757 - DNA, 23 bp, Homo sapiens
tgtctcctcccaggtttcttctc

SEQ ID NO: 3540758 - DNA, 20 bp, Homo sapiens
ctcatcccagtctgatattc

SEQ ID NO: 3540759 - DNA, 17 bp, Homo sapiens
ctcatttctcaacagtt

SEQ ID NO: 3540760 - DNA, 12 bp, Homo sapiens
ctgaaaatgtta

SEQ ID NO: 3540761 - DNA, 14 bp, Homo sapiens
ctgaaattctaaat

SEQ ID NO: 3540762 - DNA, 21 bp, Homo sapiens
ctgaagactagttatatattc

SEQ ID NO: 3540763 - DNA, 18 bp, Homo sapiens
ctgacataccttagactg

SEQ ID NO: 3540764 - DNA, 23 bp, Homo sapiens
ctgacataccttagactgaaaaa

SEQ ID NO: 3540765 - DNA, 21 bp, Homo sapiens
ctgactttgttgccttatctt

SEQ ID NO: 3540766 - DNA, 22 bp, Homo sapiens
ctgagcctcttttcaattattt

SEQ ID NO: 3540767 - DNA, 20 bp, Homo sapiens
ctgccttatctcatttctca

SEQ ID NO: 3540768 - DNA, 17 bp, Homo sapiens
ctgcgttctcatcccag

SEQ ID NO: 3540769 - DNA, 14 bp, Homo sapiens
ctgggtttaaagat

SEQ ID NO: 3540770 - DNA, 15 bp, Homo sapiens
ctggtcgtcacctgg

SEQ ID NO: 3540771 - DNA, 13 bp, Homo sapiens
ctgtaaaatggaa

SEQ ID NO: 3540772 - DNA, 21 bp, Homo sapiens
ctgtaaaatttgtttagaagt

SEQ ID NO: 3540773 - DNA, 14 bp, Homo sapiens
ctgtattttaaggt

SEQ ID NO: 3540774 - DNA, 22 bp, Homo sapiens
cttaaaattgctagtgatttca

SEQ ID NO: 3540775 - DNA, 12 bp, Homo sapiens
cttaaataaatc

SEQ ID NO: 3540776 - DNA, 22 bp, Homo sapiens
cttactagaaatatattcataa

SEQ ID NO: 3540777 - DNA, 23 bp, Homo sapiens
cttactagaaatatattcataat

SEQ ID NO: 3540778 - DNA, 13 bp, Homo sapiens
cttagactgaaaa

SEQ ID NO: 3540779 - DNA, 20 bp, Homo sapiens
cttagctatgtttccatctt

SEQ ID NO: 3540780 - DNA, 13 bp, Homo sapiens
cttatactgaaaa

SEQ ID NO: 3540781 - DNA, 14 bp, Homo sapiens
cttatcttgaaaag

SEQ ID NO: 3540782 - DNA, 21 bp, Homo sapiens
cttcccagagaacttcacaga

SEQ ID NO: 3540783 - DNA, 17 bp, Homo sapiens
cttgaaaaaatgttcta

SEQ ID NO: 3540784 - DNA, 17 bp, Homo sapiens
cttgactaataccttgt

SEQ ID NO: 3540785 - DNA, 17 bp, Homo sapiens
ctttcccacactgaaat

SEQ ID NO: 3540786 - DNA, 14 bp, Homo sapiens
cttttatttccaaa

SEQ ID NO: 3540787 - DNA, 19 bp, Homo sapiens
ctttttttaataatttcat

SEQ ID NO: 3540788 - DNA, 12 bp, Homo sapiens
gaaaaactgttg

SEQ ID NO: 3540789 - DNA, 14 bp, Homo sapiens
gaaaactattttaa

SEQ ID NO: 3540790 - DNA, 24 bp, Homo sapiens
gaaaactattttaaagctgacttt

SEQ ID NO: 3540791 - DNA, 14 bp, Homo sapiens
gaaaagtgctgttt

SEQ ID NO: 3540792 - DNA, 17 bp, Homo sapiens
gaaaataatttgttgta

SEQ ID NO: 3540793 - DNA, 14 bp, Homo sapiens
gaaaccaactgttg

SEQ ID NO: 3540794 - DNA, 14 bp, Homo sapiens
gaaagtaactgttt

SEQ ID NO: 3540795 - DNA, 20 bp, Homo sapiens
gaaatatatctgtgatttta

SEQ ID NO: 3540796 - DNA, 12 bp, Homo sapiens
gaaatatattca

SEQ ID NO: 3540797 - DNA, 15 bp, Homo sapiens
gaaatgtattcacct

SEQ ID NO: 3540798 - DNA, 16 bp, Homo sapiens
gaacactagctaagga

SEQ ID NO: 3540799 - DNA, 22 bp, Homo sapiens
gaacatccttaaatgtctaaca

SEQ ID NO: 3540800 - DNA, 20 bp, Homo sapiens
gaactaggatagatgtgatt

SEQ ID NO: 3540801 - DNA, 15 bp, Homo sapiens
gaacttgattttaaa

SEQ ID NO: 3540802 - DNA, 20 bp, Homo sapiens
gaagtaaagtttatttcatg

SEQ ID NO: 3540803 - DNA, 13 bp, Homo sapiens
gaatgtgcatttc

SEQ ID NO: 3540804 - DNA, 19 bp, Homo sapiens
gacaagaatatgttcacat

SEQ ID NO: 3540805 - DNA, 22 bp, Homo sapiens
gacatgggaggggtctagctgg

SEQ ID NO: 3540806 - DNA, 17 bp, Homo sapiens
gacccttttccttagct

SEQ ID NO: 3540807 - DNA, 17 bp, Homo sapiens
gaccggaagttgaggct

SEQ ID NO: 3540808 - DNA, 19 bp, Homo sapiens
gacgattatttatttctgt

SEQ ID NO: 3540809 - DNA, 16 bp, Homo sapiens
gactcaggttgtctgt

SEQ ID NO: 3540810 - DNA, 22 bp, Homo sapiens
gactgatggtgtctgaggttct

SEQ ID NO: 3540811 - DNA, 17 bp, Homo sapiens
gacttagcctaaacaac

SEQ ID NO: 3540812 - DNA, 23 bp, Homo sapiens
gactttttttctgattcaaaagt

SEQ ID NO: 3540813 - DNA, 16 bp, Homo sapiens
gagaaagctgtgcaga

SEQ ID NO: 3540814 - DNA, 14 bp, Homo sapiens
gagaagctcattta

SEQ ID NO: 3540815 - DNA, 16 bp, Homo sapiens
gagaatgaaaggagca

SEQ ID NO: 3540816 - DNA, 15 bp, Homo sapiens
gagccttttcttata

SEQ ID NO: 3540817 - DNA, 18 bp, Homo sapiens
gaggggtctagctggcca

SEQ ID NO: 3540818 - DNA, 19 bp, Homo sapiens
gataagaataggtcatttt

SEQ ID NO: 3540819 - DNA, 21 bp, Homo sapiens
gatagatgtgattcctgcatt

SEQ ID NO: 3540820 - DNA, 12 bp, Homo sapiens
gatcatcttgaa

SEQ ID NO: 3540821 - DNA, 17 bp, Homo sapiens
gatggaaatatgttcta

SEQ ID NO: 3540822 - DNA, 17 bp, Homo sapiens
gatgtgattcctgcatt

SEQ ID NO: 3540823 - DNA, 19 bp, Homo sapiens
gattattcttcttacatta

SEQ ID NO: 3540824 - DNA, 12 bp, Homo sapiens
gattcaaaagtg

SEQ ID NO: 3540825 - DNA, 21 bp, Homo sapiens
gcaaatggatggggataagaa

SEQ ID NO: 3540826 - DNA, 14 bp, Homo sapiens
gcaagttgtactgt

SEQ ID NO: 3540827 - DNA, 22 bp, Homo sapiens
gcaataggtggaaagagaaatg

SEQ ID NO: 3540828 - DNA, 23 bp, Homo sapiens
gcaataggtggaaagagaaatga

SEQ ID NO: 3540829 - DNA, 12 bp, Homo sapiens
gcaatcaaagca

SEQ ID NO: 3540830 - DNA, 20 bp, Homo sapiens
gcactttgggaggccgaggc

SEQ ID NO: 3540831 - DNA, 13 bp, Homo sapiens
gcacttttcatta

SEQ ID NO: 3540832 - DNA, 15 bp, Homo sapiens
gcacttttcattact

SEQ ID NO: 3540833 - DNA, 19 bp, Homo sapiens
gcagcacatggtgttgtat

SEQ ID NO: 3540834 - DNA, 18 bp, Homo sapiens
gcataaaaattgaattcg

SEQ ID NO: 3540835 - DNA, 17 bp, Homo sapiens
gcatcgaaatgtattca

SEQ ID NO: 3540836 - DNA, 19 bp, Homo sapiens
gcatctgcctctattcaat

SEQ ID NO: 3540837 - DNA, 13 bp, Homo sapiens
gccacctcctcgt

SEQ ID NO: 3540838 - DNA, 15 bp, Homo sapiens
gcctggtgggaccag

SEQ ID NO: 3540839 - DNA, 23 bp, Homo sapiens
gcctttttcataaactgagcctc

SEQ ID NO: 3540840 - DNA, 13 bp, Homo sapiens
gctaccaaagaat

SEQ ID NO: 3540841 - DNA, 17 bp, Homo sapiens
gctagccacctcctcgt

SEQ ID NO: 3540842 - DNA, 15 bp, Homo sapiens
gctagtgatttcatt

SEQ ID NO: 3540843 - DNA, 18 bp, Homo sapiens
gctatgtttccatcttca

SEQ ID NO: 3540844 - DNA, 11 bp, Homo sapiens
gctctggcccc

SEQ ID NO: 3540845 - DNA, 21 bp, Homo sapiens
gctgaagggcttcttcttata

SEQ ID NO: 3540846 - DNA, 21 bp, Homo sapiens
gctgctgggtgcgaaggcaga

SEQ ID NO: 3540847 - DNA, 14 bp, Homo sapiens
gctgtcagcctggc

SEQ ID NO: 3540848 - DNA, 14 bp, Homo sapiens
ggaaaagaacacta

SEQ ID NO: 3540849 - DNA, 14 bp, Homo sapiens
ggaaagagaaatga

SEQ ID NO: 3540850 - DNA, 24 bp, Homo sapiens
ggatagatgtgattcctgcatttt

SEQ ID NO: 3540851 - DNA, 17 bp, Homo sapiens
ggcaatatttgttctgg

SEQ ID NO: 3540852 - DNA, 19 bp, Homo sapiens
ggcatacaacctgagcctt

SEQ ID NO: 3540853 - DNA, 14 bp, Homo sapiens
ggctacctctgagt

SEQ ID NO: 3540854 - DNA, 13 bp, Homo sapiens
ggcttcttcttat

SEQ ID NO: 3540855 - DNA, 13 bp, Homo sapiens
gggataagaatag

SEQ ID NO: 3540856 - DNA, 15 bp, Homo sapiens
ggggccaaggacagg

SEQ ID NO: 3540857 - DNA, 19 bp, Homo sapiens
ggtgttagaagtgcaccag

SEQ ID NO: 3540858 - DNA, 18 bp, Homo sapiens
gtaaaatttgtttagaag

SEQ ID NO: 3540859 - DNA, 19 bp, Homo sapiens
gtaaagatgtcaataggaa

SEQ ID NO: 3540860 - DNA, 16 bp, Homo sapiens
gtaaagtttatttcat

SEQ ID NO: 3540861 - DNA, 18 bp, Homo sapiens
gtaacattataaatgaca

SEQ ID NO: 3540862 - DNA, 14 bp, Homo sapiens
gtacgtttttgcat

SEQ ID NO: 3540863 - DNA, 18 bp, Homo sapiens
gtacgtttttgcattatt

SEQ ID NO: 3540864 - DNA, 18 bp, Homo sapiens
gtactgattattcttctt

SEQ ID NO: 3540865 - DNA, 16 bp, Homo sapiens
gtactttttattcaat

SEQ ID NO: 3540866 - DNA, 15 bp, Homo sapiens
gtagcaaccttcatt

SEQ ID NO: 3540867 - DNA, 17 bp, Homo sapiens
gtatacttcattagcaa

SEQ ID NO: 3540868 - DNA, 13 bp, Homo sapiens
aaaactattttaa

SEQ ID NO: 3540869 - DNA, 18 bp, Homo sapiens
aaaagtaagaatgcaaaa

SEQ ID NO: 3540870 - DNA, 20 bp, Homo sapiens
aaaagtagcaaccttcattt

SEQ ID NO: 3540871 - DNA, 15 bp, Homo sapiens
aaaagtgaacttgat

SEQ ID NO: 3540872 - DNA, 17 bp, Homo sapiens
aaaattatttttattaa

SEQ ID NO: 3540873 - DNA, 17 bp, Homo sapiens
aaaccaactgttgacat

SEQ ID NO: 3540874 - DNA, 23 bp, Homo sapiens
aaactgagcctcttttcaattat

SEQ ID NO: 3540875 - DNA, 16 bp, Homo sapiens
aaacttaagcataaaa

SEQ ID NO: 3540876 - DNA, 16 bp, Homo sapiens
aaagaatgcatgttct

SEQ ID NO: 3540877 - DNA, 14 bp, Homo sapiens
aaagagaaatgatg

SEQ ID NO: 3540878 - DNA, 16 bp, Homo sapiens
aaataaaatgaaaaat

SEQ ID NO: 3540879 - DNA, 13 bp, Homo sapiens
aaataaatatttt

SEQ ID NO: 3540880 - DNA, 15 bp, Homo sapiens
aaataaatattttac

SEQ ID NO: 3540881 - DNA, 21 bp, Homo sapiens
aaatatatctgtgattttaaa

SEQ ID NO: 3540882 - DNA, 21 bp, Homo sapiens
aaatatgttctaacagcatct

SEQ ID NO: 3540883 - DNA, 13 bp, Homo sapiens
aaatattgacact

SEQ ID NO: 3540884 - DNA, 18 bp, Homo sapiens
aaatgagtttgtctatgg

SEQ ID NO: 3540885 - DNA, 22 bp, Homo sapiens
aaatgatgtgaaagataaatga

SEQ ID NO: 3540886 - DNA, 17 bp, Homo sapiens
aaatgttctatatgcat

SEQ ID NO: 3540887 - DNA, 19 bp, Homo sapiens
aaattgctagtgatttcat

SEQ ID NO: 3540888 - DNA, 20 bp, Homo sapiens
aaattgttcatgttaccaaa

SEQ ID NO: 3540889 - DNA, 14 bp, Homo sapiens
aaattttgctacca

SEQ ID NO: 3540890 - DNA, 20 bp, Homo sapiens
aaattttgctaccaaagaat

SEQ ID NO: 3540891 - DNA, 22 bp, Homo sapiens
aacagcatctgcctctattcaa

SEQ ID NO: 3540892 - DNA, 19 bp, Homo sapiens
aaccaactgttgacataca

SEQ ID NO: 3540893 - DNA, 21 bp, Homo sapiens
aaccaactgttgacatacaaa

SEQ ID NO: 3540894 - DNA, 19 bp, Homo sapiens
aaccatgattgaaggagaa

SEQ ID NO: 3540895 - DNA, 22 bp, Homo sapiens
aacctaaatggagaaagctgtg

SEQ ID NO: 3540896 - DNA, 20 bp, Homo sapiens
aacctaatgggaatcattcc

SEQ ID NO: 3540897 - DNA, 13 bp, Homo sapiens
aaccttcatttta

SEQ ID NO: 3540898 - DNA, 16 bp, Homo sapiens
aactaggccatttgta

SEQ ID NO: 3540899 - DNA, 21 bp, Homo sapiens
aactattttaaagctgacttt

SEQ ID NO: 3540900 - DNA, 22 bp, Homo sapiens
aactgttgaggttcctcttgga

SEQ ID NO: 3540901 - DNA, 18 bp, Homo sapiens
aactgttggttcatccag

SEQ ID NO: 3540902 - DNA, 15 bp, Homo sapiens
aacttaagcataaaa

SEQ ID NO: 3540903 - DNA, 14 bp, Homo sapiens
aagaataggtcatt

SEQ ID NO: 3540904 - DNA, 20 bp, Homo sapiens
aagacaagaatatgttcaca

SEQ ID NO: 3540905 - DNA, 23 bp, Homo sapiens
aagcaaatggatggggataagaa

SEQ ID NO: 3540906 - DNA, 16 bp, Homo sapiens
aagcctgcgttctcat

SEQ ID NO: 3540907 - DNA, 20 bp, Homo sapiens
aagctcatttagttagaaaa

SEQ ID NO: 3540908 - DNA, 15 bp, Homo sapiens
aagctgactttgttg

SEQ ID NO: 3540909 - DNA, 20 bp, Homo sapiens
aagtaactgttttcttcttg

SEQ ID NO: 3540910 - DNA, 18 bp, Homo sapiens
aagtagcaaccttcattt

SEQ ID NO: 3540911 - DNA, 21 bp, Homo sapiens
aagtagcaaccttcattttac

SEQ ID NO: 3540912 - DNA, 22 bp, Homo sapiens
aagtagcaaccttcattttaca

SEQ ID NO: 3540913 - DNA, 18 bp, Homo sapiens
aagtgatatcataaaagt

SEQ ID NO: 3540914 - DNA, 15 bp, Homo sapiens
aataaatattttaca

SEQ ID NO: 3540915 - DNA, 14 bp, Homo sapiens
aataagtgaaaata

SEQ ID NO: 3540916 - DNA, 16 bp, Homo sapiens
aatacacacagttact

SEQ ID NO: 3540917 - DNA, 22 bp, Homo sapiens
aatacacacagttactgactta

SEQ ID NO: 3540918 - DNA, 19 bp, Homo sapiens
aatatataaaagaaatata

SEQ ID NO: 3540919 - DNA, 22 bp, Homo sapiens
aatatattcataatatataaaa

SEQ ID NO: 3540920 - DNA, 22 bp, Homo sapiens
aatatttgttctggtttagtgt

SEQ ID NO: 3540921 - DNA, 13 bp, Homo sapiens
aatcaagaatcat

SEQ ID NO: 3540922 - DNA, 12 bp, Homo sapiens
aatcagagaaaa

SEQ ID NO: 3540923 - DNA, 17 bp, Homo sapiens
aatcagagaaaactgtt

SEQ ID NO: 3540924 - DNA, 16 bp, Homo sapiens
aatccctatgttgcta

SEQ ID NO: 3540925 - DNA, 15 bp, Homo sapiens
aatcctagaagcaaa

SEQ ID NO: 3540926 - DNA, 21 bp, Homo sapiens
aatctagataggtgcttttaa

SEQ ID NO: 3540927 - DNA, 19 bp, Homo sapiens
aatcttcaatatgaaggac

SEQ ID NO: 3540928 - DNA, 14 bp, Homo sapiens
aatgacagatctca

SEQ ID NO: 3540929 - DNA, 16 bp, Homo sapiens
aatgacagatctcaat

SEQ ID NO: 3540930 - DNA, 20 bp, Homo sapiens
aatgcaaaagtctagagggg

SEQ ID NO: 3540931 - DNA, 22 bp, Homo sapiens
aatgcatgttctgtgtgccctg

SEQ ID NO: 3540932 - DNA, 15 bp, Homo sapiens
aatggagaaagctgt

SEQ ID NO: 3540933 - DNA, 11 bp, Homo sapiens
aattatttcaa

SEQ ID NO: 3540934 - DNA, 21 bp, Homo sapiens
aattgctagtgatttcattac

SEQ ID NO: 3540935 - DNA, 16 bp, Homo sapiens
aatttgggaattgtgt

SEQ ID NO: 3540936 - DNA, 16 bp, Homo sapiens
aattttatagtagtgg

SEQ ID NO: 3540937 - DNA, 19 bp, Homo sapiens
aattttatagtagtgggaa

SEQ ID NO: 3540938 - DNA, 19 bp, Homo sapiens
aattttgctaccaaagaat

SEQ ID NO: 3540939 - DNA, 18 bp, Homo sapiens
acaaatccctatgttgct

SEQ ID NO: 3540940 - DNA, 13 bp, Homo sapiens
acaagaatatgtt

SEQ ID NO: 3540941 - DNA, 16 bp, Homo sapiens
acaagaatatgttcac

SEQ ID NO: 3540942 - DNA, 17 bp, Homo sapiens
acacagttactgactta

SEQ ID NO: 3540943 - DNA, 14 bp, Homo sapiens
acactgaaattcta

SEQ ID NO: 3540944 - DNA, 21 bp, Homo sapiens
acagcatctgcctctattcaa

SEQ ID NO: 3540945 - DNA, 22 bp, Homo sapiens
acagcatctgcctctattcaat

SEQ ID NO: 3540946 - DNA, 15 bp, Homo sapiens
acaggtaacattata

SEQ ID NO: 3540947 - DNA, 20 bp, Homo sapiens
acaggtaacattataaatga

SEQ ID NO: 3540948 - DNA, 18 bp, Homo sapiens
acatccttaaatgtctaa

SEQ ID NO: 3540949 - DNA, 22 bp, Homo sapiens
acatcttggtatgtggccatat

SEQ ID NO: 3540950 - DNA, 14 bp, Homo sapiens
acatggtgttgtat

SEQ ID NO: 3540951 - DNA, 22 bp, Homo sapiens
acatggtgttgtatacttcatt

SEQ ID NO: 3540952 - DNA, 13 bp, Homo sapiens
acattataaatga

SEQ ID NO: 3540953 - DNA, 14 bp, Homo sapiens
acattataaatgac

SEQ ID NO: 3540954 - DNA, 14 bp, Homo sapiens
acattattaatcat

SEQ ID NO: 3540955 - DNA, 17 bp, Homo sapiens
acccccaaattcaaaag

SEQ ID NO: 3540956 - DNA, 16 bp, Homo sapiens
acctaatgggaatcat

SEQ ID NO: 3540957 - DNA, 18 bp, Homo sapiens
acctaatgggaatcattc

SEQ ID NO: 3540958 - DNA, 12 bp, Homo sapiens
acctgggcggcc

SEQ ID NO: 3540959 - DNA, 19 bp, Homo sapiens
acctggtgcatcgaaatgt

SEQ ID NO: 3540960 - DNA, 20 bp, Homo sapiens
acctggtgcatcgaaatgta

SEQ ID NO: 3540961 - DNA, 16 bp, Homo sapiens
accttattactgtctt

SEQ ID NO: 3540962 - DNA, 16 bp, Homo sapiens
acgattatttatttct

SEQ ID NO: 3540963 - DNA, 14 bp, Homo sapiens
acggaaaaggggtg

SEQ ID NO: 3540964 - DNA, 13 bp, Homo sapiens
acgtatcatttct

SEQ ID NO: 3540965 - DNA, 15 bp, Homo sapiens
acgtatcatttctaa

SEQ ID NO: 3540966 - DNA, 15 bp, Homo sapiens
actaataccttgtgt

SEQ ID NO: 3540967 - DNA, 13 bp, Homo sapiens
actagaaatatat

SEQ ID NO: 3540968 - DNA, 14 bp, Homo sapiens
actagaaatatatt

SEQ ID NO: 3540969 - DNA, 12 bp, Homo sapiens
actaggccattt

SEQ ID NO: 3540970 - DNA, 21 bp, Homo sapiens
actatacaattcagtactgat

SEQ ID NO: 3540971 - DNA, 13 bp, Homo sapiens
actattaattcca

SEQ ID NO: 3540972 - DNA, 15 bp, Homo sapiens
actcacacattaacc

SEQ ID NO: 3540973 - DNA, 22 bp, Homo sapiens
actcaggttgtctgtagagaat

SEQ ID NO: 3540974 - DNA, 20 bp, Homo sapiens
actcgtgttcactcagcact

SEQ ID NO: 3540975 - DNA, 16 bp, Homo sapiens
actctgcacagcaact

SEQ ID NO: 3540976 - DNA, 14 bp, Homo sapiens
actgaaaaactgtt

SEQ ID NO: 3540977 - DNA, 14 bp, Homo sapiens
actgaaattctaaa

SEQ ID NO: 3540978 - DNA, 20 bp, Homo sapiens
actgaaattctaaatattga

SEQ ID NO: 3540979 - DNA, 17 bp, Homo sapiens
actgattattcttctta

SEQ ID NO: 3540980 - DNA, 21 bp, Homo sapiens
actgctggaggcagcgctggt

SEQ ID NO: 3540981 - DNA, 22 bp, Homo sapiens
actgctggaggcagcgctggtc

SEQ ID NO: 3540982 - DNA, 16 bp, Homo sapiens
actgttgacatacaaa

SEQ ID NO: 3540983 - DNA, 23 bp, Homo sapiens
actgttggttcatccagaagtgt

SEQ ID NO: 3540984 - DNA, 19 bp, Homo sapiens
acttaagcataaaaattga

SEQ ID NO: 3540985 - DNA, 17 bp, Homo sapiens
acttgactaataccttg

SEQ ID NO: 3540986 - DNA, 14 bp, Homo sapiens
acttttcattactt

SEQ ID NO: 3540987 - DNA, 12 bp, Homo sapiens
agaaaattgttt

SEQ ID NO: 3540988 - DNA, 21 bp, Homo sapiens
agaacatccttaaatgtctaa

SEQ ID NO: 3540989 - DNA, 17 bp, Homo sapiens
agaagtacgtttttgca

SEQ ID NO: 3540990 - DNA, 13 bp, Homo sapiens
agaatcattgacc

SEQ ID NO: 3540991 - DNA, 20 bp, Homo sapiens
agaggaaacttaagcataaa

SEQ ID NO: 3540992 - DNA, 19 bp, Homo sapiens
agaggagccagaagtaaag

SEQ ID NO: 3540993 - DNA, 16 bp, Homo sapiens
agatctcaattttata

SEQ ID NO: 3540994 - DNA, 21 bp, Homo sapiens
agatgtcaataggaattgcat

SEQ ID NO: 3540995 - DNA, 15 bp, Homo sapiens
agcaaccttcatttt

SEQ ID NO: 3540996 - DNA, 22 bp, Homo sapiens
agcaataggtggaaagagaaat

SEQ ID NO: 3540997 - DNA, 16 bp, Homo sapiens
agcactctgccatcct

SEQ ID NO: 3540998 - DNA, 20 bp, Homo sapiens
agcagcacatggtgttgtat

SEQ ID NO: 3540999 - DNA, 20 bp, Homo sapiens
agcatctgcctctattcaat

SEQ ID NO: 3541000 - DNA, 16 bp, Homo sapiens
agcctgctaaatgaag

SEQ ID NO: 3541001 - DNA, 13 bp, Homo sapiens
agccttttcttat

SEQ ID NO: 3541002 - DNA, 15 bp, Homo sapiens
agcgtagacatatat

SEQ ID NO: 3541003 - DNA, 15 bp, Homo sapiens
agctgtaaaatggaa

SEQ ID NO: 3541004 - DNA, 13 bp, Homo sapiens
agctgtgcagagg

SEQ ID NO: 3541005 - DNA, 22 bp, Homo sapiens
aggaactaggatagatgtgatt

SEQ ID NO: 3541006 - DNA, 16 bp, Homo sapiens
aggactattaattcca

SEQ ID NO: 3541007 - DNA, 18 bp, Homo sapiens
aggatgactttttttctg

SEQ ID NO: 3541008 - DNA, 15 bp, Homo sapiens
aggccgtgcctggtg

SEQ ID NO: 3541009 - DNA, 16 bp, Homo sapiens
agggctacctctgagt

SEQ ID NO: 3541010 - DNA, 19 bp, Homo sapiens
aggtcattttctattcacc

SEQ ID NO: 3541011 - DNA, 17 bp, Homo sapiens
aggtggaaagagaaatg

SEQ ID NO: 3541012 - DNA, 20 bp, Homo sapiens
aggtggaaagagaaatgatg

SEQ ID NO: 3541013 - DNA, 14 bp, Homo sapiens
agtaagaatgcaaa

SEQ ID NO: 3541014 - DNA, 20 bp, Homo sapiens
agtacgtttttgcattattc

SEQ ID NO: 3541015 - DNA, 14 bp, Homo sapiens
agtactgattattc

SEQ ID NO: 3541016 - DNA, 17 bp, Homo sapiens
agtactgattattcttc

SEQ ID NO: 3541017 - DNA, 15 bp, Homo sapiens
agtattagttttctg

SEQ ID NO: 3541018 - DNA, 17 bp, Homo sapiens
agtgaacttgattttaa

SEQ ID NO: 3541019 - DNA, 24 bp, Homo sapiens
agtggcccatgtgactgtggcatt

SEQ ID NO: 3541020 - DNA, 23 bp, Homo sapiens
agtggcccgcgtgattgtggcat

SEQ ID NO: 3541021 - DNA, 12 bp, Homo sapiens
agtgtattcata

SEQ ID NO: 3541022 - DNA, 15 bp, Homo sapiens
agtgttaataaatgg

SEQ ID NO: 3541023 - DNA, 17 bp, Homo sapiens
agtgttctgtattttaa

SEQ ID NO: 3541024 - DNA, 23 bp, Homo sapiens
agttacttgaaaaaatgttctat

SEQ ID NO: 3541025 - DNA, 22 bp, Homo sapiens
agttgaggcttagctatgtttc

SEQ ID NO: 3541026 - DNA, 12 bp, Homo sapiens
agtttatttcat

SEQ ID NO: 3541027 - DNA, 22 bp, Homo sapiens
agttttgtaaataagtgaaaat

SEQ ID NO: 3541028 - DNA, 17 bp, Homo sapiens
ataaaaattgaattcgt

SEQ ID NO: 3541029 - DNA, 13 bp, Homo sapiens
ataaaatgaaaaa

SEQ ID NO: 3541030 - DNA, 14 bp, Homo sapiens
ataaactgagcctc

SEQ ID NO: 3541031 - DNA, 15 bp, Homo sapiens
ataagaaaagtgaaa

SEQ ID NO: 3541032 - DNA, 17 bp, Homo sapiens
ataatttgttgtacttt

SEQ ID NO: 3541033 - DNA, 16 bp, Homo sapiens
atacaacctgagcctt

SEQ ID NO: 3541034 - DNA, 22 bp, Homo sapiens
atacaattcagtactgattatt

SEQ ID NO: 3541035 - DNA, 17 bp, Homo sapiens
ataggtagttagcaata

SEQ ID NO: 3541036 - DNA, 22 bp, Homo sapiens
ataggtcacatatgtctgtatc

SEQ ID NO: 3541037 - DNA, 15 bp, Homo sapiens
atataaaagaaatat

SEQ ID NO: 3541038 - DNA, 18 bp, Homo sapiens
atataaaagaaatatatc

SEQ ID NO: 3541039 - DNA, 18 bp, Homo sapiens
atatataaaagaaatata

SEQ ID NO: 3541040 - DNA, 21 bp, Homo sapiens
atatataaaagaaatatatct

SEQ ID NO: 3541041 - DNA, 22 bp, Homo sapiens
atatattccttactagaaatat

SEQ ID NO: 3541042 - DNA, 14 bp, Homo sapiens
atatgaatgttctt

SEQ ID NO: 3541043 - DNA, 19 bp, Homo sapiens
atatgtcagacatgaaaac

SEQ ID NO: 3541044 - DNA, 12 bp, Homo sapiens
atatgttcacat

SEQ ID NO: 3541045 - DNA, 19 bp, Homo sapiens
atattaccagaaaatgagt

SEQ ID NO: 3541046 - DNA, 19 bp, Homo sapiens
atattatcttatactgaaa

SEQ ID NO: 3541047 - DNA, 14 bp, Homo sapiens
atattgacacttag

SEQ ID NO: 3541048 - DNA, 12 bp, Homo sapiens
atcaagaatcat

SEQ ID NO: 3541049 - DNA, 15 bp, Homo sapiens
atcaagaatcattga

SEQ ID NO: 3541050 - DNA, 22 bp, Homo sapiens
atcattgacctaattgttaaat

SEQ ID NO: 3541051 - DNA, 15 bp, Homo sapiens
atctcatttctcaac

SEQ ID NO: 3541052 - DNA, 16 bp, Homo sapiens
atctgcctctattcaa

SEQ ID NO: 3541053 - DNA, 22 bp, Homo sapiens
atctgcctctattcaatttaat

SEQ ID NO: 3541054 - DNA, 14 bp, Homo sapiens
atctgcctttgttt

SEQ ID NO: 3541055 - DNA, 15 bp, Homo sapiens
atctgcctttgtttc

SEQ ID NO: 3541056 - DNA, 15 bp, Homo sapiens
atcttatactgaaaa

SEQ ID NO: 3541057 - DNA, 15 bp, Homo sapiens
atcttcagtttctga

SEQ ID NO: 3541058 - DNA, 12 bp, Homo sapiens
atcttgaaaaga

SEQ ID NO: 3541059 - DNA, 21 bp, Homo sapiens
atgaaaccaactgttgacata

SEQ ID NO: 3541060 - DNA, 22 bp, Homo sapiens
atgaaaccaactgttgacatac

SEQ ID NO: 3541061 - DNA, 17 bp, Homo sapiens
atgaatgtgcatttctt

SEQ ID NO: 3541062 - DNA, 23 bp, Homo sapiens
atgatgtgaaagataaatgatga

SEQ ID NO: 3541063 - DNA, 16 bp, Homo sapiens
atgctaagaaagcaaa

SEQ ID NO: 3541064 - DNA, 17 bp, Homo sapiens
atggaaatatgttctaa

SEQ ID NO: 3541065 - DNA, 24 bp, Homo sapiens
atggatggaaatatgttctaacag

SEQ ID NO: 3541066 - DNA, 14 bp, Homo sapiens
atgggaatcattcc

SEQ ID NO: 3541067 - DNA, 16 bp, Homo sapiens
atggtgttgtatactt

SEQ ID NO: 3541068 - DNA, 14 bp, Homo sapiens
atgtcagacatgaa

SEQ ID NO: 3541069 - DNA, 15 bp, Homo sapiens
atgtcagacatgaaa

SEQ ID NO: 3541070 - DNA, 13 bp, Homo sapiens
atgtctgtatcta

SEQ ID NO: 3541071 - DNA, 15 bp, Homo sapiens
atgttaccaaagcaa

SEQ ID NO: 3541072 - DNA, 15 bp, Homo sapiens
atgttctatatgcat

SEQ ID NO: 3541073 - DNA, 17 bp, Homo sapiens
atgttctatatgcattt

SEQ ID NO: 3541074 - DNA, 19 bp, Homo sapiens
atgttgctataagaaaagt

SEQ ID NO: 3541075 - DNA, 14 bp, Homo sapiens
attaaaagttcata

SEQ ID NO: 3541076 - DNA, 16 bp, Homo sapiens
attaaataaatatttt

SEQ ID NO: 3541077 - DNA, 17 bp, Homo sapiens
attaacttttttagaat

SEQ ID NO: 3541078 - DNA, 20 bp, Homo sapiens
attaccaagttacttgaaaa

SEQ ID NO: 3541079 - DNA, 17 bp, Homo sapiens
attatcttatactgaaa

SEQ ID NO: 3541080 - DNA, 15 bp, Homo sapiens
attattcatatgctt

SEQ ID NO: 3541081 - DNA, 15 bp, Homo sapiens
attattcttcttaca

SEQ ID NO: 3541082 - DNA, 14 bp, Homo sapiens
attatttatttctg

SEQ ID NO: 3541083 - DNA, 15 bp, Homo sapiens
attatttatttctgt

SEQ ID NO: 3541084 - DNA, 14 bp, Homo sapiens
attcaccatccttt

SEQ ID NO: 3541085 - DNA, 14 bp, Homo sapiens
attcagtactgatt

SEQ ID NO: 3541086 - DNA, 19 bp, Homo sapiens
attcataatatataaaaga

SEQ ID NO: 3541087 - DNA, 20 bp, Homo sapiens
attccatttatcctagaaaa

SEQ ID NO: 3541088 - DNA, 17 bp, Homo sapiens
attcgtttctgacatac

SEQ ID NO: 3541089 - DNA, 16 bp, Homo sapiens
attctaaatattgaca

SEQ ID NO: 3541090 - DNA, 14 bp, Homo sapiens
attcttatttctgt

SEQ ID NO: 3541091 - DNA, 17 bp, Homo sapiens
attcttatttctgtgtt

SEQ ID NO: 3541092 - DNA, 19 bp, Homo sapiens
attgacctaattgttaaat

SEQ ID NO: 3541093 - DNA, 18 bp, Homo sapiens
attgctagtgatttcatt

SEQ ID NO: 3541094 - DNA, 23 bp, Homo sapiens
attgttcatgttaccaaagcaat

SEQ ID NO: 3541095 - DNA, 20 bp, Homo sapiens
attgtttttaatttgaatca

SEQ ID NO: 3541096 - DNA, 14 bp, Homo sapiens
atttaattcttatt

SEQ ID NO: 3541097 - DNA, 19 bp, Homo sapiens
atttaattcttatttctgt

SEQ ID NO: 3541098 - DNA, 18 bp, Homo sapiens
atttatgaatgtgcattt

SEQ ID NO: 3541099 - DNA, 14 bp, Homo sapiens
atttatttctgtaa

SEQ ID NO: 3541100 - DNA, 20 bp, Homo sapiens
atttcatggattatttatga

SEQ ID NO: 3541101 - DNA, 24 bp, Homo sapiens
atttgtattcccttttatttccaa

SEQ ID NO: 3541102 - DNA, 12 bp, Homo sapiens
atttgttgtact

SEQ ID NO: 3541103 - DNA, 22 bp, Homo sapiens
atttgttgtactttttattcaa

SEQ ID NO: 3541104 - DNA, 19 bp, Homo sapiens
atttgtttttcttatccaa

SEQ ID NO: 3541105 - DNA, 15 bp, Homo sapiens
attttaaaattttgc

SEQ ID NO: 3541106 - DNA, 23 bp, Homo sapiens
attttaaggtgtacgtatcattt

SEQ ID NO: 3541107 - DNA, 16 bp, Homo sapiens
attttacattctgtct

SEQ ID NO: 3541108 - DNA, 14 bp, Homo sapiens
attttattaaatct

SEQ ID NO: 3541109 - DNA, 17 bp, Homo sapiens
attttgctaccaaagaa

SEQ ID NO: 3541110 - DNA, 19 bp, Homo sapiens
atttttttaccttaaatct

SEQ ID NO: 3541111 - DNA, 13 bp, Homo sapiens
caaagcaatattt

SEQ ID NO: 3541112 - DNA, 15 bp, Homo sapiens
caaagtttgtggcat

SEQ ID NO: 3541113 - DNA, 20 bp, Homo sapiens
caaatggatggggataagaa

SEQ ID NO: 3541114 - DNA, 11 bp, Homo sapiens
caaattgttca

SEQ ID NO: 3541115 - DNA, 20 bp, Homo sapiens
caacctgagccttttcttat

SEQ ID NO: 3541116 - DNA, 21 bp, Homo sapiens
caacctggtgcatcgaaatgt

SEQ ID NO: 3541117 - DNA, 17 bp, Homo sapiens
caactgcctggatgtgt

SEQ ID NO: 3541118 - DNA, 23 bp, Homo sapiens
caagaatcattgacctaattgtt

SEQ ID NO: 3541119 - DNA, 18 bp, Homo sapiens
caagagcaatcaaagcag

SEQ ID NO: 3541120 - DNA, 19 bp, Homo sapiens
caagagcaatcaaagcagc

SEQ ID NO: 3541121 - DNA, 18 bp, Homo sapiens
caatgtgcaagttgtact

SEQ ID NO: 3541122 - DNA, 11 bp, Homo sapiens
caattatttca

SEQ ID NO: 3541123 - DNA, 21 bp, Homo sapiens
caatttaattcttatttctgt

SEQ ID NO: 3541124 - DNA, 19 bp, Homo sapiens
cacaaatccctatgttgct

SEQ ID NO: 3541125 - DNA, 21 bp, Homo sapiens
cacattaacccccaaattcaa

SEQ ID NO: 3541126 - DNA, 22 bp, Homo sapiens
cacattaacccccaaattcaaa

SEQ ID NO: 3541127 - DNA, 19 bp, Homo sapiens
caccatcctttactattaa

SEQ ID NO: 3541128 - DNA, 17 bp, Homo sapiens
cacctgggtttgcaaga

SEQ ID NO: 3541129 - DNA, 19 bp, Homo sapiens
cactgaaattctaaatatt

SEQ ID NO: 3541130 - DNA, 21 bp, Homo sapiens
cactgaaattctaaatattga

SEQ ID NO: 3541131 - DNA, 13 bp, Homo sapiens
cagaagtgtattc

SEQ ID NO: 3541132 - DNA, 13 bp, Homo sapiens
cagagaaaactgt

SEQ ID NO: 3541133 - DNA, 17 bp, Homo sapiens
cagcctgggcgagacgg

SEQ ID NO: 3541134 - DNA, 16 bp, Homo sapiens
caggtaacattataaa

SEQ ID NO: 3541135 - DNA, 18 bp, Homo sapiens
caggtaacattataaatg

SEQ ID NO: 3541136 - DNA, 20 bp, Homo sapiens
cagtcatagggctgataata

SEQ ID NO: 3541137 - DNA, 16 bp, Homo sapiens
cagtcgaactgggggc

SEQ ID NO: 3541138 - DNA, 18 bp, Homo sapiens
cagtggcccatgtgactg

SEQ ID NO: 3541139 - DNA, 16 bp, Homo sapiens
cagtgttaataaatgg

SEQ ID NO: 3541140 - DNA, 10 bp, Homo sapiens
cagtttctga

SEQ ID NO: 3541141 - DNA, 13 bp, Homo sapiens
cataaaaattgaa

SEQ ID NO: 3541142 - DNA, 16 bp, Homo sapiens
cataaaaattgaattc

SEQ ID NO: 3541143 - DNA, 14 bp, Homo sapiens
cataaactgagcct

SEQ ID NO: 3541144 - DNA, 19 bp, Homo sapiens
cataccttagactgaaaaa

SEQ ID NO: 3541145 - DNA, 16 bp, Homo sapiens
catatactaaggagcc

SEQ ID NO: 3541146 - DNA, 13 bp, Homo sapiens
catatatttatga

SEQ ID NO: 3541147 - DNA, 17 bp, Homo sapiens
catattaccagaaaatg

SEQ ID NO: 3541148 - DNA, 16 bp, Homo sapiens
catccctatttatagt

SEQ ID NO: 3541149 - DNA, 12 bp, Homo sapiens
catccttaaatg

SEQ ID NO: 3541150 - DNA, 17 bp, Homo sapiens
catcttcagtttctgaa

SEQ ID NO: 3541151 - DNA, 16 bp, Homo sapiens
catgaaaactatttta

SEQ ID NO: 3541152 - DNA, 18 bp, Homo sapiens
catgaacttcatatacta

SEQ ID NO: 3541153 - DNA, 20 bp, Homo sapiens
catgggaggggtctagctgg

SEQ ID NO: 3541154 - DNA, 22 bp, Homo sapiens
catgttaccaaagcaatatttc

SEQ ID NO: 3541155 - DNA, 22 bp, Homo sapiens
catgttctgtgtgccctgaaaa

SEQ ID NO: 3541156 - DNA, 23 bp, Homo sapiens
catgttctgtgtgccctgaaaat

SEQ ID NO: 3541157 - DNA, 14 bp, Homo sapiens
cattactttctgct

SEQ ID NO: 3541158 - DNA, 14 bp, Homo sapiens
cattctgtctgttt

SEQ ID NO: 3541159 - DNA, 16 bp, Homo sapiens
cattgacctaattgtt

SEQ ID NO: 3541160 - DNA, 17 bp, Homo sapiens
cattgacctaattgtta

SEQ ID NO: 3541161 - DNA, 18 bp, Homo sapiens
catttatcctagaaaatt

SEQ ID NO: 3541162 - DNA, 19 bp, Homo sapiens
catttatcctagaaaattg

SEQ ID NO: 3541163 - DNA, 19 bp, Homo sapiens
cattttcggcacttttcat

SEQ ID NO: 3541164 - DNA, 13 bp, Homo sapiens
ccacactgaaatt

SEQ ID NO: 3541165 - DNA, 17 bp, Homo sapiens
ccactatacaattcagt

SEQ ID NO: 3541166 - DNA, 23 bp, Homo sapiens
ccagaagtgtattcatattacca

SEQ ID NO: 3541167 - DNA, 14 bp, Homo sapiens
ccatcttctatctt

SEQ ID NO: 3541168 - DNA, 17 bp, Homo sapiens
ccatgaggactaggagc

SEQ ID NO: 3541169 - DNA, 19 bp, Homo sapiens
cccacactgaaattctaaa

SEQ ID NO: 3541170 - DNA, 22 bp, Homo sapiens
cccagtctgatattcacctaag

SEQ ID NO: 3541171 - DNA, 14 bp, Homo sapiens
cccatgaggactag

SEQ ID NO: 3541172 - DNA, 14 bp, Homo sapiens
ccctgaaaatgtta

SEQ ID NO: 3541173 - DNA, 18 bp, Homo sapiens
ccgcgtgattgtggcatt

SEQ ID NO: 3541174 - DNA, 13 bp, Homo sapiens
cctaattgttaaa

SEQ ID NO: 3541175 - DNA, 21 bp, Homo sapiens
cctagaaaattgtttttaatt

SEQ ID NO: 3541176 - DNA, 22 bp, Homo sapiens
cctatgttgctataagaaaagt

SEQ ID NO: 3541177 - DNA, 14 bp, Homo sapiens
cctcctccgggggc

SEQ ID NO: 3541178 - DNA, 13 bp, Homo sapiens
cctgagccttttc

SEQ ID NO: 3541179 - DNA, 17 bp, Homo sapiens
cctgctgtcagcctggc

SEQ ID NO: 3541180 - DNA, 19 bp, Homo sapiens
cctggaatttaattcaaag

SEQ ID NO: 3541181 - DNA, 14 bp, Homo sapiens
ccttactagaaata

SEQ ID NO: 3541182 - DNA, 16 bp, Homo sapiens
ccttagctgtaaaatg

SEQ ID NO: 3541183 - DNA, 12 bp, Homo sapiens
ccttcctgtgcc

SEQ ID NO: 3541184 - DNA, 21 bp, Homo sapiens
ccttttccttagctgtaaaat

SEQ ID NO: 3541185 - DNA, 12 bp, Homo sapiens
ccttttcttata

SEQ ID NO: 3541186 - DNA, 14 bp, Homo sapiens
cgacatactcattt

SEQ ID NO: 3541187 - DNA, 16 bp, Homo sapiens
cgattatttatttctg

SEQ ID NO: 3541188 - DNA, 14 bp, Homo sapiens
cgcccttcctgtgc

SEQ ID NO: 3541189 - DNA, 20 bp, Homo sapiens
cggacccttttccttagctg

SEQ ID NO: 3541190 - DNA, 17 bp, Homo sapiens
ctaaaggtagatcatct

SEQ ID NO: 3541191 - DNA, 17 bp, Homo sapiens
ctaaatattgacactta

SEQ ID NO: 3541192 - DNA, 13 bp, Homo sapiens
ctaaatgaagaga

SEQ ID NO: 3541193 - DNA, 17 bp, Homo sapiens
ctaaatggagaaagctg

SEQ ID NO: 3541194 - DNA, 16 bp, Homo sapiens
ctaatgggaatcattc

SEQ ID NO: 3541195 - DNA, 17 bp, Homo sapiens
ctaatgggaatcattcc

SEQ ID NO: 3541196 - DNA, 20 bp, Homo sapiens
ctagaaatatattcataata

SEQ ID NO: 3541197 - DNA, 16 bp, Homo sapiens
ctagaacatccttaaa

SEQ ID NO: 3541198 - DNA, 20 bp, Homo sapiens
ctaggagcccagccttgcgc

SEQ ID NO: 3541199 - DNA, 14 bp, Homo sapiens
ctagtatatgtcag

SEQ ID NO: 3541200 - DNA, 22 bp, Homo sapiens
ctagtatatgtcagacatgaaa

SEQ ID NO: 3541201 - DNA, 16 bp, Homo sapiens
ctatatgcatttaatt

SEQ ID NO: 3541202 - DNA, 20 bp, Homo sapiens
ctatcactggcaatatttgt

SEQ ID NO: 3541203 - DNA, 22 bp, Homo sapiens
ctattaagggaaaggaaaagaa

SEQ ID NO: 3541204 - DNA, 14 bp, Homo sapiens
ctattaattccaag

SEQ ID NO: 3541205 - DNA, 21 bp, Homo sapiens
ctattcaatttaattcttatt

SEQ ID NO: 3541206 - DNA, 14 bp, Homo sapiens
ctattttaaagctg

SEQ ID NO: 3541207 - DNA, 22 bp, Homo sapiens
ctcatgtacattggtctttcta

SEQ ID NO: 3541208 - DNA, 21 bp, Homo sapiens
ctccccaaattgccctgttgc

SEQ ID NO: 3541209 - DNA, 16 bp, Homo sapiens
ctgaaattctaaatat

SEQ ID NO: 3541210 - DNA, 17 bp, Homo sapiens
ctgacataccttagact

SEQ ID NO: 3541211 - DNA, 22 bp, Homo sapiens
ctgacataccttagactgaaaa

SEQ ID NO: 3541212 - DNA, 13 bp, Homo sapiens
ctgacttagccta

SEQ ID NO: 3541213 - DNA, 22 bp, Homo sapiens
ctgactttgttgccttatcttg

SEQ ID NO: 3541214 - DNA, 14 bp, Homo sapiens
ctgagcctcttttc

SEQ ID NO: 3541215 - DNA, 16 bp, Homo sapiens
ctgatggtgtctgagg

SEQ ID NO: 3541216 - DNA, 18 bp, Homo sapiens
ctgcatttttttacctta

SEQ ID NO: 3541217 - DNA, 17 bp, Homo sapiens
ctgctagtatatgtcag

SEQ ID NO: 3541218 - DNA, 19 bp, Homo sapiens
ctggaatttaattcaaagt

SEQ ID NO: 3541219 - DNA, 21 bp, Homo sapiens
ctgggtttgcaagaatctaaa

SEQ ID NO: 3541220 - DNA, 21 bp, Homo sapiens
ctggtttagtgttctgtattt

SEQ ID NO: 3541221 - DNA, 23 bp, Homo sapiens
ctgtgcagaggaaacttaagcat

SEQ ID NO: 3541222 - DNA, 17 bp, Homo sapiens
ctgtgtgccctgaaaat

SEQ ID NO: 3541223 - DNA, 23 bp, Homo sapiens
cttaaataaatcaagaatcattg

SEQ ID NO: 3541224 - DNA, 15 bp, Homo sapiens
cttagctatgtttcc

SEQ ID NO: 3541225 - DNA, 13 bp, Homo sapiens
cttatagcaagaa

SEQ ID NO: 3541226 - DNA, 19 bp, Homo sapiens
cttatataagacaagaata

SEQ ID NO: 3541227 - DNA, 15 bp, Homo sapiens
cttcaatatgaagga

SEQ ID NO: 3541228 - DNA, 13 bp, Homo sapiens
cttcattttacat

SEQ ID NO: 3541229 - DNA, 12 bp, Homo sapiens
cttcttcttata

SEQ ID NO: 3541230 - DNA, 21 bp, Homo sapiens
cttggtgctatgacagtgtga

SEQ ID NO: 3541231 - DNA, 15 bp, Homo sapiens
cttgtctttaaatct

SEQ ID NO: 3541232 - DNA, 19 bp, Homo sapiens
ctttcccacactgaaattc

SEQ ID NO: 3541233 - DNA, 17 bp, Homo sapiens
ctttcttttgtaaagag

SEQ ID NO: 3541234 - DNA, 20 bp, Homo sapiens
ctttgttgccttatcttgaa

SEQ ID NO: 3541235 - DNA, 12 bp, Homo sapiens
cttttatttcca

SEQ ID NO: 3541236 - DNA, 17 bp, Homo sapiens
ctttttttgctttgttt

SEQ ID NO: 3541237 - DNA, 14 bp, Homo sapiens
gaaaaaatgttcta

SEQ ID NO: 3541238 - DNA, 15 bp, Homo sapiens
gaaaactattttaaa

SEQ ID NO: 3541239 - DNA, 13 bp, Homo sapiens
gaaaagtgctgtt

SEQ ID NO: 3541240 - DNA, 22 bp, Homo sapiens
gaaaattgtttttaatttgaat

SEQ ID NO: 3541241 - DNA, 16 bp, Homo sapiens
gaaagataaatgatga

SEQ ID NO: 3541242 - DNA, 13 bp, Homo sapiens
gaaaggaaaagaa

SEQ ID NO: 3541243 - DNA, 15 bp, Homo sapiens
gaaatgatgtgaaag

SEQ ID NO: 3541244 - DNA, 21 bp, Homo sapiens
gaaatgtattcacctttcttt

SEQ ID NO: 3541245 - DNA, 22 bp, Homo sapiens
gaaatgtattcacctttctttt

SEQ ID NO: 3541246 - DNA, 15 bp, Homo sapiens
gaactctgcacagca

SEQ ID NO: 3541247 - DNA, 17 bp, Homo sapiens
gaagtaaagtttatttc

SEQ ID NO: 3541248 - DNA, 18 bp, Homo sapiens
gaagtaaagtttatttca

SEQ ID NO: 3541249 - DNA, 14 bp, Homo sapiens
gaatcagagaaaac

SEQ ID NO: 3541250 - DNA, 12 bp, Homo sapiens
gaatcattccac

SEQ ID NO: 3541251 - DNA, 23 bp, Homo sapiens
gaatcattccactatacaattca

SEQ ID NO: 3541252 - DNA, 19 bp, Homo sapiens
gaatctagataggtgcttt

SEQ ID NO: 3541253 - DNA, 15 bp, Homo sapiens
gaatgcatgttctgt

SEQ ID NO: 3541254 - DNA, 16 bp, Homo sapiens
gaatgtgcatttcttg

SEQ ID NO: 3541255 - DNA, 16 bp, Homo sapiens
gaattgcattagtcca

SEQ ID NO: 3541256 - DNA, 22 bp, Homo sapiens
gaattgcttgaacccaggaggc

SEQ ID NO: 3541257 - DNA, 21 bp, Homo sapiens
gacataccttagactgaaaaa

SEQ ID NO: 3541258 - DNA, 18 bp, Homo sapiens
gacatgaaaactatttta

SEQ ID NO: 3541259 - DNA, 21 bp, Homo sapiens
gagcctcttttcaattatttc

SEQ ID NO: 3541260 - DNA, 15 bp, Homo sapiens
gagggattttattaa

SEQ ID NO: 3541261 - DNA, 20 bp, Homo sapiens
gagtttgagactagcctggc

SEQ ID NO: 3541262 - DNA, 18 bp, Homo sapiens
gataaatgatgattcgtg

SEQ ID NO: 3541263 - DNA, 20 bp, Homo sapiens
gataatacaggtaacattat

SEQ ID NO: 3541264 - DNA, 15 bp, Homo sapiens
gatcacaccactaca

SEQ ID NO: 3541265 - DNA, 24 bp, Homo sapiens
gatcacaccactacactccagcct

SEQ ID NO: 3541266 - DNA, 18 bp, Homo sapiens
gatctgcgaagttgaacc

SEQ ID NO: 3541267 - DNA, 18 bp, Homo sapiens
gatgactttttttctgat

SEQ ID NO: 3541268 - DNA, 23 bp, Homo sapiens
gatgctggaaatatgaaatgtat

SEQ ID NO: 3541269 - DNA, 14 bp, Homo sapiens
gatggggataagaa

SEQ ID NO: 3541270 - DNA, 16 bp, Homo sapiens
gattataaaattattt

SEQ ID NO: 3541271 - DNA, 15 bp, Homo sapiens
gattatttatttctg

SEQ ID NO: 3541272 - DNA, 16 bp, Homo sapiens
gattatttatttctgt

SEQ ID NO: 3541273 - DNA, 18 bp, Homo sapiens
gattatttatttctgtaa

SEQ ID NO: 3541274 - DNA, 18 bp, Homo sapiens
gcaaccttcattttacat

SEQ ID NO: 3541275 - DNA, 17 bp, Homo sapiens
gcacatggtgttgtata

SEQ ID NO: 3541276 - DNA, 19 bp, Homo sapiens
gcacctgctgtcagcctgg

SEQ ID NO: 3541277 - DNA, 20 bp, Homo sapiens
gcacctgctgtcagcctggc

SEQ ID NO: 3541278 - DNA, 22 bp, Homo sapiens
gcacgctggacagcactctgcc

SEQ ID NO: 3541279 - DNA, 18 bp, Homo sapiens
gcagcacatggtgttgta

SEQ ID NO: 3541280 - DNA, 22 bp, Homo sapiens
gcagcacatggtgttgtatact

SEQ ID NO: 3541281 - DNA, 22 bp, Homo sapiens
gcagttttgtaaataagtgaaa

SEQ ID NO: 3541282 - DNA, 22 bp, Homo sapiens
gcataaaaattgaattcgtttc

SEQ ID NO: 3541283 - DNA, 22 bp, Homo sapiens
gcatcatcatcacaacctaaat

SEQ ID NO: 3541284 - DNA, 13 bp, Homo sapiens
gcatccctcctgg

SEQ ID NO: 3541285 - DNA, 18 bp, Homo sapiens
gccaaaggccgtgcctgg

SEQ ID NO: 3541286 - DNA, 17 bp, Homo sapiens
gccagatgcttggcctg

SEQ ID NO: 3541287 - DNA, 15 bp, Homo sapiens
gccatatttatagaa

SEQ ID NO: 3541288 - DNA, 21 bp, Homo sapiens
gcccatgtgactgtggcattt

SEQ ID NO: 3541289 - DNA, 20 bp, Homo sapiens
gccccagtcgaactgggggc

SEQ ID NO: 3541290 - DNA, 15 bp, Homo sapiens
gccgtgcctggtggg

SEQ ID NO: 3541291 - DNA, 19 bp, Homo sapiens
gcctcttttcaattatttc

SEQ ID NO: 3541292 - DNA, 17 bp, Homo sapiens
gccttatcttgaaaaga

SEQ ID NO: 3541293 - DNA, 19 bp, Homo sapiens
gccttttcttatataagac

SEQ ID NO: 3541294 - DNA, 15 bp, Homo sapiens
gcgttctcatcccag

SEQ ID NO: 3541295 - DNA, 13 bp, Homo sapiens
gctacctctgagt

SEQ ID NO: 3541296 - DNA, 14 bp, Homo sapiens
gctataagaaaagt

SEQ ID NO: 3541297 - DNA, 13 bp, Homo sapiens
gctggacagcact

SEQ ID NO: 3541298 - DNA, 19 bp, Homo sapiens
gctggagggaggggcggga

SEQ ID NO: 3541299 - DNA, 19 bp, Homo sapiens
gctggccactgctggaggc

SEQ ID NO: 3541300 - DNA, 13 bp, Homo sapiens
ggaatttaattca

SEQ ID NO: 3541301 - DNA, 18 bp, Homo sapiens
ggcaagttttgaagcctg

SEQ ID NO: 3541302 - DNA, 12 bp, Homo sapiens
ggcaatatttgt

SEQ ID NO: 3541303 - DNA, 12 bp, Homo sapiens
ggccaaggacag

SEQ ID NO: 3541304 - DNA, 18 bp, Homo sapiens
ggccatttgtatttgtat

SEQ ID NO: 3541305 - DNA, 16 bp, Homo sapiens
ggccgtgcctggtggg

SEQ ID NO: 3541306 - DNA, 19 bp, Homo sapiens
ggtcacatatgtctgtatc

SEQ ID NO: 3541307 - DNA, 17 bp, Homo sapiens
ggtcactctgaccttat

SEQ ID NO: 3541308 - DNA, 16 bp, Homo sapiens
ggtggaaagagaaatg

SEQ ID NO: 3541309 - DNA, 17 bp, Homo sapiens
ggttcatccagaagtgt

SEQ ID NO: 3541310 - DNA, 24 bp, Homo sapiens
ggttcctcttggagtctagaacat

SEQ ID NO: 3541311 - DNA, 23 bp, Homo sapiens
ggttctttcccacactgaaattc

SEQ ID NO: 3541312 - DNA, 18 bp, Homo sapiens
ggtttagtgttctgtatt

SEQ ID NO: 3541313 - DNA, 15 bp, Homo sapiens
gtaaagtttatttca

SEQ ID NO: 3541314 - DNA, 17 bp, Homo sapiens
gtaacattataaatgac

SEQ ID NO: 3541315 - DNA, 15 bp, Homo sapiens
gtacgtatcatttct

SEQ ID NO: 3541316 - DNA, 16 bp, Homo sapiens
gtactgattattcttc

SEQ ID NO: 3541317 - DNA, 15 bp, Homo sapiens
gtagatcatcttgaa

SEQ ID NO: 3541318 - DNA, 16 bp, Homo sapiens
gtagcaaccttcattt

SEQ ID NO: 3541319 - DNA, 21 bp, Homo sapiens
gtagcaaccttcattttacat

SEQ ID NO: 3541320 - DNA, 14 bp, Homo sapiens
gtaggccaggcgtg

SEQ ID NO: 3541321 - DNA, 14 bp, Homo sapiens
gtatcatttctaat

SEQ ID NO: 3541322 - DNA, 15 bp, Homo sapiens
gtatcatttctaatt

SEQ ID NO: 3541323 - DNA, 19 bp, Homo sapiens
gtatcatttctaattttaa

SEQ ID NO: 3541324 - DNA, 19 bp, Homo sapiens
gtattaacttttttagaat

SEQ ID NO: 3541325 - DNA, 21 bp, Homo sapiens
gtattcatattaccagaaaat

SEQ ID NO: 3541326 - DNA, 23 bp, Homo sapiens
gtattcatattaccagaaaatga

SEQ ID NO: 3541327 - DNA, 22 bp, Homo sapiens
gtattgtcttaaataaatcaag

SEQ ID NO: 3541328 - DNA, 20 bp, Homo sapiens
gtgacgattatttatttctg

SEQ ID NO: 3541329 - DNA, 16 bp, Homo sapiens
gtgcagaggaaactta

SEQ ID NO: 3541330 - DNA, 18 bp, Homo sapiens
gtgcatcgaaatgtattc

SEQ ID NO: 3541331 - DNA, 18 bp, Homo sapiens
gtgggcatccctcctggt

SEQ ID NO: 3541332 - DNA, 19 bp, Homo sapiens
gtgtactccgaaacaagta

SEQ ID NO: 3541333 - DNA, 16 bp, Homo sapiens
gttaaatttaaaaata

SEQ ID NO: 3541334 - DNA, 13 bp, Homo sapiens
gttaccaaagcaa

SEQ ID NO: 3541335 - DNA, 17 bp, Homo sapiens
gttaccaaagcaatatt

SEQ ID NO: 3541336 - DNA, 19 bp, Homo sapiens
gttaccaaagcaatatttc

SEQ ID NO: 3541337 - DNA, 21 bp, Homo sapiens
gttaccagtgttaataaatgg

SEQ ID NO: 3541338 - DNA, 22 bp, Homo sapiens
gttagaagtgcaccaggtcact

SEQ ID NO: 3541339 - DNA, 23 bp, Homo sapiens
gttattctatcactggcaatatt

SEQ ID NO: 3541340 - DNA, 23 bp, Homo sapiens
gttctggtttagtgttctgtatt

SEQ ID NO: 3541341 - DNA, 20 bp, Homo sapiens
gttctgtgtgccctgaaaat

SEQ ID NO: 3541342 - DNA, 16 bp, Homo sapiens
gttgactggcatccat

SEQ ID NO: 3541343 - DNA, 13 bp, Homo sapiens
gttgctataagaa

SEQ ID NO: 3541344 - DNA, 17 bp, Homo sapiens
gttgctataagaaaagt

SEQ ID NO: 3541345 - DNA, 14 bp, Homo sapiens
gttggttcatccag

SEQ ID NO: 3541346 - DNA, 15 bp, Homo sapiens
gttgtatacttcatt

SEQ ID NO: 3541347 - DNA, 17 bp, Homo sapiens
gttgtctgtagagaatg

SEQ ID NO: 3541348 - DNA, 16 bp, Homo sapiens
gtttagtgttctgtat

SEQ ID NO: 3541349 - DNA, 19 bp, Homo sapiens
gtttttaatttgaatcaga

SEQ ID NO: 3541350 - DNA, 18 bp, Homo sapiens
taaaaattgaattcgttt

SEQ ID NO: 3541351 - DNA, 17 bp, Homo sapiens
taaaattgctagtgatt

SEQ ID NO: 3541352 - DNA, 16 bp, Homo sapiens
taaaatttgtttagaa

SEQ ID NO: 3541353 - DNA, 20 bp, Homo sapiens
taaactgagcctcttttcaa

SEQ ID NO: 3541354 - DNA, 16 bp, Homo sapiens
taaagtttatttcatg

SEQ ID NO: 3541355 - DNA, 15 bp, Homo sapiens
taaataaatatttta

SEQ ID NO: 3541356 - DNA, 21 bp, Homo sapiens
taaataaatcaagaatcattg

SEQ ID NO: 3541357 - DNA, 21 bp, Homo sapiens
taaatcttcaatatgaaggac

SEQ ID NO: 3541358 - DNA, 19 bp, Homo sapiens
taaatgaagagacttaaga

SEQ ID NO: 3541359 - DNA, 17 bp, Homo sapiens
taaatgacagatctcaa

SEQ ID NO: 3541360 - DNA, 17 bp, Homo sapiens
taactaggccatttgta

SEQ ID NO: 3541361 - DNA, 21 bp, Homo sapiens
taactggggtattaacttttt

SEQ ID NO: 3541362 - DNA, 14 bp, Homo sapiens
taagaaagcaaata

SEQ ID NO: 3541363 - DNA, 20 bp, Homo sapiens
taagaataggtcattttcta

SEQ ID NO: 3541364 - DNA, 19 bp, Homo sapiens
taagtgaaaataatttgtt

SEQ ID NO: 3541365 - DNA, 17 bp, Homo sapiens
taataaatggatactta

SEQ ID NO: 3541366 - DNA, 19 bp, Homo sapiens
taatacaggtaacattata

SEQ ID NO: 3541367 - DNA, 17 bp, Homo sapiens
taatgggaatcattcca

SEQ ID NO: 3541368 - DNA, 18 bp, Homo sapiens
taatgggaatcattccac

SEQ ID NO: 3541369 - DNA, 19 bp, Homo sapiens
taattcttatttctgtgtt

SEQ ID NO: 3541370 - DNA, 15 bp, Homo sapiens
taattgttaaattta

SEQ ID NO: 3541371 - DNA, 18 bp, Homo sapiens
taatttgttgtacttttt

SEQ ID NO: 3541372 - DNA, 20 bp, Homo sapiens
tacaggtaacattataaatg

SEQ ID NO: 3541373 - DNA, 21 bp, Homo sapiens
tacaggtaacattataaatga

SEQ ID NO: 3541374 - DNA, 14 bp, Homo sapiens
tacatgctaagaaa

SEQ ID NO: 3541375 - DNA, 17 bp, Homo sapiens
tacattattaatcattc

SEQ ID NO: 3541376 - DNA, 20 bp, Homo sapiens
taccaaagaatgcatgttct

SEQ ID NO: 3541377 - DNA, 14 bp, Homo sapiens
taccagaaaatgag

SEQ ID NO: 3541378 - DNA, 15 bp, Homo sapiens
taccagaaaatgagt

SEQ ID NO: 3541379 - DNA, 19 bp, Homo sapiens
taccagtgttaataaatgg

SEQ ID NO: 3541380 - DNA, 21 bp, Homo sapiens
taccttaaatctgcctttgtt

SEQ ID NO: 3541381 - DNA, 16 bp, Homo sapiens
taccttagactgaaaa

SEQ ID NO: 3541382 - DNA, 15 bp, Homo sapiens
tacgtatcatttcta

SEQ ID NO: 3541383 - DNA, 21 bp, Homo sapiens
tactagaaatatattcataat

SEQ ID NO: 3541384 - DNA, 17 bp, Homo sapiens
tactgacttagcctaaa

SEQ ID NO: 3541385 - DNA, 14 bp, Homo sapiens
tactgattattctt

SEQ ID NO: 3541386 - DNA, 20 bp, Homo sapiens
tacttgaaaaaatgttctat

SEQ ID NO: 3541387 - DNA, 20 bp, Homo sapiens
tactttttattcaattctgt

SEQ ID NO: 3541388 - DNA, 16 bp, Homo sapiens
tagaaatatattcata

SEQ ID NO: 3541389 - DNA, 15 bp, Homo sapiens
tagaacatccttaaa

SEQ ID NO: 3541390 - DNA, 21 bp, Homo sapiens
tagataatacaggtaacatta

SEQ ID NO: 3541391 - DNA, 17 bp, Homo sapiens
tagcaaccttcatttta

SEQ ID NO: 3541392 - DNA, 16 bp, Homo sapiens
taggccatttgtattt

SEQ ID NO: 3541393 - DNA, 22 bp, Homo sapiens
tagtagtgggaaagatacatgc

SEQ ID NO: 3541394 - DNA, 16 bp, Homo sapiens
tagtgatttcattacc

SEQ ID NO: 3541395 - DNA, 14 bp, Homo sapiens
tagtgttctgtatt

SEQ ID NO: 3541396 - DNA, 12 bp, Homo sapiens
tagttttctgta

SEQ ID NO: 3541397 - DNA, 13 bp, Homo sapiens
tataaaagaaata

SEQ ID NO: 3541398 - DNA, 20 bp, Homo sapiens
tataagacaagaatatgttc

SEQ ID NO: 3541399 - DNA, 12 bp, Homo sapiens
tatactgaaaaa

SEQ ID NO: 3541400 - DNA, 14 bp, Homo sapiens
tatataagacaaga

SEQ ID NO: 3541401 - DNA, 23 bp, Homo sapiens
tatatattccttactagaaatat

SEQ ID NO: 3541402 - DNA, 16 bp, Homo sapiens
tatatgatatatatta

SEQ ID NO: 3541403 - DNA, 14 bp, Homo sapiens
tatattaatttgtt

SEQ ID NO: 3541404 - DNA, 23 bp, Homo sapiens
tatattccttactagaaatatat

SEQ ID NO: 3541405 - DNA, 17 bp, Homo sapiens
tatcactggcaatattt

SEQ ID NO: 3541406 - DNA, 13 bp, Homo sapiens
tatcttctttcca

SEQ ID NO: 3541407 - DNA, 18 bp, Homo sapiens
tatgaatgtgcatttctt

SEQ ID NO: 3541408 - DNA, 14 bp, Homo sapiens
tatgaatgttcttg

SEQ ID NO: 3541409 - DNA, 18 bp, Homo sapiens
tatgacagtgtgagactc

SEQ ID NO: 3541410 - DNA, 20 bp, Homo sapiens
tatgtcagacatgaaaacta

SEQ ID NO: 3541411 - DNA, 19 bp, Homo sapiens
tatgtttccatcttcagtt

SEQ ID NO: 3541412 - DNA, 23 bp, Homo sapiens
tatgtttccatcttcagtttctg

SEQ ID NO: 3541413 - DNA, 21 bp, Homo sapiens
tattaagggaaaggaaaagaa

SEQ ID NO: 3541414 - DNA, 12 bp, Homo sapiens
tattaatcattc

SEQ ID NO: 3541415 - DNA, 19 bp, Homo sapiens
tattcccttttatttccaa

SEQ ID NO: 3541416 - DNA, 15 bp, Homo sapiens
tatttatgaatgtgc

SEQ ID NO: 3541417 - DNA, 17 bp, Homo sapiens
tatttatgaatgtgcat

SEQ ID NO: 3541418 - DNA, 14 bp, Homo sapiens
tatttcaatgggac

SEQ ID NO: 3541419 - DNA, 19 bp, Homo sapiens
tatttgtattcccttttat

SEQ ID NO: 3541420 - DNA, 20 bp, Homo sapiens
tattttaaagctgactttgt

SEQ ID NO: 3541421 - DNA, 22 bp, Homo sapiens
tattttaaagctgactttgttg

SEQ ID NO: 3541422 - DNA, 19 bp, Homo sapiens
tatttttattaaataaata

SEQ ID NO: 3541423 - DNA, 14 bp, Homo sapiens
tcaagaatcattga

SEQ ID NO: 3541424 - DNA, 14 bp, Homo sapiens
tcaagattgcaaag

SEQ ID NO: 3541425 - DNA, 17 bp, Homo sapiens
tcaataggaattgcatt

SEQ ID NO: 3541426 - DNA, 20 bp, Homo sapiens
tcaatgggacaggaactagg

SEQ ID NO: 3541427 - DNA, 21 bp, Homo sapiens
tcaatgtgcaagttgtactgt

SEQ ID NO: 3541428 - DNA, 23 bp, Homo sapiens
tcaatttaattcttatttctgtg

SEQ ID NO: 3541429 - DNA, 23 bp, Homo sapiens
tcacacattaacccccaaattca

SEQ ID NO: 3541430 - DNA, 18 bp, Homo sapiens
tcacatatgtctgtatct

SEQ ID NO: 3541431 - DNA, 19 bp, Homo sapiens
tcacatatgtctgtatcta

SEQ ID NO: 3541432 - DNA, 21 bp, Homo sapiens
tcacccccctgtattctcagc

SEQ ID NO: 3541433 - DNA, 12 bp, Homo sapiens
tcacctgggcgg

SEQ ID NO: 3541434 - DNA, 18 bp, Homo sapiens
tcacctgggtttgcaaga

SEQ ID NO: 3541435 - DNA, 17 bp, Homo sapiens
tcacctttcttttgtaa

SEQ ID NO: 3541436 - DNA, 21 bp, Homo sapiens
tcagagaaaactgttgaggtt

SEQ ID NO: 3541437 - DNA, 22 bp, Homo sapiens
tcagcactttgggaggccgagg

SEQ ID NO: 3541438 - DNA, 22 bp, Homo sapiens
tcaggttgtctgtagagaatga

SEQ ID NO: 3541439 - DNA, 23 bp, Homo sapiens
tcaggttgtctgtagagaatgaa

SEQ ID NO: 3541440 - DNA, 16 bp, Homo sapiens
tcagtactgattattc

SEQ ID NO: 3541441 - DNA, 12 bp, Homo sapiens
tcagtttctgaa

SEQ ID NO: 3541442 - DNA, 16 bp, Homo sapiens
tcatatgaatgttctt

SEQ ID NO: 3541443 - DNA, 17 bp, Homo sapiens
tcatattaccagaaaat

SEQ ID NO: 3541444 - DNA, 18 bp, Homo sapiens
tcatcacaacctaaatgg

SEQ ID NO: 3541445 - DNA, 19 bp, Homo sapiens
tcatcacaacctaaatgga

SEQ ID NO: 3541446 - DNA, 20 bp, Homo sapiens
tcatcacaacctaaatggag

SEQ ID NO: 3541447 - DNA, 22 bp, Homo sapiens
tcatccctatttatagttttta

SEQ ID NO: 3541448 - DNA, 24 bp, Homo sapiens
tcatgatggatggaaatatgttct

SEQ ID NO: 3541449 - DNA, 14 bp, Homo sapiens
tcatgtacattggt

SEQ ID NO: 3541450 - DNA, 23 bp, Homo sapiens
tcatgttaccaaagcaatatttc

SEQ ID NO: 3541451 - DNA, 14 bp, Homo sapiens
tcatttagttagaa

SEQ ID NO: 3541452 - DNA, 18 bp, Homo sapiens
tccacctttctctgtttt

SEQ ID NO: 3541453 - DNA, 18 bp, Homo sapiens
tccatcttcagtttctga

SEQ ID NO: 3541454 - DNA, 19 bp, Homo sapiens
tccatcttcagtttctgaa

SEQ ID NO: 3541455 - DNA, 17 bp, Homo sapiens
tcccagtctgatattca

SEQ ID NO: 3541456 - DNA, 16 bp, Homo sapiens
tccccctcctccgggg

SEQ ID NO: 3541457 - DNA, 18 bp, Homo sapiens
tccttaaatgtctaacaa

SEQ ID NO: 3541458 - DNA, 15 bp, Homo sapiens
tccttagctgtaaaa

SEQ ID NO: 3541459 - DNA, 18 bp, Homo sapiens
tctatggggatacatgaa

SEQ ID NO: 3541460 - DNA, 16 bp, Homo sapiens
tctcatcccagtctga

SEQ ID NO: 3541461 - DNA, 15 bp, Homo sapiens
tctctgttttatgaa

SEQ ID NO: 3541462 - DNA, 16 bp, Homo sapiens
tctgcatcatcatcac

SEQ ID NO: 3541463 - DNA, 13 bp, Homo sapiens
tctgtagagaatg

SEQ ID NO: 3541464 - DNA, 16 bp, Homo sapiens
tctgtatatgatatat

SEQ ID NO: 3541465 - DNA, 16 bp, Homo sapiens
tctgtgtgccctgaaa

SEQ ID NO: 3541466 - DNA, 22 bp, Homo sapiens
tcttaaataaatcaagaatcat

SEQ ID NO: 3541467 - DNA, 17 bp, Homo sapiens
tcttcaatatgaaggac

SEQ ID NO: 3541468 - DNA, 20 bp, Homo sapiens
tcttgaaaagaatctagata

SEQ ID NO: 3541469 - DNA, 15 bp, Homo sapiens
tcttggagtctagaa

SEQ ID NO: 3541470 - DNA, 17 bp, Homo sapiens
tctttcccacactgaaa

SEQ ID NO: 3541471 - DNA, 20 bp, Homo sapiens
tctttcccacactgaaattc

SEQ ID NO: 3541472 - DNA, 16 bp, Homo sapiens
tctttctacatagtta

SEQ ID NO: 3541473 - DNA, 22 bp, Homo sapiens
tctttggtattgtcttaaataa

SEQ ID NO: 3541474 - DNA, 23 bp, Homo sapiens
tgaaaaaaaattcctttcagatt

SEQ ID NO: 3541475 - DNA, 23 bp, Homo sapiens
tgaaaaaatgttctatatgcatt

SEQ ID NO: 3541476 - DNA, 13 bp, Homo sapiens
tgaaaaatctttt

SEQ ID NO: 3541477 - DNA, 15 bp, Homo sapiens
tgaaaactattttaa

SEQ ID NO: 3541478 - DNA, 19 bp, Homo sapiens
tgaaaataatttgttgtac

SEQ ID NO: 3541479 - DNA, 17 bp, Homo sapiens
tgaaagataaatgatga

SEQ ID NO: 3541480 - DNA, 21 bp, Homo sapiens
tgaaagataaatgatgattcg

SEQ ID NO: 3541481 - DNA, 22 bp, Homo sapiens
tgaaagtaactgttttcttctt

SEQ ID NO: 3541482 - DNA, 13 bp, Homo sapiens
tgaaattctaaat

SEQ ID NO: 3541483 - DNA, 16 bp, Homo sapiens
tgaacagtgttaataa

SEQ ID NO: 3541484 - DNA, 23 bp, Homo sapiens
tgaagcctgctaaatgaagagac

SEQ ID NO: 3541485 - DNA, 19 bp, Homo sapiens
tgaaggactattaattcca

SEQ ID NO: 3541486 - DNA, 16 bp, Homo sapiens
tgaagggcttcttctt

SEQ ID NO: 3541487 - DNA, 12 bp, Homo sapiens
tgaatatttgct

SEQ ID NO: 3541488 - DNA, 17 bp, Homo sapiens
tgaatatttgcttaaaa

SEQ ID NO: 3541489 - DNA, 15 bp, Homo sapiens
tgaattcgtttctga

SEQ ID NO: 3541490 - DNA, 19 bp, Homo sapiens
tgaattcgtttctgacata

SEQ ID NO: 3541491 - DNA, 20 bp, Homo sapiens
tgacatacaaaccatgattg

SEQ ID NO: 3541492 - DNA, 21 bp, Homo sapiens
tgacataccttagactgaaaa

SEQ ID NO: 3541493 - DNA, 19 bp, Homo sapiens
tgacgattatttatttctg

SEQ ID NO: 3541494 - DNA, 22 bp, Homo sapiens
tgacgattatttatttctgtaa

SEQ ID NO: 3541495 - DNA, 17 bp, Homo sapiens
tgacttagcctaaacaa

SEQ ID NO: 3541496 - DNA, 13 bp, Homo sapiens
tgacttcacagca

SEQ ID NO: 3541497 - DNA, 16 bp, Homo sapiens
tgagccttttcttata

SEQ ID NO: 3541498 - DNA, 18 bp, Homo sapiens
tgattattcttcttacat

SEQ ID NO: 3541499 - DNA, 22 bp, Homo sapiens
tgcaaagtcgacatactcattt

SEQ ID NO: 3541500 - DNA, 13 bp, Homo sapiens
tgcaagaatctaa

SEQ ID NO: 3541501 - DNA, 14 bp, Homo sapiens
tgcatcgaaatgta

SEQ ID NO: 3541502 - DNA, 18 bp, Homo sapiens
tgcctctgccttatctca

SEQ ID NO: 3541503 - DNA, 15 bp, Homo sapiens
tgccttatctcattt

SEQ ID NO: 3541504 - DNA, 18 bp, Homo sapiens
tgccttatctcatttctc

SEQ ID NO: 3541505 - DNA, 16 bp, Homo sapiens
tgccttatcttgaaaa

SEQ ID NO: 3541506 - DNA, 18 bp, Homo sapiens
tgctgggtgcgaaggcag

SEQ ID NO: 3541507 - DNA, 15 bp, Homo sapiens
tggaaagagaaatga

SEQ ID NO: 3541508 - DNA, 14 bp, Homo sapiens
tggaaatatgttct

SEQ ID NO: 3541509 - DNA, 17 bp, Homo sapiens
tggatggggataagaat

SEQ ID NO: 3541510 - DNA, 18 bp, Homo sapiens
tggcaatatttgttctgg

SEQ ID NO: 3541511 - DNA, 13 bp, Homo sapiens
tgggaatcattcc

SEQ ID NO: 3541512 - DNA, 16 bp, Homo sapiens
tgggcatccctcctgg

SEQ ID NO: 3541513 - DNA, 20 bp, Homo sapiens
tgggcatccctcctggtacc

SEQ ID NO: 3541514 - DNA, 15 bp, Homo sapiens
tgggtttgcaagaat

SEQ ID NO: 3541515 - DNA, 20 bp, Homo sapiens
tggtattgtcttaaataaat

SEQ ID NO: 3541516 - DNA, 18 bp, Homo sapiens
tggtttagtgttctgtat

SEQ ID NO: 3541517 - DNA, 19 bp, Homo sapiens
tgtaaagagaccatcttct

SEQ ID NO: 3541518 - DNA, 19 bp, Homo sapiens
tgtatagattataaaatta

SEQ ID NO: 3541519 - DNA, 20 bp, Homo sapiens
tgtattcccttttatttcca

SEQ ID NO: 3541520 - DNA, 13 bp, Homo sapiens
tgtattttaaggt

SEQ ID NO: 3541521 - DNA, 18 bp, Homo sapiens
tgtctgtagagaatgaaa

SEQ ID NO: 3541522 - DNA, 20 bp, Homo sapiens
tgtcttaaataaatcaagaa

SEQ ID NO: 3541523 - DNA, 17 bp, Homo sapiens
tgtgaaagataaatgat

SEQ ID NO: 3541524 - DNA, 14 bp, Homo sapiens
tgtgacgattattt

SEQ ID NO: 3541525 - DNA, 18 bp, Homo sapiens
tgtgtcaagattgcaaag

SEQ ID NO: 3541526 - DNA, 13 bp, Homo sapiens
tgttaataaatgg

SEQ ID NO: 3541527 - DNA, 22 bp, Homo sapiens
tgttaccagtgttaataaatgg

SEQ ID NO: 3541528 - DNA, 16 bp, Homo sapiens
tgttataatttgcaca

SEQ ID NO: 3541529 - DNA, 19 bp, Homo sapiens
tgttcatgttaccaaagca

SEQ ID NO: 3541530 - DNA, 16 bp, Homo sapiens
tgttctatatgcattt

SEQ ID NO: 3541531 - DNA, 23 bp, Homo sapiens
tgttctggtttagtgttctgtat

SEQ ID NO: 3541532 - DNA, 18 bp, Homo sapiens
tgttgtactttttattca

SEQ ID NO: 3541533 - DNA, 13 bp, Homo sapiens
ttaaaacatctct

SEQ ID NO: 3541534 - DNA, 22 bp, Homo sapiens
ttaaataaatcaagaatcattg

SEQ ID NO: 3541535 - DNA, 11 bp, Homo sapiens
ttaataaatgg

SEQ ID NO: 3541536 - DNA, 22 bp, Homo sapiens
ttaataatagtgtgtcaagatt

SEQ ID NO: 3541537 - DNA, 15 bp, Homo sapiens
ttacattattaatca

SEQ ID NO: 3541538 - DNA, 16 bp, Homo sapiens
ttaccaaagcaatatt

SEQ ID NO: 3541539 - DNA, 13 bp, Homo sapiens
ttaccagaaaatg

SEQ ID NO: 3541540 - DNA, 13 bp, Homo sapiens
ttactagaaatat

SEQ ID NO: 3541541 - DNA, 18 bp, Homo sapiens
ttactcatgtacattggt

SEQ ID NO: 3541542 - DNA, 19 bp, Homo sapiens
ttacttgaaaaaatgttct

SEQ ID NO: 3541543 - DNA, 21 bp, Homo sapiens
ttagataatacaggtaacatt

SEQ ID NO: 3541544 - DNA, 13 bp, Homo sapiens
ttagtattagttt

SEQ ID NO: 3541545 - DNA, 17 bp, Homo sapiens
ttataaaattattttta

SEQ ID NO: 3541546 - DNA, 19 bp, Homo sapiens
ttatcctagaaaattgttt

SEQ ID NO: 3541547 - DNA, 11 bp, Homo sapiens
ttatcttgaaa

SEQ ID NO: 3541548 - DNA, 16 bp, Homo sapiens
ttatgaatgtgcattt

SEQ ID NO: 3541549 - DNA, 14 bp, Homo sapiens
ttatgtacacaaat

SEQ ID NO: 3541550 - DNA, 22 bp, Homo sapiens
ttattaaataaatattttacag

SEQ ID NO: 3541551 - DNA, 12 bp, Homo sapiens
ttattaatcatt

SEQ ID NO: 3541552 - DNA, 23 bp, Homo sapiens
ttatttatttctgtaaaatttgt

SEQ ID NO: 3541553 - DNA, 15 bp, Homo sapiens
ttatttccaaaataa

SEQ ID NO: 3541554 - DNA, 16 bp, Homo sapiens
ttatttttattaaata

SEQ ID NO: 3541555 - DNA, 19 bp, Homo sapiens
ttcaaaagtaagaatgcaa

SEQ ID NO: 3541556 - DNA, 13 bp, Homo sapiens
ttcaatatgaagg

SEQ ID NO: 3541557 - DNA, 21 bp, Homo sapiens
ttcaatgggacaggaactagg

SEQ ID NO: 3541558 - DNA, 15 bp, Homo sapiens
ttcaattatttcaat

SEQ ID NO: 3541559 - DNA, 19 bp, Homo sapiens
ttcagaggagccagaagta

SEQ ID NO: 3541560 - DNA, 20 bp, Homo sapiens
ttcatattaccagaaaatga

SEQ ID NO: 3541561 - DNA, 15 bp, Homo sapiens
ttccaaaataaaatg

SEQ ID NO: 3541562 - DNA, 16 bp, Homo sapiens
ttcccacactgaaatt

SEQ ID NO: 3541563 - DNA, 22 bp, Homo sapiens
ttcccacactgaaattctaaat

SEQ ID NO: 3541564 - DNA, 15 bp, Homo sapiens
ttcccagagaagctc

SEQ ID NO: 3541565 - DNA, 20 bp, Homo sapiens
ttcccagagaagctcattta

SEQ ID NO: 3541566 - DNA, 15 bp, Homo sapiens
ttccttactagaaat

SEQ ID NO: 3541567 - DNA, 13 bp, Homo sapiens
ttccttagctgta

SEQ ID NO: 3541568 - DNA, 14 bp, Homo sapiens
ttcgtttctgacat

SEQ ID NO: 3541569 - DNA, 15 bp, Homo sapiens
ttcgtttctgacata

SEQ ID NO: 3541570 - DNA, 21 bp, Homo sapiens
ttctaaaggtagatcatcttg

SEQ ID NO: 3541571 - DNA, 22 bp, Homo sapiens
ttctcatcccagtctgatattc

SEQ ID NO: 3541572 - DNA, 15 bp, Homo sapiens
ttctgtaaaatttgt

SEQ ID NO: 3541573 - DNA, 18 bp, Homo sapiens
ttctgtgtgccctgaaaa

SEQ ID NO: 3541574 - DNA, 15 bp, Homo sapiens
ttcttcttggtgcta

SEQ ID NO: 3541575 - DNA, 16 bp, Homo sapiens
ttctttccacctttct

SEQ ID NO: 3541576 - DNA, 15 bp, Homo sapiens
ttctttttttgcttt

SEQ ID NO: 3541577 - DNA, 18 bp, Homo sapiens
ttctttttttgctttgtt

SEQ ID NO: 3541578 - DNA, 21 bp, Homo sapiens
ttgaatatttgcttaaaattg

SEQ ID NO: 3541579 - DNA, 17 bp, Homo sapiens
ttgctagtgatttcatt

SEQ ID NO: 3541580 - DNA, 23 bp, Homo sapiens
ttgtattcccttttatttccaaa

SEQ ID NO: 3541581 - DNA, 19 bp, Homo sapiens
ttgtgacgattatttattt

SEQ ID NO: 3541582 - DNA, 18 bp, Homo sapiens
ttgtgtactccgaaacaa

SEQ ID NO: 3541583 - DNA, 19 bp, Homo sapiens
tttaaatcttcaatatgaa

SEQ ID NO: 3541584 - DNA, 16 bp, Homo sapiens
tttaaggagcagtggc

SEQ ID NO: 3541585 - DNA, 18 bp, Homo sapiens
tttaaggatgactttttt

SEQ ID NO: 3541586 - DNA, 12 bp, Homo sapiens
tttaattcaaag

SEQ ID NO: 3541587 - DNA, 14 bp, Homo sapiens
tttaatttgaatca

SEQ ID NO: 3541588 - DNA, 16 bp, Homo sapiens
tttaatttgaatcaga

SEQ ID NO: 3541589 - DNA, 23 bp, Homo sapiens
tttatattaatttgtttttctta

SEQ ID NO: 3541590 - DNA, 22 bp, Homo sapiens
tttatgaatgtgcatttcttga

SEQ ID NO: 3541591 - DNA, 11 bp, Homo sapiens
tttatttcatg

SEQ ID NO: 3541592 - DNA, 22 bp, Homo sapiens
tttatttccaaaataaaatgaa

SEQ ID NO: 3541593 - DNA, 14 bp, Homo sapiens
tttcaattatttca

SEQ ID NO: 3541594 - DNA, 17 bp, Homo sapiens
tttccacctttctctgt

SEQ ID NO: 3541595 - DNA, 18 bp, Homo sapiens
tttccctggaatttaatt

SEQ ID NO: 3541596 - DNA, 23 bp, Homo sapiens
tttctaattttaagttattttaa

SEQ ID NO: 3541597 - DNA, 21 bp, Homo sapiens
tttctacatagttattctatc

SEQ ID NO: 3541598 - DNA, 16 bp, Homo sapiens
tttgctaccaaagaat

SEQ ID NO: 3541599 - DNA, 22 bp, Homo sapiens
tttgtattcccttttatttcca

SEQ ID NO: 3541600 - DNA, 16 bp, Homo sapiens
tttgttgccttatctt

SEQ ID NO: 3541601 - DNA, 16 bp, Homo sapiens
ttttaaaaaaattcat

SEQ ID NO: 3541602 - DNA, 12 bp, Homo sapiens
ttttatttccaa

SEQ ID NO: 3541603 - DNA, 16 bp, Homo sapiens
ttttcaattatttcaa

SEQ ID NO: 3541604 - DNA, 15 bp, Homo sapiens
ttttctgtatatgat

SEQ ID NO: 3541605 - DNA, 14 bp, Homo sapiens
ttttgcattattca

SEQ ID NO: 3541606 - DNA, 22 bp, Homo sapiens
ttttgtaaagagaccatcttct

SEQ ID NO: 3541607 - DNA, 15 bp, Homo sapiens
tttttcataaactga

SEQ ID NO: 3541608 - DNA, 19 bp, Homo sapiens
cttcccagagaagctcatt

SEQ ID NO: 3541609 - DNA, 12 bp, Homo sapiens
cttgaatatttg

SEQ ID NO: 3541610 - DNA, 13 bp, Homo sapiens
cttgcttgtcttt

SEQ ID NO: 3541611 - DNA, 15 bp, Homo sapiens
cttttatttccaaaa

SEQ ID NO: 3541612 - DNA, 22 bp, Homo sapiens
gaaaaaaaattcctttcagatt

SEQ ID NO: 3541613 - DNA, 20 bp, Homo sapiens
gaaagagaaatgatgtgaaa

SEQ ID NO: 3541614 - DNA, 13 bp, Homo sapiens
gaaagataaatga

SEQ ID NO: 3541615 - DNA, 18 bp, Homo sapiens
gaaagggaagtgatatca

SEQ ID NO: 3541616 - DNA, 13 bp, Homo sapiens
gaaatatgttcta

SEQ ID NO: 3541617 - DNA, 16 bp, Homo sapiens
gaacctgtccaacatg

SEQ ID NO: 3541618 - DNA, 23 bp, Homo sapiens
gaactcaatgtgcaagttgtact

SEQ ID NO: 3541619 - DNA, 16 bp, Homo sapiens
gaactctgcacagcaa

SEQ ID NO: 3541620 - DNA, 13 bp, Homo sapiens
gaacttgatttta

SEQ ID NO: 3541621 - DNA, 22 bp, Homo sapiens
gaagactagttatatattcctt

SEQ ID NO: 3541622 - DNA, 16 bp, Homo sapiens
gaaggactattaattc

SEQ ID NO: 3541623 - DNA, 15 bp, Homo sapiens
gaagggcttcttctt

SEQ ID NO: 3541624 - DNA, 20 bp, Homo sapiens
gaagtgatatcataaaagta

SEQ ID NO: 3541625 - DNA, 17 bp, Homo sapiens
gaagtgtattcatatta

SEQ ID NO: 3541626 - DNA, 15 bp, Homo sapiens
gaataggtcattttc

SEQ ID NO: 3541627 - DNA, 16 bp, Homo sapiens
gaatcattgacctaat

SEQ ID NO: 3541628 - DNA, 11 bp, Homo sapiens
gaatctaaacc

SEQ ID NO: 3541629 - DNA, 17 bp, Homo sapiens
gacagatctcaatttta

SEQ ID NO: 3541630 - DNA, 17 bp, Homo sapiens
gactaataccttgtgtt

SEQ ID NO: 3541631 - DNA, 15 bp, Homo sapiens
gacttagcctaaaca

SEQ ID NO: 3541632 - DNA, 13 bp, Homo sapiens
gacttcacagcag

SEQ ID NO: 3541633 - DNA, 12 bp, Homo sapiens
gagaaaactgtt

SEQ ID NO: 3541634 - DNA, 13 bp, Homo sapiens
gagaagctcattt

SEQ ID NO: 3541635 - DNA, 22 bp, Homo sapiens
gagccagaagtaaagtttattt

SEQ ID NO: 3541636 - DNA, 21 bp, Homo sapiens
gagtctagaacatccttaaat

SEQ ID NO: 3541637 - DNA, 20 bp, Homo sapiens
gataagaataggtcattttc

SEQ ID NO: 3541638 - DNA, 15 bp, Homo sapiens
gatacatgaacttca

SEQ ID NO: 3541639 - DNA, 16 bp, Homo sapiens
gatacatgctaagaaa

SEQ ID NO: 3541640 - DNA, 20 bp, Homo sapiens
gatagatgtgattcctgcat

SEQ ID NO: 3541641 - DNA, 15 bp, Homo sapiens
gatatcataaaagta

SEQ ID NO: 3541642 - DNA, 18 bp, Homo sapiens
gatcatcttgaatatttg

SEQ ID NO: 3541643 - DNA, 19 bp, Homo sapiens
gatgactttttttctgatt

SEQ ID NO: 3541644 - DNA, 19 bp, Homo sapiens
gatgtgaaagataaatgat

SEQ ID NO: 3541645 - DNA, 21 bp, Homo sapiens
gatgttagtgtttagataata

SEQ ID NO: 3541646 - DNA, 23 bp, Homo sapiens
gattataaaattatttttattaa

SEQ ID NO: 3541647 - DNA, 22 bp, Homo sapiens
gattcctgcatttttttacctt

SEQ ID NO: 3541648 - DNA, 18 bp, Homo sapiens
gcaccaggtcactctgac

SEQ ID NO: 3541649 - DNA, 22 bp, Homo sapiens
gcaccaggtcactctgacctta

SEQ ID NO: 3541650 - DNA, 21 bp, Homo sapiens
gcactctgccatcctgataca

SEQ ID NO: 3541651 - DNA, 18 bp, Homo sapiens
gcacttttcattactttc

SEQ ID NO: 3541652 - DNA, 15 bp, Homo sapiens
gcagtgagctaagat

SEQ ID NO: 3541653 - DNA, 14 bp, Homo sapiens
gcatccctcctggt

SEQ ID NO: 3541654 - DNA, 16 bp, Homo sapiens
gcatgttctgtgtgcc

SEQ ID NO: 3541655 - DNA, 23 bp, Homo sapiens
gcatgttctgtgtgccctgaaaa

SEQ ID NO: 3541656 - DNA, 20 bp, Homo sapiens
gccacagagaataagctgaa

SEQ ID NO: 3541657 - DNA, 15 bp, Homo sapiens
gccactgctggaggc

SEQ ID NO: 3541658 - DNA, 17 bp, Homo sapiens
gcccatgaggactagga

SEQ ID NO: 3541659 - DNA, 20 bp, Homo sapiens
gccgtgcctggtggggcgga

SEQ ID NO: 3541660 - DNA, 19 bp, Homo sapiens
gcctgtaattccagccact

SEQ ID NO: 3541661 - DNA, 14 bp, Homo sapiens
gcctttgtttctaa

SEQ ID NO: 3541662 - DNA, 22 bp, Homo sapiens
gcctttttcataaactgagcct

SEQ ID NO: 3541663 - DNA, 16 bp, Homo sapiens
gctaagaaagcaaata

SEQ ID NO: 3541664 - DNA, 13 bp, Homo sapiens
gctagtgatttca

SEQ ID NO: 3541665 - DNA, 17 bp, Homo sapiens
gctatgacagtgtgaga

SEQ ID NO: 3541666 - DNA, 20 bp, Homo sapiens
gctctggccccagtcgaact

SEQ ID NO: 3541667 - DNA, 16 bp, Homo sapiens
gctgctagtatatgtc

SEQ ID NO: 3541668 - DNA, 14 bp, Homo sapiens
gctgtaaaatggaa

SEQ ID NO: 3541669 - DNA, 14 bp, Homo sapiens
gcttgcttgtcttt

SEQ ID NO: 3541670 - DNA, 21 bp, Homo sapiens
gcttttaactggggtattaac

SEQ ID NO: 3541671 - DNA, 13 bp, Homo sapiens
ggaaagagaaatg

SEQ ID NO: 3541672 - DNA, 22 bp, Homo sapiens
ggagccaaaggccgtgcctggt

SEQ ID NO: 3541673 - DNA, 18 bp, Homo sapiens
ggatggaaatatgttcta

SEQ ID NO: 3541674 - DNA, 12 bp, Homo sapiens
ggatgtgtttga

SEQ ID NO: 3541675 - DNA, 11 bp, Homo sapiens
ggcaatatttg

SEQ ID NO: 3541676 - DNA, 15 bp, Homo sapiens
ggccaaggacagggt

SEQ ID NO: 3541677 - DNA, 22 bp, Homo sapiens
ggcttagctatgtttccatctt

SEQ ID NO: 3541678 - DNA, 14 bp, Homo sapiens
ggcttcttcttata

SEQ ID NO: 3541679 - DNA, 18 bp, Homo sapiens
ggtaacattataaatgac

SEQ ID NO: 3541680 - DNA, 17 bp, Homo sapiens
ggtattgtcttaaataa

SEQ ID NO: 3541681 - DNA, 15 bp, Homo sapiens
ggtcattttctattc

SEQ ID NO: 3541682 - DNA, 16 bp, Homo sapiens
ggtgttttataggtca

SEQ ID NO: 3541683 - DNA, 22 bp, Homo sapiens
ggttcatccagaagtgtattca

SEQ ID NO: 3541684 - DNA, 14 bp, Homo sapiens
gtaacattataaat

SEQ ID NO: 3541685 - DNA, 16 bp, Homo sapiens
gtaacattataaatga

SEQ ID NO: 3541686 - DNA, 20 bp, Homo sapiens
gtaactaggccatttgtatt

SEQ ID NO: 3541687 - DNA, 18 bp, Homo sapiens
gtaactgttttcttcttg

SEQ ID NO: 3541688 - DNA, 20 bp, Homo sapiens
gtacattggtctttctacat

SEQ ID NO: 3541689 - DNA, 20 bp, Homo sapiens
gtaccttttagtattagttt

SEQ ID NO: 3541690 - DNA, 16 bp, Homo sapiens
gtactgtatgcagttt

SEQ ID NO: 3541691 - DNA, 15 bp, Homo sapiens
gtagacatatattta

SEQ ID NO: 3541692 - DNA, 22 bp, Homo sapiens
gtagcaaccttcattttacatt

SEQ ID NO: 3541693 - DNA, 16 bp, Homo sapiens
gtagtgggaaagatac

SEQ ID NO: 3541694 - DNA, 12 bp, Homo sapiens
gtatacttcatt

SEQ ID NO: 3541695 - DNA, 20 bp, Homo sapiens
gtatcatttctaattttaag

SEQ ID NO: 3541696 - DNA, 14 bp, Homo sapiens
gtatgaaaatgatt

SEQ ID NO: 3541697 - DNA, 17 bp, Homo sapiens
gtatgtggccatattta

SEQ ID NO: 3541698 - DNA, 18 bp, Homo sapiens
gtattcccttttatttcc

SEQ ID NO: 3541699 - DNA, 21 bp, Homo sapiens
gtattcccttttatttccaaa

SEQ ID NO: 3541700 - DNA, 18 bp, Homo sapiens
gtctatggggatacatga

SEQ ID NO: 3541701 - DNA, 15 bp, Homo sapiens
gtcttaaataaatca

SEQ ID NO: 3541702 - DNA, 23 bp, Homo sapiens
gtgaaaataatttgttgtacttt

SEQ ID NO: 3541703 - DNA, 16 bp, Homo sapiens
gtgaacttgattttaa

SEQ ID NO: 3541704 - DNA, 17 bp, Homo sapiens
gtgcaagttgtactgta

SEQ ID NO: 3541705 - DNA, 22 bp, Homo sapiens
gtgctgtttgagggattttatt

SEQ ID NO: 3541706 - DNA, 16 bp, Homo sapiens
gtgtacgtatcatttc

SEQ ID NO: 3541707 - DNA, 14 bp, Homo sapiens
gtgttaataaatgg

SEQ ID NO: 3541708 - DNA, 15 bp, Homo sapiens
gtgttactcatgtac

SEQ ID NO: 3541709 - DNA, 12 bp, Homo sapiens
gtgttctgtatt

SEQ ID NO: 3541710 - DNA, 13 bp, Homo sapiens
gttaataaatgga

SEQ ID NO: 3541711 - DNA, 18 bp, Homo sapiens
gttaccaaagcaatattt

SEQ ID NO: 3541712 - DNA, 20 bp, Homo sapiens
gttaccaaagcaatatttcc

SEQ ID NO: 3541713 - DNA, 20 bp, Homo sapiens
gttcatccagaagtgtattc

SEQ ID NO: 3541714 - DNA, 15 bp, Homo sapiens
gttctaacagcatct

SEQ ID NO: 3541715 - DNA, 15 bp, Homo sapiens
gttctatatgcattt

SEQ ID NO: 3541716 - DNA, 23 bp, Homo sapiens
gttctcatcccagtctgatattc

SEQ ID NO: 3541717 - DNA, 21 bp, Homo sapiens
gttctgtgtgccctgaaaatg

SEQ ID NO: 3541718 - DNA, 16 bp, Homo sapiens
gtgaaagataaatgat

SEQ ID NO: 3541719 - DNA, 18 bp, Homo sapiens
gtgaacttgattttaaaa

SEQ ID NO: 3541720 - DNA, 14 bp, Homo sapiens
gtgactgtggcatt

SEQ ID NO: 3541721 - DNA, 15 bp, Homo sapiens
gtgattcctgcattt

SEQ ID NO: 3541722 - DNA, 15 bp, Homo sapiens
gtgattttaaaattt

SEQ ID NO: 3541723 - DNA, 14 bp, Homo sapiens
gtgccctgaaaatg

SEQ ID NO: 3541724 - DNA, 12 bp, Homo sapiens
gtgcgaaggcag

SEQ ID NO: 3541725 - DNA, 17 bp, Homo sapiens
gtggaaagagaaatgat

SEQ ID NO: 3541726 - DNA, 13 bp, Homo sapiens
gtgggaaagatac

SEQ ID NO: 3541727 - DNA, 17 bp, Homo sapiens
gtgtacgtatcatttct

SEQ ID NO: 3541728 - DNA, 13 bp, Homo sapiens
gtgtattcatatt

SEQ ID NO: 3541729 - DNA, 23 bp, Homo sapiens
gtgtattcatattaccagaaaat

SEQ ID NO: 3541730 - DNA, 15 bp, Homo sapiens
gtgttaataaatgga

SEQ ID NO: 3541731 - DNA, 16 bp, Homo sapiens
gtgttaataaatggat

SEQ ID NO: 3541732 - DNA, 15 bp, Homo sapiens
gtgttgtatacttca

SEQ ID NO: 3541733 - DNA, 21 bp, Homo sapiens
gttagaagtgcaccaggtcac

SEQ ID NO: 3541734 - DNA, 14 bp, Homo sapiens
gttatatattcctt

SEQ ID NO: 3541735 - DNA, 22 bp, Homo sapiens
gttatatattccttactagaaa

SEQ ID NO: 3541736 - DNA, 15 bp, Homo sapiens
gttctgtattttaag

SEQ ID NO: 3541737 - DNA, 23 bp, Homo sapiens
gtttagaagtacgtttttgcatt

SEQ ID NO: 3541738 - DNA, 11 bp, Homo sapiens
gtttatttcat

SEQ ID NO: 3541739 - DNA, 12 bp, Homo sapiens
gtttatttcatg

SEQ ID NO: 3541740 - DNA, 23 bp, Homo sapiens
gtttgtctatggggatacatgaa

SEQ ID NO: 3541741 - DNA, 15 bp, Homo sapiens
gttttctgtatatga

SEQ ID NO: 3541742 - DNA, 17 bp, Homo sapiens
gttttgtaaataagtga

SEQ ID NO: 3541743 - DNA, 22 bp, Homo sapiens
taaaattgctagtgatttcatt

SEQ ID NO: 3541744 - DNA, 18 bp, Homo sapiens
taaaattttgctaccaaa

SEQ ID NO: 3541745 - DNA, 19 bp, Homo sapiens
taaaattttgctaccaaag

SEQ ID NO: 3541746 - DNA, 17 bp, Homo sapiens
taaactgagcctctttt

SEQ ID NO: 3541747 - DNA, 20 bp, Homo sapiens
taaagcgtagacatatattt

SEQ ID NO: 3541748 - DNA, 15 bp, Homo sapiens
taaagctatatttct

SEQ ID NO: 3541749 - DNA, 14 bp, Homo sapiens
taaagtttatttca

SEQ ID NO: 3541750 - DNA, 14 bp, Homo sapiens
taaataaatatttt

SEQ ID NO: 3541751 - DNA, 13 bp, Homo sapiens
taaatattttaca

SEQ ID NO: 3541752 - DNA, 13 bp, Homo sapiens
taagaaaagtgaa

SEQ ID NO: 3541753 - DNA, 22 bp, Homo sapiens
taagacaagaatatgttcacat

SEQ ID NO: 3541754 - DNA, 20 bp, Homo sapiens
taagctctattatattcggt

SEQ ID NO: 3541755 - DNA, 15 bp, Homo sapiens
taaggaagggaaagg

SEQ ID NO: 3541756 - DNA, 16 bp, Homo sapiens
taaggatgactttttt

SEQ ID NO: 3541757 - DNA, 17 bp, Homo sapiens
taagttattttaaaaaa

SEQ ID NO: 3541758 - DNA, 21 bp, Homo sapiens
taataatttcatccctattta

SEQ ID NO: 3541759 - DNA, 15 bp, Homo sapiens
taatatataaaagaa

SEQ ID NO: 3541760 - DNA, 19 bp, Homo sapiens
taatatataaaagaaatat

SEQ ID NO: 3541761 - DNA, 16 bp, Homo sapiens
taatgggaatcattcc

SEQ ID NO: 3541762 - DNA, 13 bp, Homo sapiens
taattccaagatt

SEQ ID NO: 3541763 - DNA, 17 bp, Homo sapiens
taattccaagattaaaa

SEQ ID NO: 3541764 - DNA, 14 bp, Homo sapiens
taattccagccact

SEQ ID NO: 3541765 - DNA, 10 bp, Homo sapiens
taatttcatc

SEQ ID NO: 3541766 - DNA, 18 bp, Homo sapiens
taatttgaatcagagaaa

SEQ ID NO: 3541767 - DNA, 17 bp, Homo sapiens
taatttgggaattgtgt

SEQ ID NO: 3541768 - DNA, 19 bp, Homo sapiens
taatttgttgtacttttta

SEQ ID NO: 3541769 - DNA, 21 bp, Homo sapiens
taatttgtttttcttatccaa

SEQ ID NO: 3541770 - DNA, 21 bp, Homo sapiens
tacacaaatccctatgttgct

SEQ ID NO: 3541771 - DNA, 14 bp, Homo sapiens
tacacacagttact

SEQ ID NO: 3541772 - DNA, 20 bp, Homo sapiens
tacattattaatcattccat

SEQ ID NO: 3541773 - DNA, 15 bp, Homo sapiens
taccaaagaatgcat

SEQ ID NO: 3541774 - DNA, 18 bp, Homo sapiens
taccagtgttaataaatg

SEQ ID NO: 3541775 - DNA, 21 bp, Homo sapiens
taccagtgttaataaatggat

SEQ ID NO: 3541776 - DNA, 17 bp, Homo sapiens
tacgcttgcttgtcttt

SEQ ID NO: 3541777 - DNA, 18 bp, Homo sapiens
tactagaaatatattcat

SEQ ID NO: 3541778 - DNA, 17 bp, Homo sapiens
tactcatgtacattggt

SEQ ID NO: 3541779 - DNA, 21 bp, Homo sapiens
tactgctgaagggcttcttct

SEQ ID NO: 3541780 - DNA, 13 bp, Homo sapiens
tagaaatatattc

SEQ ID NO: 3541781 - DNA, 15 bp, Homo sapiens
tagaaatatattcat

SEQ ID NO: 3541782 - DNA, 14 bp, Homo sapiens
tagataatacaggt

SEQ ID NO: 3541783 - DNA, 13 bp, Homo sapiens
tagatgtgattcc

SEQ ID NO: 3541784 - DNA, 22 bp, Homo sapiens
taggagtggggcttcccccgcc

SEQ ID NO: 3541785 - DNA, 19 bp, Homo sapiens
taggtggaaagagaaatga

SEQ ID NO: 3541786 - DNA, 15 bp, Homo sapiens
tagttatatattcct

SEQ ID NO: 3541787 - DNA, 14 bp, Homo sapiens
tagtttttatatta

SEQ ID NO: 3541788 - DNA, 15 bp, Homo sapiens
tataaaattattttt

SEQ ID NO: 3541789 - DNA, 18 bp, Homo sapiens
tatagtttttatattaat

SEQ ID NO: 3541790 - DNA, 19 bp, Homo sapiens
tatataaaagaaatatatc

SEQ ID NO: 3541791 - DNA, 20 bp, Homo sapiens
tatataaaagaaatatatct

SEQ ID NO: 3541792 - DNA, 18 bp, Homo sapiens
tatatctgtgattttaaa

SEQ ID NO: 3541793 - DNA, 22 bp, Homo sapiens
tatatgcatttaattctgaaat

SEQ ID NO: 3541794 - DNA, 14 bp, Homo sapiens
tatatgtcagacat

SEQ ID NO: 3541795 - DNA, 20 bp, Homo sapiens
tatatgtcagacatgaaaac

SEQ ID NO: 3541796 - DNA, 21 bp, Homo sapiens
tatattccttactagaaatat

SEQ ID NO: 3541797 - DNA, 17 bp, Homo sapiens
tcagtactgattattct

SEQ ID NO: 3541798 - DNA, 13 bp, Homo sapiens
tcataaactgagc

SEQ ID NO: 3541799 - DNA, 15 bp, Homo sapiens
tcataaactgagcct

SEQ ID NO: 3541800 - DNA, 22 bp, Homo sapiens
tcataaactgagcctcttttca

SEQ ID NO: 3541801 - DNA, 15 bp, Homo sapiens
tcatattaccagaaa

SEQ ID NO: 3541802 - DNA, 19 bp, Homo sapiens
tcatattaccagaaaatga

SEQ ID NO: 3541803 - DNA, 15 bp, Homo sapiens
tcatcttgaatattt

SEQ ID NO: 3541804 - DNA, 18 bp, Homo sapiens
tcatcttgaatatttgct

SEQ ID NO: 3541805 - DNA, 21 bp, Homo sapiens
tcatgtacattggtctttcta

SEQ ID NO: 3541806 - DNA, 17 bp, Homo sapiens
tcattaccaagttactt

SEQ ID NO: 3541807 - DNA, 15 bp, Homo sapiens
tcattccactataca

SEQ ID NO: 3541808 - DNA, 22 bp, Homo sapiens
tcattccactatacaattcagt

SEQ ID NO: 3541809 - DNA, 20 bp, Homo sapiens
tcattccatttatcctagaa

SEQ ID NO: 3541810 - DNA, 14 bp, Homo sapiens
tcattgctcaacaa

SEQ ID NO: 3541811 - DNA, 22 bp, Homo sapiens
tcatttctaattttaagttatt

SEQ ID NO: 3541812 - DNA, 14 bp, Homo sapiens
tccaacatgtttta

SEQ ID NO: 3541813 - DNA, 19 bp, Homo sapiens
tccactatacaattcagta

SEQ ID NO: 3541814 - DNA, 17 bp, Homo sapiens
tcccacactgaaattct

SEQ ID NO: 3541815 - DNA, 21 bp, Homo sapiens
tccccaaattgccctgttgcc

SEQ ID NO: 3541816 - DNA, 18 bp, Homo sapiens
tccgggggccaaggacag

SEQ ID NO: 3541817 - DNA, 17 bp, Homo sapiens
tccttagctgtaaaatg

SEQ ID NO: 3541818 - DNA, 15 bp, Homo sapiens
tcgaaatgtattcac

SEQ ID NO: 3541819 - DNA, 21 bp, Homo sapiens
tctattcaatttaattcttat

SEQ ID NO: 3541820 - DNA, 21 bp, Homo sapiens
tctcatcccagtctgatattc

SEQ ID NO: 3541821 - DNA, 19 bp, Homo sapiens
tctgccttatctcatttct

SEQ ID NO: 3541822 - DNA, 19 bp, Homo sapiens
tctgtatagattataaaat

SEQ ID NO: 3541823 - DNA, 22 bp, Homo sapiens
tctgtatatgatatatattatc

SEQ ID NO: 3541824 - DNA, 18 bp, Homo sapiens
tcttacattattaatcat

SEQ ID NO: 3541825 - DNA, 12 bp, Homo sapiens
tcttatttctgt

SEQ ID NO: 3541826 - DNA, 17 bp, Homo sapiens
tcttctttccacctttc

SEQ ID NO: 3541827 - DNA, 18 bp, Homo sapiens
tcttttcaattatttcaa

SEQ ID NO: 3541828 - DNA, 18 bp, Homo sapiens
tgaaaaaatgttctatat

SEQ ID NO: 3541829 - DNA, 16 bp, Homo sapiens
tgaaaggagcagtggc

SEQ ID NO: 3541830 - DNA, 14 bp, Homo sapiens
tgaactcaatgtgc

SEQ ID NO: 3541831 - DNA, 16 bp, Homo sapiens
tgaacttcatatacta

SEQ ID NO: 3541832 - DNA, 13 bp, Homo sapiens
tgaatatttgctt

SEQ ID NO: 3541833 - DNA, 15 bp, Homo sapiens
tgaatgtgcatttct

SEQ ID NO: 3541834 - DNA, 16 bp, Homo sapiens
tgaatgtgcatttctt

SEQ ID NO: 3541835 - DNA, 13 bp, Homo sapiens
tgacttagcctaa

SEQ ID NO: 3541836 - DNA, 15 bp, Homo sapiens
tgacttcacagcagc

SEQ ID NO: 3541837 - DNA, 16 bp, Homo sapiens
tgactttttttctgat

SEQ ID NO: 3541838 - DNA, 13 bp, Homo sapiens
tgagactcaggtt

SEQ ID NO: 3541839 - DNA, 15 bp, Homo sapiens
tgagagctaatttaa

SEQ ID NO: 3541840 - DNA, 13 bp, Homo sapiens
tgatactattcag

SEQ ID NO: 3541841 - DNA, 12 bp, Homo sapiens
tgatgtgaaaga

SEQ ID NO: 3541842 - DNA, 14 bp, Homo sapiens
tgatgtgaaagata

SEQ ID NO: 3541843 - DNA, 20 bp, Homo sapiens
tgatgtgaaagataaatgat

SEQ ID NO: 3541844 - DNA, 14 bp, Homo sapiens
tgattcaaaagtga

SEQ ID NO: 3541845 - DNA, 14 bp, Homo sapiens
tgattttttaaagc

SEQ ID NO: 3541846 - DNA, 16 bp, Homo sapiens
tgcaagaatctaaacc

SEQ ID NO: 3541847 - DNA, 21 bp, Homo sapiens
tgcattattcatatgcttccc

SEQ ID NO: 3541848 - DNA, 15 bp, Homo sapiens
tgcatttaattctga

SEQ ID NO: 3541849 - DNA, 23 bp, Homo sapiens
tgcatttcttgacttcacagcag

SEQ ID NO: 3541850 - DNA, 17 bp, Homo sapiens
tgccctgaaaatgttac

SEQ ID NO: 3541851 - DNA, 17 bp, Homo sapiens
tgcctttgtttctaaag

SEQ ID NO: 3541852 - DNA, 13 bp, Homo sapiens
tgctaaatgaaga

SEQ ID NO: 3541853 - DNA, 16 bp, Homo sapiens
tgctaaatgaagagac

SEQ ID NO: 3541854 - DNA, 15 bp, Homo sapiens
tgctaagaaagcaaa

SEQ ID NO: 3541855 - DNA, 16 bp, Homo sapiens
tgctagtgatttcatt

SEQ ID NO: 3541856 - DNA, 15 bp, Homo sapiens
tgctgtcagcctggc

SEQ ID NO: 3541857 - DNA, 15 bp, Homo sapiens
tgcttcccagagaag

SEQ ID NO: 3541858 - DNA, 15 bp, Homo sapiens
tggaaatatgttcta

SEQ ID NO: 3541859 - DNA, 18 bp, Homo sapiens
tggatggaaatatgttct

SEQ ID NO: 3541860 - DNA, 16 bp, Homo sapiens
tgggaatcattccact

SEQ ID NO: 3541861 - DNA, 17 bp, Homo sapiens
tggtttagtgttctgta

SEQ ID NO: 3541862 - DNA, 19 bp, Homo sapiens
tggtttagtgttctgtatt

SEQ ID NO: 3541863 - DNA, 17 bp, Homo sapiens
tgtaaagagaccatctt

SEQ ID NO: 3541864 - DNA, 13 bp, Homo sapiens
tgtactgtatgca

SEQ ID NO: 3541865 - DNA, 17 bp, Homo sapiens
tgtactgtatgcagttt

SEQ ID NO: 3541866 - DNA, 16 bp, Homo sapiens
tgtactttttattcaa

SEQ ID NO: 3541867 - DNA, 20 bp, Homo sapiens
tgtatgcagttttgtaaata

SEQ ID NO: 3541868 - DNA, 15 bp, Homo sapiens
tgtatttgtattccc

SEQ ID NO: 3541869 - DNA, 16 bp, Homo sapiens
tgtcagacatgaaaac

SEQ ID NO: 3541870 - DNA, 18 bp, Homo sapiens
tgtcagacatgaaaacta

SEQ ID NO: 3541871 - DNA, 19 bp, Homo sapiens
tgtctatggggatacatga

SEQ ID NO: 3541872 - DNA, 23 bp, Homo sapiens
tgtcttaaataaatcaagaatca

SEQ ID NO: 3541873 - DNA, 14 bp, Homo sapiens
tgtctttaaatctt

SEQ ID NO: 3541874 - DNA, 17 bp, Homo sapiens
tgtgcagaggaaactta

SEQ ID NO: 3541875 - DNA, 18 bp, Homo sapiens
tgtgcctctgccttatct

SEQ ID NO: 3541876 - DNA, 15 bp, Homo sapiens
tgtggccatatttat

SEQ ID NO: 3541877 - DNA, 19 bp, Homo sapiens
tgtgttccgggaataacat

SEQ ID NO: 3541878 - DNA, 13 bp, Homo sapiens
tgtgtttgatttt

SEQ ID NO: 3541879 - DNA, 14 bp, Homo sapiens
tgttctatatgcat

SEQ ID NO: 3541880 - DNA, 22 bp, Homo sapiens
tgttcttggttcccattgtgac

SEQ ID NO: 3541881 - DNA, 14 bp, Homo sapiens
ttatgaatgtgcat

SEQ ID NO: 3541882 - DNA, 19 bp, Homo sapiens
ttatgaatgtgcatttctt

SEQ ID NO: 3541883 - DNA, 20 bp, Homo sapiens
ttattaaataaatattttac

SEQ ID NO: 3541884 - DNA, 21 bp, Homo sapiens
ttattaatcattccatttatc

SEQ ID NO: 3541885 - DNA, 17 bp, Homo sapiens
ttattcaattctgtata

SEQ ID NO: 3541886 - DNA, 22 bp, Homo sapiens
ttattctatcactggcaatatt

SEQ ID NO: 3541887 - DNA, 15 bp, Homo sapiens
ttcaaaagtaagaat

SEQ ID NO: 3541888 - DNA, 16 bp, Homo sapiens
ttcaatttaattctta

SEQ ID NO: 3541889 - DNA, 21 bp, Homo sapiens
ttcacctgggtttgcaagaat

SEQ ID NO: 3541890 - DNA, 17 bp, Homo sapiens
ttcagtttctgaagact

SEQ ID NO: 3541891 - DNA, 21 bp, Homo sapiens
ttcataatatataaaagaaat

SEQ ID NO: 3541892 - DNA, 15 bp, Homo sapiens
ttcatccagaagtgt

SEQ ID NO: 3541893 - DNA, 17 bp, Homo sapiens
ttccaaaataaaatgaa

SEQ ID NO: 3541894 - DNA, 15 bp, Homo sapiens
ttccatcttcagttt

SEQ ID NO: 3541895 - DNA, 16 bp, Homo sapiens
ttccttactagaaata

SEQ ID NO: 3541896 - DNA, 13 bp, Homo sapiens
ttcctttcagatt

SEQ ID NO: 3541897 - DNA, 14 bp, Homo sapiens
ttctcatcccagtc

SEQ ID NO: 3541898 - DNA, 17 bp, Homo sapiens
ttctcatcccagtctga

SEQ ID NO: 3541899 - DNA, 13 bp, Homo sapiens
ttctgtattttaa

SEQ ID NO: 3541900 - DNA, 13 bp, Homo sapiens
ttcttatataaga

SEQ ID NO: 3541901 - DNA, 23 bp, Homo sapiens
ttcttcttacattattaatcatt

SEQ ID NO: 3541902 - DNA, 18 bp, Homo sapiens
ttcttgacttcacagcag

SEQ ID NO: 3541903 - DNA, 13 bp, Homo sapiens
ttctttcccacac

SEQ ID NO: 3541904 - DNA, 15 bp, Homo sapiens
ttgaaaaaatgttct

SEQ ID NO: 3541905 - DNA, 14 bp, Homo sapiens
ttgaaaagaatcta

SEQ ID NO: 3541906 - DNA, 15 bp, Homo sapiens
ttgaatatttgctta

SEQ ID NO: 3541907 - DNA, 14 bp, Homo sapiens
ttgaattcgtttct

SEQ ID NO: 3541908 - DNA, 15 bp, Homo sapiens
ttgaattcgtttctg

SEQ ID NO: 3541909 - DNA, 22 bp, Homo sapiens
ttgcattagtccaaggcctttt

SEQ ID NO: 3541910 - DNA, 21 bp, Homo sapiens
ttgcattattcatatgcttcc

SEQ ID NO: 3541911 - DNA, 21 bp, Homo sapiens
ttgccttatcttgaaaagaat

SEQ ID NO: 3541912 - DNA, 17 bp, Homo sapiens
ttggaacctaatgggaa

SEQ ID NO: 3541913 - DNA, 23 bp, Homo sapiens
ttggaacctaatgggaatcattc

SEQ ID NO: 3541914 - DNA, 17 bp, Homo sapiens
ttggtattgtcttaaat

SEQ ID NO: 3541915 - DNA, 20 bp, Homo sapiens
ttgtaaataagtgaaaataa

SEQ ID NO: 3541916 - DNA, 16 bp, Homo sapiens
ttgtgacgattattta

SEQ ID NO: 3541917 - DNA, 23 bp, Homo sapiens
ttgttgccttatcttgaaaagaa

SEQ ID NO: 3541918 - DNA, 12 bp, Homo sapiens
ttgttgtacttt

SEQ ID NO: 3541919 - DNA, 19 bp, Homo sapiens
ttgtttttaatttgaatca

SEQ ID NO: 3541920 - DNA, 22 bp, Homo sapiens
tttaactggggtattaactttt

SEQ ID NO: 3541921 - DNA, 23 bp, Homo sapiens
tttaaggatgactttttttctga

SEQ ID NO: 3541922 - DNA, 16 bp, Homo sapiens
tttaagttattttaaa

SEQ ID NO: 3541923 - DNA, 15 bp, Homo sapiens
tttaataatttcatc

SEQ ID NO: 3541924 - DNA, 17 bp, Homo sapiens
tttagtgttctgtattt

SEQ ID NO: 3541925 - DNA, 12 bp, Homo sapiens
tttatttcatgg

SEQ ID NO: 3541926 - DNA, 15 bp, Homo sapiens
tttcaattatttcaa

SEQ ID NO: 3541927 - DNA, 17 bp, Homo sapiens
tttcaattatttcaatg

SEQ ID NO: 3541928 - DNA, 22 bp, Homo sapiens
tttcattaccaagttacttgaa

SEQ ID NO: 3541929 - DNA, 18 bp, Homo sapiens
tttccaaaataaaatgaa

SEQ ID NO: 3541930 - DNA, 19 bp, Homo sapiens
tttctacatagttattcta

SEQ ID NO: 3541931 - DNA, 12 bp, Homo sapiens
tttcttatccaa

SEQ ID NO: 3541932 - DNA, 20 bp, Homo sapiens
tttgctaccaaagaatgcat

SEQ ID NO: 3541933 - DNA, 19 bp, Homo sapiens
tttgtaaagagaccatctt

SEQ ID NO: 3541934 - DNA, 12 bp, Homo sapiens
tttgtaggccag

SEQ ID NO: 3541935 - DNA, 22 bp, Homo sapiens
tttgttgtactttttattcaat

SEQ ID NO: 3541936 - DNA, 13 bp, Homo sapiens
ttttatgaaacca

SEQ ID NO: 3541937 - DNA, 19 bp, Homo sapiens
ttttatgaaaccaactgtt

SEQ ID NO: 3541938 - DNA, 15 bp, Homo sapiens
ttttcataaactgag

SEQ ID NO: 3541939 - DNA, 16 bp, Homo sapiens
ttttcttatataagac

SEQ ID NO: 3541940 - DNA, 13 bp, Homo sapiens
ttttcttatccaa

SEQ ID NO: 3541941 - DNA, 19 bp, Homo sapiens
tttttattcaattctgtat

SEQ ID NO: 3541942 - DNA, 16 bp, Homo sapiens
tttttctgattcaaaa

SEQ ID NO: 3541943 - DNA, 12 bp, Homo sapiens
tttttttctgat

SEQ ID NO: 3541944 - DNA, 22 bp, Homo sapiens
agtagcaaccttcattttacat

SEQ ID NO: 3541945 - DNA, 16 bp, Homo sapiens
agtagtgggaaagata

SEQ ID NO: 3541946 - DNA, 21 bp, Homo sapiens
agtcaagagcaatcaaagcag

SEQ ID NO: 3541947 - DNA, 12 bp, Homo sapiens
agtgatttcatt

SEQ ID NO: 3541948 - DNA, 21 bp, Homo sapiens
agtgcaccaggtcactctgac

SEQ ID NO: 3541949 - DNA, 24 bp, Homo sapiens
agtggcccgcgtgattgtggcatt

SEQ ID NO: 3541950 - DNA, 14 bp, Homo sapiens
agtgggaaagatac

SEQ ID NO: 3541951 - DNA, 12 bp, Homo sapiens
agtgttctgtat

SEQ ID NO: 3541952 - DNA, 13 bp, Homo sapiens
agtgttctgtatt

SEQ ID NO: 3541953 - DNA, 11 bp, Homo sapiens
agttattttaa

SEQ ID NO: 3541954 - DNA, 13 bp, Homo sapiens
ataaaagaaatat

SEQ ID NO: 3541955 - DNA, 22 bp, Homo sapiens
ataaaagtagcaaccttcattt

SEQ ID NO: 3541956 - DNA, 20 bp, Homo sapiens
ataaactgagcctcttttca

SEQ ID NO: 3541957 - DNA, 13 bp, Homo sapiens
ataagtgaaaata

SEQ ID NO: 3541958 - DNA, 20 bp, Homo sapiens
ataatatataaaagaaatat

SEQ ID NO: 3541959 - DNA, 21 bp, Homo sapiens
ataatatataaaagaaatata

SEQ ID NO: 3541960 - DNA, 15 bp, Homo sapiens
atacaattcagtact

SEQ ID NO: 3541961 - DNA, 15 bp, Homo sapiens
atacacacagttact

SEQ ID NO: 3541962 - DNA, 20 bp, Homo sapiens
atacatgctaagaaagcaaa

SEQ ID NO: 3541963 - DNA, 22 bp, Homo sapiens
atactgaaaaaaaattcctttc

SEQ ID NO: 3541964 - DNA, 20 bp, Homo sapiens
ataggtcattttctattcac

SEQ ID NO: 3541965 - DNA, 15 bp, Homo sapiens
ataggtggaaagaga

SEQ ID NO: 3541966 - DNA, 18 bp, Homo sapiens
atagtagtgggaaagata

SEQ ID NO: 3541967 - DNA, 13 bp, Homo sapiens
atagttattctat

SEQ ID NO: 3541968 - DNA, 17 bp, Homo sapiens
atatataggctaaagat

SEQ ID NO: 3541969 - DNA, 20 bp, Homo sapiens
atatgcatttaattctgaaa

SEQ ID NO: 3541970 - DNA, 13 bp, Homo sapiens
atatgtctgtatc

SEQ ID NO: 3541971 - DNA, 16 bp, Homo sapiens
atatgttcacatcttg

SEQ ID NO: 3541972 - DNA, 14 bp, Homo sapiens
atattaccagaaaa

SEQ ID NO: 3541973 - DNA, 20 bp, Homo sapiens
atattatcttatactgaaaa

SEQ ID NO: 3541974 - DNA, 23 bp, Homo sapiens
atattcataatatataaaagaaa

SEQ ID NO: 3541975 - DNA, 18 bp, Homo sapiens
atattccttactagaaat

SEQ ID NO: 3541976 - DNA, 20 bp, Homo sapiens
atattccttactagaaatat

SEQ ID NO: 3541977 - DNA, 21 bp, Homo sapiens
atattccttactagaaatata

SEQ ID NO: 3541978 - DNA, 18 bp, Homo sapiens
atatttatgaatgtgcat

SEQ ID NO: 3541979 - DNA, 20 bp, Homo sapiens
atatttccctggaatttaat

SEQ ID NO: 3541980 - DNA, 15 bp, Homo sapiens
atcaaagcagcacat

SEQ ID NO: 3541981 - DNA, 15 bp, Homo sapiens
atcacaacctaaatg

SEQ ID NO: 3541982 - DNA, 16 bp, Homo sapiens
atcatcttgaatattt

SEQ ID NO: 3541983 - DNA, 17 bp, Homo sapiens
atcatttctaattttaa

SEQ ID NO: 3541984 - DNA, 13 bp, Homo sapiens
atccagaagtgta

SEQ ID NO: 3541985 - DNA, 17 bp, Homo sapiens
atccagaagtgtattca

SEQ ID NO: 3541986 - DNA, 23 bp, Homo sapiens
atccataagtgtgcctctgcctt

SEQ ID NO: 3541987 - DNA, 20 bp, Homo sapiens
atcctagaaaattgttttta

SEQ ID NO: 3541988 - DNA, 17 bp, Homo sapiens
atcttgaaaagaatcta

SEQ ID NO: 3541989 - DNA, 16 bp, Homo sapiens
atcttgaatatttgct

SEQ ID NO: 3541990 - DNA, 17 bp, Homo sapiens
atgaaaccaactgttga

SEQ ID NO: 3541991 - DNA, 20 bp, Homo sapiens
atgaaggactattaattcca

SEQ ID NO: 3541992 - DNA, 12 bp, Homo sapiens
atgaatgttctt

SEQ ID NO: 3541993 - DNA, 12 bp, Homo sapiens
atgatgtgaaag

SEQ ID NO: 3541994 - DNA, 15 bp, Homo sapiens
atgcatttaattctg

SEQ ID NO: 3541995 - DNA, 18 bp, Homo sapiens
atgctaagaaagcaaata

SEQ ID NO: 3541996 - DNA, 18 bp, Homo sapiens
atgcttcccagagaagct

SEQ ID NO: 3541997 - DNA, 20 bp, Homo sapiens
atggatggaaatatgttcta

SEQ ID NO: 3541998 - DNA, 12 bp, Homo sapiens
atggattattta

SEQ ID NO: 3541999 - DNA, 15 bp, Homo sapiens
atggtgttgtatact

SEQ ID NO: 3542000 - DNA, 18 bp, Homo sapiens
atgtaactaggccatttg

SEQ ID NO: 3542001 - DNA, 17 bp, Homo sapiens
atgtattcacctttctt

SEQ ID NO: 3542002 - DNA, 21 bp, Homo sapiens
atgtcagacatgaaaactatt

SEQ ID NO: 3542003 - DNA, 18 bp, Homo sapiens
atgtgaaagataaatgat

SEQ ID NO: 3542004 - DNA, 13 bp, Homo sapiens
atgtgcatttctt

SEQ ID NO: 3542005 - DNA, 14 bp, Homo sapiens
atgtgtttgatttt

SEQ ID NO: 3542006 - DNA, 17 bp, Homo sapiens
atgttctaacagcatct

SEQ ID NO: 3542007 - DNA, 21 bp, Homo sapiens
attaacccccaaattcaaaag

SEQ ID NO: 3542008 - DNA, 19 bp, Homo sapiens
attaacttttttagaatga

SEQ ID NO: 3542009 - DNA, 12 bp, Homo sapiens
attaatcattcc

SEQ ID NO: 3542010 - DNA, 12 bp, Homo sapiens
attaatttgttt

SEQ ID NO: 3542011 - DNA, 20 bp, Homo sapiens
attaatttgtttttcttatc

SEQ ID NO: 3542012 - DNA, 19 bp, Homo sapiens
attaccaagttacttgaaa

SEQ ID NO: 3542013 - DNA, 15 bp, Homo sapiens
attaccagaaaatga

SEQ ID NO: 3542014 - DNA, 14 bp, Homo sapiens
attagttttctgta

SEQ ID NO: 3542015 - DNA, 15 bp, Homo sapiens
attagttttctgtat

SEQ ID NO: 3542016 - DNA, 12 bp, Homo sapiens
attataaatgac

SEQ ID NO: 3542017 - DNA, 18 bp, Homo sapiens
attatcttatactgaaaa

SEQ ID NO: 3542018 - DNA, 12 bp, Homo sapiens
attattaatcat

SEQ ID NO: 3542019 - DNA, 20 bp, Homo sapiens
attattcatatgcttcccag

SEQ ID NO: 3542020 - DNA, 17 bp, Homo sapiens
attattcttcttacatt

SEQ ID NO: 3542021 - DNA, 20 bp, Homo sapiens
attcaaaagtaagaatgcaa

SEQ ID NO: 3542022 - DNA, 14 bp, Homo sapiens
attcaattctgtat

SEQ ID NO: 3542023 - DNA, 15 bp, Homo sapiens
attcaattctgtata

SEQ ID NO: 3542024 - DNA, 19 bp, Homo sapiens
attcacctttcttttgtaa

SEQ ID NO: 3542025 - DNA, 13 bp, Homo sapiens
attcatatgcttc

SEQ ID NO: 3542026 - DNA, 19 bp, Homo sapiens
attcatattaccagaaaat

SEQ ID NO: 3542027 - DNA, 13 bp, Homo sapiens
attcatcatatga

SEQ ID NO: 3542028 - DNA, 17 bp, Homo sapiens
attccaagattaaaagt

SEQ ID NO: 3542029 - DNA, 15 bp, Homo sapiens
attcccttttatttc

SEQ ID NO: 3542030 - DNA, 13 bp, Homo sapiens
attcctgcatttt

SEQ ID NO: 3542031 - DNA, 21 bp, Homo sapiens
attctatcactggcaatattt

SEQ ID NO: 3542032 - DNA, 14 bp, Homo sapiens
attcttcttacatt

SEQ ID NO: 3542033 - DNA, 17 bp, Homo sapiens
attgaattcgtttctga

SEQ ID NO: 3542034 - DNA, 19 bp, Homo sapiens
attgaattcgtttctgaca

SEQ ID NO: 3542035 - DNA, 19 bp, Homo sapiens
attgacacttagcagtcat

SEQ ID NO: 3542036 - DNA, 17 bp, Homo sapiens
atttaattctgaaatca

SEQ ID NO: 3542037 - DNA, 17 bp, Homo sapiens
atttcatggattattta

SEQ ID NO: 3542038 - DNA, 18 bp, Homo sapiens
atttccctggaatttaat

SEQ ID NO: 3542039 - DNA, 22 bp, Homo sapiens
atttcttgacttcacagcagcc

SEQ ID NO: 3542040 - DNA, 13 bp, Homo sapiens
atttgttgtactt

SEQ ID NO: 3542041 - DNA, 14 bp, Homo sapiens
atttgttgtacttt

SEQ ID NO: 3542042 - DNA, 15 bp, Homo sapiens
atttgtttagaagta

SEQ ID NO: 3542043 - DNA, 15 bp, Homo sapiens
atttgtttttcttat

SEQ ID NO: 3542044 - DNA, 13 bp, Homo sapiens
caaaatgttgcaa

SEQ ID NO: 3542045 - DNA, 17 bp, Homo sapiens
caaagcctgcgttctca

SEQ ID NO: 3542046 - DNA, 20 bp, Homo sapiens
caaaggccgtgcctggtggg

SEQ ID NO: 3542047 - DNA, 22 bp, Homo sapiens
caaataagctctattatattcg

SEQ ID NO: 3542048 - DNA, 22 bp, Homo sapiens
caaatggatggggataagaata

SEQ ID NO: 3542049 - DNA, 15 bp, Homo sapiens
caaattcaaaagtaa

SEQ ID NO: 3542050 - DNA, 14 bp, Homo sapiens
caacatgttttatg

SEQ ID NO: 3542051 - DNA, 15 bp, Homo sapiens
caacatgttttatgt

SEQ ID NO: 3542052 - DNA, 22 bp, Homo sapiens
caacctaaatggagaaagctgt

SEQ ID NO: 3542053 - DNA, 15 bp, Homo sapiens
caaccttcattttac

SEQ ID NO: 3542054 - DNA, 18 bp, Homo sapiens
caagggctacctctgagt

SEQ ID NO: 3542055 - DNA, 13 bp, Homo sapiens
tcgtttctgacat

SEQ ID NO: 3542056 - DNA, 20 bp, Homo sapiens
tctagaacatccttaaatgt

SEQ ID NO: 3542057 - DNA, 17 bp, Homo sapiens
tctagataggtgctttt

SEQ ID NO: 3542058 - DNA, 14 bp, Homo sapiens
tctatatgcattta

SEQ ID NO: 3542059 - DNA, 17 bp, Homo sapiens
tctatggggatacatga

SEQ ID NO: 3542060 - DNA, 14 bp, Homo sapiens
tctcatttctcaac

SEQ ID NO: 3542061 - DNA, 16 bp, Homo sapiens
tctgaccttattactg

SEQ ID NO: 3542062 - DNA, 12 bp, Homo sapiens
tctgatattcac

SEQ ID NO: 3542063 - DNA, 20 bp, Homo sapiens
tctgcatcatcatcacaacc

SEQ ID NO: 3542064 - DNA, 15 bp, Homo sapiens
tctgcctctattcaa

SEQ ID NO: 3542065 - DNA, 15 bp, Homo sapiens
tctgccttatctcat

SEQ ID NO: 3542066 - DNA, 18 bp, Homo sapiens
tctgcctttgtttctaaa

SEQ ID NO: 3542067 - DNA, 19 bp, Homo sapiens
tctgcctttgtttctaaag

SEQ ID NO: 3542068 - DNA, 19 bp, Homo sapiens
tctgtagagaatgaaagga

SEQ ID NO: 3542069 - DNA, 17 bp, Homo sapiens
tctgttttatgaaacca

SEQ ID NO: 3542070 - DNA, 19 bp, Homo sapiens
tcttacattattaatcatt

SEQ ID NO: 3542071 - DNA, 20 bp, Homo sapiens
tcttacattattaatcattc

SEQ ID NO: 3542072 - DNA, 13 bp, Homo sapiens
tcttatataagac

SEQ ID NO: 3542073 - DNA, 16 bp, Homo sapiens
tcttgaaaagaatcta

SEQ ID NO: 3542074 - DNA, 22 bp, Homo sapiens
tcttgaatatttgcttaaaatt

SEQ ID NO: 3542075 - DNA, 19 bp, Homo sapiens
tgaaaaaaaattcctttca

SEQ ID NO: 3542076 - DNA, 15 bp, Homo sapiens
tgaaaaaatgttcta

SEQ ID NO: 3542077 - DNA, 21 bp, Homo sapiens
tgaaaaaatgttctatatgca

SEQ ID NO: 3542078 - DNA, 13 bp, Homo sapiens
tgaaaatgttacc

SEQ ID NO: 3542079 - DNA, 12 bp, Homo sapiens
tgaaaccaactg

SEQ ID NO: 3542080 - DNA, 14 bp, Homo sapiens
tgaaagataaatga

SEQ ID NO: 3542081 - DNA, 15 bp, Homo sapiens
tgaaagataaatgat

SEQ ID NO: 3542082 - DNA, 19 bp, Homo sapiens
tgaacccagaactaggagt

SEQ ID NO: 3542083 - DNA, 20 bp, Homo sapiens
tgaagactagttatatattc

SEQ ID NO: 3542084 - DNA, 17 bp, Homo sapiens
tgaagggcttcttctta

SEQ ID NO: 3542085 - DNA, 16 bp, Homo sapiens
tgaatcagagaaaact

SEQ ID NO: 3542086 - DNA, 11 bp, Homo sapiens
tgaatgttctt

SEQ ID NO: 3542087 - DNA, 18 bp, Homo sapiens
tgaatgttcttggttccc

SEQ ID NO: 3542088 - DNA, 17 bp, Homo sapiens
tgacccctgctgatgcc

SEQ ID NO: 3542089 - DNA, 14 bp, Homo sapiens
tgacttcacagcag

SEQ ID NO: 3542090 - DNA, 21 bp, Homo sapiens
tgagccttttcttatataaga

SEQ ID NO: 3542091 - DNA, 14 bp, Homo sapiens
tgaggttctttccc

SEQ ID NO: 3542092 - DNA, 15 bp, Homo sapiens
tgatgtgaaagataa

SEQ ID NO: 3542093 - DNA, 19 bp, Homo sapiens
tgatgtgaaagataaatga

SEQ ID NO: 3542094 - DNA, 21 bp, Homo sapiens
tgattattcttcttacattat

SEQ ID NO: 3542095 - DNA, 14 bp, Homo sapiens
tgattcctgcattt

SEQ ID NO: 3542096 - DNA, 14 bp, Homo sapiens
tgatttcattacca

SEQ ID NO: 3542097 - DNA, 23 bp, Homo sapiens
tgcagttttgtaaataagtgaaa

SEQ ID NO: 3542098 - DNA, 22 bp, Homo sapiens
tgcatttcttgacttcacagca

SEQ ID NO: 3542099 - DNA, 14 bp, Homo sapiens
tgccctgaaaatgt

SEQ ID NO: 3542100 - DNA, 20 bp, Homo sapiens
tgcctctgccttatctcatt

SEQ ID NO: 3542101 - DNA, 14 bp, Homo sapiens
tgccttatctcatt

SEQ ID NO: 3542102 - DNA, 23 bp, Homo sapiens
tgctaagaaagcaaataagctct

SEQ ID NO: 3542103 - DNA, 14 bp, Homo sapiens
tgctaccaaagaat

SEQ ID NO: 3542104 - DNA, 15 bp, Homo sapiens
tgctaccaaagaatg

SEQ ID NO: 3542105 - DNA, 22 bp, Homo sapiens
tgctataagaaaagtgaaagta

SEQ ID NO: 3542106 - DNA, 19 bp, Homo sapiens
tgctggaggcagcgctggt

SEQ ID NO: 3542107 - DNA, 20 bp, Homo sapiens
tgctggaggcagcgctggtc

SEQ ID NO: 3542108 - DNA, 16 bp, Homo sapiens
tgcttcccagagaagc

SEQ ID NO: 3542109 - DNA, 22 bp, Homo sapiens
tggaacctaatgggaatcattc

SEQ ID NO: 3542110 - DNA, 22 bp, Homo sapiens
tggaatgtggtacaaattgttc

SEQ ID NO: 3542111 - DNA, 15 bp, Homo sapiens
tggaatttaattcaa

SEQ ID NO: 3542112 - DNA, 16 bp, Homo sapiens
tggacggagccaaagg

SEQ ID NO: 3542113 - DNA, 20 bp, Homo sapiens
tggagccctactcacacatt

SEQ ID NO: 3542114 - DNA, 15 bp, Homo sapiens
tggcaatatttgttc

SEQ ID NO: 3542115 - DNA, 14 bp, Homo sapiens
tggccactgctgga

SEQ ID NO: 3542116 - DNA, 18 bp, Homo sapiens
tgggcatccctcctggta

SEQ ID NO: 3542117 - DNA, 16 bp, Homo sapiens
tgggtgcgaaggcaga

SEQ ID NO: 3542118 - DNA, 16 bp, Homo sapiens
tggtattgtcttaaat

SEQ ID NO: 3542119 - DNA, 21 bp, Homo sapiens
tggtattgtcttaaataaatc

SEQ ID NO: 3542120 - DNA, 17 bp, Homo sapiens
tggtgttttataggtca

SEQ ID NO: 3542121 - DNA, 18 bp, Homo sapiens
tgtacattggtctttcta

SEQ ID NO: 3542122 - DNA, 17 bp, Homo sapiens
tgtacgtatcatttcta

SEQ ID NO: 3542123 - DNA, 15 bp, Homo sapiens
tgtactttttattca

SEQ ID NO: 3542124 - DNA, 15 bp, Homo sapiens
tgtatacttcattag

SEQ ID NO: 3542125 - DNA, 18 bp, Homo sapiens
tgtattcatattaccaga

SEQ ID NO: 3542126 - DNA, 23 bp, Homo sapiens
tgtattcccttttatttccaaaa

SEQ ID NO: 3542127 - DNA, 17 bp, Homo sapiens
tgtctgaggttctttcc

SEQ ID NO: 3542128 - DNA, 14 bp, Homo sapiens
tgtgagactcaggt

SEQ ID NO: 3542129 - DNA, 14 bp, Homo sapiens
tgtgccctgaaaat

SEQ ID NO: 3542130 - DNA, 18 bp, Homo sapiens
tgtggccatatttataga

SEQ ID NO: 3542131 - DNA, 19 bp, Homo sapiens
tgtggccatatttatagaa

SEQ ID NO: 3542132 - DNA, 22 bp, Homo sapiens
tgttaccaaagcaatatttccc

SEQ ID NO: 3542133 - DNA, 15 bp, Homo sapiens
tgttcactcagcact

SEQ ID NO: 3542134 - DNA, 17 bp, Homo sapiens
tgttctggtttagtgtt

SEQ ID NO: 3542135 - DNA, 21 bp, Homo sapiens
tgttctggtttagtgttctgt

SEQ ID NO: 3542136 - DNA, 18 bp, Homo sapiens
tgtttagataatacaggt

SEQ ID NO: 3542137 - DNA, 14 bp, Homo sapiens
tgtttccatcttca

SEQ ID NO: 3542138 - DNA, 20 bp, Homo sapiens
tgtttctaaaggtagatcat

SEQ ID NO: 3542139 - DNA, 22 bp, Homo sapiens
tgtttgagggattttattaaat

SEQ ID NO: 3542140 - DNA, 13 bp, Homo sapiens
ttaaaatttcact

SEQ ID NO: 3542141 - DNA, 15 bp, Homo sapiens
ttaaataaatatttt

SEQ ID NO: 3542142 - DNA, 21 bp, Homo sapiens
ttaaataaatcaagaatcatt

SEQ ID NO: 3542143 - DNA, 13 bp, Homo sapiens
ttaaatctgcctt

SEQ ID NO: 3542144 - DNA, 13 bp, Homo sapiens
ttaatcattccat

SEQ ID NO: 3542145 - DNA, 16 bp, Homo sapiens
ttaattcttatttctg

SEQ ID NO: 3542146 - DNA, 14 bp, Homo sapiens
ttactagaaatata

SEQ ID NO: 3542147 - DNA, 18 bp, Homo sapiens
ttactattaagggaaagg

SEQ ID NO: 3542148 - DNA, 20 bp, Homo sapiens
ttacttgaaaaaatgttcta

SEQ ID NO: 3542149 - DNA, 12 bp, Homo sapiens
ttagactgaaaa

SEQ ID NO: 3542150 - DNA, 18 bp, Homo sapiens
ttagctatgtttccatct

SEQ ID NO: 3542151 - DNA, 17 bp, Homo sapiens
ttagtgttctgtatttt

SEQ ID NO: 3542152 - DNA, 18 bp, Homo sapiens
ttagttttctgtatatga

SEQ ID NO: 3542153 - DNA, 13 bp, Homo sapiens
ttatactgaaaaa

SEQ ID NO: 3542154 - DNA, 17 bp, Homo sapiens
ttataggtcacatatgt

SEQ ID NO: 3542155 - DNA, 15 bp, Homo sapiens
ttatcctagaaaatt

SEQ ID NO: 3542156 - DNA, 17 bp, Homo sapiens
ttatcttatactgaaaa

SEQ ID NO: 3542157 - DNA, 20 bp, Homo sapiens
ttatgaatgtgcatttcttg

SEQ ID NO: 3542158 - DNA, 23 bp, Homo sapiens
ttattaaataaatattttacagt

SEQ ID NO: 3542159 - DNA, 15 bp, Homo sapiens
ttattaatcattcca

SEQ ID NO: 3542160 - DNA, 16 bp, Homo sapiens
ttattcaattctgtat

SEQ ID NO: 3542161 - DNA, 14 bp, Homo sapiens
ttattcttcttaca

SEQ ID NO: 3542162 - DNA, 13 bp, Homo sapiens
ttatttatttctg

SEQ ID NO: 3542163 - DNA, 14 bp, Homo sapiens
ttatttctgtaaaa

SEQ ID NO: 3542164 - DNA, 19 bp, Homo sapiens
ttatttttattaaataaat

SEQ ID NO: 3542165 - DNA, 23 bp, Homo sapiens
aatatttgttctggtttagtgtt

SEQ ID NO: 3542166 - DNA, 14 bp, Homo sapiens
aatcagagaaaact

SEQ ID NO: 3542167 - DNA, 18 bp, Homo sapiens
aatcattccactatacaa

SEQ ID NO: 3542168 - DNA, 19 bp, Homo sapiens
aatctaaacctctctaggg

SEQ ID NO: 3542169 - DNA, 15 bp, Homo sapiens
aatctgcctttgttt

SEQ ID NO: 3542170 - DNA, 17 bp, Homo sapiens
aatctgcctttgtttct

SEQ ID NO: 3542171 - DNA, 21 bp, Homo sapiens
aatgatgtgaaagataaatga

SEQ ID NO: 3542172 - DNA, 22 bp, Homo sapiens
aatgatgtgaaagataaatgat

SEQ ID NO: 3542173 - DNA, 15 bp, Homo sapiens
aatgggaatcattcc

SEQ ID NO: 3542174 - DNA, 15 bp, Homo sapiens
aatgtgcatttcttg

SEQ ID NO: 3542175 - DNA, 12 bp, Homo sapiens
aatgttaccagt

SEQ ID NO: 3542176 - DNA, 15 bp, Homo sapiens
aatgttctatatgca

SEQ ID NO: 3542177 - DNA, 18 bp, Homo sapiens
aatgttcttggttcccat

SEQ ID NO: 3542178 - DNA, 17 bp, Homo sapiens
aattcagtactgattat

SEQ ID NO: 3542179 - DNA, 22 bp, Homo sapiens
aattcatcatatgaatgttctt

SEQ ID NO: 3542180 - DNA, 13 bp, Homo sapiens
aattcgtttctga

SEQ ID NO: 3542181 - DNA, 15 bp, Homo sapiens
aattcttatttctgt

SEQ ID NO: 3542182 - DNA, 18 bp, Homo sapiens
aattcttatttctgtgtt

SEQ ID NO: 3542183 - DNA, 21 bp, Homo sapiens
aattgaattcgtttctgacat

SEQ ID NO: 3542184 - DNA, 18 bp, Homo sapiens
aattgctagtgatttcat

SEQ ID NO: 3542185 - DNA, 20 bp, Homo sapiens
aattgttaaatttaaaaata

SEQ ID NO: 3542186 - DNA, 15 bp, Homo sapiens
aatttaattcttatt

SEQ ID NO: 3542187 - DNA, 13 bp, Homo sapiens
aatttgaatcaga

SEQ ID NO: 3542188 - DNA, 15 bp, Homo sapiens
aatttgttgtacttt

SEQ ID NO: 3542189 - DNA, 11 bp, Homo sapiens
acaaaatgtta

SEQ ID NO: 3542190 - DNA, 18 bp, Homo sapiens
acaagggctacctctgag

SEQ ID NO: 3542191 - DNA, 21 bp, Homo sapiens
acaattcagtactgattattc

SEQ ID NO: 3542192 - DNA, 14 bp, Homo sapiens
acacacagttactg

SEQ ID NO: 3542193 - DNA, 17 bp, Homo sapiens
acactgaaattctaaat

SEQ ID NO: 3542194 - DNA, 13 bp, Homo sapiens
acagagggattta

SEQ ID NO: 3542195 - DNA, 17 bp, Homo sapiens
acagatctcaattttat

SEQ ID NO: 3542196 - DNA, 16 bp, Homo sapiens
acagctgaacagtgtt

SEQ ID NO: 3542197 - DNA, 22 bp, Homo sapiens
acagtctgcatcatcatcacaa

SEQ ID NO: 3542198 - DNA, 13 bp, Homo sapiens
acatactcatttg

SEQ ID NO: 3542199 - DNA, 14 bp, Homo sapiens
acatatgtctgtat

SEQ ID NO: 3542200 - DNA, 17 bp, Homo sapiens
acatatgtctgtatcta

SEQ ID NO: 3542201 - DNA, 18 bp, Homo sapiens
acatgaaaactattttaa

SEQ ID NO: 3542202 - DNA, 15 bp, Homo sapiens
acatggtgttgtata

SEQ ID NO: 3542203 - DNA, 23 bp, Homo sapiens
acatgttttatgtacacaaatcc

SEQ ID NO: 3542204 - DNA, 19 bp, Homo sapiens
acattaacccccaaattca

SEQ ID NO: 3542205 - DNA, 21 bp, Homo sapiens
acattaacccccaaattcaaa

SEQ ID NO: 3542206 - DNA, 17 bp, Homo sapiens
accaaagcaatatttcc

SEQ ID NO: 3542207 - DNA, 18 bp, Homo sapiens
accaagttacttgaaaaa

SEQ ID NO: 3542208 - DNA, 18 bp, Homo sapiens
accactacactccagcct

SEQ ID NO: 3542209 - DNA, 15 bp, Homo sapiens
accagtcaagagcaa

SEQ ID NO: 3542210 - DNA, 18 bp, Homo sapiens
accagtgttaataaatgg

SEQ ID NO: 3542211 - DNA, 15 bp, Homo sapiens
accatcctttactat

SEQ ID NO: 3542212 - DNA, 22 bp, Homo sapiens
accatcttctatcttctttcca

SEQ ID NO: 3542213 - DNA, 13 bp, Homo sapiens
acctaagtttccg

SEQ ID NO: 3542214 - DNA, 20 bp, Homo sapiens
acctaatgggaatcattcca

SEQ ID NO: 3542215 - DNA, 22 bp, Homo sapiens
acctaattgttaaatttaaaaa

SEQ ID NO: 3542216 - DNA, 21 bp, Homo sapiens
acctggtgcatcgaaatgtat

SEQ ID NO: 3542217 - DNA, 15 bp, Homo sapiens
accttagactgaaaa

SEQ ID NO: 3542218 - DNA, 17 bp, Homo sapiens
acgattatttatttctg

SEQ ID NO: 3542219 - DNA, 18 bp, Homo sapiens
acgattatttatttctgt

SEQ ID NO: 3542220 - DNA, 16 bp, Homo sapiens
acgcccttcctgtgcc

SEQ ID NO: 3542221 - DNA, 20 bp, Homo sapiens
actagaaatatattcataat

SEQ ID NO: 3542222 - DNA, 16 bp, Homo sapiens
actaggccatttgtat

SEQ ID NO: 3542223 - DNA, 14 bp, Homo sapiens
actattaattccaa

SEQ ID NO: 3542224 - DNA, 15 bp, Homo sapiens
actattaattccaag

SEQ ID NO: 3542225 - DNA, 23 bp, Homo sapiens
actcaatgtgcaagttgtactgt

SEQ ID NO: 3542226 - DNA, 18 bp, Homo sapiens
actcaggttgtctgtaga

SEQ ID NO: 3542227 - DNA, 14 bp, Homo sapiens
actcatgtacattg

SEQ ID NO: 3542228 - DNA, 16 bp, Homo sapiens
actcatgtacattggt

SEQ ID NO: 3542229 - DNA, 14 bp, Homo sapiens
actctgcacagcaa

SEQ ID NO: 3542230 - DNA, 16 bp, Homo sapiens
actgaaaaaaaattcc

SEQ ID NO: 3542231 - DNA, 21 bp, Homo sapiens
actgaaaaaaaattcctttca

SEQ ID NO: 3542232 - DNA, 23 bp, Homo sapiens
actgagcctcttttcaattattt

SEQ ID NO: 3542233 - DNA, 16 bp, Homo sapiens
actgctggaggcagcg

SEQ ID NO: 3542234 - DNA, 14 bp, Homo sapiens
actggcaatatttg

SEQ ID NO: 3542235 - DNA, 17 bp, Homo sapiens
actgttggttcatccag

SEQ ID NO: 3542236 - DNA, 21 bp, Homo sapiens
acttcacagagactctgtcct

SEQ ID NO: 3542237 - DNA, 16 bp, Homo sapiens
acttcattagcaagtg

SEQ ID NO: 3542238 - DNA, 19 bp, Homo sapiens
acttgaaaaaatgttctat

SEQ ID NO: 3542239 - DNA, 21 bp, Homo sapiens
acttgaaaaaatgttctatat

SEQ ID NO: 3542240 - DNA, 13 bp, Homo sapiens
acttttcattact

SEQ ID NO: 3542241 - DNA, 13 bp, Homo sapiens
actttttattcaa

SEQ ID NO: 3542242 - DNA, 14 bp, Homo sapiens
actttttattcaat

SEQ ID NO: 3542243 - DNA, 22 bp, Homo sapiens
actttttattcaattctgtata

SEQ ID NO: 3542244 - DNA, 14 bp, Homo sapiens
agaaatatattcat

SEQ ID NO: 3542245 - DNA, 17 bp, Homo sapiens
agaaatgatgtgaaaga

SEQ ID NO: 3542246 - DNA, 20 bp, Homo sapiens
agaaatgatgtgaaagataa

SEQ ID NO: 3542247 - DNA, 17 bp, Homo sapiens
agaacatccttaaatgt

SEQ ID NO: 3542248 - DNA, 21 bp, Homo sapiens
agaagctcatttagttagaaa

SEQ ID NO: 3542249 - DNA, 18 bp, Homo sapiens
agaagtacgtttttgcat

SEQ ID NO: 3542250 - DNA, 15 bp, Homo sapiens
agaataggtcatttt

SEQ ID NO: 3542251 - DNA, 16 bp, Homo sapiens
agacaagaatatgttc

SEQ ID NO: 3542252 - DNA, 15 bp, Homo sapiens
agacatgaaaactat

SEQ ID NO: 3542253 - DNA, 20 bp, Homo sapiens
agacatgaaaactattttaa

SEQ ID NO: 3542254 - DNA, 21 bp, Homo sapiens
agactagttatatattcctta

SEQ ID NO: 3542255 - DNA, 22 bp, Homo sapiens
agactcaggttgtctgtagaga

SEQ ID NO: 3542256 - DNA, 16 bp, Homo sapiens
agactgaaaaactgtt

SEQ ID NO: 3542257 - DNA, 15 bp, Homo sapiens
agacttaagaaagct

SEQ ID NO: 3542258 - DNA, 16 bp, Homo sapiens
agagaaatgatgtgaa

SEQ ID NO: 3542259 - DNA, 14 bp, Homo sapiens
agagacttaagaaa

SEQ ID NO: 3542260 - DNA, 14 bp, Homo sapiens
agagctaatttaag

SEQ ID NO: 3542261 - DNA, 13 bp, Homo sapiens
agatcatcttgaa

SEQ ID NO: 3542262 - DNA, 21 bp, Homo sapiens
agatgtaactaggccatttgt

SEQ ID NO: 3542263 - DNA, 19 bp, Homo sapiens
agatgtgattcctgcattt

SEQ ID NO: 3542264 - DNA, 22 bp, Homo sapiens
agatgttagtgtttagataata

SEQ ID NO: 3542265 - DNA, 22 bp, Homo sapiens
agcaaataagctctattatatt

SEQ ID NO: 3542266 - DNA, 19 bp, Homo sapiens
agcatctgcctctattcaa

SEQ ID NO: 3542267 - DNA, 20 bp, Homo sapiens
agccaaaggccgtgcctggt

SEQ ID NO: 3542268 - DNA, 20 bp, Homo sapiens
agcctaaacaacctggtgca

SEQ ID NO: 3542269 - DNA, 18 bp, Homo sapiens
agctaaggaagggaaagg

SEQ ID NO: 3542270 - DNA, 18 bp, Homo sapiens
agctctattatattcggt

SEQ ID NO: 3542271 - DNA, 16 bp, Homo sapiens
agctgtgcagaggaaa

SEQ ID NO: 3542272 - DNA, 18 bp, Homo sapiens
aggagcccagccttgcgc

SEQ ID NO: 3542273 - DNA, 15 bp, Homo sapiens
aggccatttgtattt

SEQ ID NO: 3542274 - DNA, 23 bp, Homo sapiens
aggccgtgcctggtggggcggac

SEQ ID NO: 3542275 - DNA, 23 bp, Homo sapiens
aggggtgggcatccctcctggta

SEQ ID NO: 3542276 - DNA, 22 bp, Homo sapiens
aggtagatcatcttgaatattt

SEQ ID NO: 3542277 - DNA, 18 bp, Homo sapiens
aggtggaaagagaaatga

SEQ ID NO: 3542278 - DNA, 17 bp, Homo sapiens
agtaaagtttatttcat

SEQ ID NO: 3542279 - DNA, 20 bp, Homo sapiens
agtactgattattcttctta

SEQ ID NO: 3542280 - DNA, 18 bp, Homo sapiens
agtagcaaccttcatttt

SEQ ID NO: 3542281 - DNA, 17 bp, Homo sapiens
agtagctcattcttgtg

SEQ ID NO: 3542282 - DNA, 22 bp, Homo sapiens
agtctagaacatccttaaatgt

SEQ ID NO: 3542283 - DNA, 16 bp, Homo sapiens
agtctgatattcacct

SEQ ID NO: 3542284 - DNA, 22 bp, Homo sapiens
agtgggaaagatacatgctaag

SEQ ID NO: 3542285 - DNA, 20 bp, Homo sapiens
agtgtgtcaagattgcaaag

SEQ ID NO: 3542286 - DNA, 16 bp, Homo sapiens
agtgttaataaatgga

SEQ ID NO: 3542287 - DNA, 17 bp, Homo sapiens
agtgttaataaatggat

SEQ ID NO: 3542288 - DNA, 14 bp, Homo sapiens
agttatatattcct

SEQ ID NO: 3542289 - DNA, 13 bp, Homo sapiens
agttattctatca

SEQ ID NO: 3542290 - DNA, 13 bp, Homo sapiens
agtttatttcatg

SEQ ID NO: 3542291 - DNA, 13 bp, Homo sapiens
ataaaaattgaat

SEQ ID NO: 3542292 - DNA, 17 bp, Homo sapiens
ataaaattatttttatt

SEQ ID NO: 3542293 - DNA, 14 bp, Homo sapiens
ataaatattttaca

SEQ ID NO: 3542294 - DNA, 19 bp, Homo sapiens
ataaatcaagaatcattga

SEQ ID NO: 3542295 - DNA, 11 bp, Homo sapiens
ataagctctat

SEQ ID NO: 3542296 - DNA, 22 bp, Homo sapiens
ataatacaggtaacattataaa

SEQ ID NO: 3542297 - DNA, 13 bp, Homo sapiens
ataatatataaaa

SEQ ID NO: 3542298 - DNA, 22 bp, Homo sapiens
ataatatataaaagaaatatat

SEQ ID NO: 3542299 - DNA, 11 bp, Homo sapiens
ataatttcatc

SEQ ID NO: 3542300 - DNA, 12 bp, Homo sapiens
ataatttgttgt

SEQ ID NO: 3542301 - DNA, 23 bp, Homo sapiens
atacaacctgagccttttcttat

SEQ ID NO: 3542302 - DNA, 12 bp, Homo sapiens
atacaattcagt

SEQ ID NO: 3542303 - DNA, 13 bp, Homo sapiens
atacaattcagta

SEQ ID NO: 3542304 - DNA, 16 bp, Homo sapiens
ataccttagactgaaa

SEQ ID NO: 3542305 - DNA, 18 bp, Homo sapiens
ataccttagactgaaaaa

SEQ ID NO: 3542306 - DNA, 16 bp, Homo sapiens
atactaaggagcctaa

SEQ ID NO: 3542307 - DNA, 19 bp, Homo sapiens
atagatgtgattcctgcat

SEQ ID NO: 3542308 - DNA, 19 bp, Homo sapiens
atagattataaaattattt

SEQ ID NO: 3542309 - DNA, 16 bp, Homo sapiens
ataggaattgcattag

SEQ ID NO: 3542310 - DNA, 21 bp, Homo sapiens
ataggtcacatatgtctgtat

SEQ ID NO: 3542311 - DNA, 20 bp, Homo sapiens
ataggtggaaagagaaatga

SEQ ID NO: 3542312 - DNA, 22 bp, Homo sapiens
ataggtggaaagagaaatgatg

SEQ ID NO: 3542313 - DNA, 16 bp, Homo sapiens
atataaaagaaatata

SEQ ID NO: 3542314 - DNA, 17 bp, Homo sapiens
atataaaagaaatatat

SEQ ID NO: 3542315 - DNA, 23 bp, Homo sapiens
atataaaagaaatatatctgtga

SEQ ID NO: 3542316 - DNA, 21 bp, Homo sapiens
atatattccttactagaaata

SEQ ID NO: 3542317 - DNA, 17 bp, Homo sapiens
atatgaaggactattaa

SEQ ID NO: 3542318 - DNA, 23 bp, Homo sapiens
atatgaaggactattaattccaa

SEQ ID NO: 3542319 - DNA, 14 bp, Homo sapiens
atatgtctgtatct

SEQ ID NO: 3542320 - DNA, 21 bp, Homo sapiens
atattatcttatactgaaaaa

SEQ ID NO: 3542321 - DNA, 22 bp, Homo sapiens
atattccttactagaaatatat

SEQ ID NO: 3542322 - DNA, 14 bp, Homo sapiens
atcaagaatcattg

SEQ ID NO: 3542323 - DNA, 17 bp, Homo sapiens
atcactggcaatatttg

SEQ ID NO: 3542324 - DNA, 17 bp, Homo sapiens
atcatatgaatgttctt

SEQ ID NO: 3542325 - DNA, 19 bp, Homo sapiens
atcatcttgaatatttgct

SEQ ID NO: 3542326 - DNA, 17 bp, Homo sapiens
atcattccactatacaa

SEQ ID NO: 3542327 - DNA, 16 bp, Homo sapiens
atctacttagccagat

SEQ ID NO: 3542328 - DNA, 12 bp, Homo sapiens
atctcaatttta

SEQ ID NO: 3542329 - DNA, 16 bp, Homo sapiens
atctcatttctcaaca

SEQ ID NO: 3542330 - DNA, 16 bp, Homo sapiens
atcttatactgaaaaa

SEQ ID NO: 3542331 - DNA, 15 bp, Homo sapiens
atcttctatcttctt

SEQ ID NO: 3542332 - DNA, 16 bp, Homo sapiens
atcttctatcttcttt

SEQ ID NO: 3542333 - DNA, 14 bp, Homo sapiens
atcttgaatatttg

SEQ ID NO: 3542334 - DNA, 22 bp, Homo sapiens
atgaaggactattaattccaag

SEQ ID NO: 3542335 - DNA, 15 bp, Homo sapiens
atgacagatctcaat

SEQ ID NO: 3542336 - DNA, 15 bp, Homo sapiens
atgacagtgtgagac

SEQ ID NO: 3542337 - DNA, 21 bp, Homo sapiens
atgactttttttctgattcaa

SEQ ID NO: 3542338 - DNA, 20 bp, Homo sapiens
atgatgtgaaagataaatga

SEQ ID NO: 3542339 - DNA, 21 bp, Homo sapiens
atgatgtgaaagataaatgat

SEQ ID NO: 3542340 - DNA, 13 bp, Homo sapiens
atgcatgttctgt

SEQ ID NO: 3542341 - DNA, 13 bp, Homo sapiens
atggaaatatgtt

SEQ ID NO: 3542342 - DNA, 16 bp, Homo sapiens
atggaaatatgttcta

SEQ ID NO: 3542343 - DNA, 15 bp, Homo sapiens
atggagaaagctgtg

SEQ ID NO: 3542344 - DNA, 18 bp, Homo sapiens
atggatggaaatatgttc

SEQ ID NO: 3542345 - DNA, 14 bp, Homo sapiens
atggattatttatg

SEQ ID NO: 3542346 - DNA, 16 bp, Homo sapiens
atgggaatcattccac

SEQ ID NO: 3542347 - DNA, 22 bp, Homo sapiens
atgtacattggtctttctacat

SEQ ID NO: 3542348 - DNA, 20 bp, Homo sapiens
atgtgcaagttgtactgtat

SEQ ID NO: 3542349 - DNA, 23 bp, Homo sapiens
atgtgcaagttgtactgtatgca

SEQ ID NO: 3542350 - DNA, 11 bp, Homo sapiens
atgtgcatttc

SEQ ID NO: 3542351 - DNA, 23 bp, Homo sapiens
atgttaccaaagcaatatttccc

SEQ ID NO: 3542352 - DNA, 23 bp, Homo sapiens
atgttctaacagcatctgcctct

SEQ ID NO: 3542353 - DNA, 19 bp, Homo sapiens
attaaataaatattttaca

SEQ ID NO: 3542354 - DNA, 19 bp, Homo sapiens
attaagggaaaggaaaaga

SEQ ID NO: 3542355 - DNA, 13 bp, Homo sapiens
attaatcattcca

SEQ ID NO: 3542356 - DNA, 23 bp, Homo sapiens
attaattccaagattaaaagttc

SEQ ID NO: 3542357 - DNA, 16 bp, Homo sapiens
attataaaattatttt

SEQ ID NO: 3542358 - DNA, 15 bp, Homo sapiens
attattaatcattcc

SEQ ID NO: 3542359 - DNA, 16 bp, Homo sapiens
attattaatcattcca

SEQ ID NO: 3542360 - DNA, 12 bp, Homo sapiens
attcaaaagtaa

SEQ ID NO: 3542361 - DNA, 21 bp, Homo sapiens
attcaaaagtaagaatgcaaa

SEQ ID NO: 3542362 - DNA, 22 bp, Homo sapiens
attcaaaagtgaacttgatttt

SEQ ID NO: 3542363 - DNA, 22 bp, Homo sapiens
attcacctgggtttgcaagaat

SEQ ID NO: 3542364 - DNA, 21 bp, Homo sapiens
attcatcatatgaatgttctt

SEQ ID NO: 3542365 - DNA, 22 bp, Homo sapiens
attcatcatatgaatgttcttg

SEQ ID NO: 3542366 - DNA, 21 bp, Homo sapiens
attccaagattaaaagttcat

SEQ ID NO: 3542367 - DNA, 19 bp, Homo sapiens
attcccttttatttccaaa

SEQ ID NO: 3542368 - DNA, 12 bp, Homo sapiens
attcctgcattt

SEQ ID NO: 3542369 - DNA, 16 bp, Homo sapiens
attccttactagaaat

SEQ ID NO: 3542370 - DNA, 17 bp, Homo sapiens
attccttactagaaata

SEQ ID NO: 3542371 - DNA, 18 bp, Homo sapiens
attccttactagaaatat

SEQ ID NO: 3542372 - DNA, 22 bp, Homo sapiens
attccttactagaaatatattc

SEQ ID NO: 3542373 - DNA, 22 bp, Homo sapiens
attcgtttctgacataccttag

SEQ ID NO: 3542374 - DNA, 14 bp, Homo sapiens
attctaaatattga

SEQ ID NO: 3542375 - DNA, 15 bp, Homo sapiens
attcttatttctgtg

SEQ ID NO: 3542376 - DNA, 15 bp, Homo sapiens
attcttcttacatta

SEQ ID NO: 3542377 - DNA, 23 bp, Homo sapiens
attcttcttacattattaatcat

SEQ ID NO: 3542378 - DNA, 22 bp, Homo sapiens
attgcaaagtcgacatactcat

SEQ ID NO: 3542379 - DNA, 23 bp, Homo sapiens
attgctagtgatttcattaccaa

SEQ ID NO: 3542380 - DNA, 17 bp, Homo sapiens
attgtgacgattattta

SEQ ID NO: 3542381 - DNA, 21 bp, Homo sapiens
attgtttttaatttgaatcag

SEQ ID NO: 3542382 - DNA, 15 bp, Homo sapiens
atttaaaaataggta

SEQ ID NO: 3542383 - DNA, 17 bp, Homo sapiens
atttaattcttatttct

SEQ ID NO: 3542384 - DNA, 15 bp, Homo sapiens
tccaaggcctttttc

SEQ ID NO: 3542385 - DNA, 19 bp, Homo sapiens
tccaagtaaagatgtcaat

SEQ ID NO: 3542386 - DNA, 19 bp, Homo sapiens
tccacctttctctgtttta

SEQ ID NO: 3542387 - DNA, 21 bp, Homo sapiens
tccacctttctctgttttatg

SEQ ID NO: 3542388 - DNA, 17 bp, Homo sapiens
tccagaagtgtattcat

SEQ ID NO: 3542389 - DNA, 14 bp, Homo sapiens
tccatcttcagttt

SEQ ID NO: 3542390 - DNA, 18 bp, Homo sapiens
tcccagagaagctcattt

SEQ ID NO: 3542391 - DNA, 14 bp, Homo sapiens
tccctatgttgcta

SEQ ID NO: 3542392 - DNA, 15 bp, Homo sapiens
tccttactagaaata

SEQ ID NO: 3542393 - DNA, 21 bp, Homo sapiens
tccttagctgtaaaatggaag

SEQ ID NO: 3542394 - DNA, 14 bp, Homo sapiens
tcgaaatgtattca

SEQ ID NO: 3542395 - DNA, 17 bp, Homo sapiens
tcgaaatgtattcacct

SEQ ID NO: 3542396 - DNA, 19 bp, Homo sapiens
tcggcacttttcattactt

SEQ ID NO: 3542397 - DNA, 21 bp, Homo sapiens
tcgtggagccctactcacaca

SEQ ID NO: 3542398 - DNA, 14 bp, Homo sapiens
tcgtttctgacata

SEQ ID NO: 3542399 - DNA, 16 bp, Homo sapiens
tctaaatattgacact

SEQ ID NO: 3542400 - DNA, 19 bp, Homo sapiens
tctagaacatccttaaatg

SEQ ID NO: 3542401 - DNA, 13 bp, Homo sapiens
tctatatgcattt

SEQ ID NO: 3542402 - DNA, 16 bp, Homo sapiens
tctatatgcatttaat

SEQ ID NO: 3542403 - DNA, 17 bp, Homo sapiens
tctatcactggcaatat

SEQ ID NO: 3542404 - DNA, 12 bp, Homo sapiens
tctatcttcttt

SEQ ID NO: 3542405 - DNA, 23 bp, Homo sapiens
tctatggggatacatgaacttca

SEQ ID NO: 3542406 - DNA, 17 bp, Homo sapiens
tctcaacagttcattgc

SEQ ID NO: 3542407 - DNA, 22 bp, Homo sapiens
tctcatcccagtctgatattca

SEQ ID NO: 3542408 - DNA, 22 bp, Homo sapiens
tctcatttctcaacagttcatt

SEQ ID NO: 3542409 - DNA, 13 bp, Homo sapiens
tctccacccgctc

SEQ ID NO: 3542410 - DNA, 19 bp, Homo sapiens
tctccacccgctctggccc

SEQ ID NO: 3542411 - DNA, 13 bp, Homo sapiens
tctgattcaaaag

SEQ ID NO: 3542412 - DNA, 13 bp, Homo sapiens
tctgcatcatcat

SEQ ID NO: 3542413 - DNA, 14 bp, Homo sapiens
tctgcatcatcatc

SEQ ID NO: 3542414 - DNA, 16 bp, Homo sapiens
tctgccttatctcatt

SEQ ID NO: 3542415 - DNA, 15 bp, Homo sapiens
tctgcctttgtttct

SEQ ID NO: 3542416 - DNA, 17 bp, Homo sapiens
tctggtttagtgttctg

SEQ ID NO: 3542417 - DNA, 21 bp, Homo sapiens
tctggtttagtgttctgtatt

SEQ ID NO: 3542418 - DNA, 16 bp, Homo sapiens
tctgtagagaatgaaa

SEQ ID NO: 3542419 - DNA, 20 bp, Homo sapiens
tctgtatagattataaaatt

SEQ ID NO: 3542420 - DNA, 12 bp, Homo sapiens
tctgtgttactc

SEQ ID NO: 3542421 - DNA, 16 bp, Homo sapiens
tcttaaataaatcaag

SEQ ID NO: 3542422 - DNA, 23 bp, Homo sapiens
tcttacattattaatcattccat

SEQ ID NO: 3542423 - DNA, 14 bp, Homo sapiens
tcttatactgaaaa

SEQ ID NO: 3542424 - DNA, 15 bp, Homo sapiens
tcttcagtttctgaa

SEQ ID NO: 3542425 - DNA, 13 bp, Homo sapiens
tcttgaatatttg

SEQ ID NO: 3542426 - DNA, 15 bp, Homo sapiens
tcttgacttcacagc

SEQ ID NO: 3542427 - DNA, 21 bp, Homo sapiens
tctttcccacactgaaattct

SEQ ID NO: 3542428 - DNA, 18 bp, Homo sapiens
tctttctacatagttatt

SEQ ID NO: 3542429 - DNA, 16 bp, Homo sapiens
tctttggtattgtctt

SEQ ID NO: 3542430 - DNA, 23 bp, Homo sapiens
tcttttgtaaagagaccatcttc

SEQ ID NO: 3542431 - DNA, 11 bp, Homo sapiens
tgaaaaatctt

SEQ ID NO: 3542432 - DNA, 14 bp, Homo sapiens
tgaaaactatttta

SEQ ID NO: 3542433 - DNA, 16 bp, Homo sapiens
tgaaaactattttaaa

SEQ ID NO: 3542434 - DNA, 17 bp, Homo sapiens
tgaaaatgttaccagtg

SEQ ID NO: 3542435 - DNA, 23 bp, Homo sapiens
tgaaagtaactgttttcttcttg

SEQ ID NO: 3542436 - DNA, 16 bp, Homo sapiens
tgaactcaatgtgcaa

SEQ ID NO: 3542437 - DNA, 16 bp, Homo sapiens
tgaaggcttttgatcc

SEQ ID NO: 3542438 - DNA, 19 bp, Homo sapiens
tgaagggcttcttcttata

SEQ ID NO: 3542439 - DNA, 14 bp, Homo sapiens
tgaatgtgcatttc

SEQ ID NO: 3542440 - DNA, 16 bp, Homo sapiens
tgacatacaaaccatg

SEQ ID NO: 3542441 - DNA, 13 bp, Homo sapiens
tgacataccttag

SEQ ID NO: 3542442 - DNA, 22 bp, Homo sapiens
tgacataccttagactgaaaaa

SEQ ID NO: 3542443 - DNA, 17 bp, Homo sapiens
tgacctaattgttaaat

SEQ ID NO: 3542444 - DNA, 18 bp, Homo sapiens
tgacgattatttatttct

SEQ ID NO: 3542445 - DNA, 20 bp, Homo sapiens
tgacgattatttatttctgt

SEQ ID NO: 3542446 - DNA, 14 bp, Homo sapiens
tgacttagcctaaa

SEQ ID NO: 3542447 - DNA, 17 bp, Homo sapiens
tgagactagcctggcca

SEQ ID NO: 3542448 - DNA, 22 bp, Homo sapiens
tgaggttctttcccacactgaa

SEQ ID NO: 3542449 - DNA, 19 bp, Homo sapiens
tgatactattcagaggagc

SEQ ID NO: 3542450 - DNA, 18 bp, Homo sapiens
tgatatatattatcttat

SEQ ID NO: 3542451 - DNA, 13 bp, Homo sapiens
tgatgtgaaagat

SEQ ID NO: 3542452 - DNA, 20 bp, Homo sapiens
tgattattcttcttacatta

SEQ ID NO: 3542453 - DNA, 12 bp, Homo sapiens
tgcaaaggcttc

SEQ ID NO: 3542454 - DNA, 13 bp, Homo sapiens
tgcatcatcatca

SEQ ID NO: 3542455 - DNA, 18 bp, Homo sapiens
tgcatcgaaatgtattca

SEQ ID NO: 3542456 - DNA, 13 bp, Homo sapiens
tgcattcaattta

SEQ ID NO: 3542457 - DNA, 19 bp, Homo sapiens
tgccaaacctttaaatttt

SEQ ID NO: 3542458 - DNA, 20 bp, Homo sapiens
tgcctgtaattccagccact

SEQ ID NO: 3542459 - DNA, 23 bp, Homo sapiens
tgctaccaaagaatgcatgttct

SEQ ID NO: 3542460 - DNA, 13 bp, Homo sapiens
tgctataagaaaa

SEQ ID NO: 3542461 - DNA, 17 bp, Homo sapiens
tgctgatgccacagaga

SEQ ID NO: 3542462 - DNA, 15 bp, Homo sapiens
tgcttgaacccagga

SEQ ID NO: 3542463 - DNA, 18 bp, Homo sapiens
tgctttgttttgtttgtg

SEQ ID NO: 3542464 - DNA, 16 bp, Homo sapiens
tggaaatatgttctaa

SEQ ID NO: 3542465 - DNA, 16 bp, Homo sapiens
tggaacctaatgggaa

SEQ ID NO: 3542466 - DNA, 17 bp, Homo sapiens
tggaatttaattcaaag

SEQ ID NO: 3542467 - DNA, 19 bp, Homo sapiens
tggatggaaatatgttcta

SEQ ID NO: 3542468 - DNA, 17 bp, Homo sapiens
tggccactgctggaggc

SEQ ID NO: 3542469 - DNA, 23 bp, Homo sapiens
tgggaatcattccactatacaat

SEQ ID NO: 3542470 - DNA, 19 bp, Homo sapiens
tggggatacatgaacttca

SEQ ID NO: 3542471 - DNA, 20 bp, Homo sapiens
tggtacaaattgttcatgtt

SEQ ID NO: 3542472 - DNA, 17 bp, Homo sapiens
tggtgttgtatacttca

SEQ ID NO: 3542473 - DNA, 16 bp, Homo sapiens
tggttcccattgtgac

SEQ ID NO: 3542474 - DNA, 16 bp, Homo sapiens
tgtaaaatttgtttag

SEQ ID NO: 3542475 - DNA, 17 bp, Homo sapiens
tgtacttaaattacaca

SEQ ID NO: 3542476 - DNA, 22 bp, Homo sapiens
tgtatgcagttttgtaaataag

SEQ ID NO: 3542477 - DNA, 14 bp, Homo sapiens
tgtatttgtattcc

SEQ ID NO: 3542478 - DNA, 15 bp, Homo sapiens
tgtcaagattgcaaa

SEQ ID NO: 3542479 - DNA, 14 bp, Homo sapiens
tgtctgtagagaat

SEQ ID NO: 3542480 - DNA, 15 bp, Homo sapiens
tgtctgtagagaatg

SEQ ID NO: 3542481 - DNA, 22 bp, Homo sapiens
tgtctttaaatcttcaatatga

SEQ ID NO: 3542482 - DNA, 21 bp, Homo sapiens
tgtgacgattatttatttctg

SEQ ID NO: 3542483 - DNA, 16 bp, Homo sapiens
tgtgattcctgcattt

SEQ ID NO: 3542484 - DNA, 20 bp, Homo sapiens
tgtggccatatttatagaat

SEQ ID NO: 3542485 - DNA, 16 bp, Homo sapiens
tgttaaatttaaaaat

SEQ ID NO: 3542486 - DNA, 20 bp, Homo sapiens
tgttaaatttaaaaataggt

SEQ ID NO: 3542487 - DNA, 15 bp, Homo sapiens
tgttaataaatggat

SEQ ID NO: 3542488 - DNA, 23 bp, Homo sapiens
tgttctatatgcatttaattctg

SEQ ID NO: 3542489 - DNA, 20 bp, Homo sapiens
tgttgacatacaaaccatga

SEQ ID NO: 3542490 - DNA, 16 bp, Homo sapiens
tgttgtatacttcatt

SEQ ID NO: 3542491 - DNA, 20 bp, Homo sapiens
tgtttcctgcacctgctgtc

SEQ ID NO: 3542492 - DNA, 13 bp, Homo sapiens
tgtttttcttatc

SEQ ID NO: 3542493 - DNA, 20 bp, Homo sapiens
ttaaataaatcaagaatcat

SEQ ID NO: 3542494 - DNA, 21 bp, Homo sapiens
agaaaagtgaaagtaactgtt

SEQ ID NO: 3542495 - DNA, 15 bp, Homo sapiens
agaacatccttaaat

SEQ ID NO: 3542496 - DNA, 22 bp, Homo sapiens
agaagtacgtttttgcattatt

SEQ ID NO: 3542497 - DNA, 24 bp, Homo sapiens
agaagtacgtttttgcattattca

SEQ ID NO: 3542498 - DNA, 15 bp, Homo sapiens
agaatgcaaaagtct

SEQ ID NO: 3542499 - DNA, 22 bp, Homo sapiens
agacatatatttatgaatgtgc

SEQ ID NO: 3542500 - DNA, 18 bp, Homo sapiens
agacatgaaaactatttt

SEQ ID NO: 3542501 - DNA, 13 bp, Homo sapiens
agacttaagaaag

SEQ ID NO: 3542502 - DNA, 17 bp, Homo sapiens
agagaagctcatttagt

SEQ ID NO: 3542503 - DNA, 16 bp, Homo sapiens
agataggtgcttttaa

SEQ ID NO: 3542504 - DNA, 23 bp, Homo sapiens
agatgtaactaggccatttgtat

SEQ ID NO: 3542505 - DNA, 15 bp, Homo sapiens
agcaaataagctcta

SEQ ID NO: 3542506 - DNA, 16 bp, Homo sapiens
agcaaccttcatttta

SEQ ID NO: 3542507 - DNA, 22 bp, Homo sapiens
agcaatatttccctggaattta

SEQ ID NO: 3542508 - DNA, 23 bp, Homo sapiens
agcataaaaattgaattcgtttc

SEQ ID NO: 3542509 - DNA, 23 bp, Homo sapiens
agccaaaggccgtgcctggtggg

SEQ ID NO: 3542510 - DNA, 21 bp, Homo sapiens
agcctcttttcaattatttca

SEQ ID NO: 3542511 - DNA, 20 bp, Homo sapiens
agcctgcgttctcatcccag

SEQ ID NO: 3542512 - DNA, 14 bp, Homo sapiens
agcctggccagcat

SEQ ID NO: 3542513 - DNA, 14 bp, Homo sapiens
agccttttcttata

SEQ ID NO: 3542514 - DNA, 17 bp, Homo sapiens
agctggagggaggggcg

SEQ ID NO: 3542515 - DNA, 20 bp, Homo sapiens
aggacagggtggccttactc

SEQ ID NO: 3542516 - DNA, 20 bp, Homo sapiens
aggagaattgcttgaaccca

SEQ ID NO: 3542517 - DNA, 20 bp, Homo sapiens
aggaggcagaggttgcagtg

SEQ ID NO: 3542518 - DNA, 19 bp, Homo sapiens
aggatgactttttttctga

SEQ ID NO: 3542519 - DNA, 23 bp, Homo sapiens
aggcagcgctggtcgtcacctgg

SEQ ID NO: 3542520 - DNA, 17 bp, Homo sapiens
agggaagtgatatcata

SEQ ID NO: 3542521 - DNA, 16 bp, Homo sapiens
agggcttcttcttata

SEQ ID NO: 3542522 - DNA, 15 bp, Homo sapiens
aggtagttagcaata

SEQ ID NO: 3542523 - DNA, 14 bp, Homo sapiens
aggtcattttctat

SEQ ID NO: 3542524 - DNA, 15 bp, Homo sapiens
aggtcattttctatt

SEQ ID NO: 3542525 - DNA, 22 bp, Homo sapiens
aggttctttcccacactgaaat

SEQ ID NO: 3542526 - DNA, 23 bp, Homo sapiens
aggttctttcccacactgaaatt

SEQ ID NO: 3542527 - DNA, 22 bp, Homo sapiens
aggttgtctgtagagaatgaaa

SEQ ID NO: 3542528 - DNA, 15 bp, Homo sapiens
agtacgtttttgcat

SEQ ID NO: 3542529 - DNA, 18 bp, Homo sapiens
agtacgtttttgcattat

SEQ ID NO: 3542530 - DNA, 22 bp, Homo sapiens
agtacgtttttgcattattcat

SEQ ID NO: 3542531 - DNA, 23 bp, Homo sapiens
agtagcaaccttcattttacatt

SEQ ID NO: 3542532 - DNA, 22 bp, Homo sapiens
agtagtgggaaagatacatgct

SEQ ID NO: 3542533 - DNA, 23 bp, Homo sapiens
agtatatgtcagacatgaaaact

SEQ ID NO: 3542534 - DNA, 17 bp, Homo sapiens
agtcgacatactcattt

SEQ ID NO: 3542535 - DNA, 17 bp, Homo sapiens
agtgatatcataaaagt

SEQ ID NO: 3542536 - DNA, 19 bp, Homo sapiens
agtgcaccaggtcactctg

SEQ ID NO: 3542537 - DNA, 23 bp, Homo sapiens
agtggcccatgtgactgtggcat

SEQ ID NO: 3542538 - DNA, 18 bp, Homo sapiens
agttatatattccttact

SEQ ID NO: 3542539 - DNA, 22 bp, Homo sapiens
agttattttaaaaaaattcatc

SEQ ID NO: 3542540 - DNA, 15 bp, Homo sapiens
agttgtactgtatgc

SEQ ID NO: 3542541 - DNA, 16 bp, Homo sapiens
agtttggtgttttata

SEQ ID NO: 3542542 - DNA, 17 bp, Homo sapiens
agttttctgtatatgat

SEQ ID NO: 3542543 - DNA, 12 bp, Homo sapiens
ataaaaattgaa

SEQ ID NO: 3542544 - DNA, 14 bp, Homo sapiens
ataaaagaaatata

SEQ ID NO: 3542545 - DNA, 16 bp, Homo sapiens
ataaaagaaatatatc

SEQ ID NO: 3542546 - DNA, 18 bp, Homo sapiens
ataaatattttacagtat

SEQ ID NO: 3542547 - DNA, 22 bp, Homo sapiens
ataaggcaagttttgaagcctg

SEQ ID NO: 3542548 - DNA, 23 bp, Homo sapiens
ataatacaggtaacattataaat

SEQ ID NO: 3542549 - DNA, 18 bp, Homo sapiens
ataatatataaaagaaat

SEQ ID NO: 3542550 - DNA, 19 bp, Homo sapiens
ataatatataaaagaaata

SEQ ID NO: 3542551 - DNA, 14 bp, Homo sapiens
ataatttgttgtac

SEQ ID NO: 3542552 - DNA, 15 bp, Homo sapiens
atacaacctgagcct

SEQ ID NO: 3542553 - DNA, 15 bp, Homo sapiens
atacaggtaacatta

SEQ ID NO: 3542554 - DNA, 22 bp, Homo sapiens
atacaggtaacattataaatga

SEQ ID NO: 3542555 - DNA, 17 bp, Homo sapiens
atacatgctaagaaagc

SEQ ID NO: 3542556 - DNA, 19 bp, Homo sapiens
atacatgctaagaaagcaa

SEQ ID NO: 3542557 - DNA, 23 bp, Homo sapiens
atactgaaaaaaaattcctttca

SEQ ID NO: 3542558 - DNA, 12 bp, Homo sapiens
atacttcattag

SEQ ID NO: 3542559 - DNA, 23 bp, Homo sapiens
aaatgaagagacttaagaaagct

SEQ ID NO: 3542560 - DNA, 16 bp, Homo sapiens
aaatgatgtgaaagat

SEQ ID NO: 3542561 - DNA, 18 bp, Homo sapiens
aaatgatgtgaaagataa

SEQ ID NO: 3542562 - DNA, 23 bp, Homo sapiens
aaatgatgtgaaagataaatgat

SEQ ID NO: 3542563 - DNA, 23 bp, Homo sapiens
aaatgttaccagtgttaataaat

SEQ ID NO: 3542564 - DNA, 13 bp, Homo sapiens
aaatgttctatat

SEQ ID NO: 3542565 - DNA, 20 bp, Homo sapiens
aaatgttctatatgcattta

SEQ ID NO: 3542566 - DNA, 22 bp, Homo sapiens
aaattgtttttaatttgaatca

SEQ ID NO: 3542567 - DNA, 15 bp, Homo sapiens
aacaagtagaaaagt

SEQ ID NO: 3542568 - DNA, 15 bp, Homo sapiens
aacattataaatgac

SEQ ID NO: 3542569 - DNA, 14 bp, Homo sapiens
aacatttcttgaag

SEQ ID NO: 3542570 - DNA, 16 bp, Homo sapiens
aaccaactgttgacat

SEQ ID NO: 3542571 - DNA, 17 bp, Homo sapiens
aaccaactgttgacata

SEQ ID NO: 3542572 - DNA, 19 bp, Homo sapiens
aacctgagccttttcttat

SEQ ID NO: 3542573 - DNA, 19 bp, Homo sapiens
aactaggccatttgtattt

SEQ ID NO: 3542574 - DNA, 12 bp, Homo sapiens
aactattttaaa

SEQ ID NO: 3542575 - DNA, 18 bp, Homo sapiens
aactgagcctcttttcaa

SEQ ID NO: 3542576 - DNA, 18 bp, Homo sapiens
aagaataggtcattttct

SEQ ID NO: 3542577 - DNA, 19 bp, Homo sapiens
aagaataggtcattttcta

SEQ ID NO: 3542578 - DNA, 11 bp, Homo sapiens
aagataaatga

SEQ ID NO: 3542579 - DNA, 13 bp, Homo sapiens
aagataaatgatg

SEQ ID NO: 3542580 - DNA, 13 bp, Homo sapiens
aagattgcaaagt

SEQ ID NO: 3542581 - DNA, 18 bp, Homo sapiens
aagcataaaaattgaatt

SEQ ID NO: 3542582 - DNA, 14 bp, Homo sapiens
aaggaaaagaacac

SEQ ID NO: 3542583 - DNA, 17 bp, Homo sapiens
aaggactattaattcca

SEQ ID NO: 3542584 - DNA, 17 bp, Homo sapiens
aagggctacctctgagt

SEQ ID NO: 3542585 - DNA, 18 bp, Homo sapiens
aagggctacctctgagta

SEQ ID NO: 3542586 - DNA, 19 bp, Homo sapiens
aaggtagatcatcttgaat

SEQ ID NO: 3542587 - DNA, 15 bp, Homo sapiens
aagtaagaatgcaaa

SEQ ID NO: 3542588 - DNA, 18 bp, Homo sapiens
aagtcgacatactcattt

SEQ ID NO: 3542589 - DNA, 18 bp, Homo sapiens
aagtgaacttgattttaa

SEQ ID NO: 3542590 - DNA, 22 bp, Homo sapiens
aagtgcaccaggtcactctgac

SEQ ID NO: 3542591 - DNA, 13 bp, Homo sapiens
aagttattttaaa

SEQ ID NO: 3542592 - DNA, 14 bp, Homo sapiens
aagttgtactgtat

SEQ ID NO: 3542593 - DNA, 15 bp, Homo sapiens
aataatagtgtgtca

SEQ ID NO: 3542594 - DNA, 18 bp, Homo sapiens
aatacacacagttactga

SEQ ID NO: 3542595 - DNA, 20 bp, Homo sapiens
aatacacacagttactgact

SEQ ID NO: 3542596 - DNA, 13 bp, Homo sapiens
aatatattcataa

SEQ ID NO: 3542597 - DNA, 14 bp, Homo sapiens
aatattgacactta

SEQ ID NO: 3542598 - DNA, 11 bp, Homo sapiens
aatcattccat

SEQ ID NO: 3542599 - DNA, 21 bp, Homo sapiens
aatccctatgttgctataaga

SEQ ID NO: 3542600 - DNA, 21 bp, Homo sapiens
aatctaaacctctctagggga

SEQ ID NO: 3542601 - DNA, 16 bp, Homo sapiens
aatgatgtgaaagata

SEQ ID NO: 3542602 - DNA, 18 bp, Homo sapiens
aatgatgtgaaagataaa

SEQ ID NO: 3542603 - DNA, 12 bp, Homo sapiens
aatggaatgtgg

SEQ ID NO: 3542604 - DNA, 17 bp, Homo sapiens
aatgggaatcattccac

SEQ ID NO: 3542605 - DNA, 14 bp, Homo sapiens
aatgtgcatttctt

SEQ ID NO: 3542606 - DNA, 23 bp, Homo sapiens
aatgttcttggttcccattgtga

SEQ ID NO: 3542607 - DNA, 12 bp, Homo sapiens
aattatttcaat

SEQ ID NO: 3542608 - DNA, 12 bp, Homo sapiens
aattcaaaagta

SEQ ID NO: 3542609 - DNA, 13 bp, Homo sapiens
aattcaaaagtaa

SEQ ID NO: 3542610 - DNA, 14 bp, Homo sapiens
aattcaaaagtaag

SEQ ID NO: 3542611 - DNA, 16 bp, Homo sapiens
aattcaaaagtaagaa

SEQ ID NO: 3542612 - DNA, 19 bp, Homo sapiens
aattctaaatattgacact

SEQ ID NO: 3542613 - DNA, 14 bp, Homo sapiens
aattcttatttctg

SEQ ID NO: 3542614 - DNA, 15 bp, Homo sapiens
aattgttaaatttaa

SEQ ID NO: 3542615 - DNA, 22 bp, Homo sapiens
aattgtttttaatttgaatcag

SEQ ID NO: 3542616 - DNA, 16 bp, Homo sapiens
aatttaaaaataggta

SEQ ID NO: 3542617 - DNA, 13 bp, Homo sapiens
aatttaattcaaa

SEQ ID NO: 3542618 - DNA, 15 bp, Homo sapiens
aatttaattcaaagt

SEQ ID NO: 3542619 - DNA, 21 bp, Homo sapiens
aatttgaatcagagaaaactg

SEQ ID NO: 3542620 - DNA, 14 bp, Homo sapiens
aatttgttgtactt

SEQ ID NO: 3542621 - DNA, 17 bp, Homo sapiens
aattttaagttatttta

SEQ ID NO: 3542622 - DNA, 16 bp, Homo sapiens
acaaattgttcatgtt

SEQ ID NO: 3542623 - DNA, 19 bp, Homo sapiens
tatatttatgaatgtgcat

SEQ ID NO: 3542624 - DNA, 20 bp, Homo sapiens
tatcactggcaatatttgtt

SEQ ID NO: 3542625 - DNA, 13 bp, Homo sapiens
tatcatttctaat

SEQ ID NO: 3542626 - DNA, 18 bp, Homo sapiens
tatcatttctaattttaa

SEQ ID NO: 3542627 - DNA, 16 bp, Homo sapiens
tatcttctttccacct

SEQ ID NO: 3542628 - DNA, 15 bp, Homo sapiens
tatgagagctaattt

SEQ ID NO: 3542629 - DNA, 14 bp, Homo sapiens
tatgtctgtatcta

SEQ ID NO: 3542630 - DNA, 14 bp, Homo sapiens
tattaaatcttttt

SEQ ID NO: 3542631 - DNA, 13 bp, Homo sapiens
tattaattccaag

SEQ ID NO: 3542632 - DNA, 13 bp, Homo sapiens
tattaatttgttt

SEQ ID NO: 3542633 - DNA, 15 bp, Homo sapiens
tattagttttctgta

SEQ ID NO: 3542634 - DNA, 19 bp, Homo sapiens
tattagttttctgtatatg

SEQ ID NO: 3542635 - DNA, 13 bp, Homo sapiens
tattcttcttaca

SEQ ID NO: 3542636 - DNA, 16 bp, Homo sapiens
tattgtcttaaataaa

SEQ ID NO: 3542637 - DNA, 17 bp, Homo sapiens
tatttatagaatgctga

SEQ ID NO: 3542638 - DNA, 13 bp, Homo sapiens
tatttatttctgt

SEQ ID NO: 3542639 - DNA, 13 bp, Homo sapiens
tatttgtattccc

SEQ ID NO: 3542640 - DNA, 20 bp, Homo sapiens
tattttaaaaaaattcatca

SEQ ID NO: 3542641 - DNA, 12 bp, Homo sapiens
tcaacagttcat

SEQ ID NO: 3542642 - DNA, 15 bp, Homo sapiens
tcaattatttcaatg

SEQ ID NO: 3542643 - DNA, 13 bp, Homo sapiens
tcaattctgtata

SEQ ID NO: 3542644 - DNA, 21 bp, Homo sapiens
tcacaccactacactccagcc

SEQ ID NO: 3542645 - DNA, 14 bp, Homo sapiens
tcacagcagccact

SEQ ID NO: 3542646 - DNA, 20 bp, Homo sapiens
tcacccccctgtattctcag

SEQ ID NO: 3542647 - DNA, 23 bp, Homo sapiens
tcacctgggtttgcaagaatcta

SEQ ID NO: 3542648 - DNA, 19 bp, Homo sapiens
tcagacatgaaaactattt

SEQ ID NO: 3542649 - DNA, 12 bp, Homo sapiens
tcagagaaaact

SEQ ID NO: 3542650 - DNA, 20 bp, Homo sapiens
tcagcactttccctctgcag

SEQ ID NO: 3542651 - DNA, 13 bp, Homo sapiens
gccctgaaaatgt

SEQ ID NO: 3542652 - DNA, 13 bp, Homo sapiens
gccgtgcctggtg

SEQ ID NO: 3542653 - DNA, 22 bp, Homo sapiens
gcctgggcgagacggcaagact

SEQ ID NO: 3542654 - DNA, 18 bp, Homo sapiens
gcctttttcataaactga

SEQ ID NO: 3542655 - DNA, 17 bp, Homo sapiens
gcgtgattgtggcattt

SEQ ID NO: 3542656 - DNA, 23 bp, Homo sapiens
gctaaatgaagagacttaagaaa

SEQ ID NO: 3542657 - DNA, 20 bp, Homo sapiens
gctaatttaaggatgacttt

SEQ ID NO: 3542658 - DNA, 22 bp, Homo sapiens
gctcattcttgtgacttacagt

SEQ ID NO: 3542659 - DNA, 17 bp, Homo sapiens
gcttggcacatttttga

SEQ ID NO: 3542660 - DNA, 20 bp, Homo sapiens
ggagaattgcttgaacccag

SEQ ID NO: 3542661 - DNA, 22 bp, Homo sapiens
ggcaggttgatcacctgaggtc

SEQ ID NO: 3542662 - DNA, 17 bp, Homo sapiens
ggcatccctcctggtac

SEQ ID NO: 3542663 - DNA, 15 bp, Homo sapiens
ggcatttaaggagca

SEQ ID NO: 3542664 - DNA, 18 bp, Homo sapiens
gggcatccctcctggtac

SEQ ID NO: 3542665 - DNA, 21 bp, Homo sapiens
gggctagccacctcctcgtcc

SEQ ID NO: 3542666 - DNA, 16 bp, Homo sapiens
ggttgtctgtagagaa

SEQ ID NO: 3542667 - DNA, 19 bp, Homo sapiens
gtacaaattgttcatgtta

SEQ ID NO: 3542668 - DNA, 19 bp, Homo sapiens
gtaccttttagtattagtt

SEQ ID NO: 3542669 - DNA, 17 bp, Homo sapiens
gtacgtttttgcattat

SEQ ID NO: 3542670 - DNA, 23 bp, Homo sapiens
gtactttttattcaattctgtat

SEQ ID NO: 3542671 - DNA, 22 bp, Homo sapiens
gtagatcatcttgaatatttgc

SEQ ID NO: 3542672 - DNA, 18 bp, Homo sapiens
gtagcaaccttcatttta

SEQ ID NO: 3542673 - DNA, 22 bp, Homo sapiens
gtatagattataaaattatttt

SEQ ID NO: 3542674 - DNA, 22 bp, Homo sapiens
gtattcatattaccagaaaatg

SEQ ID NO: 3542675 - DNA, 19 bp, Homo sapiens
gtattcccttttatttcca

SEQ ID NO: 3542676 - DNA, 20 bp, Homo sapiens
gtattgtcttaaataaatca

SEQ ID NO: 3542677 - DNA, 20 bp, Homo sapiens
gtcactctgaccttattact

SEQ ID NO: 3542678 - DNA, 15 bp, Homo sapiens
gtccaacatgtttta

SEQ ID NO: 3542679 - DNA, 13 bp, Homo sapiens
gtctaacaacaag

SEQ ID NO: 3542680 - DNA, 15 bp, Homo sapiens
gtctagctggccact

SEQ ID NO: 3542681 - DNA, 15 bp, Homo sapiens
gtctgaggttctttc

SEQ ID NO: 3542682 - DNA, 16 bp, Homo sapiens
gtctgcatcatcatca

SEQ ID NO: 3542683 - DNA, 20 bp, Homo sapiens
cctggaatttaattcaaagt

SEQ ID NO: 3542684 - DNA, 12 bp, Homo sapiens
ccttatcttgaa

SEQ ID NO: 3542685 - DNA, 17 bp, Homo sapiens
cgattatttatttctgt

SEQ ID NO: 3542686 - DNA, 19 bp, Homo sapiens
cgattatttatttctgtaa

SEQ ID NO: 3542687 - DNA, 22 bp, Homo sapiens
cggcacttttcattactttctg

SEQ ID NO: 3542688 - DNA, 13 bp, Homo sapiens
cgtatcatttcta

SEQ ID NO: 3542689 - DNA, 23 bp, Homo sapiens
cgtggagccctactcacacatta

SEQ ID NO: 3542690 - DNA, 12 bp, Homo sapiens
ctaaatgaagag

SEQ ID NO: 3542691 - DNA, 17 bp, Homo sapiens
ctaactccaaagcctgc

SEQ ID NO: 3542692 - DNA, 16 bp, Homo sapiens
ctacatagttattcta

SEQ ID NO: 3542693 - DNA, 12 bp, Homo sapiens
ctacctctgagt

SEQ ID NO: 3542694 - DNA, 19 bp, Homo sapiens
ctagaacatccttaaatgt

SEQ ID NO: 3542695 - DNA, 17 bp, Homo sapiens
ctagccacctcctcgtc

SEQ ID NO: 3542696 - DNA, 17 bp, Homo sapiens
ctaggccatttgtattt

SEQ ID NO: 3542697 - DNA, 19 bp, Homo sapiens
ctaggccatttgtatttgt

SEQ ID NO: 3542698 - DNA, 15 bp, Homo sapiens
ctataagaaaagtga

SEQ ID NO: 3542699 - DNA, 16 bp, Homo sapiens
ctataagaaaagtgaa

SEQ ID NO: 3542700 - DNA, 20 bp, Homo sapiens
ctataagaaaagtgaaagta

SEQ ID NO: 3542701 - DNA, 18 bp, Homo sapiens
ctatcactggcaatattt

SEQ ID NO: 3542702 - DNA, 23 bp, Homo sapiens
ctattaattccaagattaaaagt

SEQ ID NO: 3542703 - DNA, 22 bp, Homo sapiens
ctcaggttgtctgtagagaatg

SEQ ID NO: 3542704 - DNA, 17 bp, Homo sapiens
ctcatgtacattggtct

SEQ ID NO: 3542705 - DNA, 17 bp, Homo sapiens
ctctattatattcggtt

SEQ ID NO: 3542706 - DNA, 14 bp, Homo sapiens
ctgaaaaactgttg

SEQ ID NO: 3542707 - DNA, 13 bp, Homo sapiens
ctgaaattctaaa

SEQ ID NO: 3542708 - DNA, 15 bp, Homo sapiens
ctgaaattctaaata

SEQ ID NO: 3542709 - DNA, 18 bp, Homo sapiens
ctgaaattctaaatattg

SEQ ID NO: 3542710 - DNA, 18 bp, Homo sapiens
ctgacttagcctaaacaa

SEQ ID NO: 3542711 - DNA, 16 bp, Homo sapiens
ctgagccttttcttat

SEQ ID NO: 3542712 - DNA, 22 bp, Homo sapiens
ctgaggttctttcccacactga

SEQ ID NO: 3542713 - DNA, 16 bp, Homo sapiens
ctgattattcttctta

SEQ ID NO: 3542714 - DNA, 23 bp, Homo sapiens
ctgattcaaaagtgaacttgatt

SEQ ID NO: 3542715 - DNA, 22 bp, Homo sapiens
ctgcacctgctgtcagcctggc

SEQ ID NO: 3542716 - DNA, 14 bp, Homo sapiens
ctgctaaatgaaga

SEQ ID NO: 3542717 - DNA, 20 bp, Homo sapiens
ctggccccagtcgaactggg

SEQ ID NO: 3542718 - DNA, 22 bp, Homo sapiens
ctggtggggcggacggaaaagg

SEQ ID NO: 3542719 - DNA, 13 bp, Homo sapiens
tgttgcaagtcat

SEQ ID NO: 3542720 - DNA, 17 bp, Homo sapiens
tgttgtatacttcatta

SEQ ID NO: 3542721 - DNA, 23 bp, Homo sapiens
tgtttagaagtacgtttttgcat

SEQ ID NO: 3542722 - DNA, 21 bp, Homo sapiens
ttaaagcgtagacatatattt

SEQ ID NO: 3542723 - DNA, 22 bp, Homo sapiens
ttaaatcttcaatatgaaggac

SEQ ID NO: 3542724 - DNA, 22 bp, Homo sapiens
ttaagcaggaatcctagaagca

SEQ ID NO: 3542725 - DNA, 13 bp, Homo sapiens
ttaatttgaatca

SEQ ID NO: 3542726 - DNA, 19 bp, Homo sapiens
ttaatttgtttttcttatc

SEQ ID NO: 3542727 - DNA, 21 bp, Homo sapiens
ttacattattaatcattccat

SEQ ID NO: 3542728 - DNA, 14 bp, Homo sapiens
ttaccttaaatctg

SEQ ID NO: 3542729 - DNA, 15 bp, Homo sapiens
ttactagaaatatat

SEQ ID NO: 3542730 - DNA, 19 bp, Homo sapiens
ttactagaaatatattcat

SEQ ID NO: 3542731 - DNA, 21 bp, Homo sapiens
ttagaagtacgtttttgcatt

SEQ ID NO: 3542732 - DNA, 15 bp, Homo sapiens
ttagttagaaaataa

SEQ ID NO: 3542733 - DNA, 15 bp, Homo sapiens
ttataaaattatttt

SEQ ID NO: 3542734 - DNA, 19 bp, Homo sapiens
ttataaaattatttttatt

SEQ ID NO: 3542735 - DNA, 22 bp, Homo sapiens
ttataaaattatttttattaaa

SEQ ID NO: 3542736 - DNA, 11 bp, Homo sapiens
ttataaatgac

SEQ ID NO: 3542737 - DNA, 14 bp, Homo sapiens
ttatattaatttgt

SEQ ID NO: 3542738 - DNA, 16 bp, Homo sapiens
ttatctcatttctcaa

SEQ ID NO: 3542739 - DNA, 14 bp, Homo sapiens
ttatcttatactga

SEQ ID NO: 3542740 - DNA, 23 bp, Homo sapiens
ttatgaaaccaactgttgacata

SEQ ID NO: 3542741 - DNA, 14 bp, Homo sapiens
aagtttatttcatg

SEQ ID NO: 3542742 - DNA, 13 bp, Homo sapiens
aataaatatttta

SEQ ID NO: 3542743 - DNA, 17 bp, Homo sapiens
aataaatcaagaatcat

SEQ ID NO: 3542744 - DNA, 16 bp, Homo sapiens
aataatttgttgtact

SEQ ID NO: 3542745 - DNA, 17 bp, Homo sapiens
aataatttgttgtactt

SEQ ID NO: 3542746 - DNA, 18 bp, Homo sapiens
aataatttgttgtacttt

SEQ ID NO: 3542747 - DNA, 20 bp, Homo sapiens
aatacaggtaacattataaa

SEQ ID NO: 3542748 - DNA, 16 bp, Homo sapiens
aatatataaaagaaat

SEQ ID NO: 3542749 - DNA, 22 bp, Homo sapiens
aatatataaaagaaatatatct

SEQ ID NO: 3542750 - DNA, 21 bp, Homo sapiens
aatatgaaggactattaattc

SEQ ID NO: 3542751 - DNA, 14 bp, Homo sapiens
aatcaagaatcatt

SEQ ID NO: 3542752 - DNA, 16 bp, Homo sapiens
aatcaagaatcattga

SEQ ID NO: 3542753 - DNA, 23 bp, Homo sapiens
aatccctatgttgctataagaaa

SEQ ID NO: 3542754 - DNA, 22 bp, Homo sapiens
aatctaaacctctctaggggaa

SEQ ID NO: 3542755 - DNA, 11 bp, Homo sapiens
aatctgccttt

SEQ ID NO: 3542756 - DNA, 21 bp, Homo sapiens
aatctgcctttgtttctaaag

SEQ ID NO: 3542757 - DNA, 20 bp, Homo sapiens
aatctttttttaataatttc

SEQ ID NO: 3542758 - DNA, 22 bp, Homo sapiens
aatctttttttaataatttcat

SEQ ID NO: 3542759 - DNA, 23 bp, Homo sapiens
aatctttttttaataatttcatc

SEQ ID NO: 3542760 - DNA, 16 bp, Homo sapiens
aatgcatgttctgtgt

SEQ ID NO: 3542761 - DNA, 19 bp, Homo sapiens
aatgtgcaagttgtactgt

SEQ ID NO: 3542762 - DNA, 17 bp, Homo sapiens
aattcgtttctgacata

SEQ ID NO: 3542763 - DNA, 15 bp, Homo sapiens
aattgccctgttgcc

SEQ ID NO: 3542764 - DNA, 20 bp, Homo sapiens
aattgctagtgatttcatta

SEQ ID NO: 3542765 - DNA, 12 bp, Homo sapiens
aatttgaatcag

SEQ ID NO: 3542766 - DNA, 21 bp, Homo sapiens
aatttgtttagaagtacgttt

SEQ ID NO: 3542767 - DNA, 17 bp, Homo sapiens
aatttgtttttcttatc

SEQ ID NO: 3542768 - DNA, 18 bp, Homo sapiens
aattttatagtagtggga

SEQ ID NO: 3542769 - DNA, 21 bp, Homo sapiens
acacaaatccctatgttgcta

SEQ ID NO: 3542770 - DNA, 13 bp, Homo sapiens
acagtctgcatca

SEQ ID NO: 3542771 - DNA, 20 bp, Homo sapiens
acataccttagactgaaaaa

SEQ ID NO: 3542772 - DNA, 14 bp, Homo sapiens
acatgaaaactatt

SEQ ID NO: 3542773 - DNA, 18 bp, Homo sapiens
acatgaacttcatatact

SEQ ID NO: 3542774 - DNA, 22 bp, Homo sapiens
acatgaacttcatatactaagg

SEQ ID NO: 3542775 - DNA, 16 bp, Homo sapiens
acatgatactattcag

SEQ ID NO: 3542776 - DNA, 20 bp, Homo sapiens
acattaacccccaaattcaa

SEQ ID NO: 3542777 - DNA, 15 bp, Homo sapiens
acattataaatgaca

SEQ ID NO: 3542778 - DNA, 13 bp, Homo sapiens
acattattaatca

SEQ ID NO: 3542779 - DNA, 17 bp, Homo sapiens
acattattaatcattcc

SEQ ID NO: 3542780 - DNA, 13 bp, Homo sapiens
accaaagaatgca

SEQ ID NO: 3542781 - DNA, 14 bp, Homo sapiens
accaaagaatgcat

SEQ ID NO: 3542782 - DNA, 19 bp, Homo sapiens
accaaagaatgcatgttct

SEQ ID NO: 3542783 - DNA, 15 bp, Homo sapiens
accagaaaatgagtt

SEQ ID NO: 3542784 - DNA, 18 bp, Homo sapiens
accaggtcactctgacct

SEQ ID NO: 3542785 - DNA, 19 bp, Homo sapiens
accatcttctatcttcttt

SEQ ID NO: 3542786 - DNA, 23 bp, Homo sapiens
acccaggaggcagaggttgcagt

SEQ ID NO: 3542787 - DNA, 20 bp, Homo sapiens
acctaaatggagaaagctgt

SEQ ID NO: 3542788 - DNA, 20 bp, Homo sapiens
acctgagccttttcttatat

SEQ ID NO: 3542789 - DNA, 18 bp, Homo sapiens
acctgctgtcagcctggc

SEQ ID NO: 3542790 - DNA, 18 bp, Homo sapiens
acctgggcggccagaggc

SEQ ID NO: 3542791 - DNA, 16 bp, Homo sapiens
acctgggtttgcaaga

SEQ ID NO: 3542792 - DNA, 23 bp, Homo sapiens
acctggtgcatcgaaatgtattc

SEQ ID NO: 3542793 - DNA, 23 bp, Homo sapiens
accttaaatctgcctttgtttct

SEQ ID NO: 3542794 - DNA, 18 bp, Homo sapiens
actagaaatatattcata

SEQ ID NO: 3542795 - DNA, 19 bp, Homo sapiens
actagctaaggaagggaaa

SEQ ID NO: 3542796 - DNA, 22 bp, Homo sapiens
actagttatatattccttacta

SEQ ID NO: 3542797 - DNA, 16 bp, Homo sapiens
actatacaattcagta

SEQ ID NO: 3542798 - DNA, 24 bp, Homo sapiens
actcaggttgtctgtagagaatga

SEQ ID NO: 3542799 - DNA, 15 bp, Homo sapiens
actgaaattctaaat

SEQ ID NO: 3542800 - DNA, 19 bp, Homo sapiens
actgaaattctaaatattg

SEQ ID NO: 3542801 - DNA, 14 bp, Homo sapiens
actgattattcttc

SEQ ID NO: 3542802 - DNA, 14 bp, Homo sapiens
actgggtttaaaga

SEQ ID NO: 3542803 - DNA, 16 bp, Homo sapiens
actgggtttaaagatg

SEQ ID NO: 3542804 - DNA, 15 bp, Homo sapiens
actgttttcttcttg

SEQ ID NO: 3542805 - DNA, 13 bp, Homo sapiens
acttaagcataaa

SEQ ID NO: 3542806 - DNA, 12 bp, Homo sapiens
actttctgcttg

SEQ ID NO: 3542807 - DNA, 18 bp, Homo sapiens
actttgttgccttatctt

SEQ ID NO: 3542808 - DNA, 19 bp, Homo sapiens
actttgttgccttatcttg

SEQ ID NO: 3542809 - DNA, 21 bp, Homo sapiens
actttgttgccttatcttgaa

SEQ ID NO: 3542810 - DNA, 15 bp, Homo sapiens
agaaaagtgaaagta

SEQ ID NO: 3542811 - DNA, 15 bp, Homo sapiens
agaaatgatgtgaaa

SEQ ID NO: 3542812 - DNA, 16 bp, Homo sapiens
agaaatgatgtgaaag

SEQ ID NO: 3542813 - DNA, 13 bp, Homo sapiens
agaagctcattta

SEQ ID NO: 3542814 - DNA, 19 bp, Homo sapiens
agaagtaaagtttatttca

SEQ ID NO: 3542815 - DNA, 20 bp, Homo sapiens
agaagtaaagtttatttcat

SEQ ID NO: 3542816 - DNA, 17 bp, Homo sapiens
agaataggtcattttct

SEQ ID NO: 3542817 - DNA, 21 bp, Homo sapiens
agaataggtcattttctattc

SEQ ID NO: 3542818 - DNA, 12 bp, Homo sapiens
agaatatgttca

SEQ ID NO: 3542819 - DNA, 15 bp, Homo sapiens
agaatatgttcacat

SEQ ID NO: 3542820 - DNA, 20 bp, Homo sapiens
agaatctaaacctctctagg

SEQ ID NO: 3542821 - DNA, 19 bp, Homo sapiens
agaatctagataggtgctt

SEQ ID NO: 3542822 - DNA, 21 bp, Homo sapiens
agaatctagataggtgctttt

SEQ ID NO: 3542823 - DNA, 16 bp, Homo sapiens
agaatgcaaaagtcta

SEQ ID NO: 3542824 - DNA, 14 bp, Homo sapiens
agacaagaatatgt

SEQ ID NO: 3542825 - DNA, 15 bp, Homo sapiens
agacatatatttatg

SEQ ID NO: 3542826 - DNA, 14 bp, Homo sapiens
agaccatcttctat

SEQ ID NO: 3542827 - DNA, 21 bp, Homo sapiens
agacttaagaaagcttaaggt

SEQ ID NO: 3542828 - DNA, 16 bp, Homo sapiens
agagaggcaaggggtg

SEQ ID NO: 3542829 - DNA, 18 bp, Homo sapiens
agatcatcttgaatattt

SEQ ID NO: 3542830 - DNA, 22 bp, Homo sapiens
agatgtcaataggaattgcatt

SEQ ID NO: 3542831 - DNA, 20 bp, Homo sapiens
agatgtgattcctgcatttt

SEQ ID NO: 3542832 - DNA, 18 bp, Homo sapiens
agattgcaaagtcgacat

SEQ ID NO: 3542833 - DNA, 17 bp, Homo sapiens
agcaaccttcattttac

SEQ ID NO: 3542834 - DNA, 20 bp, Homo sapiens
agcagtggcccatgtgactg

SEQ ID NO: 3542835 - DNA, 18 bp, Homo sapiens
agcatctgcctctattca

SEQ ID NO: 3542836 - DNA, 20 bp, Homo sapiens
agcatggtgaaacctcatct

SEQ ID NO: 3542837 - DNA, 21 bp, Homo sapiens
agccaaaggccgtgcctggtg

SEQ ID NO: 3542838 - DNA, 23 bp, Homo sapiens
agcccactgggtttaaagatgtt

SEQ ID NO: 3542839 - DNA, 20 bp, Homo sapiens
agcctcttttcaattatttc

SEQ ID NO: 3542840 - DNA, 22 bp, Homo sapiens
agctaaggaagggaaagggaag

SEQ ID NO: 3542841 - DNA, 14 bp, Homo sapiens
agctgactttgttg

SEQ ID NO: 3542842 - DNA, 20 bp, Homo sapiens
agctggccactgctggaggc

SEQ ID NO: 3542843 - DNA, 18 bp, Homo sapiens
aggtaacattataaatga

SEQ ID NO: 3542844 - DNA, 20 bp, Homo sapiens
aggtcacatatgtctgtatc

SEQ ID NO: 3542845 - DNA, 15 bp, Homo sapiens
aggtggaaagagaaa

SEQ ID NO: 3542846 - DNA, 12 bp, Homo sapiens
aggttctttccc

SEQ ID NO: 3542847 - DNA, 16 bp, Homo sapiens
agtaaagtttatttca

SEQ ID NO: 3542848 - DNA, 18 bp, Homo sapiens
agtaaagtttatttcatg

SEQ ID NO: 3542849 - DNA, 21 bp, Homo sapiens
agtacgtttttgcattattca

SEQ ID NO: 3542850 - DNA, 20 bp, Homo sapiens
gttctttcccacactgaaat

SEQ ID NO: 3542851 - DNA, 12 bp, Homo sapiens
gttgaaggcttt

SEQ ID NO: 3542852 - DNA, 12 bp, Homo sapiens
gttgtactgtat

SEQ ID NO: 3542853 - DNA, 19 bp, Homo sapiens
gttgtactttttattcaat

SEQ ID NO: 3542854 - DNA, 11 bp, Homo sapiens
gtttaaagatg

SEQ ID NO: 3542855 - DNA, 23 bp, Homo sapiens
gtttatgtaactatcaaatggtt

SEQ ID NO: 3542856 - DNA, 21 bp, Homo sapiens
gttttgaagcctgctaaatga

SEQ ID NO: 3542857 - DNA, 15 bp, Homo sapiens
taaaaattgaattcg

SEQ ID NO: 3542858 - DNA, 15 bp, Homo sapiens
taaaagaaatatatc

SEQ ID NO: 3542859 - DNA, 17 bp, Homo sapiens
taaagagaccatcttct

SEQ ID NO: 3542860 - DNA, 16 bp, Homo sapiens
taaagatgtaactagg

SEQ ID NO: 3542861 - DNA, 17 bp, Homo sapiens
taaaggtagatcatctt

SEQ ID NO: 3542862 - DNA, 15 bp, Homo sapiens
taaagtttatttcat

SEQ ID NO: 3542863 - DNA, 20 bp, Homo sapiens
taaatgaagagacttaagaa

SEQ ID NO: 3542864 - DNA, 15 bp, Homo sapiens
taaatggatacttat

SEQ ID NO: 3542865 - DNA, 19 bp, Homo sapiens
taacatgatactattcaga

SEQ ID NO: 3542866 - DNA, 22 bp, Homo sapiens
taactggggtattaactttttt

SEQ ID NO: 3542867 - DNA, 19 bp, Homo sapiens
taagaataggtcattttct

SEQ ID NO: 3542868 - DNA, 19 bp, Homo sapiens
taagacaagaatatgttca

SEQ ID NO: 3542869 - DNA, 15 bp, Homo sapiens
taaggatgacttttt

SEQ ID NO: 3542870 - DNA, 15 bp, Homo sapiens
taataatttcatccc

SEQ ID NO: 3542871 - DNA, 18 bp, Homo sapiens
taatacacacagttactg

SEQ ID NO: 3542872 - DNA, 12 bp, Homo sapiens
taatcattccat

SEQ ID NO: 3542873 - DNA, 14 bp, Homo sapiens
taattcttatttct

SEQ ID NO: 3542874 - DNA, 15 bp, Homo sapiens
taattcttatttctg

SEQ ID NO: 3542875 - DNA, 20 bp, Homo sapiens
taattgttaaatttaaaaat

SEQ ID NO: 3542876 - DNA, 12 bp, Homo sapiens
taattttaagtt

SEQ ID NO: 3542877 - DNA, 13 bp, Homo sapiens
tacaaattgttca

SEQ ID NO: 3542878 - DNA, 22 bp, Homo sapiens
tacaacctgagccttttcttat

SEQ ID NO: 3542879 - DNA, 23 bp, Homo sapiens
tacaacctgagccttttcttata

SEQ ID NO: 3542880 - DNA, 22 bp, Homo sapiens
tacaggtaacattataaatgac

SEQ ID NO: 3542881 - DNA, 20 bp, Homo sapiens
tacatgaacttcatatacta

SEQ ID NO: 3542882 - DNA, 22 bp, Homo sapiens
tacattattaatcattccattt

SEQ ID NO: 3542883 - DNA, 19 bp, Homo sapiens
tacattggtctttctacat

SEQ ID NO: 3542884 - DNA, 17 bp, Homo sapiens
taccaagttacttgaaa

SEQ ID NO: 3542885 - DNA, 15 bp, Homo sapiens
taccttagactgaaa

SEQ ID NO: 3542886 - DNA, 22 bp, Homo sapiens
taccttagactgaaaaactgtt

SEQ ID NO: 3542887 - DNA, 13 bp, Homo sapiens
tacgcttgcttgt

SEQ ID NO: 3542888 - DNA, 15 bp, Homo sapiens
tactagaaatatatt

SEQ ID NO: 3542889 - DNA, 13 bp, Homo sapiens
tactgattattct

SEQ ID NO: 3542890 - DNA, 15 bp, Homo sapiens
tactttttattcaat

SEQ ID NO: 3542891 - DNA, 22 bp, Homo sapiens
tagataggtgcttttaactggg

SEQ ID NO: 3542892 - DNA, 21 bp, Homo sapiens
tagcaataggtggaaagagaa

SEQ ID NO: 3542893 - DNA, 19 bp, Homo sapiens
tagctaaggaagggaaagg

SEQ ID NO: 3542894 - DNA, 13 bp, Homo sapiens
taggagcccagcc

SEQ ID NO: 3542895 - DNA, 22 bp, Homo sapiens
taggtcacatatgtctgtatct

SEQ ID NO: 3542896 - DNA, 12 bp, Homo sapiens
taggtcattttc

SEQ ID NO: 3542897 - DNA, 15 bp, Homo sapiens
tagtgatttcattac

SEQ ID NO: 3542898 - DNA, 16 bp, Homo sapiens
tagttatatattcctt

SEQ ID NO: 3542899 - DNA, 15 bp, Homo sapiens
tataaaagaaatata

SEQ ID NO: 3542900 - DNA, 20 bp, Homo sapiens
tataaatgacagatctcaat

SEQ ID NO: 3542901 - DNA, 14 bp, Homo sapiens
tatataaaagaaat

SEQ ID NO: 3542902 - DNA, 15 bp, Homo sapiens
tatataaaagaaata

SEQ ID NO: 3542903 - DNA, 16 bp, Homo sapiens
tatatattatcttata

SEQ ID NO: 3542904 - DNA, 16 bp, Homo sapiens
tatatctgtgatttta

SEQ ID NO: 3542905 - DNA, 19 bp, Homo sapiens
tatatctgtgattttaaaa

SEQ ID NO: 3542906 - DNA, 20 bp, Homo sapiens
tatatgatatatattatctt

SEQ ID NO: 3542907 - DNA, 18 bp, Homo sapiens
tatatgtcagacatgaaa

SEQ ID NO: 3542908 - DNA, 13 bp, Homo sapiens
tatattcataata

SEQ ID NO: 3542909 - DNA, 23 bp, Homo sapiens
tatattcataatatataaaagaa

SEQ ID NO: 3542910 - DNA, 19 bp, Homo sapiens
tatcactggcaatatttgt

SEQ ID NO: 3542911 - DNA, 21 bp, Homo sapiens
tatcactggcaatatttgttc

SEQ ID NO: 3542912 - DNA, 20 bp, Homo sapiens
tatgaaaccaactgttgaca

SEQ ID NO: 3542913 - DNA, 22 bp, Homo sapiens
tatgacagtgtgagactcaggt

SEQ ID NO: 3542914 - DNA, 16 bp, Homo sapiens
tatgatatatattatc

SEQ ID NO: 3542915 - DNA, 22 bp, Homo sapiens
tatgcttcccagagaagctcat

SEQ ID NO: 3542916 - DNA, 18 bp, Homo sapiens
tatgtcagacatgaaaac

SEQ ID NO: 3542917 - DNA, 13 bp, Homo sapiens
tattaaatctttt

SEQ ID NO: 3542918 - DNA, 14 bp, Homo sapiens
tattaagggaaagg

SEQ ID NO: 3542919 - DNA, 15 bp, Homo sapiens
tattaatcattccat

SEQ ID NO: 3542920 - DNA, 17 bp, Homo sapiens
tattaccagaaaatgag

SEQ ID NO: 3542921 - DNA, 18 bp, Homo sapiens
tattagttttctgtatat

SEQ ID NO: 3542922 - DNA, 15 bp, Homo sapiens
tattccttactagaa

SEQ ID NO: 3542923 - DNA, 22 bp, Homo sapiens
tattccttactagaaatatatt

SEQ ID NO: 3542924 - DNA, 19 bp, Homo sapiens
tatttctgtaaaatttgtt

SEQ ID NO: 3542925 - DNA, 20 bp, Homo sapiens
tatttgttctggtttagtgt

SEQ ID NO: 3542926 - DNA, 11 bp, Homo sapiens
tcaagaatcat

SEQ ID NO: 3542927 - DNA, 17 bp, Homo sapiens
tcacatatgtctgtatc

SEQ ID NO: 3542928 - DNA, 15 bp, Homo sapiens
tcacctgaggtcagg

SEQ ID NO: 3542929 - DNA, 21 bp, Homo sapiens
tcacctttcttttgtaaagag

SEQ ID NO: 3542930 - DNA, 15 bp, Homo sapiens
tcactggcaatattt

SEQ ID NO: 3542931 - DNA, 22 bp, Homo sapiens
tcagacatgaaaactattttaa

SEQ ID NO: 3542932 - DNA, 24 bp, Homo sapiens
tcagattggggtgttagaagtgca

SEQ ID NO: 3542933 - DNA, 22 bp, Homo sapiens
tcagtactgattattcttctta

SEQ ID NO: 3542934 - DNA, 22 bp, Homo sapiens
tcataatatataaaagaaatat

SEQ ID NO: 3542935 - DNA, 22 bp, Homo sapiens
tcatatgcttcccagagaagct

SEQ ID NO: 3542936 - DNA, 16 bp, Homo sapiens
tcatattaccagaaaa

SEQ ID NO: 3542937 - DNA, 20 bp, Homo sapiens
tcatattaccagaaaatgag

SEQ ID NO: 3542938 - DNA, 22 bp, Homo sapiens
tcatccagaagtgtattcatat

SEQ ID NO: 3542939 - DNA, 13 bp, Homo sapiens
tcatccctattta

SEQ ID NO: 3542940 - DNA, 22 bp, Homo sapiens
tcatgttaccaaagcaatattt

SEQ ID NO: 3542941 - DNA, 18 bp, Homo sapiens
tcattaccaagttacttg

SEQ ID NO: 3542942 - DNA, 21 bp, Homo sapiens
tcattaccaagttacttgaaa

SEQ ID NO: 3542943 - DNA, 17 bp, Homo sapiens
tcattttctattcacca

SEQ ID NO: 3542944 - DNA, 20 bp, Homo sapiens
tccaaagcctgcgttctcat

SEQ ID NO: 3542945 - DNA, 13 bp, Homo sapiens
tccaacatgtttt

SEQ ID NO: 3542946 - DNA, 16 bp, Homo sapiens
tccaacatgttttatg

SEQ ID NO: 3542947 - DNA, 16 bp, Homo sapiens
tccagaagtgtattca

SEQ ID NO: 3542948 - DNA, 22 bp, Homo sapiens
tccagaagtgtattcatattac

SEQ ID NO: 3542949 - DNA, 16 bp, Homo sapiens
tccatcttcagtttct

SEQ ID NO: 3542950 - DNA, 18 bp, Homo sapiens
tccatttatcctagaaaa

SEQ ID NO: 3542951 - DNA, 19 bp, Homo sapiens
tccatttatcctagaaaat

SEQ ID NO: 3542952 - DNA, 14 bp, Homo sapiens
tcccacactgaaat

SEQ ID NO: 3542953 - DNA, 16 bp, Homo sapiens
tcccacactgaaattc

SEQ ID NO: 3542954 - DNA, 16 bp, Homo sapiens
tcccagtctgatattc

SEQ ID NO: 3542955 - DNA, 21 bp, Homo sapiens
tcctcttggagtctagaacat

SEQ ID NO: 3542956 - DNA, 21 bp, Homo sapiens
tccttaaatgtctaacaacaa

SEQ ID NO: 3542957 - DNA, 16 bp, Homo sapiens
tccttactagaaatat

SEQ ID NO: 3542958 - DNA, 19 bp, Homo sapiens
tcgcactgggggacatggg

SEQ ID NO: 3542959 - DNA, 18 bp, Homo sapiens
atttaattcttatttctg

SEQ ID NO: 3542960 - DNA, 20 bp, Homo sapiens
atttatcctagaaaattgtt

SEQ ID NO: 3542961 - DNA, 16 bp, Homo sapiens
atttatgaatgtgcat

SEQ ID NO: 3542962 - DNA, 23 bp, Homo sapiens
atttatgaatgtgcatttcttga

SEQ ID NO: 3542963 - DNA, 18 bp, Homo sapiens
atttcatccctatttata

SEQ ID NO: 3542964 - DNA, 20 bp, Homo sapiens
atttccaaaataaaatgaaa

SEQ ID NO: 3542965 - DNA, 23 bp, Homo sapiens
atttccaaaataaaatgaaaaat

SEQ ID NO: 3542966 - DNA, 23 bp, Homo sapiens
atttgtattcccttttatttcca

SEQ ID NO: 3542967 - DNA, 16 bp, Homo sapiens
atttgtttttcttatc

SEQ ID NO: 3542968 - DNA, 22 bp, Homo sapiens
attttaaaaaaattcatcatat

SEQ ID NO: 3542969 - DNA, 16 bp, Homo sapiens
attttaaaattttgct

SEQ ID NO: 3542970 - DNA, 12 bp, Homo sapiens
attttattaaat

SEQ ID NO: 3542971 - DNA, 21 bp, Homo sapiens
attttgctaccaaagaatgca

SEQ ID NO: 3542972 - DNA, 13 bp, Homo sapiens
atttttattaaat

SEQ ID NO: 3542973 - DNA, 14 bp, Homo sapiens
caaaagtgaacttg

SEQ ID NO: 3542974 - DNA, 16 bp, Homo sapiens
caaaataaaatgaaaa

SEQ ID NO: 3542975 - DNA, 11 bp, Homo sapiens
caaagaatgca

SEQ ID NO: 3542976 - DNA, 17 bp, Homo sapiens
caaagaatgcatgttct

SEQ ID NO: 3542977 - DNA, 18 bp, Homo sapiens
caaagaatgcatgttctg

SEQ ID NO: 3542978 - DNA, 18 bp, Homo sapiens
caaaggccgtgcctggtg

SEQ ID NO: 3542979 - DNA, 19 bp, Homo sapiens
caaagtcgacatactcatt

SEQ ID NO: 3542980 - DNA, 12 bp, Homo sapiens
caaattgttcat

SEQ ID NO: 3542981 - DNA, 22 bp, Homo sapiens
caaattgttcatgttaccaaag

SEQ ID NO: 3542982 - DNA, 22 bp, Homo sapiens
caacatgttttatgtacacaaa

SEQ ID NO: 3542983 - DNA, 12 bp, Homo sapiens
caacctgagcct

SEQ ID NO: 3542984 - DNA, 21 bp, Homo sapiens
caacctgagccttttcttata

SEQ ID NO: 3542985 - DNA, 17 bp, Homo sapiens
caaccttcattttacat

SEQ ID NO: 3542986 - DNA, 12 bp, Homo sapiens
caagaatcattg

SEQ ID NO: 3542987 - DNA, 20 bp, Homo sapiens
caagttgtactgtatgcagt

SEQ ID NO: 3542988 - DNA, 22 bp, Homo sapiens
caataggtggaaagagaaatga

SEQ ID NO: 3542989 - DNA, 12 bp, Homo sapiens
caattatttcaa

SEQ ID NO: 3542990 - DNA, 11 bp, Homo sapiens
caattctgtat

SEQ ID NO: 3542991 - DNA, 16 bp, Homo sapiens
cacaacctaaatggag

SEQ ID NO: 3542992 - DNA, 12 bp, Homo sapiens
cacactgaaatt

SEQ ID NO: 3542993 - DNA, 16 bp, Homo sapiens
cacatatgtctgtatc

SEQ ID NO: 3542994 - DNA, 15 bp, Homo sapiens
caccaggtcactctg

SEQ ID NO: 3542995 - DNA, 15 bp, Homo sapiens
cactgaaattctaaa

SEQ ID NO: 3542996 - DNA, 13 bp, Homo sapiens
cactgctggaggc

SEQ ID NO: 3542997 - DNA, 22 bp, Homo sapiens
cagaagtaaagtttatttcatg

SEQ ID NO: 3542998 - DNA, 15 bp, Homo sapiens
cagagaaaactgttg

SEQ ID NO: 3542999 - DNA, 16 bp, Homo sapiens
cagagaagctcattta

SEQ ID NO: 3543000 - DNA, 19 bp, Homo sapiens
cagcatctgcctctattca

SEQ ID NO: 3543001 - DNA, 19 bp, Homo sapiens
caggtaacattataaatga

SEQ ID NO: 3543002 - DNA, 15 bp, Homo sapiens
cagtctgatattcac

SEQ ID NO: 3543003 - DNA, 23 bp, Homo sapiens
cagtggcccgcgtgattgtggca

SEQ ID NO: 3543004 - DNA, 15 bp, Homo sapiens
cagtgttaataaatg

SEQ ID NO: 3543005 - DNA, 20 bp, Homo sapiens
cataatatataaaagaaata

SEQ ID NO: 3543006 - DNA, 16 bp, Homo sapiens
catacaacctgagcct

SEQ ID NO: 3543007 - DNA, 13 bp, Homo sapiens
catattaccagaa

SEQ ID NO: 3543008 - DNA, 21 bp, Homo sapiens
catattaccagaaaatgagtt

SEQ ID NO: 3543009 - DNA, 20 bp, Homo sapiens
catccagaagtgtattcata

SEQ ID NO: 3543010 - DNA, 18 bp, Homo sapiens
catcccagtctgatattc

SEQ ID NO: 3543011 - DNA, 14 bp, Homo sapiens
catccctcctggta

SEQ ID NO: 3543012 - DNA, 16 bp, Homo sapiens
catccctcctggtacc

SEQ ID NO: 3543013 - DNA, 15 bp, Homo sapiens
catccttaaatgtct

SEQ ID NO: 3543014 - DNA, 15 bp, Homo sapiens
catcttcagtttctg

SEQ ID NO: 3543015 - DNA, 19 bp, Homo sapiens
catcttgaatatttgctta

SEQ ID NO: 3543016 - DNA, 15 bp, Homo sapiens
catgaaaactatttt

SEQ ID NO: 3543017 - DNA, 13 bp, Homo sapiens
catgatactattc

SEQ ID NO: 3543018 - DNA, 20 bp, Homo sapiens
catgttaccaaagcaatatt

SEQ ID NO: 3543019 - DNA, 23 bp, Homo sapiens
catgttaccaaagcaatatttcc

SEQ ID NO: 3543020 - DNA, 14 bp, Homo sapiens
cattattaatcatt

SEQ ID NO: 3543021 - DNA, 15 bp, Homo sapiens
cattattaatcattc

SEQ ID NO: 3543022 - DNA, 20 bp, Homo sapiens
cattattaatcattccattt

SEQ ID NO: 3543023 - DNA, 14 bp, Homo sapiens
cattattcatatgc

SEQ ID NO: 3543024 - DNA, 18 bp, Homo sapiens
cattattcatatgcttcc

SEQ ID NO: 3543025 - DNA, 22 bp, Homo sapiens
cattccatttatcctagaaaat

SEQ ID NO: 3543026 - DNA, 23 bp, Homo sapiens
cattccatttatcctagaaaatt

SEQ ID NO: 3543027 - DNA, 21 bp, Homo sapiens
cattctgtctgtttttctttt

SEQ ID NO: 3543028 - DNA, 17 bp, Homo sapiens
catttatcctagaaaat

SEQ ID NO: 3543029 - DNA, 17 bp, Homo sapiens
catttctaattttaagt

SEQ ID NO: 3543030 - DNA, 15 bp, Homo sapiens
catttgtatttgtat

SEQ ID NO: 3543031 - DNA, 15 bp, Homo sapiens
ccaaagcaatatttc

SEQ ID NO: 3543032 - DNA, 17 bp, Homo sapiens
ccaagttacttgaaaaa

SEQ ID NO: 3543033 - DNA, 18 bp, Homo sapiens
ccacctttctctgtttta

SEQ ID NO: 3543034 - DNA, 19 bp, Homo sapiens
ccacttgactaataccttg

SEQ ID NO: 3543035 - DNA, 22 bp, Homo sapiens
ccagaagtaaagtttatttcat

SEQ ID NO: 3543036 - DNA, 16 bp, Homo sapiens
ccagagaagctcattt

SEQ ID NO: 3543037 - DNA, 19 bp, Homo sapiens
ccagtgttaataaatggat

SEQ ID NO: 3543038 - DNA, 11 bp, Homo sapiens
cccagaactag

SEQ ID NO: 3543039 - DNA, 16 bp, Homo sapiens
cccccgccttccggtg

SEQ ID NO: 3543040 - DNA, 12 bp, Homo sapiens
ccctgaaaatgt

SEQ ID NO: 3543041 - DNA, 13 bp, Homo sapiens
ccgccttccggtg

SEQ ID NO: 3543042 - DNA, 20 bp, Homo sapiens
ccggacccttttccttagct

SEQ ID NO: 3543043 - DNA, 13 bp, Homo sapiens
ccgtgcctggtgg

SEQ ID NO: 3543044 - DNA, 14 bp, Homo sapiens
ccgtgcctggtggg

SEQ ID NO: 3543045 - DNA, 22 bp, Homo sapiens
cctgggtttgcaagaatctaaa

SEQ ID NO: 3543046 - DNA, 13 bp, Homo sapiens
ccttactagaaat

SEQ ID NO: 3543047 - DNA, 15 bp, Homo sapiens
ccttactagaaatat

SEQ ID NO: 3543048 - DNA, 16 bp, Homo sapiens
ccttatcttgaaaaga

SEQ ID NO: 3543049 - DNA, 15 bp, Homo sapiens
cgattatttatttct

SEQ ID NO: 3543050 - DNA, 23 bp, Homo sapiens
cggagccaaaggccgtgcctggt

SEQ ID NO: 3543051 - DNA, 15 bp, Homo sapiens
cggcaagactccatc

SEQ ID NO: 3543052 - DNA, 22 bp, Homo sapiens
cgtatcatttctaattttaagt

SEQ ID NO: 3543053 - DNA, 16 bp, Homo sapiens
ctaaggaagggaaagg

SEQ ID NO: 3543054 - DNA, 20 bp, Homo sapiens
ctaaggagcctaactccaaa

SEQ ID NO: 3543055 - DNA, 15 bp, Homo sapiens
ctaatgggaatcatt

SEQ ID NO: 3543056 - DNA, 19 bp, Homo sapiens
ctaatgggaatcattccac

SEQ ID NO: 3543057 - DNA, 17 bp, Homo sapiens
ctaattttaagttattt

SEQ ID NO: 3543058 - DNA, 14 bp, Homo sapiens
ctacatagttattc

SEQ ID NO: 3543059 - DNA, 14 bp, Homo sapiens
ctaccaaagaatgc

SEQ ID NO: 3543060 - DNA, 16 bp, Homo sapiens
ctaccaaagaatgcat

SEQ ID NO: 3543061 - DNA, 18 bp, Homo sapiens
ctagaacatccttaaatg

SEQ ID NO: 3543062 - DNA, 20 bp, Homo sapiens
ctagaacatccttaaatgtc

SEQ ID NO: 3543063 - DNA, 18 bp, Homo sapiens
ctagataggtgcttttaa

SEQ ID NO: 3543064 - DNA, 21 bp, Homo sapiens
ctagtatatgtcagacatgaa

SEQ ID NO: 3543065 - DNA, 14 bp, Homo sapiens
ctagtgatttcatt

SEQ ID NO: 3543066 - DNA, 14 bp, Homo sapiens
ctatacaattcagt

SEQ ID NO: 3543067 - DNA, 20 bp, Homo sapiens
ctatatgcatttaattctga

SEQ ID NO: 3543068 - DNA, 21 bp, Homo sapiens
ctattaagggaaaggaaaaga

SEQ ID NO: 3543069 - DNA, 21 bp, Homo sapiens
ttaaatctgcctttgtttcta

SEQ ID NO: 3543070 - DNA, 18 bp, Homo sapiens
ttaataaatggatactta

SEQ ID NO: 3543071 - DNA, 14 bp, Homo sapiens
ttaataatttcatc

SEQ ID NO: 3543072 - DNA, 11 bp, Homo sapiens
ttaattccaag

SEQ ID NO: 3543073 - DNA, 15 bp, Homo sapiens
ttaccagaaaatgag

SEQ ID NO: 3543074 - DNA, 20 bp, Homo sapiens
ttaccagtgttaataaatgg

SEQ ID NO: 3543075 - DNA, 13 bp, Homo sapiens
ttagccaggcgtg

SEQ ID NO: 3543076 - DNA, 14 bp, Homo sapiens
ttagctatgtttcc

SEQ ID NO: 3543077 - DNA, 12 bp, Homo sapiens
ttatagaatgct

SEQ ID NO: 3543078 - DNA, 22 bp, Homo sapiens
ttatatattccttactagaaat

SEQ ID NO: 3543079 - DNA, 13 bp, Homo sapiens
ttatctcatttct

SEQ ID NO: 3543080 - DNA, 12 bp, Homo sapiens
ttattaaataaa

SEQ ID NO: 3543081 - DNA, 21 bp, Homo sapiens
ttattaaatctttttttaatg

SEQ ID NO: 3543082 - DNA, 19 bp, Homo sapiens
ttattcaattctgtataga

SEQ ID NO: 3543083 - DNA, 18 bp, Homo sapiens
ttatttccaaaataaaat

SEQ ID NO: 3543084 - DNA, 20 bp, Homo sapiens
ttatttccaaaataaaatga

SEQ ID NO: 3543085 - DNA, 12 bp, Homo sapiens
ttatttctgtaa

SEQ ID NO: 3543086 - DNA, 18 bp, Homo sapiens
ttcaaaagtaagaatgca

SEQ ID NO: 3543087 - DNA, 12 bp, Homo sapiens
ttcaattatttc

SEQ ID NO: 3543088 - DNA, 16 bp, Homo sapiens
ttcaattatttcaatg

SEQ ID NO: 3543089 - DNA, 17 bp, Homo sapiens
ttcaatttaattcttat

SEQ ID NO: 3543090 - DNA, 20 bp, Homo sapiens
ttcaatttaattcttatttc

SEQ ID NO: 3543091 - DNA, 23 bp, Homo sapiens
ttcaatttaattcttatttctgt

SEQ ID NO: 3543092 - DNA, 18 bp, Homo sapiens
ttcaccaaaccatggata

SEQ ID NO: 3543093 - DNA, 13 bp, Homo sapiens
ttcataaactgag

SEQ ID NO: 3543094 - DNA, 21 bp, Homo sapiens
ttcatattaccagaaaatgag

SEQ ID NO: 3543095 - DNA, 22 bp, Homo sapiens
ttcatattaccagaaaatgagt

SEQ ID NO: 3543096 - DNA, 19 bp, Homo sapiens
ttcatcatatgaatgttct

SEQ ID NO: 3543097 - DNA, 18 bp, Homo sapiens
ttcatccctatttatagt

SEQ ID NO: 3543098 - DNA, 13 bp, Homo sapiens
ttccacctttctc

SEQ ID NO: 3543099 - DNA, 19 bp, Homo sapiens
ttccactatacaattcagt

SEQ ID NO: 3543100 - DNA, 18 bp, Homo sapiens
ttccatttatcctagaaa

SEQ ID NO: 3543101 - DNA, 21 bp, Homo sapiens
ttccatttatcctagaaaatt

SEQ ID NO: 3543102 - DNA, 15 bp, Homo sapiens
ttcccacactgaaat

SEQ ID NO: 3543103 - DNA, 18 bp, Homo sapiens
ttccgggaataacatgat

SEQ ID NO: 3543104 - DNA, 23 bp, Homo sapiens
ttctaaatattgacacttagcag

SEQ ID NO: 3543105 - DNA, 19 bp, Homo sapiens
ttctgtgtgccctgaaaat

SEQ ID NO: 3543106 - DNA, 20 bp, Homo sapiens
ttcttacattattaatcatt

SEQ ID NO: 3543107 - DNA, 13 bp, Homo sapiens
ttcttcttacatt

SEQ ID NO: 3543108 - DNA, 13 bp, Homo sapiens
ttctttccacctt

SEQ ID NO: 3543109 - DNA, 20 bp, Homo sapiens
ttctttcccacactgaaatt

SEQ ID NO: 3543110 - DNA, 16 bp, Homo sapiens
ttcttttgtaaagaga

SEQ ID NO: 3543111 - DNA, 14 bp, Homo sapiens
ttgcaagaatctaa

SEQ ID NO: 3543112 - DNA, 15 bp, Homo sapiens
ttgcattattcatat

SEQ ID NO: 3543113 - DNA, 22 bp, Homo sapiens
ttgctataagaaaagtgaaagt

SEQ ID NO: 3543114 - DNA, 15 bp, Homo sapiens
ttggtctttctacat

SEQ ID NO: 3543115 - DNA, 13 bp, Homo sapiens
ttggtttaagcag

SEQ ID NO: 3543116 - DNA, 22 bp, Homo sapiens
ttgtgacgattatttatttctg

SEQ ID NO: 3543117 - DNA, 21 bp, Homo sapiens
ttgttcatgttaccaaagcaa

SEQ ID NO: 3543118 - DNA, 17 bp, Homo sapiens
tttaaagctgactttgt

SEQ ID NO: 3543119 - DNA, 13 bp, Homo sapiens
tttaattctgaaa

SEQ ID NO: 3543120 - DNA, 15 bp, Homo sapiens
tttatgtacacaaat

SEQ ID NO: 3543121 - DNA, 17 bp, Homo sapiens
tttattcaattctgtat

SEQ ID NO: 3543122 - DNA, 21 bp, Homo sapiens
tttcagattggggtgttagaa

SEQ ID NO: 3543123 - DNA, 14 bp, Homo sapiens
tttcataaactgag

SEQ ID NO: 3543124 - DNA, 16 bp, Homo sapiens
tttctgacatacctta

SEQ ID NO: 3543125 - DNA, 13 bp, Homo sapiens
tttgcaagaatct

SEQ ID NO: 3543126 - DNA, 23 bp, Homo sapiens
tttgctaccaaagaatgcatgtt

SEQ ID NO: 3543127 - DNA, 21 bp, Homo sapiens
tttgtaaagagaccatcttct

SEQ ID NO: 3543128 - DNA, 20 bp, Homo sapiens
tttgttgccttatcttgaaa

SEQ ID NO: 3543129 - DNA, 18 bp, Homo sapiens
tttgtttagaagtacgtt

SEQ ID NO: 3543130 - DNA, 19 bp, Homo sapiens
tttgtttttcttatccaag

SEQ ID NO: 3543131 - DNA, 15 bp, Homo sapiens
ttttaataatttcat

SEQ ID NO: 3543132 - DNA, 16 bp, Homo sapiens
ttttaataatttcatc

SEQ ID NO: 3543133 - DNA, 17 bp, Homo sapiens
ttttaatttgaatcaga

SEQ ID NO: 3543134 - DNA, 22 bp, Homo sapiens
ttttataggtcacatatgtctg

SEQ ID NO: 3543135 - DNA, 20 bp, Homo sapiens
ttttccttagctgtaaaatg

SEQ ID NO: 3543136 - DNA, 16 bp, Homo sapiens
ttttgcattattcata

SEQ ID NO: 3543137 - DNA, 12 bp, Homo sapiens
ttttgtaaagag

SEQ ID NO: 3543138 - DNA, 12 bp, Homo sapiens
ttttgtaaataa

SEQ ID NO: 3543139 - DNA, 12 bp, Homo sapiens
tttttattaaat

SEQ ID NO: 3543140 - DNA, 12 bp, Homo sapiens
aaaaatgttcta

SEQ ID NO: 3543141 - DNA, 17 bp, Homo sapiens
aaaatgttctatatgca

SEQ ID NO: 3543142 - DNA, 23 bp, Homo sapiens
aaaatgttctatatgcatttaat

SEQ ID NO: 3543143 - DNA, 19 bp, Homo sapiens
aaaattgctagtgatttca

SEQ ID NO: 3543144 - DNA, 18 bp, Homo sapiens
aaaccaactgttgacata

SEQ ID NO: 3543145 - DNA, 17 bp, Homo sapiens
aaacttaagcataaaaa

SEQ ID NO: 3543146 - DNA, 18 bp, Homo sapiens
aaagataaatgatgattc

SEQ ID NO: 3543147 - DNA, 17 bp, Homo sapiens
aaagcaaataagctcta

SEQ ID NO: 3543148 - DNA, 16 bp, Homo sapiens
aaaggtagatcatctt

SEQ ID NO: 3543149 - DNA, 18 bp, Homo sapiens
aaaggtagatcatcttga

SEQ ID NO: 3543150 - DNA, 22 bp, Homo sapiens
aaagtagcaaccttcattttac

SEQ ID NO: 3543151 - DNA, 23 bp, Homo sapiens
aaagtagcaaccttcattttaca

SEQ ID NO: 3543152 - DNA, 16 bp, Homo sapiens
aaataaatattttaca

SEQ ID NO: 3543153 - DNA, 19 bp, Homo sapiens
aaatatatctgtgatttta

SEQ ID NO: 3543154 - DNA, 12 bp, Homo sapiens
aaatatattcat

SEQ ID NO: 3543155 - DNA, 12 bp, Homo sapiens
aaatatgttcta

SEQ ID NO: 3543156 - DNA, 21 bp, Homo sapiens
aaatctgcctttgtttctaaa

SEQ ID NO: 3543157 - DNA, 14 bp, Homo sapiens
acaacctaaatgga

SEQ ID NO: 3543158 - DNA, 15 bp, Homo sapiens
acaacctaaatggag

SEQ ID NO: 3543159 - DNA, 22 bp, Homo sapiens
acaacctgagccttttcttata

SEQ ID NO: 3543160 - DNA, 18 bp, Homo sapiens
acaacctggtgcatcgaa

SEQ ID NO: 3543161 - DNA, 18 bp, Homo sapiens
acacagttactgacttag

SEQ ID NO: 3543162 - DNA, 16 bp, Homo sapiens
acagatctcaatttta

SEQ ID NO: 3543163 - DNA, 14 bp, Homo sapiens
acagttactgactt

SEQ ID NO: 3543164 - DNA, 18 bp, Homo sapiens
acataccttagactgaaa

SEQ ID NO: 3543165 - DNA, 15 bp, Homo sapiens
acatatgtctgtatc

SEQ ID NO: 3543166 - DNA, 16 bp, Homo sapiens
acatccttaaatgtct

SEQ ID NO: 3543167 - DNA, 16 bp, Homo sapiens
acatgaaaactatttt

SEQ ID NO: 3543168 - DNA, 19 bp, Homo sapiens
acatgaacttcatatacta

SEQ ID NO: 3543169 - DNA, 19 bp, Homo sapiens
acatgctaagaaagcaaat

SEQ ID NO: 3543170 - DNA, 20 bp, Homo sapiens
acattataaatgacagatct

SEQ ID NO: 3543171 - DNA, 16 bp, Homo sapiens
acattattaatcattc

SEQ ID NO: 3543172 - DNA, 19 bp, Homo sapiens
acattattaatcattccat

SEQ ID NO: 3543173 - DNA, 15 bp, Homo sapiens
accaaagcaatattt

SEQ ID NO: 3543174 - DNA, 16 bp, Homo sapiens
accaagttacttgaaa

SEQ ID NO: 3543175 - DNA, 16 bp, Homo sapiens
accaggtcactctgac

SEQ ID NO: 3543176 - DNA, 20 bp, Homo sapiens
accaggtcactctgacctta

SEQ ID NO: 3543177 - DNA, 21 bp, Homo sapiens
acctaaatggagaaagctgtg

SEQ ID NO: 3543178 - DNA, 17 bp, Homo sapiens
acctaatgggaatcatt

SEQ ID NO: 3543179 - DNA, 22 bp, Homo sapiens
acctaatgggaatcattccact

SEQ ID NO: 3543180 - DNA, 23 bp, Homo sapiens
acctaattgttaaatttaaaaat

SEQ ID NO: 3543181 - DNA, 19 bp, Homo sapiens
acctgagccttttcttata

SEQ ID NO: 3543182 - DNA, 20 bp, Homo sapiens
accttcattttacattctgt

SEQ ID NO: 3543183 - DNA, 12 bp, Homo sapiens
acgtatcatttc

SEQ ID NO: 3543184 - DNA, 14 bp, Homo sapiens
acgtatcatttcta

SEQ ID NO: 3543185 - DNA, 17 bp, Homo sapiens
actagaaatatattcat

SEQ ID NO: 3543186 - DNA, 15 bp, Homo sapiens
actatacaattcagt

SEQ ID NO: 3543187 - DNA, 16 bp, Homo sapiens
actattaagggaaagg

SEQ ID NO: 3543188 - DNA, 22 bp, Homo sapiens
actcaagcagtgtgctggacct

SEQ ID NO: 3543189 - DNA, 13 bp, Homo sapiens
actcatgtacatt

SEQ ID NO: 3543190 - DNA, 19 bp, Homo sapiens
actccgaaacaagtagaaa

SEQ ID NO: 3543191 - DNA, 20 bp, Homo sapiens
actgattattcttcttacat

SEQ ID NO: 3543192 - DNA, 23 bp, Homo sapiens
actgattattcttcttacattat

SEQ ID NO: 3543193 - DNA, 22 bp, Homo sapiens
actgcctggatgtgtttgattt

SEQ ID NO: 3543194 - DNA, 13 bp, Homo sapiens
actggcaatattt

SEQ ID NO: 3543195 - DNA, 18 bp, Homo sapiens
actggcaatatttgttct

SEQ ID NO: 3543196 - DNA, 15 bp, Homo sapiens
acttaagcataaaaa

SEQ ID NO: 3543197 - DNA, 21 bp, Homo sapiens
actttttattcaattctgtat

SEQ ID NO: 3543198 - DNA, 15 bp, Homo sapiens
acttttttagaatga

SEQ ID NO: 3543199 - DNA, 14 bp, Homo sapiens
actttttttctgat

SEQ ID NO: 3543200 - DNA, 12 bp, Homo sapiens
agaaaactgttg

SEQ ID NO: 3543201 - DNA, 16 bp, Homo sapiens
agaaaagtgaaagtaa

SEQ ID NO: 3543202 - DNA, 15 bp, Homo sapiens
atagaatgctgaact

SEQ ID NO: 3543203 - DNA, 23 bp, Homo sapiens
atagcaagaactctgcacagcaa

SEQ ID NO: 3543204 - DNA, 14 bp, Homo sapiens
atataagacaagaa

SEQ ID NO: 3543205 - DNA, 16 bp, Homo sapiens
atatataaaagaaata

SEQ ID NO: 3543206 - DNA, 15 bp, Homo sapiens
atatatattatctta

SEQ ID NO: 3543207 - DNA, 15 bp, Homo sapiens
atatgcatttaattc

SEQ ID NO: 3543208 - DNA, 21 bp, Homo sapiens
atatgtcagacatgaaaacta

SEQ ID NO: 3543209 - DNA, 22 bp, Homo sapiens
atattcataatatataaaagaa

SEQ ID NO: 3543210 - DNA, 19 bp, Homo sapiens
atattccttactagaaata

SEQ ID NO: 3543211 - DNA, 12 bp, Homo sapiens
atattttacagt

SEQ ID NO: 3543212 - DNA, 20 bp, Homo sapiens
atcatcacaacctaaatgga

SEQ ID NO: 3543213 - DNA, 11 bp, Homo sapiens
atcatcttgaa

SEQ ID NO: 3543214 - DNA, 14 bp, Homo sapiens
atcttatactgaaa

SEQ ID NO: 3543215 - DNA, 16 bp, Homo sapiens
atcttcagtttctgaa

SEQ ID NO: 3543216 - DNA, 17 bp, Homo sapiens
atcttcagtttctgaag

SEQ ID NO: 3543217 - DNA, 18 bp, Homo sapiens
atgaagagacttaagaaa

SEQ ID NO: 3543218 - DNA, 14 bp, Homo sapiens
atgaatgtgcattt

SEQ ID NO: 3543219 - DNA, 17 bp, Homo sapiens
atgactttttttctgat

SEQ ID NO: 3543220 - DNA, 20 bp, Homo sapiens
atgttaccaaagcaatattt

SEQ ID NO: 3543221 - DNA, 21 bp, Homo sapiens
atgttctgtgtgccctgaaaa

SEQ ID NO: 3543222 - DNA, 22 bp, Homo sapiens
atgttctgtgtgccctgaaaat

SEQ ID NO: 3543223 - DNA, 22 bp, Homo sapiens
atgttcttggttcccattgtga

SEQ ID NO: 3543224 - DNA, 19 bp, Homo sapiens
atgtttccatcttcagttt

SEQ ID NO: 3543225 - DNA, 19 bp, Homo sapiens
attaacccccaaattcaaa

SEQ ID NO: 3543226 - DNA, 14 bp, Homo sapiens
attaatcattccat

SEQ ID NO: 3543227 - DNA, 19 bp, Homo sapiens
attaatttgtttttcttat

SEQ ID NO: 3543228 - DNA, 21 bp, Homo sapiens
attagcaagtgagtttggtgt

SEQ ID NO: 3543229 - DNA, 23 bp, Homo sapiens
attagtccaaggcctttttcata

SEQ ID NO: 3543230 - DNA, 20 bp, Homo sapiens
attagttttctgtatatgat

SEQ ID NO: 3543231 - DNA, 15 bp, Homo sapiens
attataaaattattt

SEQ ID NO: 3543232 - DNA, 18 bp, Homo sapiens
attataaaattattttta

SEQ ID NO: 3543233 - DNA, 17 bp, Homo sapiens
attattaatcattccat

SEQ ID NO: 3543234 - DNA, 13 bp, Homo sapiens
attatttatttct

SEQ ID NO: 3543235 - DNA, 16 bp, Homo sapiens
attcaaaagtaagaat

SEQ ID NO: 3543236 - DNA, 22 bp, Homo sapiens
attcaatttaattcttatttct

SEQ ID NO: 3543237 - DNA, 23 bp, Homo sapiens
attcaatttaattcttatttctg

SEQ ID NO: 3543238 - DNA, 17 bp, Homo sapiens
attcacctttcttttgt

SEQ ID NO: 3543239 - DNA, 21 bp, Homo sapiens
attcatattaccagaaaatga

SEQ ID NO: 3543240 - DNA, 22 bp, Homo sapiens
attccaagattaaaagttcata

SEQ ID NO: 3543241 - DNA, 12 bp, Homo sapiens
attcttatttct

SEQ ID NO: 3543242 - DNA, 13 bp, Homo sapiens
attcttatttctg

SEQ ID NO: 3543243 - DNA, 17 bp, Homo sapiens
attgctagtgatttcat

SEQ ID NO: 3543244 - DNA, 16 bp, Homo sapiens
attggtctttctacat

SEQ ID NO: 3543245 - DNA, 19 bp, Homo sapiens
attgttaaatttaaaaata

SEQ ID NO: 3543246 - DNA, 16 bp, Homo sapiens
attgttcatgttacca

SEQ ID NO: 3543247 - DNA, 23 bp, Homo sapiens
atttaaggatgactttttttctg

SEQ ID NO: 3543248 - DNA, 22 bp, Homo sapiens
atttatgaatgtgcatttcttg

SEQ ID NO: 3543249 - DNA, 12 bp, Homo sapiens
atttatttctgt

SEQ ID NO: 3543250 - DNA, 19 bp, Homo sapiens
atttcatggattatttatg

SEQ ID NO: 3543251 - DNA, 19 bp, Homo sapiens
atttctgtaaaatttgttt

SEQ ID NO: 3543252 - DNA, 16 bp, Homo sapiens
atttgaatcagagaaa

SEQ ID NO: 3543253 - DNA, 24 bp, Homo sapiens
atttgaatcagagaaaactgttga

SEQ ID NO: 3543254 - DNA, 24 bp, Homo sapiens
atttgcttaaaattgctagtgatt

SEQ ID NO: 3543255 - DNA, 13 bp, Homo sapiens
atttgtttagaag

SEQ ID NO: 3543256 - DNA, 20 bp, Homo sapiens
attttaaaaaaattcatcat

SEQ ID NO: 3543257 - DNA, 22 bp, Homo sapiens
attttaaagctgactttgttgc

SEQ ID NO: 3543258 - DNA, 23 bp, Homo sapiens
attttatagtagtgggaaagata

SEQ ID NO: 3543259 - DNA, 19 bp, Homo sapiens
atttttattaaataaatat

SEQ ID NO: 3543260 - DNA, 14 bp, Homo sapiens
caaagaatgcatgt

SEQ ID NO: 3543261 - DNA, 17 bp, Homo sapiens
caaatccctatgttgct

SEQ ID NO: 3543262 - DNA, 19 bp, Homo sapiens
caagaactctgcacagcaa

SEQ ID NO: 3543263 - DNA, 20 bp, Homo sapiens
caagaactctgcacagcaac

SEQ ID NO: 3543264 - DNA, 19 bp, Homo sapiens
caataggtggaaagagaaa

SEQ ID NO: 3543265 - DNA, 22 bp, Homo sapiens
caatatttccctggaatttaat

SEQ ID NO: 3543266 - DNA, 13 bp, Homo sapiens
caattatttcaat

SEQ ID NO: 3543267 - DNA, 15 bp, Homo sapiens
caatttaattcttat

SEQ ID NO: 3543268 - DNA, 19 bp, Homo sapiens
caatttaattcttatttct

SEQ ID NO: 3543269 - DNA, 20 bp, Homo sapiens
caatttaattcttatttctg

SEQ ID NO: 3543270 - DNA, 14 bp, Homo sapiens
cacaacctaaatgg

SEQ ID NO: 3543271 - DNA, 17 bp, Homo sapiens
cacatatgtctgtatct

SEQ ID NO: 3543272 - DNA, 19 bp, Homo sapiens
cacctttctctgttttatg

SEQ ID NO: 3543273 - DNA, 19 bp, Homo sapiens
cactctgaccttattactg

SEQ ID NO: 3543274 - DNA, 18 bp, Homo sapiens
cactgggtttaaagatgt

SEQ ID NO: 3543275 - DNA, 21 bp, Homo sapiens
cagcgctggtcgtcacctggg

SEQ ID NO: 3543276 - DNA, 20 bp, Homo sapiens
caggaggcagaggttgcagt

SEQ ID NO: 3543277 - DNA, 15 bp, Homo sapiens
cagggctccacagag

SEQ ID NO: 3543278 - DNA, 17 bp, Homo sapiens
caggtaacattataaat

SEQ ID NO: 3543279 - DNA, 15 bp, Homo sapiens
caggtcactctgacc

SEQ ID NO: 3543280 - DNA, 16 bp, Homo sapiens
catacaaaccatgatt

SEQ ID NO: 3543281 - DNA, 12 bp, Homo sapiens
catactcatttg

SEQ ID NO: 3543282 - DNA, 21 bp, Homo sapiens
catatatttatgaatgtgcat

SEQ ID NO: 3543283 - DNA, 16 bp, Homo sapiens
catattaccagaaaat

SEQ ID NO: 3543284 - DNA, 15 bp, Homo sapiens
catcacaacctaaat

SEQ ID NO: 3543285 - DNA, 22 bp, Homo sapiens
catcacaacctaaatggagaaa

SEQ ID NO: 3543286 - DNA, 15 bp, Homo sapiens
catcatatgaatgtt

SEQ ID NO: 3543287 - DNA, 17 bp, Homo sapiens
catcatatgaatgttct

SEQ ID NO: 3543288 - DNA, 21 bp, Homo sapiens
catcgaaatgtattcaccttt

SEQ ID NO: 3543289 - DNA, 17 bp, Homo sapiens
catcttgaatatttgct

SEQ ID NO: 3543290 - DNA, 20 bp, Homo sapiens
catgaaaactattttaaagc

SEQ ID NO: 3543291 - DNA, 23 bp, Homo sapiens
catgatggatggaaatatgttct

SEQ ID NO: 3543292 - DNA, 16 bp, Homo sapiens
catgctaagaaagcaa

SEQ ID NO: 3543293 - DNA, 18 bp, Homo sapiens
catgttaccaaagcaata

SEQ ID NO: 3543294 - DNA, 21 bp, Homo sapiens
catgttttatgtacacaaatc

SEQ ID NO: 3543295 - DNA, 14 bp, Homo sapiens
cattataaatgaca

SEQ ID NO: 3543296 - DNA, 16 bp, Homo sapiens
cattattaatcattcc

SEQ ID NO: 3543297 - DNA, 18 bp, Homo sapiens
cattattaatcattccat

SEQ ID NO: 3543298 - DNA, 21 bp, Homo sapiens
cattccactatacaattcagt

SEQ ID NO: 3543299 - DNA, 20 bp, Homo sapiens
cattgacctaattgttaaat

SEQ ID NO: 3543300 - DNA, 18 bp, Homo sapiens
cattggtctttctacata

SEQ ID NO: 3543301 - DNA, 18 bp, Homo sapiens
catttaattctgaaatca

SEQ ID NO: 3543302 - DNA, 21 bp, Homo sapiens
catttctcaacagttcattgc

SEQ ID NO: 3543303 - DNA, 17 bp, Homo sapiens
ccagtgttaataaatgg

SEQ ID NO: 3543304 - DNA, 18 bp, Homo sapiens
ccatcttctatcttcttt

SEQ ID NO: 3543305 - DNA, 17 bp, Homo sapiens
ccatttgtatttgtatt

SEQ ID NO: 3543306 - DNA, 18 bp, Homo sapiens
cccagtcgaactgggggc

SEQ ID NO: 3543307 - DNA, 19 bp, Homo sapiens
cccatgtgactgtggcatt

SEQ ID NO: 3543308 - DNA, 11 bp, Homo sapiens
ccctcctggta

SEQ ID NO: 3543309 - DNA, 13 bp, Homo sapiens
cccttcctgtgcc

SEQ ID NO: 3543310 - DNA, 14 bp, Homo sapiens
ccgggaataacatg

SEQ ID NO: 3543311 - DNA, 14 bp, Homo sapiens
cctgaaaatgttac

SEQ ID NO: 3543312 - DNA, 18 bp, Homo sapiens
ctgtagagaatgaaagga

SEQ ID NO: 3543313 - DNA, 23 bp, Homo sapiens
ctgtatagattataaaattattt

SEQ ID NO: 3543314 - DNA, 20 bp, Homo sapiens
ctgtatctacttagccagat

SEQ ID NO: 3543315 - DNA, 13 bp, Homo sapiens
ctgtatgcagttt

SEQ ID NO: 3543316 - DNA, 13 bp, Homo sapiens
ctgtcagcctggc

SEQ ID NO: 3543317 - DNA, 15 bp, Homo sapiens
ctgtccaacatgttt

SEQ ID NO: 3543318 - DNA, 19 bp, Homo sapiens
ctgtgtgccctgaaaatgt

SEQ ID NO: 3543319 - DNA, 21 bp, Homo sapiens
ctgttgacatacaaaccatga

SEQ ID NO: 3543320 - DNA, 16 bp, Homo sapiens
ctgttggttcatccag

SEQ ID NO: 3543321 - DNA, 14 bp, Homo sapiens
ctgttttcttcttg

SEQ ID NO: 3543322 - DNA, 14 bp, Homo sapiens
cttactagaaatat

SEQ ID NO: 3543323 - DNA, 20 bp, Homo sapiens
cttagcagtcatagggctga

SEQ ID NO: 3543324 - DNA, 14 bp, Homo sapiens
cttatactgaaaaa

SEQ ID NO: 3543325 - DNA, 14 bp, Homo sapiens
cttatctcatttct

SEQ ID NO: 3543326 - DNA, 14 bp, Homo sapiens
cttctatcttcttt

SEQ ID NO: 3543327 - DNA, 20 bp, Homo sapiens
cttcttacattattaatcat

SEQ ID NO: 3543328 - DNA, 16 bp, Homo sapiens
cttgacttcacagcag

SEQ ID NO: 3543329 - DNA, 17 bp, Homo sapiens
cttgacttcacagcagc

SEQ ID NO: 3543330 - DNA, 20 bp, Homo sapiens
cttggcctggtgggaccagg

SEQ ID NO: 3543331 - DNA, 13 bp, Homo sapiens
cttggtgctatga

SEQ ID NO: 3543332 - DNA, 21 bp, Homo sapiens
cttgtgacttacagtgccaac

SEQ ID NO: 3543333 - DNA, 16 bp, Homo sapiens
ctttactagtgccaaa

SEQ ID NO: 3543334 - DNA, 17 bp, Homo sapiens
cttttcaattatttcaa

SEQ ID NO: 3543335 - DNA, 18 bp, Homo sapiens
cttttcaattatttcaat

SEQ ID NO: 3543336 - DNA, 20 bp, Homo sapiens
cttttccttagctgtaaaat

SEQ ID NO: 3543337 - DNA, 22 bp, Homo sapiens
cttttgtaaagagaccatcttc

SEQ ID NO: 3543338 - DNA, 15 bp, Homo sapiens
ctttttcataaactg

SEQ ID NO: 3543339 - DNA, 23 bp, Homo sapiens
gaaaaaatgttctatatgcattt

SEQ ID NO: 3543340 - DNA, 18 bp, Homo sapiens
gaaaactgttgaggttcc

SEQ ID NO: 3543341 - DNA, 20 bp, Homo sapiens
gaaaataatttgttgtactt

SEQ ID NO: 3543342 - DNA, 22 bp, Homo sapiens
gaaatatatctgtgattttaaa

SEQ ID NO: 3543343 - DNA, 18 bp, Homo sapiens
gaacatccttaaatgtct

SEQ ID NO: 3543344 - DNA, 16 bp, Homo sapiens
gaacccagaactagga

SEQ ID NO: 3543345 - DNA, 23 bp, Homo sapiens
gaacctaatgggaatcattccac

SEQ ID NO: 3543346 - DNA, 20 bp, Homo sapiens
gaacctgtccaacatgtttt

SEQ ID NO: 3543347 - DNA, 17 bp, Homo sapiens
gaactgggggctagcca

SEQ ID NO: 3543348 - DNA, 23 bp, Homo sapiens
gaagcccactgggtttaaagatg

SEQ ID NO: 3543349 - DNA, 15 bp, Homo sapiens
gaagtacgtttttgc

SEQ ID NO: 3543350 - DNA, 22 bp, Homo sapiens
gaagtacgtttttgcattattc

SEQ ID NO: 3543351 - DNA, 13 bp, Homo sapiens
gaatcagagaaaa

SEQ ID NO: 3543352 - DNA, 14 bp, Homo sapiens
gaatgcatgttctg

SEQ ID NO: 3543353 - DNA, 14 bp, Homo sapiens
gacatatatttatg

SEQ ID NO: 3543354 - DNA, 16 bp, Homo sapiens
gacatgaaaactattt

SEQ ID NO: 3543355 - DNA, 20 bp, Homo sapiens
gacatgaaaactattttaaa

SEQ ID NO: 3543356 - DNA, 21 bp, Homo sapiens
gacctaattgttaaatttaaa

SEQ ID NO: 3543357 - DNA, 14 bp, Homo sapiens
gacgattatttatt

SEQ ID NO: 3543358 - DNA, 15 bp, Homo sapiens
gacgattatttattt

SEQ ID NO: 3543359 - DNA, 16 bp, Homo sapiens
gacgattatttatttc

SEQ ID NO: 3543360 - DNA, 18 bp, Homo sapiens
gacgattatttatttctg

SEQ ID NO: 3543361 - DNA, 15 bp, Homo sapiens
gactgaaaaactgtt

SEQ ID NO: 3543362 - DNA, 16 bp, Homo sapiens
gactgatggtgtctga

SEQ ID NO: 3543363 - DNA, 15 bp, Homo sapiens
gacttcacagcagcc

SEQ ID NO: 3543364 - DNA, 22 bp, Homo sapiens
gactttgttgccttatcttgaa

SEQ ID NO: 3543365 - DNA, 16 bp, Homo sapiens
gagaaatgatgtgaaa

SEQ ID NO: 3543366 - DNA, 21 bp, Homo sapiens
gagaaatgatgtgaaagataa

SEQ ID NO: 3543367 - DNA, 14 bp, Homo sapiens
gagccttttcttat

SEQ ID NO: 3543368 - DNA, 18 bp, Homo sapiens
gataatacacacagttac

SEQ ID NO: 3543369 - DNA, 21 bp, Homo sapiens
gatacatgctaagaaagcaaa

SEQ ID NO: 3543370 - DNA, 22 bp, Homo sapiens
gatacatgctaagaaagcaaat

SEQ ID NO: 3543371 - DNA, 16 bp, Homo sapiens
gatagcttgggattta

SEQ ID NO: 3543372 - DNA, 14 bp, Homo sapiens
gatatcataaaagt

SEQ ID NO: 3543373 - DNA, 23 bp, Homo sapiens
gatcacaccactacactccagcc

SEQ ID NO: 3543374 - DNA, 18 bp, Homo sapiens
gatgtgaaagataaatga

SEQ ID NO: 3543375 - DNA, 24 bp, Homo sapiens
gattttaaaaaccagtcaagagca

SEQ ID NO: 3543376 - DNA, 17 bp, Homo sapiens
gcaaccttcattttaca

SEQ ID NO: 3543377 - DNA, 23 bp, Homo sapiens
gcaatatttccctggaatttaat

SEQ ID NO: 3543378 - DNA, 21 bp, Homo sapiens
gcataaaaattgaattcgttt

SEQ ID NO: 3543379 - DNA, 17 bp, Homo sapiens
gcattcgcactggggga

SEQ ID NO: 3543380 - DNA, 12 bp, Homo sapiens
gccaaggacagg

SEQ ID NO: 3543381 - DNA, 15 bp, Homo sapiens
gccacctcctcgtcc

SEQ ID NO: 3543382 - DNA, 24 bp, Homo sapiens
gccactgctggaggcagcgctggt

SEQ ID NO: 3543383 - DNA, 20 bp, Homo sapiens
gccatttgtatttgtattcc

SEQ ID NO: 3543384 - DNA, 14 bp, Homo sapiens
gcccatgtgactgt

SEQ ID NO: 3543385 - DNA, 18 bp, Homo sapiens
gcccatgtgactgtggca

SEQ ID NO: 3543386 - DNA, 22 bp, Homo sapiens
aaaactgttggttcatccagaa

SEQ ID NO: 3543387 - DNA, 23 bp, Homo sapiens
aaaatctttttttaataatttca

SEQ ID NO: 3543388 - DNA, 15 bp, Homo sapiens
aaaatgttctatatg

SEQ ID NO: 3543389 - DNA, 20 bp, Homo sapiens
aaaattgaattcgtttctga

SEQ ID NO: 3543390 - DNA, 22 bp, Homo sapiens
aaaattgaattcgtttctgaca

SEQ ID NO: 3543391 - DNA, 21 bp, Homo sapiens
aaaattgctagtgatttcatt

SEQ ID NO: 3543392 - DNA, 17 bp, Homo sapiens
aaaattttgctaccaaa

SEQ ID NO: 3543393 - DNA, 14 bp, Homo sapiens
aaactgagcctctt

SEQ ID NO: 3543394 - DNA, 13 bp, Homo sapiens
aaagaaatatatc

SEQ ID NO: 3543395 - DNA, 12 bp, Homo sapiens
aaagagaaatga

SEQ ID NO: 3543396 - DNA, 19 bp, Homo sapiens
aaagagaaatgatgtgaaa

SEQ ID NO: 3543397 - DNA, 13 bp, Homo sapiens
aaagataaatgat

SEQ ID NO: 3543398 - DNA, 12 bp, Homo sapiens
aaagtgctgttt

SEQ ID NO: 3543399 - DNA, 14 bp, Homo sapiens
aaataagtgaaaat

SEQ ID NO: 3543400 - DNA, 23 bp, Homo sapiens
aaatctttttttaatggaatgtg

SEQ ID NO: 3543401 - DNA, 14 bp, Homo sapiens
aaattatttttatt

SEQ ID NO: 3543402 - DNA, 20 bp, Homo sapiens
aaattgctagtgatttcatt

SEQ ID NO: 3543403 - DNA, 16 bp, Homo sapiens
aaattttgctaccaaa

SEQ ID NO: 3543404 - DNA, 20 bp, Homo sapiens
aacaagggctacctctgagt

SEQ ID NO: 3543405 - DNA, 23 bp, Homo sapiens
aacagcatctgcctctattcaat

SEQ ID NO: 3543406 - DNA, 18 bp, Homo sapiens
aacatccttaaatgtcta

SEQ ID NO: 3543407 - DNA, 16 bp, Homo sapiens
aacatctctgttgaag

SEQ ID NO: 3543408 - DNA, 21 bp, Homo sapiens
aacatgttttatgtacacaaa

SEQ ID NO: 3543409 - DNA, 14 bp, Homo sapiens
aacattataaatga

SEQ ID NO: 3543410 - DNA, 20 bp, Homo sapiens
aacctgtccaacatgtttta

SEQ ID NO: 3543411 - DNA, 17 bp, Homo sapiens
aactaggccatttgtat

SEQ ID NO: 3543412 - DNA, 19 bp, Homo sapiens
aactcgtgttcactcagca

SEQ ID NO: 3543413 - DNA, 15 bp, Homo sapiens
aactgttttcttctt

SEQ ID NO: 3543414 - DNA, 16 bp, Homo sapiens
aacttaagcataaaaa

SEQ ID NO: 3543415 - DNA, 17 bp, Homo sapiens
aacttaagcataaaaat

SEQ ID NO: 3543416 - DNA, 18 bp, Homo sapiens
aagaactctgcacagcaa

SEQ ID NO: 3543417 - DNA, 12 bp, Homo sapiens
aagaataggtca

SEQ ID NO: 3543418 - DNA, 13 bp, Homo sapiens
aagaatatgttca

SEQ ID NO: 3543419 - DNA, 13 bp, Homo sapiens
aagacaagaatat

SEQ ID NO: 3543420 - DNA, 17 bp, Homo sapiens
aagagaccatcttctat

SEQ ID NO: 3543421 - DNA, 18 bp, Homo sapiens
aagagacttaagaaagct

SEQ ID NO: 3543422 - DNA, 12 bp, Homo sapiens
aagataaatgat

SEQ ID NO: 3543423 - DNA, 13 bp, Homo sapiens
aagatacatgcta

SEQ ID NO: 3543424 - DNA, 18 bp, Homo sapiens
aagatacatgctaagaaa

SEQ ID NO: 3543425 - DNA, 13 bp, Homo sapiens
aagcaatatttcc

SEQ ID NO: 3543426 - DNA, 17 bp, Homo sapiens
aagtaaagtttatttca

SEQ ID NO: 3543427 - DNA, 20 bp, Homo sapiens
aagtagcaaccttcatttta

SEQ ID NO: 3543428 - DNA, 17 bp, Homo sapiens
aagtgaaagtaactgtt

SEQ ID NO: 3543429 - DNA, 23 bp, Homo sapiens
aagtgctgtttgagggattttat

SEQ ID NO: 3543430 - DNA, 21 bp, Homo sapiens
aagtgtattcatattaccaga

SEQ ID NO: 3543431 - DNA, 12 bp, Homo sapiens
aagttacttgaa

SEQ ID NO: 3543432 - DNA, 12 bp, Homo sapiens
aagttattttaa

SEQ ID NO: 3543433 - DNA, 20 bp, Homo sapiens
aagttgaggcttagctatgt

SEQ ID NO: 3543434 - DNA, 19 bp, Homo sapiens
caatatgaaggactattaa

SEQ ID NO: 3543435 - DNA, 13 bp, Homo sapiens
caatatttgttct

SEQ ID NO: 3543436 - DNA, 17 bp, Homo sapiens
caatcaaagcagcacat

SEQ ID NO: 3543437 - DNA, 12 bp, Homo sapiens
caattctgtata

SEQ ID NO: 3543438 - DNA, 16 bp, Homo sapiens
caatttaattcttatt

SEQ ID NO: 3543439 - DNA, 23 bp, Homo sapiens
caatttaattcttatttctgtgt

SEQ ID NO: 3543440 - DNA, 20 bp, Homo sapiens
cacaaatccctatgttgcta

SEQ ID NO: 3543441 - DNA, 21 bp, Homo sapiens
cacaacctaaatggagaaagc

SEQ ID NO: 3543442 - DNA, 13 bp, Homo sapiens
cacactgaaattc

SEQ ID NO: 3543443 - DNA, 18 bp, Homo sapiens
cacatggtgttgtatact

SEQ ID NO: 3543444 - DNA, 17 bp, Homo sapiens
caccaggtcactctgac

SEQ ID NO: 3543445 - DNA, 15 bp, Homo sapiens
cactatacaattcag

SEQ ID NO: 3543446 - DNA, 15 bp, Homo sapiens
cactggcaatatttg

SEQ ID NO: 3543447 - DNA, 20 bp, Homo sapiens
cacttttcattactttctgc

SEQ ID NO: 3543448 - DNA, 21 bp, Homo sapiens
cagaaaatgagtttgtctatg

SEQ ID NO: 3543449 - DNA, 21 bp, Homo sapiens
cagaagtaaagtttatttcat

SEQ ID NO: 3543450 - DNA, 14 bp, Homo sapiens
cagacatgaaaact

SEQ ID NO: 3543451 - DNA, 14 bp, Homo sapiens
cagagaagctcatt

SEQ ID NO: 3543452 - DNA, 21 bp, Homo sapiens
cagcagccacttgactaatac

SEQ ID NO: 3543453 - DNA, 20 bp, Homo sapiens
caggtaacattataaatgac

SEQ ID NO: 3543454 - DNA, 20 bp, Homo sapiens
caggttgtctgtagagaatg

SEQ ID NO: 3543455 - DNA, 16 bp, Homo sapiens
cataatatataaaaga

SEQ ID NO: 3543456 - DNA, 21 bp, Homo sapiens
cataatatataaaagaaatat

SEQ ID NO: 3543457 - DNA, 14 bp, Homo sapiens
catacaaaccatga

SEQ ID NO: 3543458 - DNA, 18 bp, Homo sapiens
cataccttagactgaaaa

SEQ ID NO: 3543459 - DNA, 16 bp, Homo sapiens
catagggctgataata

SEQ ID NO: 3543460 - DNA, 16 bp, Homo sapiens
catcacaacctaaatg

SEQ ID NO: 3543461 - DNA, 18 bp, Homo sapiens
catccataagtgtgcctc

SEQ ID NO: 3543462 - DNA, 12 bp, Homo sapiens
catcgaaatgta

SEQ ID NO: 3543463 - DNA, 23 bp, Homo sapiens
catctgcctctattcaatttaat

SEQ ID NO: 3543464 - DNA, 19 bp, Homo sapiens
catcttctatcttctttcc

SEQ ID NO: 3543465 - DNA, 15 bp, Homo sapiens
catcttgaatatttg

SEQ ID NO: 3543466 - DNA, 21 bp, Homo sapiens
catggattatttatgagagct

SEQ ID NO: 3543467 - DNA, 20 bp, Homo sapiens
catgtacattggtctttcta

SEQ ID NO: 3543468 - DNA, 21 bp, Homo sapiens
cattaacccccaaattcaaaa

SEQ ID NO: 3543469 - DNA, 12 bp, Homo sapiens
cattataaatga

SEQ ID NO: 3543470 - DNA, 13 bp, Homo sapiens
cattataaatgac

SEQ ID NO: 3543471 - DNA, 12 bp, Homo sapiens
cattattaatca

SEQ ID NO: 3543472 - DNA, 15 bp, Homo sapiens
catttatcctagaaa

SEQ ID NO: 3543473 - DNA, 16 bp, Homo sapiens
catttctaattttaag

SEQ ID NO: 3543474 - DNA, 13 bp, Homo sapiens
catttgtatttgt

SEQ ID NO: 3543475 - DNA, 15 bp, Homo sapiens
cattttacattctgt

SEQ ID NO: 3543476 - DNA, 15 bp, Homo sapiens
ccaaattcaaaagta

SEQ ID NO: 3543477 - DNA, 18 bp, Homo sapiens
ccaaattgccctgttgcc

SEQ ID NO: 3543478 - DNA, 19 bp, Homo sapiens
ccaaggcctttttcataaa

SEQ ID NO: 3543479 - DNA, 16 bp, Homo sapiens
ccacccgctctggccc

SEQ ID NO: 3543480 - DNA, 15 bp, Homo sapiens
ccactacactccagc

SEQ ID NO: 3543481 - DNA, 23 bp, Homo sapiens
ccactgctggaggcagcgctggt

SEQ ID NO: 3543482 - DNA, 16 bp, Homo sapiens
ccactgggtttaaaga

SEQ ID NO: 3543483 - DNA, 17 bp, Homo sapiens
ccactgggtttaaagat

SEQ ID NO: 3543484 - DNA, 21 bp, Homo sapiens
ccactgggtttaaagatgtta

SEQ ID NO: 3543485 - DNA, 23 bp, Homo sapiens
ccagaagtaaagtttatttcatg

SEQ ID NO: 3543486 - DNA, 22 bp, Homo sapiens
ccagaagtgtattcatattacc

SEQ ID NO: 3543487 - DNA, 16 bp, Homo sapiens
ccagtgttaataaatg

SEQ ID NO: 3543488 - DNA, 14 bp, Homo sapiens
ccatatttatagaa

SEQ ID NO: 3543489 - DNA, 14 bp, Homo sapiens
cccaaattcaaaag

SEQ ID NO: 3543490 - DNA, 14 bp, Homo sapiens
cccagtctgatatt

SEQ ID NO: 3543491 - DNA, 23 bp, Homo sapiens
ccctatgttgctataagaaaagt

SEQ ID NO: 3543492 - DNA, 16 bp, Homo sapiens
cccttcctgtgcctgt

SEQ ID NO: 3543493 - DNA, 12 bp, Homo sapiens
ccgtgcctggtg

SEQ ID NO: 3543494 - DNA, 18 bp, Homo sapiens
cctaaacaacctggtgca

SEQ ID NO: 3543495 - DNA, 20 bp, Homo sapiens
cctatgttgctataagaaaa

SEQ ID NO: 3543496 - DNA, 20 bp, Homo sapiens
cctcttggagtctagaacat

SEQ ID NO: 3543497 - DNA, 15 bp, Homo sapiens
cctgaaaatgttacc

SEQ ID NO: 3543498 - DNA, 17 bp, Homo sapiens
cctgctaaatgaagaga

SEQ ID NO: 3543499 - DNA, 16 bp, Homo sapiens
cctgctgtcagcctgg

SEQ ID NO: 3543500 - DNA, 17 bp, Homo sapiens
cctggtgcatcgaaatg

SEQ ID NO: 3543501 - DNA, 13 bp, Homo sapiens
ccttatcttgaaa

SEQ ID NO: 3543502 - DNA, 16 bp, Homo sapiens
ccttttagtattagtt

SEQ ID NO: 3543503 - DNA, 18 bp, Homo sapiens
cgtatcatttctaatttt

SEQ ID NO: 3543504 - DNA, 21 bp, Homo sapiens
ctaaaggtagatcatcttgaa

SEQ ID NO: 3543505 - DNA, 18 bp, Homo sapiens
ctaaatggagaaagctgt

SEQ ID NO: 3543506 - DNA, 19 bp, Homo sapiens
ctaattgttaaatttaaaa

SEQ ID NO: 3543507 - DNA, 17 bp, Homo sapiens
ctacgcccttcctgtgc

SEQ ID NO: 3543508 - DNA, 21 bp, Homo sapiens
ctagaacatccttaaatgtct

SEQ ID NO: 3543509 - DNA, 16 bp, Homo sapiens
ctagccacctcctcgt

SEQ ID NO: 3543510 - DNA, 19 bp, Homo sapiens
ctagctggccactgctgga

SEQ ID NO: 3543511 - DNA, 14 bp, Homo sapiens
ctatatgcatttaa

SEQ ID NO: 3543512 - DNA, 16 bp, Homo sapiens
ctatgtttccatcttc

SEQ ID NO: 3543513 - DNA, 18 bp, Homo sapiens
ctatgtttccatcttcag

SEQ ID NO: 3543514 - DNA, 19 bp, Homo sapiens
ctatgtttccatcttcagt

SEQ ID NO: 3543515 - DNA, 21 bp, Homo sapiens
ctcaatgtgcaagttgtactg

SEQ ID NO: 3543516 - DNA, 12 bp, Homo sapiens
ctcaattttata

SEQ ID NO: 3543517 - DNA, 22 bp, Homo sapiens
ctcctggtaccaagctgctggg

SEQ ID NO: 3543518 - DNA, 13 bp, Homo sapiens
ctgaaatcagtct

SEQ ID NO: 3543519 - DNA, 17 bp, Homo sapiens
ctgaaattctaaatatt

SEQ ID NO: 3543520 - DNA, 20 bp, Homo sapiens
ctgaagggcttcttcttata

SEQ ID NO: 3543521 - DNA, 18 bp, Homo sapiens
ctgaccgtcgaccttggg

SEQ ID NO: 3543522 - DNA, 12 bp, Homo sapiens
ctgacttagcct

SEQ ID NO: 3543523 - DNA, 15 bp, Homo sapiens
ctgactttgttgcct

SEQ ID NO: 3543524 - DNA, 23 bp, Homo sapiens
ctgactttgttgccttatcttga

SEQ ID NO: 3543525 - DNA, 13 bp, Homo sapiens
ctgagcctctttt

SEQ ID NO: 3543526 - DNA, 21 bp, Homo sapiens
ctgattattcttcttacatta

SEQ ID NO: 3543527 - DNA, 17 bp, Homo sapiens
ctgattcaaaagtgaac

SEQ ID NO: 3543528 - DNA, 16 bp, Homo sapiens
ctggccagcatggtga

SEQ ID NO: 3543529 - DNA, 19 bp, Homo sapiens
ctggtttagtgttctgtat

SEQ ID NO: 3543530 - DNA, 11 bp, Homo sapiens
ctgtattttaa

SEQ ID NO: 3543531 - DNA, 14 bp, Homo sapiens
ctgtccaacatgtt

SEQ ID NO: 3543532 - DNA, 15 bp, Homo sapiens
ctgtgattttaaaat

SEQ ID NO: 3543533 - DNA, 22 bp, Homo sapiens
ctgttggttcatccagaagtgt

SEQ ID NO: 3543534 - DNA, 13 bp, Homo sapiens
cttaagcataaaa

SEQ ID NO: 3543535 - DNA, 22 bp, Homo sapiens
cttaagcataaaaattgaattc

SEQ ID NO: 3543536 - DNA, 22 bp, Homo sapiens
cttacattattaatcattccat

SEQ ID NO: 3543537 - DNA, 21 bp, Homo sapiens
cttactagaaatatattcata

SEQ ID NO: 3543538 - DNA, 18 bp, Homo sapiens
cttagactgaaaaactgt

SEQ ID NO: 3543539 - DNA, 16 bp, Homo sapiens
cttatctcatttctca

SEQ ID NO: 3543540 - DNA, 15 bp, Homo sapiens
cttatcttgaaaaga

SEQ ID NO: 3543541 - DNA, 20 bp, Homo sapiens
cttatcttgaaaagaatcta

SEQ ID NO: 3543542 - DNA, 11 bp, Homo sapiens
cttatttctgt

SEQ ID NO: 3543543 - DNA, 16 bp, Homo sapiens
cttcacagcagccact

SEQ ID NO: 3543544 - DNA, 15 bp, Homo sapiens
ttcaacatttcttga

SEQ ID NO: 3543545 - DNA, 13 bp, Homo sapiens
ttcactcagcact

SEQ ID NO: 3543546 - DNA, 21 bp, Homo sapiens
ttcataaactgagcctctttt

SEQ ID NO: 3543547 - DNA, 17 bp, Homo sapiens
ttcatattaccagaaaa

SEQ ID NO: 3543548 - DNA, 15 bp, Homo sapiens
ttcatggattattta

SEQ ID NO: 3543549 - DNA, 18 bp, Homo sapiens
ttcattgctcaacaagaa

SEQ ID NO: 3543550 - DNA, 18 bp, Homo sapiens
ttcccagagaacttcaca

SEQ ID NO: 3543551 - DNA, 16 bp, Homo sapiens
ttcccagagaagctca

SEQ ID NO: 3543552 - DNA, 22 bp, Homo sapiens
ttcctcttggagtctagaacat

SEQ ID NO: 3543553 - DNA, 16 bp, Homo sapiens
ttcctgcacctgctgt

SEQ ID NO: 3543554 - DNA, 19 bp, Homo sapiens
ttccttagctgtaaaatgg

SEQ ID NO: 3543555 - DNA, 14 bp, Homo sapiens
ttcctttccccctc

SEQ ID NO: 3543556 - DNA, 22 bp, Homo sapiens
ttctatcactggcaatatttgt

SEQ ID NO: 3543557 - DNA, 13 bp, Homo sapiens
ttctatcttcttt

SEQ ID NO: 3543558 - DNA, 15 bp, Homo sapiens
ttctcaacagttcat

SEQ ID NO: 3543559 - DNA, 16 bp, Homo sapiens
ttctcaacagttcatt

SEQ ID NO: 3543560 - DNA, 23 bp, Homo sapiens
ttctggtttagtgttctgtattt

SEQ ID NO: 3543561 - DNA, 20 bp, Homo sapiens
ttctgtaaaatttgtttaga

SEQ ID NO: 3543562 - DNA, 16 bp, Homo sapiens
ttgaaaaaatgttcta

SEQ ID NO: 3543563 - DNA, 16 bp, Homo sapiens
ttgaaggagaacctgt

SEQ ID NO: 3543564 - DNA, 12 bp, Homo sapiens
ttgaattcgttt

SEQ ID NO: 3543565 - DNA, 17 bp, Homo sapiens
ttgtgacgattatttat

SEQ ID NO: 3543566 - DNA, 16 bp, Homo sapiens
tttaaatcttcaatat

SEQ ID NO: 3543567 - DNA, 22 bp, Homo sapiens
tttaattcttatttctgtgtta

SEQ ID NO: 3543568 - DNA, 20 bp, Homo sapiens
tttaatttgaatcagagaaa

SEQ ID NO: 3543569 - DNA, 20 bp, Homo sapiens
tttacattctgtctgttttt

SEQ ID NO: 3543570 - DNA, 21 bp, Homo sapiens
tttatgaatgtgcatttcttg

SEQ ID NO: 3543571 - DNA, 12 bp, Homo sapiens
tttattaaataa

SEQ ID NO: 3543572 - DNA, 12 bp, Homo sapiens
tttatttccaaa

SEQ ID NO: 3543573 - DNA, 20 bp, Homo sapiens
tttgaagcctgctaaatgaa

SEQ ID NO: 3543574 - DNA, 23 bp, Homo sapiens
tttgtggcatacaacctgagcct

SEQ ID NO: 3543575 - DNA, 12 bp, Homo sapiens
tttgttgtactt

SEQ ID NO: 3543576 - DNA, 13 bp, Homo sapiens
tttgttgtacttt

SEQ ID NO: 3543577 - DNA, 16 bp, Homo sapiens
ttttaatttgaatcag

SEQ ID NO: 3543578 - DNA, 16 bp, Homo sapiens
ttttacattctgtctg

SEQ ID NO: 3543579 - DNA, 16 bp, Homo sapiens
ttttaccttaaatctg

SEQ ID NO: 3543580 - DNA, 14 bp, Homo sapiens
ttttattaaatctt

SEQ ID NO: 3543581 - DNA, 14 bp, Homo sapiens
ttttcataaactga

SEQ ID NO: 3543582 - DNA, 18 bp, Homo sapiens
ttttcataaactgagcct

SEQ ID NO: 3543583 - DNA, 12 bp, Homo sapiens
ttttccttagct

SEQ ID NO: 3543584 - DNA, 22 bp, Homo sapiens
ttttctgtatatgatatatatt

SEQ ID NO: 3543585 - DNA, 20 bp, Homo sapiens
ttttgaagcctgctaaatga

SEQ ID NO: 3543586 - DNA, 20 bp, Homo sapiens
ttttgctaccaaagaatgca

SEQ ID NO: 3543587 - DNA, 13 bp, Homo sapiens
ttttgctttgttt

SEQ ID NO: 3543588 - DNA, 16 bp, Homo sapiens
tttttaataatttcat

SEQ ID NO: 3543589 - DNA, 13 bp, Homo sapiens
tttttcttatcca

SEQ ID NO: 3543590 - DNA, 16 bp, Homo sapiens
tttttgcattattcat

SEQ ID NO: 3543591 - DNA, 15 bp, Homo sapiens
aaaaatgttctatat

SEQ ID NO: 3543592 - DNA, 12 bp, Homo sapiens
aaaaattgaatt

SEQ ID NO: 3543593 - DNA, 14 bp, Homo sapiens
aaaagaaatatatc

SEQ ID NO: 3543594 - DNA, 23 bp, Homo sapiens
aaaagaatctagataggtgcttt

SEQ ID NO: 3543595 - DNA, 15 bp, Homo sapiens
aaaagtaagaatgca

SEQ ID NO: 3543596 - DNA, 19 bp, Homo sapiens
aaaagtgaacttgatttta

SEQ ID NO: 3543597 - DNA, 11 bp, Homo sapiens
aaaatgttacc

SEQ ID NO: 3543598 - DNA, 20 bp, Homo sapiens
aaaattgtttttaatttgaa

SEQ ID NO: 3543599 - DNA, 22 bp, Homo sapiens
aaaattttctttcaacatttct

SEQ ID NO: 3543600 - DNA, 16 bp, Homo sapiens
aaacaacctggtgcat

SEQ ID NO: 3543601 - DNA, 19 bp, Homo sapiens
aaactgagcctcttttcaa

SEQ ID NO: 3543602 - DNA, 14 bp, Homo sapiens
aaacttaagcataa

SEQ ID NO: 3543603 - DNA, 17 bp, Homo sapiens
aaagaatgcatgttctg

SEQ ID NO: 3543604 - DNA, 18 bp, Homo sapiens
aaagagaaatgatgtgaa

SEQ ID NO: 3543605 - DNA, 15 bp, Homo sapiens
aaagataaatgatga

SEQ ID NO: 3543606 - DNA, 13 bp, Homo sapiens
aaagcaatatttc

SEQ ID NO: 3543607 - DNA, 22 bp, Homo sapiens
aaagcagcacatggtgttgtat

SEQ ID NO: 3543608 - DNA, 15 bp, Homo sapiens
aaagtttatttcatg

SEQ ID NO: 3543609 - DNA, 15 bp, Homo sapiens
aaatatattcataat

SEQ ID NO: 3543610 - DNA, 19 bp, Homo sapiens
aaatccctatgttgctata

SEQ ID NO: 3543611 - DNA, 14 bp, Homo sapiens
aaatgatgattcgt

SEQ ID NO: 3543612 - DNA, 14 bp, Homo sapiens
aaatgatgtgaaag

SEQ ID NO: 3543613 - DNA, 22 bp, Homo sapiens
aaatgttctatatgcatttaat

SEQ ID NO: 3543614 - DNA, 13 bp, Homo sapiens
aaattgttcatgt

SEQ ID NO: 3543615 - DNA, 23 bp, Homo sapiens
aacaacctggtgcatcgaaatgt

SEQ ID NO: 3543616 - DNA, 18 bp, Homo sapiens
aacaagggctacctctga

SEQ ID NO: 3543617 - DNA, 13 bp, Homo sapiens
aacatttcttgaa

SEQ ID NO: 3543618 - DNA, 21 bp, Homo sapiens
aacctaatgggaatcattcca

SEQ ID NO: 3543619 - DNA, 21 bp, Homo sapiens
aacctggtgcatcgaaatgta

SEQ ID NO: 3543620 - DNA, 19 bp, Homo sapiens
aactggggtattaactttt

SEQ ID NO: 3543621 - DNA, 13 bp, Homo sapiens
aactgttgacata

SEQ ID NO: 3543622 - DNA, 18 bp, Homo sapiens
aactgttgacatacaaac

SEQ ID NO: 3543623 - DNA, 14 bp, Homo sapiens
aacttgattttaaa

SEQ ID NO: 3543624 - DNA, 15 bp, Homo sapiens
aagaaagcaaataag

SEQ ID NO: 3543625 - DNA, 11 bp, Homo sapiens
aagaaatatat

SEQ ID NO: 3543626 - DNA, 20 bp, Homo sapiens
aagaatctagataggtgctt

SEQ ID NO: 3543627 - DNA, 12 bp, Homo sapiens
aagaatgcaaaa

SEQ ID NO: 3543628 - DNA, 18 bp, Homo sapiens
aagactagttatatattc

SEQ ID NO: 3543629 - DNA, 17 bp, Homo sapiens
aagagcaatcaaagcag

SEQ ID NO: 3543630 - DNA, 14 bp, Homo sapiens
aagatacatgctaa

SEQ ID NO: 3543631 - DNA, 23 bp, Homo sapiens
aagatgtaactaggccatttgta

SEQ ID NO: 3543632 - DNA, 14 bp, Homo sapiens
aagcaatatttccc

SEQ ID NO: 3543633 - DNA, 15 bp, Homo sapiens
aagcataaaaattga

SEQ ID NO: 3543634 - DNA, 16 bp, Homo sapiens
aagcataaaaattgaa

SEQ ID NO: 3543635 - DNA, 19 bp, Homo sapiens
aagcctgctaaatgaagag

SEQ ID NO: 3543636 - DNA, 12 bp, Homo sapiens
aaggagcagtgg

SEQ ID NO: 3543637 - DNA, 21 bp, Homo sapiens
aaggcttttgatccttttgag

SEQ ID NO: 3543638 - DNA, 17 bp, Homo sapiens
aagggaaaggaaaagaa

SEQ ID NO: 3543639 - DNA, 18 bp, Homo sapiens
aagtaaagtttatttcat

SEQ ID NO: 3543640 - DNA, 19 bp, Homo sapiens
aagtaactgttttcttctt

SEQ ID NO: 3543641 - DNA, 16 bp, Homo sapiens
aagtacgtttttgcat

SEQ ID NO: 3543642 - DNA, 21 bp, Homo sapiens
aagtgcaccaggtcactctga

SEQ ID NO: 3543643 - DNA, 14 bp, Homo sapiens
aataaaatgaaaaa

SEQ ID NO: 3543644 - DNA, 14 bp, Homo sapiens
aataaatattttac

SEQ ID NO: 3543645 - DNA, 16 bp, Homo sapiens
aataacatgatactat

SEQ ID NO: 3543646 - DNA, 21 bp, Homo sapiens
aataacatgatactattcaga

SEQ ID NO: 3543647 - DNA, 12 bp, Homo sapiens
aataatttcatc

SEQ ID NO: 3543648 - DNA, 16 bp, Homo sapiens
aatacaggtaacatta

SEQ ID NO: 3543649 - DNA, 23 bp, Homo sapiens
aatacaggtaacattataaatga

SEQ ID NO: 3543650 - DNA, 21 bp, Homo sapiens
aataggtggaaagagaaatga

SEQ ID NO: 3543651 - DNA, 22 bp, Homo sapiens
aatagtgtgtcaagattgcaaa

SEQ ID NO: 3543652 - DNA, 22 bp, Homo sapiens
aatataataattagccaggcgt

SEQ ID NO: 3543653 - DNA, 14 bp, Homo sapiens
aatatataaaagaa

SEQ ID NO: 3543654 - DNA, 20 bp, Homo sapiens
aatatttgtaggccaggcgt

SEQ ID NO: 3543655 - DNA, 17 bp, Homo sapiens
gtatcatttctaatttt

SEQ ID NO: 3543656 - DNA, 14 bp, Homo sapiens
gtcacaatttcaga

SEQ ID NO: 3543657 - DNA, 18 bp, Homo sapiens
gtcacatatgtctgtatc

SEQ ID NO: 3543658 - DNA, 17 bp, Homo sapiens
gtcatagggctgataat

SEQ ID NO: 3543659 - DNA, 24 bp, Homo sapiens
gtcatgatggatggaaatatgttc

SEQ ID NO: 3543660 - DNA, 15 bp, Homo sapiens
gtcattttctattca

SEQ ID NO: 3543661 - DNA, 16 bp, Homo sapiens
gtccaacatgttttat

SEQ ID NO: 3543662 - DNA, 18 bp, Homo sapiens
gtcgtcacctgggcggcc

SEQ ID NO: 3543663 - DNA, 20 bp, Homo sapiens
gtcttaaataaatcaagaat

SEQ ID NO: 3543664 - DNA, 14 bp, Homo sapiens
gtgacgattattta

SEQ ID NO: 3543665 - DNA, 14 bp, Homo sapiens
gtgattgtggcatt

SEQ ID NO: 3543666 - DNA, 15 bp, Homo sapiens
gtgcatcgaaatgta

SEQ ID NO: 3543667 - DNA, 19 bp, Homo sapiens
gtgcatcgaaatgtattca

SEQ ID NO: 3543668 - DNA, 23 bp, Homo sapiens
gtgcatcgaaatgtattcacctt

SEQ ID NO: 3543669 - DNA, 16 bp, Homo sapiens
gtggaaagagaaatga

SEQ ID NO: 3543670 - DNA, 15 bp, Homo sapiens
gtggagattggatca

SEQ ID NO: 3543671 - DNA, 20 bp, Homo sapiens
gtgtgtcaagattgcaaagt

SEQ ID NO: 3543672 - DNA, 24 bp, Homo sapiens
gttctcatcccagtctgatattca

SEQ ID NO: 3543673 - DNA, 21 bp, Homo sapiens
gtttgagactagcctggccag

SEQ ID NO: 3543674 - DNA, 16 bp, Homo sapiens
gttttatgaaaccaac

SEQ ID NO: 3543675 - DNA, 14 bp, Homo sapiens
taaaagaaatatat

SEQ ID NO: 3543676 - DNA, 18 bp, Homo sapiens
taaaattatttttattaa

SEQ ID NO: 3543677 - DNA, 19 bp, Homo sapiens
taaaattatttttattaaa

SEQ ID NO: 3543678 - DNA, 20 bp, Homo sapiens
taaaattatttttattaaat

SEQ ID NO: 3543679 - DNA, 20 bp, Homo sapiens
taaagtttatttcatggatt

SEQ ID NO: 3543680 - DNA, 19 bp, Homo sapiens
taaataaatcaagaatcat

SEQ ID NO: 3543681 - DNA, 10 bp, Homo sapiens
taaatatttt

SEQ ID NO: 3543682 - DNA, 15 bp, Homo sapiens
taaatattttacagt

SEQ ID NO: 3543683 - DNA, 18 bp, Homo sapiens
taaatggagaaagctgtg

SEQ ID NO: 3543684 - DNA, 15 bp, Homo sapiens
taacattataaatga

SEQ ID NO: 3543685 - DNA, 16 bp, Homo sapiens
taacattataaatgac

SEQ ID NO: 3543686 - DNA, 17 bp, Homo sapiens
taacattataaatgaca

SEQ ID NO: 3543687 - DNA, 23 bp, Homo sapiens
taactaggccatttgtatttgta

SEQ ID NO: 3543688 - DNA, 23 bp, Homo sapiens
taactggggtattaactttttta

SEQ ID NO: 3543689 - DNA, 23 bp, Homo sapiens
taactgttttcttcttggtgcta

SEQ ID NO: 3543690 - DNA, 22 bp, Homo sapiens
taaggtgtacgtatcatttcta

SEQ ID NO: 3543691 - DNA, 20 bp, Homo sapiens
taagtgaaaataatttgttg

SEQ ID NO: 3543692 - DNA, 13 bp, Homo sapiens
taataatttcatc

SEQ ID NO: 3543693 - DNA, 23 bp, Homo sapiens
taattccaagattaaaagttcat

SEQ ID NO: 3543694 - DNA, 14 bp, Homo sapiens
taatttgaatcaga

SEQ ID NO: 3543695 - DNA, 15 bp, Homo sapiens
taatttgttgtactt

SEQ ID NO: 3543696 - DNA, 19 bp, Homo sapiens
tacattattaatcattcca

SEQ ID NO: 3543697 - DNA, 21 bp, Homo sapiens
tacattattaatcattccatt

SEQ ID NO: 3543698 - DNA, 15 bp, Homo sapiens
taccaagctgctggg

SEQ ID NO: 3543699 - DNA, 20 bp, Homo sapiens
taccagtgttaataaatgga

SEQ ID NO: 3543700 - DNA, 14 bp, Homo sapiens
tacgtatcatttct

SEQ ID NO: 3543701 - DNA, 16 bp, Homo sapiens
tactaaggagcctaac

SEQ ID NO: 3543702 - DNA, 19 bp, Homo sapiens
tactcatgtacattggtct

SEQ ID NO: 3543703 - DNA, 13 bp, Homo sapiens
tactccgaaacaa

SEQ ID NO: 3543704 - DNA, 18 bp, Homo sapiens
tactgattattcttctta

SEQ ID NO: 3543705 - DNA, 23 bp, Homo sapiens
tagaaaattgtttttaatttgaa

SEQ ID NO: 3543706 - DNA, 17 bp, Homo sapiens
tagaacatccttaaatg

SEQ ID NO: 3543707 - DNA, 22 bp, Homo sapiens
tagaacatccttaaatgtctaa

SEQ ID NO: 3543708 - DNA, 24 bp, Homo sapiens
tagaagtgcaccaggtcactctga

SEQ ID NO: 3543709 - DNA, 15 bp, Homo sapiens
tagagaatgaaagga

SEQ ID NO: 3543710 - DNA, 16 bp, Homo sapiens
taggatagatgtgatt

SEQ ID NO: 3543711 - DNA, 15 bp, Homo sapiens
taggccatttgtatt

SEQ ID NO: 3543712 - DNA, 23 bp, Homo sapiens
tagggctgataatacacacagtt

SEQ ID NO: 3543713 - DNA, 18 bp, Homo sapiens
taggtggaaagagaaatg

SEQ ID NO: 3543714 - DNA, 21 bp, Homo sapiens
taggtggaaagagaaatgatg

SEQ ID NO: 3543715 - DNA, 13 bp, Homo sapiens
tagtagtgggaaa

SEQ ID NO: 3543716 - DNA, 21 bp, Homo sapiens
tagtatatgtcagacatgaaa

SEQ ID NO: 3543717 - DNA, 14 bp, Homo sapiens
tagtgggaaagata

SEQ ID NO: 3543718 - DNA, 13 bp, Homo sapiens
tagttttctgtat

SEQ ID NO: 3543719 - DNA, 19 bp, Homo sapiens
tataaatgacagatctcaa

SEQ ID NO: 3543720 - DNA, 13 bp, Homo sapiens
tatacaattcagt

SEQ ID NO: 3543721 - DNA, 23 bp, Homo sapiens
tataggtcacatatgtctgtatc

SEQ ID NO: 3543722 - DNA, 16 bp, Homo sapiens
tatataaaagaaatat

SEQ ID NO: 3543723 - DNA, 22 bp, Homo sapiens
tatatattatcttatactgaaa

SEQ ID NO: 3543724 - DNA, 22 bp, Homo sapiens
tatatattccttactagaaata

SEQ ID NO: 3543725 - DNA, 17 bp, Homo sapiens
tatattccttactagaa

SEQ ID NO: 3543726 - DNA, 18 bp, Homo sapiens
tatattccttactagaaa

SEQ ID NO: 3543727 - DNA, 16 bp, Homo sapiens
tatcctagaaaattgt

SEQ ID NO: 3543728 - DNA, 16 bp, Homo sapiens
tatcttatactgaaaa

SEQ ID NO: 3543729 - DNA, 14 bp, Homo sapiens
tatcttgaaaagaa

SEQ ID NO: 3543730 - DNA, 19 bp, Homo sapiens
tatgaatgtgcatttcttg

SEQ ID NO: 3543731 - DNA, 13 bp, Homo sapiens
tatgaatgttctt

SEQ ID NO: 3543732 - DNA, 19 bp, Homo sapiens
tatgcatttaattctgaaa

SEQ ID NO: 3543733 - DNA, 14 bp, Homo sapiens
tatgcttcccagag

SEQ ID NO: 3543734 - DNA, 16 bp, Homo sapiens
tatgttgctataagaa

SEQ ID NO: 3543735 - DNA, 22 bp, Homo sapiens
tatgttgctataagaaaagtga

SEQ ID NO: 3543736 - DNA, 13 bp, Homo sapiens
tattaactttttt

SEQ ID NO: 3543737 - DNA, 13 bp, Homo sapiens
tattaatcattcc

SEQ ID NO: 3543738 - DNA, 14 bp, Homo sapiens
tattaatcattcca

SEQ ID NO: 3543739 - DNA, 15 bp, Homo sapiens
tattaccagaaaatg

SEQ ID NO: 3543740 - DNA, 16 bp, Homo sapiens
tattaccagaaaatga

SEQ ID NO: 3543741 - DNA, 19 bp, Homo sapiens
tattccttactagaaatat

SEQ ID NO: 3543742 - DNA, 14 bp, Homo sapiens
tattgtcttaaata

SEQ ID NO: 3543743 - DNA, 23 bp, Homo sapiens
tattgtcttaaataaatcaagaa

SEQ ID NO: 3543744 - DNA, 22 bp, Homo sapiens
tatttatgaatgtgcatttctt

SEQ ID NO: 3543745 - DNA, 19 bp, Homo sapiens
tatttccaaaataaaatga

SEQ ID NO: 3543746 - DNA, 20 bp, Homo sapiens
tatttctgtaaaatttgttt

SEQ ID NO: 3543747 - DNA, 13 bp, Homo sapiens
tatttctgtgtta

SEQ ID NO: 3543748 - DNA, 17 bp, Homo sapiens
tcaaaagtaagaatgca

SEQ ID NO: 3543749 - DNA, 17 bp, Homo sapiens
tcaacaagaacgattca

SEQ ID NO: 3543750 - DNA, 16 bp, Homo sapiens
tcaacagttcattgct

SEQ ID NO: 3543751 - DNA, 16 bp, Homo sapiens
tcaataggaattgcat

SEQ ID NO: 3543752 - DNA, 13 bp, Homo sapiens
tcaattatttcaa

SEQ ID NO: 3543753 - DNA, 21 bp, Homo sapiens
tcaatttaattcttatttctg

SEQ ID NO: 3543754 - DNA, 15 bp, Homo sapiens
tcacaacctaaatgg

SEQ ID NO: 3543755 - DNA, 20 bp, Homo sapiens
tcagacatgaaaactatttt

SEQ ID NO: 3543756 - DNA, 13 bp, Homo sapiens
tcaggttgtctgt

SEQ ID NO: 3543757 - DNA, 20 bp, Homo sapiens
tcaggttgtctgtagagaat

SEQ ID NO: 3543758 - DNA, 16 bp, Homo sapiens
tcatagggctgataat

SEQ ID NO: 3543759 - DNA, 15 bp, Homo sapiens
tcatatgaatgttct

SEQ ID NO: 3543760 - DNA, 14 bp, Homo sapiens
tcatattaccagaa

SEQ ID NO: 3543761 - DNA, 12 bp, Homo sapiens
tcattactttct

SEQ ID NO: 3543762 - DNA, 22 bp, Homo sapiens
tcattgctcaacaagaacgatt

SEQ ID NO: 3543763 - DNA, 12 bp, Homo sapiens
tcattttctatt

SEQ ID NO: 3543764 - DNA, 16 bp, Homo sapiens
tccaagattaaaagtt

SEQ ID NO: 3543765 - DNA, 19 bp, Homo sapiens
gagagtacatttgctttaa

SEQ ID NO: 3543766 - DNA, 16 bp, Homo sapiens
gagagtcaaagctgac

SEQ ID NO: 3543767 - DNA, 14 bp, Homo sapiens
gagagttccgggga

SEQ ID NO: 3543768 - DNA, 20 bp, Homo sapiens
gagagttctttgctgcccct

SEQ ID NO: 3543769 - DNA, 15 bp, Homo sapiens
gagatactggtggaa

SEQ ID NO: 3543770 - DNA, 11 bp, Homo sapiens
gagatactgtg

SEQ ID NO: 3543771 - DNA, 12 bp, Homo sapiens
gagatactgtgt

SEQ ID NO: 3543772 - DNA, 17 bp, Homo sapiens
gagatctttctttccaa

SEQ ID NO: 3543773 - DNA, 14 bp, Homo sapiens
gagatgctgtgccc

SEQ ID NO: 3543774 - DNA, 13 bp, Homo sapiens
gagatggaagctt

SEQ ID NO: 3543775 - DNA, 15 bp, Homo sapiens
gagatggaagcttgt

SEQ ID NO: 3543776 - DNA, 18 bp, Homo sapiens
gagatggaagcttgttga

SEQ ID NO: 3543777 - DNA, 23 bp, Homo sapiens
gagatggactcaggatccagtga

SEQ ID NO: 3543778 - DNA, 14 bp, Homo sapiens
gagatggagggctt

SEQ ID NO: 3543779 - DNA, 15 bp, Homo sapiens
gagatggagggcttg

SEQ ID NO: 3543780 - DNA, 18 bp, Homo sapiens
gagatggagtttctctct

SEQ ID NO: 3543781 - DNA, 15 bp, Homo sapiens
gagatggccatgctc

SEQ ID NO: 3543782 - DNA, 15 bp, Homo sapiens
gagatttggaataca

SEQ ID NO: 3543783 - DNA, 15 bp, Homo sapiens
gagcaaaagaaacac

SEQ ID NO: 3543784 - DNA, 22 bp, Homo sapiens
gagcaaaagaaacaccagtgtt

SEQ ID NO: 3543785 - DNA, 12 bp, Homo sapiens
gagcaaaataat

SEQ ID NO: 3543786 - DNA, 11 bp, Homo sapiens
gagcaagagga

SEQ ID NO: 3543787 - DNA, 13 bp, Homo sapiens
gagcaagccggca

SEQ ID NO: 3543788 - DNA, 19 bp, Homo sapiens
gagcacaaagaagaaagct

SEQ ID NO: 3543789 - DNA, 22 bp, Homo sapiens
gagcacccagagcaccccctgc

SEQ ID NO: 3543790 - DNA, 16 bp, Homo sapiens
gagcacccattccaaa

SEQ ID NO: 3543791 - DNA, 15 bp, Homo sapiens
gagcaccccctgctc

SEQ ID NO: 3543792 - DNA, 16 bp, Homo sapiens
gagcaccccctgctcc

SEQ ID NO: 3543793 - DNA, 17 bp, Homo sapiens
gagcaccccctgctcca

SEQ ID NO: 3543794 - DNA, 13 bp, Homo sapiens
gagcactgaacca

SEQ ID NO: 3543795 - DNA, 17 bp, Homo sapiens
gagcactgaaccacatt

SEQ ID NO: 3543796 - DNA, 14 bp, Homo sapiens
gagcagcagcacca

SEQ ID NO: 3543797 - DNA, 15 bp, Homo sapiens
gagcagcaggcctct

SEQ ID NO: 3543798 - DNA, 16 bp, Homo sapiens
gagcagcaggcctctg

SEQ ID NO: 3543799 - DNA, 13 bp, Homo sapiens
gagcagcccaggg

SEQ ID NO: 3543800 - DNA, 17 bp, Homo sapiens
gagcagcccagggccta

SEQ ID NO: 3543801 - DNA, 19 bp, Homo sapiens
gagcagcccccgggccgct

SEQ ID NO: 3543802 - DNA, 15 bp, Homo sapiens
gagcagccgccagct

SEQ ID NO: 3543803 - DNA, 13 bp, Homo sapiens
gagcaggagcccc

SEQ ID NO: 3543804 - DNA, 14 bp, Homo sapiens
gccagtgcagccac

SEQ ID NO: 3543805 - DNA, 17 bp, Homo sapiens
gccagtgcagccactgg

SEQ ID NO: 3543806 - DNA, 15 bp, Homo sapiens
gccagtgggaccctc

SEQ ID NO: 3543807 - DNA, 18 bp, Homo sapiens
gccagtgtctaggcactg

SEQ ID NO: 3543808 - DNA, 22 bp, Homo sapiens
gccagttatggctataggtgct

SEQ ID NO: 3543809 - DNA, 19 bp, Homo sapiens
gccagttttccctggaact

SEQ ID NO: 3543810 - DNA, 20 bp, Homo sapiens
gccataaacggttcctggtg

SEQ ID NO: 3543811 - DNA, 23 bp, Homo sapiens
gccataaacggttcctggtgact

SEQ ID NO: 3543812 - DNA, 13 bp, Homo sapiens
gccataacttgaa

SEQ ID NO: 3543813 - DNA, 15 bp, Homo sapiens
gccataacttgaaaa

SEQ ID NO: 3543814 - DNA, 17 bp, Homo sapiens
gccataatgttgcttct

SEQ ID NO: 3543815 - DNA, 19 bp, Homo sapiens
gccatacataaaagaaata

SEQ ID NO: 3543816 - DNA, 15 bp, Homo sapiens
gccatatgtaacatc

SEQ ID NO: 3543817 - DNA, 15 bp, Homo sapiens
gccatccttctgtgt

SEQ ID NO: 3543818 - DNA, 18 bp, Homo sapiens
gccatcgccgggactcca

SEQ ID NO: 3543819 - DNA, 22 bp, Homo sapiens
gccatcgcgggatggtgcagac

SEQ ID NO: 3543820 - DNA, 12 bp, Homo sapiens
gccatctctgct

SEQ ID NO: 3543821 - DNA, 17 bp, Homo sapiens
gccatctgactgccaag

SEQ ID NO: 3543822 - DNA, 20 bp, Homo sapiens
gccatctggagagcccagag

SEQ ID NO: 3543823 - DNA, 14 bp, Homo sapiens
gccatcttctttct

SEQ ID NO: 3543824 - DNA, 22 bp, Homo sapiens
gccatgataataggtcatatgt

SEQ ID NO: 3543825 - DNA, 13 bp, Homo sapiens
gccatgatgtcct

SEQ ID NO: 3543826 - DNA, 21 bp, Homo sapiens
gccatgctcaacccccctccc

SEQ ID NO: 3543827 - DNA, 22 bp, Homo sapiens
gccatgctcaacccccctccca

SEQ ID NO: 3543828 - DNA, 13 bp, Homo sapiens
gccatgctgggcc

SEQ ID NO: 3543829 - DNA, 22 bp, Homo sapiens
gccatgctgggccactggggac

SEQ ID NO: 3543830 - DNA, 17 bp, Homo sapiens
gccatgtataaatgtga

SEQ ID NO: 3543831 - DNA, 18 bp, Homo sapiens
gccatgtggggttgctga

SEQ ID NO: 3543832 - DNA, 20 bp, Homo sapiens
gccatttccaagaggctgta

SEQ ID NO: 3543833 - DNA, 15 bp, Homo sapiens
gccatttttacatct

SEQ ID NO: 3543834 - DNA, 14 bp, Homo sapiens
gcccaaacccttaa

SEQ ID NO: 3543835 - DNA, 16 bp, Homo sapiens
gcccaaacccttaact

SEQ ID NO: 3543836 - DNA, 19 bp, Homo sapiens
gcccaaccatcggtccaca

SEQ ID NO: 3543837 - DNA, 22 bp, Homo sapiens
gcccaacctacattccaccctg

SEQ ID NO: 3543838 - DNA, 24 bp, Homo sapiens
gcccaacctctgtggtcacccatg

SEQ ID NO: 3543839 - DNA, 22 bp, Homo sapiens
gcccaagaatagatgctgactg

SEQ ID NO: 3543840 - DNA, 19 bp, Homo sapiens
gcccaagggatctggtcct

SEQ ID NO: 3543841 - DNA, 13 bp, Homo sapiens
gcccaatgctgct

SEQ ID NO: 3543842 - DNA, 18 bp, Homo sapiens
gcccaatgctgcttttgg

SEQ ID NO: 3543843 - DNA, 13 bp, Homo sapiens
gcccacacctggt

SEQ ID NO: 3543844 - DNA, 16 bp, Homo sapiens
gcccaccatctgtttg

SEQ ID NO: 3543845 - DNA, 18 bp, Homo sapiens
gcccactccccagcccca

SEQ ID NO: 3543846 - DNA, 17 bp, Homo sapiens
gcccactgtcctgggcc

SEQ ID NO: 3543847 - DNA, 18 bp, Homo sapiens
gcccactgtcctgggcct

SEQ ID NO: 3543848 - DNA, 10 bp, Homo sapiens
gcccagagac

SEQ ID NO: 3543849 - DNA, 20 bp, Homo sapiens
gcccagagacatacttgaag

SEQ ID NO: 3543850 - DNA, 23 bp, Homo sapiens
gcccagagacatacttgaagggc

SEQ ID NO: 3543851 - DNA, 19 bp, Homo sapiens
gcccagagacccaagctgc

SEQ ID NO: 3543852 - DNA, 14 bp, Homo sapiens
gcccagagccacct

SEQ ID NO: 3543853 - DNA, 14 bp, Homo sapiens
gcccagagcccagc

SEQ ID NO: 3543854 - DNA, 18 bp, Homo sapiens
gcccagagggtggcaaga

SEQ ID NO: 3543855 - DNA, 16 bp, Homo sapiens
gcccagagtcccccca

SEQ ID NO: 3543856 - DNA, 18 bp, Homo sapiens
gcccagagtccccccact

SEQ ID NO: 3543857 - DNA, 23 bp, Homo sapiens
gcccagagtccccccactcccag

SEQ ID NO: 3543858 - DNA, 15 bp, Homo sapiens
gcccagcctgggagc

SEQ ID NO: 3543859 - DNA, 14 bp, Homo sapiens
gcccagcgccaagt

SEQ ID NO: 3543860 - DNA, 15 bp, Homo sapiens
gcccagcgccaagta

SEQ ID NO: 3543861 - DNA, 18 bp, Homo sapiens
gcccaggaccatcatcct

SEQ ID NO: 3543862 - DNA, 22 bp, Homo sapiens
gcccaggagacagaccacttgc

SEQ ID NO: 3543863 - DNA, 19 bp, Homo sapiens
gcccaggagacctccagct

SEQ ID NO: 3543864 - DNA, 20 bp, Homo sapiens
gcccaggagacctccagcta

SEQ ID NO: 3543865 - DNA, 20 bp, Homo sapiens
gcccaggcagcctccgggcg

SEQ ID NO: 3543866 - DNA, 15 bp, Homo sapiens
gcccagggccagtgg

SEQ ID NO: 3543867 - DNA, 17 bp, Homo sapiens
gcccagggcccagagcc

SEQ ID NO: 3543868 - DNA, 14 bp, Homo sapiens
gcccagtaaaattt

SEQ ID NO: 3543869 - DNA, 14 bp, Homo sapiens
gcccagtcgacccc

SEQ ID NO: 3543870 - DNA, 15 bp, Homo sapiens
gcccagtcgacccca

SEQ ID NO: 3543871 - DNA, 15 bp, Homo sapiens
gcccagtgccagcaa

SEQ ID NO: 3543872 - DNA, 21 bp, Homo sapiens
gcccagtgccagcaagtcctt

SEQ ID NO: 3543873 - DNA, 18 bp, Homo sapiens
gcccatgtgtacattctg

SEQ ID NO: 3543874 - DNA, 20 bp, Homo sapiens
gcccatgtgtacattctgcc

SEQ ID NO: 3543875 - DNA, 21 bp, Homo sapiens
gcccatgtgtacattctgcct

SEQ ID NO: 3543876 - DNA, 19 bp, Homo sapiens
gcccatttgggcagagagg

SEQ ID NO: 3543877 - DNA, 13 bp, Homo sapiens
gccccacaggact

SEQ ID NO: 3543878 - DNA, 14 bp, Homo sapiens
gccccaccactccc

SEQ ID NO: 3543879 - DNA, 19 bp, Homo sapiens
gccccaccactccccaacc

SEQ ID NO: 3543880 - DNA, 21 bp, Homo sapiens
gccccaccccacctcacagct

SEQ ID NO: 3543881 - DNA, 22 bp, Homo sapiens
gccccaccccatccagccagac

SEQ ID NO: 3543882 - DNA, 15 bp, Homo sapiens
gccccaccggccagg

SEQ ID NO: 3543883 - DNA, 17 bp, Homo sapiens
gccccaccggccaggcc

SEQ ID NO: 3543884 - DNA, 21 bp, Homo sapiens
gccccacttctggccacatca

SEQ ID NO: 3543885 - DNA, 12 bp, Homo sapiens
gccccagaggcc

SEQ ID NO: 3543886 - DNA, 15 bp, Homo sapiens
gccccagaggccctg

SEQ ID NO: 3543887 - DNA, 17 bp, Homo sapiens
gccccagaggccctgga

SEQ ID NO: 3543888 - DNA, 18 bp, Homo sapiens
gccccagaggccctggag

SEQ ID NO: 3543889 - DNA, 19 bp, Homo sapiens
gccccagaggccctggagg

SEQ ID NO: 3543890 - DNA, 22 bp, Homo sapiens
gccccagaggccctggaggtct

SEQ ID NO: 3543891 - DNA, 15 bp, Homo sapiens
gccccagcttggctc

SEQ ID NO: 3543892 - DNA, 17 bp, Homo sapiens
gccccagcttgggcaga

SEQ ID NO: 3543893 - DNA, 15 bp, Homo sapiens
gccccaggaaaggcc

SEQ ID NO: 3543894 - DNA, 22 bp, Homo sapiens
gccccaggaaaggcccagccac

SEQ ID NO: 3543895 - DNA, 16 bp, Homo sapiens
gccccaggaccagctc

SEQ ID NO: 3543896 - DNA, 22 bp, Homo sapiens
gccccaggaccagctcaggaca

SEQ ID NO: 3543897 - DNA, 24 bp, Homo sapiens
gccccaggaccagctcaggacaga

SEQ ID NO: 3543898 - DNA, 12 bp, Homo sapiens
gccccaggagaa

SEQ ID NO: 3543899 - DNA, 19 bp, Homo sapiens
gccccagtgcggttcctca

SEQ ID NO: 3543900 - DNA, 19 bp, Homo sapiens
gccccatccctgcttgccc

SEQ ID NO: 3543901 - DNA, 12 bp, Homo sapiens
gccccatcctca

SEQ ID NO: 3543902 - DNA, 18 bp, Homo sapiens
gccccatcctcatccctg

SEQ ID NO: 3543903 - DNA, 18 bp, Homo sapiens
gccccatggcagctcctg

SEQ ID NO: 3543904 - DNA, 22 bp, Homo sapiens
gccccatggcagctcctgacct

SEQ ID NO: 3543905 - DNA, 14 bp, Homo sapiens
gccccattcctaag

SEQ ID NO: 3543906 - DNA, 16 bp, Homo sapiens
gccccattcctaagag

SEQ ID NO: 3543907 - DNA, 20 bp, Homo sapiens
gcccccaccgaggttcccag

SEQ ID NO: 3543908 - DNA, 16 bp, Homo sapiens
gcccccacctccaccc

SEQ ID NO: 3543909 - DNA, 16 bp, Homo sapiens
gcccccagaaagcctc

SEQ ID NO: 3543910 - DNA, 17 bp, Homo sapiens
gcccccagaaagcctcc

SEQ ID NO: 3543911 - DNA, 14 bp, Homo sapiens
gcccccagccctgg

SEQ ID NO: 3543912 - DNA, 17 bp, Homo sapiens
gcccccagccctgggaa

SEQ ID NO: 3543913 - DNA, 18 bp, Homo sapiens
gcccccagccctgggaac

SEQ ID NO: 3543914 - DNA, 15 bp, Homo sapiens
gcccccagctaagaa

SEQ ID NO: 3543915 - DNA, 18 bp, Homo sapiens
gcccccagggcctccagg

SEQ ID NO: 3543916 - DNA, 20 bp, Homo sapiens
gcccccagggcctccagggc

SEQ ID NO: 3543917 - DNA, 19 bp, Homo sapiens
gcccccattcccagcctga

SEQ ID NO: 3543918 - DNA, 17 bp, Homo sapiens
gcccccccccacccctg

SEQ ID NO: 3543919 - DNA, 20 bp, Homo sapiens
gccccccgcgcgcccaccct

SEQ ID NO: 3543920 - DNA, 15 bp, Homo sapiens
gccccctccaggaga

SEQ ID NO: 3543921 - DNA, 18 bp, Homo sapiens
gccccctgggctggggcc

SEQ ID NO: 3543922 - DNA, 16 bp, Homo sapiens
gcccccttcaggagcc

SEQ ID NO: 3543923 - DNA, 19 bp, Homo sapiens
gcccccttcaggagcctgg

SEQ ID NO: 3543924 - DNA, 23 bp, Homo sapiens
gcccccttcaggagcctggccag

SEQ ID NO: 3543925 - DNA, 13 bp, Homo sapiens
gccccgacacacg

SEQ ID NO: 3543926 - DNA, 21 bp, Homo sapiens
gccccgacgtttgcggcagtg

SEQ ID NO: 3543927 - DNA, 19 bp, Homo sapiens
gccccgagcccaggcagct

SEQ ID NO: 3543928 - DNA, 20 bp, Homo sapiens
gccccgcagacggtctgtgt

SEQ ID NO: 3543929 - DNA, 19 bp, Homo sapiens
gccccgccagggctgggga

SEQ ID NO: 3543930 - DNA, 20 bp, Homo sapiens
gccccgccagggctggggac

SEQ ID NO: 3543931 - DNA, 17 bp, Homo sapiens
gccccgccccagagctc

SEQ ID NO: 3543932 - DNA, 19 bp, Homo sapiens
ggcaggtgtgggatctggg

SEQ ID NO: 3543933 - DNA, 18 bp, Homo sapiens
ggcagtgactccccagcc

SEQ ID NO: 3543934 - DNA, 21 bp, Homo sapiens
ggcagtgactccccagcccag

SEQ ID NO: 3543935 - DNA, 22 bp, Homo sapiens
ggcagtgactccccagcccagc

SEQ ID NO: 3543936 - DNA, 17 bp, Homo sapiens
ggcagtgattctgtttg

SEQ ID NO: 3543937 - DNA, 21 bp, Homo sapiens
ggcagtgggacagggcatggc

SEQ ID NO: 3543938 - DNA, 12 bp, Homo sapiens
ggcataaagtaa

SEQ ID NO: 3543939 - DNA, 21 bp, Homo sapiens
ggcatactgccttgtttaatg

SEQ ID NO: 3543940 - DNA, 20 bp, Homo sapiens
ggcatcctcaggtggtcagg

SEQ ID NO: 3543941 - DNA, 23 bp, Homo sapiens
ggcatctctccccatatataaat

SEQ ID NO: 3543942 - DNA, 16 bp, Homo sapiens
ggcatcttggaaaagg

SEQ ID NO: 3543943 - DNA, 23 bp, Homo sapiens
ggcatgggtccagggcctgacac

SEQ ID NO: 3543944 - DNA, 21 bp, Homo sapiens
ggcatggtggctcatgcctgt

SEQ ID NO: 3543945 - DNA, 13 bp, Homo sapiens
ggcattctcccag

SEQ ID NO: 3543946 - DNA, 14 bp, Homo sapiens
ggcattctcccagc

SEQ ID NO: 3543947 - DNA, 20 bp, Homo sapiens
ggcatttctaaaatgttaaa

SEQ ID NO: 3543948 - DNA, 14 bp, Homo sapiens
ggccaaaatcaaga

SEQ ID NO: 3543949 - DNA, 15 bp, Homo sapiens
ggccaaacccttgct

SEQ ID NO: 3543950 - DNA, 19 bp, Homo sapiens
ggccaaacccttgctttcc

SEQ ID NO: 3543951 - DNA, 21 bp, Homo sapiens
ggccaaacccttgctttcctg

SEQ ID NO: 3543952 - DNA, 17 bp, Homo sapiens
ggccaacctcaggctcc

SEQ ID NO: 3543953 - DNA, 22 bp, Homo sapiens
ggccaactgcaaaaaaagcctc

SEQ ID NO: 3543954 - DNA, 13 bp, Homo sapiens
ggccaaggagctg

SEQ ID NO: 3543955 - DNA, 14 bp, Homo sapiens
ggccaaggagctgc

SEQ ID NO: 3543956 - DNA, 17 bp, Homo sapiens
ggccacacccaggaagg

SEQ ID NO: 3543957 - DNA, 19 bp, Homo sapiens
ggccacatcagccccacag

SEQ ID NO: 3543958 - DNA, 19 bp, Homo sapiens
ggccaccacctttggctgg

SEQ ID NO: 3543959 - DNA, 24 bp, Homo sapiens
ggccaccacctttggctggtagca

SEQ ID NO: 3543960 - DNA, 16 bp, Homo sapiens
ggccaccccaaacccc

SEQ ID NO: 3543961 - DNA, 20 bp, Homo sapiens
ggccaccccaaaccccagcc

SEQ ID NO: 3543962 - DNA, 23 bp, Homo sapiens
ggccaccccaaaccccagcccca

SEQ ID NO: 3543963 - DNA, 13 bp, Homo sapiens
ggccacctgcagg

SEQ ID NO: 3543964 - DNA, 15 bp, Homo sapiens
ggccactaaagcttc

SEQ ID NO: 3543965 - DNA, 16 bp, Homo sapiens
ggccactaaagcttca

SEQ ID NO: 3543966 - DNA, 11 bp, Homo sapiens
ggccactaagc

SEQ ID NO: 3543967 - DNA, 14 bp, Homo sapiens
ggccactggggact

SEQ ID NO: 3543968 - DNA, 21 bp, Homo sapiens
ggccactttcagagcccccag

SEQ ID NO: 3543969 - DNA, 16 bp, Homo sapiens
ggccagacacaggccc

SEQ ID NO: 3543970 - DNA, 15 bp, Homo sapiens
ggccagacatgccac

SEQ ID NO: 3543971 - DNA, 18 bp, Homo sapiens
ggccagacatgccacaag

SEQ ID NO: 3543972 - DNA, 15 bp, Homo sapiens
ggccagagaaagcaa

SEQ ID NO: 3543973 - DNA, 16 bp, Homo sapiens
ggccagagaaagcaaa

SEQ ID NO: 3543974 - DNA, 23 bp, Homo sapiens
ggccagagaaagcaaaggtgcac

SEQ ID NO: 3543975 - DNA, 16 bp, Homo sapiens
ggccagagagggaaaa

SEQ ID NO: 3543976 - DNA, 20 bp, Homo sapiens
ggccagagagggaaaaggca

SEQ ID NO: 3543977 - DNA, 11 bp, Homo sapiens
ggccagagcca

SEQ ID NO: 3543978 - DNA, 12 bp, Homo sapiens
ggccagagccag

SEQ ID NO: 3543979 - DNA, 14 bp, Homo sapiens
ggccagagccaggg

SEQ ID NO: 3543980 - DNA, 12 bp, Homo sapiens
ggccagatccag

SEQ ID NO: 3543981 - DNA, 21 bp, Homo sapiens
ggccagatgcacatccctgga

SEQ ID NO: 3543982 - DNA, 18 bp, Homo sapiens
ggccagcagctgatgctg

SEQ ID NO: 3543983 - DNA, 20 bp, Homo sapiens
ggccagcagctgatgctgta

SEQ ID NO: 3543984 - DNA, 14 bp, Homo sapiens
ggccagccatgtct

SEQ ID NO: 3543985 - DNA, 15 bp, Homo sapiens
ggccagccatgtctg

SEQ ID NO: 3543986 - DNA, 11 bp, Homo sapiens
ggccagcccag

SEQ ID NO: 3543987 - DNA, 16 bp, Homo sapiens
ggccagcccagccagg

SEQ ID NO: 3543988 - DNA, 18 bp, Homo sapiens
ggccagcccagccaggcc

SEQ ID NO: 3543989 - DNA, 13 bp, Homo sapiens
ggccagctctgga

SEQ ID NO: 3543990 - DNA, 23 bp, Homo sapiens
ggccaggccttacatctggctgg

SEQ ID NO: 3543991 - DNA, 19 bp, Homo sapiens
ggccaggtggccactccag

SEQ ID NO: 3543992 - DNA, 20 bp, Homo sapiens
ggccagtgagatcaatgtga

SEQ ID NO: 3543993 - DNA, 19 bp, Homo sapiens
ggccagtggccttccccag

SEQ ID NO: 3543994 - DNA, 24 bp, Homo sapiens
ggccagtttatatactgctattta

SEQ ID NO: 3543995 - DNA, 20 bp, Homo sapiens
ggccataaacggttcctggt

SEQ ID NO: 3543996 - DNA, 23 bp, Homo sapiens
ggccataaacggttcctggtgac

SEQ ID NO: 3543997 - DNA, 15 bp, Homo sapiens
ggccatctcaggaga

SEQ ID NO: 3543998 - DNA, 17 bp, Homo sapiens
ggccatctcaggagatg

SEQ ID NO: 3543999 - DNA, 22 bp, Homo sapiens
ggccatctgactgccaagccag

SEQ ID NO: 3544000 - DNA, 20 bp, Homo sapiens
ggccatctggagagcccaga

SEQ ID NO: 3544001 - DNA, 16 bp, Homo sapiens
ggccatcttctttctt

SEQ ID NO: 3544002 - DNA, 23 bp, Homo sapiens
ggccatcttctttcttccaccca

SEQ ID NO: 3544003 - DNA, 22 bp, Homo sapiens
ggccatgatgtccttggactcc

SEQ ID NO: 3544004 - DNA, 21 bp, Homo sapiens
ggccatgcctcctcaggagcc

SEQ ID NO: 3544005 - DNA, 18 bp, Homo sapiens
ggcccacgtgtatagtat

SEQ ID NO: 3544006 - DNA, 22 bp, Homo sapiens
ggcccacgtgtatagtatctgt

SEQ ID NO: 3544007 - DNA, 12 bp, Homo sapiens
ggcccagagccc

SEQ ID NO: 3544008 - DNA, 14 bp, Homo sapiens
ggcccagagcccag

SEQ ID NO: 3544009 - DNA, 15 bp, Homo sapiens
ggcccagagcccagc

SEQ ID NO: 3544010 - DNA, 17 bp, Homo sapiens
ggcccagagcccagctc

SEQ ID NO: 3544011 - DNA, 19 bp, Homo sapiens
ggcccagagcccagctcca

SEQ ID NO: 3544012 - DNA, 15 bp, Homo sapiens
ggcccagcccagagc

SEQ ID NO: 3544013 - DNA, 16 bp, Homo sapiens
ggcccagcccagagcc

SEQ ID NO: 3544014 - DNA, 20 bp, Homo sapiens
ggcccaggagacctccagct

SEQ ID NO: 3544015 - DNA, 16 bp, Homo sapiens
ggcccagggcccagag

SEQ ID NO: 3544016 - DNA, 19 bp, Homo sapiens
ggcccagggcccagagccc

SEQ ID NO: 3544017 - DNA, 20 bp, Homo sapiens
ggcccaggttcgagacccaa

SEQ ID NO: 3544018 - DNA, 15 bp, Homo sapiens
ggcccagtgccagca

SEQ ID NO: 3544019 - DNA, 17 bp, Homo sapiens
ggccccaccggccaggc

SEQ ID NO: 3544020 - DNA, 22 bp, Homo sapiens
ggccccacctcggcacacactg

SEQ ID NO: 3544021 - DNA, 21 bp, Homo sapiens
ggccccagaggccctggaggt

SEQ ID NO: 3544022 - DNA, 18 bp, Homo sapiens
ggccccaggaaaggccca

SEQ ID NO: 3544023 - DNA, 20 bp, Homo sapiens
ggccccatcctcatccctga

SEQ ID NO: 3544024 - DNA, 19 bp, Homo sapiens
ggccccatggcagctcctg

SEQ ID NO: 3544025 - DNA, 15 bp, Homo sapiens
ggcccccagccctgg

SEQ ID NO: 3544026 - DNA, 13 bp, Homo sapiens
ggcccccttcagg

SEQ ID NO: 3544027 - DNA, 15 bp, Homo sapiens
ggccccgccagggct

SEQ ID NO: 3544028 - DNA, 19 bp, Homo sapiens
ggccccgccagggctgggg

SEQ ID NO: 3544029 - DNA, 16 bp, Homo sapiens
ggccccgggctggaga

SEQ ID NO: 3544030 - DNA, 13 bp, Homo sapiens
ggcccctccatcc

SEQ ID NO: 3544031 - DNA, 19 bp, Homo sapiens
ggccctccctgtctccagg

SEQ ID NO: 3544032 - DNA, 20 bp, Homo sapiens
ggccctccctgttccccaga

SEQ ID NO: 3544033 - DNA, 14 bp, Homo sapiens
ggccctcctcagct

SEQ ID NO: 3544034 - DNA, 14 bp, Homo sapiens
ggccctctggagtg

SEQ ID NO: 3544035 - DNA, 18 bp, Homo sapiens
ggccctctggagtggcca

SEQ ID NO: 3544036 - DNA, 19 bp, Homo sapiens
ggccctctggagtggccac

SEQ ID NO: 3544037 - DNA, 16 bp, Homo sapiens
ggccctctttccctgc

SEQ ID NO: 3544038 - DNA, 14 bp, Homo sapiens
ggccctgagctgag

SEQ ID NO: 3544039 - DNA, 23 bp, Homo sapiens
ggccctgcacaggtggctgtttc

SEQ ID NO: 3544040 - DNA, 13 bp, Homo sapiens
ggccctgccccac

SEQ ID NO: 3544041 - DNA, 9 bp, Homo sapiens
ggccctgct

SEQ ID NO: 3544042 - DNA, 16 bp, Homo sapiens
ggccctggcaccccca

SEQ ID NO: 3544043 - DNA, 20 bp, Homo sapiens
ggccctggggatcttcccac

SEQ ID NO: 3544044 - DNA, 19 bp, Homo sapiens
ggccctgggggtctgggcg

SEQ ID NO: 3544045 - DNA, 12 bp, Homo sapiens
ggccctgtgcct

SEQ ID NO: 3544046 - DNA, 18 bp, Homo sapiens
ggcccttggaaaaacagg

SEQ ID NO: 3544047 - DNA, 17 bp, Homo sapiens
ggccgactcagggacct

SEQ ID NO: 3544048 - DNA, 17 bp, Homo sapiens
ggccgccccgccccaga

SEQ ID NO: 3544049 - DNA, 17 bp, Homo sapiens
ggccgcccggcagtgca

SEQ ID NO: 3544050 - DNA, 18 bp, Homo sapiens
ggccgcgccacccgggca

SEQ ID NO: 3544051 - DNA, 15 bp, Homo sapiens
ggccgcgcccagcag

SEQ ID NO: 3544052 - DNA, 21 bp, Homo sapiens
ggccgctgccacccacctccc

SEQ ID NO: 3544053 - DNA, 22 bp, Homo sapiens
ggccgctggctggtgggccccc

SEQ ID NO: 3544054 - DNA, 13 bp, Homo sapiens
ggccggctgagtg

SEQ ID NO: 3544055 - DNA, 16 bp, Homo sapiens
ggccgggcagggggac

SEQ ID NO: 3544056 - DNA, 16 bp, Homo sapiens
ggccgtggcacagctg

SEQ ID NO: 3544057 - DNA, 18 bp, Homo sapiens
ggccgtggcacagctggg

SEQ ID NO: 3544058 - DNA, 18 bp, Homo sapiens
ggcctaggtgcagctcct

SEQ ID NO: 3544059 - DNA, 22 bp, Homo sapiens
ggcctaggtgcagctcctcagc

SEQ ID NO: 3544060 - DNA, 19 bp, Homo sapiens
ggcctatgaaactggttta

SEQ ID NO: 3544061 - DNA, 23 bp, Homo sapiens
ggcctcagcctgctttcctgcag

SEQ ID NO: 3544062 - DNA, 21 bp, Homo sapiens
ggcctccaacgcccctgtggc

SEQ ID NO: 3544063 - DNA, 17 bp, Homo sapiens
ggcctcccagagtgctg

SEQ ID NO: 3544064 - DNA, 19 bp, Homo sapiens
ggcctcccagagtgctggg

SEQ ID NO: 3544065 - DNA, 12 bp, Homo sapiens
ggcctccctgct

SEQ ID NO: 3544066 - DNA, 16 bp, Homo sapiens
ggcctccctgctgtgc

SEQ ID NO: 3544067 - DNA, 17 bp, Homo sapiens
ggcctccctgctgtgcc

SEQ ID NO: 3544068 - DNA, 16 bp, Homo sapiens
gtacacccatgaaaga

SEQ ID NO: 3544069 - DNA, 14 bp, Homo sapiens
gtacagaggggaca

SEQ ID NO: 3544070 - DNA, 16 bp, Homo sapiens
gtacaggagaggcagc

SEQ ID NO: 3544071 - DNA, 21 bp, Homo sapiens
gtacagtttattgatattcaa

SEQ ID NO: 3544072 - DNA, 17 bp, Homo sapiens
gtacatagttatttatt

SEQ ID NO: 3544073 - DNA, 18 bp, Homo sapiens
gtacatagttatttattt

SEQ ID NO: 3544074 - DNA, 14 bp, Homo sapiens
gtacatatgtgctg

SEQ ID NO: 3544075 - DNA, 17 bp, Homo sapiens
gtacatatttattttct

SEQ ID NO: 3544076 - DNA, 21 bp, Homo sapiens
gtacattgagcaaataaactt

SEQ ID NO: 3544077 - DNA, 12 bp, Homo sapiens
gtacatttctga

SEQ ID NO: 3544078 - DNA, 15 bp, Homo sapiens
gtacatttctgattc

SEQ ID NO: 3544079 - DNA, 17 bp, Homo sapiens
gtacatttctgattctg

SEQ ID NO: 3544080 - DNA, 17 bp, Homo sapiens
gtaccaaatctgacata

SEQ ID NO: 3544081 - DNA, 18 bp, Homo sapiens
gtaccaaatctgacatat

SEQ ID NO: 3544082 - DNA, 22 bp, Homo sapiens
gtaccagttaatttttccaact

SEQ ID NO: 3544083 - DNA, 22 bp, Homo sapiens
gtaccatttaatggggaggaca

SEQ ID NO: 3544084 - DNA, 22 bp, Homo sapiens
gtacccattctgttttccccca

SEQ ID NO: 3544085 - DNA, 16 bp, Homo sapiens
gtacctcaagccccat

SEQ ID NO: 3544086 - DNA, 17 bp, Homo sapiens
gggccagatccagcctg

SEQ ID NO: 3544087 - DNA, 17 bp, Homo sapiens
gggccaggtgcagacct

SEQ ID NO: 3544088 - DNA, 19 bp, Homo sapiens
gggccatctgactgccaag

SEQ ID NO: 3544089 - DNA, 21 bp, Homo sapiens
gggccatctgactgccaagcc

SEQ ID NO: 3544090 - DNA, 12 bp, Homo sapiens
gggcccaagtgg

SEQ ID NO: 3544091 - DNA, 18 bp, Homo sapiens
gggcccacacctggtgga

SEQ ID NO: 3544092 - DNA, 13 bp, Homo sapiens
gggcccagcccag

SEQ ID NO: 3544093 - DNA, 19 bp, Homo sapiens
gggcccagcccagagccac

SEQ ID NO: 3544094 - DNA, 20 bp, Homo sapiens
gggccccgccagggctgggg

SEQ ID NO: 3544095 - DNA, 12 bp, Homo sapiens
gggcccctgagg

SEQ ID NO: 3544096 - DNA, 13 bp, Homo sapiens
gggccctctttcc

SEQ ID NO: 3544097 - DNA, 19 bp, Homo sapiens
gggccctgccccaccccat

SEQ ID NO: 3544098 - DNA, 11 bp, Homo sapiens
gggccctggca

SEQ ID NO: 3544099 - DNA, 14 bp, Homo sapiens
gggccctggccagg

SEQ ID NO: 3544100 - DNA, 17 bp, Homo sapiens
gggccgccacggcctgg

SEQ ID NO: 3544101 - DNA, 21 bp, Homo sapiens
gggccgccacggcctggctgg

SEQ ID NO: 3544102 - DNA, 13 bp, Homo sapiens
gggccgctgccac

SEQ ID NO: 3544103 - DNA, 19 bp, Homo sapiens
gggcctcaggctccgggca

SEQ ID NO: 3544104 - DNA, 16 bp, Homo sapiens
gggcctcaggctctgc

SEQ ID NO: 3544105 - DNA, 18 bp, Homo sapiens
gggcctcaggctctgcac

SEQ ID NO: 3544106 - DNA, 23 bp, Homo sapiens
gggcctctgttcctttctctggg

SEQ ID NO: 3544107 - DNA, 15 bp, Homo sapiens
gggcctgacaccccc

SEQ ID NO: 3544108 - DNA, 18 bp, Homo sapiens
gggcctgacaccccctcc

SEQ ID NO: 3544109 - DNA, 22 bp, Homo sapiens
gggcctgagggtccacctggag

SEQ ID NO: 3544110 - DNA, 16 bp, Homo sapiens
gggcctgcagaaggaa

SEQ ID NO: 3544111 - DNA, 21 bp, Homo sapiens
gggcctgcggaggcggtggca

SEQ ID NO: 3544112 - DNA, 19 bp, Homo sapiens
gggcctggaggtctggctg

SEQ ID NO: 3544113 - DNA, 20 bp, Homo sapiens
gggcctggaggtctggctga

SEQ ID NO: 3544114 - DNA, 13 bp, Homo sapiens
gggcgcagccctc

SEQ ID NO: 3544115 - DNA, 15 bp, Homo sapiens
gggcgtgggaggagg

SEQ ID NO: 3544116 - DNA, 19 bp, Homo sapiens
gggcgtttcctactgcgcc

SEQ ID NO: 3544117 - DNA, 21 bp, Homo sapiens
gggctacagaaaccacagtct

SEQ ID NO: 3544118 - DNA, 18 bp, Homo sapiens
gggctcagagtggggtag

SEQ ID NO: 3544119 - DNA, 19 bp, Homo sapiens
gggctcctcttagctcagc

SEQ ID NO: 3544120 - DNA, 21 bp, Homo sapiens
gggctcgccgtgtctcagcct

SEQ ID NO: 3544121 - DNA, 21 bp, Homo sapiens
gggctgacccagcatctccca

SEQ ID NO: 3544122 - DNA, 17 bp, Homo sapiens
gggctgagccctcctga

SEQ ID NO: 3544123 - DNA, 15 bp, Homo sapiens
gggctgagcctggtc

SEQ ID NO: 3544124 - DNA, 23 bp, Homo sapiens
gggctgagcctggtcccacgagg

SEQ ID NO: 3544125 - DNA, 14 bp, Homo sapiens
gggctgcaggcagg

SEQ ID NO: 3544126 - DNA, 23 bp, Homo sapiens
gggctgcaggcaggcggctcctc

SEQ ID NO: 3544127 - DNA, 21 bp, Homo sapiens
gggctgccctggtgctgccac

SEQ ID NO: 3544128 - DNA, 16 bp, Homo sapiens
gggctgccgagccacc

SEQ ID NO: 3544129 - DNA, 21 bp, Homo sapiens
gggctggcacgtgacaggctc

SEQ ID NO: 3544130 - DNA, 10 bp, Homo sapiens
ggtaaatgtt

SEQ ID NO: 3544131 - DNA, 12 bp, Homo sapiens
ggtaactgtcct

SEQ ID NO: 3544132 - DNA, 13 bp, Homo sapiens
ggtaactgtcctg

SEQ ID NO: 3544133 - DNA, 14 bp, Homo sapiens
ggtaactgtcctgt

SEQ ID NO: 3544134 - DNA, 17 bp, Homo sapiens
ggtaactgtcctgtcct

SEQ ID NO: 3544135 - DNA, 20 bp, Homo sapiens
ggtaattgggaactgaaatc

SEQ ID NO: 3544136 - DNA, 14 bp, Homo sapiens
ggtaattgtacaat

SEQ ID NO: 3544137 - DNA, 17 bp, Homo sapiens
ggtaattgtacaataaa

SEQ ID NO: 3544138 - DNA, 20 bp, Homo sapiens
ggtaattgtacaataaattt

SEQ ID NO: 3544139 - DNA, 16 bp, Homo sapiens
ggtacaggagaggcag

SEQ ID NO: 3544140 - DNA, 17 bp, Homo sapiens
ggtacaggagaggcagc

SEQ ID NO: 3544141 - DNA, 12 bp, Homo sapiens
ggtacctgccct

SEQ ID NO: 3544142 - DNA, 17 bp, Homo sapiens
ggtactcccaaactgac

SEQ ID NO: 3544143 - DNA, 21 bp, Homo sapiens
ggtactcccaaactgacaatt

SEQ ID NO: 3544144 - DNA, 22 bp, Homo sapiens
ggtactcccaaactgacaattt

SEQ ID NO: 3544145 - DNA, 20 bp, Homo sapiens
ggtactgcattctctcccat

SEQ ID NO: 3544146 - DNA, 20 bp, Homo sapiens
ggtacttatttctcagctgt

SEQ ID NO: 3544147 - DNA, 15 bp, Homo sapiens
ggtacttcttgaagg

SEQ ID NO: 3544148 - DNA, 15 bp, Homo sapiens
ggtagatgctgaggc

SEQ ID NO: 3544149 - DNA, 18 bp, Homo sapiens
ggtagatgctgaggcccc

SEQ ID NO: 3544150 - DNA, 16 bp, Homo sapiens
ggtaggaactgctggg

SEQ ID NO: 3544151 - DNA, 21 bp, Homo sapiens
ggtagggatatggcaggactc

SEQ ID NO: 3544152 - DNA, 16 bp, Homo sapiens
ggtagtggctggggtg

SEQ ID NO: 3544153 - DNA, 16 bp, Homo sapiens
ggtatctggcttccct

SEQ ID NO: 3544154 - DNA, 18 bp, Homo sapiens
ggtattttgtttctttta

SEQ ID NO: 3544155 - DNA, 21 bp, Homo sapiens
ggtcaacttaaggtatattta

SEQ ID NO: 3544156 - DNA, 19 bp, Homo sapiens
ggtcaccagacggggctgg

SEQ ID NO: 3544157 - DNA, 21 bp, Homo sapiens
ggtcagaggagcgcaggcagc

SEQ ID NO: 3544158 - DNA, 15 bp, Homo sapiens
ggtcagcctggaagg

SEQ ID NO: 3544159 - DNA, 21 bp, Homo sapiens
ggtcatctggcggaggtctct

SEQ ID NO: 3544160 - DNA, 17 bp, Homo sapiens
ggtcatgccctcctctc

SEQ ID NO: 3544161 - DNA, 20 bp, Homo sapiens
ggtcatgtgagtctgggata

SEQ ID NO: 3544162 - DNA, 16 bp, Homo sapiens
ggtccacagctggaaa

SEQ ID NO: 3544163 - DNA, 13 bp, Homo sapiens
ggtccagctctga

SEQ ID NO: 3544164 - DNA, 14 bp, Homo sapiens
ggtccagctctgac

SEQ ID NO: 3544165 - DNA, 21 bp, Homo sapiens
ggtccagctctgacatccctt

SEQ ID NO: 3544166 - DNA, 16 bp, Homo sapiens
ggtccaggagagcctg

SEQ ID NO: 3544167 - DNA, 21 bp, Homo sapiens
ggtccagggaggggtccctgc

SEQ ID NO: 3544168 - DNA, 12 bp, Homo sapiens
ggtcccagctcc

SEQ ID NO: 3544169 - DNA, 16 bp, Homo sapiens
ggtcccggccagctct

SEQ ID NO: 3544170 - DNA, 18 bp, Homo sapiens
ggtcccggccagctctgg

SEQ ID NO: 3544171 - DNA, 20 bp, Homo sapiens
ggtcccggccagctctggag

SEQ ID NO: 3544172 - DNA, 22 bp, Homo sapiens
ggtcccttaaggcacagtggga

SEQ ID NO: 3544173 - DNA, 20 bp, Homo sapiens
ggtcctcctatctccctggc

SEQ ID NO: 3544174 - DNA, 22 bp, Homo sapiens
ggtcctcctatctccctggctc

SEQ ID NO: 3544175 - DNA, 11 bp, Homo sapiens
ggtcctctctg

SEQ ID NO: 3544176 - DNA, 18 bp, Homo sapiens
ggtcctctctgagtcaaa

SEQ ID NO: 3544177 - DNA, 23 bp, Homo sapiens
ggtcctctctgagtcaaatccag

SEQ ID NO: 3544178 - DNA, 19 bp, Homo sapiens
ggtcctgcagtctggctga

SEQ ID NO: 3544179 - DNA, 15 bp, Homo sapiens
ggtcggatctcacag

SEQ ID NO: 3544180 - DNA, 18 bp, Homo sapiens
ggtcgggcagccagcaga

SEQ ID NO: 3544181 - DNA, 15 bp, Homo sapiens
ggtcgtgggaaaggg

SEQ ID NO: 3544182 - DNA, 22 bp, Homo sapiens
ggtcgtgggaaaggggagtagg

SEQ ID NO: 3544183 - DNA, 16 bp, Homo sapiens
ggtcgttttccaaaga

SEQ ID NO: 3544184 - DNA, 15 bp, Homo sapiens
ggtctccccaattct

SEQ ID NO: 3544185 - DNA, 20 bp, Homo sapiens
ggtctccccaattctcccct

SEQ ID NO: 3544186 - DNA, 17 bp, Homo sapiens
ggtctccgaaatgctgt

SEQ ID NO: 3544187 - DNA, 19 bp, Homo sapiens
ggtctccgaaatgctgtct

SEQ ID NO: 3544188 - DNA, 12 bp, Homo sapiens
ggtctcctcagg

SEQ ID NO: 3544189 - DNA, 15 bp, Homo sapiens
ggtctcctcaggacc

SEQ ID NO: 3544190 - DNA, 19 bp, Homo sapiens
ggtctcctcaggaccaggg

SEQ ID NO: 3544191 - DNA, 16 bp, Homo sapiens
ggtctcgaactcctga

SEQ ID NO: 3544192 - DNA, 20 bp, Homo sapiens
ggtctcggatgacaccctgg

SEQ ID NO: 3544193 - DNA, 15 bp, Homo sapiens
ggtctctcagggatg

SEQ ID NO: 3544194 - DNA, 16 bp, Homo sapiens
ggtctctgccccagcc

SEQ ID NO: 3544195 - DNA, 17 bp, Homo sapiens
ggtctctgggagcccag

SEQ ID NO: 3544196 - DNA, 18 bp, Homo sapiens
ggtctctgggagcccaga

SEQ ID NO: 3544197 - DNA, 20 bp, Homo sapiens
ggtctctgggagcccagaac

SEQ ID NO: 3544198 - DNA, 21 bp, Homo sapiens
ggtctcttctgaataaagcaa

SEQ ID NO: 3544199 - DNA, 23 bp, Homo sapiens
ggtctgactccaaagctgttcca

SEQ ID NO: 3544200 - DNA, 20 bp, Homo sapiens
ggtctgagtcatggccgggt

SEQ ID NO: 3544201 - DNA, 15 bp, Homo sapiens
ggtctgattggctgc

SEQ ID NO: 3544202 - DNA, 17 bp, Homo sapiens
ggtctgattttctcact

SEQ ID NO: 3544203 - DNA, 17 bp, Homo sapiens
ggtctgccttctgctga

SEQ ID NO: 3544204 - DNA, 20 bp, Homo sapiens
ggtctgggatatggctgccc

SEQ ID NO: 3544205 - DNA, 23 bp, Homo sapiens
ggtctgggcgtccagctcagccc

SEQ ID NO: 3544206 - DNA, 17 bp, Homo sapiens
ggtctggggacaggccc

SEQ ID NO: 3544207 - DNA, 16 bp, Homo sapiens
ggtctgtatgtcatgg

SEQ ID NO: 3544208 - DNA, 16 bp, Homo sapiens
ggtctgtgtcatttct

SEQ ID NO: 3544209 - DNA, 16 bp, Homo sapiens
ggtctgtgtgctgttt

SEQ ID NO: 3544210 - DNA, 18 bp, Homo sapiens
ggtcttagctctttctct

SEQ ID NO: 3544211 - DNA, 16 bp, Homo sapiens
ggtcttgcatttaaaa

SEQ ID NO: 3544212 - DNA, 17 bp, Homo sapiens
ggtctttctctcagtga

SEQ ID NO: 3544213 - DNA, 21 bp, Homo sapiens
ggtgaatctgtctatctgtga

SEQ ID NO: 3544214 - DNA, 16 bp, Homo sapiens
ggtgacacctccccct

SEQ ID NO: 3544215 - DNA, 12 bp, Homo sapiens
ggtgacagtggc

SEQ ID NO: 3544216 - DNA, 23 bp, Homo sapiens
ggtgagcaagcaccaacctccag

SEQ ID NO: 3544217 - DNA, 16 bp, Homo sapiens
ggtgaggggctttctc

SEQ ID NO: 3544218 - DNA, 18 bp, Homo sapiens
ggtgaggtgaactccagg

SEQ ID NO: 3544219 - DNA, 22 bp, Homo sapiens
ggtgatggaacaagagaagtac

SEQ ID NO: 3544220 - DNA, 18 bp, Homo sapiens
ggtgcaaagttccctact

SEQ ID NO: 3544221 - DNA, 19 bp, Homo sapiens
ggtgcacgcaggcacagca

SEQ ID NO: 3544222 - DNA, 16 bp, Homo sapiens
ggtgcactccagactc

SEQ ID NO: 3544223 - DNA, 19 bp, Homo sapiens
ggtgcagacgcggcgggga

SEQ ID NO: 3544224 - DNA, 20 bp, Homo sapiens
ggtgcagccccagggcctgc

SEQ ID NO: 3544225 - DNA, 19 bp, Homo sapiens
ggtgcagccttcccctccc

SEQ ID NO: 3544226 - DNA, 15 bp, Homo sapiens
ggtgcagctcctcag

SEQ ID NO: 3544227 - DNA, 13 bp, Homo sapiens
ggtgcatgggctc

SEQ ID NO: 3544228 - DNA, 14 bp, Homo sapiens
ggtgccaccaccct

SEQ ID NO: 3544229 - DNA, 17 bp, Homo sapiens
ggtgccaccaccctgcc

SEQ ID NO: 3544230 - DNA, 21 bp, Homo sapiens
ggtgccaccaccctgcccccc

SEQ ID NO: 3544231 - DNA, 16 bp, Homo sapiens
ggcctcgtgaggggca

SEQ ID NO: 3544232 - DNA, 20 bp, Homo sapiens
ggcctctcattccagaggaa

SEQ ID NO: 3544233 - DNA, 23 bp, Homo sapiens
ggcctcttgagttcctctgcagt

SEQ ID NO: 3544234 - DNA, 17 bp, Homo sapiens
ggcctgaactgaggaga

SEQ ID NO: 3544235 - DNA, 21 bp, Homo sapiens
ggcctgaagtcttctcctcca

SEQ ID NO: 3544236 - DNA, 21 bp, Homo sapiens
ggcctgacaccccctccccgc

SEQ ID NO: 3544237 - DNA, 19 bp, Homo sapiens
ggcctgagggtccacctgg

SEQ ID NO: 3544238 - DNA, 23 bp, Homo sapiens
ggcctgagggtccacctggagag

SEQ ID NO: 3544239 - DNA, 12 bp, Homo sapiens
ggcctgcaggag

SEQ ID NO: 3544240 - DNA, 14 bp, Homo sapiens
ggcctgcaggaggg

SEQ ID NO: 3544241 - DNA, 14 bp, Homo sapiens
ggcctgccccctgg

SEQ ID NO: 3544242 - DNA, 13 bp, Homo sapiens
ggcctgctgccag

SEQ ID NO: 3544243 - DNA, 17 bp, Homo sapiens
ggcctgctgccagtgca

SEQ ID NO: 3544244 - DNA, 20 bp, Homo sapiens
ggcctgctgccagtgcagcc

SEQ ID NO: 3544245 - DNA, 23 bp, Homo sapiens
ggcctgctgccagtgcagccact

SEQ ID NO: 3544246 - DNA, 16 bp, Homo sapiens
ggcctggagcaggccc

SEQ ID NO: 3544247 - DNA, 17 bp, Homo sapiens
ggcctggagcaggccca

SEQ ID NO: 3544248 - DNA, 15 bp, Homo sapiens
ggcctggagccccat

SEQ ID NO: 3544249 - DNA, 10 bp, Homo sapiens
ggcctggagg

SEQ ID NO: 3544250 - DNA, 18 bp, Homo sapiens
ggcctggaggtctggctg

SEQ ID NO: 3544251 - DNA, 14 bp, Homo sapiens
ggcctggcagccgt

SEQ ID NO: 3544252 - DNA, 15 bp, Homo sapiens
ggcctggccatttcc

SEQ ID NO: 3544253 - DNA, 19 bp, Homo sapiens
ggcctggggacccaaaccc

SEQ ID NO: 3544254 - DNA, 18 bp, Homo sapiens
ggcctggggtgcatctcc

SEQ ID NO: 3544255 - DNA, 20 bp, Homo sapiens
ggcctggggtgcatctcctc

SEQ ID NO: 3544256 - DNA, 18 bp, Homo sapiens
ggcctgtcccttgcctct

SEQ ID NO: 3544257 - DNA, 19 bp, Homo sapiens
ggcctgtgccagcaccaca

SEQ ID NO: 3544258 - DNA, 23 bp, Homo sapiens
ggcctgtgccagcaccacagccg

SEQ ID NO: 3544259 - DNA, 23 bp, Homo sapiens
ggcctttgcaagatgcttggttg

SEQ ID NO: 3544260 - DNA, 22 bp, Homo sapiens
ggcgagggatgatgagggaagc

SEQ ID NO: 3544261 - DNA, 23 bp, Homo sapiens
ggcgcatgcatgggaggaattca

SEQ ID NO: 3544262 - DNA, 22 bp, Homo sapiens
ggcggagccttcccgggcgggc

SEQ ID NO: 3544263 - DNA, 15 bp, Homo sapiens
ggcggaggtctctgg

SEQ ID NO: 3544264 - DNA, 16 bp, Homo sapiens
ggcggaggtctctggg

SEQ ID NO: 3544265 - DNA, 20 bp, Homo sapiens
ggcggaggtctctgggagcc

SEQ ID NO: 3544266 - DNA, 23 bp, Homo sapiens
ggcggaggtctctgggagcccag

SEQ ID NO: 3544267 - DNA, 14 bp, Homo sapiens
ggcggcacagcctt

SEQ ID NO: 3544268 - DNA, 14 bp, Homo sapiens
ggcggccccgccgc

SEQ ID NO: 3544269 - DNA, 20 bp, Homo sapiens
ggcggcccggccggagggca

SEQ ID NO: 3544270 - DNA, 13 bp, Homo sapiens
ggcggctcctcct

SEQ ID NO: 3544271 - DNA, 22 bp, Homo sapiens
ggcgggtgtggagaccaggctc

SEQ ID NO: 3544272 - DNA, 14 bp, Homo sapiens
ggcggtggctgccc

SEQ ID NO: 3544273 - DNA, 17 bp, Homo sapiens
ggcgtactacccagctc

SEQ ID NO: 3544274 - DNA, 23 bp, Homo sapiens
ggcgtctctaatgtctgcagctc

SEQ ID NO: 3544275 - DNA, 21 bp, Homo sapiens
ggcgtctgttcccccttcaca

SEQ ID NO: 3544276 - DNA, 18 bp, Homo sapiens
ggcgtgaggcctgggctg

SEQ ID NO: 3544277 - DNA, 13 bp, Homo sapiens
ggcgtggcctccc

SEQ ID NO: 3544278 - DNA, 14 bp, Homo sapiens
ggcgtttcctactg

SEQ ID NO: 3544279 - DNA, 13 bp, Homo sapiens
ggctagagaaatc

SEQ ID NO: 3544280 - DNA, 14 bp, Homo sapiens
ggctagctgtgctg

SEQ ID NO: 3544281 - DNA, 18 bp, Homo sapiens
ggctattttctaaagact

SEQ ID NO: 3544282 - DNA, 20 bp, Homo sapiens
ggctattttctaaagacttg

SEQ ID NO: 3544283 - DNA, 18 bp, Homo sapiens
ggctcacaaggcccagga

SEQ ID NO: 3544284 - DNA, 20 bp, Homo sapiens
ggctcacaaggcccaggaga

SEQ ID NO: 3544285 - DNA, 20 bp, Homo sapiens
ggctcacgtcgcggccgcct

SEQ ID NO: 3544286 - DNA, 18 bp, Homo sapiens
ggctcactggcaggtgtg

SEQ ID NO: 3544287 - DNA, 17 bp, Homo sapiens
ggctcactggctttgaa

SEQ ID NO: 3544288 - DNA, 14 bp, Homo sapiens
ggctcagagtgggg

SEQ ID NO: 3544289 - DNA, 23 bp, Homo sapiens
ggctcagcctggtttctgggtgc

SEQ ID NO: 3544290 - DNA, 11 bp, Homo sapiens
ggctcaggaga

SEQ ID NO: 3544291 - DNA, 13 bp, Homo sapiens
ggctcaggagaag

SEQ ID NO: 3544292 - DNA, 15 bp, Homo sapiens
ggatagtgttctgct

SEQ ID NO: 3544293 - DNA, 16 bp, Homo sapiens
ggatagtgttctgctc

SEQ ID NO: 3544294 - DNA, 16 bp, Homo sapiens
ggatatggcaggactc

SEQ ID NO: 3544295 - DNA, 17 bp, Homo sapiens
ggatatggctgcccagg

SEQ ID NO: 3544296 - DNA, 11 bp, Homo sapiens
ggatatttaac

SEQ ID NO: 3544297 - DNA, 18 bp, Homo sapiens
ggatatttcaatctttta

SEQ ID NO: 3544298 - DNA, 23 bp, Homo sapiens
ggatccagccacttccccctctt

SEQ ID NO: 3544299 - DNA, 12 bp, Homo sapiens
ggatccagggca

SEQ ID NO: 3544300 - DNA, 21 bp, Homo sapiens
ggatccagggcagcaggccag

SEQ ID NO: 3544301 - DNA, 14 bp, Homo sapiens
ggatccccttccta

SEQ ID NO: 3544302 - DNA, 17 bp, Homo sapiens
ggatcctgaatctgtgc

SEQ ID NO: 3544303 - DNA, 19 bp, Homo sapiens
ggatctccactggaccctt

SEQ ID NO: 3544304 - DNA, 17 bp, Homo sapiens
ggatctggtcctaccca

SEQ ID NO: 3544305 - DNA, 19 bp, Homo sapiens
ggatctgtgattggctggt

SEQ ID NO: 3544306 - DNA, 18 bp, Homo sapiens
ggatgacaccctggcctg

SEQ ID NO: 3544307 - DNA, 21 bp, Homo sapiens
ggatgacatgcactcagctct

SEQ ID NO: 3544308 - DNA, 14 bp, Homo sapiens
ggatgacctccaga

SEQ ID NO: 3544309 - DNA, 17 bp, Homo sapiens
ggatgacctccagaagt

SEQ ID NO: 3544310 - DNA, 13 bp, Homo sapiens
ggatgagaaacag

SEQ ID NO: 3544311 - DNA, 19 bp, Homo sapiens
ggatgaggtcaccagggga

SEQ ID NO: 3544312 - DNA, 23 bp, Homo sapiens
ggatgatgtctttttattaaaat

SEQ ID NO: 3544313 - DNA, 19 bp, Homo sapiens
ggatgcccagatgaactga

SEQ ID NO: 3544314 - DNA, 12 bp, Homo sapiens
ggatgccctgga

SEQ ID NO: 3544315 - DNA, 18 bp, Homo sapiens
ggatgccctggaggtggc

SEQ ID NO: 3544316 - DNA, 21 bp, Homo sapiens
ggatgccctggaggtggctga

SEQ ID NO: 3544317 - DNA, 13 bp, Homo sapiens
ggatgctgggctg

SEQ ID NO: 3544318 - DNA, 14 bp, Homo sapiens
ggatgctgggctgg

SEQ ID NO: 3544319 - DNA, 16 bp, Homo sapiens
ggatgctgggctgggc

SEQ ID NO: 3544320 - DNA, 18 bp, Homo sapiens
ggatgctgggctgggccc

SEQ ID NO: 3544321 - DNA, 18 bp, Homo sapiens
ggatggactaaatgatct

SEQ ID NO: 3544322 - DNA, 20 bp, Homo sapiens
ggatggagaaagaagtggag

SEQ ID NO: 3544323 - DNA, 18 bp, Homo sapiens
ggatggagggaagacctg

SEQ ID NO: 3544324 - DNA, 14 bp, Homo sapiens
ggatggcagactct

SEQ ID NO: 3544325 - DNA, 17 bp, Homo sapiens
ggatggtgcatgggctc

SEQ ID NO: 3544326 - DNA, 14 bp, Homo sapiens
ggatgtataaattt

SEQ ID NO: 3544327 - DNA, 23 bp, Homo sapiens
ggatgttctgcctctccctgggt

SEQ ID NO: 3544328 - DNA, 20 bp, Homo sapiens
ggatgttgctatagtgacat

SEQ ID NO: 3544329 - DNA, 15 bp, Homo sapiens
ggattaactaaagaa

SEQ ID NO: 3544330 - DNA, 20 bp, Homo sapiens
ggattaagaaaccttgctct

SEQ ID NO: 3544331 - DNA, 16 bp, Homo sapiens
ggattacagaaactga

SEQ ID NO: 3544332 - DNA, 17 bp, Homo sapiens
ggattacagaaactgat

SEQ ID NO: 3544333 - DNA, 20 bp, Homo sapiens
ggattacagaaactgatgcc

SEQ ID NO: 3544334 - DNA, 17 bp, Homo sapiens
ggattagggagagaaga

SEQ ID NO: 3544335 - DNA, 13 bp, Homo sapiens
ggattattttttc

SEQ ID NO: 3544336 - DNA, 14 bp, Homo sapiens
ggattattttttca

SEQ ID NO: 3544337 - DNA, 20 bp, Homo sapiens
ggattattttttcagaccga

SEQ ID NO: 3544338 - DNA, 22 bp, Homo sapiens
ggattccactcgtgtgtttcta

SEQ ID NO: 3544339 - DNA, 17 bp, Homo sapiens
ggattcctgagctggcc

SEQ ID NO: 3544340 - DNA, 19 bp, Homo sapiens
ggattgaggggccctggcc

SEQ ID NO: 3544341 - DNA, 19 bp, Homo sapiens
ggattggggggtgggcttt

SEQ ID NO: 3544342 - DNA, 17 bp, Homo sapiens
ggattggggtccctcta

SEQ ID NO: 3544343 - DNA, 19 bp, Homo sapiens
ggattgtatttaagacata

SEQ ID NO: 3544344 - DNA, 15 bp, Homo sapiens
ggattgtgtatctgt

SEQ ID NO: 3544345 - DNA, 14 bp, Homo sapiens
ggattttaccaaag

SEQ ID NO: 3544346 - DNA, 16 bp, Homo sapiens
ggattttaccaaagca

SEQ ID NO: 3544347 - DNA, 23 bp, Homo sapiens
ggcaaaaggatctttgtggccaa

SEQ ID NO: 3544348 - DNA, 10 bp, Homo sapiens
ggcaaacaat

SEQ ID NO: 3544349 - DNA, 12 bp, Homo sapiens
ggcaaacaatcc

SEQ ID NO: 3544350 - DNA, 19 bp, Homo sapiens
ggcaaacgtttctcaaatc

SEQ ID NO: 3544351 - DNA, 18 bp, Homo sapiens
ggcaaagataatttattt

SEQ ID NO: 3544352 - DNA, 13 bp, Homo sapiens
ggcaaaggcctgg

SEQ ID NO: 3544353 - DNA, 19 bp, Homo sapiens
ggcaaagtgacaaagcaat

SEQ ID NO: 3544354 - DNA, 14 bp, Homo sapiens
ggcaaagtttaaat

SEQ ID NO: 3544355 - DNA, 18 bp, Homo sapiens
ggcaaagtttaaatgtat

SEQ ID NO: 3544356 - DNA, 22 bp, Homo sapiens
ggcaaagtttaaatgtatttta

SEQ ID NO: 3544357 - DNA, 24 bp, Homo sapiens
ggcaaagtttaaatgtattttaca

SEQ ID NO: 3544358 - DNA, 13 bp, Homo sapiens
ggcaaatccaggc

SEQ ID NO: 3544359 - DNA, 19 bp, Homo sapiens
ggcaacagatctggaacct

SEQ ID NO: 3544360 - DNA, 13 bp, Homo sapiens
ggcaaccagccag

SEQ ID NO: 3544361 - DNA, 14 bp, Homo sapiens
ggcaaggccctgcc

SEQ ID NO: 3544362 - DNA, 14 bp, Homo sapiens
ggcaaggggtgagg

SEQ ID NO: 3544363 - DNA, 22 bp, Homo sapiens
ggcacaatgttggagcagcagg

SEQ ID NO: 3544364 - DNA, 17 bp, Homo sapiens
ggcacacctcctcccac

SEQ ID NO: 3544365 - DNA, 17 bp, Homo sapiens
ggcacactttctggcaa

SEQ ID NO: 3544366 - DNA, 15 bp, Homo sapiens
ggcacagcagctgca

SEQ ID NO: 3544367 - DNA, 12 bp, Homo sapiens
ggcacagctggg

SEQ ID NO: 3544368 - DNA, 17 bp, Homo sapiens
ggcacagtgggagctga

SEQ ID NO: 3544369 - DNA, 16 bp, Homo sapiens
ggcaccacagcctcca

SEQ ID NO: 3544370 - DNA, 16 bp, Homo sapiens
ggcaccagacacccag

SEQ ID NO: 3544371 - DNA, 19 bp, Homo sapiens
ggcaccagacacccaggac

SEQ ID NO: 3544372 - DNA, 16 bp, Homo sapiens
ggcaccatcagcctgt

SEQ ID NO: 3544373 - DNA, 20 bp, Homo sapiens
ggcacccccacaagctgtcc

SEQ ID NO: 3544374 - DNA, 19 bp, Homo sapiens
ggcaccctggtctgtggag

SEQ ID NO: 3544375 - DNA, 18 bp, Homo sapiens
ggcaccgtccaggcccca

SEQ ID NO: 3544376 - DNA, 17 bp, Homo sapiens
ggcacctaatccaggca

SEQ ID NO: 3544377 - DNA, 18 bp, Homo sapiens
ggcacctaatccaggcag

SEQ ID NO: 3544378 - DNA, 19 bp, Homo sapiens
ggcacctgtttcccgggca

SEQ ID NO: 3544379 - DNA, 20 bp, Homo sapiens
ggcacggcgggatcctccac

SEQ ID NO: 3544380 - DNA, 17 bp, Homo sapiens
ggcacgtccttgggcgt

SEQ ID NO: 3544381 - DNA, 16 bp, Homo sapiens
ggcactggcgaggaga

SEQ ID NO: 3544382 - DNA, 15 bp, Homo sapiens
ggcactggtggcccg

SEQ ID NO: 3544383 - DNA, 12 bp, Homo sapiens
ggcactggtggg

SEQ ID NO: 3544384 - DNA, 13 bp, Homo sapiens
ggcacttggagga

SEQ ID NO: 3544385 - DNA, 21 bp, Homo sapiens
ggcagacatggtggggtctcc

SEQ ID NO: 3544386 - DNA, 20 bp, Homo sapiens
ggcagagaccataagagaaa

SEQ ID NO: 3544387 - DNA, 21 bp, Homo sapiens
ggcagagaccataagagaaac

SEQ ID NO: 3544388 - DNA, 13 bp, Homo sapiens
ggcagagccaggc

SEQ ID NO: 3544389 - DNA, 15 bp, Homo sapiens
ggcagagccaggctg

SEQ ID NO: 3544390 - DNA, 21 bp, Homo sapiens
ggcagagtggcgtggcctccc

SEQ ID NO: 3544391 - DNA, 18 bp, Homo sapiens
ggcagagttacagttctg

SEQ ID NO: 3544392 - DNA, 16 bp, Homo sapiens
ggcagatccaggacta

SEQ ID NO: 3544393 - DNA, 14 bp, Homo sapiens
ggcagcactcccca

SEQ ID NO: 3544394 - DNA, 24 bp, Homo sapiens
ggcagcactccccagagctgtgcc

SEQ ID NO: 3544395 - DNA, 12 bp, Homo sapiens
ggcagcagcccc

SEQ ID NO: 3544396 - DNA, 19 bp, Homo sapiens
ggcagcatgcttgggctga

SEQ ID NO: 3544397 - DNA, 21 bp, Homo sapiens
ggcagccgtgccttcagctct

SEQ ID NO: 3544398 - DNA, 12 bp, Homo sapiens
ggcagcgacccc

SEQ ID NO: 3544399 - DNA, 13 bp, Homo sapiens
ggcagcgacccca

SEQ ID NO: 3544400 - DNA, 15 bp, Homo sapiens
ggcagcgcagggctg

SEQ ID NO: 3544401 - DNA, 18 bp, Homo sapiens
ggcagcgcagggctggca

SEQ ID NO: 3544402 - DNA, 19 bp, Homo sapiens
ggcagcgcagggctggcac

SEQ ID NO: 3544403 - DNA, 15 bp, Homo sapiens
ggcagcgcatgtgtg

SEQ ID NO: 3544404 - DNA, 15 bp, Homo sapiens
ggcagctcctgacct

SEQ ID NO: 3544405 - DNA, 13 bp, Homo sapiens
ggcagctgaaatt

SEQ ID NO: 3544406 - DNA, 12 bp, Homo sapiens
ggcagctgccac

SEQ ID NO: 3544407 - DNA, 11 bp, Homo sapiens
ggcagctgctg

SEQ ID NO: 3544408 - DNA, 16 bp, Homo sapiens
ggcagctggcccccag

SEQ ID NO: 3544409 - DNA, 14 bp, Homo sapiens
ggcagcttgctggg

SEQ ID NO: 3544410 - DNA, 20 bp, Homo sapiens
ggcagcttgctgggctttgg

SEQ ID NO: 3544411 - DNA, 13 bp, Homo sapiens
ggcaggaaagcca

SEQ ID NO: 3544412 - DNA, 15 bp, Homo sapiens
ggcaggaaagccaca

SEQ ID NO: 3544413 - DNA, 21 bp, Homo sapiens
ggcaggaccttcgggctgtgc

SEQ ID NO: 3544414 - DNA, 18 bp, Homo sapiens
ggcaggactcctggcagg

SEQ ID NO: 3544415 - DNA, 22 bp, Homo sapiens
ggcaggactcctggcagggcca

SEQ ID NO: 3544416 - DNA, 20 bp, Homo sapiens
ggcaggattctctgcagccc

SEQ ID NO: 3544417 - DNA, 11 bp, Homo sapiens
ggcaggcccac

SEQ ID NO: 3544418 - DNA, 21 bp, Homo sapiens
ggcaggcccactccccagccc

SEQ ID NO: 3544419 - DNA, 12 bp, Homo sapiens
ggcaggctgagg

SEQ ID NO: 3544420 - DNA, 23 bp, Homo sapiens
ggcagggaaatgtatgtgtgtct

SEQ ID NO: 3544421 - DNA, 12 bp, Homo sapiens
ggcagggaagga

SEQ ID NO: 3544422 - DNA, 16 bp, Homo sapiens
ggcagggaaggacagg

SEQ ID NO: 3544423 - DNA, 17 bp, Homo sapiens
ggcagggaaggacagga

SEQ ID NO: 3544424 - DNA, 14 bp, Homo sapiens
ggcagggagggctt

SEQ ID NO: 3544425 - DNA, 15 bp, Homo sapiens
ggcagggctgaggcc

SEQ ID NO: 3544426 - DNA, 19 bp, Homo sapiens
ggcaggggagacaggagcc

SEQ ID NO: 3544427 - DNA, 22 bp, Homo sapiens
ggcagggggccccgccagggct

SEQ ID NO: 3544428 - DNA, 21 bp, Homo sapiens
ggcaggtctagtgttcctgca

SEQ ID NO: 3544429 - DNA, 13 bp, Homo sapiens
ggcaggtgtggga

SEQ ID NO: 3544430 - DNA, 19 bp, Homo sapiens
tattcaggggaaacttgat

SEQ ID NO: 3544431 - DNA, 21 bp, Homo sapiens
tattccactatttgcagaggc

SEQ ID NO: 3544432 - DNA, 13 bp, Homo sapiens
tattcccaagccg

SEQ ID NO: 3544433 - DNA, 12 bp, Homo sapiens
tattcccatgag

SEQ ID NO: 3544434 - DNA, 13 bp, Homo sapiens
tattccccagtga

SEQ ID NO: 3544435 - DNA, 18 bp, Homo sapiens
tattccccagtgactcca

SEQ ID NO: 3544436 - DNA, 19 bp, Homo sapiens
tattccccagtgactccag

SEQ ID NO: 3544437 - DNA, 21 bp, Homo sapiens
tattccccagtgactccaggg

SEQ ID NO: 3544438 - DNA, 23 bp, Homo sapiens
tattctaatagtttttcactttg

SEQ ID NO: 3544439 - DNA, 15 bp, Homo sapiens
tattctattttacaa

SEQ ID NO: 3544440 - DNA, 12 bp, Homo sapiens
tattctgaaaaa

SEQ ID NO: 3544441 - DNA, 23 bp, Homo sapiens
tattctgaaaaagacataaaaca

SEQ ID NO: 3544442 - DNA, 16 bp, Homo sapiens
tattctgaagcaacat

SEQ ID NO: 3544443 - DNA, 20 bp, Homo sapiens
tattctttagcttacctggg

SEQ ID NO: 3544444 - DNA, 16 bp, Homo sapiens
tattgaaatgatttca

SEQ ID NO: 3544445 - DNA, 22 bp, Homo sapiens
tattgaaatgatttcacagtgt

SEQ ID NO: 3544446 - DNA, 15 bp, Homo sapiens
tattgacttgtatat

SEQ ID NO: 3544447 - DNA, 17 bp, Homo sapiens
tattgacttgtatattt

SEQ ID NO: 3544448 - DNA, 16 bp, Homo sapiens
tcaacccccctcccag

SEQ ID NO: 3544449 - DNA, 17 bp, Homo sapiens
tcaacccccctcccaga

SEQ ID NO: 3544450 - DNA, 23 bp, Homo sapiens
tcaaccggaaggaggccaaccag

SEQ ID NO: 3544451 - DNA, 14 bp, Homo sapiens
tcaacgcagccctg

SEQ ID NO: 3544452 - DNA, 15 bp, Homo sapiens
tcaacgcagccctgc

SEQ ID NO: 3544453 - DNA, 18 bp, Homo sapiens
tcaacgcagccctgcttt

SEQ ID NO: 3544454 - DNA, 16 bp, Homo sapiens
tcaactcttcgaagcc

SEQ ID NO: 3544455 - DNA, 19 bp, Homo sapiens
tcaactggttgtatatttt

SEQ ID NO: 3544456 - DNA, 12 bp, Homo sapiens
tcaagaaactga

SEQ ID NO: 3544457 - DNA, 23 bp, Homo sapiens
tcaagaaactgaggaattttctt

SEQ ID NO: 3544458 - DNA, 15 bp, Homo sapiens
tcaagacaagagctg

SEQ ID NO: 3544459 - DNA, 22 bp, Homo sapiens
tcaagacaagagctgttatgct

SEQ ID NO: 3544460 - DNA, 23 bp, Homo sapiens
tcaagacaagagctgttatgctg

SEQ ID NO: 3544461 - DNA, 20 bp, Homo sapiens
tcaagacgaggggcagggaa

SEQ ID NO: 3544462 - DNA, 15 bp, Homo sapiens
tcaagagaaacttca

SEQ ID NO: 3544463 - DNA, 20 bp, Homo sapiens
tcaagagggcactggtggcc

SEQ ID NO: 3544464 - DNA, 18 bp, Homo sapiens
tcaagatttttttcctga

SEQ ID NO: 3544465 - DNA, 21 bp, Homo sapiens
tcaagcaaacatcaaataaat

SEQ ID NO: 3544466 - DNA, 16 bp, Homo sapiens
tcaagcaatcctccta

SEQ ID NO: 3544467 - DNA, 22 bp, Homo sapiens
tcaagccatgtataaatgtgat

SEQ ID NO: 3544468 - DNA, 18 bp, Homo sapiens
tcaagccccatttcctca

SEQ ID NO: 3544469 - DNA, 17 bp, Homo sapiens
tcaagcctctaaacaga

SEQ ID NO: 3544470 - DNA, 20 bp, Homo sapiens
tcaagctcctcctccctgca

SEQ ID NO: 3544471 - DNA, 21 bp, Homo sapiens
tcaagctggtggcctctgcag

SEQ ID NO: 3544472 - DNA, 23 bp, Homo sapiens
tcaaggaatttcttaacttcttg

SEQ ID NO: 3544473 - DNA, 16 bp, Homo sapiens
tcaaggataaatatct

SEQ ID NO: 3544474 - DNA, 16 bp, Homo sapiens
tcaagtaaaacaaatg

SEQ ID NO: 3544475 - DNA, 17 bp, Homo sapiens
tcaagtaaaacaaatga

SEQ ID NO: 3544476 - DNA, 19 bp, Homo sapiens
tcaagtaaaacaaatgaaa

SEQ ID NO: 3544477 - DNA, 21 bp, Homo sapiens
tcaagtaaaacaaatgaaatt

SEQ ID NO: 3544478 - DNA, 12 bp, Homo sapiens
tcaagtaaaaga

SEQ ID NO: 3544479 - DNA, 14 bp, Homo sapiens
tcaagtaaaagaaa

SEQ ID NO: 3544480 - DNA, 23 bp, Homo sapiens
tcaagtattaagcagttcattct

SEQ ID NO: 3544481 - DNA, 20 bp, Homo sapiens
tcaagtattttgtgtttgga

SEQ ID NO: 3544482 - DNA, 19 bp, Homo sapiens
tcaagtgattctcctgcct

SEQ ID NO: 3544483 - DNA, 17 bp, Homo sapiens
tcaagttgtttcatgag

SEQ ID NO: 3544484 - DNA, 15 bp, Homo sapiens
tcaatatgcaagcag

SEQ ID NO: 3544485 - DNA, 18 bp, Homo sapiens
tcaatatgcaagcagctt

SEQ ID NO: 3544486 - DNA, 19 bp, Homo sapiens
tcaatatgcaagcagcttt

SEQ ID NO: 3544487 - DNA, 19 bp, Homo sapiens
tcaatgagagcataattta

SEQ ID NO: 3544488 - DNA, 20 bp, Homo sapiens
tcaatgcccagtaaaatttc

SEQ ID NO: 3544489 - DNA, 14 bp, Homo sapiens
tcaatgtacttgtt

SEQ ID NO: 3544490 - DNA, 22 bp, Homo sapiens
tcaatgtacttgtttgaatatt

SEQ ID NO: 3544491 - DNA, 14 bp, Homo sapiens
tcaatgtgctctgt

SEQ ID NO: 3544492 - DNA, 18 bp, Homo sapiens
tcaatgtgctctgtaaca

SEQ ID NO: 3544493 - DNA, 15 bp, Homo sapiens
tcaattaaacggatt

SEQ ID NO: 3544494 - DNA, 16 bp, Homo sapiens
tcaattaaacggatta

SEQ ID NO: 3544495 - DNA, 15 bp, Homo sapiens
tcaattatttgcata

SEQ ID NO: 3544496 - DNA, 14 bp, Homo sapiens
tcaattgtttatat

SEQ ID NO: 3544497 - DNA, 12 bp, Homo sapiens
tcaatttcagca

SEQ ID NO: 3544498 - DNA, 16 bp, Homo sapiens
tcaattttatccctca

SEQ ID NO: 3544499 - DNA, 22 bp, Homo sapiens
tcaattttttttccgtaaatgt

SEQ ID NO: 3544500 - DNA, 16 bp, Homo sapiens
tcacaaagaacaggaa

SEQ ID NO: 3544501 - DNA, 12 bp, Homo sapiens
tcacaaagccca

SEQ ID NO: 3544502 - DNA, 22 bp, Homo sapiens
tcacaaatttcacttatacctg

SEQ ID NO: 3544503 - DNA, 18 bp, Homo sapiens
tcacaacccttctctgtt

SEQ ID NO: 3544504 - DNA, 19 bp, Homo sapiens
tcacaacccttctctgttg

SEQ ID NO: 3544505 - DNA, 14 bp, Homo sapiens
tcacaaccttctgt

SEQ ID NO: 3544506 - DNA, 13 bp, Homo sapiens
tcacaagcctcct

SEQ ID NO: 3544507 - DNA, 15 bp, Homo sapiens
tcacaagcctcctgt

SEQ ID NO: 3544508 - DNA, 23 bp, Homo sapiens
tcacaagcctcctgtacctcagt

SEQ ID NO: 3544509 - DNA, 16 bp, Homo sapiens
tcacaaggcccaggag

SEQ ID NO: 3544510 - DNA, 15 bp, Homo sapiens
tcacaattatgtgca

SEQ ID NO: 3544511 - DNA, 15 bp, Homo sapiens
tcacacattacaaca

SEQ ID NO: 3544512 - DNA, 21 bp, Homo sapiens
tcacactaagagggcagactg

SEQ ID NO: 3544513 - DNA, 13 bp, Homo sapiens
tcacactcttcag

SEQ ID NO: 3544514 - DNA, 23 bp, Homo sapiens
tcacactcttcagtgactcctgc

SEQ ID NO: 3544515 - DNA, 23 bp, Homo sapiens
tcacagcaagtcactggccagtg

SEQ ID NO: 3544516 - DNA, 17 bp, Homo sapiens
tcacagccagactggca

SEQ ID NO: 3544517 - DNA, 17 bp, Homo sapiens
tcacaggactctgcctc

SEQ ID NO: 3544518 - DNA, 22 bp, Homo sapiens
tcacaggcgcctaaagtcattg

SEQ ID NO: 3544519 - DNA, 16 bp, Homo sapiens
tcacagggaatggcca

SEQ ID NO: 3544520 - DNA, 19 bp, Homo sapiens
tcacagggaatggccacaa

SEQ ID NO: 3544521 - DNA, 22 bp, Homo sapiens
tcacagggtgagggccacctcc

SEQ ID NO: 3544522 - DNA, 18 bp, Homo sapiens
tcacagtgctcttttctc

SEQ ID NO: 3544523 - DNA, 20 bp, Homo sapiens
tcacatgtcagccactgtga

SEQ ID NO: 3544524 - DNA, 14 bp, Homo sapiens
tcaccacagacttt

SEQ ID NO: 3544525 - DNA, 24 bp, Homo sapiens
tcaccaccaataaatcagaccatg

SEQ ID NO: 3544526 - DNA, 18 bp, Homo sapiens
tcaccactaccagccagc

SEQ ID NO: 3544527 - DNA, 19 bp, Homo sapiens
tcaccagacggggctggag

SEQ ID NO: 3544528 - DNA, 19 bp, Homo sapiens
tcaccagagactttagggg

SEQ ID NO: 3544529 - DNA, 21 bp, Homo sapiens
tcaccagatttgctaatttat

SEQ ID NO: 3544530 - DNA, 20 bp, Homo sapiens
tcaccagccccccgcgcgcc

SEQ ID NO: 3544531 - DNA, 24 bp, Homo sapiens
tcaccaggggaggagcctgtgcgt

SEQ ID NO: 3544532 - DNA, 16 bp, Homo sapiens
tcaccagtgttcctga

SEQ ID NO: 3544533 - DNA, 21 bp, Homo sapiens
tcaccagtgttcctgaagctg

SEQ ID NO: 3544534 - DNA, 14 bp, Homo sapiens
tcaccagttaaaag

SEQ ID NO: 3544535 - DNA, 17 bp, Homo sapiens
tcaccatctttgtcaaa

SEQ ID NO: 3544536 - DNA, 13 bp, Homo sapiens
tcacccacctctg

SEQ ID NO: 3544537 - DNA, 13 bp, Homo sapiens
tcacccactctgc

SEQ ID NO: 3544538 - DNA, 14 bp, Homo sapiens
tcacccactctgca

SEQ ID NO: 3544539 - DNA, 22 bp, Homo sapiens
tcacccatgcatcttccactgg

SEQ ID NO: 3544540 - DNA, 18 bp, Homo sapiens
tcacccccagctttgcta

SEQ ID NO: 3544541 - DNA, 14 bp, Homo sapiens
tcacccctagccct

SEQ ID NO: 3544542 - DNA, 17 bp, Homo sapiens
tcacccctagccctggt

SEQ ID NO: 3544543 - DNA, 20 bp, Homo sapiens
tcacccctagccctggttag

SEQ ID NO: 3544544 - DNA, 15 bp, Homo sapiens
tcaccctacctgtgc

SEQ ID NO: 3544545 - DNA, 19 bp, Homo sapiens
tcacctcctctgtgatttc

SEQ ID NO: 3544546 - DNA, 15 bp, Homo sapiens
tcacctgaggtcggg

SEQ ID NO: 3544547 - DNA, 19 bp, Homo sapiens
tcacctgagtcaccctacc

SEQ ID NO: 3544548 - DNA, 13 bp, Homo sapiens
tcacctgctccag

SEQ ID NO: 3544549 - DNA, 15 bp, Homo sapiens
tcacctgtgactcct

SEQ ID NO: 3544550 - DNA, 19 bp, Homo sapiens
tcacctgtgactcctgttg

SEQ ID NO: 3544551 - DNA, 20 bp, Homo sapiens
tcacctgttcatttgaagaa

SEQ ID NO: 3544552 - DNA, 21 bp, Homo sapiens
tcacggatggtgcatgggctc

SEQ ID NO: 3544553 - DNA, 21 bp, Homo sapiens
tcacgtgctttgtgttcagtt

SEQ ID NO: 3544554 - DNA, 17 bp, Homo sapiens
tcacgtttggtgcttct

SEQ ID NO: 3544555 - DNA, 19 bp, Homo sapiens
tcactagaatggataaaat

SEQ ID NO: 3544556 - DNA, 21 bp, Homo sapiens
tcactagagacaaatctttaa

SEQ ID NO: 3544557 - DNA, 11 bp, Homo sapiens
tcactcctgga

SEQ ID NO: 3544558 - DNA, 14 bp, Homo sapiens
tcactcctggaggc

SEQ ID NO: 3544559 - DNA, 22 bp, Homo sapiens
tcactctggcttcaaaaagcca

SEQ ID NO: 3544560 - DNA, 22 bp, Homo sapiens
tcactctgggcctggggaccca

SEQ ID NO: 3544561 - DNA, 14 bp, Homo sapiens
tcactctgtccctg

SEQ ID NO: 3544562 - DNA, 14 bp, Homo sapiens
tcactgcaaacaca

SEQ ID NO: 3544563 - DNA, 18 bp, Homo sapiens
tcactgcaaacacacctt

SEQ ID NO: 3544564 - DNA, 15 bp, Homo sapiens
tcactgctggctgcc

SEQ ID NO: 3544565 - DNA, 23 bp, Homo sapiens
tcactgctgttatatttcatcat

SEQ ID NO: 3544566 - DNA, 21 bp, Homo sapiens
tcactggattataagttctat

SEQ ID NO: 3544567 - DNA, 18 bp, Homo sapiens
tcactgggaagctcccac

SEQ ID NO: 3544568 - DNA, 21 bp, Homo sapiens
tcactgggaagctcccacccc

SEQ ID NO: 3544569 - DNA, 20 bp, Homo sapiens
tcactgtagaatgatttcat

SEQ ID NO: 3544570 - DNA, 15 bp, Homo sapiens
tcactgtcctccaag

SEQ ID NO: 3544571 - DNA, 16 bp, Homo sapiens
tcactgtcctccaagc

SEQ ID NO: 3544572 - DNA, 11 bp, Homo sapiens
tcactgtgctg

SEQ ID NO: 3544573 - DNA, 16 bp, Homo sapiens
tcactgtgctggggca

SEQ ID NO: 3544574 - DNA, 21 bp, Homo sapiens
tcactgtgcttaatttaaata

SEQ ID NO: 3544575 - DNA, 20 bp, Homo sapiens
tagcccaggatatattttat

SEQ ID NO: 3544576 - DNA, 21 bp, Homo sapiens
tagcccaggatatattttatt

SEQ ID NO: 3544577 - DNA, 20 bp, Homo sapiens
tagccctggttagctgacag

SEQ ID NO: 3544578 - DNA, 16 bp, Homo sapiens
tagcctaaagggcagg

SEQ ID NO: 3544579 - DNA, 21 bp, Homo sapiens
tagcctaaagggcagggccca

SEQ ID NO: 3544580 - DNA, 13 bp, Homo sapiens
tagcctctggact

SEQ ID NO: 3544581 - DNA, 18 bp, Homo sapiens
tagcggagcccagcctgg

SEQ ID NO: 3544582 - DNA, 16 bp, Homo sapiens
tagcgttttttaaatg

SEQ ID NO: 3544583 - DNA, 17 bp, Homo sapiens
tagcgttttttaaatgt

SEQ ID NO: 3544584 - DNA, 14 bp, Homo sapiens
tagctaagccaaga

SEQ ID NO: 3544585 - DNA, 22 bp, Homo sapiens
tagctaagtacacaataagcaa

SEQ ID NO: 3544586 - DNA, 13 bp, Homo sapiens
tagctaattattt

SEQ ID NO: 3544587 - DNA, 18 bp, Homo sapiens
tagctatttttatacact

SEQ ID NO: 3544588 - DNA, 20 bp, Homo sapiens
tagctatttttatacactgt

SEQ ID NO: 3544589 - DNA, 21 bp, Homo sapiens
tagctatttttatacactgta

SEQ ID NO: 3544590 - DNA, 15 bp, Homo sapiens
tagctcagctgagca

SEQ ID NO: 3544591 - DNA, 21 bp, Homo sapiens
tagctcctgccacatggagcc

SEQ ID NO: 3544592 - DNA, 15 bp, Homo sapiens
tagctctcacagaca

SEQ ID NO: 3544593 - DNA, 13 bp, Homo sapiens
tagctctgctgct

SEQ ID NO: 3544594 - DNA, 15 bp, Homo sapiens
tagctctgctgctga

SEQ ID NO: 3544595 - DNA, 17 bp, Homo sapiens
tagctcttcccactttt

SEQ ID NO: 3544596 - DNA, 18 bp, Homo sapiens
tagctgggggtgggccag

SEQ ID NO: 3544597 - DNA, 20 bp, Homo sapiens
tagctgggggtgggccaggc

SEQ ID NO: 3544598 - DNA, 17 bp, Homo sapiens
tagctgtcgtacattga

SEQ ID NO: 3544599 - DNA, 20 bp, Homo sapiens
tagcttaatcttaatgtctg

SEQ ID NO: 3544600 - DNA, 21 bp, Homo sapiens
tagcttacaagccagctggag

SEQ ID NO: 3544601 - DNA, 23 bp, Homo sapiens
tagctttaatgatatgcttgtaa

SEQ ID NO: 3544602 - DNA, 11 bp, Homo sapiens
tagctttgctc

SEQ ID NO: 3544603 - DNA, 13 bp, Homo sapiens
tagcttttccctt

SEQ ID NO: 3544604 - DNA, 14 bp, Homo sapiens
taggaaactgaagc

SEQ ID NO: 3544605 - DNA, 15 bp, Homo sapiens
taggaaccctggagg

SEQ ID NO: 3544606 - DNA, 15 bp, Homo sapiens
taggaactgctgggc

SEQ ID NO: 3544607 - DNA, 17 bp, Homo sapiens
taggaatgtacatgaag

SEQ ID NO: 3544608 - DNA, 18 bp, Homo sapiens
taggaccctcgagagcct

SEQ ID NO: 3544609 - DNA, 19 bp, Homo sapiens
taggagaaagcaaaataca

SEQ ID NO: 3544610 - DNA, 15 bp, Homo sapiens
taggagaagccagga

SEQ ID NO: 3544611 - DNA, 22 bp, Homo sapiens
taggagaagtcttctatttatt

SEQ ID NO: 3544612 - DNA, 22 bp, Homo sapiens
taggagacagatcactcctgga

SEQ ID NO: 3544613 - DNA, 13 bp, Homo sapiens
taggatcctggag

SEQ ID NO: 3544614 - DNA, 18 bp, Homo sapiens
taggattttgagggtggg

SEQ ID NO: 3544615 - DNA, 18 bp, Homo sapiens
taggcactgagcagggat

SEQ ID NO: 3544616 - DNA, 14 bp, Homo sapiens
taggcagggggccc

SEQ ID NO: 3544617 - DNA, 15 bp, Homo sapiens
taggcagggggccct

SEQ ID NO: 3544618 - DNA, 16 bp, Homo sapiens
taggcagggggccctg

SEQ ID NO: 3544619 - DNA, 13 bp, Homo sapiens
taggccaggcctt

SEQ ID NO: 3544620 - DNA, 16 bp, Homo sapiens
taggccccagaggccc

SEQ ID NO: 3544621 - DNA, 17 bp, Homo sapiens
taggccccagaggccct

SEQ ID NO: 3544622 - DNA, 19 bp, Homo sapiens
taggccccagaggccctgg

SEQ ID NO: 3544623 - DNA, 21 bp, Homo sapiens
taggccccagaggccctggag

SEQ ID NO: 3544624 - DNA, 19 bp, Homo sapiens
taggcctgtcccttgcctc

SEQ ID NO: 3544625 - DNA, 14 bp, Homo sapiens
taggcctttcctct

SEQ ID NO: 3544626 - DNA, 16 bp, Homo sapiens
taggctcttaagcagc

SEQ ID NO: 3544627 - DNA, 20 bp, Homo sapiens
taggctcttatgtgtgcctt

SEQ ID NO: 3544628 - DNA, 16 bp, Homo sapiens
taggctggtggcccag

SEQ ID NO: 3544629 - DNA, 18 bp, Homo sapiens
taggctggtggcccagga

SEQ ID NO: 3544630 - DNA, 21 bp, Homo sapiens
taggctgtaactactttataa

SEQ ID NO: 3544631 - DNA, 20 bp, Homo sapiens
tagggacaggaccccagctc

SEQ ID NO: 3544632 - DNA, 21 bp, Homo sapiens
tagggacaggaccccagctct

SEQ ID NO: 3544633 - DNA, 22 bp, Homo sapiens
tagggacaggaccccagctctg

SEQ ID NO: 3544634 - DNA, 20 bp, Homo sapiens
tagggatgcggatcctgctg

SEQ ID NO: 3544635 - DNA, 21 bp, Homo sapiens
tagggatgcggatcctgctgg

SEQ ID NO: 3544636 - DNA, 21 bp, Homo sapiens
taggggcttataataaaggac

SEQ ID NO: 3544637 - DNA, 17 bp, Homo sapiens
taggggtcctgggggca

SEQ ID NO: 3544638 - DNA, 23 bp, Homo sapiens
tagggtccctgaacgccctggta

SEQ ID NO: 3544639 - DNA, 17 bp, Homo sapiens
tagggtctttcttggga

SEQ ID NO: 3544640 - DNA, 17 bp, Homo sapiens
tagggttttcagatgaa

SEQ ID NO: 3544641 - DNA, 22 bp, Homo sapiens
tagggttttcagatgaaaagaa

SEQ ID NO: 3544642 - DNA, 23 bp, Homo sapiens
taggtaaatttttaggcaaagat

SEQ ID NO: 3544643 - DNA, 17 bp, Homo sapiens
taggtcgttttccaaag

SEQ ID NO: 3544644 - DNA, 12 bp, Homo sapiens
taggtctttctc

SEQ ID NO: 3544645 - DNA, 14 bp, Homo sapiens
taggtctttctctc

SEQ ID NO: 3544646 - DNA, 16 bp, Homo sapiens
taggtgcccagggcca

SEQ ID NO: 3544647 - DNA, 18 bp, Homo sapiens
taggtgctacaaaaacac

SEQ ID NO: 3544648 - DNA, 21 bp, Homo sapiens
taggtgctttagagataattg

SEQ ID NO: 3544649 - DNA, 20 bp, Homo sapiens
taggtttttttccttctgaa

SEQ ID NO: 3544650 - DNA, 15 bp, Homo sapiens
tagtaaaaatacaaa

SEQ ID NO: 3544651 - DNA, 11 bp, Homo sapiens
tagtaaatgtg

SEQ ID NO: 3544652 - DNA, 12 bp, Homo sapiens
tagtacaaagtt

SEQ ID NO: 3544653 - DNA, 14 bp, Homo sapiens
tagtacaaagtttc

SEQ ID NO: 3544654 - DNA, 16 bp, Homo sapiens
tagtacctgtgactct

SEQ ID NO: 3544655 - DNA, 18 bp, Homo sapiens
tagtactttgtgctcata

SEQ ID NO: 3544656 - DNA, 15 bp, Homo sapiens
tagtagtgtggcctg

SEQ ID NO: 3544657 - DNA, 12 bp, Homo sapiens
tagtatcctcca

SEQ ID NO: 3544658 - DNA, 14 bp, Homo sapiens
tagtatcctccagg

SEQ ID NO: 3544659 - DNA, 16 bp, Homo sapiens
tagtatcctccaggtt

SEQ ID NO: 3544660 - DNA, 16 bp, Homo sapiens
tagtatctatatgact

SEQ ID NO: 3544661 - DNA, 14 bp, Homo sapiens
tagtattccaatca

SEQ ID NO: 3544662 - DNA, 17 bp, Homo sapiens
tagtcaacatatactat

SEQ ID NO: 3544663 - DNA, 14 bp, Homo sapiens
tagtcaagctcctc

SEQ ID NO: 3544664 - DNA, 13 bp, Homo sapiens
tagtcatgtgacc

SEQ ID NO: 3544665 - DNA, 15 bp, Homo sapiens
tagtcatttgttaat

SEQ ID NO: 3544666 - DNA, 18 bp, Homo sapiens
tagtccttttgggaagaa

SEQ ID NO: 3544667 - DNA, 17 bp, Homo sapiens
tagtctgaaactggctt

SEQ ID NO: 3544668 - DNA, 14 bp, Homo sapiens
taatttttcctttt

SEQ ID NO: 3544669 - DNA, 22 bp, Homo sapiens
taatttttgtgtttttaataaa

SEQ ID NO: 3544670 - DNA, 13 bp, Homo sapiens
taattttttacta

SEQ ID NO: 3544671 - DNA, 15 bp, Homo sapiens
tacaaaaaaacacgt

SEQ ID NO: 3544672 - DNA, 13 bp, Homo sapiens
tacaaaaacacag

SEQ ID NO: 3544673 - DNA, 16 bp, Homo sapiens
tacaaaaacacagcaa

SEQ ID NO: 3544674 - DNA, 18 bp, Homo sapiens
tacaaaaacacagcaagg

SEQ ID NO: 3544675 - DNA, 16 bp, Homo sapiens
tacaaaacattaaact

SEQ ID NO: 3544676 - DNA, 19 bp, Homo sapiens
tacaaaacctatttttcct

SEQ ID NO: 3544677 - DNA, 20 bp, Homo sapiens
tacaaaataaacaaataaca

SEQ ID NO: 3544678 - DNA, 14 bp, Homo sapiens
tacaaactcagatc

SEQ ID NO: 3544679 - DNA, 17 bp, Homo sapiens
tacaaagggaaagcctc

SEQ ID NO: 3544680 - DNA, 20 bp, Homo sapiens
tacaaagggaaagcctctgg

SEQ ID NO: 3544681 - DNA, 18 bp, Homo sapiens
tacaaagttaaaattgtt

SEQ ID NO: 3544682 - DNA, 19 bp, Homo sapiens
tacaaatgccttaaaatgg

SEQ ID NO: 3544683 - DNA, 21 bp, Homo sapiens
tacaaatgccttaaaatggaa

SEQ ID NO: 3544684 - DNA, 19 bp, Homo sapiens
tacaaatgtttttcatcca

SEQ ID NO: 3544685 - DNA, 23 bp, Homo sapiens
tacaacagaaaccagaaaagcaa

SEQ ID NO: 3544686 - DNA, 14 bp, Homo sapiens
tacaaccctaccct

SEQ ID NO: 3544687 - DNA, 18 bp, Homo sapiens
tacaactaaataacacag

SEQ ID NO: 3544688 - DNA, 18 bp, Homo sapiens
tacaagggcataaagtaa

SEQ ID NO: 3544689 - DNA, 16 bp, Homo sapiens
tacaagtaatattatt

SEQ ID NO: 3544690 - DNA, 20 bp, Homo sapiens
tacaagtataacagttttga

SEQ ID NO: 3544691 - DNA, 21 bp, Homo sapiens
tacaagttccaacatgcaata

SEQ ID NO: 3544692 - DNA, 11 bp, Homo sapiens
tacaatgtgag

SEQ ID NO: 3544693 - DNA, 18 bp, Homo sapiens
tacacaaagaacttgctg

SEQ ID NO: 3544694 - DNA, 21 bp, Homo sapiens
tacacaaagaacttgctgctg

SEQ ID NO: 3544695 - DNA, 14 bp, Homo sapiens
tacacaataagcaa

SEQ ID NO: 3544696 - DNA, 21 bp, Homo sapiens
tacacacacacagacatatat

SEQ ID NO: 3544697 - DNA, 15 bp, Homo sapiens
tacacacgctgcctt

SEQ ID NO: 3544698 - DNA, 16 bp, Homo sapiens
tacacacgctgccttc

SEQ ID NO: 3544699 - DNA, 17 bp, Homo sapiens
tacacacgctgccttcg

SEQ ID NO: 3544700 - DNA, 17 bp, Homo sapiens
tacacactcaaatcaag

SEQ ID NO: 3544701 - DNA, 17 bp, Homo sapiens
tacacatttttaaattg

SEQ ID NO: 3544702 - DNA, 19 bp, Homo sapiens
tacacatttttaaattgtt

SEQ ID NO: 3544703 - DNA, 23 bp, Homo sapiens
tacacatttttaaattgttagct

SEQ ID NO: 3544704 - DNA, 21 bp, Homo sapiens
tacaccagcaatttagacaaa

SEQ ID NO: 3544705 - DNA, 17 bp, Homo sapiens
tacaccagcattccttt

SEQ ID NO: 3544706 - DNA, 19 bp, Homo sapiens
tacacccagttctgaataa

SEQ ID NO: 3544707 - DNA, 17 bp, Homo sapiens
tacaccgggcctggaga

SEQ ID NO: 3544708 - DNA, 21 bp, Homo sapiens
tacaccgtttagaaaaaacaa

SEQ ID NO: 3544709 - DNA, 19 bp, Homo sapiens
tacacctttctcctttgta

SEQ ID NO: 3544710 - DNA, 19 bp, Homo sapiens
tacactcatggggaagctt

SEQ ID NO: 3544711 - DNA, 23 bp, Homo sapiens
tacactctgtattgaaaatggct

SEQ ID NO: 3544712 - DNA, 16 bp, Homo sapiens
tacactgatgcaagga

SEQ ID NO: 3544713 - DNA, 16 bp, Homo sapiens
tacactggtatttata

SEQ ID NO: 3544714 - DNA, 22 bp, Homo sapiens
tacactgtaagctttgttctgg

SEQ ID NO: 3544715 - DNA, 16 bp, Homo sapiens
tacacttataaaataa

SEQ ID NO: 3544716 - DNA, 23 bp, Homo sapiens
tacacttataaaataacttgcat

SEQ ID NO: 3544717 - DNA, 15 bp, Homo sapiens
tacagaaactgatgc

SEQ ID NO: 3544718 - DNA, 23 bp, Homo sapiens
tacagacagcttacaggagccag

SEQ ID NO: 3544719 - DNA, 19 bp, Homo sapiens
tacagactggatgtaccac

SEQ ID NO: 3544720 - DNA, 15 bp, Homo sapiens
tacagaggaaatctg

SEQ ID NO: 3544721 - DNA, 17 bp, Homo sapiens
tacagaggaaatctgta

SEQ ID NO: 3544722 - DNA, 14 bp, Homo sapiens
tacagaggacagta

SEQ ID NO: 3544723 - DNA, 14 bp, Homo sapiens
tacagataaaatgt

SEQ ID NO: 3544724 - DNA, 23 bp, Homo sapiens
tacagatctgcaccaccatgccc

SEQ ID NO: 3544725 - DNA, 17 bp, Homo sapiens
tacagatttattccttt

SEQ ID NO: 3544726 - DNA, 20 bp, Homo sapiens
tacagatttattcctttgtt

SEQ ID NO: 3544727 - DNA, 18 bp, Homo sapiens
tacagctaatcagcattc

SEQ ID NO: 3544728 - DNA, 13 bp, Homo sapiens
tacagctgcctgc

SEQ ID NO: 3544729 - DNA, 14 bp, Homo sapiens
tactctttgaaagc

SEQ ID NO: 3544730 - DNA, 11 bp, Homo sapiens
tactgatgaga

SEQ ID NO: 3544731 - DNA, 15 bp, Homo sapiens
tactgatgagagaat

SEQ ID NO: 3544732 - DNA, 23 bp, Homo sapiens
tactgatgttcctagtgaaagag

SEQ ID NO: 3544733 - DNA, 17 bp, Homo sapiens
tactgcatatgaaagga

SEQ ID NO: 3544734 - DNA, 18 bp, Homo sapiens
tactgcattctctcccat

SEQ ID NO: 3544735 - DNA, 19 bp, Homo sapiens
tactgcattctctcccatc

SEQ ID NO: 3544736 - DNA, 21 bp, Homo sapiens
tactgccttgtttaatgttaa

SEQ ID NO: 3544737 - DNA, 20 bp, Homo sapiens
tactgctctataaatagtat

SEQ ID NO: 3544738 - DNA, 15 bp, Homo sapiens
tactgctctcctcca

SEQ ID NO: 3544739 - DNA, 13 bp, Homo sapiens
tactgctgctgct

SEQ ID NO: 3544740 - DNA, 22 bp, Homo sapiens
tactggcattggcccttggtgg

SEQ ID NO: 3544741 - DNA, 19 bp, Homo sapiens
tactgtaatgctgcctcag

SEQ ID NO: 3544742 - DNA, 17 bp, Homo sapiens
tactgtatggaaacact

SEQ ID NO: 3544743 - DNA, 15 bp, Homo sapiens
tactgtggcctgcag

SEQ ID NO: 3544744 - DNA, 21 bp, Homo sapiens
tactgtgggcaaagtcctcct

SEQ ID NO: 3544745 - DNA, 18 bp, Homo sapiens
tacttaattgccagcaaa

SEQ ID NO: 3544746 - DNA, 18 bp, Homo sapiens
tacttacatatctgactt

SEQ ID NO: 3544747 - DNA, 13 bp, Homo sapiens
tacttatttaact

SEQ ID NO: 3544748 - DNA, 18 bp, Homo sapiens
tacttatttctcagctgt

SEQ ID NO: 3544749 - DNA, 19 bp, Homo sapiens
tacttatttctcagctgtg

SEQ ID NO: 3544750 - DNA, 19 bp, Homo sapiens
tacttattttcagtgcatc

SEQ ID NO: 3544751 - DNA, 19 bp, Homo sapiens
tacttatttttgacagtgt

SEQ ID NO: 3544752 - DNA, 20 bp, Homo sapiens
tacttatttttgacagtgtt

SEQ ID NO: 3544753 - DNA, 21 bp, Homo sapiens
tacttcaaaagccataacttg

SEQ ID NO: 3544754 - DNA, 21 bp, Homo sapiens
tacttccctcaggcctatgca

SEQ ID NO: 3544755 - DNA, 12 bp, Homo sapiens
tacttccttatg

SEQ ID NO: 3544756 - DNA, 14 bp, Homo sapiens
tacttcttgaaggt

SEQ ID NO: 3544757 - DNA, 19 bp, Homo sapiens
tacttgaagggccagagcc

SEQ ID NO: 3544758 - DNA, 20 bp, Homo sapiens
tacttgaagggccagagcca

SEQ ID NO: 3544759 - DNA, 21 bp, Homo sapiens
tacttgaagggccagagccag

SEQ ID NO: 3544760 - DNA, 14 bp, Homo sapiens
tacttgcacactct

SEQ ID NO: 3544761 - DNA, 17 bp, Homo sapiens
tacttggcccccttcag

SEQ ID NO: 3544762 - DNA, 19 bp, Homo sapiens
tacttggcccccttcagga

SEQ ID NO: 3544763 - DNA, 16 bp, Homo sapiens
tacttgtttgaatatt

SEQ ID NO: 3544764 - DNA, 14 bp, Homo sapiens
tactttaaacttgt

SEQ ID NO: 3544765 - DNA, 17 bp, Homo sapiens
tactttaaatgttctgt

SEQ ID NO: 3544766 - DNA, 18 bp, Homo sapiens
tactttacacaattctta

SEQ ID NO: 3544767 - DNA, 19 bp, Homo sapiens
tactttataactaacatgt

SEQ ID NO: 3544768 - DNA, 23 bp, Homo sapiens
tactttataactaacatgtcctg

SEQ ID NO: 3544769 - DNA, 21 bp, Homo sapiens
tactttctatctcatctgtct

SEQ ID NO: 3544770 - DNA, 15 bp, Homo sapiens
tactttctatgtgac

SEQ ID NO: 3544771 - DNA, 16 bp, Homo sapiens
tactttctatgtgaca

SEQ ID NO: 3544772 - DNA, 18 bp, Homo sapiens
tactttgaagtgcagctc

SEQ ID NO: 3544773 - DNA, 20 bp, Homo sapiens
tactttgtgctcataaattg

SEQ ID NO: 3544774 - DNA, 12 bp, Homo sapiens
tacttttcaaag

SEQ ID NO: 3544775 - DNA, 12 bp, Homo sapiens
tacttttccttt

SEQ ID NO: 3544776 - DNA, 12 bp, Homo sapiens
tagaaaaaacaa

SEQ ID NO: 3544777 - DNA, 19 bp, Homo sapiens
tagaaaaagtcaatgtact

SEQ ID NO: 3544778 - DNA, 23 bp, Homo sapiens
tagaaaaagtcaatgtacttgtt

SEQ ID NO: 3544779 - DNA, 17 bp, Homo sapiens
tagaaaatgacttattt

SEQ ID NO: 3544780 - DNA, 13 bp, Homo sapiens
tagaaactacaaa

SEQ ID NO: 3544781 - DNA, 16 bp, Homo sapiens
tagaaactgaggccca

SEQ ID NO: 3544782 - DNA, 19 bp, Homo sapiens
tagaaactgaggcccagag

SEQ ID NO: 3544783 - DNA, 16 bp, Homo sapiens
tagaaagagaaacagt

SEQ ID NO: 3544784 - DNA, 15 bp, Homo sapiens
tagaaatataattga

SEQ ID NO: 3544785 - DNA, 19 bp, Homo sapiens
tagaaattacacccaaaga

SEQ ID NO: 3544786 - DNA, 15 bp, Homo sapiens
tagaacacaggcaaa

SEQ ID NO: 3544787 - DNA, 19 bp, Homo sapiens
tagaacattccatttgctt

SEQ ID NO: 3544788 - DNA, 17 bp, Homo sapiens
tagaactcctgtcttct

SEQ ID NO: 3544789 - DNA, 15 bp, Homo sapiens
tagaataggcagggg

SEQ ID NO: 3544790 - DNA, 21 bp, Homo sapiens
tagaatggataaaataatgct

SEQ ID NO: 3544791 - DNA, 18 bp, Homo sapiens
tagaatggttgagttaca

SEQ ID NO: 3544792 - DNA, 19 bp, Homo sapiens
tagaatgttttcaaatgtt

SEQ ID NO: 3544793 - DNA, 22 bp, Homo sapiens
tagacaaagccttaagcaaatt

SEQ ID NO: 3544794 - DNA, 18 bp, Homo sapiens
tagacaattgaggtaagt

SEQ ID NO: 3544795 - DNA, 19 bp, Homo sapiens
tagacacatatgaggggga

SEQ ID NO: 3544796 - DNA, 14 bp, Homo sapiens
tagacagcatgaga

SEQ ID NO: 3544797 - DNA, 18 bp, Homo sapiens
tagacattcagactaaaa

SEQ ID NO: 3544798 - DNA, 15 bp, Homo sapiens
tagacattctcacat

SEQ ID NO: 3544799 - DNA, 13 bp, Homo sapiens
tagaccaaagcaa

SEQ ID NO: 3544800 - DNA, 16 bp, Homo sapiens
tagaccaaagcaaaga

SEQ ID NO: 3544801 - DNA, 20 bp, Homo sapiens
tagacttgaaagttttccag

SEQ ID NO: 3544802 - DNA, 20 bp, Homo sapiens
tagagaaaataaatttaact

SEQ ID NO: 3544803 - DNA, 20 bp, Homo sapiens
tagagaaaattcaggtctgt

SEQ ID NO: 3544804 - DNA, 19 bp, Homo sapiens
tagagaagtatacataagt

SEQ ID NO: 3544805 - DNA, 23 bp, Homo sapiens
tagagactttgatactaccaggg

SEQ ID NO: 3544806 - DNA, 23 bp, Homo sapiens
tagagagaaccaataaaagtggt

SEQ ID NO: 3544807 - DNA, 15 bp, Homo sapiens
tagagataattgctt

SEQ ID NO: 3544808 - DNA, 18 bp, Homo sapiens
tagagcccctactgtggg

SEQ ID NO: 3544809 - DNA, 18 bp, Homo sapiens
tagagctaaaaaggccct

SEQ ID NO: 3544810 - DNA, 21 bp, Homo sapiens
tagagctcttgtgttcagaag

SEQ ID NO: 3544811 - DNA, 22 bp, Homo sapiens
tagagctcttgtgttcagaaga

SEQ ID NO: 3544812 - DNA, 23 bp, Homo sapiens
tagagctcttgtgttcagaagaa

SEQ ID NO: 3544813 - DNA, 23 bp, Homo sapiens
taagcccccagggcctccagggc

SEQ ID NO: 3544814 - DNA, 20 bp, Homo sapiens
taagccgcagacctggagct

SEQ ID NO: 3544815 - DNA, 20 bp, Homo sapiens
taagccttataaaccaatct

SEQ ID NO: 3544816 - DNA, 22 bp, Homo sapiens
taagctggctgtacctgttcct

SEQ ID NO: 3544817 - DNA, 13 bp, Homo sapiens
taagctttgttct

SEQ ID NO: 3544818 - DNA, 17 bp, Homo sapiens
taagctttgttctggga

SEQ ID NO: 3544819 - DNA, 18 bp, Homo sapiens
taaggatagtgtgaagat

SEQ ID NO: 3544820 - DNA, 19 bp, Homo sapiens
taaggatagtgtgaagatc

SEQ ID NO: 3544821 - DNA, 17 bp, Homo sapiens
taaggcacagtgggagc

SEQ ID NO: 3544822 - DNA, 19 bp, Homo sapiens
taaggtctaatcagtgatt

SEQ ID NO: 3544823 - DNA, 10 bp, Homo sapiens
taaggtggct

SEQ ID NO: 3544824 - DNA, 18 bp, Homo sapiens
taaggttacctttgttcc

SEQ ID NO: 3544825 - DNA, 13 bp, Homo sapiens
taagtaaaaccac

SEQ ID NO: 3544826 - DNA, 15 bp, Homo sapiens
taagtaaaaccacag

SEQ ID NO: 3544827 - DNA, 16 bp, Homo sapiens
taagtaaaaccacagc

SEQ ID NO: 3544828 - DNA, 18 bp, Homo sapiens
taagtaaaaccacagcag

SEQ ID NO: 3544829 - DNA, 13 bp, Homo sapiens
taagtaaaagtct

SEQ ID NO: 3544830 - DNA, 20 bp, Homo sapiens
taagtaacttttaaaatttg

SEQ ID NO: 3544831 - DNA, 14 bp, Homo sapiens
taagtaatttagaa

SEQ ID NO: 3544832 - DNA, 10 bp, Homo sapiens
taagtattta

SEQ ID NO: 3544833 - DNA, 18 bp, Homo sapiens
taagtatttaaatgttct

SEQ ID NO: 3544834 - DNA, 17 bp, Homo sapiens
taagtcattggcaaagt

SEQ ID NO: 3544835 - DNA, 15 bp, Homo sapiens
taagtgaaaatatag

SEQ ID NO: 3544836 - DNA, 13 bp, Homo sapiens
taagttatctttg

SEQ ID NO: 3544837 - DNA, 13 bp, Homo sapiens
taagttgaccttt

SEQ ID NO: 3544838 - DNA, 23 bp, Homo sapiens
taagttgacctttatttattaaa

SEQ ID NO: 3544839 - DNA, 15 bp, Homo sapiens
taataaacataatga

SEQ ID NO: 3544840 - DNA, 12 bp, Homo sapiens
taataaactctc

SEQ ID NO: 3544841 - DNA, 15 bp, Homo sapiens
taataaactctctag

SEQ ID NO: 3544842 - DNA, 20 bp, Homo sapiens
taataaactcttaagagaac

SEQ ID NO: 3544843 - DNA, 12 bp, Homo sapiens
taataaagagaa

SEQ ID NO: 3544844 - DNA, 16 bp, Homo sapiens
taataaaggactgtaa

SEQ ID NO: 3544845 - DNA, 14 bp, Homo sapiens
taataaattgctta

SEQ ID NO: 3544846 - DNA, 19 bp, Homo sapiens
taataaattgcttactgat

SEQ ID NO: 3544847 - DNA, 16 bp, Homo sapiens
taataataaagaatag

SEQ ID NO: 3544848 - DNA, 18 bp, Homo sapiens
taataatattaataagaa

SEQ ID NO: 3544849 - DNA, 16 bp, Homo sapiens
taataatttttgctga

SEQ ID NO: 3544850 - DNA, 19 bp, Homo sapiens
taatacaagtaatattatt

SEQ ID NO: 3544851 - DNA, 20 bp, Homo sapiens
taataccacagctatttaga

SEQ ID NO: 3544852 - DNA, 16 bp, Homo sapiens
taataggtcatatgtt

SEQ ID NO: 3544853 - DNA, 14 bp, Homo sapiens
taatagtagatttg

SEQ ID NO: 3544854 - DNA, 21 bp, Homo sapiens
taatataccagcttgtatgca

SEQ ID NO: 3544855 - DNA, 12 bp, Homo sapiens
taatatggattt

SEQ ID NO: 3544856 - DNA, 21 bp, Homo sapiens
taatattgatatgcttataca

SEQ ID NO: 3544857 - DNA, 15 bp, Homo sapiens
taatatttaccaaag

SEQ ID NO: 3544858 - DNA, 17 bp, Homo sapiens
taatatttaccaaagta

SEQ ID NO: 3544859 - DNA, 13 bp, Homo sapiens
taatatttctaaa

SEQ ID NO: 3544860 - DNA, 21 bp, Homo sapiens
taatcaaattctgtctgggga

SEQ ID NO: 3544861 - DNA, 22 bp, Homo sapiens
taatcaaattctgtctggggac

SEQ ID NO: 3544862 - DNA, 11 bp, Homo sapiens
taatcaagaga

SEQ ID NO: 3544863 - DNA, 16 bp, Homo sapiens
taatcaagagaaactt

SEQ ID NO: 3544864 - DNA, 20 bp, Homo sapiens
taatcagtgattatttttcc

SEQ ID NO: 3544865 - DNA, 14 bp, Homo sapiens
taatcatacaaact

SEQ ID NO: 3544866 - DNA, 15 bp, Homo sapiens
taatcatacaaactc

SEQ ID NO: 3544867 - DNA, 18 bp, Homo sapiens
taatcatacaaactctca

SEQ ID NO: 3544868 - DNA, 13 bp, Homo sapiens
taatccaccccca

SEQ ID NO: 3544869 - DNA, 14 bp, Homo sapiens
taatccacccccag

SEQ ID NO: 3544870 - DNA, 18 bp, Homo sapiens
taatccaggcagatccag

SEQ ID NO: 3544871 - DNA, 19 bp, Homo sapiens
taatccaggcagatccagg

SEQ ID NO: 3544872 - DNA, 23 bp, Homo sapiens
taatccaggcagatccaggacta

SEQ ID NO: 3544873 - DNA, 12 bp, Homo sapiens
taatccatttca

SEQ ID NO: 3544874 - DNA, 18 bp, Homo sapiens
taatccatttcaggactc

SEQ ID NO: 3544875 - DNA, 18 bp, Homo sapiens
taatcctgtaccaaatct

SEQ ID NO: 3544876 - DNA, 23 bp, Homo sapiens
taatcctgtaccaaatctgacat

SEQ ID NO: 3544877 - DNA, 19 bp, Homo sapiens
taatctaaaagctctgttc

SEQ ID NO: 3544878 - DNA, 14 bp, Homo sapiens
taatctagaacaca

SEQ ID NO: 3544879 - DNA, 22 bp, Homo sapiens
taatctagaacacaggcaaaat

SEQ ID NO: 3544880 - DNA, 16 bp, Homo sapiens
taatctagttgtcaat

SEQ ID NO: 3544881 - DNA, 13 bp, Homo sapiens
taatctgatgtat

SEQ ID NO: 3544882 - DNA, 19 bp, Homo sapiens
taatctgatgtataatgta

SEQ ID NO: 3544883 - DNA, 15 bp, Homo sapiens
taatctggactcctc

SEQ ID NO: 3544884 - DNA, 17 bp, Homo sapiens
gttttgaagattctatg

SEQ ID NO: 3544885 - DNA, 18 bp, Homo sapiens
gttttggatgttgctata

SEQ ID NO: 3544886 - DNA, 18 bp, Homo sapiens
gttttggcagccatgata

SEQ ID NO: 3544887 - DNA, 20 bp, Homo sapiens
gttttggcagccatgataat

SEQ ID NO: 3544888 - DNA, 22 bp, Homo sapiens
gttttgtatacagagaagaaaa

SEQ ID NO: 3544889 - DNA, 22 bp, Homo sapiens
gtttttaacttttaatttaaaa

SEQ ID NO: 3544890 - DNA, 21 bp, Homo sapiens
gtttttaagggtttgtggaaa

SEQ ID NO: 3544891 - DNA, 21 bp, Homo sapiens
gtttttaatttaaactgtgtt

SEQ ID NO: 3544892 - DNA, 18 bp, Homo sapiens
gtttttattgtaaaacaa

SEQ ID NO: 3544893 - DNA, 16 bp, Homo sapiens
gtttttcaattaaacg

SEQ ID NO: 3544894 - DNA, 20 bp, Homo sapiens
gtttttcatcttttgaagag

SEQ ID NO: 3544895 - DNA, 18 bp, Homo sapiens
gtttttccttgtagcatt

SEQ ID NO: 3544896 - DNA, 22 bp, Homo sapiens
gtttttgtatttattaatttga

SEQ ID NO: 3544897 - DNA, 17 bp, Homo sapiens
gttttttcttctttctt

SEQ ID NO: 3544898 - DNA, 14 bp, Homo sapiens
taaaaaaaagaaac

SEQ ID NO: 3544899 - DNA, 17 bp, Homo sapiens
taaaaaaaagaaacttt

SEQ ID NO: 3544900 - DNA, 14 bp, Homo sapiens
taaaaacacaaaaa

SEQ ID NO: 3544901 - DNA, 19 bp, Homo sapiens
taaaaagatgaaaaagaat

SEQ ID NO: 3544902 - DNA, 16 bp, Homo sapiens
taaaaagcctctttct

SEQ ID NO: 3544903 - DNA, 11 bp, Homo sapiens
taaaaaggaca

SEQ ID NO: 3544904 - DNA, 18 bp, Homo sapiens
taaaaaggacatcagcaa

SEQ ID NO: 3544905 - DNA, 15 bp, Homo sapiens
taaaaaggcccttag

SEQ ID NO: 3544906 - DNA, 17 bp, Homo sapiens
taaaaaggcccttagag

SEQ ID NO: 3544907 - DNA, 19 bp, Homo sapiens
taaaaagtataaaatagta

SEQ ID NO: 3544908 - DNA, 14 bp, Homo sapiens
taaaaagtgtttaa

SEQ ID NO: 3544909 - DNA, 16 bp, Homo sapiens
taaaaagttgttcttt

SEQ ID NO: 3544910 - DNA, 17 bp, Homo sapiens
taaaaataccttctatg

SEQ ID NO: 3544911 - DNA, 16 bp, Homo sapiens
taaaaatcatatagac

SEQ ID NO: 3544912 - DNA, 21 bp, Homo sapiens
taaaaatgaaggaattacatt

SEQ ID NO: 3544913 - DNA, 12 bp, Homo sapiens
taaaaatttata

SEQ ID NO: 3544914 - DNA, 15 bp, Homo sapiens
taaaacaaagggaaa

SEQ ID NO: 3544915 - DNA, 13 bp, Homo sapiens
taaaacaaatgaa

SEQ ID NO: 3544916 - DNA, 21 bp, Homo sapiens
taaaacaattctgtgacatac

SEQ ID NO: 3544917 - DNA, 15 bp, Homo sapiens
taaaacactcatccc

SEQ ID NO: 3544918 - DNA, 15 bp, Homo sapiens
taaaacataaacaca

SEQ ID NO: 3544919 - DNA, 13 bp, Homo sapiens
taaaaccacagca

SEQ ID NO: 3544920 - DNA, 20 bp, Homo sapiens
taaaacccaaaggtggcagc

SEQ ID NO: 3544921 - DNA, 23 bp, Homo sapiens
taaaactgctcatttcatgaagc

SEQ ID NO: 3544922 - DNA, 23 bp, Homo sapiens
taaaactgggattaagaaacctt

SEQ ID NO: 3544923 - DNA, 15 bp, Homo sapiens
taaaacttctgctcg

SEQ ID NO: 3544924 - DNA, 13 bp, Homo sapiens
taaaagaagcttt

SEQ ID NO: 3544925 - DNA, 14 bp, Homo sapiens
taaaagatgaaaat

SEQ ID NO: 3544926 - DNA, 20 bp, Homo sapiens
taaaagcacaagtacttttg

SEQ ID NO: 3544927 - DNA, 16 bp, Homo sapiens
taaaagcattttgtaa

SEQ ID NO: 3544928 - DNA, 16 bp, Homo sapiens
taaaaggatgtataaa

SEQ ID NO: 3544929 - DNA, 17 bp, Homo sapiens
taaaaggtcaaaactga

SEQ ID NO: 3544930 - DNA, 16 bp, Homo sapiens
taaaagtaataaagag

SEQ ID NO: 3544931 - DNA, 12 bp, Homo sapiens
taaaagtttcta

SEQ ID NO: 3544932 - DNA, 19 bp, Homo sapiens
taaaataacagatttctca

SEQ ID NO: 3544933 - DNA, 18 bp, Homo sapiens
taaaatcaacttaacatg

SEQ ID NO: 3544934 - DNA, 15 bp, Homo sapiens
taaaatctaaaattt

SEQ ID NO: 3544935 - DNA, 21 bp, Homo sapiens
taaaatctgcttgtattccaa

SEQ ID NO: 3544936 - DNA, 15 bp, Homo sapiens
taaaatgaggatcca

SEQ ID NO: 3544937 - DNA, 19 bp, Homo sapiens
taaaatggcaagttttcca

SEQ ID NO: 3544938 - DNA, 17 bp, Homo sapiens
taaaatggcgaacatgt

SEQ ID NO: 3544939 - DNA, 16 bp, Homo sapiens
taaaatggtttgtcct

SEQ ID NO: 3544940 - DNA, 14 bp, Homo sapiens
taaaatgtattcaa

SEQ ID NO: 3544941 - DNA, 18 bp, Homo sapiens
taaaatgttaaaacataa

SEQ ID NO: 3544942 - DNA, 21 bp, Homo sapiens
taaaatgtttggatggtttgt

SEQ ID NO: 3544943 - DNA, 20 bp, Homo sapiens
taaaattaatgcagatttct

SEQ ID NO: 3544944 - DNA, 16 bp, Homo sapiens
taaaattgttatcaaa

SEQ ID NO: 3544945 - DNA, 15 bp, Homo sapiens
taaaatttcataatt

SEQ ID NO: 3544946 - DNA, 17 bp, Homo sapiens
taaaatttcataattct

SEQ ID NO: 3544947 - DNA, 23 bp, Homo sapiens
taaacaaaaaacccacaattgaa

SEQ ID NO: 3544948 - DNA, 23 bp, Homo sapiens
taaacaaacaaattaatgttgtt

SEQ ID NO: 3544949 - DNA, 13 bp, Homo sapiens
taaacaaagacat

SEQ ID NO: 3544950 - DNA, 16 bp, Homo sapiens
taaacaaagacattga

SEQ ID NO: 3544951 - DNA, 18 bp, Homo sapiens
taaacaaagacattgaca

SEQ ID NO: 3544952 - DNA, 20 bp, Homo sapiens
taaacaatctttcatgtctt

SEQ ID NO: 3544953 - DNA, 14 bp, Homo sapiens
taaacacatttcca

SEQ ID NO: 3544954 - DNA, 23 bp, Homo sapiens
taaacacatttccattcatggat

SEQ ID NO: 3544955 - DNA, 19 bp, Homo sapiens
taaacagacaggaatttag

SEQ ID NO: 3544956 - DNA, 19 bp, Homo sapiens
taaacagttatgaaaactt

SEQ ID NO: 3544957 - DNA, 15 bp, Homo sapiens
taaacataataaatc

SEQ ID NO: 3544958 - DNA, 23 bp, Homo sapiens
taaacataataaatcacacattc

SEQ ID NO: 3544959 - DNA, 16 bp, Homo sapiens
taaacataatgaaaat

SEQ ID NO: 3544960 - DNA, 16 bp, Homo sapiens
taaacatattcaagga

SEQ ID NO: 3544961 - DNA, 14 bp, Homo sapiens
taaacattaatatt

SEQ ID NO: 3544962 - DNA, 19 bp, Homo sapiens
taaacattaatatttacca

SEQ ID NO: 3544963 - DNA, 19 bp, Homo sapiens
taaacattattaagtaact

SEQ ID NO: 3544964 - DNA, 18 bp, Homo sapiens
taaaccccaagcttccca

SEQ ID NO: 3544965 - DNA, 19 bp, Homo sapiens
taaaccccaagcttcccaa

SEQ ID NO: 3544966 - DNA, 13 bp, Homo sapiens
taaacggattatt

SEQ ID NO: 3544967 - DNA, 15 bp, Homo sapiens
taaacggattatttt

SEQ ID NO: 3544968 - DNA, 16 bp, Homo sapiens
taaacggattattttt

SEQ ID NO: 3544969 - DNA, 17 bp, Homo sapiens
taaacggattatttttt

SEQ ID NO: 3544970 - DNA, 22 bp, Homo sapiens
taaacggattattttttcagac

SEQ ID NO: 3544971 - DNA, 22 bp, Homo sapiens
taaacggttcctggtgactcct

SEQ ID NO: 3544972 - DNA, 17 bp, Homo sapiens
gttcttcagtcctttgt

SEQ ID NO: 3544973 - DNA, 19 bp, Homo sapiens
gttcttcagtcctttgtct

SEQ ID NO: 3544974 - DNA, 21 bp, Homo sapiens
gttcttgggggaggccacccc

SEQ ID NO: 3544975 - DNA, 20 bp, Homo sapiens
gttctttcatttgctttgga

SEQ ID NO: 3544976 - DNA, 19 bp, Homo sapiens
gttctttcctccccctgca

SEQ ID NO: 3544977 - DNA, 14 bp, Homo sapiens
gttctttcttcctc

SEQ ID NO: 3544978 - DNA, 18 bp, Homo sapiens
gttctttcttcctctgct

SEQ ID NO: 3544979 - DNA, 15 bp, Homo sapiens
gttctttgggccaga

SEQ ID NO: 3544980 - DNA, 22 bp, Homo sapiens
gttgaaaatgcaactctaactc

SEQ ID NO: 3544981 - DNA, 16 bp, Homo sapiens
gttgaagcgcggaccc

SEQ ID NO: 3544982 - DNA, 19 bp, Homo sapiens
gttgacaggtacttggagg

SEQ ID NO: 3544983 - DNA, 13 bp, Homo sapiens
gttgacagtatta

SEQ ID NO: 3544984 - DNA, 18 bp, Homo sapiens
gttgacagtattaacact

SEQ ID NO: 3544985 - DNA, 11 bp, Homo sapiens
gttgaccttta

SEQ ID NO: 3544986 - DNA, 13 bp, Homo sapiens
gttgagtgtgtgg

SEQ ID NO: 3544987 - DNA, 12 bp, Homo sapiens
gttgataaaaac

SEQ ID NO: 3544988 - DNA, 19 bp, Homo sapiens
gttgatataaaactctggg

SEQ ID NO: 3544989 - DNA, 15 bp, Homo sapiens
gttgatggaaaataa

SEQ ID NO: 3544990 - DNA, 20 bp, Homo sapiens
gttgcagccgcagagaaatg

SEQ ID NO: 3544991 - DNA, 13 bp, Homo sapiens
gttgcctgacttt

SEQ ID NO: 3544992 - DNA, 13 bp, Homo sapiens
gttgcgtttttcc

SEQ ID NO: 3544993 - DNA, 15 bp, Homo sapiens
gttgctaatgacagc

SEQ ID NO: 3544994 - DNA, 22 bp, Homo sapiens
gttgctaatgacagccttgcaa

SEQ ID NO: 3544995 - DNA, 13 bp, Homo sapiens
gttgctatttcca

SEQ ID NO: 3544996 - DNA, 15 bp, Homo sapiens
gttgctggtcctgca

SEQ ID NO: 3544997 - DNA, 13 bp, Homo sapiens
gttgctgtggctc

SEQ ID NO: 3544998 - DNA, 15 bp, Homo sapiens
gttgctgtggctcca

SEQ ID NO: 3544999 - DNA, 17 bp, Homo sapiens
gttgctgttaatctgat

SEQ ID NO: 3545000 - DNA, 19 bp, Homo sapiens
gttgctgttttcctccctt

SEQ ID NO: 3545001 - DNA, 21 bp, Homo sapiens
gttgcttctcaggctatatgc

SEQ ID NO: 3545002 - DNA, 22 bp, Homo sapiens
gttggaatgaattaaataaacc

SEQ ID NO: 3545003 - DNA, 21 bp, Homo sapiens
gttggacgggatgacctccag

SEQ ID NO: 3545004 - DNA, 23 bp, Homo sapiens
gttggacgggatgacctccagaa

SEQ ID NO: 3545005 - DNA, 23 bp, Homo sapiens
gttggagcagcaggcctctggga

SEQ ID NO: 3545006 - DNA, 13 bp, Homo sapiens
gttggcaccttcc

SEQ ID NO: 3545007 - DNA, 16 bp, Homo sapiens
gttggcaccttccccc

SEQ ID NO: 3545008 - DNA, 12 bp, Homo sapiens
gttggcaggccc

SEQ ID NO: 3545009 - DNA, 13 bp, Homo sapiens
gttggcaggccca

SEQ ID NO: 3545010 - DNA, 16 bp, Homo sapiens
gttgggagcctagctc

SEQ ID NO: 3545011 - DNA, 18 bp, Homo sapiens
gttgggaggatacagagg

SEQ ID NO: 3545012 - DNA, 18 bp, Homo sapiens
gttgggcccctgaggagc

SEQ ID NO: 3545013 - DNA, 19 bp, Homo sapiens
gttgggcccctgaggagct

SEQ ID NO: 3545014 - DNA, 15 bp, Homo sapiens
gttgggggtcgggtg

SEQ ID NO: 3545015 - DNA, 21 bp, Homo sapiens
gttgggtcaccagacggggct

SEQ ID NO: 3545016 - DNA, 19 bp, Homo sapiens
gttggtctgccttctgctg

SEQ ID NO: 3545017 - DNA, 13 bp, Homo sapiens
gttggtggtgctg

SEQ ID NO: 3545018 - DNA, 17 bp, Homo sapiens
gttgtaaaatagaaaaa

SEQ ID NO: 3545019 - DNA, 14 bp, Homo sapiens
gttgtagcagaaac

SEQ ID NO: 3545020 - DNA, 14 bp, Homo sapiens
gttgtcaataaatg

SEQ ID NO: 3545021 - DNA, 18 bp, Homo sapiens
gttgtcacatctcaggga

SEQ ID NO: 3545022 - DNA, 19 bp, Homo sapiens
gttgtctgaagtcactgca

SEQ ID NO: 3545023 - DNA, 20 bp, Homo sapiens
gttgtgagaatggcctggag

SEQ ID NO: 3545024 - DNA, 16 bp, Homo sapiens
gttgtgtgtatatgta

SEQ ID NO: 3545025 - DNA, 13 bp, Homo sapiens
gttgtgtgtggga

SEQ ID NO: 3545026 - DNA, 14 bp, Homo sapiens
gttgtgtgtgggag

SEQ ID NO: 3545027 - DNA, 22 bp, Homo sapiens
gttgttgtgtgtatatgtattt

SEQ ID NO: 3545028 - DNA, 10 bp, Homo sapiens
gtttaaaatc

SEQ ID NO: 3545029 - DNA, 18 bp, Homo sapiens
gtttaaacaatctttcat

SEQ ID NO: 3545030 - DNA, 20 bp, Homo sapiens
gtttaaacaatctttcatgt

SEQ ID NO: 3545031 - DNA, 13 bp, Homo sapiens
gtttaaagaaagt

SEQ ID NO: 3545032 - DNA, 16 bp, Homo sapiens
gtttaaagaaagtgta

SEQ ID NO: 3545033 - DNA, 21 bp, Homo sapiens
gtttaaagaaagtgtatttgg

SEQ ID NO: 3545034 - DNA, 15 bp, Homo sapiens
gtttaattcagcaga

SEQ ID NO: 3545035 - DNA, 13 bp, Homo sapiens
gtttacagtattt

SEQ ID NO: 3545036 - DNA, 20 bp, Homo sapiens
gtttacatgaagcagaacct

SEQ ID NO: 3545037 - DNA, 13 bp, Homo sapiens
gtttacattttta

SEQ ID NO: 3545038 - DNA, 14 bp, Homo sapiens
gtttagaaaaaaca

SEQ ID NO: 3545039 - DNA, 20 bp, Homo sapiens
gtttagatgaggctcagaga

SEQ ID NO: 3545040 - DNA, 21 bp, Homo sapiens
gtttaggctggtggcccagga

SEQ ID NO: 3545041 - DNA, 14 bp, Homo sapiens
gtttataataaaaa

SEQ ID NO: 3545042 - DNA, 14 bp, Homo sapiens
gtttataattggct

SEQ ID NO: 3545043 - DNA, 23 bp, Homo sapiens
gtttatagagaatgatgataaca

SEQ ID NO: 3545044 - DNA, 15 bp, Homo sapiens
gtttatccaaatctt

SEQ ID NO: 3545045 - DNA, 16 bp, Homo sapiens
gtttatccaaatcttg

SEQ ID NO: 3545046 - DNA, 21 bp, Homo sapiens
gtttattaatcttagtgtatg

SEQ ID NO: 3545047 - DNA, 18 bp, Homo sapiens
gtttattctttgcaaata

SEQ ID NO: 3545048 - DNA, 22 bp, Homo sapiens
gtttattgaattcatttcactg

SEQ ID NO: 3545049 - DNA, 15 bp, Homo sapiens
gtttcagaccccccc

SEQ ID NO: 3545050 - DNA, 21 bp, Homo sapiens
gtttcatgttagttaccttat

SEQ ID NO: 3545051 - DNA, 19 bp, Homo sapiens
gtttccagagagtggagag

SEQ ID NO: 3545052 - DNA, 16 bp, Homo sapiens
gtttccatcatttctg

SEQ ID NO: 3545053 - DNA, 17 bp, Homo sapiens
gtttccatcatttctgt

SEQ ID NO: 3545054 - DNA, 21 bp, Homo sapiens
gtttcccatcccactgctccc

SEQ ID NO: 3545055 - DNA, 16 bp, Homo sapiens
gtttcccattggttca

SEQ ID NO: 3545056 - DNA, 21 bp, Homo sapiens
gtttcccattggttcacctgt

SEQ ID NO: 3545057 - DNA, 17 bp, Homo sapiens
gtttcccgtaaggctgt

SEQ ID NO: 3545058 - DNA, 14 bp, Homo sapiens
gtttccgctttgct

SEQ ID NO: 3545059 - DNA, 17 bp, Homo sapiens
gtttccttttcaggaga

SEQ ID NO: 3545060 - DNA, 15 bp, Homo sapiens
gtttctacattcaga

SEQ ID NO: 3545061 - DNA, 16 bp, Homo sapiens
gtttctattctgtcag

SEQ ID NO: 3545062 - DNA, 17 bp, Homo sapiens
gtttctccatgttggtc

SEQ ID NO: 3545063 - DNA, 19 bp, Homo sapiens
gtttctccttttcctatcc

SEQ ID NO: 3545064 - DNA, 20 bp, Homo sapiens
gtttctctaaggaattattt

SEQ ID NO: 3545065 - DNA, 17 bp, Homo sapiens
gtttctgtttgattctt

SEQ ID NO: 3545066 - DNA, 21 bp, Homo sapiens
gtttcttgctgccatgatgta

SEQ ID NO: 3545067 - DNA, 15 bp, Homo sapiens
gtttctttaaaattg

SEQ ID NO: 3545068 - DNA, 19 bp, Homo sapiens
gtttctttctctgaggaca

SEQ ID NO: 3545069 - DNA, 17 bp, Homo sapiens
gttcctgaagctgctgt

SEQ ID NO: 3545070 - DNA, 15 bp, Homo sapiens
gttcctggtgactcc

SEQ ID NO: 3545071 - DNA, 20 bp, Homo sapiens
gttcctgtggggttgttttt

SEQ ID NO: 3545072 - DNA, 20 bp, Homo sapiens
gttcctgtgtgaccctgggc

SEQ ID NO: 3545073 - DNA, 15 bp, Homo sapiens
gttccttatccctct

SEQ ID NO: 3545074 - DNA, 19 bp, Homo sapiens
gttccttatccctctcttc

SEQ ID NO: 3545075 - DNA, 19 bp, Homo sapiens
gttcctttgttaaatttag

SEQ ID NO: 3545076 - DNA, 20 bp, Homo sapiens
gttccttttttcaatatgca

SEQ ID NO: 3545077 - DNA, 20 bp, Homo sapiens
gttcgagaccagcctggcca

SEQ ID NO: 3545078 - DNA, 16 bp, Homo sapiens
gttcgatacctggagc

SEQ ID NO: 3545079 - DNA, 22 bp, Homo sapiens
gttctaggcatacttttcaaag

SEQ ID NO: 3545080 - DNA, 17 bp, Homo sapiens
gttctattttactgtct

SEQ ID NO: 3545081 - DNA, 18 bp, Homo sapiens
gttctattttactgtctt

SEQ ID NO: 3545082 - DNA, 20 bp, Homo sapiens
gttctcacttattattaata

SEQ ID NO: 3545083 - DNA, 18 bp, Homo sapiens
gttctccagtcattatgt

SEQ ID NO: 3545084 - DNA, 10 bp, Homo sapiens
gttctctgaa

SEQ ID NO: 3545085 - DNA, 19 bp, Homo sapiens
gttctgaggccagaaaggt

SEQ ID NO: 3545086 - DNA, 17 bp, Homo sapiens
gttctgcctctccctgg

SEQ ID NO: 3545087 - DNA, 19 bp, Homo sapiens
gttctgcctgccagctgca

SEQ ID NO: 3545088 - DNA, 21 bp, Homo sapiens
gttctgctccataccttttct

SEQ ID NO: 3545089 - DNA, 13 bp, Homo sapiens
gttctgctcctgc

SEQ ID NO: 3545090 - DNA, 14 bp, Homo sapiens
gttctgctcctgct

SEQ ID NO: 3545091 - DNA, 22 bp, Homo sapiens
gttctgctcctgcttttctgtc

SEQ ID NO: 3545092 - DNA, 21 bp, Homo sapiens
gttctgggagttgctgttaat

SEQ ID NO: 3545093 - DNA, 16 bp, Homo sapiens
gttctgtagattcatg

SEQ ID NO: 3545094 - DNA, 22 bp, Homo sapiens
gttctgtgtcctctgcctgggc

SEQ ID NO: 3545095 - DNA, 22 bp, Homo sapiens
gttcttacctgtatgtctccag

SEQ ID NO: 3545096 - DNA, 20 bp, Homo sapiens
gttcttagagtgtagctgta

SEQ ID NO: 3545097 - DNA, 21 bp, Homo sapiens
gttcttataagaagaagagag

SEQ ID NO: 3545098 - DNA, 17 bp, Homo sapiens
gttcttatgcaaaatgg

SEQ ID NO: 3545099 - DNA, 15 bp, Homo sapiens
gttcttcagtccttt

SEQ ID NO: 3545100 - DNA, 16 bp, Homo sapiens
ctgtattttctttcac

SEQ ID NO: 3545101 - DNA, 20 bp, Homo sapiens
ctgtattttctttcacttta

SEQ ID NO: 3545102 - DNA, 18 bp, Homo sapiens
ctgtcaagagggaggaag

SEQ ID NO: 3545103 - DNA, 19 bp, Homo sapiens
ctgtcacccacagaccgcc

SEQ ID NO: 3545104 - DNA, 21 bp, Homo sapiens
ctgtcagcaagactgaagatg

SEQ ID NO: 3545105 - DNA, 21 bp, Homo sapiens
ctgtcagctcccctcggagaa

SEQ ID NO: 3545106 - DNA, 18 bp, Homo sapiens
ctgtcagtggggcagcct

SEQ ID NO: 3545107 - DNA, 19 bp, Homo sapiens
ctgtcagtggggcagcctc

SEQ ID NO: 3545108 - DNA, 22 bp, Homo sapiens
ctgtcagtggggcagcctctcc

SEQ ID NO: 3545109 - DNA, 20 bp, Homo sapiens
ctgtcatcctcaaagaaagt

SEQ ID NO: 3545110 - DNA, 23 bp, Homo sapiens
ctgtcatcctcaaagaaagtgta

SEQ ID NO: 3545111 - DNA, 16 bp, Homo sapiens
ctgtcattcagaaaaa

SEQ ID NO: 3545112 - DNA, 18 bp, Homo sapiens
ctgtccagctccaacctg

SEQ ID NO: 3545113 - DNA, 23 bp, Homo sapiens
ctgtccaggcactgctgcccagc

SEQ ID NO: 3545114 - DNA, 15 bp, Homo sapiens
ctgtcccacccacac

SEQ ID NO: 3545115 - DNA, 21 bp, Homo sapiens
ctgtcccacccacacagctgc

SEQ ID NO: 3545116 - DNA, 21 bp, Homo sapiens
ctgtccctagtaaaaatacaa

SEQ ID NO: 3545117 - DNA, 17 bp, Homo sapiens
ctgtccctctagtgcct

SEQ ID NO: 3545118 - DNA, 19 bp, Homo sapiens
ctgtccctctagtgccttc

SEQ ID NO: 3545119 - DNA, 15 bp, Homo sapiens
ctgtccgtgcccctt

SEQ ID NO: 3545120 - DNA, 19 bp, Homo sapiens
ctgtccgtgccccttccct

SEQ ID NO: 3545121 - DNA, 21 bp, Homo sapiens
ctgtccgtgccccttccctgg

SEQ ID NO: 3545122 - DNA, 20 bp, Homo sapiens
ctgtcctcagccttgccaga

SEQ ID NO: 3545123 - DNA, 12 bp, Homo sapiens
ctgtcctccaag

SEQ ID NO: 3545124 - DNA, 15 bp, Homo sapiens
ctgtcctccaagcca

SEQ ID NO: 3545125 - DNA, 21 bp, Homo sapiens
ctgtcctccgtgaaaatatgt

SEQ ID NO: 3545126 - DNA, 15 bp, Homo sapiens
ctgtcctcttggcca

SEQ ID NO: 3545127 - DNA, 18 bp, Homo sapiens
ctgtcctcttggccatcc

SEQ ID NO: 3545128 - DNA, 12 bp, Homo sapiens
ctgtcctctttg

SEQ ID NO: 3545129 - DNA, 22 bp, Homo sapiens
ctgtcctgccacccagccccag

SEQ ID NO: 3545130 - DNA, 13 bp, Homo sapiens
ctgtcctggaggt

SEQ ID NO: 3545131 - DNA, 13 bp, Homo sapiens
ctgtcctgggcct

SEQ ID NO: 3545132 - DNA, 14 bp, Homo sapiens
ctgtcctgggcctg

SEQ ID NO: 3545133 - DNA, 12 bp, Homo sapiens
ctgtccttccct

SEQ ID NO: 3545134 - DNA, 13 bp, Homo sapiens
ctgtccttgccct

SEQ ID NO: 3545135 - DNA, 20 bp, Homo sapiens
ctgtcgaaggggaggcacac

SEQ ID NO: 3545136 - DNA, 21 bp, Homo sapiens
ctgtcgaaggggaggcacact

SEQ ID NO: 3545137 - DNA, 15 bp, Homo sapiens
ctgtcgttaaaaaca

SEQ ID NO: 3545138 - DNA, 19 bp, Homo sapiens
ctgtctcatcttctgaaga

SEQ ID NO: 3545139 - DNA, 16 bp, Homo sapiens
ctgtctccagctgcct

SEQ ID NO: 3545140 - DNA, 17 bp, Homo sapiens
ctgtctccagctgcctg

SEQ ID NO: 3545141 - DNA, 17 bp, Homo sapiens
ctgtctcggctctgcat

SEQ ID NO: 3545142 - DNA, 18 bp, Homo sapiens
ctgtctgagacaggtgcc

SEQ ID NO: 3545143 - DNA, 14 bp, Homo sapiens
ctgtctgctgccag

SEQ ID NO: 3545144 - DNA, 14 bp, Homo sapiens
ctgtctggccctgg

SEQ ID NO: 3545145 - DNA, 12 bp, Homo sapiens
ctgtctgtctct

SEQ ID NO: 3545146 - DNA, 18 bp, Homo sapiens
ctgtctgttgtattcatt

SEQ ID NO: 3545147 - DNA, 14 bp, Homo sapiens
ctgtcttctttctc

SEQ ID NO: 3545148 - DNA, 21 bp, Homo sapiens
ctgtcttctttctccatggag

SEQ ID NO: 3545149 - DNA, 23 bp, Homo sapiens
ctgtcttctttctccatggagcc

SEQ ID NO: 3545150 - DNA, 12 bp, Homo sapiens
ctgtcttgaatt

SEQ ID NO: 3545151 - DNA, 13 bp, Homo sapiens
ctgtctttaagaa

SEQ ID NO: 3545152 - DNA, 18 bp, Homo sapiens
ctgtctttcttgctccct

SEQ ID NO: 3545153 - DNA, 22 bp, Homo sapiens
ctgtctttcttgctccctgact

SEQ ID NO: 3545154 - DNA, 23 bp, Homo sapiens
ctgtctttcttgctccctgactg

SEQ ID NO: 3545155 - DNA, 21 bp, Homo sapiens
ctgtgaacaagcttcagtaag

SEQ ID NO: 3545156 - DNA, 17 bp, Homo sapiens
ctgtgaacttgactggg

SEQ ID NO: 3545157 - DNA, 14 bp, Homo sapiens
ctgtgacctctgac

SEQ ID NO: 3545158 - DNA, 15 bp, Homo sapiens
ctgtgactcctgttg

SEQ ID NO: 3545159 - DNA, 21 bp, Homo sapiens
ctgtgactcctgttgccatgg

SEQ ID NO: 3545160 - DNA, 22 bp, Homo sapiens
ctgtgactcttagccctcacca

SEQ ID NO: 3545161 - DNA, 23 bp, Homo sapiens
ctgtgagcacaaagaagaaagct

SEQ ID NO: 3545162 - DNA, 17 bp, Homo sapiens
ctgtgaggggtgtttgg

SEQ ID NO: 3545163 - DNA, 22 bp, Homo sapiens
ctgtgatctgggtctctaatct

SEQ ID NO: 3545164 - DNA, 19 bp, Homo sapiens
ctgtgatgacattccctgc

SEQ ID NO: 3545165 - DNA, 15 bp, Homo sapiens
ctgtgattggctggt

SEQ ID NO: 3545166 - DNA, 17 bp, Homo sapiens
ctgtgatttttatcaca

SEQ ID NO: 3545167 - DNA, 13 bp, Homo sapiens
ctgtgcagaccca

SEQ ID NO: 3545168 - DNA, 13 bp, Homo sapiens
ctgtgcctcctca

SEQ ID NO: 3545169 - DNA, 16 bp, Homo sapiens
ctgtgcctcctcaccc

SEQ ID NO: 3545170 - DNA, 15 bp, Homo sapiens
ctgtgcctctgcctg

SEQ ID NO: 3545171 - DNA, 14 bp, Homo sapiens
ctgtgcctctggga

SEQ ID NO: 3545172 - DNA, 16 bp, Homo sapiens
ctgtgcctctgggact

SEQ ID NO: 3545173 - DNA, 14 bp, Homo sapiens
ctgtgccttccctt

SEQ ID NO: 3545174 - DNA, 14 bp, Homo sapiens
ctgtgcctttccta

SEQ ID NO: 3545175 - DNA, 19 bp, Homo sapiens
ctgtgcgtcccagctgaag

SEQ ID NO: 3545176 - DNA, 17 bp, Homo sapiens
ctgtgctccacactcag

SEQ ID NO: 3545177 - DNA, 13 bp, Homo sapiens
ctgtgctctggca

SEQ ID NO: 3545178 - DNA, 21 bp, Homo sapiens
ctgtgctctggcaccatcagc

SEQ ID NO: 3545179 - DNA, 17 bp, Homo sapiens
ctgtgctggggcacggc

SEQ ID NO: 3545180 - DNA, 14 bp, Homo sapiens
ctgtgctgtactga

SEQ ID NO: 3545181 - DNA, 12 bp, Homo sapiens
ctgtgctttgga

SEQ ID NO: 3545182 - DNA, 15 bp, Homo sapiens
ctgtgctttggaaca

SEQ ID NO: 3545183 - DNA, 17 bp, Homo sapiens
ctgtggagatggactca

SEQ ID NO: 3545184 - DNA, 14 bp, Homo sapiens
ctgtggagctgcca

SEQ ID NO: 3545185 - DNA, 23 bp, Homo sapiens
ctgtggagctgccacagagaagt

SEQ ID NO: 3545186 - DNA, 19 bp, Homo sapiens
ctgtggcagagttacagtt

SEQ ID NO: 3545187 - DNA, 13 bp, Homo sapiens
ctgtggccctggc

SEQ ID NO: 3545188 - DNA, 13 bp, Homo sapiens
ctgtggcctgcag

SEQ ID NO: 3545189 - DNA, 14 bp, Homo sapiens
ctgtggcctgcagg

SEQ ID NO: 3545190 - DNA, 18 bp, Homo sapiens
ctgtggcctgcaggaggg

SEQ ID NO: 3545191 - DNA, 11 bp, Homo sapiens
ctgtggctcca

SEQ ID NO: 3545192 - DNA, 19 bp, Homo sapiens
ctgtggggaacacagctac

SEQ ID NO: 3545193 - DNA, 14 bp, Homo sapiens
ctgtggtgcagtgt

SEQ ID NO: 3545194 - DNA, 16 bp, Homo sapiens
ctgtggtgcagtgtgt

SEQ ID NO: 3545195 - DNA, 17 bp, Homo sapiens
ctgtggtttcatgttag

SEQ ID NO: 3545196 - DNA, 15 bp, Homo sapiens
ctgtgtacaatgtga

SEQ ID NO: 3545197 - DNA, 16 bp, Homo sapiens
ctgtgtacaatgtgag

SEQ ID NO: 3545198 - DNA, 18 bp, Homo sapiens
ctgtgtcatttcttcact

SEQ ID NO: 3545199 - DNA, 16 bp, Homo sapiens
ctgtgtcctaaggccc

SEQ ID NO: 3545200 - DNA, 15 bp, Homo sapiens
ctgtgtcctccacca

SEQ ID NO: 3545201 - DNA, 17 bp, Homo sapiens
ctgtgtcctccaccatg

SEQ ID NO: 3545202 - DNA, 19 bp, Homo sapiens
ctgtgtcctctgcctgggc

SEQ ID NO: 3545203 - DNA, 17 bp, Homo sapiens
ctgtgtgagtgagcaca

SEQ ID NO: 3545204 - DNA, 18 bp, Homo sapiens
ctgtgtgctgtttgaaaa

SEQ ID NO: 3545205 - DNA, 22 bp, Homo sapiens
ctgtgtgtccaaaactgcctca

SEQ ID NO: 3545206 - DNA, 16 bp, Homo sapiens
ctgtgtgtgtgtatgt

SEQ ID NO: 3545207 - DNA, 20 bp, Homo sapiens
ctgtgtgtgtgtatgtgggg

SEQ ID NO: 3545208 - DNA, 21 bp, Homo sapiens
ctgtgtgtgtgtatgtggggg

SEQ ID NO: 3545209 - DNA, 16 bp, Homo sapiens
ctgtgtgtttatgtgt

SEQ ID NO: 3545210 - DNA, 20 bp, Homo sapiens
ctgtgtgtttatgtgtgtgt

SEQ ID NO: 3545211 - DNA, 16 bp, Homo sapiens
ctgtgttaactgttca

SEQ ID NO: 3545212 - DNA, 15 bp, Homo sapiens
ctgtgttatgaaaat

SEQ ID NO: 3545213 - DNA, 20 bp, Homo sapiens
ctgtgttcgactcagcctca

SEQ ID NO: 3545214 - DNA, 21 bp, Homo sapiens
ctgtgttcgactcagcctcag

SEQ ID NO: 3545215 - DNA, 11 bp, Homo sapiens
ctgtgttgaaa

SEQ ID NO: 3545216 - DNA, 20 bp, Homo sapiens
ctgtgttgaaacagaaaaat

SEQ ID NO: 3545217 - DNA, 21 bp, Homo sapiens
ctgtgtttaactgctgcaggg

SEQ ID NO: 3545218 - DNA, 15 bp, Homo sapiens
ctgttaaaagatgaa

SEQ ID NO: 3545219 - DNA, 20 bp, Homo sapiens
ctgttaaaagatgaaaatat

SEQ ID NO: 3545220 - DNA, 21 bp, Homo sapiens
ctgttaaaagatgaaaatatt

SEQ ID NO: 3545221 - DNA, 23 bp, Homo sapiens
ctgttaaaagatgaaaatatttg

SEQ ID NO: 3545222 - DNA, 13 bp, Homo sapiens
ctgttaatctgat

SEQ ID NO: 3545223 - DNA, 13 bp, Homo sapiens
ctgttacaaaaga

SEQ ID NO: 3545224 - DNA, 18 bp, Homo sapiens
ctgttacactttttggaa

SEQ ID NO: 3545225 - DNA, 19 bp, Homo sapiens
ctgttacactttttggaag

SEQ ID NO: 3545226 - DNA, 16 bp, Homo sapiens
ctgcagttaccacagc

SEQ ID NO: 3545227 - DNA, 18 bp, Homo sapiens
ctgcatctgaccagcagc

SEQ ID NO: 3545228 - DNA, 22 bp, Homo sapiens
ctgcatctgaccagcagcgcct

SEQ ID NO: 3545229 - DNA, 15 bp, Homo sapiens
ctgcatgagctggca

SEQ ID NO: 3545230 - DNA, 16 bp, Homo sapiens
ctgcatgagctggcaa

SEQ ID NO: 3545231 - DNA, 14 bp, Homo sapiens
ctgcatgttttcca

SEQ ID NO: 3545232 - DNA, 19 bp, Homo sapiens
ctgcattaccagcttaaaa

SEQ ID NO: 3545233 - DNA, 15 bp, Homo sapiens
ctgcattattctctt

SEQ ID NO: 3545234 - DNA, 19 bp, Homo sapiens
ctgcattcctttttcttca

SEQ ID NO: 3545235 - DNA, 19 bp, Homo sapiens
ctgcattctctcccatcct

SEQ ID NO: 3545236 - DNA, 21 bp, Homo sapiens
ctgcattctctcccatcctgg

SEQ ID NO: 3545237 - DNA, 15 bp, Homo sapiens
ctgcatttaaaaaaa

SEQ ID NO: 3545238 - DNA, 22 bp, Homo sapiens
ctgcatttgtgaaatgatggtg

SEQ ID NO: 3545239 - DNA, 15 bp, Homo sapiens
ctgccaaaatgctct

SEQ ID NO: 3545240 - DNA, 14 bp, Homo sapiens
ctgccaagccagat

SEQ ID NO: 3545241 - DNA, 17 bp, Homo sapiens
ctgccaagccagattct

SEQ ID NO: 3545242 - DNA, 15 bp, Homo sapiens
ctgccaaggagcatc

SEQ ID NO: 3545243 - DNA, 21 bp, Homo sapiens
ctgccaaggagcatccttggc

SEQ ID NO: 3545244 - DNA, 12 bp, Homo sapiens
ctgccacacagg

SEQ ID NO: 3545245 - DNA, 13 bp, Homo sapiens
ctgccacacttca

SEQ ID NO: 3545246 - DNA, 19 bp, Homo sapiens
ctgccacatggagccccct

SEQ ID NO: 3545247 - DNA, 12 bp, Homo sapiens
ctgccaccagca

SEQ ID NO: 3545248 - DNA, 16 bp, Homo sapiens
ctgccaccagcatcca

SEQ ID NO: 3545249 - DNA, 18 bp, Homo sapiens
ctgccacccacctccctg

SEQ ID NO: 3545250 - DNA, 19 bp, Homo sapiens
ctgccacccacctccctgc

SEQ ID NO: 3545251 - DNA, 18 bp, Homo sapiens
ctgccacccagccccagc

SEQ ID NO: 3545252 - DNA, 16 bp, Homo sapiens
ctgccacccccttccc

SEQ ID NO: 3545253 - DNA, 21 bp, Homo sapiens
ctgccacccccttccctggga

SEQ ID NO: 3545254 - DNA, 23 bp, Homo sapiens
ctgccacccccttccctgggagg

SEQ ID NO: 3545255 - DNA, 14 bp, Homo sapiens
ctgccaggctgttt

SEQ ID NO: 3545256 - DNA, 14 bp, Homo sapiens
ctgccagggcttcc

SEQ ID NO: 3545257 - DNA, 16 bp, Homo sapiens
ctgccaggggctctgt

SEQ ID NO: 3545258 - DNA, 17 bp, Homo sapiens
ctgccaggggctctgtg

SEQ ID NO: 3545259 - DNA, 22 bp, Homo sapiens
ctgggcatgggtccagggcctg

SEQ ID NO: 3545260 - DNA, 21 bp, Homo sapiens
ctgggcattagcaaggcagag

SEQ ID NO: 3545261 - DNA, 14 bp, Homo sapiens
ctctctgagtcaaa

SEQ ID NO: 3545262 - DNA, 15 bp, Homo sapiens
ctctctgagtcaaat

SEQ ID NO: 3545263 - DNA, 17 bp, Homo sapiens
ctctctgagtcaaatcc

SEQ ID NO: 3545264 - DNA, 22 bp, Homo sapiens
ctctctgagtcaaatccagtgg

SEQ ID NO: 3545265 - DNA, 18 bp, Homo sapiens
ctctctggctggtcttca

SEQ ID NO: 3545266 - DNA, 15 bp, Homo sapiens
ctctcttcctccact

SEQ ID NO: 3545267 - DNA, 17 bp, Homo sapiens
ctctcttcctccacttc

SEQ ID NO: 3545268 - DNA, 23 bp, Homo sapiens
ctctcttgtcctcttctgctctt

SEQ ID NO: 3545269 - DNA, 21 bp, Homo sapiens
ctctcttgttgtccaggctgg

SEQ ID NO: 3545270 - DNA, 14 bp, Homo sapiens
ctctgacagtccac

SEQ ID NO: 3545271 - DNA, 17 bp, Homo sapiens
ctctgacatcccttcct

SEQ ID NO: 3545272 - DNA, 21 bp, Homo sapiens
ctctgagggggtgggggtgcc

SEQ ID NO: 3545273 - DNA, 13 bp, Homo sapiens
ctctgaggggtgg

SEQ ID NO: 3545274 - DNA, 19 bp, Homo sapiens
ctctgagtcaaatccagtg

SEQ ID NO: 3545275 - DNA, 19 bp, Homo sapiens
ctctgattagttgacagta

SEQ ID NO: 3545276 - DNA, 21 bp, Homo sapiens
ctctgattagttgacagtatt

SEQ ID NO: 3545277 - DNA, 18 bp, Homo sapiens
ctctgattttcaaagctt

SEQ ID NO: 3545278 - DNA, 19 bp, Homo sapiens
ctctgattttcaaagcttt

SEQ ID NO: 3545279 - DNA, 17 bp, Homo sapiens
ctctgcacagacaagca

SEQ ID NO: 3545280 - DNA, 14 bp, Homo sapiens
ctctgcacccagaa

SEQ ID NO: 3545281 - DNA, 16 bp, Homo sapiens
ctctgcacccgcctcg

SEQ ID NO: 3545282 - DNA, 17 bp, Homo sapiens
ctctgcacccgcctcga

SEQ ID NO: 3545283 - DNA, 17 bp, Homo sapiens
ctctgcacgctcaatgc

SEQ ID NO: 3545284 - DNA, 22 bp, Homo sapiens
ctctgcacgctcaatgcccagt

SEQ ID NO: 3545285 - DNA, 19 bp, Homo sapiens
ctctgcactcccacctgac

SEQ ID NO: 3545286 - DNA, 14 bp, Homo sapiens
ctctgcagcccatt

SEQ ID NO: 3545287 - DNA, 21 bp, Homo sapiens
ctctgcagcccattcccaagg

SEQ ID NO: 3545288 - DNA, 12 bp, Homo sapiens
ctctgcagtttt

SEQ ID NO: 3545289 - DNA, 15 bp, Homo sapiens
ctctgcatgttttcc

SEQ ID NO: 3545290 - DNA, 17 bp, Homo sapiens
ctctgcatttaaaaaaa

SEQ ID NO: 3545291 - DNA, 14 bp, Homo sapiens
ctctgcccaaccct

SEQ ID NO: 3545292 - DNA, 13 bp, Homo sapiens
ctctgccccagcc

SEQ ID NO: 3545293 - DNA, 17 bp, Homo sapiens
ctctgccccagcctgtc

SEQ ID NO: 3545294 - DNA, 24 bp, Homo sapiens
ctctgccccatcctccagcaggga

SEQ ID NO: 3545295 - DNA, 12 bp, Homo sapiens
ctctgccctggg

SEQ ID NO: 3545296 - DNA, 21 bp, Homo sapiens
ctctgccggtcgggcagccag

SEQ ID NO: 3545297 - DNA, 23 bp, Homo sapiens
ctctgccggtcgggcagccagca

SEQ ID NO: 3545298 - DNA, 24 bp, Homo sapiens
ctctgccggtcgggcagccagcag

SEQ ID NO: 3545299 - DNA, 13 bp, Homo sapiens
ctctgcctcacct

SEQ ID NO: 3545300 - DNA, 15 bp, Homo sapiens
ctctgcctcctcttc

SEQ ID NO: 3545301 - DNA, 12 bp, Homo sapiens
ctctgcctgggc

SEQ ID NO: 3545302 - DNA, 20 bp, Homo sapiens
ctctgcgtcggtcctggtgc

SEQ ID NO: 3545303 - DNA, 11 bp, Homo sapiens
ctctgctggga

SEQ ID NO: 3545304 - DNA, 15 bp, Homo sapiens
ctctggaataaagtt

SEQ ID NO: 3545305 - DNA, 21 bp, Homo sapiens
ctctggaataaagttgcagat

SEQ ID NO: 3545306 - DNA, 22 bp, Homo sapiens
ctctggaataaagttgcagatg

SEQ ID NO: 3545307 - DNA, 23 bp, Homo sapiens
ctctggactggaaagcacaagac

SEQ ID NO: 3545308 - DNA, 13 bp, Homo sapiens
ctctggagaacag

SEQ ID NO: 3545309 - DNA, 18 bp, Homo sapiens
ctctggagaacagtggtt

SEQ ID NO: 3545310 - DNA, 17 bp, Homo sapiens
ctctggagaaggcctgg

SEQ ID NO: 3545311 - DNA, 12 bp, Homo sapiens
ctctggagtggc

SEQ ID NO: 3545312 - DNA, 13 bp, Homo sapiens
ctctggcaccatc

SEQ ID NO: 3545313 - DNA, 16 bp, Homo sapiens
ctctggcaccatcagc

SEQ ID NO: 3545314 - DNA, 21 bp, Homo sapiens
ctctggcaccatcagcctgtt

SEQ ID NO: 3545315 - DNA, 14 bp, Homo sapiens
ctctggcagcaccg

SEQ ID NO: 3545316 - DNA, 18 bp, Homo sapiens
ctctgggacccacagaac

SEQ ID NO: 3545317 - DNA, 14 bp, Homo sapiens
ctctgggagcccag

SEQ ID NO: 3545318 - DNA, 19 bp, Homo sapiens
ctctgggagcccagaaccc

SEQ ID NO: 3545319 - DNA, 17 bp, Homo sapiens
ctctgggcaaagcccct

SEQ ID NO: 3545320 - DNA, 21 bp, Homo sapiens
ctctgggcaaagcccctcaca

SEQ ID NO: 3545321 - DNA, 16 bp, Homo sapiens
ctctgggcctgagggt

SEQ ID NO: 3545322 - DNA, 23 bp, Homo sapiens
ctctggggacagcttcctcacac

SEQ ID NO: 3545323 - DNA, 18 bp, Homo sapiens
ctctgggggtcctctctg

SEQ ID NO: 3545324 - DNA, 17 bp, Homo sapiens
ctctgggtgctgccctg

SEQ ID NO: 3545325 - DNA, 17 bp, Homo sapiens
ctctggtaatattgact

SEQ ID NO: 3545326 - DNA, 19 bp, Homo sapiens
ctctgtaacatcgcacagt

SEQ ID NO: 3545327 - DNA, 14 bp, Homo sapiens
ctctgtccctgtcc

SEQ ID NO: 3545328 - DNA, 17 bp, Homo sapiens
ctctgtccgtgcccctt

SEQ ID NO: 3545329 - DNA, 17 bp, Homo sapiens
ctctgtcctcttggcca

SEQ ID NO: 3545330 - DNA, 20 bp, Homo sapiens
ctctgtgcacttatttatga

SEQ ID NO: 3545331 - DNA, 23 bp, Homo sapiens
ctctgtgccttgccacattaaat

SEQ ID NO: 3545332 - DNA, 21 bp, Homo sapiens
ctctgtggcaaaaagagtcag

SEQ ID NO: 3545333 - DNA, 20 bp, Homo sapiens
ctctgttaataatctcacat

SEQ ID NO: 3545334 - DNA, 13 bp, Homo sapiens
ctctgttacaaaa

SEQ ID NO: 3545335 - DNA, 22 bp, Homo sapiens
ctctgttacactttttggaagt

SEQ ID NO: 3545336 - DNA, 20 bp, Homo sapiens
ctctgttcctttctctgggc

SEQ ID NO: 3545337 - DNA, 18 bp, Homo sapiens
ctctgttggtctgccttc

SEQ ID NO: 3545338 - DNA, 23 bp, Homo sapiens
ctctgttggtctgccttctgctg

SEQ ID NO: 3545339 - DNA, 22 bp, Homo sapiens
ctcttaaagaaaacccaccccg

SEQ ID NO: 3545340 - DNA, 15 bp, Homo sapiens
ctcttacacactgga

SEQ ID NO: 3545341 - DNA, 16 bp, Homo sapiens
ctcttagctcagctga

SEQ ID NO: 3545342 - DNA, 14 bp, Homo sapiens
ctcttcccactcca

SEQ ID NO: 3545343 - DNA, 16 bp, Homo sapiens
ctcttcccactccagc

SEQ ID NO: 3545344 - DNA, 18 bp, Homo sapiens
ctcttcccactccagctg

SEQ ID NO: 3545345 - DNA, 22 bp, Homo sapiens
ctcttccccttagaaacactgc

SEQ ID NO: 3545346 - DNA, 14 bp, Homo sapiens
ctcttccccttccc

SEQ ID NO: 3545347 - DNA, 17 bp, Homo sapiens
ctcttccccttcctgtt

SEQ ID NO: 3545348 - DNA, 20 bp, Homo sapiens
ctcttccccttcctgtttca

SEQ ID NO: 3545349 - DNA, 22 bp, Homo sapiens
ctcttccccttcctgtttcaga

SEQ ID NO: 3545350 - DNA, 21 bp, Homo sapiens
ctcttcccgccgcccagccca

SEQ ID NO: 3545351 - DNA, 18 bp, Homo sapiens
ctcttccgggcagaaaca

SEQ ID NO: 3545352 - DNA, 18 bp, Homo sapiens
ctcttcgaagccttgcct

SEQ ID NO: 3545353 - DNA, 19 bp, Homo sapiens
ctcttctaacatgaaatat

SEQ ID NO: 3545354 - DNA, 21 bp, Homo sapiens
ctcttctaacatgaaatatat

SEQ ID NO: 3545355 - DNA, 19 bp, Homo sapiens
ctcttctattttgtaaact

SEQ ID NO: 3545356 - DNA, 12 bp, Homo sapiens
ctcttctccact

SEQ ID NO: 3545357 - DNA, 14 bp, Homo sapiens
ctcttctccactgg

SEQ ID NO: 3545358 - DNA, 15 bp, Homo sapiens
ctcttctccactgga

SEQ ID NO: 3545359 - DNA, 17 bp, Homo sapiens
ctcttctccactggatg

SEQ ID NO: 3545360 - DNA, 19 bp, Homo sapiens
ctcttctccactggatgga

SEQ ID NO: 3545361 - DNA, 13 bp, Homo sapiens
ctcttctctccag

SEQ ID NO: 3545362 - DNA, 19 bp, Homo sapiens
ctcttctctccagctgact

SEQ ID NO: 3545363 - DNA, 22 bp, Homo sapiens
ctcttctctccagctgactaaa

SEQ ID NO: 3545364 - DNA, 10 bp, Homo sapiens
ctcttctgaa

SEQ ID NO: 3545365 - DNA, 12 bp, Homo sapiens
ctcttctgctct

SEQ ID NO: 3545366 - DNA, 15 bp, Homo sapiens
ctcttcttctgaaga

SEQ ID NO: 3545367 - DNA, 14 bp, Homo sapiens
ctcttgaaaagttc

SEQ ID NO: 3545368 - DNA, 15 bp, Homo sapiens
ctcttgatctctctt

SEQ ID NO: 3545369 - DNA, 20 bp, Homo sapiens
ctcttgatctctcttgtcct

SEQ ID NO: 3545370 - DNA, 16 bp, Homo sapiens
ctcttgccactgcctc

SEQ ID NO: 3545371 - DNA, 17 bp, Homo sapiens
ctcttgccactgcctct

SEQ ID NO: 3545372 - DNA, 19 bp, Homo sapiens
ctcttgccactgcctcttc

SEQ ID NO: 3545373 - DNA, 22 bp, Homo sapiens
ctcttgccactgcctcttcctc

SEQ ID NO: 3545374 - DNA, 14 bp, Homo sapiens
ctcttggccatcct

SEQ ID NO: 3545375 - DNA, 14 bp, Homo sapiens
ctcttggctccact

SEQ ID NO: 3545376 - DNA, 15 bp, Homo sapiens
ctcttggctgacccc

SEQ ID NO: 3545377 - DNA, 21 bp, Homo sapiens
ctcttggctgacccctctggt

SEQ ID NO: 3545378 - DNA, 23 bp, Homo sapiens
ctcttgggaccccagagaaaacc

SEQ ID NO: 3545379 - DNA, 22 bp, Homo sapiens
ctcttggttcgatacctggagc

SEQ ID NO: 3545380 - DNA, 21 bp, Homo sapiens
ctcttgtattatctcctttga

SEQ ID NO: 3545381 - DNA, 15 bp, Homo sapiens
ctcttgtcctcttct

SEQ ID NO: 3545382 - DNA, 16 bp, Homo sapiens
ctcttgtgttcagaag

SEQ ID NO: 3545383 - DNA, 17 bp, Homo sapiens
ctcttgttgtccaggct

SEQ ID NO: 3545384 - DNA, 17 bp, Homo sapiens
ctctttaataaattgct

SEQ ID NO: 3545385 - DNA, 22 bp, Homo sapiens
ctctttatcaagcaacattctt

SEQ ID NO: 3545386 - DNA, 14 bp, Homo sapiens
ctctttcatctgta

SEQ ID NO: 3545387 - DNA, 13 bp, Homo sapiens
ctctttccaccat

SEQ ID NO: 3545388 - DNA, 20 bp, Homo sapiens
ctctttcttattttgtaata

SEQ ID NO: 3545389 - DNA, 23 bp, Homo sapiens
ctctttcttattttgtaataaac

SEQ ID NO: 3545390 - DNA, 15 bp, Homo sapiens
ctctttcttttctct

SEQ ID NO: 3545391 - DNA, 14 bp, Homo sapiens
ctctttgctttgct

SEQ ID NO: 3545392 - DNA, 18 bp, Homo sapiens
ctctttgctttgctttct

SEQ ID NO: 3545393 - DNA, 22 bp, Homo sapiens
ctctttgctttgctttctgctc

SEQ ID NO: 3545394 - DNA, 17 bp, Homo sapiens
ctcttttcctggcagct

SEQ ID NO: 3545395 - DNA, 21 bp, Homo sapiens
ctcttttcctggcagctgctg

SEQ ID NO: 3545396 - DNA, 20 bp, Homo sapiens
ctcttttcctggtgctcttt

SEQ ID NO: 3545397 - DNA, 15 bp, Homo sapiens
ctcttttctttctgt

SEQ ID NO: 3545398 - DNA, 13 bp, Homo sapiens
ctctttttaaagt

SEQ ID NO: 3545399 - DNA, 13 bp, Homo sapiens
ctgaaaaagacat

SEQ ID NO: 3545400 - DNA, 16 bp, Homo sapiens
ctgaaaaagacataaa

SEQ ID NO: 3545401 - DNA, 14 bp, Homo sapiens
ctgaaaaaggaact

SEQ ID NO: 3545402 - DNA, 22 bp, Homo sapiens
ctgaaaaatctaagtgatataa

SEQ ID NO: 3545403 - DNA, 15 bp, Homo sapiens
ctgaaaacctctcct

SEQ ID NO: 3545404 - DNA, 20 bp, Homo sapiens
ctgaaaatattgttttacaa

SEQ ID NO: 3545405 - DNA, 22 bp, Homo sapiens
ctgaaaatattgttttacaata

SEQ ID NO: 3545406 - DNA, 15 bp, Homo sapiens
ctgaaaatttaacag

SEQ ID NO: 3545407 - DNA, 15 bp, Homo sapiens
ctgaaacaacttgga

SEQ ID NO: 3545408 - DNA, 22 bp, Homo sapiens
ctgaaagagtccattgtttaaa

SEQ ID NO: 3545409 - DNA, 15 bp, Homo sapiens
ctgaaaggccagcag

SEQ ID NO: 3545410 - DNA, 17 bp, Homo sapiens
ctgaaaggccagcagct

SEQ ID NO: 3545411 - DNA, 19 bp, Homo sapiens
ctgaaagtgaaagtccaga

SEQ ID NO: 3545412 - DNA, 23 bp, Homo sapiens
ctgaaagtgaaagtccagaaact

SEQ ID NO: 3545413 - DNA, 22 bp, Homo sapiens
ctgaaatatccacccagcaggc

SEQ ID NO: 3545414 - DNA, 17 bp, Homo sapiens
ctgaaattcaccaagaa

SEQ ID NO: 3545415 - DNA, 14 bp, Homo sapiens
ctgaaatttcagat

SEQ ID NO: 3545416 - DNA, 23 bp, Homo sapiens
ctgaaatttgttatacttcaaaa

SEQ ID NO: 3545417 - DNA, 12 bp, Homo sapiens
ctgaacaagaat

SEQ ID NO: 3545418 - DNA, 13 bp, Homo sapiens
ctgaacaagaatt

SEQ ID NO: 3545419 - DNA, 16 bp, Homo sapiens
ctgaacaagaattgga

SEQ ID NO: 3545420 - DNA, 23 bp, Homo sapiens
ctgaacaggaaagagctaggaac

SEQ ID NO: 3545421 - DNA, 13 bp, Homo sapiens
ctgaactccaccg

SEQ ID NO: 3545422 - DNA, 21 bp, Homo sapiens
ctgaactccaccgaccaactg

SEQ ID NO: 3545423 - DNA, 13 bp, Homo sapiens
ctgaactgaggag

SEQ ID NO: 3545424 - DNA, 16 bp, Homo sapiens
ctgaacttttgtggag

SEQ ID NO: 3545425 - DNA, 12 bp, Homo sapiens
ctgaagagcatt

SEQ ID NO: 3545426 - DNA, 15 bp, Homo sapiens
ctgaagagtcctctg

SEQ ID NO: 3545427 - DNA, 16 bp, Homo sapiens
ctgaagcaacatttta

SEQ ID NO: 3545428 - DNA, 19 bp, Homo sapiens
ctgaagcctttcttttgga

SEQ ID NO: 3545429 - DNA, 23 bp, Homo sapiens
ctgaagcctttgcattttggaga

SEQ ID NO: 3545430 - DNA, 19 bp, Homo sapiens
ctgaagctgctgcagctcc

SEQ ID NO: 3545431 - DNA, 14 bp, Homo sapiens
ctgaagctgctgtg

SEQ ID NO: 3545432 - DNA, 16 bp, Homo sapiens
ctgaagctgctgtgtc

SEQ ID NO: 3545433 - DNA, 22 bp, Homo sapiens
ctgaaggaataaattgctcctt

SEQ ID NO: 3545434 - DNA, 16 bp, Homo sapiens
ctgaaggcagtggcag

SEQ ID NO: 3545435 - DNA, 19 bp, Homo sapiens
ctgaaggggccatgatggc

SEQ ID NO: 3545436 - DNA, 19 bp, Homo sapiens
ctgaaggggttttcttgat

SEQ ID NO: 3545437 - DNA, 22 bp, Homo sapiens
ctgaagtcactgcacagtgcat

SEQ ID NO: 3545438 - DNA, 15 bp, Homo sapiens
ctgaagtctgagccc

SEQ ID NO: 3545439 - DNA, 18 bp, Homo sapiens
ctgaagtcttctcctcca

SEQ ID NO: 3545440 - DNA, 22 bp, Homo sapiens
ctgaagtgacctcactggcctg

SEQ ID NO: 3545441 - DNA, 15 bp, Homo sapiens
ctgaagtttttgaaa

SEQ ID NO: 3545442 - DNA, 16 bp, Homo sapiens
ctgaagtttttgaaat

SEQ ID NO: 3545443 - DNA, 23 bp, Homo sapiens
ctgaagtttttgaaatacctttg

SEQ ID NO: 3545444 - DNA, 15 bp, Homo sapiens
ctgaataaagcaatt

SEQ ID NO: 3545445 - DNA, 12 bp, Homo sapiens
ctgaatattttt

SEQ ID NO: 3545446 - DNA, 20 bp, Homo sapiens
ctgaatattttttatttcta

SEQ ID NO: 3545447 - DNA, 12 bp, Homo sapiens
ctgaatcagctg

SEQ ID NO: 3545448 - DNA, 15 bp, Homo sapiens
ctgaatcagctggac

SEQ ID NO: 3545449 - DNA, 17 bp, Homo sapiens
ctgaatcagctggacat

SEQ ID NO: 3545450 - DNA, 16 bp, Homo sapiens
ctgaatccgtacttgg

SEQ ID NO: 3545451 - DNA, 17 bp, Homo sapiens
ctgaatgaaaataactg

SEQ ID NO: 3545452 - DNA, 18 bp, Homo sapiens
ctgaatgaaaataactga

SEQ ID NO: 3545453 - DNA, 18 bp, Homo sapiens
ctgaatgcctcgctccct

SEQ ID NO: 3545454 - DNA, 20 bp, Homo sapiens
ctgaatgcctcgctcccttc

SEQ ID NO: 3545455 - DNA, 23 bp, Homo sapiens
ctgaatgcctcgctcccttcaag

SEQ ID NO: 3545456 - DNA, 13 bp, Homo sapiens
ctgaatttccctc

SEQ ID NO: 3545457 - DNA, 13 bp, Homo sapiens
ctgaatttcttct

SEQ ID NO: 3545458 - DNA, 15 bp, Homo sapiens
ctgacaattttacct

SEQ ID NO: 3545459 - DNA, 17 bp, Homo sapiens
ctgacacaccaggcgct

SEQ ID NO: 3545460 - DNA, 15 bp, Homo sapiens
ctgacaccccctccc

SEQ ID NO: 3545461 - DNA, 17 bp, Homo sapiens
ctgacaccccctccccg

SEQ ID NO: 3545462 - DNA, 16 bp, Homo sapiens
ctgacagactcactgg

SEQ ID NO: 3545463 - DNA, 21 bp, Homo sapiens
ctgacagccacaccgtggcag

SEQ ID NO: 3545464 - DNA, 23 bp, Homo sapiens
ctgacagccacaccgtggcagct

SEQ ID NO: 3545465 - DNA, 19 bp, Homo sapiens
ctgacagccttccccagct

SEQ ID NO: 3545466 - DNA, 19 bp, Homo sapiens
ctgacagctgctcctagag

SEQ ID NO: 3545467 - DNA, 22 bp, Homo sapiens
ctgacagctgctcctagaggga

SEQ ID NO: 3545468 - DNA, 13 bp, Homo sapiens
ctgacagggagca

SEQ ID NO: 3545469 - DNA, 14 bp, Homo sapiens
ctgacagggagcag

SEQ ID NO: 3545470 - DNA, 16 bp, Homo sapiens
ctgacagtcagctgtg

SEQ ID NO: 3545471 - DNA, 14 bp, Homo sapiens
ctgacagtccacag

SEQ ID NO: 3545472 - DNA, 19 bp, Homo sapiens
ctgacagtccacaggggcc

SEQ ID NO: 3545473 - DNA, 14 bp, Homo sapiens
ctgacatcccttcc

SEQ ID NO: 3545474 - DNA, 15 bp, Homo sapiens
ctgacatcccttcct

SEQ ID NO: 3545475 - DNA, 15 bp, Homo sapiens
ctgacatgctcacac

SEQ ID NO: 3545476 - DNA, 14 bp, Homo sapiens
ctgacattgctcca

SEQ ID NO: 3545477 - DNA, 20 bp, Homo sapiens
ctgacattgctccaagatgt

SEQ ID NO: 3545478 - DNA, 14 bp, Homo sapiens
ctgacattggagcc

SEQ ID NO: 3545479 - DNA, 16 bp, Homo sapiens
ctgacattggagcctg

SEQ ID NO: 3545480 - DNA, 15 bp, Homo sapiens
ctgaccagcagcgcc

SEQ ID NO: 3545481 - DNA, 22 bp, Homo sapiens
ctgaccagcagcgcctttccca

SEQ ID NO: 3545482 - DNA, 17 bp, Homo sapiens
ctgaccagcctccatgc

SEQ ID NO: 3545483 - DNA, 16 bp, Homo sapiens
ctgaccatcatgccct

SEQ ID NO: 3545484 - DNA, 19 bp, Homo sapiens
ctgaccatcatgccctctc

SEQ ID NO: 3545485 - DNA, 12 bp, Homo sapiens
ctgacccagcat

SEQ ID NO: 3545486 - DNA, 13 bp, Homo sapiens
ctgacccagtgcc

SEQ ID NO: 3545487 - DNA, 21 bp, Homo sapiens
ctgacccagtgcccccactga

SEQ ID NO: 3545488 - DNA, 23 bp, Homo sapiens
ctgacccagtgcccccactgacc

SEQ ID NO: 3545489 - DNA, 22 bp, Homo sapiens
ctgaccccaagggggctgctgc

SEQ ID NO: 3545490 - DNA, 19 bp, Homo sapiens
ctgacccccatctgagctg

SEQ ID NO: 3545491 - DNA, 22 bp, Homo sapiens
ctgaccccgagaagtgctcttg

SEQ ID NO: 3545492 - DNA, 16 bp, Homo sapiens
ctgacccctctggtgt

SEQ ID NO: 3545493 - DNA, 15 bp, Homo sapiens
ctgaccctcaggcac

SEQ ID NO: 3545494 - DNA, 22 bp, Homo sapiens
ctgaccctcaggcacaccttgc

SEQ ID NO: 3545495 - DNA, 21 bp, Homo sapiens
ctgaccgatgtgtctcccaga

SEQ ID NO: 3545496 - DNA, 14 bp, Homo sapiens
ctgacctaccccag

SEQ ID NO: 3545497 - DNA, 15 bp, Homo sapiens
ctgacctaccccagc

SEQ ID NO: 3545498 - DNA, 16 bp, Homo sapiens
ctgacctaccccagcc

SEQ ID NO: 3545499 - DNA, 20 bp, Homo sapiens
ctgacctaccccagccaggc

SEQ ID NO: 3545500 - DNA, 21 bp, Homo sapiens
ctgacctgagcggcaccctgg

SEQ ID NO: 3545501 - DNA, 15 bp, Homo sapiens
ctgaccttaaatgca

SEQ ID NO: 3545502 - DNA, 14 bp, Homo sapiens
ctgaccttgggtcc

SEQ ID NO: 3545503 - DNA, 12 bp, Homo sapiens
ctgacgattctt

SEQ ID NO: 3545504 - DNA, 19 bp, Homo sapiens
ctgacggccagggagaagc

SEQ ID NO: 3545505 - DNA, 14 bp, Homo sapiens
ctgactaaactttt

SEQ ID NO: 3545506 - DNA, 18 bp, Homo sapiens
ctgactagaactcctgtc

SEQ ID NO: 3545507 - DNA, 18 bp, Homo sapiens
ctgactccaaagctgttc

SEQ ID NO: 3545508 - DNA, 20 bp, Homo sapiens
ctgactccaaagctgttcca

SEQ ID NO: 3545509 - DNA, 15 bp, Homo sapiens
ctgactggaggaggc

SEQ ID NO: 3545510 - DNA, 21 bp, Homo sapiens
ctgactggccaaacccttgct

SEQ ID NO: 3545511 - DNA, 18 bp, Homo sapiens
ctgactgtcacaactcct

SEQ ID NO: 3545512 - DNA, 22 bp, Homo sapiens
ctgacttcagtgaatatttttg

SEQ ID NO: 3545513 - DNA, 13 bp, Homo sapiens
ctgacttctaagt

SEQ ID NO: 3545514 - DNA, 18 bp, Homo sapiens
ctgagaaagactattcaa

SEQ ID NO: 3545515 - DNA, 19 bp, Homo sapiens
ctgagaaagactattcaaa

SEQ ID NO: 3545516 - DNA, 15 bp, Homo sapiens
ctgagaaagaggcag

SEQ ID NO: 3545517 - DNA, 18 bp, Homo sapiens
ctgagaagccccgacaca

SEQ ID NO: 3545518 - DNA, 20 bp, Homo sapiens
ctgagaagccccgacacacg

SEQ ID NO: 3545519 - DNA, 13 bp, Homo sapiens
ctgagaccttgct

SEQ ID NO: 3545520 - DNA, 21 bp, Homo sapiens
ctgagagaccctggcctcaag

SEQ ID NO: 3545521 - DNA, 15 bp, Homo sapiens
ctgagagcatctcag

SEQ ID NO: 3545522 - DNA, 17 bp, Homo sapiens
ctgagagcatctcagga

SEQ ID NO: 3545523 - DNA, 17 bp, Homo sapiens
ctgagagctgtttttga

SEQ ID NO: 3545524 - DNA, 16 bp, Homo sapiens
ctgagatgccccgagc

SEQ ID NO: 3545525 - DNA, 21 bp, Homo sapiens
ctgagatgtgaacacatcagc

SEQ ID NO: 3545526 - DNA, 20 bp, Homo sapiens
ctgagcaaatattaaaattg

SEQ ID NO: 3545527 - DNA, 12 bp, Homo sapiens
ctgagcacttag

SEQ ID NO: 3545528 - DNA, 15 bp, Homo sapiens
ctgagcacttagcag

SEQ ID NO: 3545529 - DNA, 14 bp, Homo sapiens
ctgagcagccgcca

SEQ ID NO: 3545530 - DNA, 20 bp, Homo sapiens
ctgagcagccgccagctggg

SEQ ID NO: 3545531 - DNA, 13 bp, Homo sapiens
ctgagcagggatc

SEQ ID NO: 3545532 - DNA, 16 bp, Homo sapiens
ctgagcagggatctgc

SEQ ID NO: 3545533 - DNA, 20 bp, Homo sapiens
ctgagcagggatctgccccc

SEQ ID NO: 3545534 - DNA, 13 bp, Homo sapiens
ctgagcagggtcc

SEQ ID NO: 3545535 - DNA, 15 bp, Homo sapiens
ctgagcagggtccac

SEQ ID NO: 3545536 - DNA, 17 bp, Homo sapiens
ctgagcagggtccacag

SEQ ID NO: 3545537 - DNA, 22 bp, Homo sapiens
ctgagcagggtccacagctgga

SEQ ID NO: 3545538 - DNA, 22 bp, Homo sapiens
ctgagcaggtacatttctgatt

SEQ ID NO: 3545539 - DNA, 15 bp, Homo sapiens
ctgagcatggagaca

SEQ ID NO: 3545540 - DNA, 18 bp, Homo sapiens
ctgagcatggagacagca

SEQ ID NO: 3545541 - DNA, 14 bp, Homo sapiens
ctgagccagcaggg

SEQ ID NO: 3545542 - DNA, 18 bp, Homo sapiens
ctgagcccatttctgggg

SEQ ID NO: 3545543 - DNA, 16 bp, Homo sapiens
ctgagcccctggggaa

SEQ ID NO: 3545544 - DNA, 13 bp, Homo sapiens
ctgagcccctgtc

SEQ ID NO: 3545545 - DNA, 16 bp, Homo sapiens
ctgagcccctgtctag

SEQ ID NO: 3545546 - DNA, 23 bp, Homo sapiens
ctgagcccctgtctagagaggga

SEQ ID NO: 3545547 - DNA, 12 bp, Homo sapiens
ctgagcctggtc

SEQ ID NO: 3545548 - DNA, 19 bp, Homo sapiens
ctgagcggcaccctggtct

SEQ ID NO: 3545549 - DNA, 18 bp, Homo sapiens
ctgagctggaaggggcca

SEQ ID NO: 3545550 - DNA, 21 bp, Homo sapiens
ctgaggaaattgctttgtatt

SEQ ID NO: 3545551 - DNA, 18 bp, Homo sapiens
ctgaggaagagggactgt

SEQ ID NO: 3545552 - DNA, 23 bp, Homo sapiens
ctgaggagcagcaggagggggga

SEQ ID NO: 3545553 - DNA, 13 bp, Homo sapiens
ctgaggagctttg

SEQ ID NO: 3545554 - DNA, 20 bp, Homo sapiens
ctgaggcaggagaatcactt

SEQ ID NO: 3545555 - DNA, 13 bp, Homo sapiens
ctgaggccagaaa

SEQ ID NO: 3545556 - DNA, 23 bp, Homo sapiens
ctgaggccagaaaggtgtgagga

SEQ ID NO: 3545557 - DNA, 16 bp, Homo sapiens
ctgaggcccagagagg

SEQ ID NO: 3545558 - DNA, 22 bp, Homo sapiens
ctgaggcccctaggtgcccagg

SEQ ID NO: 3545559 - DNA, 22 bp, Homo sapiens
ctgaggcctgccccctgggctg

SEQ ID NO: 3545560 - DNA, 22 bp, Homo sapiens
ctgagggattgaggggccctgg

SEQ ID NO: 3545561 - DNA, 18 bp, Homo sapiens
ctgagggctaattctggg

SEQ ID NO: 3545562 - DNA, 20 bp, Homo sapiens
ctgagggggtgggggtgctg

SEQ ID NO: 3545563 - DNA, 13 bp, Homo sapiens
ctgagggtccacc

SEQ ID NO: 3545564 - DNA, 15 bp, Homo sapiens
ctgagggtccacctg

SEQ ID NO: 3545565 - DNA, 18 bp, Homo sapiens
ctgagggtcgtgggaaag

SEQ ID NO: 3545566 - DNA, 14 bp, Homo sapiens
ctgaggtcactgct

SEQ ID NO: 3545567 - DNA, 21 bp, Homo sapiens
ctgaggtccttatgtcctgtc

SEQ ID NO: 3545568 - DNA, 14 bp, Homo sapiens
ctgaggtgggagca

SEQ ID NO: 3545569 - DNA, 20 bp, Homo sapiens
ctgagtagctggattacagg

SEQ ID NO: 3545570 - DNA, 14 bp, Homo sapiens
ctgagtcaaatcca

SEQ ID NO: 3545571 - DNA, 15 bp, Homo sapiens
ctgagtcaaatccag

SEQ ID NO: 3545572 - DNA, 17 bp, Homo sapiens
ctgagtcaaatccagtg

SEQ ID NO: 3545573 - DNA, 18 bp, Homo sapiens
ctgagtcaaatccagtgg

SEQ ID NO: 3545574 - DNA, 20 bp, Homo sapiens
ctgagtcaaatccagtggtg

SEQ ID NO: 3545575 - DNA, 21 bp, Homo sapiens
ctcattctggttccctgctgc

SEQ ID NO: 3545576 - DNA, 21 bp, Homo sapiens
ctcattgctctgaatatgtca

SEQ ID NO: 3545577 - DNA, 21 bp, Homo sapiens
ctcatttagcattgaaataat

SEQ ID NO: 3545578 - DNA, 22 bp, Homo sapiens
ctcatttagcattgaaataata

SEQ ID NO: 3545579 - DNA, 20 bp, Homo sapiens
ctcatttctcataattttgc

SEQ ID NO: 3545580 - DNA, 21 bp, Homo sapiens
ctcattttatttacagctgtg

SEQ ID NO: 3545581 - DNA, 13 bp, Homo sapiens
ctccaaacctcca

SEQ ID NO: 3545582 - DNA, 13 bp, Homo sapiens
ctccaaagaagat

SEQ ID NO: 3545583 - DNA, 17 bp, Homo sapiens
ctccaaagaagatagct

SEQ ID NO: 3545584 - DNA, 19 bp, Homo sapiens
ctccaaaggaactctagag

SEQ ID NO: 3545585 - DNA, 13 bp, Homo sapiens
ctccaacgcccct

SEQ ID NO: 3545586 - DNA, 19 bp, Homo sapiens
ctccaactccatactccac

SEQ ID NO: 3545587 - DNA, 14 bp, Homo sapiens
ctccaagcatttca

SEQ ID NO: 3545588 - DNA, 14 bp, Homo sapiens
ctccaagctccatc

SEQ ID NO: 3545589 - DNA, 22 bp, Homo sapiens
ctccaagggtttcgactggtcc

SEQ ID NO: 3545590 - DNA, 23 bp, Homo sapiens
ctccaagggtttcgactggtcca

SEQ ID NO: 3545591 - DNA, 23 bp, Homo sapiens
ctccaattttttaagtgaaaata

SEQ ID NO: 3545592 - DNA, 23 bp, Homo sapiens
ctccacacacagctgggctgtgg

SEQ ID NO: 3545593 - DNA, 22 bp, Homo sapiens
ctccacacccaccccctctgga

SEQ ID NO: 3545594 - DNA, 13 bp, Homo sapiens
ctccacactcaga

SEQ ID NO: 3545595 - DNA, 14 bp, Homo sapiens
ctccacactcagaa

SEQ ID NO: 3545596 - DNA, 14 bp, Homo sapiens
ctccacagagagga

SEQ ID NO: 3545597 - DNA, 20 bp, Homo sapiens
ctccacagagaggaggggac

SEQ ID NO: 3545598 - DNA, 18 bp, Homo sapiens
ctccacatgctgcctggc

SEQ ID NO: 3545599 - DNA, 16 bp, Homo sapiens
ctccaccagcagcatg

SEQ ID NO: 3545600 - DNA, 16 bp, Homo sapiens
ctccaccgaccaactg

SEQ ID NO: 3545601 - DNA, 17 bp, Homo sapiens
ctccaccgaccaactgc

SEQ ID NO: 3545602 - DNA, 15 bp, Homo sapiens
ctccactactctctt

SEQ ID NO: 3545603 - DNA, 14 bp, Homo sapiens
ctccactccaagtg

SEQ ID NO: 3545604 - DNA, 16 bp, Homo sapiens
ctccactccactgcct

SEQ ID NO: 3545605 - DNA, 15 bp, Homo sapiens
ctccactgccttcga

SEQ ID NO: 3545606 - DNA, 14 bp, Homo sapiens
ctccactggaccct

SEQ ID NO: 3545607 - DNA, 16 bp, Homo sapiens
ctccagaagatgccag

SEQ ID NO: 3545608 - DNA, 17 bp, Homo sapiens
ctccagaagatgccagc

SEQ ID NO: 3545609 - DNA, 20 bp, Homo sapiens
ctccagaagatgccagcttc

SEQ ID NO: 3545610 - DNA, 17 bp, Homo sapiens
ctccagacccctggctt

SEQ ID NO: 3545611 - DNA, 18 bp, Homo sapiens
ctccagacccctggcttt

SEQ ID NO: 3545612 - DNA, 14 bp, Homo sapiens
ctccagacctgatc

SEQ ID NO: 3545613 - DNA, 23 bp, Homo sapiens
ctccagacctgatcctggaggcc

SEQ ID NO: 3545614 - DNA, 15 bp, Homo sapiens
ctccagactcagcag

SEQ ID NO: 3545615 - DNA, 16 bp, Homo sapiens
ctccagactcagcaga

SEQ ID NO: 3545616 - DNA, 14 bp, Homo sapiens
ctccagactctggg

SEQ ID NO: 3545617 - DNA, 15 bp, Homo sapiens
ctccagactctgggg

SEQ ID NO: 3545618 - DNA, 17 bp, Homo sapiens
ctccagactctgggggt

SEQ ID NO: 3545619 - DNA, 22 bp, Homo sapiens
ctccagcaggcccatgggaggc

SEQ ID NO: 3545620 - DNA, 23 bp, Homo sapiens
ctccagcctcccctcccctgggg

SEQ ID NO: 3545621 - DNA, 14 bp, Homo sapiens
ctccagcctccctg

SEQ ID NO: 3545622 - DNA, 15 bp, Homo sapiens
ctccagctcatatgc

SEQ ID NO: 3545623 - DNA, 13 bp, Homo sapiens
ctccagctgcctg

SEQ ID NO: 3545624 - DNA, 18 bp, Homo sapiens
ctccagctgcctgggccc

SEQ ID NO: 3545625 - DNA, 19 bp, Homo sapiens
ctccagctgcctgggcccg

SEQ ID NO: 3545626 - DNA, 19 bp, Homo sapiens
ctccaggagagagccagga

SEQ ID NO: 3545627 - DNA, 14 bp, Homo sapiens
ctccaggagggctc

SEQ ID NO: 3545628 - DNA, 17 bp, Homo sapiens
ctccaggagggctcggg

SEQ ID NO: 3545629 - DNA, 20 bp, Homo sapiens
ctccaggcatgtgtctggcc

SEQ ID NO: 3545630 - DNA, 22 bp, Homo sapiens
ctccaggcatgtgtctggccct

SEQ ID NO: 3545631 - DNA, 12 bp, Homo sapiens
ctccaggcctgt

SEQ ID NO: 3545632 - DNA, 14 bp, Homo sapiens
ctccaggcctgtca

SEQ ID NO: 3545633 - DNA, 13 bp, Homo sapiens
ctccagggccccc

SEQ ID NO: 3545634 - DNA, 14 bp, Homo sapiens
ctccaggggcctgc

SEQ ID NO: 3545635 - DNA, 16 bp, Homo sapiens
ctccaggggcctgcag

SEQ ID NO: 3545636 - DNA, 17 bp, Homo sapiens
ctccaggggcctgcaga

SEQ ID NO: 3545637 - DNA, 18 bp, Homo sapiens
ctccaggggcctgcagaa

SEQ ID NO: 3545638 - DNA, 19 bp, Homo sapiens
ctccagggtgacaaggcct

SEQ ID NO: 3545639 - DNA, 22 bp, Homo sapiens
ctccagggtgacaaggcctgct

SEQ ID NO: 3545640 - DNA, 20 bp, Homo sapiens
ctccaggtcagcctggaagg

SEQ ID NO: 3545641 - DNA, 20 bp, Homo sapiens
ctccaggtcggagtgcctgg

SEQ ID NO: 3545642 - DNA, 14 bp, Homo sapiens
ctccaggtttttca

SEQ ID NO: 3545643 - DNA, 21 bp, Homo sapiens
ctccaggtttttcaattaaac

SEQ ID NO: 3545644 - DNA, 12 bp, Homo sapiens
ctccagtgcagt

SEQ ID NO: 3545645 - DNA, 15 bp, Homo sapiens
ctccagtgcagtcca

SEQ ID NO: 3545646 - DNA, 14 bp, Homo sapiens
ctccagtgtcaggg

SEQ ID NO: 3545647 - DNA, 16 bp, Homo sapiens
ctccatactccactcc

SEQ ID NO: 3545648 - DNA, 11 bp, Homo sapiens
ctccatcccct

SEQ ID NO: 3545649 - DNA, 18 bp, Homo sapiens
ctccatcccctccctgcc

SEQ ID NO: 3545650 - DNA, 23 bp, Homo sapiens
ctccatcccctccctgcctgctc

SEQ ID NO: 3545651 - DNA, 20 bp, Homo sapiens
ctccatccgtgcctcttttt

SEQ ID NO: 3545652 - DNA, 19 bp, Homo sapiens
ctccatctcaaaacaaaac

SEQ ID NO: 3545653 - DNA, 15 bp, Homo sapiens
ctccatctcttctgc

SEQ ID NO: 3545654 - DNA, 23 bp, Homo sapiens
ctccatctcttctgcaagcctca

SEQ ID NO: 3545655 - DNA, 16 bp, Homo sapiens
ctccatgctgcctcca

SEQ ID NO: 3545656 - DNA, 17 bp, Homo sapiens
ctccatgctgcctccag

SEQ ID NO: 3545657 - DNA, 20 bp, Homo sapiens
ctccatgttggtcaggctgg

SEQ ID NO: 3545658 - DNA, 14 bp, Homo sapiens
ctccattctatttt

SEQ ID NO: 3545659 - DNA, 17 bp, Homo sapiens
ctcccaaagtgctggga

SEQ ID NO: 3545660 - DNA, 21 bp, Homo sapiens
ctcccaaggcattctcccagc

SEQ ID NO: 3545661 - DNA, 21 bp, Homo sapiens
ctcccaatttcagactcccat

SEQ ID NO: 3545662 - DNA, 15 bp, Homo sapiens
ctcccacaggccctt

SEQ ID NO: 3545663 - DNA, 20 bp, Homo sapiens
ctcccacaggcccttcctct

SEQ ID NO: 3545664 - DNA, 21 bp, Homo sapiens
ctcccacaggcccttcctctc

SEQ ID NO: 3545665 - DNA, 21 bp, Homo sapiens
ctcccacatgaggccatctca

SEQ ID NO: 3545666 - DNA, 22 bp, Homo sapiens
ctcccaccagaacgcaccccac

SEQ ID NO: 3545667 - DNA, 17 bp, Homo sapiens
ctcccaccccactcagg

SEQ ID NO: 3545668 - DNA, 20 bp, Homo sapiens
ctcccaccccactcagggga

SEQ ID NO: 3545669 - DNA, 15 bp, Homo sapiens
ctcccacctgacaca

SEQ ID NO: 3545670 - DNA, 21 bp, Homo sapiens
ctcccagaacctctaagtgct

SEQ ID NO: 3545671 - DNA, 16 bp, Homo sapiens
ctcccagacaggccct

SEQ ID NO: 3545672 - DNA, 18 bp, Homo sapiens
ctcccagacaggccctcc

SEQ ID NO: 3545673 - DNA, 22 bp, Homo sapiens
ctcccagaggagccaccagttc

SEQ ID NO: 3545674 - DNA, 23 bp, Homo sapiens
ctcccagaggagccaccagttct

SEQ ID NO: 3545675 - DNA, 13 bp, Homo sapiens
ctcccagcatcgc

SEQ ID NO: 3545676 - DNA, 22 bp, Homo sapiens
ctcccaggcgccccttccccct

SEQ ID NO: 3545677 - DNA, 12 bp, Homo sapiens
ctcccaggctct

SEQ ID NO: 3545678 - DNA, 15 bp, Homo sapiens
ctcccatcctggggc

SEQ ID NO: 3545679 - DNA, 17 bp, Homo sapiens
ctcccatcctggggcag

SEQ ID NO: 3545680 - DNA, 17 bp, Homo sapiens
ctcccattcctgaagaa

SEQ ID NO: 3545681 - DNA, 19 bp, Homo sapiens
ctcccattgtccctctgcc

SEQ ID NO: 3545682 - DNA, 19 bp, Homo sapiens
ctccccaacccctctccag

SEQ ID NO: 3545683 - DNA, 13 bp, Homo sapiens
ctccccaaggctg

SEQ ID NO: 3545684 - DNA, 16 bp, Homo sapiens
ctccccaattctcccc

SEQ ID NO: 3545685 - DNA, 13 bp, Homo sapiens
ctccccagagctg

SEQ ID NO: 3545686 - DNA, 14 bp, Homo sapiens
ctccccagccagcc

SEQ ID NO: 3545687 - DNA, 17 bp, Homo sapiens
ctccccagccagccctt

SEQ ID NO: 3545688 - DNA, 18 bp, Homo sapiens
ctccccagccagcccttc

SEQ ID NO: 3545689 - DNA, 16 bp, Homo sapiens
ctccccagccagcctg

SEQ ID NO: 3545690 - DNA, 18 bp, Homo sapiens
ctccccagccagcctggc

SEQ ID NO: 3545691 - DNA, 14 bp, Homo sapiens
ctccccagcccaga

SEQ ID NO: 3545692 - DNA, 20 bp, Homo sapiens
ctccccagcccagcacccct

SEQ ID NO: 3545693 - DNA, 14 bp, Homo sapiens
ctccccagccccag

SEQ ID NO: 3545694 - DNA, 11 bp, Homo sapiens
ctccccaggga

SEQ ID NO: 3545695 - DNA, 14 bp, Homo sapiens
ctccccagggagct

SEQ ID NO: 3545696 - DNA, 18 bp, Homo sapiens
ctccccatatataaatta

SEQ ID NO: 3545697 - DNA, 17 bp, Homo sapiens
ctcccccaccactcagg

SEQ ID NO: 3545698 - DNA, 14 bp, Homo sapiens
ctcccccactccac

SEQ ID NO: 3545699 - DNA, 13 bp, Homo sapiens
ctcccccagccac

SEQ ID NO: 3545700 - DNA, 21 bp, Homo sapiens
ctcccccataaaatgatcctg

SEQ ID NO: 3545701 - DNA, 18 bp, Homo sapiens
ctcccccccatgcactgt

SEQ ID NO: 3545702 - DNA, 20 bp, Homo sapiens
ctcccccccatgcactgtga

SEQ ID NO: 3545703 - DNA, 21 bp, Homo sapiens
ctcccccccatgcactgtgaa

SEQ ID NO: 3545704 - DNA, 12 bp, Homo sapiens
ctccccctgcaa

SEQ ID NO: 3545705 - DNA, 13 bp, Homo sapiens
ctccccctgcaac

SEQ ID NO: 3545706 - DNA, 15 bp, Homo sapiens
ctccccgcccctgtg

SEQ ID NO: 3545707 - DNA, 20 bp, Homo sapiens
ctccccgcccctgtggccct

SEQ ID NO: 3545708 - DNA, 13 bp, Homo sapiens
ctccccgctcagg

SEQ ID NO: 3545709 - DNA, 17 bp, Homo sapiens
ctccccgctcaggggcc

SEQ ID NO: 3545710 - DNA, 18 bp, Homo sapiens
ctcccctaaagccaggct

SEQ ID NO: 3545711 - DNA, 20 bp, Homo sapiens
ctcccctaaagccaggctca

SEQ ID NO: 3545712 - DNA, 19 bp, Homo sapiens
ctcccctatgctggtagat

SEQ ID NO: 3545713 - DNA, 14 bp, Homo sapiens
ctcccctcctgcac

SEQ ID NO: 3545714 - DNA, 19 bp, Homo sapiens
ctcccctcctgcacacagg

SEQ ID NO: 3545715 - DNA, 22 bp, Homo sapiens
ctcccctctcgccccatccctg

SEQ ID NO: 3545716 - DNA, 19 bp, Homo sapiens
ctccccttctctgcctcac

SEQ ID NO: 3545717 - DNA, 13 bp, Homo sapiens
ctcccgccccgcc

SEQ ID NO: 3545718 - DNA, 19 bp, Homo sapiens
ctcccgcccttccatgtgc

SEQ ID NO: 3545719 - DNA, 15 bp, Homo sapiens
ctcccggagggccct

SEQ ID NO: 3545720 - DNA, 15 bp, Homo sapiens
ctcccggtgcccaag

SEQ ID NO: 3545721 - DNA, 14 bp, Homo sapiens
ctccctcatcggcc

SEQ ID NO: 3545722 - DNA, 20 bp, Homo sapiens
ctccctgcatctgaccagca

SEQ ID NO: 3545723 - DNA, 22 bp, Homo sapiens
ctccctgcatctgaccagcagc

SEQ ID NO: 3545724 - DNA, 23 bp, Homo sapiens
ctccctgcatctgaccagcagcg

SEQ ID NO: 3545725 - DNA, 15 bp, Homo sapiens
ctccctgcctccagg

SEQ ID NO: 3545726 - DNA, 16 bp, Homo sapiens
ctccctgcctccagga

SEQ ID NO: 3545727 - DNA, 15 bp, Homo sapiens
ctccctgcctgctcc

SEQ ID NO: 3545728 - DNA, 13 bp, Homo sapiens
ctccctgctgtgc

SEQ ID NO: 3545729 - DNA, 14 bp, Homo sapiens
ctccctggctcact

SEQ ID NO: 3545730 - DNA, 20 bp, Homo sapiens
ctccctggctcactggcagg

SEQ ID NO: 3545731 - DNA, 13 bp, Homo sapiens
ctccctgggagcc

SEQ ID NO: 3545732 - DNA, 13 bp, Homo sapiens
ctccctgtctcca

SEQ ID NO: 3545733 - DNA, 15 bp, Homo sapiens
ctccctgtctccagc

SEQ ID NO: 3545734 - DNA, 18 bp, Homo sapiens
ctccctgtctccagctgc

SEQ ID NO: 3545735 - DNA, 19 bp, Homo sapiens
ctcccttaccctcctctgc

SEQ ID NO: 3545736 - DNA, 12 bp, Homo sapiens
ctcccttcaacc

SEQ ID NO: 3545737 - DNA, 23 bp, Homo sapiens
ctcccttcaaccattccccatgg

SEQ ID NO: 3545738 - DNA, 22 bp, Homo sapiens
ctccctttctctctcctctctg

SEQ ID NO: 3545739 - DNA, 15 bp, Homo sapiens
ctccgaaatgctgtc

SEQ ID NO: 3545740 - DNA, 18 bp, Homo sapiens
ctccgaaatgctgtcttt

SEQ ID NO: 3545741 - DNA, 17 bp, Homo sapiens
ctccgagctctggtgct

SEQ ID NO: 3545742 - DNA, 13 bp, Homo sapiens
ctccgaggggtgg

SEQ ID NO: 3545743 - DNA, 23 bp, Homo sapiens
ctccgcagggcgcccagcgccgt

SEQ ID NO: 3545744 - DNA, 19 bp, Homo sapiens
ctccggagcgccctgcagg

SEQ ID NO: 3545745 - DNA, 15 bp, Homo sapiens
ctccgggactgccct

SEQ ID NO: 3545746 - DNA, 13 bp, Homo sapiens
ctccgggcgtgtg

SEQ ID NO: 3545747 - DNA, 18 bp, Homo sapiens
ctccgtagctctgctgct

SEQ ID NO: 3545748 - DNA, 17 bp, Homo sapiens
ctccgtagggtctttct

SEQ ID NO: 3545749 - DNA, 16 bp, Homo sapiens
ctccgtcactacctgg

SEQ ID NO: 3545750 - DNA, 17 bp, Homo sapiens
ctccgtcactacctggc

SEQ ID NO: 3545751 - DNA, 19 bp, Homo sapiens
ctccgtcactacctggctg

SEQ ID NO: 3545752 - DNA, 23 bp, Homo sapiens
ctccgtgaaaatatgtttggaat

SEQ ID NO: 3545753 - DNA, 15 bp, Homo sapiens
ctccgttccatctgg

SEQ ID NO: 3545754 - DNA, 22 bp, Homo sapiens
ctcctaccctcccaccagaacg

SEQ ID NO: 3545755 - DNA, 18 bp, Homo sapiens
ctcctacctcagcctcct

SEQ ID NO: 3545756 - DNA, 18 bp, Homo sapiens
ctcctacctgtctgctgc

SEQ ID NO: 3545757 - DNA, 22 bp, Homo sapiens
ctcctacctgtctgctgccagc

SEQ ID NO: 3545758 - DNA, 23 bp, Homo sapiens
ctcctacctgtctgctgccagca

SEQ ID NO: 3545759 - DNA, 15 bp, Homo sapiens
ctcctacgcaccatt

SEQ ID NO: 3545760 - DNA, 20 bp, Homo sapiens
ctcctaggctaaatgagaat

SEQ ID NO: 3545761 - DNA, 21 bp, Homo sapiens
ctcctataaagggcccacacc

SEQ ID NO: 3545762 - DNA, 14 bp, Homo sapiens
ctcctatctccctg

SEQ ID NO: 3545763 - DNA, 14 bp, Homo sapiens
ctcctcactgtatc

SEQ ID NO: 3545764 - DNA, 16 bp, Homo sapiens
ctcctcactgtatcca

SEQ ID NO: 3545765 - DNA, 16 bp, Homo sapiens
ctcctcagcacccctc

SEQ ID NO: 3545766 - DNA, 16 bp, Homo sapiens
ctcctcagctccctgc

SEQ ID NO: 3545767 - DNA, 12 bp, Homo sapiens
ctcctcaggacc

SEQ ID NO: 3545768 - DNA, 13 bp, Homo sapiens
ctcctcaggagcc

SEQ ID NO: 3545769 - DNA, 13 bp, Homo sapiens
ctcctcatctcca

SEQ ID NO: 3545770 - DNA, 22 bp, Homo sapiens
ctcctccaggtcggagtgcctg

SEQ ID NO: 3545771 - DNA, 18 bp, Homo sapiens
ctcctccatctttctaca

SEQ ID NO: 3545772 - DNA, 13 bp, Homo sapiens
ctcctcccaaggc

SEQ ID NO: 3545773 - DNA, 12 bp, Homo sapiens
ctcctcccactg

SEQ ID NO: 3545774 - DNA, 17 bp, Homo sapiens
ctcctcccactgcccac

SEQ ID NO: 3545775 - DNA, 12 bp, Homo sapiens
ctcctcccagga

SEQ ID NO: 3545776 - DNA, 12 bp, Homo sapiens
ctcctcccccag

SEQ ID NO: 3545777 - DNA, 15 bp, Homo sapiens
ctcctcccctactct

SEQ ID NO: 3545778 - DNA, 17 bp, Homo sapiens
ctcctcccgaaaaatgt

SEQ ID NO: 3545779 - DNA, 20 bp, Homo sapiens
ctcctcccgccccgcccctc

SEQ ID NO: 3545780 - DNA, 15 bp, Homo sapiens
ctcctcccggtgccc

SEQ ID NO: 3545781 - DNA, 13 bp, Homo sapiens
ctcctccctgcat

SEQ ID NO: 3545782 - DNA, 15 bp, Homo sapiens
ctcctcctttttcct

SEQ ID NO: 3545783 - DNA, 17 bp, Homo sapiens
ctcctcggagagcagca

SEQ ID NO: 3545784 - DNA, 18 bp, Homo sapiens
ctcctctaggccctgtga

SEQ ID NO: 3545785 - DNA, 14 bp, Homo sapiens
ctcctctccccagc

SEQ ID NO: 3545786 - DNA, 18 bp, Homo sapiens
ctcctctccccagcccag

SEQ ID NO: 3545787 - DNA, 19 bp, Homo sapiens
ctcctctccccagcccaga

SEQ ID NO: 3545788 - DNA, 22 bp, Homo sapiens
ctcctctccccagcccagagac

SEQ ID NO: 3545789 - DNA, 23 bp, Homo sapiens
ctcctctccccagcccagagaca

SEQ ID NO: 3545790 - DNA, 19 bp, Homo sapiens
ctcctcttgccactgcctc

SEQ ID NO: 3545791 - DNA, 14 bp, Homo sapiens
ctcctgacctcaag

SEQ ID NO: 3545792 - DNA, 19 bp, Homo sapiens
ctcctgatgtagcttgaga

SEQ ID NO: 3545793 - DNA, 18 bp, Homo sapiens
ctcctgccacatggagcc

SEQ ID NO: 3545794 - DNA, 17 bp, Homo sapiens
ctcctgccccctgccag

SEQ ID NO: 3545795 - DNA, 12 bp, Homo sapiens
ctcctgcctcag

SEQ ID NO: 3545796 - DNA, 12 bp, Homo sapiens
ctcctgctggta

SEQ ID NO: 3545797 - DNA, 15 bp, Homo sapiens
ctcctgctggtacct

SEQ ID NO: 3545798 - DNA, 18 bp, Homo sapiens
ctcctgcttttctgtcct

SEQ ID NO: 3545799 - DNA, 19 bp, Homo sapiens
ctcctgcttttctgtcctg

SEQ ID NO: 3545800 - DNA, 21 bp, Homo sapiens
ctcctgcttttctgtcctggg

SEQ ID NO: 3545801 - DNA, 14 bp, Homo sapiens
ctcctggaggctgg

SEQ ID NO: 3545802 - DNA, 10 bp, Homo sapiens
ctcctggcag

SEQ ID NO: 3545803 - DNA, 12 bp, Homo sapiens
ctcctggccttt

SEQ ID NO: 3545804 - DNA, 13 bp, Homo sapiens
ctcctggcctttt

SEQ ID NO: 3545805 - DNA, 17 bp, Homo sapiens
ctcctgggaacacatct

SEQ ID NO: 3545806 - DNA, 20 bp, Homo sapiens
ctcctgggcattagcaaggc

SEQ ID NO: 3545807 - DNA, 14 bp, Homo sapiens
ctcctgggggttct

SEQ ID NO: 3545808 - DNA, 18 bp, Homo sapiens
ctcctgggggttctttct

SEQ ID NO: 3545809 - DNA, 23 bp, Homo sapiens
ctcctgggggttctttcttcctc

SEQ ID NO: 3545810 - DNA, 16 bp, Homo sapiens
ctcctgtacctcagtg

SEQ ID NO: 3545811 - DNA, 19 bp, Homo sapiens
ctcctgtccaaagtaggga

SEQ ID NO: 3545812 - DNA, 13 bp, Homo sapiens
ctcctgtcccttt

SEQ ID NO: 3545813 - DNA, 14 bp, Homo sapiens
ctcctgtccctttt

SEQ ID NO: 3545814 - DNA, 19 bp, Homo sapiens
ctcctgtcccttttccctt

SEQ ID NO: 3545815 - DNA, 17 bp, Homo sapiens
ctcctgtcttctttctc

SEQ ID NO: 3545816 - DNA, 16 bp, Homo sapiens
ctcctgttgccatgga

SEQ ID NO: 3545817 - DNA, 15 bp, Homo sapiens
ctccttatcccttgg

SEQ ID NO: 3545818 - DNA, 13 bp, Homo sapiens
ctccttcagcacg

SEQ ID NO: 3545819 - DNA, 15 bp, Homo sapiens
ctccttggcaccccc

SEQ ID NO: 3545820 - DNA, 20 bp, Homo sapiens
ctccttggcacccccatgct

SEQ ID NO: 3545821 - DNA, 14 bp, Homo sapiens
ctccttggccacag

SEQ ID NO: 3545822 - DNA, 17 bp, Homo sapiens
ctccttggctttatgca

SEQ ID NO: 3545823 - DNA, 14 bp, Homo sapiens
ctccttgtggccta

SEQ ID NO: 3545824 - DNA, 18 bp, Homo sapiens
ctccttgtggcctatgaa

SEQ ID NO: 3545825 - DNA, 16 bp, Homo sapiens
ctcctttcacaacctt

SEQ ID NO: 3545826 - DNA, 17 bp, Homo sapiens
ctcctttgaagaaggca

SEQ ID NO: 3545827 - DNA, 14 bp, Homo sapiens
ctcctttgtacttt

SEQ ID NO: 3545828 - DNA, 20 bp, Homo sapiens
ctcctttgtactttgtgctt

SEQ ID NO: 3545829 - DNA, 22 bp, Homo sapiens
ctcgactgtcagtggggcagcc

SEQ ID NO: 3545830 - DNA, 19 bp, Homo sapiens
ctcgcagggaatgcagcag

SEQ ID NO: 3545831 - DNA, 17 bp, Homo sapiens
ctcgcccagcaggagag

SEQ ID NO: 3545832 - DNA, 15 bp, Homo sapiens
ctcgccccatccctg

SEQ ID NO: 3545833 - DNA, 16 bp, Homo sapiens
ctcggagagcagcagc

SEQ ID NO: 3545834 - DNA, 21 bp, Homo sapiens
ctcggcacacactgtgcccca

SEQ ID NO: 3545835 - DNA, 20 bp, Homo sapiens
ctcggctactggttacctgg

SEQ ID NO: 3545836 - DNA, 15 bp, Homo sapiens
ctcggctgccagggg

SEQ ID NO: 3545837 - DNA, 16 bp, Homo sapiens
ctcggctgccaggggc

SEQ ID NO: 3545838 - DNA, 19 bp, Homo sapiens
ctcggctgccaggggctct

SEQ ID NO: 3545839 - DNA, 19 bp, Homo sapiens
ctcgggagccctagccctg

SEQ ID NO: 3545840 - DNA, 20 bp, Homo sapiens
ctcgggccgtaggggctcct

SEQ ID NO: 3545841 - DNA, 15 bp, Homo sapiens
ctcggtatctggctt

SEQ ID NO: 3545842 - DNA, 22 bp, Homo sapiens
ctcggtatctggcttccctgga

SEQ ID NO: 3545843 - DNA, 13 bp, Homo sapiens
ctcggtgtcccca

SEQ ID NO: 3545844 - DNA, 20 bp, Homo sapiens
ctcggtgtccccaccatctg

SEQ ID NO: 3545845 - DNA, 21 bp, Homo sapiens
ctcggtgtccccaccatctgc

SEQ ID NO: 3545846 - DNA, 20 bp, Homo sapiens
ctcgtatatgtctcaggtcc

SEQ ID NO: 3545847 - DNA, 22 bp, Homo sapiens
ctcgtcagctgggatgtgaagt

SEQ ID NO: 3545848 - DNA, 15 bp, Homo sapiens
ctcgtgagtcattta

SEQ ID NO: 3545849 - DNA, 19 bp, Homo sapiens
ctcgtgggtcccagagacc

SEQ ID NO: 3545850 - DNA, 16 bp, Homo sapiens
ctcgtggtgaggctga

SEQ ID NO: 3545851 - DNA, 17 bp, Homo sapiens
ctcgtggtgaggctgac

SEQ ID NO: 3545852 - DNA, 14 bp, Homo sapiens
ctcgtgtgtttcta

SEQ ID NO: 3545853 - DNA, 18 bp, Homo sapiens
ctcgtttacactgcacat

SEQ ID NO: 3545854 - DNA, 22 bp, Homo sapiens
ctctaaacagacaggaatttag

SEQ ID NO: 3545855 - DNA, 14 bp, Homo sapiens
ctctaaagagcatc

SEQ ID NO: 3545856 - DNA, 22 bp, Homo sapiens
ctctaaagtctgttgattaaag

SEQ ID NO: 3545857 - DNA, 14 bp, Homo sapiens
ctctaacagccctc

SEQ ID NO: 3545858 - DNA, 14 bp, Homo sapiens
ctctaagtgctgct

SEQ ID NO: 3545859 - DNA, 17 bp, Homo sapiens
ctctaagtgctgctgtg

SEQ ID NO: 3545860 - DNA, 18 bp, Homo sapiens
ctctaagtgctgctgtgg

SEQ ID NO: 3545861 - DNA, 16 bp, Homo sapiens
ctctaattcacagtgc

SEQ ID NO: 3545862 - DNA, 16 bp, Homo sapiens
ctctacaaactcccac

SEQ ID NO: 3545863 - DNA, 17 bp, Homo sapiens
ctctacaaactcccact

SEQ ID NO: 3545864 - DNA, 15 bp, Homo sapiens
ctctaccttcaaata

SEQ ID NO: 3545865 - DNA, 17 bp, Homo sapiens
ctctacttagcatgtcc

SEQ ID NO: 3545866 - DNA, 14 bp, Homo sapiens
ctctagcctctgga

SEQ ID NO: 3545867 - DNA, 16 bp, Homo sapiens
ctctagcctctggact

SEQ ID NO: 3545868 - DNA, 21 bp, Homo sapiens
ctctagggactgccaggctgt

SEQ ID NO: 3545869 - DNA, 18 bp, Homo sapiens
ctctagtagtgtggcctg

SEQ ID NO: 3545870 - DNA, 19 bp, Homo sapiens
ctctagtagtgtggcctgt

SEQ ID NO: 3545871 - DNA, 14 bp, Homo sapiens
ctctagtcatttgt

SEQ ID NO: 3545872 - DNA, 14 bp, Homo sapiens
ctctagtgccttct

SEQ ID NO: 3545873 - DNA, 22 bp, Homo sapiens
ctctataacagatcctttcaaa

SEQ ID NO: 3545874 - DNA, 15 bp, Homo sapiens
ctctatagcaccagg

SEQ ID NO: 3545875 - DNA, 19 bp, Homo sapiens
ctctatcagaaatacaaaa

SEQ ID NO: 3545876 - DNA, 19 bp, Homo sapiens
ctctatttattagccaact

SEQ ID NO: 3545877 - DNA, 13 bp, Homo sapiens
ctctattttaatt

SEQ ID NO: 3545878 - DNA, 16 bp, Homo sapiens
ctctcagaaataaatc

SEQ ID NO: 3545879 - DNA, 14 bp, Homo sapiens
ctctccactgcctt

SEQ ID NO: 3545880 - DNA, 15 bp, Homo sapiens
ctctccactgccttc

SEQ ID NO: 3545881 - DNA, 14 bp, Homo sapiens
ctctccagctgact

SEQ ID NO: 3545882 - DNA, 16 bp, Homo sapiens
ctctccagctgactaa

SEQ ID NO: 3545883 - DNA, 12 bp, Homo sapiens
ctctccagggtg

SEQ ID NO: 3545884 - DNA, 14 bp, Homo sapiens
ctctccaggtcagc

SEQ ID NO: 3545885 - DNA, 17 bp, Homo sapiens
ctctccaggtcagcctg

SEQ ID NO: 3545886 - DNA, 18 bp, Homo sapiens
ctctccaggtcagcctgg

SEQ ID NO: 3545887 - DNA, 19 bp, Homo sapiens
ctctccaggtcagcctgga

SEQ ID NO: 3545888 - DNA, 13 bp, Homo sapiens
ctctcccatcctg

SEQ ID NO: 3545889 - DNA, 18 bp, Homo sapiens
ctctcccatcctggggca

SEQ ID NO: 3545890 - DNA, 19 bp, Homo sapiens
ctctcccattgtccctctg

SEQ ID NO: 3545891 - DNA, 21 bp, Homo sapiens
ctctcccattgtccctctgcc

SEQ ID NO: 3545892 - DNA, 16 bp, Homo sapiens
ctctccccagcccaga

SEQ ID NO: 3545893 - DNA, 19 bp, Homo sapiens
ctctccccatatataaatt

SEQ ID NO: 3545894 - DNA, 21 bp, Homo sapiens
ctctcccccaaggccactgcg

SEQ ID NO: 3545895 - DNA, 23 bp, Homo sapiens
ctctccccgctcaggggcctgga

SEQ ID NO: 3545896 - DNA, 23 bp, Homo sapiens
ctctcccctctcgccccatccct

SEQ ID NO: 3545897 - DNA, 13 bp, Homo sapiens
ctctccctgggtc

SEQ ID NO: 3545898 - DNA, 17 bp, Homo sapiens
ctctccgactctgcacc

SEQ ID NO: 3545899 - DNA, 14 bp, Homo sapiens
ctctccgagctctg

SEQ ID NO: 3545900 - DNA, 15 bp, Homo sapiens
ctctccgcgcctacc

SEQ ID NO: 3545901 - DNA, 21 bp, Homo sapiens
ctctccgtttattataaactg

SEQ ID NO: 3545902 - DNA, 18 bp, Homo sapiens
ctctcctcatctccaagg

SEQ ID NO: 3545903 - DNA, 20 bp, Homo sapiens
ctctcctcatgttctgcttt

SEQ ID NO: 3545904 - DNA, 10 bp, Homo sapiens
ctctcctctc

SEQ ID NO: 3545905 - DNA, 12 bp, Homo sapiens
ctctcctctctg

SEQ ID NO: 3545906 - DNA, 15 bp, Homo sapiens
ctctcctcttgccac

SEQ ID NO: 3545907 - DNA, 12 bp, Homo sapiens
ctctcctgaccc

SEQ ID NO: 3545908 - DNA, 16 bp, Homo sapiens
ctctcctgacccctgc

SEQ ID NO: 3545909 - DNA, 14 bp, Homo sapiens
ctctccttcctgtg

SEQ ID NO: 3545910 - DNA, 20 bp, Homo sapiens
ctctccttggccacagactg

SEQ ID NO: 3545911 - DNA, 22 bp, Homo sapiens
ctctccttttgaggcttctcct

SEQ ID NO: 3545912 - DNA, 16 bp, Homo sapiens
ctctcgccccatccct

SEQ ID NO: 3545913 - DNA, 16 bp, Homo sapiens
ctctcgtctctcgttt

SEQ ID NO: 3545914 - DNA, 19 bp, Homo sapiens
ctctctacaaactcccact

SEQ ID NO: 3545915 - DNA, 13 bp, Homo sapiens
ctctctccagggt

SEQ ID NO: 3545916 - DNA, 18 bp, Homo sapiens
ctctctccaggtcagcct

SEQ ID NO: 3545917 - DNA, 11 bp, Homo sapiens
ctctctcctct

SEQ ID NO: 3545918 - DNA, 12 bp, Homo sapiens
ctctctcctctc

SEQ ID NO: 3545919 - DNA, 16 bp, Homo sapiens
ctctctccttggccac

SEQ ID NO: 3545920 - DNA, 12 bp, Homo sapiens
ctctctctgagg

SEQ ID NO: 3545921 - DNA, 18 bp, Homo sapiens
ctctctgagggggtgggg

SEQ ID NO: 3545922 - DNA, 17 bp, Homo sapiens
gaatttcccaggaccct

SEQ ID NO: 3545923 - DNA, 13 bp, Homo sapiens
gaatttcttaact

SEQ ID NO: 3545924 - DNA, 17 bp, Homo sapiens
gaatttcttaacttctt

SEQ ID NO: 3545925 - DNA, 19 bp, Homo sapiens
gaatttcttaacttcttgc

SEQ ID NO: 3545926 - DNA, 21 bp, Homo sapiens
gaatttcttaacttcttgctt

SEQ ID NO: 3545927 - DNA, 17 bp, Homo sapiens
gaatttcttcttttcct

SEQ ID NO: 3545928 - DNA, 14 bp, Homo sapiens
gaatttgaggtcta

SEQ ID NO: 3545929 - DNA, 19 bp, Homo sapiens
gaatttgaggtctagagag

SEQ ID NO: 3545930 - DNA, 15 bp, Homo sapiens
gaatttgccagagga

SEQ ID NO: 3545931 - DNA, 23 bp, Homo sapiens
gaatttgggaggaggaaaagaaa

SEQ ID NO: 3545932 - DNA, 22 bp, Homo sapiens
gaatttggggcaggaaatactt

SEQ ID NO: 3545933 - DNA, 22 bp, Homo sapiens
gaatttttttttcctagccctc

SEQ ID NO: 3545934 - DNA, 22 bp, Homo sapiens
gacaaatattcctttgcatatt

SEQ ID NO: 3545935 - DNA, 16 bp, Homo sapiens
gacaacacagcctata

SEQ ID NO: 3545936 - DNA, 21 bp, Homo sapiens
gacaacacttaatagcaacag

SEQ ID NO: 3545937 - DNA, 23 bp, Homo sapiens
gacaacatcgcaatagtttttta

SEQ ID NO: 3545938 - DNA, 19 bp, Homo sapiens
gacaagagctgttatgctg

SEQ ID NO: 3545939 - DNA, 14 bp, Homo sapiens
gacaagcagccctt

SEQ ID NO: 3545940 - DNA, 13 bp, Homo sapiens
gacaatcactgcc

SEQ ID NO: 3545941 - DNA, 20 bp, Homo sapiens
gacacaataggtctttctct

SEQ ID NO: 3545942 - DNA, 21 bp, Homo sapiens
gacacaataggtctttctctc

SEQ ID NO: 3545943 - DNA, 19 bp, Homo sapiens
gacacacatacataatggt

SEQ ID NO: 3545944 - DNA, 17 bp, Homo sapiens
gacacacggggctcggg

SEQ ID NO: 3545945 - DNA, 13 bp, Homo sapiens
gacacagctcttc

SEQ ID NO: 3545946 - DNA, 16 bp, Homo sapiens
gacacagctcttcatt

SEQ ID NO: 3545947 - DNA, 17 bp, Homo sapiens
gacacaggccctccctg

SEQ ID NO: 3545948 - DNA, 19 bp, Homo sapiens
gacacatacagagtgggcc

SEQ ID NO: 3545949 - DNA, 15 bp, Homo sapiens
gacacatatgagggg

SEQ ID NO: 3545950 - DNA, 18 bp, Homo sapiens
gacaccaagctcaccctt

SEQ ID NO: 3545951 - DNA, 22 bp, Homo sapiens
gacaccaagctcacccttcgtc

SEQ ID NO: 3545952 - DNA, 19 bp, Homo sapiens
gacacccatgccagagagg

SEQ ID NO: 3545953 - DNA, 13 bp, Homo sapiens
gacaccccctccc

SEQ ID NO: 3545954 - DNA, 21 bp, Homo sapiens
gacaccccctccccgcccctg

SEQ ID NO: 3545955 - DNA, 14 bp, Homo sapiens
gacaccctctgggg

SEQ ID NO: 3545956 - DNA, 16 bp, Homo sapiens
gacaccctctgggggt

SEQ ID NO: 3545957 - DNA, 21 bp, Homo sapiens
gacaccctggcctgaactgag

SEQ ID NO: 3545958 - DNA, 22 bp, Homo sapiens
gacacctccccctttcacactg

SEQ ID NO: 3545959 - DNA, 12 bp, Homo sapiens
gacacctttcat

SEQ ID NO: 3545960 - DNA, 13 bp, Homo sapiens
gacacgtggcctc

SEQ ID NO: 3545961 - DNA, 20 bp, Homo sapiens
gacactaaactccatgatat

SEQ ID NO: 3545962 - DNA, 21 bp, Homo sapiens
gacactaaactccatgatatt

SEQ ID NO: 3545963 - DNA, 16 bp, Homo sapiens
gacactagaagatttt

SEQ ID NO: 3545964 - DNA, 14 bp, Homo sapiens
gacactccttcccc

SEQ ID NO: 3545965 - DNA, 16 bp, Homo sapiens
gacactgccacacagg

SEQ ID NO: 3545966 - DNA, 14 bp, Homo sapiens
gacactgctctaac

SEQ ID NO: 3545967 - DNA, 21 bp, Homo sapiens
gacactgctctaacagccctc

SEQ ID NO: 3545968 - DNA, 20 bp, Homo sapiens
gacactttgccaaggctctc

SEQ ID NO: 3545969 - DNA, 19 bp, Homo sapiens
gacagaaaagtgcctgagc

SEQ ID NO: 3545970 - DNA, 23 bp, Homo sapiens
gacagacaacactgggaaacaga

SEQ ID NO: 3545971 - DNA, 14 bp, Homo sapiens
gacagactcactgg

SEQ ID NO: 3545972 - DNA, 20 bp, Homo sapiens
gacagaggtttgaaggagaa

SEQ ID NO: 3545973 - DNA, 22 bp, Homo sapiens
gacagaggtttgaaggagaatg

SEQ ID NO: 3545974 - DNA, 18 bp, Homo sapiens
gacagatatatttaagcc

SEQ ID NO: 3545975 - DNA, 22 bp, Homo sapiens
gacagatattttatctattggc

SEQ ID NO: 3545976 - DNA, 23 bp, Homo sapiens
gacagcaattcatggttcaagta

SEQ ID NO: 3545977 - DNA, 17 bp, Homo sapiens
gacagccattttccaac

SEQ ID NO: 3545978 - DNA, 23 bp, Homo sapiens
gacagccttccccagctccagca

SEQ ID NO: 3545979 - DNA, 16 bp, Homo sapiens
gacagccttgcaaccc

SEQ ID NO: 3545980 - DNA, 18 bp, Homo sapiens
gacagctggcggaggctg

SEQ ID NO: 3545981 - DNA, 20 bp, Homo sapiens
gacagctggcggaggctgct

SEQ ID NO: 3545982 - DNA, 20 bp, Homo sapiens
gacagcttacaggagccagc

SEQ ID NO: 3545983 - DNA, 23 bp, Homo sapiens
gacagcttgacttgtggggcagg

SEQ ID NO: 3545984 - DNA, 14 bp, Homo sapiens
gacaggaccccagc

SEQ ID NO: 3545985 - DNA, 17 bp, Homo sapiens
gacaggaccccagctct

SEQ ID NO: 3545986 - DNA, 12 bp, Homo sapiens
gacaggaccctc

SEQ ID NO: 3545987 - DNA, 17 bp, Homo sapiens
gacaggagatgctgtgc

SEQ ID NO: 3545988 - DNA, 19 bp, Homo sapiens
gacaggagatgctgtgccc

SEQ ID NO: 3545989 - DNA, 23 bp, Homo sapiens
gacaggagcctagcggagcccag

SEQ ID NO: 3545990 - DNA, 13 bp, Homo sapiens
gacaggccctccc

SEQ ID NO: 3545991 - DNA, 20 bp, Homo sapiens
gacaggccctccctgtctcc

SEQ ID NO: 3545992 - DNA, 14 bp, Homo sapiens
gacaggctcgtcag

SEQ ID NO: 3545993 - DNA, 19 bp, Homo sapiens
gacaggctgaagagaggga

SEQ ID NO: 3545994 - DNA, 16 bp, Homo sapiens
gacagggcctggagcc

SEQ ID NO: 3545995 - DNA, 14 bp, Homo sapiens
gacagggtcttgct

SEQ ID NO: 3545996 - DNA, 21 bp, Homo sapiens
gacaggtgcctaacctgggac

SEQ ID NO: 3545997 - DNA, 17 bp, Homo sapiens
gacaggtgggcctggga

SEQ ID NO: 3545998 - DNA, 19 bp, Homo sapiens
gacagtatcgtttgtttat

SEQ ID NO: 3545999 - DNA, 15 bp, Homo sapiens
gacagtatttgtggg

SEQ ID NO: 3546000 - DNA, 18 bp, Homo sapiens
gacagtcagctgtgggga

SEQ ID NO: 3546001 - DNA, 14 bp, Homo sapiens
gacagtccacaggg

SEQ ID NO: 3546002 - DNA, 18 bp, Homo sapiens
gacagtccacaggggcca

SEQ ID NO: 3546003 - DNA, 18 bp, Homo sapiens
gacagtcctttcccacca

SEQ ID NO: 3546004 - DNA, 20 bp, Homo sapiens
gacagtcctttcccaccatt

SEQ ID NO: 3546005 - DNA, 20 bp, Homo sapiens
gacagtgccatccccacctt

SEQ ID NO: 3546006 - DNA, 13 bp, Homo sapiens
gacagtggcctct

SEQ ID NO: 3546007 - DNA, 18 bp, Homo sapiens
gacagtggcctcttgagt

SEQ ID NO: 3546008 - DNA, 15 bp, Homo sapiens
gacagttgatggagc

SEQ ID NO: 3546009 - DNA, 18 bp, Homo sapiens
gacagttgatggagcccc

SEQ ID NO: 3546010 - DNA, 15 bp, Homo sapiens
gacatacttgaaggg

SEQ ID NO: 3546011 - DNA, 18 bp, Homo sapiens
gacatacttgaagggcca

SEQ ID NO: 3546012 - DNA, 19 bp, Homo sapiens
gacatacttgaagggccag

SEQ ID NO: 3546013 - DNA, 22 bp, Homo sapiens
gacatacttgaagggccagagc

SEQ ID NO: 3546014 - DNA, 22 bp, Homo sapiens
gacatagaatctgtgacctctg

SEQ ID NO: 3546015 - DNA, 13 bp, Homo sapiens
gacatattatgcc

SEQ ID NO: 3546016 - DNA, 20 bp, Homo sapiens
gacatattatgcctgaatga

SEQ ID NO: 3546017 - DNA, 18 bp, Homo sapiens
gacatccacataaccctg

SEQ ID NO: 3546018 - DNA, 15 bp, Homo sapiens
gacatcccttcctgg

SEQ ID NO: 3546019 - DNA, 19 bp, Homo sapiens
gacatcccttcctggaaac

SEQ ID NO: 3546020 - DNA, 14 bp, Homo sapiens
gacatctgacccca

SEQ ID NO: 3546021 - DNA, 16 bp, Homo sapiens
gacatgaaaagttatt

SEQ ID NO: 3546022 - DNA, 12 bp, Homo sapiens
gacatgcagtta

SEQ ID NO: 3546023 - DNA, 14 bp, Homo sapiens
gacatgcagttata

SEQ ID NO: 3546024 - DNA, 16 bp, Homo sapiens
gacatgcttttctgcc

SEQ ID NO: 3546025 - DNA, 12 bp, Homo sapiens
gacatgtgacat

SEQ ID NO: 3546026 - DNA, 16 bp, Homo sapiens
gacatgtgacatttat

SEQ ID NO: 3546027 - DNA, 20 bp, Homo sapiens
gacatgtgacatttatatat

SEQ ID NO: 3546028 - DNA, 17 bp, Homo sapiens
gacattagagaaaacct

SEQ ID NO: 3546029 - DNA, 19 bp, Homo sapiens
gacattcagactaaaaata

SEQ ID NO: 3546030 - DNA, 23 bp, Homo sapiens
gacattcttagctgtaacttaac

SEQ ID NO: 3546031 - DNA, 19 bp, Homo sapiens
gacattgacagcaattcat

SEQ ID NO: 3546032 - DNA, 19 bp, Homo sapiens
gacattgtagagcttctgg

SEQ ID NO: 3546033 - DNA, 16 bp, Homo sapiens
gacatttctttggaaa

SEQ ID NO: 3546034 - DNA, 23 bp, Homo sapiens
gacatttgggagacatgtgacat

SEQ ID NO: 3546035 - DNA, 21 bp, Homo sapiens
gacatttgtgggcaagcagat

SEQ ID NO: 3546036 - DNA, 15 bp, Homo sapiens
gacattttatgtctt

SEQ ID NO: 3546037 - DNA, 15 bp, Homo sapiens
gaccaattctggaca

SEQ ID NO: 3546038 - DNA, 13 bp, Homo sapiens
gaccaattgaagc

SEQ ID NO: 3546039 - DNA, 13 bp, Homo sapiens
gaccacctgccca

SEQ ID NO: 3546040 - DNA, 15 bp, Homo sapiens
gaccacgccccagga

SEQ ID NO: 3546041 - DNA, 17 bp, Homo sapiens
gaccactgggtgagaga

SEQ ID NO: 3546042 - DNA, 19 bp, Homo sapiens
gaccagaactttttcctct

SEQ ID NO: 3546043 - DNA, 16 bp, Homo sapiens
gaccagcagcgccttt

SEQ ID NO: 3546044 - DNA, 23 bp, Homo sapiens
gaccagcagcgcctttcccaact

SEQ ID NO: 3546045 - DNA, 14 bp, Homo sapiens
gaccagctcaggac

SEQ ID NO: 3546046 - DNA, 13 bp, Homo sapiens
gaccagggatgct

SEQ ID NO: 3546047 - DNA, 15 bp, Homo sapiens
gaccagggatgctgg

SEQ ID NO: 3546048 - DNA, 17 bp, Homo sapiens
gaccagggatgctgggc

SEQ ID NO: 3546049 - DNA, 18 bp, Homo sapiens
gaccagggatgctgggct

SEQ ID NO: 3546050 - DNA, 20 bp, Homo sapiens
gaccagggatgctgggctgg

SEQ ID NO: 3546051 - DNA, 18 bp, Homo sapiens
gaccaggtttgcaggagc

SEQ ID NO: 3546052 - DNA, 12 bp, Homo sapiens
gaccagtgcctg

SEQ ID NO: 3546053 - DNA, 18 bp, Homo sapiens
gaccagtttaagccgcag

SEQ ID NO: 3546054 - DNA, 18 bp, Homo sapiens
gaccatattacctggatt

SEQ ID NO: 3546055 - DNA, 18 bp, Homo sapiens
gaccatcaagaacctaca

SEQ ID NO: 3546056 - DNA, 13 bp, Homo sapiens
gaccatctgctgc

SEQ ID NO: 3546057 - DNA, 18 bp, Homo sapiens
gaccatctgctgcagtta

SEQ ID NO: 3546058 - DNA, 17 bp, Homo sapiens
gaaagagtccattgttt

SEQ ID NO: 3546059 - DNA, 14 bp, Homo sapiens
gaaagataactagg

SEQ ID NO: 3546060 - DNA, 23 bp, Homo sapiens
gaaagatggctgtgcctctgcct

SEQ ID NO: 3546061 - DNA, 15 bp, Homo sapiens
gaaagatgtgttttt

SEQ ID NO: 3546062 - DNA, 15 bp, Homo sapiens
gaaagcaaaatacat

SEQ ID NO: 3546063 - DNA, 19 bp, Homo sapiens
gaaagcagagcctcctggg

SEQ ID NO: 3546064 - DNA, 20 bp, Homo sapiens
gaaagcagagcctcctggga

SEQ ID NO: 3546065 - DNA, 17 bp, Homo sapiens
gaaagcatatcccacca

SEQ ID NO: 3546066 - DNA, 15 bp, Homo sapiens
gaaagcctcctgccc

SEQ ID NO: 3546067 - DNA, 19 bp, Homo sapiens
gaaagcctcctgccccctg

SEQ ID NO: 3546068 - DNA, 22 bp, Homo sapiens
gaaagcctcctgccccctgcca

SEQ ID NO: 3546069 - DNA, 23 bp, Homo sapiens
gaaagcctcctgccccctgccag

SEQ ID NO: 3546070 - DNA, 14 bp, Homo sapiens
gaaagcctctggcc

SEQ ID NO: 3546071 - DNA, 21 bp, Homo sapiens
gaaaggatctgtgattggctg

SEQ ID NO: 3546072 - DNA, 22 bp, Homo sapiens
gaaaggatctgtgattggctgg

SEQ ID NO: 3546073 - DNA, 23 bp, Homo sapiens
gaaaggatctgtgattggctggt

SEQ ID NO: 3546074 - DNA, 13 bp, Homo sapiens
gaaaggattttac

SEQ ID NO: 3546075 - DNA, 17 bp, Homo sapiens
gaaaggattttaccaaa

SEQ ID NO: 3546076 - DNA, 15 bp, Homo sapiens
gaaaggccagcagct

SEQ ID NO: 3546077 - DNA, 21 bp, Homo sapiens
gaaaggccagcagctgatgct

SEQ ID NO: 3546078 - DNA, 19 bp, Homo sapiens
gaaagggattgctgaggca

SEQ ID NO: 3546079 - DNA, 19 bp, Homo sapiens
gaaaggggagtaggtgggg

SEQ ID NO: 3546080 - DNA, 20 bp, Homo sapiens
gaaaggggctcttctgagca

SEQ ID NO: 3546081 - DNA, 20 bp, Homo sapiens
gaaaggtgtgaggagagagg

SEQ ID NO: 3546082 - DNA, 21 bp, Homo sapiens
gaaagtaatttaatttgtaaa

SEQ ID NO: 3546083 - DNA, 17 bp, Homo sapiens
gaaagtcaggctagctg

SEQ ID NO: 3546084 - DNA, 16 bp, Homo sapiens
gaaagtgaaagtccag

SEQ ID NO: 3546085 - DNA, 22 bp, Homo sapiens
gaaagtgtgaagacccaaaaca

SEQ ID NO: 3546086 - DNA, 18 bp, Homo sapiens
gaaagttttccagtattg

SEQ ID NO: 3546087 - DNA, 21 bp, Homo sapiens
gaaagttttccagtattgaaa

SEQ ID NO: 3546088 - DNA, 16 bp, Homo sapiens
gaaataaaatatatct

SEQ ID NO: 3546089 - DNA, 14 bp, Homo sapiens
gaaataaagtcaga

SEQ ID NO: 3546090 - DNA, 14 bp, Homo sapiens
gaaataaatcacag

SEQ ID NO: 3546091 - DNA, 16 bp, Homo sapiens
gaaataaatgaaactt

SEQ ID NO: 3546092 - DNA, 21 bp, Homo sapiens
gaaataaatgtatcatagaaa

SEQ ID NO: 3546093 - DNA, 17 bp, Homo sapiens
gaaataacaaaatggac

SEQ ID NO: 3546094 - DNA, 13 bp, Homo sapiens
gaaatacaaaaaa

SEQ ID NO: 3546095 - DNA, 16 bp, Homo sapiens
gaaatacctttgtagt

SEQ ID NO: 3546096 - DNA, 23 bp, Homo sapiens
gaaatacctttgtagttactcaa

SEQ ID NO: 3546097 - DNA, 19 bp, Homo sapiens
gaaataggatctccactgg

SEQ ID NO: 3546098 - DNA, 20 bp, Homo sapiens
gaaatatgtattctgtaaaa

SEQ ID NO: 3546099 - DNA, 20 bp, Homo sapiens
gaaatcaaatatgcaaagca

SEQ ID NO: 3546100 - DNA, 16 bp, Homo sapiens
gaaatgaggtctgttt

SEQ ID NO: 3546101 - DNA, 22 bp, Homo sapiens
gaaatgaggtctgtttaaagtg

SEQ ID NO: 3546102 - DNA, 12 bp, Homo sapiens
gaaatgccccag

SEQ ID NO: 3546103 - DNA, 22 bp, Homo sapiens
gaaatgctgttggtaaagcaca

SEQ ID NO: 3546104 - DNA, 15 bp, Homo sapiens
gaaatgcttttatat

SEQ ID NO: 3546105 - DNA, 16 bp, Homo sapiens
gaaatgcttttatatt

SEQ ID NO: 3546106 - DNA, 21 bp, Homo sapiens
gaaatgcttttatattctaat

SEQ ID NO: 3546107 - DNA, 17 bp, Homo sapiens
gaaatggctatgaacag

SEQ ID NO: 3546108 - DNA, 23 bp, Homo sapiens
gaaatggcttattaaactttgaa

SEQ ID NO: 3546109 - DNA, 23 bp, Homo sapiens
gaaatggtttcacttgctctttg

SEQ ID NO: 3546110 - DNA, 22 bp, Homo sapiens
gaaatgtatgtgtgtctatttt

SEQ ID NO: 3546111 - DNA, 14 bp, Homo sapiens
gaaatgtgaagagg

SEQ ID NO: 3546112 - DNA, 22 bp, Homo sapiens
gaaattgactgatgattttcct

SEQ ID NO: 3546113 - DNA, 21 bp, Homo sapiens
gaaatttcagattcccagagc

SEQ ID NO: 3546114 - DNA, 17 bp, Homo sapiens
gaaatttgttataatga

SEQ ID NO: 3546115 - DNA, 18 bp, Homo sapiens
gaaatttgttatacttca

SEQ ID NO: 3546116 - DNA, 19 bp, Homo sapiens
gaaatttttacctttatct

SEQ ID NO: 3546117 - DNA, 13 bp, Homo sapiens
gaacaaaacttct

SEQ ID NO: 3546118 - DNA, 15 bp, Homo sapiens
gaacaacatgttcta

SEQ ID NO: 3546119 - DNA, 16 bp, Homo sapiens
gaacaacatgttctac

SEQ ID NO: 3546120 - DNA, 13 bp, Homo sapiens
gaacacagaactg

SEQ ID NO: 3546121 - DNA, 17 bp, Homo sapiens
gaacacaggcaaaatcc

SEQ ID NO: 3546122 - DNA, 17 bp, Homo sapiens
gaacacagttctgggca

SEQ ID NO: 3546123 - DNA, 21 bp, Homo sapiens
gaacaccctggatgctgttga

SEQ ID NO: 3546124 - DNA, 17 bp, Homo sapiens
gaacagataatccctgt

SEQ ID NO: 3546125 - DNA, 21 bp, Homo sapiens
gaacagcgggtacttatttct

SEQ ID NO: 3546126 - DNA, 22 bp, Homo sapiens
gaacaggaaaataaaatattta

SEQ ID NO: 3546127 - DNA, 18 bp, Homo sapiens
gaacaggaaagagctagg

SEQ ID NO: 3546128 - DNA, 21 bp, Homo sapiens
gaacagtggtggcaacattca

SEQ ID NO: 3546129 - DNA, 15 bp, Homo sapiens
gaacagtggttgcct

SEQ ID NO: 3546130 - DNA, 14 bp, Homo sapiens
gaacattcagctct

SEQ ID NO: 3546131 - DNA, 23 bp, Homo sapiens
gaaccaaaaatcccaccttccca

SEQ ID NO: 3546132 - DNA, 17 bp, Homo sapiens
gaaccacattcagggaa

SEQ ID NO: 3546133 - DNA, 17 bp, Homo sapiens
gaataatttccttcagg

SEQ ID NO: 3546134 - DNA, 18 bp, Homo sapiens
gaataatttccttcaggc

SEQ ID NO: 3546135 - DNA, 22 bp, Homo sapiens
gaataatttccttcaggcagct

SEQ ID NO: 3546136 - DNA, 16 bp, Homo sapiens
gaatacacatgcagga

SEQ ID NO: 3546137 - DNA, 20 bp, Homo sapiens
gaatactacttatgaaatgt

SEQ ID NO: 3546138 - DNA, 21 bp, Homo sapiens
gaatacttattttcagtgcat

SEQ ID NO: 3546139 - DNA, 17 bp, Homo sapiens
gaatagaagctaaggtt

SEQ ID NO: 3546140 - DNA, 18 bp, Homo sapiens
gaatagaagctaaggttt

SEQ ID NO: 3546141 - DNA, 17 bp, Homo sapiens
gaatagatcagtatttc

SEQ ID NO: 3546142 - DNA, 15 bp, Homo sapiens
gaatagatgctgact

SEQ ID NO: 3546143 - DNA, 17 bp, Homo sapiens
gaatagtacatgcagaa

SEQ ID NO: 3546144 - DNA, 21 bp, Homo sapiens
gaatagttggtcatctagcaa

SEQ ID NO: 3546145 - DNA, 19 bp, Homo sapiens
gaatattttaattaaaatt

SEQ ID NO: 3546146 - DNA, 14 bp, Homo sapiens
gaatattttatctt

SEQ ID NO: 3546147 - DNA, 16 bp, Homo sapiens
gaatatttttgtattt

SEQ ID NO: 3546148 - DNA, 17 bp, Homo sapiens
gaatatttttgtatttt

SEQ ID NO: 3546149 - DNA, 20 bp, Homo sapiens
gaatattttttatttctaag

SEQ ID NO: 3546150 - DNA, 23 bp, Homo sapiens
gaatcagaacagatgctgagcca

SEQ ID NO: 3546151 - DNA, 13 bp, Homo sapiens
gaatcagaactca

SEQ ID NO: 3546152 - DNA, 15 bp, Homo sapiens
gaatccagaaggaag

SEQ ID NO: 3546153 - DNA, 22 bp, Homo sapiens
gaatcctatatagaatgctgca

SEQ ID NO: 3546154 - DNA, 14 bp, Homo sapiens
gaatctagaggagg

SEQ ID NO: 3546155 - DNA, 13 bp, Homo sapiens
gaatctatattta

SEQ ID NO: 3546156 - DNA, 12 bp, Homo sapiens
gaatctgtctat

SEQ ID NO: 3546157 - DNA, 16 bp, Homo sapiens
gaatcttaatttatta

SEQ ID NO: 3546158 - DNA, 15 bp, Homo sapiens
gaatcttcactagaa

SEQ ID NO: 3546159 - DNA, 17 bp, Homo sapiens
gaatcttcctggcacaa

SEQ ID NO: 3546160 - DNA, 18 bp, Homo sapiens
gaatgaaaataactgaac

SEQ ID NO: 3546161 - DNA, 23 bp, Homo sapiens
gaatgaaatcctgcttcagtgta

SEQ ID NO: 3546162 - DNA, 17 bp, Homo sapiens
gaatgaaccttctggcc

SEQ ID NO: 3546163 - DNA, 14 bp, Homo sapiens
gaatgaattaaata

SEQ ID NO: 3546164 - DNA, 13 bp, Homo sapiens
gaatgagacatcc

SEQ ID NO: 3546165 - DNA, 15 bp, Homo sapiens
gaatgagacatccag

SEQ ID NO: 3546166 - DNA, 15 bp, Homo sapiens
gaatgagcctttgtg

SEQ ID NO: 3546167 - DNA, 17 bp, Homo sapiens
gaatgagcctttgtgct

SEQ ID NO: 3546168 - DNA, 16 bp, Homo sapiens
gaatgcagcaggaagg

SEQ ID NO: 3546169 - DNA, 13 bp, Homo sapiens
gaatgcattcaaa

SEQ ID NO: 3546170 - DNA, 17 bp, Homo sapiens
gaatgcctcgctccctt

SEQ ID NO: 3546171 - DNA, 21 bp, Homo sapiens
gaatggatcaatacacacaca

SEQ ID NO: 3546172 - DNA, 13 bp, Homo sapiens
gaatggcagctgc

SEQ ID NO: 3546173 - DNA, 16 bp, Homo sapiens
gaatggcagctgccac

SEQ ID NO: 3546174 - DNA, 19 bp, Homo sapiens
gaatggcagtcctggaggc

SEQ ID NO: 3546175 - DNA, 15 bp, Homo sapiens
gaatggcatggcagg

SEQ ID NO: 3546176 - DNA, 18 bp, Homo sapiens
gaatggccctcattcagt

SEQ ID NO: 3546177 - DNA, 17 bp, Homo sapiens
gaatggcctggagcagg

SEQ ID NO: 3546178 - DNA, 21 bp, Homo sapiens
gaatggtttttcttttcttta

SEQ ID NO: 3546179 - DNA, 20 bp, Homo sapiens
gaatgtacatgaagcaatta

SEQ ID NO: 3546180 - DNA, 15 bp, Homo sapiens
gaatgtcaataaatt

SEQ ID NO: 3546181 - DNA, 21 bp, Homo sapiens
gaatgtcagttgttatttatt

SEQ ID NO: 3546182 - DNA, 22 bp, Homo sapiens
gaatgtggcccctgaacaagaa

SEQ ID NO: 3546183 - DNA, 21 bp, Homo sapiens
gaatgtgtgtgtgtggcaggg

SEQ ID NO: 3546184 - DNA, 19 bp, Homo sapiens
gaatgttctttctgctcta

SEQ ID NO: 3546185 - DNA, 17 bp, Homo sapiens
gaatgttttcaaatgtt

SEQ ID NO: 3546186 - DNA, 21 bp, Homo sapiens
gaattaatatccctacatgta

SEQ ID NO: 3546187 - DNA, 19 bp, Homo sapiens
gaattacgtgctctgtggg

SEQ ID NO: 3546188 - DNA, 18 bp, Homo sapiens
gaattaggctgtaactac

SEQ ID NO: 3546189 - DNA, 23 bp, Homo sapiens
gaattaggctgtaactactttat

SEQ ID NO: 3546190 - DNA, 15 bp, Homo sapiens
gaattatctcaagta

SEQ ID NO: 3546191 - DNA, 16 bp, Homo sapiens
gaattatctcaagtaa

SEQ ID NO: 3546192 - DNA, 23 bp, Homo sapiens
gaattcaccagtgttcctgaagc

SEQ ID NO: 3546193 - DNA, 12 bp, Homo sapiens
gaattccctccc

SEQ ID NO: 3546194 - DNA, 20 bp, Homo sapiens
gaattcctttacaactaaat

SEQ ID NO: 3546195 - DNA, 22 bp, Homo sapiens
gaattcctttacaactaaataa

SEQ ID NO: 3546196 - DNA, 12 bp, Homo sapiens
gaattcttctgc

SEQ ID NO: 3546197 - DNA, 9 bp, Homo sapiens
gaattgttt

SEQ ID NO: 3546198 - DNA, 16 bp, Homo sapiens
gaatttactggacata

SEQ ID NO: 3546199 - DNA, 23 bp, Homo sapiens
gaatttatgtgaaatgctttctg

SEQ ID NO: 3546200 - DNA, 21 bp, Homo sapiens
gaatttatttttaagaaagaa

SEQ ID NO: 3546201 - DNA, 16 bp, Homo sapiens
gaccatctttagcagt

SEQ ID NO: 3546202 - DNA, 16 bp, Homo sapiens
gacccaaaccccctgc

SEQ ID NO: 3546203 - DNA, 17 bp, Homo sapiens
gacccaaaccccctgca

SEQ ID NO: 3546204 - DNA, 19 bp, Homo sapiens
gacccaaaccccctgcagc

SEQ ID NO: 3546205 - DNA, 20 bp, Homo sapiens
gacccaaaccccctgcagcc

SEQ ID NO: 3546206 - DNA, 17 bp, Homo sapiens
gacccagaatggagcct

SEQ ID NO: 3546207 - DNA, 17 bp, Homo sapiens
gacccagcatctcccag

SEQ ID NO: 3546208 - DNA, 14 bp, Homo sapiens
gacccagtcccaca

SEQ ID NO: 3546209 - DNA, 20 bp, Homo sapiens
gacccagtgcccccactgac

SEQ ID NO: 3546210 - DNA, 17 bp, Homo sapiens
gaccccaaaggaacact

SEQ ID NO: 3546211 - DNA, 18 bp, Homo sapiens
gaccccaagggggctgct

SEQ ID NO: 3546212 - DNA, 13 bp, Homo sapiens
gaccccagagaaa

SEQ ID NO: 3546213 - DNA, 14 bp, Homo sapiens
gaccccagctctgc

SEQ ID NO: 3546214 - DNA, 17 bp, Homo sapiens
gaccccaggacctcttc

SEQ ID NO: 3546215 - DNA, 16 bp, Homo sapiens
gaccccgagaaccctg

SEQ ID NO: 3546216 - DNA, 20 bp, Homo sapiens
gaccccgccatgcatgcagc

SEQ ID NO: 3546217 - DNA, 22 bp, Homo sapiens
gacccctggcttttcactgctg

SEQ ID NO: 3546218 - DNA, 13 bp, Homo sapiens
gacccctgggagc

SEQ ID NO: 3546219 - DNA, 14 bp, Homo sapiens
gacccctgggagct

SEQ ID NO: 3546220 - DNA, 17 bp, Homo sapiens
gacccggaggggcctgg

SEQ ID NO: 3546221 - DNA, 18 bp, Homo sapiens
gacccggaggggcctggc

SEQ ID NO: 3546222 - DNA, 22 bp, Homo sapiens
gaccctcaggaattcagtgcct

SEQ ID NO: 3546223 - DNA, 16 bp, Homo sapiens
gaccctcaggcacacc

SEQ ID NO: 3546224 - DNA, 17 bp, Homo sapiens
gaccctcaggcacacct

SEQ ID NO: 3546225 - DNA, 15 bp, Homo sapiens
gaccctcgagagcct

SEQ ID NO: 3546226 - DNA, 19 bp, Homo sapiens
gaccctcgagagccttact

SEQ ID NO: 3546227 - DNA, 16 bp, Homo sapiens
gaccctcgggccccat

SEQ ID NO: 3546228 - DNA, 22 bp, Homo sapiens
gaccctgaatccgtacttgggt

SEQ ID NO: 3546229 - DNA, 15 bp, Homo sapiens
gaccctgcaagacca

SEQ ID NO: 3546230 - DNA, 15 bp, Homo sapiens
gaccctgtcctgcag

SEQ ID NO: 3546231 - DNA, 17 bp, Homo sapiens
gacccttacagcctctg

SEQ ID NO: 3546232 - DNA, 20 bp, Homo sapiens
gacccttacagcctctgact

SEQ ID NO: 3546233 - DNA, 15 bp, Homo sapiens
gacccttctgggtcc

SEQ ID NO: 3546234 - DNA, 20 bp, Homo sapiens
gacccttctgggtccaggga

SEQ ID NO: 3546235 - DNA, 16 bp, Homo sapiens
gaccgagccctggaga

SEQ ID NO: 3546236 - DNA, 19 bp, Homo sapiens
gaccgagccctggagagcc

SEQ ID NO: 3546237 - DNA, 19 bp, Homo sapiens
gaccggcggaccccagcca

SEQ ID NO: 3546238 - DNA, 12 bp, Homo sapiens
gaccgggccagg

SEQ ID NO: 3546239 - DNA, 22 bp, Homo sapiens
gaccgtccaggggagatgggga

SEQ ID NO: 3546240 - DNA, 13 bp, Homo sapiens
gacctaccccagc

SEQ ID NO: 3546241 - DNA, 17 bp, Homo sapiens
gacctaccccagccagg

SEQ ID NO: 3546242 - DNA, 18 bp, Homo sapiens
gacctaccccagccaggc

SEQ ID NO: 3546243 - DNA, 18 bp, Homo sapiens
gacctcaaggaagctacg

SEQ ID NO: 3546244 - DNA, 19 bp, Homo sapiens
gacctcagttttatgcccc

SEQ ID NO: 3546245 - DNA, 15 bp, Homo sapiens
gacctccgcccctgc

SEQ ID NO: 3546246 - DNA, 21 bp, Homo sapiens
gacctccgcccctgcccccgc

SEQ ID NO: 3546247 - DNA, 12 bp, Homo sapiens
gacctccggagc

SEQ ID NO: 3546248 - DNA, 21 bp, Homo sapiens
gacctccggagcgccctgcag

SEQ ID NO: 3546249 - DNA, 12 bp, Homo sapiens
gacctctcccag

SEQ ID NO: 3546250 - DNA, 20 bp, Homo sapiens
gacctctgacaactgtgaag

SEQ ID NO: 3546251 - DNA, 16 bp, Homo sapiens
ctgttcccccttcaca

SEQ ID NO: 3546252 - DNA, 20 bp, Homo sapiens
ctgttcctcccccataaaat

SEQ ID NO: 3546253 - DNA, 18 bp, Homo sapiens
ctgttctccctttctctc

SEQ ID NO: 3546254 - DNA, 13 bp, Homo sapiens
ctgttctgcgctg

SEQ ID NO: 3546255 - DNA, 21 bp, Homo sapiens
ctgttctgcgctgtgtacaat

SEQ ID NO: 3546256 - DNA, 16 bp, Homo sapiens
ctgttcttcagtcctt

SEQ ID NO: 3546257 - DNA, 16 bp, Homo sapiens
ctgttcttgcataggc

SEQ ID NO: 3546258 - DNA, 20 bp, Homo sapiens
ctgttcttgggcctcaggct

SEQ ID NO: 3546259 - DNA, 17 bp, Homo sapiens
ctgttgacacaggtctt

SEQ ID NO: 3546260 - DNA, 22 bp, Homo sapiens
ctgttgagggccaagagatctg

SEQ ID NO: 3546261 - DNA, 15 bp, Homo sapiens
ctgttgataaaaact

SEQ ID NO: 3546262 - DNA, 16 bp, Homo sapiens
ctgttggcaggcccac

SEQ ID NO: 3546263 - DNA, 16 bp, Homo sapiens
ctgttgggacagccat

SEQ ID NO: 3546264 - DNA, 17 bp, Homo sapiens
ctgttgggacagccatt

SEQ ID NO: 3546265 - DNA, 22 bp, Homo sapiens
ctgttgggacagccattttcca

SEQ ID NO: 3546266 - DNA, 23 bp, Homo sapiens
ctgttgggacagccattttccaa

SEQ ID NO: 3546267 - DNA, 21 bp, Homo sapiens
ctgttggtctgccttctgctg

SEQ ID NO: 3546268 - DNA, 22 bp, Homo sapiens
ctgttgttcttataagaagaag

SEQ ID NO: 3546269 - DNA, 12 bp, Homo sapiens
ctgtttcaaaca

SEQ ID NO: 3546270 - DNA, 19 bp, Homo sapiens
ctgtttcccgtaaggctgt

SEQ ID NO: 3546271 - DNA, 13 bp, Homo sapiens
ctgtttccctgct

SEQ ID NO: 3546272 - DNA, 13 bp, Homo sapiens
ctgtttcctagct

SEQ ID NO: 3546273 - DNA, 13 bp, Homo sapiens
ctgttttccccca

SEQ ID NO: 3546274 - DNA, 15 bp, Homo sapiens
ctgttttcctccctt

SEQ ID NO: 3546275 - DNA, 19 bp, Homo sapiens
ctgttttcctcccttctgc

SEQ ID NO: 3546276 - DNA, 21 bp, Homo sapiens
ctgttttcctcccttctgcta

SEQ ID NO: 3546277 - DNA, 13 bp, Homo sapiens
ctgttttccttct

SEQ ID NO: 3546278 - DNA, 20 bp, Homo sapiens
ctgttttctacccttggaaa

SEQ ID NO: 3546279 - DNA, 18 bp, Homo sapiens
ctgttttcttctattcca

SEQ ID NO: 3546280 - DNA, 14 bp, Homo sapiens
ctgttttgccagcc

SEQ ID NO: 3546281 - DNA, 16 bp, Homo sapiens
ctgttttggatgttgc

SEQ ID NO: 3546282 - DNA, 23 bp, Homo sapiens
ctgtttttctctaatgcttgatt

SEQ ID NO: 3546283 - DNA, 23 bp, Homo sapiens
cttaaaacctgcttttcaatgtg

SEQ ID NO: 3546284 - DNA, 19 bp, Homo sapiens
cttaaaagtaataaagaga

SEQ ID NO: 3546285 - DNA, 14 bp, Homo sapiens
cttaaaagtttcta

SEQ ID NO: 3546286 - DNA, 19 bp, Homo sapiens
cttaaaatgcattgaaaga

SEQ ID NO: 3546287 - DNA, 11 bp, Homo sapiens
cttaaacaaaa

SEQ ID NO: 3546288 - DNA, 16 bp, Homo sapiens
cttaaacacaggctgt

SEQ ID NO: 3546289 - DNA, 21 bp, Homo sapiens
cttaaacacaggctgtcctta

SEQ ID NO: 3546290 - DNA, 13 bp, Homo sapiens
cttaaactggaaa

SEQ ID NO: 3546291 - DNA, 14 bp, Homo sapiens
cttaaactggaaag

SEQ ID NO: 3546292 - DNA, 12 bp, Homo sapiens
cttaactatgag

SEQ ID NO: 3546293 - DNA, 14 bp, Homo sapiens
cttaactatttcac

SEQ ID NO: 3546294 - DNA, 16 bp, Homo sapiens
cttaactatttcacat

SEQ ID NO: 3546295 - DNA, 14 bp, Homo sapiens
cttaacttcttgct

SEQ ID NO: 3546296 - DNA, 17 bp, Homo sapiens
cttaagcaaattttgta

SEQ ID NO: 3546297 - DNA, 14 bp, Homo sapiens
cttaagcagcatgg

SEQ ID NO: 3546298 - DNA, 15 bp, Homo sapiens
cttaagcagcatgga

SEQ ID NO: 3546299 - DNA, 22 bp, Homo sapiens
cttaagcagcatggaaaaatgg

SEQ ID NO: 3546300 - DNA, 20 bp, Homo sapiens
cttaagtatatcatgtaaag

SEQ ID NO: 3546301 - DNA, 19 bp, Homo sapiens
cttaagttagttccactga

SEQ ID NO: 3546302 - DNA, 21 bp, Homo sapiens
cttaagttagttccactgaga

SEQ ID NO: 3546303 - DNA, 14 bp, Homo sapiens
cttaatatatttga

SEQ ID NO: 3546304 - DNA, 20 bp, Homo sapiens
cttaatcaggtcctcagaga

SEQ ID NO: 3546305 - DNA, 15 bp, Homo sapiens
cttaatccattaaaa

SEQ ID NO: 3546306 - DNA, 15 bp, Homo sapiens
cttaatgacaacact

SEQ ID NO: 3546307 - DNA, 16 bp, Homo sapiens
cttaatgacaacactt

SEQ ID NO: 3546308 - DNA, 17 bp, Homo sapiens
cttaatgtatgttacca

SEQ ID NO: 3546309 - DNA, 21 bp, Homo sapiens
cttaatgtatgttaccaaaaa

SEQ ID NO: 3546310 - DNA, 21 bp, Homo sapiens
cttaatgtctggtgtttgtca

SEQ ID NO: 3546311 - DNA, 18 bp, Homo sapiens
cttaattgccagcaaata

SEQ ID NO: 3546312 - DNA, 17 bp, Homo sapiens
cttacaagccagctgga

SEQ ID NO: 3546313 - DNA, 21 bp, Homo sapiens
cttacaatcgcaaatcaaaac

SEQ ID NO: 3546314 - DNA, 13 bp, Homo sapiens
cttacaggagcca

SEQ ID NO: 3546315 - DNA, 15 bp, Homo sapiens
cttacaggagccagc

SEQ ID NO: 3546316 - DNA, 20 bp, Homo sapiens
cttacaggagccagcctgct

SEQ ID NO: 3546317 - DNA, 15 bp, Homo sapiens
cttacatctggctgg

SEQ ID NO: 3546318 - DNA, 13 bp, Homo sapiens
cttacatttcacc

SEQ ID NO: 3546319 - DNA, 12 bp, Homo sapiens
cttacctgggca

SEQ ID NO: 3546320 - DNA, 18 bp, Homo sapiens
cttactaaaaagtataaa

SEQ ID NO: 3546321 - DNA, 14 bp, Homo sapiens
cttactgatattat

SEQ ID NO: 3546322 - DNA, 19 bp, Homo sapiens
cttacttcaaagtgcctgg

SEQ ID NO: 3546323 - DNA, 20 bp, Homo sapiens
cttacttcaaagtgcctggg

SEQ ID NO: 3546324 - DNA, 22 bp, Homo sapiens
cttacttcaaagtgcctgggct

SEQ ID NO: 3546325 - DNA, 11 bp, Homo sapiens
cttagaaactg

SEQ ID NO: 3546326 - DNA, 15 bp, Homo sapiens
cttagagtgtagctg

SEQ ID NO: 3546327 - DNA, 14 bp, Homo sapiens
cttagagtttctgt

SEQ ID NO: 3546328 - DNA, 19 bp, Homo sapiens
cttagcaataaatgctttt

SEQ ID NO: 3546329 - DNA, 19 bp, Homo sapiens
cttagccctcaccacagcc

SEQ ID NO: 3546330 - DNA, 18 bp, Homo sapiens
cttagctcagctgagcat

SEQ ID NO: 3546331 - DNA, 23 bp, Homo sapiens
cttaggagaagtcttctatttat

SEQ ID NO: 3546332 - DNA, 15 bp, Homo sapiens
cttaggccagcacca

SEQ ID NO: 3546333 - DNA, 21 bp, Homo sapiens
cttagggacaggaccccagct

SEQ ID NO: 3546334 - DNA, 22 bp, Homo sapiens
cttagggacaggaccccagctc

SEQ ID NO: 3546335 - DNA, 15 bp, Homo sapiens
cttagtacaaagttt

SEQ ID NO: 3546336 - DNA, 19 bp, Homo sapiens
cttagttggctttgcccac

SEQ ID NO: 3546337 - DNA, 15 bp, Homo sapiens
cttataaaccaatct

SEQ ID NO: 3546338 - DNA, 17 bp, Homo sapiens
cttataaaccaatctta

SEQ ID NO: 3546339 - DNA, 20 bp, Homo sapiens
cttataaagtggaagtatgt

SEQ ID NO: 3546340 - DNA, 17 bp, Homo sapiens
cttataataaaggactg

SEQ ID NO: 3546341 - DNA, 16 bp, Homo sapiens
cttatacttttctcaa

SEQ ID NO: 3546342 - DNA, 19 bp, Homo sapiens
cttatagttactgtgtaat

SEQ ID NO: 3546343 - DNA, 13 bp, Homo sapiens
cttatccaggttg

SEQ ID NO: 3546344 - DNA, 21 bp, Homo sapiens
cttatccaggttggttttgct

SEQ ID NO: 3546345 - DNA, 16 bp, Homo sapiens
cttatccctctcttcc

SEQ ID NO: 3546346 - DNA, 16 bp, Homo sapiens
cttatctccaagacca

SEQ ID NO: 3546347 - DNA, 22 bp, Homo sapiens
cttatctgaaaggccagcagct

SEQ ID NO: 3546348 - DNA, 15 bp, Homo sapiens
cttatggcatgactc

SEQ ID NO: 3546349 - DNA, 15 bp, Homo sapiens
cttatgtagaaactg

SEQ ID NO: 3546350 - DNA, 17 bp, Homo sapiens
cttattattaataatga

SEQ ID NO: 3546351 - DNA, 21 bp, Homo sapiens
cttattattaataatgaagta

SEQ ID NO: 3546352 - DNA, 16 bp, Homo sapiens
cttattcagttcttac

SEQ ID NO: 3546353 - DNA, 19 bp, Homo sapiens
cttattcctaatggctatt

SEQ ID NO: 3546354 - DNA, 18 bp, Homo sapiens
cttattggcagctctact

SEQ ID NO: 3546355 - DNA, 18 bp, Homo sapiens
cttatttacccttttccc

SEQ ID NO: 3546356 - DNA, 11 bp, Homo sapiens
cttatttctgc

SEQ ID NO: 3546357 - DNA, 19 bp, Homo sapiens
cttatttgccttctactcc

SEQ ID NO: 3546358 - DNA, 22 bp, Homo sapiens
cttatttgccttctactcccct

SEQ ID NO: 3546359 - DNA, 18 bp, Homo sapiens
cttattttcaagaaactg

SEQ ID NO: 3546360 - DNA, 14 bp, Homo sapiens
cttattttgtaata

SEQ ID NO: 3546361 - DNA, 17 bp, Homo sapiens
cttattttgtaataaac

SEQ ID NO: 3546362 - DNA, 21 bp, Homo sapiens
cttattttgtaataaactctc

SEQ ID NO: 3546363 - DNA, 23 bp, Homo sapiens
cttattttgtaataaactctcta

SEQ ID NO: 3546364 - DNA, 17 bp, Homo sapiens
cttatttttgacagtgt

SEQ ID NO: 3546365 - DNA, 20 bp, Homo sapiens
cttcaaaaagccacagcaga

SEQ ID NO: 3546366 - DNA, 21 bp, Homo sapiens
cttcaaaagtttgtttgctta

SEQ ID NO: 3546367 - DNA, 19 bp, Homo sapiens
cttcaaagctgaatatttt

SEQ ID NO: 3546368 - DNA, 13 bp, Homo sapiens
ctttgaaagaagc

SEQ ID NO: 3546369 - DNA, 15 bp, Homo sapiens
ctttgaaagaagcaa

SEQ ID NO: 3546370 - DNA, 20 bp, Homo sapiens
ctttgaaagaagcaagacac

SEQ ID NO: 3546371 - DNA, 16 bp, Homo sapiens
ctttgaataaatgtca

SEQ ID NO: 3546372 - DNA, 13 bp, Homo sapiens
ctttgactgtcag

SEQ ID NO: 3546373 - DNA, 17 bp, Homo sapiens
ctttgactgtcagcaag

SEQ ID NO: 3546374 - DNA, 13 bp, Homo sapiens
ctttgagcatttt

SEQ ID NO: 3546375 - DNA, 21 bp, Homo sapiens
ctttgagtgtcttaattaaaa

SEQ ID NO: 3546376 - DNA, 22 bp, Homo sapiens
ctttgatatgccaccagcgaac

SEQ ID NO: 3546377 - DNA, 12 bp, Homo sapiens
ctttgcaaataa

SEQ ID NO: 3546378 - DNA, 18 bp, Homo sapiens
ctttgcacagctctccgg

SEQ ID NO: 3546379 - DNA, 16 bp, Homo sapiens
ctttgcaccaaagaca

SEQ ID NO: 3546380 - DNA, 23 bp, Homo sapiens
ctttgcatattataaaggataaa

SEQ ID NO: 3546381 - DNA, 14 bp, Homo sapiens
ctttgcattttgga

SEQ ID NO: 3546382 - DNA, 17 bp, Homo sapiens
ctttgccaaaaagcata

SEQ ID NO: 3546383 - DNA, 16 bp, Homo sapiens
ctttgccaaggctctc

SEQ ID NO: 3546384 - DNA, 22 bp, Homo sapiens
ctttgccaaggctctcccctct

SEQ ID NO: 3546385 - DNA, 14 bp, Homo sapiens
ctttgccatctctg

SEQ ID NO: 3546386 - DNA, 19 bp, Homo sapiens
ctttgccatctctgctcca

SEQ ID NO: 3546387 - DNA, 21 bp, Homo sapiens
ctttgcctcttctttgtgcct

SEQ ID NO: 3546388 - DNA, 19 bp, Homo sapiens
ctttgctgcagagatcaag

SEQ ID NO: 3546389 - DNA, 17 bp, Homo sapiens
ctttgctgcattccttt

SEQ ID NO: 3546390 - DNA, 15 bp, Homo sapiens
ctttgctgcccctgt

SEQ ID NO: 3546391 - DNA, 19 bp, Homo sapiens
ctttgctgctgaaggctca

SEQ ID NO: 3546392 - DNA, 13 bp, Homo sapiens
ctttgctttctgc

SEQ ID NO: 3546393 - DNA, 15 bp, Homo sapiens
ctttgctttctgctc

SEQ ID NO: 3546394 - DNA, 22 bp, Homo sapiens
ctttggcattgctgcatatttg

SEQ ID NO: 3546395 - DNA, 20 bp, Homo sapiens
ctttggcctggggtgcatct

SEQ ID NO: 3546396 - DNA, 13 bp, Homo sapiens
ctttggctgcagg

SEQ ID NO: 3546397 - DNA, 13 bp, Homo sapiens
ctttgggccagac

SEQ ID NO: 3546398 - DNA, 18 bp, Homo sapiens
ctttgggggagtgggcgc

SEQ ID NO: 3546399 - DNA, 14 bp, Homo sapiens
ctttggttcagcta

SEQ ID NO: 3546400 - DNA, 17 bp, Homo sapiens
ctttgtaagtgaaaaac

SEQ ID NO: 3546401 - DNA, 21 bp, Homo sapiens
ctttgtaagtgaaaaacatga

SEQ ID NO: 3546402 - DNA, 19 bp, Homo sapiens
ctttgtagttactcaagca

SEQ ID NO: 3546403 - DNA, 21 bp, Homo sapiens
ctttgtatataggcttctcac

SEQ ID NO: 3546404 - DNA, 22 bp, Homo sapiens
ctttgtattgtatattacaatg

SEQ ID NO: 3546405 - DNA, 17 bp, Homo sapiens
ctttgtcattcagttct

SEQ ID NO: 3546406 - DNA, 18 bp, Homo sapiens
ctttgtcattcagttcta

SEQ ID NO: 3546407 - DNA, 19 bp, Homo sapiens
ctttgtctccaaagaagat

SEQ ID NO: 3546408 - DNA, 21 bp, Homo sapiens
ctttgtctttctttgtcattc

SEQ ID NO: 3546409 - DNA, 13 bp, Homo sapiens
ctttgtgcctttg

SEQ ID NO: 3546410 - DNA, 18 bp, Homo sapiens
ctttgtgcctttggcctg

SEQ ID NO: 3546411 - DNA, 17 bp, Homo sapiens
ctttgtgctttttgtca

SEQ ID NO: 3546412 - DNA, 16 bp, Homo sapiens
gatgaactgactgaag

SEQ ID NO: 3546413 - DNA, 20 bp, Homo sapiens
gatgaagtcacccctttctg

SEQ ID NO: 3546414 - DNA, 13 bp, Homo sapiens
gatgaatgtcagt

SEQ ID NO: 3546415 - DNA, 21 bp, Homo sapiens
gatgaatgtcagttgttattt

SEQ ID NO: 3546416 - DNA, 22 bp, Homo sapiens
gatgaatgtcagttgttattta

SEQ ID NO: 3546417 - DNA, 15 bp, Homo sapiens
gatgactaaaatatt

SEQ ID NO: 3546418 - DNA, 22 bp, Homo sapiens
gatgactttgcagatggaaaga

SEQ ID NO: 3546419 - DNA, 13 bp, Homo sapiens
gatgagagaatgt

SEQ ID NO: 3546420 - DNA, 17 bp, Homo sapiens
gatgaggctcagagagg

SEQ ID NO: 3546421 - DNA, 17 bp, Homo sapiens
gatgatggcagagccag

SEQ ID NO: 3546422 - DNA, 19 bp, Homo sapiens
gatgcaaggattacagaaa

SEQ ID NO: 3546423 - DNA, 14 bp, Homo sapiens
gatgcacagtatct

SEQ ID NO: 3546424 - DNA, 21 bp, Homo sapiens
gatgcacagtatctgctgttc

SEQ ID NO: 3546425 - DNA, 23 bp, Homo sapiens
gatgcacgtggggcccactgctc

SEQ ID NO: 3546426 - DNA, 20 bp, Homo sapiens
gatgcagtcctcaggaaggg

SEQ ID NO: 3546427 - DNA, 14 bp, Homo sapiens
gatgcatatagaca

SEQ ID NO: 3546428 - DNA, 12 bp, Homo sapiens
gatgccagcttc

SEQ ID NO: 3546429 - DNA, 23 bp, Homo sapiens
gatgccagcttctctctccaggg

SEQ ID NO: 3546430 - DNA, 17 bp, Homo sapiens
gatgccccgagcccagg

SEQ ID NO: 3546431 - DNA, 18 bp, Homo sapiens
gatgccctggaggtggct

SEQ ID NO: 3546432 - DNA, 13 bp, Homo sapiens
gatgccttgaggt

SEQ ID NO: 3546433 - DNA, 14 bp, Homo sapiens
gatgctaaaacctg

SEQ ID NO: 3546434 - DNA, 16 bp, Homo sapiens
gatgctactactgcag

SEQ ID NO: 3546435 - DNA, 23 bp, Homo sapiens
gcaaaggtgcactccagactctg

SEQ ID NO: 3546436 - DNA, 18 bp, Homo sapiens
gcaaaggtgtgcttcctg

SEQ ID NO: 3546437 - DNA, 20 bp, Homo sapiens
gcaaagtgacaaagcaattt

SEQ ID NO: 3546438 - DNA, 23 bp, Homo sapiens
gcaaagttccctacttcctgtga

SEQ ID NO: 3546439 - DNA, 17 bp, Homo sapiens
gcaaataaacttacaga

SEQ ID NO: 3546440 - DNA, 18 bp, Homo sapiens
gcaaatagattcagagaa

SEQ ID NO: 3546441 - DNA, 20 bp, Homo sapiens
gcaaatagattcagagaaat

SEQ ID NO: 3546442 - DNA, 16 bp, Homo sapiens
gcaaatattaaaattg

SEQ ID NO: 3546443 - DNA, 13 bp, Homo sapiens
gcaaatccaggct

SEQ ID NO: 3546444 - DNA, 15 bp, Homo sapiens
gcaaatgtggctcct

SEQ ID NO: 3546445 - DNA, 18 bp, Homo sapiens
gcaaattttgtattattg

SEQ ID NO: 3546446 - DNA, 15 bp, Homo sapiens
gcaacaatggatatt

SEQ ID NO: 3546447 - DNA, 21 bp, Homo sapiens
gcaacaatggatattgcctgt

SEQ ID NO: 3546448 - DNA, 18 bp, Homo sapiens
gcaacactttttatgtta

SEQ ID NO: 3546449 - DNA, 13 bp, Homo sapiens
gcaacagagcact

SEQ ID NO: 3546450 - DNA, 15 bp, Homo sapiens
gcaacatttgacaaa

SEQ ID NO: 3546451 - DNA, 17 bp, Homo sapiens
gcaaccctacagtatat

SEQ ID NO: 3546452 - DNA, 20 bp, Homo sapiens
gcaacccttcctgctgctgc

SEQ ID NO: 3546453 - DNA, 13 bp, Homo sapiens
gcaacgcccctcc

SEQ ID NO: 3546454 - DNA, 19 bp, Homo sapiens
gcaacgcccctccaaacct

SEQ ID NO: 3546455 - DNA, 14 bp, Homo sapiens
gcaacgtagcctgg

SEQ ID NO: 3546456 - DNA, 15 bp, Homo sapiens
gcaacgtagcctggg

SEQ ID NO: 3546457 - DNA, 15 bp, Homo sapiens
gcaacttccgctgag

SEQ ID NO: 3546458 - DNA, 23 bp, Homo sapiens
gcaagacacgtggcctcgtgagg

SEQ ID NO: 3546459 - DNA, 16 bp, Homo sapiens
gcaagacagaaaagtg

SEQ ID NO: 3546460 - DNA, 19 bp, Homo sapiens
gcaagacagaaaagtgcct

SEQ ID NO: 3546461 - DNA, 12 bp, Homo sapiens
gcaagaccacgg

SEQ ID NO: 3546462 - DNA, 23 bp, Homo sapiens
gcaagaccacggagggagcgaca

SEQ ID NO: 3546463 - DNA, 23 bp, Homo sapiens
gcaagacctcatctgtggagctg

SEQ ID NO: 3546464 - DNA, 20 bp, Homo sapiens
gcaagcaccaacctccagac

SEQ ID NO: 3546465 - DNA, 21 bp, Homo sapiens
gcaagcaccaacctccagact

SEQ ID NO: 3546466 - DNA, 11 bp, Homo sapiens
gcaagcagatg

SEQ ID NO: 3546467 - DNA, 12 bp, Homo sapiens
gcaagcagcttt

SEQ ID NO: 3546468 - DNA, 23 bp, Homo sapiens
gcaagcagctttttattccctgc

SEQ ID NO: 3546469 - DNA, 13 bp, Homo sapiens
gcaagcaggagtg

SEQ ID NO: 3546470 - DNA, 15 bp, Homo sapiens
gcaagcccctgctcc

SEQ ID NO: 3546471 - DNA, 15 bp, Homo sapiens
gcaagccctgttgac

SEQ ID NO: 3546472 - DNA, 17 bp, Homo sapiens
gcaagcgagcacagtat

SEQ ID NO: 3546473 - DNA, 21 bp, Homo sapiens
gcaagctaggccccagaggcc

SEQ ID NO: 3546474 - DNA, 22 bp, Homo sapiens
gcaagctaggccccagaggccc

SEQ ID NO: 3546475 - DNA, 14 bp, Homo sapiens
gcaaggattacaga

SEQ ID NO: 3546476 - DNA, 12 bp, Homo sapiens
gcaaggcagagc

SEQ ID NO: 3546477 - DNA, 15 bp, Homo sapiens
gcaaggccctgccct

SEQ ID NO: 3546478 - DNA, 22 bp, Homo sapiens
gcaaggggtgaggataggacag

SEQ ID NO: 3546479 - DNA, 15 bp, Homo sapiens
gcaaggtactctggt

SEQ ID NO: 3546480 - DNA, 18 bp, Homo sapiens
gcaaggtccggcccatcc

SEQ ID NO: 3546481 - DNA, 21 bp, Homo sapiens
gcaaggtttaggctggtggcc

SEQ ID NO: 3546482 - DNA, 23 bp, Homo sapiens
gcaaggtttaggctggtggccca

SEQ ID NO: 3546483 - DNA, 23 bp, Homo sapiens
gcaagtcccttcagactggccct

SEQ ID NO: 3546484 - DNA, 20 bp, Homo sapiens
gcaagtggagctgtctgtct

SEQ ID NO: 3546485 - DNA, 17 bp, Homo sapiens
gcaataatccaccccca

SEQ ID NO: 3546486 - DNA, 16 bp, Homo sapiens
gcaatagttttttact

SEQ ID NO: 3546487 - DNA, 15 bp, Homo sapiens
gcaatgtgttttttc

SEQ ID NO: 3546488 - DNA, 21 bp, Homo sapiens
gcaatttactgatgagagaat

SEQ ID NO: 3546489 - DNA, 22 bp, Homo sapiens
gcaatttactgatgagagaatg

SEQ ID NO: 3546490 - DNA, 16 bp, Homo sapiens
gcacaaaagacagctg

SEQ ID NO: 3546491 - DNA, 14 bp, Homo sapiens
gcacaaagaagaaa

SEQ ID NO: 3546492 - DNA, 18 bp, Homo sapiens
gcacaaagaagaaagctg

SEQ ID NO: 3546493 - DNA, 16 bp, Homo sapiens
gcacaaatatttattt

SEQ ID NO: 3546494 - DNA, 21 bp, Homo sapiens
gcacaagactggcccagtgcc

SEQ ID NO: 3546495 - DNA, 16 bp, Homo sapiens
gcacaatgttggagca

SEQ ID NO: 3546496 - DNA, 12 bp, Homo sapiens
gcacacagggca

SEQ ID NO: 3546497 - DNA, 17 bp, Homo sapiens
gcacaccattttgtaaa

SEQ ID NO: 3546498 - DNA, 22 bp, Homo sapiens
gcacacctcctcccactgccca

SEQ ID NO: 3546499 - DNA, 22 bp, Homo sapiens
gcacacctgaatcagctggaca

SEQ ID NO: 3546500 - DNA, 13 bp, Homo sapiens
gcacaccttgcag

SEQ ID NO: 3546501 - DNA, 12 bp, Homo sapiens
gcacacgctgct

SEQ ID NO: 3546502 - DNA, 13 bp, Homo sapiens
gcacacgctgctc

SEQ ID NO: 3546503 - DNA, 18 bp, Homo sapiens
gcacacgctgctctgccc

SEQ ID NO: 3546504 - DNA, 15 bp, Homo sapiens
gcacactttctggca

SEQ ID NO: 3546505 - DNA, 16 bp, Homo sapiens
gcacagagggaagcca

SEQ ID NO: 3546506 - DNA, 18 bp, Homo sapiens
gcacagagggaagccatg

SEQ ID NO: 3546507 - DNA, 20 bp, Homo sapiens
gcacagagggaagccatgtg

SEQ ID NO: 3546508 - DNA, 23 bp, Homo sapiens
gcacagggaaaattgccccatcc

SEQ ID NO: 3546509 - DNA, 17 bp, Homo sapiens
gcacagtaggtcccggc

SEQ ID NO: 3546510 - DNA, 16 bp, Homo sapiens
gcacagtatctgctgt

SEQ ID NO: 3546511 - DNA, 18 bp, Homo sapiens
gcacagtatctgctgttc

SEQ ID NO: 3546512 - DNA, 15 bp, Homo sapiens
gcacagtgcatctca

SEQ ID NO: 3546513 - DNA, 21 bp, Homo sapiens
gcacagtgcatctcagcccac

SEQ ID NO: 3546514 - DNA, 22 bp, Homo sapiens
gcacagtgggagctgagctgga

SEQ ID NO: 3546515 - DNA, 13 bp, Homo sapiens
gcacatccctgga

SEQ ID NO: 3546516 - DNA, 15 bp, Homo sapiens
gcacatctgttttgt

SEQ ID NO: 3546517 - DNA, 16 bp, Homo sapiens
gcacatgctgtctggc

SEQ ID NO: 3546518 - DNA, 13 bp, Homo sapiens
gcaccaaagacat

SEQ ID NO: 3546519 - DNA, 13 bp, Homo sapiens
gcaccaaccacag

SEQ ID NO: 3546520 - DNA, 17 bp, Homo sapiens
gcaccaacctccagact

SEQ ID NO: 3546521 - DNA, 19 bp, Homo sapiens
gcaccaacctccagactca

SEQ ID NO: 3546522 - DNA, 20 bp, Homo sapiens
gcaccaacctccagactcag

SEQ ID NO: 3546523 - DNA, 21 bp, Homo sapiens
gcaccacagccggtcagagga

SEQ ID NO: 3546524 - DNA, 12 bp, Homo sapiens
gcaccacagcct

SEQ ID NO: 3546525 - DNA, 16 bp, Homo sapiens
gcaccacagcctccaa

SEQ ID NO: 3546526 - DNA, 13 bp, Homo sapiens
gcaccaccatgcc

SEQ ID NO: 3546527 - DNA, 14 bp, Homo sapiens
gcaccaccatgccc

SEQ ID NO: 3546528 - DNA, 12 bp, Homo sapiens
gcacccagaaca

SEQ ID NO: 3546529 - DNA, 17 bp, Homo sapiens
gcacccagagcaccccc

SEQ ID NO: 3546530 - DNA, 15 bp, Homo sapiens
gcaccccactgggag

SEQ ID NO: 3546531 - DNA, 21 bp, Homo sapiens
gcacccccacaagctgtccct

SEQ ID NO: 3546532 - DNA, 14 bp, Homo sapiens
gcacccccatgctg

SEQ ID NO: 3546533 - DNA, 17 bp, Homo sapiens
gcacccccatgctgcct

SEQ ID NO: 3546534 - DNA, 13 bp, Homo sapiens
gcacccctccagt

SEQ ID NO: 3546535 - DNA, 19 bp, Homo sapiens
gcacccctgagccagcagg

SEQ ID NO: 3546536 - DNA, 20 bp, Homo sapiens
gcacccctgagccagcaggg

SEQ ID NO: 3546537 - DNA, 20 bp, Homo sapiens
gcacccgcggcccgcgcagc

SEQ ID NO: 3546538 - DNA, 13 bp, Homo sapiens
gcacccggctcgt

SEQ ID NO: 3546539 - DNA, 17 bp, Homo sapiens
gcaccctcatacacaga

SEQ ID NO: 3546540 - DNA, 20 bp, Homo sapiens
gcaccctcatacacagaaac

SEQ ID NO: 3546541 - DNA, 17 bp, Homo sapiens
gcaccctgcgcctccag

SEQ ID NO: 3546542 - DNA, 19 bp, Homo sapiens
gcaccctgcgcctccagag

SEQ ID NO: 3546543 - DNA, 14 bp, Homo sapiens
gcaccgcctcttcc

SEQ ID NO: 3546544 - DNA, 16 bp, Homo sapiens
gcaccgtccaggcccc

SEQ ID NO: 3546545 - DNA, 23 bp, Homo sapiens
gcacctaaaacccaaaggtggca

SEQ ID NO: 3546546 - DNA, 15 bp, Homo sapiens
gcacctaatccaggc

SEQ ID NO: 3546547 - DNA, 17 bp, Homo sapiens
gcacctaatccaggcag

SEQ ID NO: 3546548 - DNA, 18 bp, Homo sapiens
gcacctaatccaggcaga

SEQ ID NO: 3546549 - DNA, 22 bp, Homo sapiens
gcacctaatccaggcagatcca

SEQ ID NO: 3546550 - DNA, 16 bp, Homo sapiens
gcacctatctcagcca

SEQ ID NO: 3546551 - DNA, 18 bp, Homo sapiens
gcacctatctcagccata

SEQ ID NO: 3546552 - DNA, 22 bp, Homo sapiens
gcacctatgagatggccatgct

SEQ ID NO: 3546553 - DNA, 23 bp, Homo sapiens
gcacctatgagatggccatgctc

SEQ ID NO: 3546554 - DNA, 22 bp, Homo sapiens
gcacctcctaccctcccaccag

SEQ ID NO: 3546555 - DNA, 15 bp, Homo sapiens
gcacctgcctccacc

SEQ ID NO: 3546556 - DNA, 16 bp, Homo sapiens
gcacctgcctccacca

SEQ ID NO: 3546557 - DNA, 19 bp, Homo sapiens
gcaccttccccctccccca

SEQ ID NO: 3546558 - DNA, 22 bp, Homo sapiens
gcacgcggatgctactactgca

SEQ ID NO: 3546559 - DNA, 19 bp, Homo sapiens
gcacggcgggatcctccac

SEQ ID NO: 3546560 - DNA, 20 bp, Homo sapiens
gcacggcgggatcctccaca

SEQ ID NO: 3546561 - DNA, 23 bp, Homo sapiens
gcacggcgtggtgtgtccctgga

SEQ ID NO: 3546562 - DNA, 15 bp, Homo sapiens
gcacgtccttgggcg

SEQ ID NO: 3546563 - DNA, 15 bp, Homo sapiens
gcacgtgacaggctc

SEQ ID NO: 3546564 - DNA, 16 bp, Homo sapiens
gcacgtggggcccact

SEQ ID NO: 3546565 - DNA, 19 bp, Homo sapiens
gcactaaaatgaggatcca

SEQ ID NO: 3546566 - DNA, 23 bp, Homo sapiens
gcactaaggggcccggccagcca

SEQ ID NO: 3546567 - DNA, 12 bp, Homo sapiens
gcatttctaaaa

SEQ ID NO: 3546568 - DNA, 22 bp, Homo sapiens
gcatttctaaaatgttaaaaca

SEQ ID NO: 3546569 - DNA, 22 bp, Homo sapiens
gcatttgtataaagaaactggt

SEQ ID NO: 3546570 - DNA, 20 bp, Homo sapiens
gcatttgtttgctgaaattt

SEQ ID NO: 3546571 - DNA, 15 bp, Homo sapiens
gcattttaagtaaaa

SEQ ID NO: 3546572 - DNA, 23 bp, Homo sapiens
gcattttagaaactacaaatata

SEQ ID NO: 3546573 - DNA, 20 bp, Homo sapiens
gcattttcctccatcgcagt

SEQ ID NO: 3546574 - DNA, 17 bp, Homo sapiens
gccaaaacaagccaaag

SEQ ID NO: 3546575 - DNA, 13 bp, Homo sapiens
gccaaaacccagc

SEQ ID NO: 3546576 - DNA, 16 bp, Homo sapiens
gccaaaacccagctgc

SEQ ID NO: 3546577 - DNA, 14 bp, Homo sapiens
gccaaaagctgctc

SEQ ID NO: 3546578 - DNA, 15 bp, Homo sapiens
gccaaaagctgctca

SEQ ID NO: 3546579 - DNA, 17 bp, Homo sapiens
gccaaacccttgctttc

SEQ ID NO: 3546580 - DNA, 15 bp, Homo sapiens
gccaaactcaggccc

SEQ ID NO: 3546581 - DNA, 19 bp, Homo sapiens
gccaaagaaacaagctgtg

SEQ ID NO: 3546582 - DNA, 19 bp, Homo sapiens
gccaaagagcctcccacca

SEQ ID NO: 3546583 - DNA, 23 bp, Homo sapiens
gccaaagagcctcccaccagagc

SEQ ID NO: 3546584 - DNA, 17 bp, Homo sapiens
gccaaaggatgtgatat

SEQ ID NO: 3546585 - DNA, 17 bp, Homo sapiens
gccaaatttcttttgct

SEQ ID NO: 3546586 - DNA, 13 bp, Homo sapiens
gccaaccagcccg

SEQ ID NO: 3546587 - DNA, 23 bp, Homo sapiens
gccaaccatcatgtgtagagccc

SEQ ID NO: 3546588 - DNA, 17 bp, Homo sapiens
gccaacctcaggctcct

SEQ ID NO: 3546589 - DNA, 14 bp, Homo sapiens
gccaagaatacttg

SEQ ID NO: 3546590 - DNA, 16 bp, Homo sapiens
gccaagagatctgtgt

SEQ ID NO: 3546591 - DNA, 18 bp, Homo sapiens
gccaagagatctgtgtgg

SEQ ID NO: 3546592 - DNA, 15 bp, Homo sapiens
gccaagccagattct

SEQ ID NO: 3546593 - DNA, 16 bp, Homo sapiens
gccaagctggcacaaa

SEQ ID NO: 3546594 - DNA, 11 bp, Homo sapiens
gccaaggagct

SEQ ID NO: 3546595 - DNA, 14 bp, Homo sapiens
gccaaggagctgct

SEQ ID NO: 3546596 - DNA, 15 bp, Homo sapiens
gccaaggagctgcta

SEQ ID NO: 3546597 - DNA, 23 bp, Homo sapiens
gccaaggagctgctatagcctgg

SEQ ID NO: 3546598 - DNA, 20 bp, Homo sapiens
gccaaggagggtgagtgcaa

SEQ ID NO: 3546599 - DNA, 19 bp, Homo sapiens
gccaaggctctcccctctc

SEQ ID NO: 3546600 - DNA, 21 bp, Homo sapiens
gccaagggatggacatcttgt

SEQ ID NO: 3546601 - DNA, 15 bp, Homo sapiens
gccaatctaaaatgg

SEQ ID NO: 3546602 - DNA, 19 bp, Homo sapiens
gccaatggagactgtctca

SEQ ID NO: 3546603 - DNA, 14 bp, Homo sapiens
gccacaaggacttc

SEQ ID NO: 3546604 - DNA, 17 bp, Homo sapiens
gccacaaggacttcctg

SEQ ID NO: 3546605 - DNA, 22 bp, Homo sapiens
gccacaccgtggcagcttgctg

SEQ ID NO: 3546606 - DNA, 20 bp, Homo sapiens
gccacacctggccttaaaga

SEQ ID NO: 3546607 - DNA, 22 bp, Homo sapiens
gccacactctgggctccagagt

SEQ ID NO: 3546608 - DNA, 19 bp, Homo sapiens
gccacagacccctgggagc

SEQ ID NO: 3546609 - DNA, 16 bp, Homo sapiens
gccacagtcactggat

SEQ ID NO: 3546610 - DNA, 19 bp, Homo sapiens
gccacagtggggctgcagg

SEQ ID NO: 3546611 - DNA, 18 bp, Homo sapiens
gccacatcttgctctgca

SEQ ID NO: 3546612 - DNA, 13 bp, Homo sapiens
gccacatggagcc

SEQ ID NO: 3546613 - DNA, 16 bp, Homo sapiens
gccacatggagccccc

SEQ ID NO: 3546614 - DNA, 14 bp, Homo sapiens
gccacattgctggc

SEQ ID NO: 3546615 - DNA, 15 bp, Homo sapiens
gccacattgctggct

SEQ ID NO: 3546616 - DNA, 16 bp, Homo sapiens
gccacatttagtcctg

SEQ ID NO: 3546617 - DNA, 22 bp, Homo sapiens
gccacatttagtcctgtactgt

SEQ ID NO: 3546618 - DNA, 13 bp, Homo sapiens
gccaccaccctgc

SEQ ID NO: 3546619 - DNA, 18 bp, Homo sapiens
gccaccacctttggctgg

SEQ ID NO: 3546620 - DNA, 19 bp, Homo sapiens
gccaccacctttggctggt

SEQ ID NO: 3546621 - DNA, 20 bp, Homo sapiens
gccaccatgcttgcctgaag

SEQ ID NO: 3546622 - DNA, 17 bp, Homo sapiens
gccacccacctccctgc

SEQ ID NO: 3546623 - DNA, 22 bp, Homo sapiens
gccaccccaaaccccagcccca

SEQ ID NO: 3546624 - DNA, 17 bp, Homo sapiens
gccacccccttccctgg

SEQ ID NO: 3546625 - DNA, 13 bp, Homo sapiens
gccaccctccacg

SEQ ID NO: 3546626 - DNA, 18 bp, Homo sapiens
gccaccggtgggcagtgg

SEQ ID NO: 3546627 - DNA, 12 bp, Homo sapiens
gccacctgcagg

SEQ ID NO: 3546628 - DNA, 17 bp, Homo sapiens
gccacctgggaacacag

SEQ ID NO: 3546629 - DNA, 22 bp, Homo sapiens
gccacctgggaacacagttctg

SEQ ID NO: 3546630 - DNA, 12 bp, Homo sapiens
gccacggcctgg

SEQ ID NO: 3546631 - DNA, 13 bp, Homo sapiens
gccacggcctggc

SEQ ID NO: 3546632 - DNA, 15 bp, Homo sapiens
gccacggcctggctg

SEQ ID NO: 3546633 - DNA, 20 bp, Homo sapiens
gccacggcctggctggtggg

SEQ ID NO: 3546634 - DNA, 16 bp, Homo sapiens
gccacgtcccagcatc

SEQ ID NO: 3546635 - DNA, 21 bp, Homo sapiens
gccacgtcccagcatccctgg

SEQ ID NO: 3546636 - DNA, 22 bp, Homo sapiens
gccacgtcccagcatccctgga

SEQ ID NO: 3546637 - DNA, 13 bp, Homo sapiens
gccactaagcaga

SEQ ID NO: 3546638 - DNA, 19 bp, Homo sapiens
gccactccagacccctggc

SEQ ID NO: 3546639 - DNA, 22 bp, Homo sapiens
gccactccagacccctggcttt

SEQ ID NO: 3546640 - DNA, 15 bp, Homo sapiens
gccactgggacagct

SEQ ID NO: 3546641 - DNA, 18 bp, Homo sapiens
gccactgggacagctggc

SEQ ID NO: 3546642 - DNA, 18 bp, Homo sapiens
gccactggggactttatt

SEQ ID NO: 3546643 - DNA, 18 bp, Homo sapiens
gccagaacgtggctctgc

SEQ ID NO: 3546644 - DNA, 22 bp, Homo sapiens
gccagaacgtggctctgctggc

SEQ ID NO: 3546645 - DNA, 22 bp, Homo sapiens
gccagacccacgggctcatgca

SEQ ID NO: 3546646 - DNA, 16 bp, Homo sapiens
gccagaccccacgctg

SEQ ID NO: 3546647 - DNA, 13 bp, Homo sapiens
gccagagaagcta

SEQ ID NO: 3546648 - DNA, 22 bp, Homo sapiens
gccagagagggaaaaggcaggt

SEQ ID NO: 3546649 - DNA, 16 bp, Homo sapiens
gccagagatccaaaag

SEQ ID NO: 3546650 - DNA, 23 bp, Homo sapiens
gccagagatccaaaagaagcccc

SEQ ID NO: 3546651 - DNA, 14 bp, Homo sapiens
gccagagccagggg

SEQ ID NO: 3546652 - DNA, 20 bp, Homo sapiens
gccagatccagcctggggtc

SEQ ID NO: 3546653 - DNA, 13 bp, Homo sapiens
gccagcaaataaa

SEQ ID NO: 3546654 - DNA, 17 bp, Homo sapiens
gccagcaccacagccgg

SEQ ID NO: 3546655 - DNA, 17 bp, Homo sapiens
gccagcagctgatgctg

SEQ ID NO: 3546656 - DNA, 14 bp, Homo sapiens
gccagccacagacc

SEQ ID NO: 3546657 - DNA, 20 bp, Homo sapiens
gccagccacagacccctggg

SEQ ID NO: 3546658 - DNA, 23 bp, Homo sapiens
gccagccacagacccctgggagc

SEQ ID NO: 3546659 - DNA, 17 bp, Homo sapiens
gccagcccagccaggcc

SEQ ID NO: 3546660 - DNA, 19 bp, Homo sapiens
gccagcctgcttcccacaa

SEQ ID NO: 3546661 - DNA, 13 bp, Homo sapiens
gccagcctggctg

SEQ ID NO: 3546662 - DNA, 15 bp, Homo sapiens
gccagcgtcccttgg

SEQ ID NO: 3546663 - DNA, 16 bp, Homo sapiens
gccagcgtcccttggt

SEQ ID NO: 3546664 - DNA, 14 bp, Homo sapiens
gccagctgggagca

SEQ ID NO: 3546665 - DNA, 17 bp, Homo sapiens
gccagctgtgcactttc

SEQ ID NO: 3546666 - DNA, 20 bp, Homo sapiens
gccagcttctctctccaggg

SEQ ID NO: 3546667 - DNA, 18 bp, Homo sapiens
gccaggaatttcccagga

SEQ ID NO: 3546668 - DNA, 19 bp, Homo sapiens
gccaggaatttcccaggac

SEQ ID NO: 3546669 - DNA, 18 bp, Homo sapiens
gccaggaccctgacctcc

SEQ ID NO: 3546670 - DNA, 23 bp, Homo sapiens
gccaggaccctgacctccgcccc

SEQ ID NO: 3546671 - DNA, 17 bp, Homo sapiens
gccaggacgggccacac

SEQ ID NO: 3546672 - DNA, 14 bp, Homo sapiens
gccaggactcccag

SEQ ID NO: 3546673 - DNA, 16 bp, Homo sapiens
gccaggactcccagaa

SEQ ID NO: 3546674 - DNA, 19 bp, Homo sapiens
gccaggactcccagaacct

SEQ ID NO: 3546675 - DNA, 12 bp, Homo sapiens
gccaggatgccc

SEQ ID NO: 3546676 - DNA, 14 bp, Homo sapiens
gccaggcagggaga

SEQ ID NO: 3546677 - DNA, 23 bp, Homo sapiens
gccaggcagggagagagtagctg

SEQ ID NO: 3546678 - DNA, 13 bp, Homo sapiens
gccaggccagctg

SEQ ID NO: 3546679 - DNA, 14 bp, Homo sapiens
gccaggccctcagt

SEQ ID NO: 3546680 - DNA, 16 bp, Homo sapiens
gccaggccgcgcccag

SEQ ID NO: 3546681 - DNA, 14 bp, Homo sapiens
gccaggctcaggag

SEQ ID NO: 3546682 - DNA, 16 bp, Homo sapiens
gccaggctcctacctg

SEQ ID NO: 3546683 - DNA, 15 bp, Homo sapiens
gccaggctgcctcct

SEQ ID NO: 3546684 - DNA, 14 bp, Homo sapiens
gccagggagaagct

SEQ ID NO: 3546685 - DNA, 14 bp, Homo sapiens
gccagggctgggga

SEQ ID NO: 3546686 - DNA, 15 bp, Homo sapiens
gccagggctggggac

SEQ ID NO: 3546687 - DNA, 10 bp, Homo sapiens
gccagggctt

SEQ ID NO: 3546688 - DNA, 18 bp, Homo sapiens
gccaggggctctgtggca

SEQ ID NO: 3546689 - DNA, 20 bp, Homo sapiens
gccaggggggtgaggagctg

SEQ ID NO: 3546690 - DNA, 20 bp, Homo sapiens
gccaggtacaggagaggcag

SEQ ID NO: 3546691 - DNA, 22 bp, Homo sapiens
gccaggtactgcattctctccc

SEQ ID NO: 3546692 - DNA, 23 bp, Homo sapiens
gccaggtactgcattctctccca

SEQ ID NO: 3546693 - DNA, 17 bp, Homo sapiens
gccaggtctgactccaa

SEQ ID NO: 3546694 - DNA, 18 bp, Homo sapiens
gccaggtctgactccaaa

SEQ ID NO: 3546695 - DNA, 21 bp, Homo sapiens
gccaggtctgactccaaagct

SEQ ID NO: 3546696 - DNA, 19 bp, Homo sapiens
gccaggtgcagaccttggg

SEQ ID NO: 3546697 - DNA, 23 bp, Homo sapiens
gccaggtgcccgcgccaggccct

SEQ ID NO: 3546698 - DNA, 20 bp, Homo sapiens
gccagtcagacgccaggcac

SEQ ID NO: 3546699 - DNA, 15 bp, Homo sapiens
atcctccagcaggga

SEQ ID NO: 3546700 - DNA, 19 bp, Homo sapiens
atcctccaggtttttcaat

SEQ ID NO: 3546701 - DNA, 22 bp, Homo sapiens
atcctcctacctcagcctcctg

SEQ ID NO: 3546702 - DNA, 16 bp, Homo sapiens
atcctgaaatttcaga

SEQ ID NO: 3546703 - DNA, 19 bp, Homo sapiens
atcctgaactttctccctc

SEQ ID NO: 3546704 - DNA, 20 bp, Homo sapiens
atcctgaactttctccctca

SEQ ID NO: 3546705 - DNA, 17 bp, Homo sapiens
atcctgaatctgtgcaa

SEQ ID NO: 3546706 - DNA, 21 bp, Homo sapiens
atcctgcagatactttgaagt

SEQ ID NO: 3546707 - DNA, 19 bp, Homo sapiens
atcctgcagggcttctcct

SEQ ID NO: 3546708 - DNA, 20 bp, Homo sapiens
atcctgcagggcttctcctc

SEQ ID NO: 3546709 - DNA, 13 bp, Homo sapiens
atcctgctaagtt

SEQ ID NO: 3546710 - DNA, 18 bp, Homo sapiens
atcctgggcatccttctt

SEQ ID NO: 3546711 - DNA, 21 bp, Homo sapiens
atcctgtaccaaatctgacat

SEQ ID NO: 3546712 - DNA, 15 bp, Homo sapiens
atcctgttctgcgct

SEQ ID NO: 3546713 - DNA, 16 bp, Homo sapiens
atcctgttctgcgctg

SEQ ID NO: 3546714 - DNA, 17 bp, Homo sapiens
atccttaaccattctgt

SEQ ID NO: 3546715 - DNA, 19 bp, Homo sapiens
atccttccctgtctgccag

SEQ ID NO: 3546716 - DNA, 20 bp, Homo sapiens
atcctttcaaaagaagagtt

SEQ ID NO: 3546717 - DNA, 21 bp, Homo sapiens
atcgattgtgtacttttcctt

SEQ ID NO: 3546718 - DNA, 22 bp, Homo sapiens
atcgattgtgtacttttccttt

SEQ ID NO: 3546719 - DNA, 17 bp, Homo sapiens
atcgctttatgtttttg

SEQ ID NO: 3546720 - DNA, 17 bp, Homo sapiens
atcggaggcccatgccc

SEQ ID NO: 3546721 - DNA, 23 bp, Homo sapiens
atcggccaagaatacttgaagaa

SEQ ID NO: 3546722 - DNA, 15 bp, Homo sapiens
atcgggagcacccag

SEQ ID NO: 3546723 - DNA, 16 bp, Homo sapiens
atcggttgttctttcc

SEQ ID NO: 3546724 - DNA, 12 bp, Homo sapiens
atcgtccaggga

SEQ ID NO: 3546725 - DNA, 23 bp, Homo sapiens
atcgtccagggagcattttcctc

SEQ ID NO: 3546726 - DNA, 23 bp, Homo sapiens
atcgtgttggtattttcagagaa

SEQ ID NO: 3546727 - DNA, 19 bp, Homo sapiens
atctaaaaatagacttaaa

SEQ ID NO: 3546728 - DNA, 20 bp, Homo sapiens
atctaaaatattattttatt

SEQ ID NO: 3546729 - DNA, 13 bp, Homo sapiens
atctaagcctgaa

SEQ ID NO: 3546730 - DNA, 22 bp, Homo sapiens
atctaatatcccagaaaaagta

SEQ ID NO: 3546731 - DNA, 21 bp, Homo sapiens
atctaccccagactagatgta

SEQ ID NO: 3546732 - DNA, 22 bp, Homo sapiens
atctaccccagactagatgtag

SEQ ID NO: 3546733 - DNA, 19 bp, Homo sapiens
atctaccttttctggcaaa

SEQ ID NO: 3546734 - DNA, 19 bp, Homo sapiens
atctacttttactcataag

SEQ ID NO: 3546735 - DNA, 20 bp, Homo sapiens
atctagaggagggggcaggc

SEQ ID NO: 3546736 - DNA, 13 bp, Homo sapiens
atctatccctgcg

SEQ ID NO: 3546737 - DNA, 16 bp, Homo sapiens
atctcaaaacaaaaca

SEQ ID NO: 3546738 - DNA, 13 bp, Homo sapiens
atctcaagtaaaa

SEQ ID NO: 3546739 - DNA, 20 bp, Homo sapiens
atctcaagtaaaacaaatga

SEQ ID NO: 3546740 - DNA, 17 bp, Homo sapiens
atctcacaccttagcta

SEQ ID NO: 3546741 - DNA, 20 bp, Homo sapiens
atctcagggaactgaccctc

SEQ ID NO: 3546742 - DNA, 16 bp, Homo sapiens
atctcattgcttacaa

SEQ ID NO: 3546743 - DNA, 23 bp, Homo sapiens
atctccactggacccttgattca

SEQ ID NO: 3546744 - DNA, 21 bp, Homo sapiens
atctcccacatgccaggggcc

SEQ ID NO: 3546745 - DNA, 11 bp, Homo sapiens
atctccctggc

SEQ ID NO: 3546746 - DNA, 15 bp, Homo sapiens
atctccctggctcac

SEQ ID NO: 3546747 - DNA, 17 bp, Homo sapiens
atctccgttccatctgg

SEQ ID NO: 3546748 - DNA, 21 bp, Homo sapiens
atctccgttccatctgggctt

SEQ ID NO: 3546749 - DNA, 11 bp, Homo sapiens
atctcctcccg

SEQ ID NO: 3546750 - DNA, 19 bp, Homo sapiens
atctcctttgaagaaggca

SEQ ID NO: 3546751 - DNA, 14 bp, Homo sapiens
atctctcaaatctg

SEQ ID NO: 3546752 - DNA, 17 bp, Homo sapiens
atctctccccatatata

SEQ ID NO: 3546753 - DNA, 20 bp, Homo sapiens
atctctcttgtcctcttctg

SEQ ID NO: 3546754 - DNA, 21 bp, Homo sapiens
atctctcttgtcctcttctgc

SEQ ID NO: 3546755 - DNA, 22 bp, Homo sapiens
atctctgaaggagttacaggga

SEQ ID NO: 3546756 - DNA, 15 bp, Homo sapiens
atctctgtgtgcaca

SEQ ID NO: 3546757 - DNA, 20 bp, Homo sapiens
atctctttgtacaggaactg

SEQ ID NO: 3546758 - DNA, 13 bp, Homo sapiens
atctgaaaggcca

SEQ ID NO: 3546759 - DNA, 20 bp, Homo sapiens
atctgaaaggccagcagctg

SEQ ID NO: 3546760 - DNA, 18 bp, Homo sapiens
atctgaatgaaaataact

SEQ ID NO: 3546761 - DNA, 12 bp, Homo sapiens
atctgacatatt

SEQ ID NO: 3546762 - DNA, 18 bp, Homo sapiens
atctgacatattatgcct

SEQ ID NO: 3546763 - DNA, 20 bp, Homo sapiens
atctgacatattatgcctga

SEQ ID NO: 3546764 - DNA, 15 bp, Homo sapiens
atctgaccagcagcg

SEQ ID NO: 3546765 - DNA, 12 bp, Homo sapiens
atctgacccagt

SEQ ID NO: 3546766 - DNA, 14 bp, Homo sapiens
atctgacccagtgc

SEQ ID NO: 3546767 - DNA, 18 bp, Homo sapiens
atctgacccagtgccccc

SEQ ID NO: 3546768 - DNA, 23 bp, Homo sapiens
atctgaccccaagggggctgctg

SEQ ID NO: 3546769 - DNA, 15 bp, Homo sapiens
atctgactgccaagc

SEQ ID NO: 3546770 - DNA, 16 bp, Homo sapiens
atctgactgccaagcc

SEQ ID NO: 3546771 - DNA, 19 bp, Homo sapiens
atctgactgccaagccaga

SEQ ID NO: 3546772 - DNA, 20 bp, Homo sapiens
atctgagaggccacagtgca

SEQ ID NO: 3546773 - DNA, 12 bp, Homo sapiens
atctgagctggg

SEQ ID NO: 3546774 - DNA, 16 bp, Homo sapiens
atctgccccctagttc

SEQ ID NO: 3546775 - DNA, 14 bp, Homo sapiens
atctgcctggaggc

SEQ ID NO: 3546776 - DNA, 20 bp, Homo sapiens
atctgctaagtaatttagaa

SEQ ID NO: 3546777 - DNA, 13 bp, Homo sapiens
atctgctgcagtt

SEQ ID NO: 3546778 - DNA, 20 bp, Homo sapiens
atctgcttcatccaatgtga

SEQ ID NO: 3546779 - DNA, 21 bp, Homo sapiens
atctgcttcatccaatgtgaa

SEQ ID NO: 3546780 - DNA, 16 bp, Homo sapiens
atctggaacctcagcc

SEQ ID NO: 3546781 - DNA, 18 bp, Homo sapiens
atctggaacctcagcctg

SEQ ID NO: 3546782 - DNA, 19 bp, Homo sapiens
atctggaacctcagcctgg

SEQ ID NO: 3546783 - DNA, 22 bp, Homo sapiens
atctggaacctcagcctggcca

SEQ ID NO: 3546784 - DNA, 19 bp, Homo sapiens
atctggactcctctgtcca

SEQ ID NO: 3546785 - DNA, 18 bp, Homo sapiens
atctggctgcacaggctg

SEQ ID NO: 3546786 - DNA, 11 bp, Homo sapiens
atctggcttcc

SEQ ID NO: 3546787 - DNA, 13 bp, Homo sapiens
atctggcttccct

SEQ ID NO: 3546788 - DNA, 16 bp, Homo sapiens
atctggcttccctgga

SEQ ID NO: 3546789 - DNA, 17 bp, Homo sapiens
atctggtcctacccatc

SEQ ID NO: 3546790 - DNA, 21 bp, Homo sapiens
atctggttttgggtgtttttc

SEQ ID NO: 3546791 - DNA, 11 bp, Homo sapiens
atctgtaacag

SEQ ID NO: 3546792 - DNA, 23 bp, Homo sapiens
atctgtaacaggtattttgtttc

SEQ ID NO: 3546793 - DNA, 16 bp, Homo sapiens
atctgtacctctgcct

SEQ ID NO: 3546794 - DNA, 16 bp, Homo sapiens
atctgtgacctctgac

SEQ ID NO: 3546795 - DNA, 19 bp, Homo sapiens
atctgtgatgacattccct

SEQ ID NO: 3546796 - DNA, 13 bp, Homo sapiens
atctgtgattggc

SEQ ID NO: 3546797 - DNA, 14 bp, Homo sapiens
atctgtgattggct

SEQ ID NO: 3546798 - DNA, 15 bp, Homo sapiens
atctgtggagctgcc

SEQ ID NO: 3546799 - DNA, 14 bp, Homo sapiens
atctgttctaacat

SEQ ID NO: 3546800 - DNA, 14 bp, Homo sapiens
atctgttggagaaa

SEQ ID NO: 3546801 - DNA, 17 bp, Homo sapiens
atctgttggagaaagaa

SEQ ID NO: 3546802 - DNA, 21 bp, Homo sapiens
atctgtttaaagcatatagag

SEQ ID NO: 3546803 - DNA, 22 bp, Homo sapiens
atctgtttgaagattatatgaa

SEQ ID NO: 3546804 - DNA, 16 bp, Homo sapiens
atctgttttggatgtt

SEQ ID NO: 3546805 - DNA, 22 bp, Homo sapiens
atctgttttggatgttgctata

SEQ ID NO: 3546806 - DNA, 20 bp, Homo sapiens
atcttaaacataataaatca

SEQ ID NO: 3546807 - DNA, 16 bp, Homo sapiens
atcttaatatatttga

SEQ ID NO: 3546808 - DNA, 13 bp, Homo sapiens
atcttaatgtctg

SEQ ID NO: 3546809 - DNA, 23 bp, Homo sapiens
atcttaatgtctggtgtttgtca

SEQ ID NO: 3546810 - DNA, 19 bp, Homo sapiens
atcttagtgtatgattact

SEQ ID NO: 3546811 - DNA, 17 bp, Homo sapiens
atcttcactagaagccg

SEQ ID NO: 3546812 - DNA, 17 bp, Homo sapiens
atcttcatgtccagtga

SEQ ID NO: 3546813 - DNA, 15 bp, Homo sapiens
atcttcctggcacaa

SEQ ID NO: 3546814 - DNA, 19 bp, Homo sapiens
atcttcctggcacaatgtt

SEQ ID NO: 3546815 - DNA, 18 bp, Homo sapiens
atcttctttcttccaccc

SEQ ID NO: 3546816 - DNA, 21 bp, Homo sapiens
atcttctttcttccacccaca

SEQ ID NO: 3546817 - DNA, 15 bp, Homo sapiens
atcttgagaaccttt

SEQ ID NO: 3546818 - DNA, 17 bp, Homo sapiens
atcttgcagcatttact

SEQ ID NO: 3546819 - DNA, 19 bp, Homo sapiens
atcttgcagcatttactat

SEQ ID NO: 3546820 - DNA, 20 bp, Homo sapiens
atcttgcagcatttactatg

SEQ ID NO: 3546821 - DNA, 17 bp, Homo sapiens
atcttgctctcttttat

SEQ ID NO: 3546822 - DNA, 20 bp, Homo sapiens
atcttggtcagatttgaact

SEQ ID NO: 3546823 - DNA, 15 bp, Homo sapiens
atcttgtgctatgaa

SEQ ID NO: 3546824 - DNA, 14 bp, Homo sapiens
atctttaatttata

SEQ ID NO: 3546825 - DNA, 20 bp, Homo sapiens
atctttagcagtttcctcag

SEQ ID NO: 3546826 - DNA, 22 bp, Homo sapiens
atctttattttagtcttgatgt

SEQ ID NO: 3546827 - DNA, 17 bp, Homo sapiens
atctttcatgtcttgtc

SEQ ID NO: 3546828 - DNA, 22 bp, Homo sapiens
atctttctccttgaatatcttt

SEQ ID NO: 3546829 - DNA, 23 bp, Homo sapiens
atctttctttccaaaacatttct

SEQ ID NO: 3546830 - DNA, 14 bp, Homo sapiens
atctttgtggccaa

SEQ ID NO: 3546831 - DNA, 15 bp, Homo sapiens
atctttgtggccaag

SEQ ID NO: 3546832 - DNA, 19 bp, Homo sapiens
atctttgtggccaaggagc

SEQ ID NO: 3546833 - DNA, 14 bp, Homo sapiens
atcttttaaattgc

SEQ ID NO: 3546834 - DNA, 13 bp, Homo sapiens
atcttttgaagag

SEQ ID NO: 3546835 - DNA, 13 bp, Homo sapiens
ataaattattact

SEQ ID NO: 3546836 - DNA, 15 bp, Homo sapiens
ataaattattacttt

SEQ ID NO: 3546837 - DNA, 21 bp, Homo sapiens
ataaattcctctttgctttgc

SEQ ID NO: 3546838 - DNA, 14 bp, Homo sapiens
ataaattctaaatt

SEQ ID NO: 3546839 - DNA, 21 bp, Homo sapiens
ataaattctaaattacaaagg

SEQ ID NO: 3546840 - DNA, 20 bp, Homo sapiens
ataaattctactaagttatt

SEQ ID NO: 3546841 - DNA, 21 bp, Homo sapiens
ataaattggcctctgtatgca

SEQ ID NO: 3546842 - DNA, 12 bp, Homo sapiens
ataaatttctgg

SEQ ID NO: 3546843 - DNA, 17 bp, Homo sapiens
ataaattttttgaaaca

SEQ ID NO: 3546844 - DNA, 16 bp, Homo sapiens
ataaattttttttggt

SEQ ID NO: 3546845 - DNA, 17 bp, Homo sapiens
ataaattttttttggtc

SEQ ID NO: 3546846 - DNA, 14 bp, Homo sapiens
ataacaacttcata

SEQ ID NO: 3546847 - DNA, 23 bp, Homo sapiens
ataacagaaagcctgggtgacat

SEQ ID NO: 3546848 - DNA, 22 bp, Homo sapiens
ataacagttttgagtaattcaa

SEQ ID NO: 3546849 - DNA, 19 bp, Homo sapiens
ataacatgtgaaaagaata

SEQ ID NO: 3546850 - DNA, 21 bp, Homo sapiens
ataaccaatagttgccaatct

SEQ ID NO: 3546851 - DNA, 22 bp, Homo sapiens
ataaccctgtcacccacagacc

SEQ ID NO: 3546852 - DNA, 21 bp, Homo sapiens
ataacggaaaaataattgcca

SEQ ID NO: 3546853 - DNA, 15 bp, Homo sapiens
ataactaacatgtcc

SEQ ID NO: 3546854 - DNA, 18 bp, Homo sapiens
ataactattacagtgttg

SEQ ID NO: 3546855 - DNA, 17 bp, Homo sapiens
ataactgagttatattg

SEQ ID NO: 3546856 - DNA, 17 bp, Homo sapiens
ataagacttagattgtg

SEQ ID NO: 3546857 - DNA, 12 bp, Homo sapiens
ataagagaaacc

SEQ ID NO: 3546858 - DNA, 14 bp, Homo sapiens
ataagagaaacctg

SEQ ID NO: 3546859 - DNA, 15 bp, Homo sapiens
ataagatattttatt

SEQ ID NO: 3546860 - DNA, 23 bp, Homo sapiens
ataagcaggttgttatttaggtt

SEQ ID NO: 3546861 - DNA, 13 bp, Homo sapiens
ataaggtggcttc

SEQ ID NO: 3546862 - DNA, 14 bp, Homo sapiens
ataagtcaaaagga

SEQ ID NO: 3546863 - DNA, 15 bp, Homo sapiens
ataagtcaaaaggaa

SEQ ID NO: 3546864 - DNA, 17 bp, Homo sapiens
ataagtcaaaaggaaca

SEQ ID NO: 3546865 - DNA, 14 bp, Homo sapiens
ataagtgtacatat

SEQ ID NO: 3546866 - DNA, 19 bp, Homo sapiens
ataagtgtacatatgtgct

SEQ ID NO: 3546867 - DNA, 20 bp, Homo sapiens
ataagtgtacatatgtgctg

SEQ ID NO: 3546868 - DNA, 19 bp, Homo sapiens
ataagtgtacgattcttaa

SEQ ID NO: 3546869 - DNA, 21 bp, Homo sapiens
ataataaacataatgaaaata

SEQ ID NO: 3546870 - DNA, 14 bp, Homo sapiens
ataataaagaatag

SEQ ID NO: 3546871 - DNA, 13 bp, Homo sapiens
ataataaatcaca

SEQ ID NO: 3546872 - DNA, 14 bp, Homo sapiens
ataataaatcacac

SEQ ID NO: 3546873 - DNA, 17 bp, Homo sapiens
ataataggtcatatgtt

SEQ ID NO: 3546874 - DNA, 20 bp, Homo sapiens
ataatagtagatttgaacag

SEQ ID NO: 3546875 - DNA, 20 bp, Homo sapiens
ataatccacccccaggtgca

SEQ ID NO: 3546876 - DNA, 16 bp, Homo sapiens
ataatctcatccccaa

SEQ ID NO: 3546877 - DNA, 14 bp, Homo sapiens
ataatctgagcagg

SEQ ID NO: 3546878 - DNA, 18 bp, Homo sapiens
ataatctggactcctctg

SEQ ID NO: 3546879 - DNA, 17 bp, Homo sapiens
ataatgaaaatattttt

SEQ ID NO: 3546880 - DNA, 21 bp, Homo sapiens
ataatggtactcccaaactga

SEQ ID NO: 3546881 - DNA, 23 bp, Homo sapiens
ataatggtactcccaaactgaca

SEQ ID NO: 3546882 - DNA, 15 bp, Homo sapiens
ataatgtatttgaaa

SEQ ID NO: 3546883 - DNA, 12 bp, Homo sapiens
ataatgttaaca

SEQ ID NO: 3546884 - DNA, 19 bp, Homo sapiens
ataatgtttgatagtaaat

SEQ ID NO: 3546885 - DNA, 14 bp, Homo sapiens
ataatgttttggga

SEQ ID NO: 3546886 - DNA, 14 bp, Homo sapiens
ataattctgaaaca

SEQ ID NO: 3546887 - DNA, 15 bp, Homo sapiens
ataattctggagata

SEQ ID NO: 3546888 - DNA, 22 bp, Homo sapiens
ataattgacaggattattggaa

SEQ ID NO: 3546889 - DNA, 16 bp, Homo sapiens
ataattggatttccta

SEQ ID NO: 3546890 - DNA, 11 bp, Homo sapiens
ataattggctt

SEQ ID NO: 3546891 - DNA, 13 bp, Homo sapiens
ataatttatttca

SEQ ID NO: 3546892 - DNA, 15 bp, Homo sapiens
ataattttaaacaaa

SEQ ID NO: 3546893 - DNA, 22 bp, Homo sapiens
ataattttcctttaatatgaaa

SEQ ID NO: 3546894 - DNA, 13 bp, Homo sapiens
ataattttgtaat

SEQ ID NO: 3546895 - DNA, 23 bp, Homo sapiens
ataattttgtaatgtatcaaata

SEQ ID NO: 3546896 - DNA, 18 bp, Homo sapiens
atacaaactctcaccatg

SEQ ID NO: 3546897 - DNA, 18 bp, Homo sapiens
atacaacagaaaccagaa

SEQ ID NO: 3546898 - DNA, 15 bp, Homo sapiens
atacaatacatagga

SEQ ID NO: 3546899 - DNA, 20 bp, Homo sapiens
atacacactcaaatcaagaa

SEQ ID NO: 3546900 - DNA, 18 bp, Homo sapiens
atacaccagcattccttt

SEQ ID NO: 3546901 - DNA, 14 bp, Homo sapiens
atacaccgggcctg

SEQ ID NO: 3546902 - DNA, 16 bp, Homo sapiens
atacaccgtttagaaa

SEQ ID NO: 3546903 - DNA, 19 bp, Homo sapiens
atacactaaccaaatctct

SEQ ID NO: 3546904 - DNA, 16 bp, Homo sapiens
atacactgtaagcttt

SEQ ID NO: 3546905 - DNA, 17 bp, Homo sapiens
atacactgtaagctttg

SEQ ID NO: 3546906 - DNA, 22 bp, Homo sapiens
atacactgtaagctttgttctg

SEQ ID NO: 3546907 - DNA, 12 bp, Homo sapiens
atacagaggaaa

SEQ ID NO: 3546908 - DNA, 21 bp, Homo sapiens
atacagaggaaatctgtaaca

SEQ ID NO: 3546909 - DNA, 12 bp, Homo sapiens
atacagaggaga

SEQ ID NO: 3546910 - DNA, 13 bp, Homo sapiens
atacagaggagat

SEQ ID NO: 3546911 - DNA, 13 bp, Homo sapiens
atacaggtaacta

SEQ ID NO: 3546912 - DNA, 14 bp, Homo sapiens
atacaggtgacagt

SEQ ID NO: 3546913 - DNA, 18 bp, Homo sapiens
atacaggtgacagtgaag

SEQ ID NO: 3546914 - DNA, 23 bp, Homo sapiens
atacatacaccagcattcctttt

SEQ ID NO: 3546915 - DNA, 19 bp, Homo sapiens
atacatcagcttggtagtt

SEQ ID NO: 3546916 - DNA, 15 bp, Homo sapiens
atacatgcatataat

SEQ ID NO: 3546917 - DNA, 16 bp, Homo sapiens
atacatttaaaacatt

SEQ ID NO: 3546918 - DNA, 12 bp, Homo sapiens
atacatttgtat

SEQ ID NO: 3546919 - DNA, 15 bp, Homo sapiens
atacatttgtattta

SEQ ID NO: 3546920 - DNA, 12 bp, Homo sapiens
ataccagcctac

SEQ ID NO: 3546921 - DNA, 14 bp, Homo sapiens
ataccaggcagtgt

SEQ ID NO: 3546922 - DNA, 23 bp, Homo sapiens
ataccattatatgttccccctgt

SEQ ID NO: 3546923 - DNA, 13 bp, Homo sapiens
atacccacccaga

SEQ ID NO: 3546924 - DNA, 14 bp, Homo sapiens
atacccacccagaa

SEQ ID NO: 3546925 - DNA, 22 bp, Homo sapiens
ataccctccctccctaccctaa

SEQ ID NO: 3546926 - DNA, 22 bp, Homo sapiens
atacccttggaaatactgtatg

SEQ ID NO: 3546927 - DNA, 16 bp, Homo sapiens
atacctcaaactatct

SEQ ID NO: 3546928 - DNA, 14 bp, Homo sapiens
atacctgcccctgc

SEQ ID NO: 3546929 - DNA, 19 bp, Homo sapiens
atacctgcccctgcctgac

SEQ ID NO: 3546930 - DNA, 13 bp, Homo sapiens
atacctttgtagt

SEQ ID NO: 3546931 - DNA, 20 bp, Homo sapiens
atactaccagggtctctcag

SEQ ID NO: 3546932 - DNA, 22 bp, Homo sapiens
atactaccagggtctctcaggg

SEQ ID NO: 3546933 - DNA, 16 bp, Homo sapiens
atactatgaaatatgt

SEQ ID NO: 3546934 - DNA, 21 bp, Homo sapiens
atactgcaaactatttaaaga

SEQ ID NO: 3546935 - DNA, 20 bp, Homo sapiens
atactgccttgtttaatgtt

SEQ ID NO: 3546936 - DNA, 23 bp, Homo sapiens
atactgccttgtttaatgttaat

SEQ ID NO: 3546937 - DNA, 17 bp, Homo sapiens
atactgggtctgcgatg

SEQ ID NO: 3546938 - DNA, 23 bp, Homo sapiens
atacttattttcagtgcatcatt

SEQ ID NO: 3546939 - DNA, 17 bp, Homo sapiens
atacttgaagggccaga

SEQ ID NO: 3546940 - DNA, 21 bp, Homo sapiens
atacttgaagggccagagcca

SEQ ID NO: 3546941 - DNA, 23 bp, Homo sapiens
atacttgaagggccagagccagg

SEQ ID NO: 3546942 - DNA, 13 bp, Homo sapiens
atacttttcaaag

SEQ ID NO: 3546943 - DNA, 14 bp, Homo sapiens
atacttttcaaagc

SEQ ID NO: 3546944 - DNA, 17 bp, Homo sapiens
atagaataaaggcagtt

SEQ ID NO: 3546945 - DNA, 14 bp, Homo sapiens
atagacaattgagg

SEQ ID NO: 3546946 - DNA, 21 bp, Homo sapiens
atagacaattgaggtaagttt

SEQ ID NO: 3546947 - DNA, 14 bp, Homo sapiens
atagacacacatac

SEQ ID NO: 3546948 - DNA, 12 bp, Homo sapiens
atagacaccata

SEQ ID NO: 3546949 - DNA, 14 bp, Homo sapiens
atagaccaattgaa

SEQ ID NO: 3546950 - DNA, 15 bp, Homo sapiens
atagaccaattgaag

SEQ ID NO: 3546951 - DNA, 16 bp, Homo sapiens
atagaccaattgaagc

SEQ ID NO: 3546952 - DNA, 17 bp, Homo sapiens
atagaccaattgaagca

SEQ ID NO: 3546953 - DNA, 20 bp, Homo sapiens
atagaccaattgaagcatga

SEQ ID NO: 3546954 - DNA, 14 bp, Homo sapiens
atagacctgacaat

SEQ ID NO: 3546955 - DNA, 15 bp, Homo sapiens
atagacctgacaatt

SEQ ID NO: 3546956 - DNA, 22 bp, Homo sapiens
atagacctgacaatttgtgata

SEQ ID NO: 3546957 - DNA, 22 bp, Homo sapiens
atagagctagctaatctctaca

SEQ ID NO: 3546958 - DNA, 18 bp, Homo sapiens
atagagcttttaaaaatg

SEQ ID NO: 3546959 - DNA, 13 bp, Homo sapiens
atagagtgcagtg

SEQ ID NO: 3546960 - DNA, 14 bp, Homo sapiens
atagatataaatat

SEQ ID NO: 3546961 - DNA, 13 bp, Homo sapiens
atattctatttta

SEQ ID NO: 3546962 - DNA, 15 bp, Homo sapiens
atattgatatgctta

SEQ ID NO: 3546963 - DNA, 23 bp, Homo sapiens
atattgcctaagaataaacattt

SEQ ID NO: 3546964 - DNA, 19 bp, Homo sapiens
atattggaattataaatat

SEQ ID NO: 3546965 - DNA, 18 bp, Homo sapiens
atattgtttttgtattta

SEQ ID NO: 3546966 - DNA, 12 bp, Homo sapiens
atatttaagcct

SEQ ID NO: 3546967 - DNA, 20 bp, Homo sapiens
atatttaagccttataaacc

SEQ ID NO: 3546968 - DNA, 19 bp, Homo sapiens
atatttaaggatagtgtga

SEQ ID NO: 3546969 - DNA, 22 bp, Homo sapiens
atatttaaggatagtgtgaaga

SEQ ID NO: 3546970 - DNA, 23 bp, Homo sapiens
atatttaaggatagtgtgaagat

SEQ ID NO: 3546971 - DNA, 14 bp, Homo sapiens
atatttactctata

SEQ ID NO: 3546972 - DNA, 22 bp, Homo sapiens
atatttagatgtaattttgtgt

SEQ ID NO: 3546973 - DNA, 20 bp, Homo sapiens
atatttcaggttcttcagaa

SEQ ID NO: 3546974 - DNA, 10 bp, Homo sapiens
atatttcatt

SEQ ID NO: 3546975 - DNA, 15 bp, Homo sapiens
atatttgaaaaaaac

SEQ ID NO: 3546976 - DNA, 20 bp, Homo sapiens
atatttgcaaagtgtattag

SEQ ID NO: 3546977 - DNA, 16 bp, Homo sapiens
atatttgccaataaag

SEQ ID NO: 3546978 - DNA, 23 bp, Homo sapiens
atatttggggtccttttttatac

SEQ ID NO: 3546979 - DNA, 12 bp, Homo sapiens
atatttgtacat

SEQ ID NO: 3546980 - DNA, 18 bp, Homo sapiens
agggtctttttctagggt

SEQ ID NO: 3546981 - DNA, 18 bp, Homo sapiens
agggttaatcatatttga

SEQ ID NO: 3546982 - DNA, 21 bp, Homo sapiens
agggttctggtgtttggtttc

SEQ ID NO: 3546983 - DNA, 21 bp, Homo sapiens
agggtttacatgaagcagaac

SEQ ID NO: 3546984 - DNA, 14 bp, Homo sapiens
agggtttcgactgg

SEQ ID NO: 3546985 - DNA, 14 bp, Homo sapiens
aggtaaacaaagac

SEQ ID NO: 3546986 - DNA, 21 bp, Homo sapiens
aggtacatttctgattctgat

SEQ ID NO: 3546987 - DNA, 17 bp, Homo sapiens
aggtacttggagggctc

SEQ ID NO: 3546988 - DNA, 17 bp, Homo sapiens
aggtagaatgttttcaa

SEQ ID NO: 3546989 - DNA, 17 bp, Homo sapiens
aggtagcactctcagag

SEQ ID NO: 3546990 - DNA, 19 bp, Homo sapiens
aggtagccttgtgttctga

SEQ ID NO: 3546991 - DNA, 18 bp, Homo sapiens
aggtatgatctcttctgg

SEQ ID NO: 3546992 - DNA, 20 bp, Homo sapiens
aggtattcaatatcctttgc

SEQ ID NO: 3546993 - DNA, 17 bp, Homo sapiens
aggtattttgtttcttt

SEQ ID NO: 3546994 - DNA, 20 bp, Homo sapiens
aggtattttgtttcttttaa

SEQ ID NO: 3546995 - DNA, 19 bp, Homo sapiens
aggtatttttctttaacca

SEQ ID NO: 3546996 - DNA, 23 bp, Homo sapiens
aggtcacacgaggggccccgtgt

SEQ ID NO: 3546997 - DNA, 14 bp, Homo sapiens
aggtcaccagggga

SEQ ID NO: 3546998 - DNA, 18 bp, Homo sapiens
aggtcaccaggggaggag

SEQ ID NO: 3546999 - DNA, 22 bp, Homo sapiens
aggtcaccaggggaggagcctg

SEQ ID NO: 3547000 - DNA, 19 bp, Homo sapiens
aggtcactcgtggtgaggc

SEQ ID NO: 3547001 - DNA, 16 bp, Homo sapiens
aggtcactctgggcct

SEQ ID NO: 3547002 - DNA, 18 bp, Homo sapiens
aggtcactctgggcctgg

SEQ ID NO: 3547003 - DNA, 19 bp, Homo sapiens
aggtcactctgggcctggg

SEQ ID NO: 3547004 - DNA, 12 bp, Homo sapiens
aggtcactgcta

SEQ ID NO: 3547005 - DNA, 14 bp, Homo sapiens
aggtcatatgttgt

SEQ ID NO: 3547006 - DNA, 20 bp, Homo sapiens
aggtccaaattcaccttccc

SEQ ID NO: 3547007 - DNA, 22 bp, Homo sapiens
aggtccaaattcaccttcccct

SEQ ID NO: 3547008 - DNA, 16 bp, Homo sapiens
aggtccaagcagagtg

SEQ ID NO: 3547009 - DNA, 19 bp, Homo sapiens
aggtcccggccagctctgg

SEQ ID NO: 3547010 - DNA, 20 bp, Homo sapiens
aggtcccggccagctctgga

SEQ ID NO: 3547011 - DNA, 20 bp, Homo sapiens
aggtcctgcagtctggctga

SEQ ID NO: 3547012 - DNA, 23 bp, Homo sapiens
aggtcctggtgcctatctgcctg

SEQ ID NO: 3547013 - DNA, 17 bp, Homo sapiens
aggtccttgccctttgt

SEQ ID NO: 3547014 - DNA, 16 bp, Homo sapiens
aggtctaatcagtgat

SEQ ID NO: 3547015 - DNA, 13 bp, Homo sapiens
aggtctagagaga

SEQ ID NO: 3547016 - DNA, 14 bp, Homo sapiens
aggtctagagagaa

SEQ ID NO: 3547017 - DNA, 18 bp, Homo sapiens
aggtctctgggagcccag

SEQ ID NO: 3547018 - DNA, 15 bp, Homo sapiens
aggtctgactccaaa

SEQ ID NO: 3547019 - DNA, 16 bp, Homo sapiens
aggtctgactccaaag

SEQ ID NO: 3547020 - DNA, 20 bp, Homo sapiens
aggtctgattggctgcttaa

SEQ ID NO: 3547021 - DNA, 12 bp, Homo sapiens
aggtctggctga

SEQ ID NO: 3547022 - DNA, 19 bp, Homo sapiens
aggtctgtatgtcatggat

SEQ ID NO: 3547023 - DNA, 12 bp, Homo sapiens
aggtctgtttaa

SEQ ID NO: 3547024 - DNA, 21 bp, Homo sapiens
aggtcttggccgactcaggga

SEQ ID NO: 3547025 - DNA, 13 bp, Homo sapiens
aggtctttctctc

SEQ ID NO: 3547026 - DNA, 16 bp, Homo sapiens
aggtgaaaatgaagaa

SEQ ID NO: 3547027 - DNA, 15 bp, Homo sapiens
aggtgaaatccctgc

SEQ ID NO: 3547028 - DNA, 13 bp, Homo sapiens
aggtgaactccag

SEQ ID NO: 3547029 - DNA, 16 bp, Homo sapiens
aggtgaactccaggca

SEQ ID NO: 3547030 - DNA, 19 bp, Homo sapiens
aggtgaggtgaactccagg

SEQ ID NO: 3547031 - DNA, 15 bp, Homo sapiens
aggtgcactccagac

SEQ ID NO: 3547032 - DNA, 19 bp, Homo sapiens
aggtgcactccagactctg

SEQ ID NO: 3547033 - DNA, 16 bp, Homo sapiens
aggtgcagaccttggg

SEQ ID NO: 3547034 - DNA, 17 bp, Homo sapiens
aggtgcagccccagggc

SEQ ID NO: 3547035 - DNA, 19 bp, Homo sapiens
aggtgccaccaccctgccc

SEQ ID NO: 3547036 - DNA, 14 bp, Homo sapiens
aggtgcccagggcc

SEQ ID NO: 3547037 - DNA, 19 bp, Homo sapiens
aggtgcccgcgccaggccc

SEQ ID NO: 3547038 - DNA, 20 bp, Homo sapiens
aggtgcccgcgccaggccct

SEQ ID NO: 3547039 - DNA, 17 bp, Homo sapiens
aggtgcctaacctggga

SEQ ID NO: 3547040 - DNA, 21 bp, Homo sapiens
aggtgcctaacctgggacctg

SEQ ID NO: 3547041 - DNA, 16 bp, Homo sapiens
aggtgctaacatagat

SEQ ID NO: 3547042 - DNA, 16 bp, Homo sapiens
aggtgctacaaaaaca

SEQ ID NO: 3547043 - DNA, 18 bp, Homo sapiens
aggtgctacaaaaacaca

SEQ ID NO: 3547044 - DNA, 19 bp, Homo sapiens
aggtgctacaaaaacacag

SEQ ID NO: 3547045 - DNA, 17 bp, Homo sapiens
aggtgctcatgctgctc

SEQ ID NO: 3547046 - DNA, 18 bp, Homo sapiens
aggtgcttttggcagaga

SEQ ID NO: 3547047 - DNA, 20 bp, Homo sapiens
aggtgcttttggcagagacc

SEQ ID NO: 3547048 - DNA, 14 bp, Homo sapiens
aggtggccactcca

SEQ ID NO: 3547049 - DNA, 17 bp, Homo sapiens
aggtggccactccagac

SEQ ID NO: 3547050 - DNA, 15 bp, Homo sapiens
aggtggccgccatgc

SEQ ID NO: 3547051 - DNA, 17 bp, Homo sapiens
aggtggctgagcccctg

SEQ ID NO: 3547052 - DNA, 11 bp, Homo sapiens
aggtggcttct

SEQ ID NO: 3547053 - DNA, 19 bp, Homo sapiens
aggtggcttctcacggcct

SEQ ID NO: 3547054 - DNA, 19 bp, Homo sapiens
aggtgggagatttggaata

SEQ ID NO: 3547055 - DNA, 16 bp, Homo sapiens
aggtgggccacaccca

SEQ ID NO: 3547056 - DNA, 13 bp, Homo sapiens
aggtgggcctggg

SEQ ID NO: 3547057 - DNA, 17 bp, Homo sapiens
aggtggggatcctgcct

SEQ ID NO: 3547058 - DNA, 16 bp, Homo sapiens
aggtggttcgtgctgt

SEQ ID NO: 3547059 - DNA, 20 bp, Homo sapiens
aggtggttcgtgctgtgctc

SEQ ID NO: 3547060 - DNA, 20 bp, Homo sapiens
aggtgtataaatgtacattt

SEQ ID NO: 3547061 - DNA, 22 bp, Homo sapiens
aggtgtatgccacacctggcct

SEQ ID NO: 3547062 - DNA, 21 bp, Homo sapiens
aggtgtattggtgttgcagcc

SEQ ID NO: 3547063 - DNA, 17 bp, Homo sapiens
aggtgtgaggagagagg

SEQ ID NO: 3547064 - DNA, 17 bp, Homo sapiens
aggtgtgcttcctgctg

SEQ ID NO: 3547065 - DNA, 15 bp, Homo sapiens
aggtgtgggatctgg

SEQ ID NO: 3547066 - DNA, 13 bp, Homo sapiens
aggtgttctgctg

SEQ ID NO: 3547067 - DNA, 15 bp, Homo sapiens
aggtgttctgctgat

SEQ ID NO: 3547068 - DNA, 15 bp, Homo sapiens
aggtgttgtcccttc

SEQ ID NO: 3547069 - DNA, 16 bp, Homo sapiens
aggttaatatttaaga

SEQ ID NO: 3547070 - DNA, 18 bp, Homo sapiens
aggttcatggattttcca

SEQ ID NO: 3547071 - DNA, 16 bp, Homo sapiens
aggttgtctgaagtca

SEQ ID NO: 3547072 - DNA, 18 bp, Homo sapiens
aggttgtggggcctcagg

SEQ ID NO: 3547073 - DNA, 14 bp, Homo sapiens
aggtttgaaggaga

SEQ ID NO: 3547074 - DNA, 17 bp, Homo sapiens
aggttttcagagaatta

SEQ ID NO: 3547075 - DNA, 13 bp, Homo sapiens
aggtttttcaatt

SEQ ID NO: 3547076 - DNA, 15 bp, Homo sapiens
aggtttttcaattaa

SEQ ID NO: 3547077 - DNA, 17 bp, Homo sapiens
aggtttttcaattaaac

SEQ ID NO: 3547078 - DNA, 18 bp, Homo sapiens
aggtttttcaattaaacg

SEQ ID NO: 3547079 - DNA, 20 bp, Homo sapiens
aggtttttcaattaaacgga

SEQ ID NO: 3547080 - DNA, 22 bp, Homo sapiens
aggtttttcaattaaacggatt

SEQ ID NO: 3547081 - DNA, 23 bp, Homo sapiens
aggtttttcaattaaacggatta

SEQ ID NO: 3547082 - DNA, 19 bp, Homo sapiens
agtaaaaatacaaaaatta

SEQ ID NO: 3547083 - DNA, 18 bp, Homo sapiens
agtaaaacaaatgaaatt

SEQ ID NO: 3547084 - DNA, 16 bp, Homo sapiens
agtaaaaccacagcag

SEQ ID NO: 3547085 - DNA, 19 bp, Homo sapiens
agtaaaaccacagcagttg

SEQ ID NO: 3547086 - DNA, 16 bp, Homo sapiens
agtaaaatttcaggat

SEQ ID NO: 3547087 - DNA, 18 bp, Homo sapiens
agtaaaatttcaggatta

SEQ ID NO: 3547088 - DNA, 16 bp, Homo sapiens
agtaaacagggtacct

SEQ ID NO: 3547089 - DNA, 13 bp, Homo sapiens
agtaacagacaca

SEQ ID NO: 3547090 - DNA, 17 bp, Homo sapiens
agtaactcattgctctg

SEQ ID NO: 3547091 - DNA, 21 bp, Homo sapiens
agtaaggctggtaagagaagt

SEQ ID NO: 3547092 - DNA, 22 bp, Homo sapiens
agtgaaggtggggagaagctga

SEQ ID NO: 3547093 - DNA, 15 bp, Homo sapiens
agtgaagtccttcag

SEQ ID NO: 3547094 - DNA, 13 bp, Homo sapiens
agtgaataaatgt

SEQ ID NO: 3547095 - DNA, 15 bp, Homo sapiens
agtgaatacattaac

SEQ ID NO: 3547096 - DNA, 20 bp, Homo sapiens
agtgaatacattaacggtgc

SEQ ID NO: 3547097 - DNA, 23 bp, Homo sapiens
agtgaatacattaacggtgctaa

SEQ ID NO: 3547098 - DNA, 17 bp, Homo sapiens
agtgaatatttttgtat

SEQ ID NO: 3547099 - DNA, 19 bp, Homo sapiens
agtgaattagttttaaaat

SEQ ID NO: 3547100 - DNA, 13 bp, Homo sapiens
agtgacatgcagt

SEQ ID NO: 3547101 - DNA, 15 bp, Homo sapiens
agttataaaccaatg

SEQ ID NO: 3547102 - DNA, 19 bp, Homo sapiens
agttataaaccaatgaaat

SEQ ID NO: 3547103 - DNA, 14 bp, Homo sapiens
agttatatatatgt

SEQ ID NO: 3547104 - DNA, 13 bp, Homo sapiens
agttatatgtaca

SEQ ID NO: 3547105 - DNA, 17 bp, Homo sapiens
agttatatgtacagttt

SEQ ID NO: 3547106 - DNA, 17 bp, Homo sapiens
agttattaattaaagaa

SEQ ID NO: 3547107 - DNA, 22 bp, Homo sapiens
agttcaagctaaatattgttta

SEQ ID NO: 3547108 - DNA, 20 bp, Homo sapiens
agttcagaatggcagtcctg

SEQ ID NO: 3547109 - DNA, 13 bp, Homo sapiens
agttcagggaccg

SEQ ID NO: 3547110 - DNA, 18 bp, Homo sapiens
agttcataaatttatggt

SEQ ID NO: 3547111 - DNA, 19 bp, Homo sapiens
agttcatcttgcagcattt

SEQ ID NO: 3547112 - DNA, 19 bp, Homo sapiens
agttcattctaccaagctg

SEQ ID NO: 3547113 - DNA, 11 bp, Homo sapiens
agttccaacat

SEQ ID NO: 3547114 - DNA, 18 bp, Homo sapiens
agttccaacatgcaatac

SEQ ID NO: 3547115 - DNA, 20 bp, Homo sapiens
agttccaagtccaataagac

SEQ ID NO: 3547116 - DNA, 16 bp, Homo sapiens
agttcccattctttca

SEQ ID NO: 3547117 - DNA, 17 bp, Homo sapiens
agttccctacttcctgt

SEQ ID NO: 3547118 - DNA, 14 bp, Homo sapiens
agttccggggagaa

SEQ ID NO: 3547119 - DNA, 22 bp, Homo sapiens
agttccggggagaaacccagag

SEQ ID NO: 3547120 - DNA, 14 bp, Homo sapiens
agttcctctgcagt

SEQ ID NO: 3547121 - DNA, 16 bp, Homo sapiens
agttcctgtcccacat

SEQ ID NO: 3547122 - DNA, 23 bp, Homo sapiens
agttccttatccctctcttcccc

SEQ ID NO: 3547123 - DNA, 10 bp, Homo sapiens
agttctaggc

SEQ ID NO: 3547124 - DNA, 14 bp, Homo sapiens
agttctaggccttt

SEQ ID NO: 3547125 - DNA, 20 bp, Homo sapiens
agttctaggcctttcctctg

SEQ ID NO: 3547126 - DNA, 21 bp, Homo sapiens
agttctaggcctttcctctgc

SEQ ID NO: 3547127 - DNA, 16 bp, Homo sapiens
agttctatttaaaatg

SEQ ID NO: 3547128 - DNA, 17 bp, Homo sapiens
agttctatttaaaatgg

SEQ ID NO: 3547129 - DNA, 16 bp, Homo sapiens
agttctatttcttgaa

SEQ ID NO: 3547130 - DNA, 22 bp, Homo sapiens
agttctctgggaagtggtcagc

SEQ ID NO: 3547131 - DNA, 16 bp, Homo sapiens
agttctgtggtttcat

SEQ ID NO: 3547132 - DNA, 19 bp, Homo sapiens
agttctgtggtttcatgtt

SEQ ID NO: 3547133 - DNA, 23 bp, Homo sapiens
agttctgtggtttcatgttagtt

SEQ ID NO: 3547134 - DNA, 16 bp, Homo sapiens
agttcttgggggaggc

SEQ ID NO: 3547135 - DNA, 19 bp, Homo sapiens
agttctttcctccccctgc

SEQ ID NO: 3547136 - DNA, 22 bp, Homo sapiens
agttctttcctccccctgcaac

SEQ ID NO: 3547137 - DNA, 21 bp, Homo sapiens
agttctttgctgcccctgtct

SEQ ID NO: 3547138 - DNA, 21 bp, Homo sapiens
agttctttgggccagacatgc

SEQ ID NO: 3547139 - DNA, 14 bp, Homo sapiens
agttctttttgcca

SEQ ID NO: 3547140 - DNA, 23 bp, Homo sapiens
agttctttttgccagttttccct

SEQ ID NO: 3547141 - DNA, 14 bp, Homo sapiens
agttgaaaagactc

SEQ ID NO: 3547142 - DNA, 22 bp, Homo sapiens
agttgaaaagactccaaagaaa

SEQ ID NO: 3547143 - DNA, 18 bp, Homo sapiens
agttgaaaatgcaactct

SEQ ID NO: 3547144 - DNA, 17 bp, Homo sapiens
agttgaagactttgttt

SEQ ID NO: 3547145 - DNA, 12 bp, Homo sapiens
agttgaccttta

SEQ ID NO: 3547146 - DNA, 21 bp, Homo sapiens
agttgacttatagtacatgat

SEQ ID NO: 3547147 - DNA, 17 bp, Homo sapiens
agttgatctggaaccca

SEQ ID NO: 3547148 - DNA, 15 bp, Homo sapiens
agttgatggagcccc

SEQ ID NO: 3547149 - DNA, 17 bp, Homo sapiens
agttgatggagccccag

SEQ ID NO: 3547150 - DNA, 22 bp, Homo sapiens
agttgcatgctagcatgggtat

SEQ ID NO: 3547151 - DNA, 18 bp, Homo sapiens
agttgccaatctaaaatg

SEQ ID NO: 3547152 - DNA, 14 bp, Homo sapiens
agttgccacattta

SEQ ID NO: 3547153 - DNA, 19 bp, Homo sapiens
agttgcccccattcccagc

SEQ ID NO: 3547154 - DNA, 23 bp, Homo sapiens
agttgcccccattcccagcctga

SEQ ID NO: 3547155 - DNA, 16 bp, Homo sapiens
agttgctgtgtgtctg

SEQ ID NO: 3547156 - DNA, 20 bp, Homo sapiens
agttgctgtgtgtctgtcct

SEQ ID NO: 3547157 - DNA, 20 bp, Homo sapiens
agttgggggtcgggtggggg

SEQ ID NO: 3547158 - DNA, 16 bp, Homo sapiens
agttgtaaaatagaaa

SEQ ID NO: 3547159 - DNA, 20 bp, Homo sapiens
agttgtatcagcacgtgtgg

SEQ ID NO: 3547160 - DNA, 14 bp, Homo sapiens
agttgtcaataaat

SEQ ID NO: 3547161 - DNA, 11 bp, Homo sapiens
agttgttcttt

SEQ ID NO: 3547162 - DNA, 13 bp, Homo sapiens
agttgttctttgt

SEQ ID NO: 3547163 - DNA, 20 bp, Homo sapiens
agttgtttgggctttaacat

SEQ ID NO: 3547164 - DNA, 19 bp, Homo sapiens
agtttaaatgtattttaca

SEQ ID NO: 3547165 - DNA, 13 bp, Homo sapiens
agtttacagtatt

SEQ ID NO: 3547166 - DNA, 14 bp, Homo sapiens
agtttacagtattt

SEQ ID NO: 3547167 - DNA, 16 bp, Homo sapiens
agtttacagtatttct

SEQ ID NO: 3547168 - DNA, 21 bp, Homo sapiens
agtttatatactgctatttac

SEQ ID NO: 3547169 - DNA, 19 bp, Homo sapiens
agtttattgatattcaata

SEQ ID NO: 3547170 - DNA, 15 bp, Homo sapiens
agtttcctcagtgat

SEQ ID NO: 3547171 - DNA, 20 bp, Homo sapiens
agtttctagctctcacagac

SEQ ID NO: 3547172 - DNA, 21 bp, Homo sapiens
agtttctattctgtcagtgtt

SEQ ID NO: 3547173 - DNA, 16 bp, Homo sapiens
agtttctcagctccca

SEQ ID NO: 3547174 - DNA, 20 bp, Homo sapiens
agtttctgtcgttaaaaaca

SEQ ID NO: 3547175 - DNA, 18 bp, Homo sapiens
agtttctgtttgattctt

SEQ ID NO: 3547176 - DNA, 18 bp, Homo sapiens
agtttgctgtgctttgga

SEQ ID NO: 3547177 - DNA, 21 bp, Homo sapiens
agtttggagagtcagatcttt

SEQ ID NO: 3547178 - DNA, 12 bp, Homo sapiens
agtttgtagcca

SEQ ID NO: 3547179 - DNA, 17 bp, Homo sapiens
agtttgtagttgtttta

SEQ ID NO: 3547180 - DNA, 14 bp, Homo sapiens
agtttgtggtaact

SEQ ID NO: 3547181 - DNA, 12 bp, Homo sapiens
agtttgttttag

SEQ ID NO: 3547182 - DNA, 18 bp, Homo sapiens
agttttatttgtattact

SEQ ID NO: 3547183 - DNA, 13 bp, Homo sapiens
agttttccagtat

SEQ ID NO: 3547184 - DNA, 15 bp, Homo sapiens
agttttccagtattg

SEQ ID NO: 3547185 - DNA, 18 bp, Homo sapiens
agttttccagtattgaaa

SEQ ID NO: 3547186 - DNA, 18 bp, Homo sapiens
agttttcccttgaggaaa

SEQ ID NO: 3547187 - DNA, 13 bp, Homo sapiens
agttttctgagaa

SEQ ID NO: 3547188 - DNA, 19 bp, Homo sapiens
agttttctgagaaagacta

SEQ ID NO: 3547189 - DNA, 23 bp, Homo sapiens
agttttctgagaaagactattca

SEQ ID NO: 3547190 - DNA, 14 bp, Homo sapiens
agttttgacattta

SEQ ID NO: 3547191 - DNA, 18 bp, Homo sapiens
agtttttagaatgttgaa

SEQ ID NO: 3547192 - DNA, 11 bp, Homo sapiens
agtttttcctc

SEQ ID NO: 3547193 - DNA, 20 bp, Homo sapiens
agttttttcttccttttcac

SEQ ID NO: 3547194 - DNA, 23 bp, Homo sapiens
agttttttcttccttttcactgc

SEQ ID NO: 3547195 - DNA, 23 bp, Homo sapiens
agttttttgaaattatgtgacat

SEQ ID NO: 3547196 - DNA, 13 bp, Homo sapiens
ataaaaagcctct

SEQ ID NO: 3547197 - DNA, 14 bp, Homo sapiens
ataaaaagcctctt

SEQ ID NO: 3547198 - DNA, 17 bp, Homo sapiens
ataaaaagcctctttct

SEQ ID NO: 3547199 - DNA, 14 bp, Homo sapiens
ataaaaaggacatc

SEQ ID NO: 3547200 - DNA, 13 bp, Homo sapiens
ataaaaatatatt

SEQ ID NO: 3547201 - DNA, 21 bp, Homo sapiens
ataaaaatcatatagaccaat

SEQ ID NO: 3547202 - DNA, 12 bp, Homo sapiens
ataaaacagaat

SEQ ID NO: 3547203 - DNA, 13 bp, Homo sapiens
ataaaacgctttc

SEQ ID NO: 3547204 - DNA, 15 bp, Homo sapiens
ataaaactggctttg

SEQ ID NO: 3547205 - DNA, 23 bp, Homo sapiens
ataaaatgtaaactgtttcttta

SEQ ID NO: 3547206 - DNA, 19 bp, Homo sapiens
ataaaatgtattcaagcaa

SEQ ID NO: 3547207 - DNA, 20 bp, Homo sapiens
ataaacactgttttatagaa

SEQ ID NO: 3547208 - DNA, 14 bp, Homo sapiens
ataaaccaatgaaa

SEQ ID NO: 3547209 - DNA, 23 bp, Homo sapiens
ataaacggttcctggtgactcct

SEQ ID NO: 3547210 - DNA, 13 bp, Homo sapiens
ataaactgaattt

SEQ ID NO: 3547211 - DNA, 18 bp, Homo sapiens
ataaactggtatgaataa

SEQ ID NO: 3547212 - DNA, 21 bp, Homo sapiens
ataaactggtatgaataattg

SEQ ID NO: 3547213 - DNA, 12 bp, Homo sapiens
ataaagaaaaac

SEQ ID NO: 3547214 - DNA, 20 bp, Homo sapiens
ataaagacaatcactgccaa

SEQ ID NO: 3547215 - DNA, 12 bp, Homo sapiens
ataaagacacct

SEQ ID NO: 3547216 - DNA, 13 bp, Homo sapiens
ataaagagaaata

SEQ ID NO: 3547217 - DNA, 14 bp, Homo sapiens
ataaagagaaatat

SEQ ID NO: 3547218 - DNA, 14 bp, Homo sapiens
ataaagataaatgc

SEQ ID NO: 3547219 - DNA, 15 bp, Homo sapiens
ataaagatacaaaat

SEQ ID NO: 3547220 - DNA, 17 bp, Homo sapiens
ataaagatacaaaatgt

SEQ ID NO: 3547221 - DNA, 18 bp, Homo sapiens
ataaagatacaaaatgtt

SEQ ID NO: 3547222 - DNA, 19 bp, Homo sapiens
ataaagcaataagaacaaa

SEQ ID NO: 3547223 - DNA, 14 bp, Homo sapiens
ataaaggactgtaa

SEQ ID NO: 3547224 - DNA, 18 bp, Homo sapiens
ataaagggcccacacctg

SEQ ID NO: 3547225 - DNA, 19 bp, Homo sapiens
ataaagggcccacacctgg

SEQ ID NO: 3547226 - DNA, 21 bp, Homo sapiens
ataaaggtctgcactccttta

SEQ ID NO: 3547227 - DNA, 14 bp, Homo sapiens
ataaataaagtttc

SEQ ID NO: 3547228 - DNA, 13 bp, Homo sapiens
ataaataatctca

SEQ ID NO: 3547229 - DNA, 21 bp, Homo sapiens
ataaatatatctaccccagac

SEQ ID NO: 3547230 - DNA, 14 bp, Homo sapiens
ataaatcacacatt

SEQ ID NO: 3547231 - DNA, 16 bp, Homo sapiens
ataaatctgacccagt

SEQ ID NO: 3547232 - DNA, 19 bp, Homo sapiens
ataaatctgacccagtgcc

SEQ ID NO: 3547233 - DNA, 21 bp, Homo sapiens
ataaatgtaaaaatgaaggaa

SEQ ID NO: 3547234 - DNA, 14 bp, Homo sapiens
agggaactgaccct

SEQ ID NO: 3547235 - DNA, 21 bp, Homo sapiens
agggaagacctgaaagagagg

SEQ ID NO: 3547236 - DNA, 22 bp, Homo sapiens
agggaagacctgaaagagagga

SEQ ID NO: 3547237 - DNA, 18 bp, Homo sapiens
agggaagatgacctgccc

SEQ ID NO: 3547238 - DNA, 21 bp, Homo sapiens
agggaagatgacctgccccaa

SEQ ID NO: 3547239 - DNA, 15 bp, Homo sapiens
agggaagctgtcctg

SEQ ID NO: 3547240 - DNA, 16 bp, Homo sapiens
agggaagggagccaag

SEQ ID NO: 3547241 - DNA, 20 bp, Homo sapiens
agggaagggagccaagggat

SEQ ID NO: 3547242 - DNA, 15 bp, Homo sapiens
agggaatctagccca

SEQ ID NO: 3547243 - DNA, 19 bp, Homo sapiens
agggaatctagcccaacct

SEQ ID NO: 3547244 - DNA, 20 bp, Homo sapiens
agggaatctagcccaaccta

SEQ ID NO: 3547245 - DNA, 15 bp, Homo sapiens
agggaatggccacaa

SEQ ID NO: 3547246 - DNA, 18 bp, Homo sapiens
agggaatgggagacttga

SEQ ID NO: 3547247 - DNA, 20 bp, Homo sapiens
agggacagaggccccagcct

SEQ ID NO: 3547248 - DNA, 17 bp, Homo sapiens
agggacaggaccccagc

SEQ ID NO: 3547249 - DNA, 21 bp, Homo sapiens
agggacaggaccccagctctg

SEQ ID NO: 3547250 - DNA, 17 bp, Homo sapiens
agggacaggataagagg

SEQ ID NO: 3547251 - DNA, 16 bp, Homo sapiens
agggacaggctgaaga

SEQ ID NO: 3547252 - DNA, 17 bp, Homo sapiens
agggacaggctgaagag

SEQ ID NO: 3547253 - DNA, 18 bp, Homo sapiens
agggacaggctgaagaga

SEQ ID NO: 3547254 - DNA, 20 bp, Homo sapiens
agggacaggctgaagagagg

SEQ ID NO: 3547255 - DNA, 21 bp, Homo sapiens
agggaccactgggtgagagag

SEQ ID NO: 3547256 - DNA, 18 bp, Homo sapiens
agggaccatcaagaacct

SEQ ID NO: 3547257 - DNA, 15 bp, Homo sapiens
agggaccggtgctgc

SEQ ID NO: 3547258 - DNA, 21 bp, Homo sapiens
agggaccggtgctgcaggagt

SEQ ID NO: 3547259 - DNA, 13 bp, Homo sapiens
agggacctctccc

SEQ ID NO: 3547260 - DNA, 13 bp, Homo sapiens
agggacctgagag

SEQ ID NO: 3547261 - DNA, 16 bp, Homo sapiens
agggactacctctgtg

SEQ ID NO: 3547262 - DNA, 17 bp, Homo sapiens
agggactacctctgtgc

SEQ ID NO: 3547263 - DNA, 17 bp, Homo sapiens
agggactgccaggctgt

SEQ ID NO: 3547264 - DNA, 18 bp, Homo sapiens
agggactgccaggctgtt

SEQ ID NO: 3547265 - DNA, 13 bp, Homo sapiens
agggagaagctcc

SEQ ID NO: 3547266 - DNA, 14 bp, Homo sapiens
agggagacaccagt

SEQ ID NO: 3547267 - DNA, 14 bp, Homo sapiens
agggagagaagata

SEQ ID NO: 3547268 - DNA, 17 bp, Homo sapiens
agggagcaccctgccca

SEQ ID NO: 3547269 - DNA, 15 bp, Homo sapiens
agggagccaagggat

SEQ ID NO: 3547270 - DNA, 16 bp, Homo sapiens
agggagccaagggatg

SEQ ID NO: 3547271 - DNA, 17 bp, Homo sapiens
agggagccaagggatgg

SEQ ID NO: 3547272 - DNA, 14 bp, Homo sapiens
agggagctctgggg

SEQ ID NO: 3547273 - DNA, 14 bp, Homo sapiens
agggaggcggcctc

SEQ ID NO: 3547274 - DNA, 22 bp, Homo sapiens
agggagggatgaccttcccagg

SEQ ID NO: 3547275 - DNA, 12 bp, Homo sapiens
agggaggggcct

SEQ ID NO: 3547276 - DNA, 18 bp, Homo sapiens
agggatatggcaggactc

SEQ ID NO: 3547277 - DNA, 22 bp, Homo sapiens
agggatccccaggaggcctggg

SEQ ID NO: 3547278 - DNA, 16 bp, Homo sapiens
agggatgaccttccca

SEQ ID NO: 3547279 - DNA, 17 bp, Homo sapiens
agggatgatgagggaag

SEQ ID NO: 3547280 - DNA, 20 bp, Homo sapiens
agggatgatggcagagccag

SEQ ID NO: 3547281 - DNA, 17 bp, Homo sapiens
agggatgccctggaggt

SEQ ID NO: 3547282 - DNA, 18 bp, Homo sapiens
agggatgcggatcctgct

SEQ ID NO: 3547283 - DNA, 20 bp, Homo sapiens
agggatgcggatcctgctgg

SEQ ID NO: 3547284 - DNA, 13 bp, Homo sapiens
agggatgctgggc

SEQ ID NO: 3547285 - DNA, 16 bp, Homo sapiens
agggatgctgggctgg

SEQ ID NO: 3547286 - DNA, 16 bp, Homo sapiens
agggatggacatcttg

SEQ ID NO: 3547287 - DNA, 17 bp, Homo sapiens
agggatggagaaagaag

SEQ ID NO: 3547288 - DNA, 15 bp, Homo sapiens
agggattgctgaggc

SEQ ID NO: 3547289 - DNA, 15 bp, Homo sapiens
agggcaatctttgcc

SEQ ID NO: 3547290 - DNA, 19 bp, Homo sapiens
agggcagcaggccagagaa

SEQ ID NO: 3547291 - DNA, 13 bp, Homo sapiens
agggcagctggcc

SEQ ID NO: 3547292 - DNA, 14 bp, Homo sapiens
agggcagctggccc

SEQ ID NO: 3547293 - DNA, 9 bp, Homo sapiens
agggcagga

SEQ ID NO: 3547294 - DNA, 17 bp, Homo sapiens
agggcagggacaggata

SEQ ID NO: 3547295 - DNA, 23 bp, Homo sapiens
agggcagtccttactcccccacc

SEQ ID NO: 3547296 - DNA, 22 bp, Homo sapiens
agggccaagagatctgtgtggc

SEQ ID NO: 3547297 - DNA, 18 bp, Homo sapiens
agggccaccggtgggcag

SEQ ID NO: 3547298 - DNA, 14 bp, Homo sapiens
agggccacctgcag

SEQ ID NO: 3547299 - DNA, 19 bp, Homo sapiens
agggccacctgcaggaccc

SEQ ID NO: 3547300 - DNA, 12 bp, Homo sapiens
agggccagagcc

SEQ ID NO: 3547301 - DNA, 13 bp, Homo sapiens
agggccagagcca

SEQ ID NO: 3547302 - DNA, 18 bp, Homo sapiens
agggcccacacctggtgg

SEQ ID NO: 3547303 - DNA, 12 bp, Homo sapiens
agggcccagagc

SEQ ID NO: 3547304 - DNA, 15 bp, Homo sapiens
agggcccagagccca

SEQ ID NO: 3547305 - DNA, 11 bp, Homo sapiens
agggcccagcc

SEQ ID NO: 3547306 - DNA, 13 bp, Homo sapiens
agggcccccaccg

SEQ ID NO: 3547307 - DNA, 18 bp, Homo sapiens
agggccctgagctgaggg

SEQ ID NO: 3547308 - DNA, 13 bp, Homo sapiens
agggcctccaggg

SEQ ID NO: 3547309 - DNA, 18 bp, Homo sapiens
agggcctgacaccccctc

SEQ ID NO: 3547310 - DNA, 19 bp, Homo sapiens
agggcctgacaccccctcc

SEQ ID NO: 3547311 - DNA, 21 bp, Homo sapiens
agggcgaccccgtcacagcct

SEQ ID NO: 3547312 - DNA, 19 bp, Homo sapiens
agggctaaataaagaggag

SEQ ID NO: 3547313 - DNA, 20 bp, Homo sapiens
agggctaaataaagaggaga

SEQ ID NO: 3547314 - DNA, 23 bp, Homo sapiens
agggctaattctgggaagggaga

SEQ ID NO: 3547315 - DNA, 19 bp, Homo sapiens
agggctcagggcagtggct

SEQ ID NO: 3547316 - DNA, 15 bp, Homo sapiens
agggctccctgccct

SEQ ID NO: 3547317 - DNA, 23 bp, Homo sapiens
agggctcggggtgtgtcatttct

SEQ ID NO: 3547318 - DNA, 24 bp, Homo sapiens
agggctcggggtgtgtcatttcta

SEQ ID NO: 3547319 - DNA, 19 bp, Homo sapiens
agggctgaaaacggagagg

SEQ ID NO: 3547320 - DNA, 16 bp, Homo sapiens
agggctgagcctggtc

SEQ ID NO: 3547321 - DNA, 20 bp, Homo sapiens
agggctggcacgtgacaggc

SEQ ID NO: 3547322 - DNA, 22 bp, Homo sapiens
agggctggcacgtgacaggctc

SEQ ID NO: 3547323 - DNA, 17 bp, Homo sapiens
agggctggggatgcgcc

SEQ ID NO: 3547324 - DNA, 19 bp, Homo sapiens
agggctggggatgcgcctg

SEQ ID NO: 3547325 - DNA, 16 bp, Homo sapiens
agggctggttaatgta

SEQ ID NO: 3547326 - DNA, 13 bp, Homo sapiens
agggcttcctctt

SEQ ID NO: 3547327 - DNA, 15 bp, Homo sapiens
agggcttggcccagc

SEQ ID NO: 3547328 - DNA, 21 bp, Homo sapiens
agggcttggggctgcacctcc

SEQ ID NO: 3547329 - DNA, 19 bp, Homo sapiens
agggctttggttccttctc

SEQ ID NO: 3547330 - DNA, 21 bp, Homo sapiens
agggctttggttccttctctg

SEQ ID NO: 3547331 - DNA, 16 bp, Homo sapiens
aggggaatcagaactc

SEQ ID NO: 3547332 - DNA, 21 bp, Homo sapiens
aggggaattccctccccctcc

SEQ ID NO: 3547333 - DNA, 23 bp, Homo sapiens
aggggaccccgagaaccctgagc

SEQ ID NO: 3547334 - DNA, 12 bp, Homo sapiens
aggggagcccac

SEQ ID NO: 3547335 - DNA, 16 bp, Homo sapiens
aggggaggagcctgtg

SEQ ID NO: 3547336 - DNA, 20 bp, Homo sapiens
aggggaggcacactttctgg

SEQ ID NO: 3547337 - DNA, 14 bp, Homo sapiens
aggggatccagcca

SEQ ID NO: 3547338 - DNA, 15 bp, Homo sapiens
aggggatccagccac

SEQ ID NO: 3547339 - DNA, 17 bp, Homo sapiens
aggggatccagccactt

SEQ ID NO: 3547340 - DNA, 18 bp, Homo sapiens
aggggcaagctaggcccc

SEQ ID NO: 3547341 - DNA, 22 bp, Homo sapiens
aggggcacctatgagatggcca

SEQ ID NO: 3547342 - DNA, 21 bp, Homo sapiens
aggggccccatggcagctcct

SEQ ID NO: 3547343 - DNA, 13 bp, Homo sapiens
aggggcccggcca

SEQ ID NO: 3547344 - DNA, 19 bp, Homo sapiens
aggggcccggccagccatg

SEQ ID NO: 3547345 - DNA, 16 bp, Homo sapiens
aggggccgctgccacc

SEQ ID NO: 3547346 - DNA, 19 bp, Homo sapiens
aggggcctaggcctcagcc

SEQ ID NO: 3547347 - DNA, 12 bp, Homo sapiens
aggggcctctgt

SEQ ID NO: 3547348 - DNA, 13 bp, Homo sapiens
aggggcctgcaga

SEQ ID NO: 3547349 - DNA, 15 bp, Homo sapiens
aggggcctgcagaag

SEQ ID NO: 3547350 - DNA, 22 bp, Homo sapiens
aggggcgtctgttcccccttca

SEQ ID NO: 3547351 - DNA, 20 bp, Homo sapiens
aggggcgttctcccaaagat

SEQ ID NO: 3547352 - DNA, 14 bp, Homo sapiens
aggggctcctgagt

SEQ ID NO: 3547353 - DNA, 16 bp, Homo sapiens
aggggctcctgagtgt

SEQ ID NO: 3547354 - DNA, 15 bp, Homo sapiens
aggggctctgtggca

SEQ ID NO: 3547355 - DNA, 16 bp, Homo sapiens
aggggctctgtggcaa

SEQ ID NO: 3547356 - DNA, 15 bp, Homo sapiens
aggggctttctcttc

SEQ ID NO: 3547357 - DNA, 21 bp, Homo sapiens
aggggctttctcttccccttc

SEQ ID NO: 3547358 - DNA, 22 bp, Homo sapiens
aggggctttctcttccccttcc

SEQ ID NO: 3547359 - DNA, 16 bp, Homo sapiens
agggggacagcaggga

SEQ ID NO: 3547360 - DNA, 18 bp, Homo sapiens
agggggccccgccagggc

SEQ ID NO: 3547361 - DNA, 16 bp, Homo sapiens
agggggccctgcccca

SEQ ID NO: 3547362 - DNA, 21 bp, Homo sapiens
agggggccctgccccacccca

SEQ ID NO: 3547363 - DNA, 15 bp, Homo sapiens
agggggccctgctac

SEQ ID NO: 3547364 - DNA, 16 bp, Homo sapiens
agggggctgctgctcc

SEQ ID NO: 3547365 - DNA, 14 bp, Homo sapiens
aggggggctgtgcc

SEQ ID NO: 3547366 - DNA, 20 bp, Homo sapiens
agggggtttgctggggaact

SEQ ID NO: 3547367 - DNA, 23 bp, Homo sapiens
aggggtccctgcaaaactccagg

SEQ ID NO: 3547368 - DNA, 20 bp, Homo sapiens
aggggtgcggcggtcccagc

SEQ ID NO: 3547369 - DNA, 16 bp, Homo sapiens
aggggtgggggtgccg

SEQ ID NO: 3547370 - DNA, 22 bp, Homo sapiens
aggggtgggggtgccgctctct

SEQ ID NO: 3547371 - DNA, 16 bp, Homo sapiens
atgtctgcagctcaag

SEQ ID NO: 3547372 - DNA, 14 bp, Homo sapiens
atgtctgcatttcg

SEQ ID NO: 3547373 - DNA, 17 bp, Homo sapiens
atgtcttaatttttgaa

SEQ ID NO: 3547374 - DNA, 22 bp, Homo sapiens
atgtcttgtcatacaaatttat

SEQ ID NO: 3547375 - DNA, 16 bp, Homo sapiens
atgtctttcatgtaaa

SEQ ID NO: 3547376 - DNA, 22 bp, Homo sapiens
atgtctttttattaaaatattt

SEQ ID NO: 3547377 - DNA, 14 bp, Homo sapiens
atgtgaaatgcttt

SEQ ID NO: 3547378 - DNA, 12 bp, Homo sapiens
atgtgaagatat

SEQ ID NO: 3547379 - DNA, 23 bp, Homo sapiens
atgtgaagttcatcttgcagcat

SEQ ID NO: 3547380 - DNA, 13 bp, Homo sapiens
atgtgacatttat

SEQ ID NO: 3547381 - DNA, 19 bp, Homo sapiens
atgtgacatttatatattg

SEQ ID NO: 3547382 - DNA, 16 bp, Homo sapiens
atgtgacattttacat

SEQ ID NO: 3547383 - DNA, 16 bp, Homo sapiens
atgtgatatataagtg

SEQ ID NO: 3547384 - DNA, 17 bp, Homo sapiens
atgtgatatataagtgt

SEQ ID NO: 3547385 - DNA, 19 bp, Homo sapiens
atgtgcacatctgttttgt

SEQ ID NO: 3547386 - DNA, 13 bp, Homo sapiens
atgtgcagcattt

SEQ ID NO: 3547387 - DNA, 14 bp, Homo sapiens
atgtgcagtttgga

SEQ ID NO: 3547388 - DNA, 21 bp, Homo sapiens
atgtgcctttctttgcctctg

SEQ ID NO: 3547389 - DNA, 23 bp, Homo sapiens
atgtggaaggaaaatatttcatt

SEQ ID NO: 3547390 - DNA, 16 bp, Homo sapiens
atgtggaagtgtgggt

SEQ ID NO: 3547391 - DNA, 23 bp, Homo sapiens
atgtggaagtgtgggtctgtgtg

SEQ ID NO: 3547392 - DNA, 20 bp, Homo sapiens
atgtggcctttagcaaaact

SEQ ID NO: 3547393 - DNA, 16 bp, Homo sapiens
atgtggcctttgaatt

SEQ ID NO: 3547394 - DNA, 17 bp, Homo sapiens
atgtgggggtctgtgtg

SEQ ID NO: 3547395 - DNA, 19 bp, Homo sapiens
atgtggtgacacctccccc

SEQ ID NO: 3547396 - DNA, 20 bp, Homo sapiens
atgtggtgacacctccccct

SEQ ID NO: 3547397 - DNA, 18 bp, Homo sapiens
atgtgtacaatgtacaca

SEQ ID NO: 3547398 - DNA, 18 bp, Homo sapiens
atgtgtacattctgccta

SEQ ID NO: 3547399 - DNA, 14 bp, Homo sapiens
atgtgtagttataa

SEQ ID NO: 3547400 - DNA, 20 bp, Homo sapiens
atgtgtcattggaagccatc

SEQ ID NO: 3547401 - DNA, 16 bp, Homo sapiens
atgtgtgtctattttg

SEQ ID NO: 3547402 - DNA, 21 bp, Homo sapiens
atgtgttgtaaaaatgtcttt

SEQ ID NO: 3547403 - DNA, 15 bp, Homo sapiens
atgtgtttcttgctg

SEQ ID NO: 3547404 - DNA, 19 bp, Homo sapiens
atgtgttttcatcatttca

SEQ ID NO: 3547405 - DNA, 21 bp, Homo sapiens
atgtgtttttgggaagaagaa

SEQ ID NO: 3547406 - DNA, 15 bp, Homo sapiens
atgttaaaacataaa

SEQ ID NO: 3547407 - DNA, 19 bp, Homo sapiens
atgttaaaacataaacaca

SEQ ID NO: 3547408 - DNA, 21 bp, Homo sapiens
atgttaaaacataaacacatt

SEQ ID NO: 3547409 - DNA, 13 bp, Homo sapiens
atgttaaagttta

SEQ ID NO: 3547410 - DNA, 21 bp, Homo sapiens
atgttaagcagctaaattttc

SEQ ID NO: 3547411 - DNA, 22 bp, Homo sapiens
atgttaatattttaggtgtaaa

SEQ ID NO: 3547412 - DNA, 15 bp, Homo sapiens
atgttaatattttat

SEQ ID NO: 3547413 - DNA, 16 bp, Homo sapiens
atgttaatattttatg

SEQ ID NO: 3547414 - DNA, 14 bp, Homo sapiens
atgttagtatttta

SEQ ID NO: 3547415 - DNA, 18 bp, Homo sapiens
atgttagtattttaatcc

SEQ ID NO: 3547416 - DNA, 21 bp, Homo sapiens
atgttagtattttaatcctgt

SEQ ID NO: 3547417 - DNA, 22 bp, Homo sapiens
atgttagttaccttatagttac

SEQ ID NO: 3547418 - DNA, 24 bp, Homo sapiens
atgttatgactatgtaaactactt

SEQ ID NO: 3547419 - DNA, 15 bp, Homo sapiens
atgttattttccttc

SEQ ID NO: 3547420 - DNA, 23 bp, Homo sapiens
atgttcagaaggttgctctagat

SEQ ID NO: 3547421 - DNA, 15 bp, Homo sapiens
atgttcctagtgaaa

SEQ ID NO: 3547422 - DNA, 17 bp, Homo sapiens
atgttcctagtgaaaga

SEQ ID NO: 3547423 - DNA, 23 bp, Homo sapiens
atgttcctccttttcttcaccct

SEQ ID NO: 3547424 - DNA, 17 bp, Homo sapiens
atgttctaacagatcag

SEQ ID NO: 3547425 - DNA, 21 bp, Homo sapiens
atgttcttagcaataaatgct

SEQ ID NO: 3547426 - DNA, 20 bp, Homo sapiens
atgttctttcacccatccta

SEQ ID NO: 3547427 - DNA, 11 bp, Homo sapiens
atgttctttct

SEQ ID NO: 3547428 - DNA, 12 bp, Homo sapiens
atgttctttctg

SEQ ID NO: 3547429 - DNA, 20 bp, Homo sapiens
atgttgactgacttatggca

SEQ ID NO: 3547430 - DNA, 18 bp, Homo sapiens
atgttgctatagtgacat

SEQ ID NO: 3547431 - DNA, 19 bp, Homo sapiens
atgttgctggactgtcata

SEQ ID NO: 3547432 - DNA, 14 bp, Homo sapiens
atgttgcttctcag

SEQ ID NO: 3547433 - DNA, 18 bp, Homo sapiens
atgttggagcagcaggcc

SEQ ID NO: 3547434 - DNA, 16 bp, Homo sapiens
atgttggccaggctgg

SEQ ID NO: 3547435 - DNA, 15 bp, Homo sapiens
atgttgtaatgctgc

SEQ ID NO: 3547436 - DNA, 18 bp, Homo sapiens
atgttgtaatgctgcact

SEQ ID NO: 3547437 - DNA, 19 bp, Homo sapiens
atgttgtgtttggttcaat

SEQ ID NO: 3547438 - DNA, 16 bp, Homo sapiens
atgttgttgtgtgtat

SEQ ID NO: 3547439 - DNA, 21 bp, Homo sapiens
atgttgttgtgtgtatatgta

SEQ ID NO: 3547440 - DNA, 22 bp, Homo sapiens
atgttgttgtgtgtatatgtat

SEQ ID NO: 3547441 - DNA, 16 bp, Homo sapiens
atgttgtttataataa

SEQ ID NO: 3547442 - DNA, 22 bp, Homo sapiens
atgttgtttataataaaaatat

SEQ ID NO: 3547443 - DNA, 12 bp, Homo sapiens
atgtttgaaatg

SEQ ID NO: 3547444 - DNA, 22 bp, Homo sapiens
atgtttgaaatgaggtctgttt

SEQ ID NO: 3547445 - DNA, 15 bp, Homo sapiens
atgtttgatagtaaa

SEQ ID NO: 3547446 - DNA, 18 bp, Homo sapiens
atgttttcaaatgttctc

SEQ ID NO: 3547447 - DNA, 11 bp, Homo sapiens
atgtttttaaa

SEQ ID NO: 3547448 - DNA, 15 bp, Homo sapiens
atgtttttaactttt

SEQ ID NO: 3547449 - DNA, 18 bp, Homo sapiens
atgtttttatttcaattg

SEQ ID NO: 3547450 - DNA, 20 bp, Homo sapiens
atgtttttcatccattccta

SEQ ID NO: 3547451 - DNA, 16 bp, Homo sapiens
attaaaaaagagacat

SEQ ID NO: 3547452 - DNA, 18 bp, Homo sapiens
attaaaaactgtgatttt

SEQ ID NO: 3547453 - DNA, 17 bp, Homo sapiens
attaaaaataccttcta

SEQ ID NO: 3547454 - DNA, 15 bp, Homo sapiens
attaaaagaatattt

SEQ ID NO: 3547455 - DNA, 15 bp, Homo sapiens
attaaaataaaccaa

SEQ ID NO: 3547456 - DNA, 13 bp, Homo sapiens
attaaacggatta

SEQ ID NO: 3547457 - DNA, 14 bp, Homo sapiens
attaaacggattat

SEQ ID NO: 3547458 - DNA, 17 bp, Homo sapiens
attaaacggattatttt

SEQ ID NO: 3547459 - DNA, 19 bp, Homo sapiens
attaaacggattatttttt

SEQ ID NO: 3547460 - DNA, 14 bp, Homo sapiens
attaaacttcagca

SEQ ID NO: 3547461 - DNA, 14 bp, Homo sapiens
attaaatatatttt

SEQ ID NO: 3547462 - DNA, 18 bp, Homo sapiens
attaaatggtttttaaat

SEQ ID NO: 3547463 - DNA, 16 bp, Homo sapiens
attaaatgtggaagga

SEQ ID NO: 3547464 - DNA, 16 bp, Homo sapiens
attaaatgtgtcattg

SEQ ID NO: 3547465 - DNA, 14 bp, Homo sapiens
attaaattctcaaa

SEQ ID NO: 3547466 - DNA, 20 bp, Homo sapiens
attaaattctcaaagtttta

SEQ ID NO: 3547467 - DNA, 13 bp, Homo sapiens
attaaatttaatt

SEQ ID NO: 3547468 - DNA, 17 bp, Homo sapiens
attaaattttttttaca

SEQ ID NO: 3547469 - DNA, 18 bp, Homo sapiens
attaaattttttttacat

SEQ ID NO: 3547470 - DNA, 19 bp, Homo sapiens
attaaattttttttacatt

SEQ ID NO: 3547471 - DNA, 20 bp, Homo sapiens
attaaattttttttacattt

SEQ ID NO: 3547472 - DNA, 14 bp, Homo sapiens
attaaccttttcaa

SEQ ID NO: 3547473 - DNA, 15 bp, Homo sapiens
attaacgatgtccaa

SEQ ID NO: 3547474 - DNA, 14 bp, Homo sapiens
attaactaaagaag

SEQ ID NO: 3547475 - DNA, 17 bp, Homo sapiens
attaactaaagaagagg

SEQ ID NO: 3547476 - DNA, 20 bp, Homo sapiens
attaactgtattttctttca

SEQ ID NO: 3547477 - DNA, 21 bp, Homo sapiens
attaagaaaccttgctctcct

SEQ ID NO: 3547478 - DNA, 12 bp, Homo sapiens
attaagaaatag

SEQ ID NO: 3547479 - DNA, 13 bp, Homo sapiens
attaagcagttca

SEQ ID NO: 3547480 - DNA, 15 bp, Homo sapiens
attaagcagttcatt

SEQ ID NO: 3547481 - DNA, 15 bp, Homo sapiens
attaataatgaagta

SEQ ID NO: 3547482 - DNA, 20 bp, Homo sapiens
attaatatccctacatgtat

SEQ ID NO: 3547483 - DNA, 22 bp, Homo sapiens
attaatcaagagaaacttcaaa

SEQ ID NO: 3547484 - DNA, 22 bp, Homo sapiens
attaatcatacaaactctcacc

SEQ ID NO: 3547485 - DNA, 17 bp, Homo sapiens
attaatcttagtgtatg

SEQ ID NO: 3547486 - DNA, 19 bp, Homo sapiens
attaatcttagtgtatgat

SEQ ID NO: 3547487 - DNA, 12 bp, Homo sapiens
attaatgactta

SEQ ID NO: 3547488 - DNA, 18 bp, Homo sapiens
attaatgcagatttctct

SEQ ID NO: 3547489 - DNA, 18 bp, Homo sapiens
attaatggtttattcttt

SEQ ID NO: 3547490 - DNA, 20 bp, Homo sapiens
attaatggtttattctttgc

SEQ ID NO: 3547491 - DNA, 20 bp, Homo sapiens
attaatgtcagtatttcaac

SEQ ID NO: 3547492 - DNA, 13 bp, Homo sapiens
attaattaaagaa

SEQ ID NO: 3547493 - DNA, 14 bp, Homo sapiens
attaattgctttga

SEQ ID NO: 3547494 - DNA, 16 bp, Homo sapiens
attaatttagaatggt

SEQ ID NO: 3547495 - DNA, 13 bp, Homo sapiens
attaatttgaaac

SEQ ID NO: 3547496 - DNA, 15 bp, Homo sapiens
attaatttgaaacca

SEQ ID NO: 3547497 - DNA, 22 bp, Homo sapiens
attacaaacaataagaacaagt

SEQ ID NO: 3547498 - DNA, 24 bp, Homo sapiens
attacaaagttaaaattgttatca

SEQ ID NO: 3547499 - DNA, 23 bp, Homo sapiens
attacaaatcagaagtcatcttg

SEQ ID NO: 3547500 - DNA, 12 bp, Homo sapiens
attacaccacag

SEQ ID NO: 3547501 - DNA, 14 bp, Homo sapiens
attacacccaaaga

SEQ ID NO: 3547502 - DNA, 14 bp, Homo sapiens
attacagaaactga

SEQ ID NO: 3547503 - DNA, 17 bp, Homo sapiens
attgaaagaatgtaaag

SEQ ID NO: 3547504 - DNA, 18 bp, Homo sapiens
attgaaagaatgtaaagc

SEQ ID NO: 3547505 - DNA, 16 bp, Homo sapiens
attgaaagttctggaa

SEQ ID NO: 3547506 - DNA, 21 bp, Homo sapiens
attgaaatgatttcacagtgt

SEQ ID NO: 3547507 - DNA, 14 bp, Homo sapiens
attgaacttccagg

SEQ ID NO: 3547508 - DNA, 16 bp, Homo sapiens
attgaagaatgttaga

SEQ ID NO: 3547509 - DNA, 17 bp, Homo sapiens
attgaattggaaagact

SEQ ID NO: 3547510 - DNA, 16 bp, Homo sapiens
attgacagctttgctg

SEQ ID NO: 3547511 - DNA, 15 bp, Homo sapiens
attgactgatgattt

SEQ ID NO: 3547512 - DNA, 13 bp, Homo sapiens
attgactttgtct

SEQ ID NO: 3547513 - DNA, 13 bp, Homo sapiens
attgagcttacaa

SEQ ID NO: 3547514 - DNA, 18 bp, Homo sapiens
attgagggcattagtact

SEQ ID NO: 3547515 - DNA, 17 bp, Homo sapiens
attgatatgcttataca

SEQ ID NO: 3547516 - DNA, 20 bp, Homo sapiens
attgatattcaataaagcag

SEQ ID NO: 3547517 - DNA, 15 bp, Homo sapiens
attgatcataaactg

SEQ ID NO: 3547518 - DNA, 15 bp, Homo sapiens
attgatctgttttgg

SEQ ID NO: 3547519 - DNA, 19 bp, Homo sapiens
attgatctgttttggatgt

SEQ ID NO: 3547520 - DNA, 13 bp, Homo sapiens
attgatgttttca

SEQ ID NO: 3547521 - DNA, 17 bp, Homo sapiens
attgatgttttcataga

SEQ ID NO: 3547522 - DNA, 14 bp, Homo sapiens
attgatttttaaga

SEQ ID NO: 3547523 - DNA, 17 bp, Homo sapiens
attgatttttaagaaag

SEQ ID NO: 3547524 - DNA, 20 bp, Homo sapiens
attgatttttaagaaagtaa

SEQ ID NO: 3547525 - DNA, 15 bp, Homo sapiens
attgcacattgtaaa

SEQ ID NO: 3547526 - DNA, 20 bp, Homo sapiens
attgcacctatctcagccat

SEQ ID NO: 3547527 - DNA, 22 bp, Homo sapiens
attgcacctatctcagccatag

SEQ ID NO: 3547528 - DNA, 18 bp, Homo sapiens
attgcactgaagtttttg

SEQ ID NO: 3547529 - DNA, 23 bp, Homo sapiens
attgcagcctaagaagaaggcca

SEQ ID NO: 3547530 - DNA, 23 bp, Homo sapiens
attgcaggagtccctgccatcat

SEQ ID NO: 3547531 - DNA, 13 bp, Homo sapiens
attgcagtttaca

SEQ ID NO: 3547532 - DNA, 19 bp, Homo sapiens
attgcagtttacagtattt

SEQ ID NO: 3547533 - DNA, 16 bp, Homo sapiens
attgcatttcctgaca

SEQ ID NO: 3547534 - DNA, 17 bp, Homo sapiens
attgcatttcctgacag

SEQ ID NO: 3547535 - DNA, 18 bp, Homo sapiens
attgccaaaacccagctg

SEQ ID NO: 3547536 - DNA, 14 bp, Homo sapiens
attgccagcaaata

SEQ ID NO: 3547537 - DNA, 21 bp, Homo sapiens
attgcccctggctttgcctct

SEQ ID NO: 3547538 - DNA, 19 bp, Homo sapiens
attgcctgtaacaatgtaa

SEQ ID NO: 3547539 - DNA, 14 bp, Homo sapiens
attgcgcctaatgt

SEQ ID NO: 3547540 - DNA, 18 bp, Homo sapiens
attgctagccagcattcc

SEQ ID NO: 3547541 - DNA, 14 bp, Homo sapiens
attgctatcagcaa

SEQ ID NO: 3547542 - DNA, 21 bp, Homo sapiens
attgctccaagatgttctcct

SEQ ID NO: 3547543 - DNA, 19 bp, Homo sapiens
attgctctgaatatgtcat

SEQ ID NO: 3547544 - DNA, 20 bp, Homo sapiens
attgctgcatatttgacctt

SEQ ID NO: 3547545 - DNA, 14 bp, Homo sapiens
attgctggctgccc

SEQ ID NO: 3547546 - DNA, 21 bp, Homo sapiens
attgcttacaagcctaagaat

SEQ ID NO: 3547547 - DNA, 20 bp, Homo sapiens
attgcttctaaaacaataaa

SEQ ID NO: 3547548 - DNA, 10 bp, Homo sapiens
attgctttga

SEQ ID NO: 3547549 - DNA, 21 bp, Homo sapiens
attgctttgtattgtatatta

SEQ ID NO: 3547550 - DNA, 15 bp, Homo sapiens
attggaattataaat

SEQ ID NO: 3547551 - DNA, 20 bp, Homo sapiens
attggataaagtttggtgtt

SEQ ID NO: 3547552 - DNA, 22 bp, Homo sapiens
attggatttcctaatactgtca

SEQ ID NO: 3547553 - DNA, 15 bp, Homo sapiens
attggcaaagtgaca

SEQ ID NO: 3547554 - DNA, 20 bp, Homo sapiens
attggctccatatcatttga

SEQ ID NO: 3547555 - DNA, 15 bp, Homo sapiens
attggcttaaaggga

SEQ ID NO: 3547556 - DNA, 16 bp, Homo sapiens
attgggaactgaaatc

SEQ ID NO: 3547557 - DNA, 15 bp, Homo sapiens
attggggtccctcta

SEQ ID NO: 3547558 - DNA, 12 bp, Homo sapiens
attggtgttgac

SEQ ID NO: 3547559 - DNA, 15 bp, Homo sapiens
attggtgttgcagcc

SEQ ID NO: 3547560 - DNA, 14 bp, Homo sapiens
attggttcacctgt

SEQ ID NO: 3547561 - DNA, 16 bp, Homo sapiens
attggttggcaaacta

SEQ ID NO: 3547562 - DNA, 15 bp, Homo sapiens
attggtttaaagaaa

SEQ ID NO: 3547563 - DNA, 17 bp, Homo sapiens
attggtttaaagaaagt

SEQ ID NO: 3547564 - DNA, 22 bp, Homo sapiens
attggttttccaatcatttgac

SEQ ID NO: 3547565 - DNA, 14 bp, Homo sapiens
attgtaaatgtgct

SEQ ID NO: 3547566 - DNA, 14 bp, Homo sapiens
attgtacaataaat

SEQ ID NO: 3547567 - DNA, 18 bp, Homo sapiens
attgtagagccagaggtc

SEQ ID NO: 3547568 - DNA, 15 bp, Homo sapiens
attgtatattacaat

SEQ ID NO: 3547569 - DNA, 17 bp, Homo sapiens
attgtatattacaatga

SEQ ID NO: 3547570 - DNA, 18 bp, Homo sapiens
attgtatattacaatgat

SEQ ID NO: 3547571 - DNA, 20 bp, Homo sapiens
attgtatattacaatgatca

SEQ ID NO: 3547572 - DNA, 23 bp, Homo sapiens
attgtgaaataaaactggctttg

SEQ ID NO: 3547573 - DNA, 22 bp, Homo sapiens
atgattactggcctttttcatt

SEQ ID NO: 3547574 - DNA, 20 bp, Homo sapiens
atgattgtttctcaaatctt

SEQ ID NO: 3547575 - DNA, 17 bp, Homo sapiens
atgatttaatttgaaat

SEQ ID NO: 3547576 - DNA, 21 bp, Homo sapiens
atgatttcagtcatagcaagc

SEQ ID NO: 3547577 - DNA, 21 bp, Homo sapiens
atgatttcatgctatctctgt

SEQ ID NO: 3547578 - DNA, 14 bp, Homo sapiens
atgcaaagcactga

SEQ ID NO: 3547579 - DNA, 21 bp, Homo sapiens
atgcaaatagattcagagaaa

SEQ ID NO: 3547580 - DNA, 17 bp, Homo sapiens
atgcaactctaactctg

SEQ ID NO: 3547581 - DNA, 16 bp, Homo sapiens
atgcaagcagcttttt

SEQ ID NO: 3547582 - DNA, 17 bp, Homo sapiens
atgcaaggattacagaa

SEQ ID NO: 3547583 - DNA, 21 bp, Homo sapiens
atgcaaggattacagaaactg

SEQ ID NO: 3547584 - DNA, 22 bp, Homo sapiens
atgcaatactggtcaacttaag

SEQ ID NO: 3547585 - DNA, 15 bp, Homo sapiens
atgcacaaaactact

SEQ ID NO: 3547586 - DNA, 14 bp, Homo sapiens
atgcacacatatat

SEQ ID NO: 3547587 - DNA, 14 bp, Homo sapiens
atgcacagtatctg

SEQ ID NO: 3547588 - DNA, 22 bp, Homo sapiens
atgcacatgctgtctggccctg

SEQ ID NO: 3547589 - DNA, 17 bp, Homo sapiens
atgcacgtggggcccac

SEQ ID NO: 3547590 - DNA, 13 bp, Homo sapiens
atgcactgtgaag

SEQ ID NO: 3547591 - DNA, 22 bp, Homo sapiens
atgcagcaggaaggaacaaaga

SEQ ID NO: 3547592 - DNA, 16 bp, Homo sapiens
atgcagccatatatgg

SEQ ID NO: 3547593 - DNA, 15 bp, Homo sapiens
atgcaggaaggaaaa

SEQ ID NO: 3547594 - DNA, 19 bp, Homo sapiens
atgcagtactaaaattaat

SEQ ID NO: 3547595 - DNA, 15 bp, Homo sapiens
atgcagtcctcagga

SEQ ID NO: 3547596 - DNA, 15 bp, Homo sapiens
atgcagtgaactatt

SEQ ID NO: 3547597 - DNA, 15 bp, Homo sapiens
atgcagttatatatt

SEQ ID NO: 3547598 - DNA, 22 bp, Homo sapiens
atgcagttcaaaaacaagacag

SEQ ID NO: 3547599 - DNA, 14 bp, Homo sapiens
atgcataaatgcat

SEQ ID NO: 3547600 - DNA, 13 bp, Homo sapiens
atgcatatagaca

SEQ ID NO: 3547601 - DNA, 17 bp, Homo sapiens
atgcatatagacacaca

SEQ ID NO: 3547602 - DNA, 20 bp, Homo sapiens
atgcatatgtcactagaatg

SEQ ID NO: 3547603 - DNA, 23 bp, Homo sapiens
atgcatatgtcactagaatggat

SEQ ID NO: 3547604 - DNA, 12 bp, Homo sapiens
atgcatatttgc

SEQ ID NO: 3547605 - DNA, 23 bp, Homo sapiens
atgcatggagggctgccctgtac

SEQ ID NO: 3547606 - DNA, 18 bp, Homo sapiens
atgcatggtgccccagga

SEQ ID NO: 3547607 - DNA, 20 bp, Homo sapiens
atgcatggtgccccaggacc

SEQ ID NO: 3547608 - DNA, 13 bp, Homo sapiens
atgcatgtagcat

SEQ ID NO: 3547609 - DNA, 15 bp, Homo sapiens
atgcatgtagcatat

SEQ ID NO: 3547610 - DNA, 17 bp, Homo sapiens
atgcattcaaaatataa

SEQ ID NO: 3547611 - DNA, 18 bp, Homo sapiens
atgccaaaaaaagacagg

SEQ ID NO: 3547612 - DNA, 22 bp, Homo sapiens
atgccaattagcaattgactgt

SEQ ID NO: 3547613 - DNA, 16 bp, Homo sapiens
atgccacaaggacttc

SEQ ID NO: 3547614 - DNA, 15 bp, Homo sapiens
atgccactgggacag

SEQ ID NO: 3547615 - DNA, 23 bp, Homo sapiens
atgccactgggacagctggctgg

SEQ ID NO: 3547616 - DNA, 20 bp, Homo sapiens
atgccacttccttttaactg

SEQ ID NO: 3547617 - DNA, 21 bp, Homo sapiens
atttatacaccagcaatttag

SEQ ID NO: 3547618 - DNA, 16 bp, Homo sapiens
atttatatcaggtgta

SEQ ID NO: 3547619 - DNA, 19 bp, Homo sapiens
atttatcctgaaatttcag

SEQ ID NO: 3547620 - DNA, 21 bp, Homo sapiens
atttatcctgaaatttcagat

SEQ ID NO: 3547621 - DNA, 22 bp, Homo sapiens
atttatctttacttttaaacag

SEQ ID NO: 3547622 - DNA, 21 bp, Homo sapiens
atttatgccttgatgatttaa

SEQ ID NO: 3547623 - DNA, 17 bp, Homo sapiens
atttattaatttgaaac

SEQ ID NO: 3547624 - DNA, 12 bp, Homo sapiens
atttattacaac

SEQ ID NO: 3547625 - DNA, 15 bp, Homo sapiens
atttattagccaact

SEQ ID NO: 3547626 - DNA, 16 bp, Homo sapiens
atttattagccaactg

SEQ ID NO: 3547627 - DNA, 14 bp, Homo sapiens
atttattcattagt

SEQ ID NO: 3547628 - DNA, 13 bp, Homo sapiens
atttattccccag

SEQ ID NO: 3547629 - DNA, 21 bp, Homo sapiens
atttattccccagtgactcca

SEQ ID NO: 3547630 - DNA, 23 bp, Homo sapiens
atttattccccagtgactccagg

SEQ ID NO: 3547631 - DNA, 13 bp, Homo sapiens
atttattcctttg

SEQ ID NO: 3547632 - DNA, 19 bp, Homo sapiens
atttattgaaatgatttca

SEQ ID NO: 3547633 - DNA, 20 bp, Homo sapiens
atttattgaaatgatttcac

SEQ ID NO: 3547634 - DNA, 13 bp, Homo sapiens
atttattgatgtt

SEQ ID NO: 3547635 - DNA, 14 bp, Homo sapiens
atttattgatgttt

SEQ ID NO: 3547636 - DNA, 15 bp, Homo sapiens
atttattgatgtttt

SEQ ID NO: 3547637 - DNA, 14 bp, Homo sapiens
atttattgttagaa

SEQ ID NO: 3547638 - DNA, 12 bp, Homo sapiens
atttatttattt

SEQ ID NO: 3547639 - DNA, 16 bp, Homo sapiens
atttatttatttgttt

SEQ ID NO: 3547640 - DNA, 18 bp, Homo sapiens
atttatttcaataaatct

SEQ ID NO: 3547641 - DNA, 20 bp, Homo sapiens
atttatttttaagaaagaaa

SEQ ID NO: 3547642 - DNA, 23 bp, Homo sapiens
atttcaaacagtctcccttccta

SEQ ID NO: 3547643 - DNA, 20 bp, Homo sapiens
atttcaaacattttgtatca

SEQ ID NO: 3547644 - DNA, 19 bp, Homo sapiens
atttcaaacttaaacaaaa

SEQ ID NO: 3547645 - DNA, 20 bp, Homo sapiens
atttcaaacttaaacaaaaa

SEQ ID NO: 3547646 - DNA, 23 bp, Homo sapiens
atttcaaacttaaacaaaaaact

SEQ ID NO: 3547647 - DNA, 13 bp, Homo sapiens
atttcaatactta

SEQ ID NO: 3547648 - DNA, 15 bp, Homo sapiens
atttcaatcttttaa

SEQ ID NO: 3547649 - DNA, 15 bp, Homo sapiens
atttcaattgtttat

SEQ ID NO: 3547650 - DNA, 23 bp, Homo sapiens
atttcaattgtttatatggataa

SEQ ID NO: 3547651 - DNA, 21 bp, Homo sapiens
atttcacctactaatgtctct

SEQ ID NO: 3547652 - DNA, 16 bp, Homo sapiens
atttcactagagacaa

SEQ ID NO: 3547653 - DNA, 16 bp, Homo sapiens
atttcagagaggcctt

SEQ ID NO: 3547654 - DNA, 18 bp, Homo sapiens
atttcaggactctctcca

SEQ ID NO: 3547655 - DNA, 20 bp, Homo sapiens
atttcaggactctctccagg

SEQ ID NO: 3547656 - DNA, 20 bp, Homo sapiens
atttcaggattaactaaaga

SEQ ID NO: 3547657 - DNA, 22 bp, Homo sapiens
atttcaggattaactaaagaag

SEQ ID NO: 3547658 - DNA, 22 bp, Homo sapiens
atttcatacaacagaaaccaga

SEQ ID NO: 3547659 - DNA, 16 bp, Homo sapiens
atttcatgaaaaagct

SEQ ID NO: 3547660 - DNA, 17 bp, Homo sapiens
atttcatgaaaaagctg

SEQ ID NO: 3547661 - DNA, 18 bp, Homo sapiens
atttcatgaaaaagctgc

SEQ ID NO: 3547662 - DNA, 18 bp, Homo sapiens
atttcccaacacaaagat

SEQ ID NO: 3547663 - DNA, 12 bp, Homo sapiens
atttcccaggac

SEQ ID NO: 3547664 - DNA, 19 bp, Homo sapiens
atttcccaggaccctgaag

SEQ ID NO: 3547665 - DNA, 21 bp, Homo sapiens
atttcccccttcatccatcct

SEQ ID NO: 3547666 - DNA, 22 bp, Homo sapiens
atttcccctctgcacccagaac

SEQ ID NO: 3547667 - DNA, 14 bp, Homo sapiens
atttccctctctca

SEQ ID NO: 3547668 - DNA, 21 bp, Homo sapiens
atttccgtgaactctggtgct

SEQ ID NO: 3547669 - DNA, 17 bp, Homo sapiens
atttcctaatactgtca

SEQ ID NO: 3547670 - DNA, 23 bp, Homo sapiens
atttcctatagctacatgttctt

SEQ ID NO: 3547671 - DNA, 15 bp, Homo sapiens
atttcctctgttctt

SEQ ID NO: 3547672 - DNA, 12 bp, Homo sapiens
atttccttcagg

SEQ ID NO: 3547673 - DNA, 16 bp, Homo sapiens
atttccttcaggcagc

SEQ ID NO: 3547674 - DNA, 14 bp, Homo sapiens
atttctaaaatgtt

SEQ ID NO: 3547675 - DNA, 21 bp, Homo sapiens
atttctaaaatgttaaaacat

SEQ ID NO: 3547676 - DNA, 13 bp, Homo sapiens
atttctactatga

SEQ ID NO: 3547677 - DNA, 19 bp, Homo sapiens
atttctagtacctgtgact

SEQ ID NO: 3547678 - DNA, 21 bp, Homo sapiens
atttctagtacctgtgactct

SEQ ID NO: 3547679 - DNA, 21 bp, Homo sapiens
atttctagttctttcctcccc

SEQ ID NO: 3547680 - DNA, 22 bp, Homo sapiens
atttctatacagtagcttgaaa

SEQ ID NO: 3547681 - DNA, 19 bp, Homo sapiens
atttctatattcctccagc

SEQ ID NO: 3547682 - DNA, 24 bp, Homo sapiens
atttctcagaagtctttcagcaag

SEQ ID NO: 3547683 - DNA, 13 bp, Homo sapiens
atttctcagctgt

SEQ ID NO: 3547684 - DNA, 18 bp, Homo sapiens
atttctcataattttgca

SEQ ID NO: 3547685 - DNA, 15 bp, Homo sapiens
atttctcatgttgaa

SEQ ID NO: 3547686 - DNA, 18 bp, Homo sapiens
atttctccatcccctccc

SEQ ID NO: 3547687 - DNA, 14 bp, Homo sapiens
atttctgatgtctc

SEQ ID NO: 3547688 - DNA, 15 bp, Homo sapiens
atttctgattctgat

SEQ ID NO: 3547689 - DNA, 21 bp, Homo sapiens
atttctgctctggaataaagt

SEQ ID NO: 3547690 - DNA, 18 bp, Homo sapiens
atttctgggatatttaac

SEQ ID NO: 3547691 - DNA, 19 bp, Homo sapiens
atttctggggggagaaaaa

SEQ ID NO: 3547692 - DNA, 21 bp, Homo sapiens
atttctggggggagaaaaaaa

SEQ ID NO: 3547693 - DNA, 21 bp, Homo sapiens
caaggggtgaggataggacag

SEQ ID NO: 3547694 - DNA, 21 bp, Homo sapiens
caagggtgatgggaaagcatt

SEQ ID NO: 3547695 - DNA, 23 bp, Homo sapiens
caagggtttcgactggtccagct

SEQ ID NO: 3547696 - DNA, 16 bp, Homo sapiens
caaggtactctggtga

SEQ ID NO: 3547697 - DNA, 14 bp, Homo sapiens
caaggtctttggtt

SEQ ID NO: 3547698 - DNA, 14 bp, Homo sapiens
caaggtgaggtgaa

SEQ ID NO: 3547699 - DNA, 20 bp, Homo sapiens
caaggtgaggtgaactccag

SEQ ID NO: 3547700 - DNA, 23 bp, Homo sapiens
caaggtgaggtgaactccaggca

SEQ ID NO: 3547701 - DNA, 11 bp, Homo sapiens
caaggtgctaa

SEQ ID NO: 3547702 - DNA, 12 bp, Homo sapiens
caaggtgctaac

SEQ ID NO: 3547703 - DNA, 14 bp, Homo sapiens
caaggtgctaacat

SEQ ID NO: 3547704 - DNA, 19 bp, Homo sapiens
caaggtggggattgcccct

SEQ ID NO: 3547705 - DNA, 23 bp, Homo sapiens
caaggtggggattgcccctggct

SEQ ID NO: 3547706 - DNA, 23 bp, Homo sapiens
caaggtttaggctggtggcccag

SEQ ID NO: 3547707 - DNA, 24 bp, Homo sapiens
caaggtttaggctggtggcccagg

SEQ ID NO: 3547708 - DNA, 12 bp, Homo sapiens
caagtaaaacaa

SEQ ID NO: 3547709 - DNA, 14 bp, Homo sapiens
caagtaaaagaaaa

SEQ ID NO: 3547710 - DNA, 15 bp, Homo sapiens
caagtaaaagaaaag

SEQ ID NO: 3547711 - DNA, 12 bp, Homo sapiens
caagtaatatta

SEQ ID NO: 3547712 - DNA, 18 bp, Homo sapiens
caagtattaagcagttca

SEQ ID NO: 3547713 - DNA, 19 bp, Homo sapiens
caagtattaagcagttcat

SEQ ID NO: 3547714 - DNA, 20 bp, Homo sapiens
caagtattaagcagttcatt

SEQ ID NO: 3547715 - DNA, 11 bp, Homo sapiens
caagtattttg

SEQ ID NO: 3547716 - DNA, 22 bp, Homo sapiens
caagtccagctgggaagccctt

SEQ ID NO: 3547717 - DNA, 18 bp, Homo sapiens
caagtccttaggctactg

SEQ ID NO: 3547718 - DNA, 21 bp, Homo sapiens
caagtgaaataacaaaatgga

SEQ ID NO: 3547719 - DNA, 22 bp, Homo sapiens
caagtgactctcctgcctcagc

SEQ ID NO: 3547720 - DNA, 15 bp, Homo sapiens
caaattaatgttcca

SEQ ID NO: 3547721 - DNA, 14 bp, Homo sapiens
caaattgcactgaa

SEQ ID NO: 3547722 - DNA, 15 bp, Homo sapiens
caaattgcactgaag

SEQ ID NO: 3547723 - DNA, 17 bp, Homo sapiens
caaattgcactgaagtt

SEQ ID NO: 3547724 - DNA, 21 bp, Homo sapiens
caaattgcactgaagtttttg

SEQ ID NO: 3547725 - DNA, 14 bp, Homo sapiens
caaattgtcagcaa

SEQ ID NO: 3547726 - DNA, 16 bp, Homo sapiens
caacaacgtgagagaa

SEQ ID NO: 3547727 - DNA, 20 bp, Homo sapiens
caacaaggtggtgtgatctt

SEQ ID NO: 3547728 - DNA, 20 bp, Homo sapiens
caacaatgtgttgtaaaaat

SEQ ID NO: 3547729 - DNA, 19 bp, Homo sapiens
caacacttaatagcaacag

SEQ ID NO: 3547730 - DNA, 20 bp, Homo sapiens
caacactttgagcattttta

SEQ ID NO: 3547731 - DNA, 21 bp, Homo sapiens
caacactttgagcatttttaa

SEQ ID NO: 3547732 - DNA, 13 bp, Homo sapiens
caacagagcactt

SEQ ID NO: 3547733 - DNA, 13 bp, Homo sapiens
caacagatctgga

SEQ ID NO: 3547734 - DNA, 17 bp, Homo sapiens
caacagatctggaacct

SEQ ID NO: 3547735 - DNA, 15 bp, Homo sapiens
caacagatttaaaga

SEQ ID NO: 3547736 - DNA, 20 bp, Homo sapiens
caacagcagtctccttcagc

SEQ ID NO: 3547737 - DNA, 17 bp, Homo sapiens
caacagccaagctggca

SEQ ID NO: 3547738 - DNA, 12 bp, Homo sapiens
caacagccctgc

SEQ ID NO: 3547739 - DNA, 17 bp, Homo sapiens
caacagccctgcctgag

SEQ ID NO: 3547740 - DNA, 18 bp, Homo sapiens
caacagccctgcctgaga

SEQ ID NO: 3547741 - DNA, 22 bp, Homo sapiens
caacatcactaatttggctttc

SEQ ID NO: 3547742 - DNA, 13 bp, Homo sapiens
caacatcttttta

SEQ ID NO: 3547743 - DNA, 22 bp, Homo sapiens
caacattcattgccaagggccc

SEQ ID NO: 3547744 - DNA, 22 bp, Homo sapiens
caaccagcccgacagtgccatc

SEQ ID NO: 3547745 - DNA, 15 bp, Homo sapiens
caaccatcatgtgta

SEQ ID NO: 3547746 - DNA, 21 bp, Homo sapiens
caaccatcatgtgtagagccc

SEQ ID NO: 3547747 - DNA, 19 bp, Homo sapiens
caacccagtgggtctggga

SEQ ID NO: 3547748 - DNA, 13 bp, Homo sapiens
caacccccctccc

SEQ ID NO: 3547749 - DNA, 15 bp, Homo sapiens
caacccctctccagg

SEQ ID NO: 3547750 - DNA, 19 bp, Homo sapiens
caaccctaccctggcaggg

SEQ ID NO: 3547751 - DNA, 18 bp, Homo sapiens
caaccctcagagccaccc

SEQ ID NO: 3547752 - DNA, 19 bp, Homo sapiens
caacccttcctgaaacttc

SEQ ID NO: 3547753 - DNA, 15 bp, Homo sapiens
caacccttctctgtt

SEQ ID NO: 3547754 - DNA, 19 bp, Homo sapiens
caacctacattccaccctg

SEQ ID NO: 3547755 - DNA, 14 bp, Homo sapiens
caacctcaggctcc

SEQ ID NO: 3547756 - DNA, 15 bp, Homo sapiens
caacctcaggctcct

SEQ ID NO: 3547757 - DNA, 12 bp, Homo sapiens
atttcttccctg

SEQ ID NO: 3547758 - DNA, 13 bp, Homo sapiens
atttcttccctgc

SEQ ID NO: 3547759 - DNA, 15 bp, Homo sapiens
atttcttccctgctt

SEQ ID NO: 3547760 - DNA, 18 bp, Homo sapiens
atttcttcttttcctgca

SEQ ID NO: 3547761 - DNA, 20 bp, Homo sapiens
atttcttcttttcctgcagg

SEQ ID NO: 3547762 - DNA, 21 bp, Homo sapiens
atttcttgaagaataaattct

SEQ ID NO: 3547763 - DNA, 14 bp, Homo sapiens
atttctttcttcca

SEQ ID NO: 3547764 - DNA, 21 bp, Homo sapiens
atttctttctttgcaccaaag

SEQ ID NO: 3547765 - DNA, 21 bp, Homo sapiens
atttgaccagaactttttcct

SEQ ID NO: 3547766 - DNA, 22 bp, Homo sapiens
atttgaccagaactttttcctc

SEQ ID NO: 3547767 - DNA, 22 bp, Homo sapiens
atttgacttgaaaagaaagaaa

SEQ ID NO: 3547768 - DNA, 16 bp, Homo sapiens
atttgaggtcagtgtt

SEQ ID NO: 3547769 - DNA, 16 bp, Homo sapiens
atttgaggtctagaga

SEQ ID NO: 3547770 - DNA, 21 bp, Homo sapiens
atttgaggtctagagagaacc

SEQ ID NO: 3547771 - DNA, 16 bp, Homo sapiens
atttgataaactgaat

SEQ ID NO: 3547772 - DNA, 12 bp, Homo sapiens
atttgcagaggc

SEQ ID NO: 3547773 - DNA, 19 bp, Homo sapiens
atttgcattgaggaaatat

SEQ ID NO: 3547774 - DNA, 16 bp, Homo sapiens
atttgccaataaagct

SEQ ID NO: 3547775 - DNA, 20 bp, Homo sapiens
atttgccaataaagcttttg

SEQ ID NO: 3547776 - DNA, 13 bp, Homo sapiens
atttgccagagga

SEQ ID NO: 3547777 - DNA, 22 bp, Homo sapiens
atttgcttgcaatctaatctga

SEQ ID NO: 3547778 - DNA, 18 bp, Homo sapiens
atttggatgattgtcata

SEQ ID NO: 3547779 - DNA, 16 bp, Homo sapiens
atttggctttcacatt

SEQ ID NO: 3547780 - DNA, 14 bp, Homo sapiens
atttgggcagagag

SEQ ID NO: 3547781 - DNA, 19 bp, Homo sapiens
atttgggcctgctccagac

SEQ ID NO: 3547782 - DNA, 16 bp, Homo sapiens
atttgtaaaaatgagt

SEQ ID NO: 3547783 - DNA, 23 bp, Homo sapiens
atttgtaaaaatgagtcatttgt

SEQ ID NO: 3547784 - DNA, 14 bp, Homo sapiens
atttgtaaaacttc

SEQ ID NO: 3547785 - DNA, 16 bp, Homo sapiens
atttgtaaaacttctg

SEQ ID NO: 3547786 - DNA, 19 bp, Homo sapiens
atttgtaaaacttctgctc

SEQ ID NO: 3547787 - DNA, 19 bp, Homo sapiens
atttgtaaatttatgtgat

SEQ ID NO: 3547788 - DNA, 16 bp, Homo sapiens
atttgtagctttgccc

SEQ ID NO: 3547789 - DNA, 22 bp, Homo sapiens
atttgtcaacagatttaaagaa

SEQ ID NO: 3547790 - DNA, 13 bp, Homo sapiens
atttgtcttaaaa

SEQ ID NO: 3547791 - DNA, 19 bp, Homo sapiens
atttgtcttaaaaatttat

SEQ ID NO: 3547792 - DNA, 24 bp, Homo sapiens
atttgttaatatttcttcgtgatg

SEQ ID NO: 3547793 - DNA, 14 bp, Homo sapiens
atttgttacagcca

SEQ ID NO: 3547794 - DNA, 13 bp, Homo sapiens
atttgttggaatg

SEQ ID NO: 3547795 - DNA, 14 bp, Homo sapiens
atttgttggaatga

SEQ ID NO: 3547796 - DNA, 18 bp, Homo sapiens
atttgtttctttctctga

SEQ ID NO: 3547797 - DNA, 20 bp, Homo sapiens
atttgtttctttctctgagg

SEQ ID NO: 3547798 - DNA, 16 bp, Homo sapiens
attttaaaaaatggtc

SEQ ID NO: 3547799 - DNA, 13 bp, Homo sapiens
attttaaacaaag

SEQ ID NO: 3547800 - DNA, 14 bp, Homo sapiens
attttaatcctgta

SEQ ID NO: 3547801 - DNA, 15 bp, Homo sapiens
attttaatcctgtac

SEQ ID NO: 3547802 - DNA, 17 bp, Homo sapiens
attttaatcctgtacca

SEQ ID NO: 3547803 - DNA, 22 bp, Homo sapiens
attttaatgtactaatatttct

SEQ ID NO: 3547804 - DNA, 22 bp, Homo sapiens
attttacaagggcataaagtaa

SEQ ID NO: 3547805 - DNA, 23 bp, Homo sapiens
attttacatgaagctgtataatt

SEQ ID NO: 3547806 - DNA, 12 bp, Homo sapiens
attttacattaa

SEQ ID NO: 3547807 - DNA, 12 bp, Homo sapiens
attttaccaaag

SEQ ID NO: 3547808 - DNA, 18 bp, Homo sapiens
attttaccaaagcatcaa

SEQ ID NO: 3547809 - DNA, 12 bp, Homo sapiens
attttacctatt

SEQ ID NO: 3547810 - DNA, 22 bp, Homo sapiens
caaacattcgtgagctggggac

SEQ ID NO: 3547811 - DNA, 20 bp, Homo sapiens
caaacccagagggttgctgg

SEQ ID NO: 3547812 - DNA, 13 bp, Homo sapiens
caaaccccagccc

SEQ ID NO: 3547813 - DNA, 14 bp, Homo sapiens
caaaccccagcccc

SEQ ID NO: 3547814 - DNA, 15 bp, Homo sapiens
caaaccccagcccca

SEQ ID NO: 3547815 - DNA, 23 bp, Homo sapiens
caaacccttaactgacatgggcc

SEQ ID NO: 3547816 - DNA, 22 bp, Homo sapiens
caaacctaagtccttccacctg

SEQ ID NO: 3547817 - DNA, 13 bp, Homo sapiens
caaacctccagcc

SEQ ID NO: 3547818 - DNA, 16 bp, Homo sapiens
caaacctccagcctcc

SEQ ID NO: 3547819 - DNA, 20 bp, Homo sapiens
caaacctccagcctccctgt

SEQ ID NO: 3547820 - DNA, 12 bp, Homo sapiens
caaacctgggaa

SEQ ID NO: 3547821 - DNA, 13 bp, Homo sapiens
caaactctgctgt

SEQ ID NO: 3547822 - DNA, 15 bp, Homo sapiens
caaactgacaatttt

SEQ ID NO: 3547823 - DNA, 20 bp, Homo sapiens
caaactggccgcgggggcag

SEQ ID NO: 3547824 - DNA, 15 bp, Homo sapiens
caaacttaaacaaaa

SEQ ID NO: 3547825 - DNA, 21 bp, Homo sapiens
caaacttaatgttcttatgca

SEQ ID NO: 3547826 - DNA, 21 bp, Homo sapiens
caaagaaaatgaaatgcatat

SEQ ID NO: 3547827 - DNA, 18 bp, Homo sapiens
caaagaaacaagctgtgc

SEQ ID NO: 3547828 - DNA, 19 bp, Homo sapiens
caaagaaacaagctgtgca

SEQ ID NO: 3547829 - DNA, 20 bp, Homo sapiens
caaagaaacaagctgtgcag

SEQ ID NO: 3547830 - DNA, 14 bp, Homo sapiens
caaagaaagtgtat

SEQ ID NO: 3547831 - DNA, 16 bp, Homo sapiens
caaagaaagtgtattg

SEQ ID NO: 3547832 - DNA, 14 bp, Homo sapiens
caaagaaatgtaag

SEQ ID NO: 3547833 - DNA, 17 bp, Homo sapiens
caaagaaccatgcagga

SEQ ID NO: 3547834 - DNA, 16 bp, Homo sapiens
caaagaagaaagctga

SEQ ID NO: 3547835 - DNA, 13 bp, Homo sapiens
caaagacatcagt

SEQ ID NO: 3547836 - DNA, 15 bp, Homo sapiens
caaagacattgacag

SEQ ID NO: 3547837 - DNA, 19 bp, Homo sapiens
caaagacattgacagcaat

SEQ ID NO: 3547838 - DNA, 20 bp, Homo sapiens
caaagacattgacagcaatt

SEQ ID NO: 3547839 - DNA, 14 bp, Homo sapiens
caaagagatattga

SEQ ID NO: 3547840 - DNA, 12 bp, Homo sapiens
caaagataattt

SEQ ID NO: 3547841 - DNA, 19 bp, Homo sapiens
caaagataatttatttcaa

SEQ ID NO: 3547842 - DNA, 17 bp, Homo sapiens
caaagattctctatgta

SEQ ID NO: 3547843 - DNA, 18 bp, Homo sapiens
caaagcaaaacagactgt

SEQ ID NO: 3547844 - DNA, 12 bp, Homo sapiens
caaagcaaagaa

SEQ ID NO: 3547845 - DNA, 18 bp, Homo sapiens
caaagcaattctttcaag

SEQ ID NO: 3547846 - DNA, 20 bp, Homo sapiens
caaagcactgacttctaagt

SEQ ID NO: 3547847 - DNA, 18 bp, Homo sapiens
caaagcacttaagtgtta

SEQ ID NO: 3547848 - DNA, 20 bp, Homo sapiens
caaagcagctttaaaaaaat

SEQ ID NO: 3547849 - DNA, 22 bp, Homo sapiens
caaagcagctttaaaaaaataa

SEQ ID NO: 3547850 - DNA, 22 bp, Homo sapiens
caaagccaaggcagcgacccca

SEQ ID NO: 3547851 - DNA, 23 bp, Homo sapiens
caaagccaaggcagcgaccccag

SEQ ID NO: 3547852 - DNA, 14 bp, Homo sapiens
caaagcccaaggga

SEQ ID NO: 3547853 - DNA, 18 bp, Homo sapiens
caaagcccctcacactgc

SEQ ID NO: 3547854 - DNA, 20 bp, Homo sapiens
caaagcttgtcaaagatgcc

SEQ ID NO: 3547855 - DNA, 16 bp, Homo sapiens
caaaggaacactgaca

SEQ ID NO: 3547856 - DNA, 23 bp, Homo sapiens
caaaggcctaattctatgcctgt

SEQ ID NO: 3547857 - DNA, 22 bp, Homo sapiens
caaaggctgacagactcactgg

SEQ ID NO: 3547858 - DNA, 14 bp, Homo sapiens
caaagggaaaaaag

SEQ ID NO: 3547859 - DNA, 17 bp, Homo sapiens
caaagggaaagcctctg

SEQ ID NO: 3547860 - DNA, 20 bp, Homo sapiens
caaagggaaagcctctggcc

SEQ ID NO: 3547861 - DNA, 20 bp, Homo sapiens
caaagggccatcgttcatcc

SEQ ID NO: 3547862 - DNA, 19 bp, Homo sapiens
caaaggtgcactccagact

SEQ ID NO: 3547863 - DNA, 23 bp, Homo sapiens
caaaggtgcactccagactctgg

SEQ ID NO: 3547864 - DNA, 24 bp, Homo sapiens
caaaggtggcagcttgtgaagatt

SEQ ID NO: 3547865 - DNA, 15 bp, Homo sapiens
caaaggttgagatgt

SEQ ID NO: 3547866 - DNA, 16 bp, Homo sapiens
caaagtcattaaagac

SEQ ID NO: 3547867 - DNA, 23 bp, Homo sapiens
caaagtctgctctcatataagac

SEQ ID NO: 3547868 - DNA, 14 bp, Homo sapiens
caaagtgacaaagc

SEQ ID NO: 3547869 - DNA, 22 bp, Homo sapiens
caaagtgtattaggaagtgttt

SEQ ID NO: 3547870 - DNA, 19 bp, Homo sapiens
caaagtgtggtctctggaa

SEQ ID NO: 3547871 - DNA, 19 bp, Homo sapiens
caaagttaatgggatggtc

SEQ ID NO: 3547872 - DNA, 12 bp, Homo sapiens
caaagtttcaat

SEQ ID NO: 3547873 - DNA, 16 bp, Homo sapiens
caaagtttcaatttgt

SEQ ID NO: 3547874 - DNA, 16 bp, Homo sapiens
caaataaacttacaga

SEQ ID NO: 3547875 - DNA, 17 bp, Homo sapiens
caaataaataattttca

SEQ ID NO: 3547876 - DNA, 15 bp, Homo sapiens
caaataaatttctgg

SEQ ID NO: 3547877 - DNA, 14 bp, Homo sapiens
caaatacaatcagc

SEQ ID NO: 3547878 - DNA, 18 bp, Homo sapiens
caaatagattcagagaaa

SEQ ID NO: 3547879 - DNA, 19 bp, Homo sapiens
caaatagattcagagaaat

SEQ ID NO: 3547880 - DNA, 21 bp, Homo sapiens
caaatatgagtacaaatgcct

SEQ ID NO: 3547881 - DNA, 23 bp, Homo sapiens
caaatatgagtacaaatgcctta

SEQ ID NO: 3547882 - DNA, 21 bp, Homo sapiens
caaatatgttaaagtttaagt

SEQ ID NO: 3547883 - DNA, 12 bp, Homo sapiens
caaatatttatt

SEQ ID NO: 3547884 - DNA, 13 bp, Homo sapiens
caaatcaaggata

SEQ ID NO: 3547885 - DNA, 17 bp, Homo sapiens
caaatcaaggataaata

SEQ ID NO: 3547886 - DNA, 12 bp, Homo sapiens
caaatccagtgg

SEQ ID NO: 3547887 - DNA, 14 bp, Homo sapiens
caaatccagtggtg

SEQ ID NO: 3547888 - DNA, 16 bp, Homo sapiens
caaatccagtggtggg

SEQ ID NO: 3547889 - DNA, 23 bp, Homo sapiens
caaatcctagactgctcctgggc

SEQ ID NO: 3547890 - DNA, 15 bp, Homo sapiens
caaatctgacatatt

SEQ ID NO: 3547891 - DNA, 16 bp, Homo sapiens
caaatcttgaatttct

SEQ ID NO: 3547892 - DNA, 13 bp, Homo sapiens
caaatctttaaga

SEQ ID NO: 3547893 - DNA, 15 bp, Homo sapiens
caaatctttaagaat

SEQ ID NO: 3547894 - DNA, 10 bp, Homo sapiens
caaatgaatt

SEQ ID NO: 3547895 - DNA, 20 bp, Homo sapiens
caaatgaccgagccctggag

SEQ ID NO: 3547896 - DNA, 22 bp, Homo sapiens
caaatgaccgagccctggagag

SEQ ID NO: 3547897 - DNA, 15 bp, Homo sapiens
caaatggggccagat

SEQ ID NO: 3547898 - DNA, 16 bp, Homo sapiens
caaatggggccagatc

SEQ ID NO: 3547899 - DNA, 17 bp, Homo sapiens
caaatggggccagatcc

SEQ ID NO: 3547900 - DNA, 18 bp, Homo sapiens
caaatgtagttttgtata

SEQ ID NO: 3547901 - DNA, 17 bp, Homo sapiens
caaatgttttaaagttt

SEQ ID NO: 3547902 - DNA, 22 bp, Homo sapiens
cagtgcagtttcttttcacatt

SEQ ID NO: 3547903 - DNA, 21 bp, Homo sapiens
cagtgcatcattactgttcca

SEQ ID NO: 3547904 - DNA, 18 bp, Homo sapiens
cagtgcatctcagcccac

SEQ ID NO: 3547905 - DNA, 20 bp, Homo sapiens
cagtgccatccccaccttca

SEQ ID NO: 3547906 - DNA, 20 bp, Homo sapiens
cagtgcccccactgaccaga

SEQ ID NO: 3547907 - DNA, 22 bp, Homo sapiens
cagtgcccccactgaccagaac

SEQ ID NO: 3547908 - DNA, 22 bp, Homo sapiens
cagtgccttcaacaacgtgaga

SEQ ID NO: 3547909 - DNA, 18 bp, Homo sapiens
cagtgcggttcctcatct

SEQ ID NO: 3547910 - DNA, 21 bp, Homo sapiens
cagtggagatcaggagtgaca

SEQ ID NO: 3547911 - DNA, 23 bp, Homo sapiens
cagtggatcttcagaactgccct

SEQ ID NO: 3547912 - DNA, 15 bp, Homo sapiens
cagtggcaggggagc

SEQ ID NO: 3547913 - DNA, 17 bp, Homo sapiens
cagtggcaggggagcag

SEQ ID NO: 3547914 - DNA, 18 bp, Homo sapiens
cagtggcaggggagcagg

SEQ ID NO: 3547915 - DNA, 18 bp, Homo sapiens
cagtggctggtttctgag

SEQ ID NO: 3547916 - DNA, 19 bp, Homo sapiens
cagtgggaatgttctttct

SEQ ID NO: 3547917 - DNA, 16 bp, Homo sapiens
cagtgggacagggcat

SEQ ID NO: 3547918 - DNA, 19 bp, Homo sapiens
cagtgggacagggcatggc

SEQ ID NO: 3547919 - DNA, 18 bp, Homo sapiens
cagtgggcgttgggagcc

SEQ ID NO: 3547920 - DNA, 18 bp, Homo sapiens
cagtggtgggtaattgta

SEQ ID NO: 3547921 - DNA, 20 bp, Homo sapiens
cagtggtgggtaattgtaca

SEQ ID NO: 3547922 - DNA, 23 bp, Homo sapiens
cagtggtgggtaattgtacaata

SEQ ID NO: 3547923 - DNA, 20 bp, Homo sapiens
cagtgtaaatcccagactga

SEQ ID NO: 3547924 - DNA, 13 bp, Homo sapiens
cagtgtcctttcc

SEQ ID NO: 3547925 - DNA, 15 bp, Homo sapiens
cagtgtgcactaagg

SEQ ID NO: 3547926 - DNA, 17 bp, Homo sapiens
cagtgtgtgaaaattca

SEQ ID NO: 3547927 - DNA, 20 bp, Homo sapiens
cagtgtgtggtcaacatttc

SEQ ID NO: 3547928 - DNA, 19 bp, Homo sapiens
cagtgttatttattcccca

SEQ ID NO: 3547929 - DNA, 17 bp, Homo sapiens
cagtgttcctgaagctg

SEQ ID NO: 3547930 - DNA, 18 bp, Homo sapiens
cagtgttcctgaagctgc

SEQ ID NO: 3547931 - DNA, 19 bp, Homo sapiens
cagtgttcctgaagctgct

SEQ ID NO: 3547932 - DNA, 22 bp, Homo sapiens
cagtgttcctgaagctgctgtg

SEQ ID NO: 3547933 - DNA, 23 bp, Homo sapiens
cagtgttcctgaagctgctgtgt

SEQ ID NO: 3547934 - DNA, 18 bp, Homo sapiens
cagtgttccttgtgcccg

SEQ ID NO: 3547935 - DNA, 19 bp, Homo sapiens
cagtgttgcgtttttcctt

SEQ ID NO: 3547936 - DNA, 19 bp, Homo sapiens
cagtgtttccctctgtgtt

SEQ ID NO: 3547937 - DNA, 20 bp, Homo sapiens
cagtgtttccctctgtgtta

SEQ ID NO: 3547938 - DNA, 24 bp, Homo sapiens
cagttaactattgcatttatatgt

SEQ ID NO: 3547939 - DNA, 12 bp, Homo sapiens
cagttaattttt

SEQ ID NO: 3547940 - DNA, 14 bp, Homo sapiens
cagttcaagaaagc

SEQ ID NO: 3547941 - DNA, 13 bp, Homo sapiens
cagttcaccctga

SEQ ID NO: 3547942 - DNA, 22 bp, Homo sapiens
cagttcagaatggcagtcctgg

SEQ ID NO: 3547943 - DNA, 19 bp, Homo sapiens
cagttcatcaccatttcct

SEQ ID NO: 3547944 - DNA, 23 bp, Homo sapiens
cagttcatcaccatttcctcctt

SEQ ID NO: 3547945 - DNA, 15 bp, Homo sapiens
cagttcattctacca

SEQ ID NO: 3547946 - DNA, 14 bp, Homo sapiens
cagttcctgtccca

SEQ ID NO: 3547947 - DNA, 21 bp, Homo sapiens
cagttcctgtcccacatggcc

SEQ ID NO: 3547948 - DNA, 19 bp, Homo sapiens
cagttctaggcctttcctc

SEQ ID NO: 3547949 - DNA, 15 bp, Homo sapiens
cagttctgaataact

SEQ ID NO: 3547950 - DNA, 20 bp, Homo sapiens
cagttctgacgctgacaata

SEQ ID NO: 3547951 - DNA, 18 bp, Homo sapiens
cagttctgtcatatgtta

SEQ ID NO: 3547952 - DNA, 23 bp, Homo sapiens
cagttctgtgatctgggtctcta

SEQ ID NO: 3547953 - DNA, 17 bp, Homo sapiens
cagttctttgggccaga

SEQ ID NO: 3547954 - DNA, 19 bp, Homo sapiens
cagttctttgggccagaca

SEQ ID NO: 3547955 - DNA, 22 bp, Homo sapiens
cagttctttgggccagacatgc

SEQ ID NO: 3547956 - DNA, 20 bp, Homo sapiens
cagttgatggagccccaggg

SEQ ID NO: 3547957 - DNA, 19 bp, Homo sapiens
cagttgcacttctaagact

SEQ ID NO: 3547958 - DNA, 17 bp, Homo sapiens
cagttggtaacttttgt

SEQ ID NO: 3547959 - DNA, 18 bp, Homo sapiens
cagttgtagcagaaacca

SEQ ID NO: 3547960 - DNA, 13 bp, Homo sapiens
cagttgttattta

SEQ ID NO: 3547961 - DNA, 16 bp, Homo sapiens
cagttgttatttattg

SEQ ID NO: 3547962 - DNA, 14 bp, Homo sapiens
cagtttaagccgca

SEQ ID NO: 3547963 - DNA, 23 bp, Homo sapiens
cagtttaagccgcagacctggag

SEQ ID NO: 3547964 - DNA, 12 bp, Homo sapiens
cagtttacagta

SEQ ID NO: 3547965 - DNA, 14 bp, Homo sapiens
cagtttacagtatt

SEQ ID NO: 3547966 - DNA, 18 bp, Homo sapiens
cagtttacagtatttcta

SEQ ID NO: 3547967 - DNA, 15 bp, Homo sapiens
cagtttcctcagtga

SEQ ID NO: 3547968 - DNA, 22 bp, Homo sapiens
cagtttcttgcttggaagccag

SEQ ID NO: 3547969 - DNA, 23 bp, Homo sapiens
cagtttcttgcttggaagccagg

SEQ ID NO: 3547970 - DNA, 12 bp, Homo sapiens
cagtttgctttg

SEQ ID NO: 3547971 - DNA, 13 bp, Homo sapiens
cagtttggaatta

SEQ ID NO: 3547972 - DNA, 16 bp, Homo sapiens
cagtttgtcttggata

SEQ ID NO: 3547973 - DNA, 18 bp, Homo sapiens
cagttttatagctttatt

SEQ ID NO: 3547974 - DNA, 21 bp, Homo sapiens
cagttttccgaagtctctgat

SEQ ID NO: 3547975 - DNA, 11 bp, Homo sapiens
cagttttcctt

SEQ ID NO: 3547976 - DNA, 14 bp, Homo sapiens
cagttttctgagaa

SEQ ID NO: 3547977 - DNA, 21 bp, Homo sapiens
cagtttttcataagatatttt

SEQ ID NO: 3547978 - DNA, 11 bp, Homo sapiens
cagtttttcct

SEQ ID NO: 3547979 - DNA, 15 bp, Homo sapiens
cataaaagccccagc

SEQ ID NO: 3547980 - DNA, 15 bp, Homo sapiens
cataaaataaataat

SEQ ID NO: 3547981 - DNA, 14 bp, Homo sapiens
cataaacaaagaca

SEQ ID NO: 3547982 - DNA, 15 bp, Homo sapiens
cataaacggttcctg

SEQ ID NO: 3547983 - DNA, 17 bp, Homo sapiens
cataaacggttcctggt

SEQ ID NO: 3547984 - DNA, 20 bp, Homo sapiens
cataaagacaatcactgcca

SEQ ID NO: 3547985 - DNA, 21 bp, Homo sapiens
cataaagacaatcactgccaa

SEQ ID NO: 3547986 - DNA, 16 bp, Homo sapiens
cataaatcatgttgtt

SEQ ID NO: 3547987 - DNA, 12 bp, Homo sapiens
cataaattattt

SEQ ID NO: 3547988 - DNA, 22 bp, Homo sapiens
cataaattatttgattatttaa

SEQ ID NO: 3547989 - DNA, 19 bp, Homo sapiens
cataaattggcctctgtat

SEQ ID NO: 3547990 - DNA, 12 bp, Homo sapiens
cataacctgtct

SEQ ID NO: 3547991 - DNA, 23 bp, Homo sapiens
cataacctgtctcacctggactt

SEQ ID NO: 3547992 - DNA, 22 bp, Homo sapiens
cataacggaaaaataattgcca

SEQ ID NO: 3547993 - DNA, 13 bp, Homo sapiens
cataacggaaagt

SEQ ID NO: 3547994 - DNA, 15 bp, Homo sapiens
cataagagaaacctg

SEQ ID NO: 3547995 - DNA, 15 bp, Homo sapiens
cataagatattttat

SEQ ID NO: 3547996 - DNA, 15 bp, Homo sapiens
cataagtaactttta

SEQ ID NO: 3547997 - DNA, 21 bp, Homo sapiens
cataagtaacttttaaaattt

SEQ ID NO: 3547998 - DNA, 24 bp, Homo sapiens
cataagtaacttttaaaatttgtc

SEQ ID NO: 3547999 - DNA, 19 bp, Homo sapiens
cataagttatgcctctgac

SEQ ID NO: 3548000 - DNA, 16 bp, Homo sapiens
cataataaatcacaca

SEQ ID NO: 3548001 - DNA, 20 bp, Homo sapiens
cataataaatcacacattca

SEQ ID NO: 3548002 - DNA, 14 bp, Homo sapiens
cataatggggtcct

SEQ ID NO: 3548003 - DNA, 16 bp, Homo sapiens
cataatggtactccca

SEQ ID NO: 3548004 - DNA, 20 bp, Homo sapiens
cataatggtactcccaaact

SEQ ID NO: 3548005 - DNA, 21 bp, Homo sapiens
cataatggtactcccaaactg

SEQ ID NO: 3548006 - DNA, 13 bp, Homo sapiens
cataattctgaaa

SEQ ID NO: 3548007 - DNA, 13 bp, Homo sapiens
cataatttaaaaa

SEQ ID NO: 3548008 - DNA, 18 bp, Homo sapiens
cataatttaaaaatatat

SEQ ID NO: 3548009 - DNA, 17 bp, Homo sapiens
catacaaactctcacca

SEQ ID NO: 3548010 - DNA, 17 bp, Homo sapiens
catacaaatttataaag

SEQ ID NO: 3548011 - DNA, 17 bp, Homo sapiens
catacaacagaaaccag

SEQ ID NO: 3548012 - DNA, 13 bp, Homo sapiens
catacaccagcat

SEQ ID NO: 3548013 - DNA, 19 bp, Homo sapiens
catacacctcgtcaagagc

SEQ ID NO: 3548014 - DNA, 20 bp, Homo sapiens
catacaccttgctaacctaa

SEQ ID NO: 3548015 - DNA, 13 bp, Homo sapiens
catacataaaaga

SEQ ID NO: 3548016 - DNA, 14 bp, Homo sapiens
catacataaaagaa

SEQ ID NO: 3548017 - DNA, 18 bp, Homo sapiens
catacataaaagaaataa

SEQ ID NO: 3548018 - DNA, 16 bp, Homo sapiens
cataccattgtggaat

SEQ ID NO: 3548019 - DNA, 16 bp, Homo sapiens
catactgccttgttta

SEQ ID NO: 3548020 - DNA, 12 bp, Homo sapiens
catactgctgga

SEQ ID NO: 3548021 - DNA, 13 bp, Homo sapiens
catacttgaaggg

SEQ ID NO: 3548022 - DNA, 13 bp, Homo sapiens
catacttttcaaa

SEQ ID NO: 3548023 - DNA, 17 bp, Homo sapiens
catagcaagcttttgct

SEQ ID NO: 3548024 - DNA, 13 bp, Homo sapiens
catagctctgggg

SEQ ID NO: 3548025 - DNA, 20 bp, Homo sapiens
catagctctggggtgggcag

SEQ ID NO: 3548026 - DNA, 19 bp, Homo sapiens
cataggctcttaagcagca

SEQ ID NO: 3548027 - DNA, 23 bp, Homo sapiens
catagtaaaatacctctaataaa

SEQ ID NO: 3548028 - DNA, 12 bp, Homo sapiens
catataaatgtt

SEQ ID NO: 3548029 - DNA, 22 bp, Homo sapiens
catataaatgtttatattgttt

SEQ ID NO: 3548030 - DNA, 16 bp, Homo sapiens
catataatgaataaat

SEQ ID NO: 3548031 - DNA, 15 bp, Homo sapiens
catatagaaagcttt

SEQ ID NO: 3548032 - DNA, 17 bp, Homo sapiens
catatagaccaattgaa

SEQ ID NO: 3548033 - DNA, 20 bp, Homo sapiens
catatagaccaattgaagca

SEQ ID NO: 3548034 - DNA, 12 bp, Homo sapiens
catgagaatcta

SEQ ID NO: 3548035 - DNA, 22 bp, Homo sapiens
catgagaatgctagcaggctgt

SEQ ID NO: 3548036 - DNA, 22 bp, Homo sapiens
catgagccactgtgcttggcca

SEQ ID NO: 3548037 - DNA, 20 bp, Homo sapiens
catgagctggcaaccagcca

SEQ ID NO: 3548038 - DNA, 21 bp, Homo sapiens
catgagctggcaaccagccag

SEQ ID NO: 3548039 - DNA, 15 bp, Homo sapiens
catgaggccatctca

SEQ ID NO: 3548040 - DNA, 19 bp, Homo sapiens
catgaggccatctcaggag

SEQ ID NO: 3548041 - DNA, 21 bp, Homo sapiens
catgaggccatctcaggagat

SEQ ID NO: 3548042 - DNA, 17 bp, Homo sapiens
catgagtcaaaacaaag

SEQ ID NO: 3548043 - DNA, 14 bp, Homo sapiens
catgagtggaaata

SEQ ID NO: 3548044 - DNA, 15 bp, Homo sapiens
catgataataggtca

SEQ ID NO: 3548045 - DNA, 16 bp, Homo sapiens
catgataattcagcag

SEQ ID NO: 3548046 - DNA, 20 bp, Homo sapiens
catgatccccgtctctgccc

SEQ ID NO: 3548047 - DNA, 21 bp, Homo sapiens
catgatccccgtctctgccct

SEQ ID NO: 3548048 - DNA, 12 bp, Homo sapiens
catgatgcacag

SEQ ID NO: 3548049 - DNA, 17 bp, Homo sapiens
catgatgcacagtatct

SEQ ID NO: 3548050 - DNA, 18 bp, Homo sapiens
catgatgcacagtatctg

SEQ ID NO: 3548051 - DNA, 15 bp, Homo sapiens
catgatggcaacaga

SEQ ID NO: 3548052 - DNA, 20 bp, Homo sapiens
catgatggcaacagatctgg

SEQ ID NO: 3548053 - DNA, 15 bp, Homo sapiens
catgatgtccttgga

SEQ ID NO: 3548054 - DNA, 15 bp, Homo sapiens
catgatgtgaagagt

SEQ ID NO: 3548055 - DNA, 21 bp, Homo sapiens
catgatgtgaagagtttcaca

SEQ ID NO: 3548056 - DNA, 16 bp, Homo sapiens
catgattcatgccaat

SEQ ID NO: 3548057 - DNA, 16 bp, Homo sapiens
catgattttacaagta

SEQ ID NO: 3548058 - DNA, 21 bp, Homo sapiens
catgcaagtggagctgtctgt

SEQ ID NO: 3548059 - DNA, 13 bp, Homo sapiens
catgcaccttcca

SEQ ID NO: 3548060 - DNA, 14 bp, Homo sapiens
catgcaccttccag

SEQ ID NO: 3548061 - DNA, 23 bp, Homo sapiens
catgcactcacccctagccctgg

SEQ ID NO: 3548062 - DNA, 10 bp, Homo sapiens
catgcactgt

SEQ ID NO: 3548063 - DNA, 18 bp, Homo sapiens
catgcactgtgaaggacc

SEQ ID NO: 3548064 - DNA, 14 bp, Homo sapiens
catgcagaaagcat

SEQ ID NO: 3548065 - DNA, 15 bp, Homo sapiens
catgcagttatatat

SEQ ID NO: 3548066 - DNA, 21 bp, Homo sapiens
catgcagttatatattttgtt

SEQ ID NO: 3548067 - DNA, 12 bp, Homo sapiens
catgcatataat

SEQ ID NO: 3548068 - DNA, 18 bp, Homo sapiens
catgcatataatgaataa

SEQ ID NO: 3548069 - DNA, 20 bp, Homo sapiens
catgccaaccctgggctatt

SEQ ID NO: 3548070 - DNA, 19 bp, Homo sapiens
catgccagtaactgtgctg

SEQ ID NO: 3548071 - DNA, 22 bp, Homo sapiens
catgccctccactccactgcct

SEQ ID NO: 3548072 - DNA, 23 bp, Homo sapiens
catgccctccactccactgcctt

SEQ ID NO: 3548073 - DNA, 13 bp, Homo sapiens
catgccctcctct

SEQ ID NO: 3548074 - DNA, 15 bp, Homo sapiens
catgccctcctctcc

SEQ ID NO: 3548075 - DNA, 17 bp, Homo sapiens
catgccctcctctccca

SEQ ID NO: 3548076 - DNA, 20 bp, Homo sapiens
catgccctcctctcccattg

SEQ ID NO: 3548077 - DNA, 18 bp, Homo sapiens
catgccctctctcgggag

SEQ ID NO: 3548078 - DNA, 15 bp, Homo sapiens
catgcgtcaggggcc

SEQ ID NO: 3548079 - DNA, 16 bp, Homo sapiens
catgcgtcaggggcct

SEQ ID NO: 3548080 - DNA, 18 bp, Homo sapiens
catgctagtgttgtattt

SEQ ID NO: 3548081 - DNA, 19 bp, Homo sapiens
catgctagtgttgtatttc

SEQ ID NO: 3548082 - DNA, 16 bp, Homo sapiens
catgctatctctgtgt

SEQ ID NO: 3548083 - DNA, 13 bp, Homo sapiens
catgctcaacccc

SEQ ID NO: 3548084 - DNA, 21 bp, Homo sapiens
catgctcaacccccctcccag

SEQ ID NO: 3548085 - DNA, 18 bp, Homo sapiens
catgctcacacattacaa

SEQ ID NO: 3548086 - DNA, 22 bp, Homo sapiens
catgctcacacattacaacagt

SEQ ID NO: 3548087 - DNA, 12 bp, Homo sapiens
catgctgcctcc

SEQ ID NO: 3548088 - DNA, 20 bp, Homo sapiens
catgctgcctggcacagacc

SEQ ID NO: 3548089 - DNA, 21 bp, Homo sapiens
catgctgcctggcacagacca

SEQ ID NO: 3548090 - DNA, 22 bp, Homo sapiens
catgctgcctggcacagaccag

SEQ ID NO: 3548091 - DNA, 22 bp, Homo sapiens
catgctgctcccctaaagccag

SEQ ID NO: 3548092 - DNA, 16 bp, Homo sapiens
catgctgctggggaag

SEQ ID NO: 3548093 - DNA, 14 bp, Homo sapiens
catgctgggccact

SEQ ID NO: 3548094 - DNA, 19 bp, Homo sapiens
catgctgggccactgggga

SEQ ID NO: 3548095 - DNA, 20 bp, Homo sapiens
catgctgggccactggggac

SEQ ID NO: 3548096 - DNA, 22 bp, Homo sapiens
cagcctcagaaggccccagaga

SEQ ID NO: 3548097 - DNA, 14 bp, Homo sapiens
cagcctccaagctc

SEQ ID NO: 3548098 - DNA, 18 bp, Homo sapiens
cagcctccatgctgcctc

SEQ ID NO: 3548099 - DNA, 21 bp, Homo sapiens
cagcctccccagtagctggga

SEQ ID NO: 3548100 - DNA, 13 bp, Homo sapiens
cagcctcccctcc

SEQ ID NO: 3548101 - DNA, 21 bp, Homo sapiens
cagcctcccctcccctgggga

SEQ ID NO: 3548102 - DNA, 12 bp, Homo sapiens
cagcctccctga

SEQ ID NO: 3548103 - DNA, 12 bp, Homo sapiens
cagcctccctgt

SEQ ID NO: 3548104 - DNA, 14 bp, Homo sapiens
cagcctccctgtct

SEQ ID NO: 3548105 - DNA, 19 bp, Homo sapiens
cagcctccctgtctccagc

SEQ ID NO: 3548106 - DNA, 20 bp, Homo sapiens
cagcctcctgagtagctgga

SEQ ID NO: 3548107 - DNA, 18 bp, Homo sapiens
cagcctctccgactctgc

SEQ ID NO: 3548108 - DNA, 14 bp, Homo sapiens
cagcctctctggct

SEQ ID NO: 3548109 - DNA, 19 bp, Homo sapiens
cagcctctctggctggtct

SEQ ID NO: 3548110 - DNA, 23 bp, Homo sapiens
cagcctctgacttaagctgcctc

SEQ ID NO: 3548111 - DNA, 11 bp, Homo sapiens
cagcctctgcc

SEQ ID NO: 3548112 - DNA, 15 bp, Homo sapiens
cagcctgactagaac

SEQ ID NO: 3548113 - DNA, 16 bp, Homo sapiens
cagcctgattcggggc

SEQ ID NO: 3548114 - DNA, 12 bp, Homo sapiens
cagcctgcagga

SEQ ID NO: 3548115 - DNA, 17 bp, Homo sapiens
cagcctgctttcctgca

SEQ ID NO: 3548116 - DNA, 20 bp, Homo sapiens
cagcctggcacagggcagtg

SEQ ID NO: 3548117 - DNA, 15 bp, Homo sapiens
cagcctggccagaca

SEQ ID NO: 3548118 - DNA, 18 bp, Homo sapiens
cagcctggccagacacag

SEQ ID NO: 3548119 - DNA, 20 bp, Homo sapiens
cagcctggctgggactggga

SEQ ID NO: 3548120 - DNA, 13 bp, Homo sapiens
cagcctgggagcc

SEQ ID NO: 3548121 - DNA, 20 bp, Homo sapiens
cagcctgggagcccagaggg

SEQ ID NO: 3548122 - DNA, 20 bp, Homo sapiens
cagcctgggcgacaaaaacg

SEQ ID NO: 3548123 - DNA, 19 bp, Homo sapiens
cagcctgtcctgggctggt

SEQ ID NO: 3548124 - DNA, 15 bp, Homo sapiens
cagccttagagctct

SEQ ID NO: 3548125 - DNA, 18 bp, Homo sapiens
cagccttcatcagaactc

SEQ ID NO: 3548126 - DNA, 23 bp, Homo sapiens
cagccttcatcagaactcttcct

SEQ ID NO: 3548127 - DNA, 11 bp, Homo sapiens
cagccttcccc

SEQ ID NO: 3548128 - DNA, 14 bp, Homo sapiens
cagccttcccctcc

SEQ ID NO: 3548129 - DNA, 16 bp, Homo sapiens
cagccttctactgctc

SEQ ID NO: 3548130 - DNA, 19 bp, Homo sapiens
cagccttgcagcggctcct

SEQ ID NO: 3548131 - DNA, 22 bp, Homo sapiens
cagccttgcagcggctcctgca

SEQ ID NO: 3548132 - DNA, 14 bp, Homo sapiens
cagccttgccagag

SEQ ID NO: 3548133 - DNA, 19 bp, Homo sapiens
cagccttgtacagtctgct

SEQ ID NO: 3548134 - DNA, 14 bp, Homo sapiens
cagccttttatgta

SEQ ID NO: 3548135 - DNA, 15 bp, Homo sapiens
cagcgaactctcaga

SEQ ID NO: 3548136 - DNA, 19 bp, Homo sapiens
cagcgaactctcagaaata

SEQ ID NO: 3548137 - DNA, 13 bp, Homo sapiens
cagcgaccccagg

SEQ ID NO: 3548138 - DNA, 13 bp, Homo sapiens
cagcgcagggctg

SEQ ID NO: 3548139 - DNA, 14 bp, Homo sapiens
cagcgcatgtgtgc

SEQ ID NO: 3548140 - DNA, 23 bp, Homo sapiens
cagcgccaaaacaagccaaagag

SEQ ID NO: 3548141 - DNA, 16 bp, Homo sapiens
cagcgccacctggaag

SEQ ID NO: 3548142 - DNA, 12 bp, Homo sapiens
cagcggctcctg

SEQ ID NO: 3548143 - DNA, 14 bp, Homo sapiens
cagcggctcctgca

SEQ ID NO: 3548144 - DNA, 16 bp, Homo sapiens
cagcgtaaaatggtga

SEQ ID NO: 3548145 - DNA, 20 bp, Homo sapiens
cagctaaacaccaacccctg

SEQ ID NO: 3548146 - DNA, 22 bp, Homo sapiens
cagctaaacaccaacccctgac

SEQ ID NO: 3548147 - DNA, 13 bp, Homo sapiens
cagctaagaacct

SEQ ID NO: 3548148 - DNA, 18 bp, Homo sapiens
cagctaagctaggaatga

SEQ ID NO: 3548149 - DNA, 23 bp, Homo sapiens
cagctacaaccctaccctggcag

SEQ ID NO: 3548150 - DNA, 18 bp, Homo sapiens
cagctacacctttctcct

SEQ ID NO: 3548151 - DNA, 21 bp, Homo sapiens
cagctacctcaaccaatgcca

SEQ ID NO: 3548152 - DNA, 16 bp, Homo sapiens
cagctacttggaaggc

SEQ ID NO: 3548153 - DNA, 13 bp, Homo sapiens
cagctagtgcctt

SEQ ID NO: 3548154 - DNA, 20 bp, Homo sapiens
cagctatttcagcctcctgt

SEQ ID NO: 3548155 - DNA, 14 bp, Homo sapiens
cagctcacccctgg

SEQ ID NO: 3548156 - DNA, 13 bp, Homo sapiens
cagctcagccagt

SEQ ID NO: 3548157 - DNA, 23 bp, Homo sapiens
cagctcagccctggcctggctgg

SEQ ID NO: 3548158 - DNA, 17 bp, Homo sapiens
cagctccaacctgcaaa

SEQ ID NO: 3548159 - DNA, 16 bp, Homo sapiens
cagctcccctcggaga

SEQ ID NO: 3548160 - DNA, 19 bp, Homo sapiens
cagctccgggatcagcaac

SEQ ID NO: 3548161 - DNA, 18 bp, Homo sapiens
cagctccgtgtttctcta

SEQ ID NO: 3548162 - DNA, 20 bp, Homo sapiens
cagctccgtgtttctctaag

SEQ ID NO: 3548163 - DNA, 17 bp, Homo sapiens
cagctcctcagcggctc

SEQ ID NO: 3548164 - DNA, 17 bp, Homo sapiens
cagctcctccatgcctg

SEQ ID NO: 3548165 - DNA, 14 bp, Homo sapiens
cagctctagcctct

SEQ ID NO: 3548166 - DNA, 16 bp, Homo sapiens
cagctctagcctctgg

SEQ ID NO: 3548167 - DNA, 20 bp, Homo sapiens
cagctctagcctctggactg

SEQ ID NO: 3548168 - DNA, 21 bp, Homo sapiens
cagctctagcctctggactgg

SEQ ID NO: 3548169 - DNA, 14 bp, Homo sapiens
cagctctgacatcc

SEQ ID NO: 3548170 - DNA, 18 bp, Homo sapiens
cagctctgacatcccttc

SEQ ID NO: 3548171 - DNA, 21 bp, Homo sapiens
cagctctgacatcccttcctg

SEQ ID NO: 3548172 - DNA, 22 bp, Homo sapiens
cagctctgacatcccttcctgg

SEQ ID NO: 3548173 - DNA, 17 bp, Homo sapiens
cagctctggacagcccc

SEQ ID NO: 3548174 - DNA, 23 bp, Homo sapiens
cagctctggacagccccaccctg

SEQ ID NO: 3548175 - DNA, 13 bp, Homo sapiens
cagctctggagaa

SEQ ID NO: 3548176 - DNA, 15 bp, Homo sapiens
cagctctggagaaca

SEQ ID NO: 3548177 - DNA, 17 bp, Homo sapiens
cagctctgtcctcttgg

SEQ ID NO: 3548178 - DNA, 15 bp, Homo sapiens
cagctcttcattcca

SEQ ID NO: 3548179 - DNA, 13 bp, Homo sapiens
cagctcttccagg

SEQ ID NO: 3548180 - DNA, 22 bp, Homo sapiens
cagctcttccagggcagcggct

SEQ ID NO: 3548181 - DNA, 21 bp, Homo sapiens
cagctgaaatatgctggctgg

SEQ ID NO: 3548182 - DNA, 18 bp, Homo sapiens
cagctgaaggcagtggca

SEQ ID NO: 3548183 - DNA, 14 bp, Homo sapiens
cagctgagaggctg

SEQ ID NO: 3548184 - DNA, 23 bp, Homo sapiens
cagctgagcatggagacagcagt

SEQ ID NO: 3548185 - DNA, 16 bp, Homo sapiens
cagctgatgctgtact

SEQ ID NO: 3548186 - DNA, 19 bp, Homo sapiens
cagctgcaaggtactctgg

SEQ ID NO: 3548187 - DNA, 20 bp, Homo sapiens
cagctgcaaggtactctggt

SEQ ID NO: 3548188 - DNA, 22 bp, Homo sapiens
cagctgcaaggtactctggtga

SEQ ID NO: 3548189 - DNA, 16 bp, Homo sapiens
cagctgcaccccttcc

SEQ ID NO: 3548190 - DNA, 20 bp, Homo sapiens
cagctgcaccccttcctggg

SEQ ID NO: 3548191 - DNA, 23 bp, Homo sapiens
cagctgcaccccttcctgggcac

SEQ ID NO: 3548192 - DNA, 18 bp, Homo sapiens
cagctgcactgatgctgc

SEQ ID NO: 3548193 - DNA, 20 bp, Homo sapiens
cagctgccctagctgacccc

SEQ ID NO: 3548194 - DNA, 14 bp, Homo sapiens
cagctgcctcctgc

SEQ ID NO: 3548195 - DNA, 15 bp, Homo sapiens
cagctgcctcctgcg

SEQ ID NO: 3548196 - DNA, 14 bp, Homo sapiens
cagctgcctgggcc

SEQ ID NO: 3548197 - DNA, 15 bp, Homo sapiens
cagctgcctgggccc

SEQ ID NO: 3548198 - DNA, 18 bp, Homo sapiens
cagctgctcctagaggga

SEQ ID NO: 3548199 - DNA, 13 bp, Homo sapiens
cagctgctgtggg

SEQ ID NO: 3548200 - DNA, 20 bp, Homo sapiens
cagctggaaagttgggcccc

SEQ ID NO: 3548201 - DNA, 18 bp, Homo sapiens
cagctggagaaatatggt

SEQ ID NO: 3548202 - DNA, 13 bp, Homo sapiens
cagctggccccca

SEQ ID NO: 3548203 - DNA, 14 bp, Homo sapiens
cagctggcccccag

SEQ ID NO: 3548204 - DNA, 14 bp, Homo sapiens
cacaagtggtggta

SEQ ID NO: 3548205 - DNA, 16 bp, Homo sapiens
cacaatgttggagcag

SEQ ID NO: 3548206 - DNA, 17 bp, Homo sapiens
cacaatgttggagcagc

SEQ ID NO: 3548207 - DNA, 23 bp, Homo sapiens
cacaatgttggagcagcaggcct

SEQ ID NO: 3548208 - DNA, 14 bp, Homo sapiens
cacacagctgagca

SEQ ID NO: 3548209 - DNA, 16 bp, Homo sapiens
cacaccattttgtaaa

SEQ ID NO: 3548210 - DNA, 21 bp, Homo sapiens
cacaccattttgtaaatgaaa

SEQ ID NO: 3548211 - DNA, 20 bp, Homo sapiens
cacacccaccccctctggag

SEQ ID NO: 3548212 - DNA, 19 bp, Homo sapiens
cacacccagtgggaagagt

SEQ ID NO: 3548213 - DNA, 17 bp, Homo sapiens
cacacccctgtcccacc

SEQ ID NO: 3548214 - DNA, 17 bp, Homo sapiens
cacacctgaacttgcct

SEQ ID NO: 3548215 - DNA, 23 bp, Homo sapiens
cacacctgaatcagctggacata

SEQ ID NO: 3548216 - DNA, 12 bp, Homo sapiens
cacacctggcct

SEQ ID NO: 3548217 - DNA, 23 bp, Homo sapiens
cacacctggtggatacctggttg

SEQ ID NO: 3548218 - DNA, 13 bp, Homo sapiens
cacaccttgcaga

SEQ ID NO: 3548219 - DNA, 14 bp, Homo sapiens
cacaccttggagaa

SEQ ID NO: 3548220 - DNA, 20 bp, Homo sapiens
cacacgatgttgtcaaggat

SEQ ID NO: 3548221 - DNA, 12 bp, Homo sapiens
cacacgctgcct

SEQ ID NO: 3548222 - DNA, 13 bp, Homo sapiens
cacacgctgcctt

SEQ ID NO: 3548223 - DNA, 13 bp, Homo sapiens
cagcccctgcaca

SEQ ID NO: 3548224 - DNA, 15 bp, Homo sapiens
cagcccgtgtccagg

SEQ ID NO: 3548225 - DNA, 15 bp, Homo sapiens
cagccctccctgccc

SEQ ID NO: 3548226 - DNA, 22 bp, Homo sapiens
cagccctccctgcccctccctt

SEQ ID NO: 3548227 - DNA, 18 bp, Homo sapiens
cagccctcctctgcactc

SEQ ID NO: 3548228 - DNA, 13 bp, Homo sapiens
cagccctgcacca

SEQ ID NO: 3548229 - DNA, 23 bp, Homo sapiens
cagccctgcaccatgctgctggg

SEQ ID NO: 3548230 - DNA, 20 bp, Homo sapiens
cagccctgctttgggctgcc

SEQ ID NO: 3548231 - DNA, 22 bp, Homo sapiens
cagccctgctttgggctgccct

SEQ ID NO: 3548232 - DNA, 23 bp, Homo sapiens
cagccctgctttgggctgccctg

SEQ ID NO: 3548233 - DNA, 23 bp, Homo sapiens
cagcccttatgcggttaattttg

SEQ ID NO: 3548234 - DNA, 15 bp, Homo sapiens
cagcccttccctggc

SEQ ID NO: 3548235 - DNA, 16 bp, Homo sapiens
cagcccttccctggcc

SEQ ID NO: 3548236 - DNA, 14 bp, Homo sapiens
cagccgcagagaaa

SEQ ID NO: 3548237 - DNA, 15 bp, Homo sapiens
cagccgcagagaaat

SEQ ID NO: 3548238 - DNA, 18 bp, Homo sapiens
cagccgccagctgggagc

SEQ ID NO: 3548239 - DNA, 15 bp, Homo sapiens
cagccggtcagagga

SEQ ID NO: 3548240 - DNA, 16 bp, Homo sapiens
cagccgtattttacat

SEQ ID NO: 3548241 - DNA, 19 bp, Homo sapiens
cagcctaagaagaaggcca

SEQ ID NO: 3548242 - DNA, 23 bp, Homo sapiens
cagcctaccgctggccctgccgt

SEQ ID NO: 3548243 - DNA, 14 bp, Homo sapiens
cccactgaccagaa

SEQ ID NO: 3548244 - DNA, 13 bp, Homo sapiens
cccactgctcccc

SEQ ID NO: 3548245 - DNA, 14 bp, Homo sapiens
cccactgctgagct

SEQ ID NO: 3548246 - DNA, 17 bp, Homo sapiens
cccacttctggccacat

SEQ ID NO: 3548247 - DNA, 21 bp, Homo sapiens
cccactttcatctaccttttc

SEQ ID NO: 3548248 - DNA, 20 bp, Homo sapiens
cccagaaagcctcctgcccc

SEQ ID NO: 3548249 - DNA, 14 bp, Homo sapiens
cccagaacccacat

SEQ ID NO: 3548250 - DNA, 20 bp, Homo sapiens
cccagaatgagacatccagc

SEQ ID NO: 3548251 - DNA, 18 bp, Homo sapiens
cccagaatgcctcctgca

SEQ ID NO: 3548252 - DNA, 15 bp, Homo sapiens
cccagaatggagcct

SEQ ID NO: 3548253 - DNA, 17 bp, Homo sapiens
cccagaatggagcctgc

SEQ ID NO: 3548254 - DNA, 20 bp, Homo sapiens
cccagaatggagcctgctct

SEQ ID NO: 3548255 - DNA, 21 bp, Homo sapiens
cccagaatggagcctgctctc

SEQ ID NO: 3548256 - DNA, 20 bp, Homo sapiens
cccagaatttaccatcatct

SEQ ID NO: 3548257 - DNA, 14 bp, Homo sapiens
cccagacaggccct

SEQ ID NO: 3548258 - DNA, 17 bp, Homo sapiens
cccagactactattttc

SEQ ID NO: 3548259 - DNA, 22 bp, Homo sapiens
cccagactactattttcttttt

SEQ ID NO: 3548260 - DNA, 12 bp, Homo sapiens
cccagactcaga

SEQ ID NO: 3548261 - DNA, 19 bp, Homo sapiens
cccagactgtctccacggc

SEQ ID NO: 3548262 - DNA, 18 bp, Homo sapiens
cccagagacatacttgaa

SEQ ID NO: 3548263 - DNA, 23 bp, Homo sapiens
cccagagacatacttgaagggcc

SEQ ID NO: 3548264 - DNA, 18 bp, Homo sapiens
cccagagacctcatcagc

SEQ ID NO: 3548265 - DNA, 18 bp, Homo sapiens
cccagagagaccctgcaa

SEQ ID NO: 3548266 - DNA, 18 bp, Homo sapiens
cccagagccacctggatc

SEQ ID NO: 3548267 - DNA, 9 bp, Homo sapiens
cccagagct

SEQ ID NO: 3548268 - DNA, 13 bp, Homo sapiens
cccagagctgtgc

SEQ ID NO: 3548269 - DNA, 15 bp, Homo sapiens
cccagagctgtgcca

SEQ ID NO: 3548270 - DNA, 18 bp, Homo sapiens
cccagagctgtgccagca

SEQ ID NO: 3548271 - DNA, 14 bp, Homo sapiens
cccagaggccctgg

SEQ ID NO: 3548272 - DNA, 16 bp, Homo sapiens
cccagaggccctggag

SEQ ID NO: 3548273 - DNA, 18 bp, Homo sapiens
cccagcaacgcccctcca

SEQ ID NO: 3548274 - DNA, 19 bp, Homo sapiens
cccagcaagacctcatctg

SEQ ID NO: 3548275 - DNA, 20 bp, Homo sapiens
cccagcacaaagcagatcct

SEQ ID NO: 3548276 - DNA, 16 bp, Homo sapiens
cccagcaccccttcct

SEQ ID NO: 3548277 - DNA, 21 bp, Homo sapiens
cccagcatcgcactctggcag

SEQ ID NO: 3548278 - DNA, 19 bp, Homo sapiens
cccagcatctcccagcaag

SEQ ID NO: 3548279 - DNA, 23 bp, Homo sapiens
cccagcatgcaccacgggcccgg

SEQ ID NO: 3548280 - DNA, 14 bp, Homo sapiens
cccagccaggctcc

SEQ ID NO: 3548281 - DNA, 10 bp, Homo sapiens
cccagcccag

SEQ ID NO: 3548282 - DNA, 12 bp, Homo sapiens
cccagcccagag

SEQ ID NO: 3548283 - DNA, 14 bp, Homo sapiens
cccagcccagagac

SEQ ID NO: 3548284 - DNA, 16 bp, Homo sapiens
cccagcccagagacat

SEQ ID NO: 3548285 - DNA, 21 bp, Homo sapiens
cccagccctgggaaccactcc

SEQ ID NO: 3548286 - DNA, 22 bp, Homo sapiens
cccagccctgggaaccactccc

SEQ ID NO: 3548287 - DNA, 23 bp, Homo sapiens
cccagccctgggaaccactccca

SEQ ID NO: 3548288 - DNA, 17 bp, Homo sapiens
cccagcctccctgaagc

SEQ ID NO: 3548289 - DNA, 12 bp, Homo sapiens
cccagcctgact

SEQ ID NO: 3548290 - DNA, 23 bp, Homo sapiens
cccagcctgactagaactcctgt

SEQ ID NO: 3548291 - DNA, 18 bp, Homo sapiens
cccagcctgggagcccag

SEQ ID NO: 3548292 - DNA, 17 bp, Homo sapiens
cccagctaagaacctgg

SEQ ID NO: 3548293 - DNA, 19 bp, Homo sapiens
cccagctaagaacctggaa

SEQ ID NO: 3548294 - DNA, 22 bp, Homo sapiens
cccagctaagaacctggaactt

SEQ ID NO: 3548295 - DNA, 22 bp, Homo sapiens
cccagctacctcaaccaatgcc

SEQ ID NO: 3548296 - DNA, 21 bp, Homo sapiens
cccagctatggttctctcgca

SEQ ID NO: 3548297 - DNA, 12 bp, Homo sapiens
cccagctccagc

SEQ ID NO: 3548298 - DNA, 20 bp, Homo sapiens
cccagctctagcctctggac

SEQ ID NO: 3548299 - DNA, 21 bp, Homo sapiens
cccagctctagcctctggact

SEQ ID NO: 3548300 - DNA, 12 bp, Homo sapiens
cccagctctgcg

SEQ ID NO: 3548301 - DNA, 20 bp, Homo sapiens
cccagctgcaccccttcctg

SEQ ID NO: 3548302 - DNA, 15 bp, Homo sapiens
cccagcttggctcac

SEQ ID NO: 3548303 - DNA, 21 bp, Homo sapiens
cccagctttccctgccaggcc

SEQ ID NO: 3548304 - DNA, 20 bp, Homo sapiens
cccaggaccagctcaggaca

SEQ ID NO: 3548305 - DNA, 21 bp, Homo sapiens
cccaggaccagctcaggacag

SEQ ID NO: 3548306 - DNA, 13 bp, Homo sapiens
cccaggaccctga

SEQ ID NO: 3548307 - DNA, 16 bp, Homo sapiens
cccaggagacagacca

SEQ ID NO: 3548308 - DNA, 13 bp, Homo sapiens
cccaggcagcctc

SEQ ID NO: 3548309 - DNA, 12 bp, Homo sapiens
cccaggcagcta

SEQ ID NO: 3548310 - DNA, 20 bp, Homo sapiens
cccaggcagctatttcagcc

SEQ ID NO: 3548311 - DNA, 18 bp, Homo sapiens
cccaggcgccccttcccc

SEQ ID NO: 3548312 - DNA, 14 bp, Homo sapiens
cccagggagctctg

SEQ ID NO: 3548313 - DNA, 15 bp, Homo sapiens
cccagggagctctgg

SEQ ID NO: 3548314 - DNA, 16 bp, Homo sapiens
cccagggagctctggg

SEQ ID NO: 3548315 - DNA, 14 bp, Homo sapiens
cccagggcccagag

SEQ ID NO: 3548316 - DNA, 15 bp, Homo sapiens
cccagggcccagagc

SEQ ID NO: 3548317 - DNA, 14 bp, Homo sapiens
cccagggcctccag

SEQ ID NO: 3548318 - DNA, 17 bp, Homo sapiens
cccagggcctccagggc

SEQ ID NO: 3548319 - DNA, 14 bp, Homo sapiens
cccagggctggaga

SEQ ID NO: 3548320 - DNA, 14 bp, Homo sapiens
cccaggggagccct

SEQ ID NO: 3548321 - DNA, 17 bp, Homo sapiens
cccaggtgcagccccag

SEQ ID NO: 3548322 - DNA, 15 bp, Homo sapiens
cccaggtggcctgga

SEQ ID NO: 3548323 - DNA, 19 bp, Homo sapiens
cccaggttcccccagcaag

SEQ ID NO: 3548324 - DNA, 21 bp, Homo sapiens
cccagtcccacactgtggcca

SEQ ID NO: 3548325 - DNA, 18 bp, Homo sapiens
cccagtcggccccatctc

SEQ ID NO: 3548326 - DNA, 13 bp, Homo sapiens
cccagtctttctt

SEQ ID NO: 3548327 - DNA, 14 bp, Homo sapiens
cccagtgaagcctc

SEQ ID NO: 3548328 - DNA, 15 bp, Homo sapiens
cccagtgacaacatc

SEQ ID NO: 3548329 - DNA, 13 bp, Homo sapiens
cccagtgactcca

SEQ ID NO: 3548330 - DNA, 13 bp, Homo sapiens
cccagtgccagca

SEQ ID NO: 3548331 - DNA, 15 bp, Homo sapiens
cccagtgccagcaag

SEQ ID NO: 3548332 - DNA, 21 bp, Homo sapiens
cccagtgcggttcctcatctg

SEQ ID NO: 3548333 - DNA, 20 bp, Homo sapiens
cccagtgtgagaccccaaag

SEQ ID NO: 3548334 - DNA, 21 bp, Homo sapiens
cccagtgtgagaccccaaaga

SEQ ID NO: 3548335 - DNA, 21 bp, Homo sapiens
cccagtgttatttattcccca

SEQ ID NO: 3548336 - DNA, 20 bp, Homo sapiens
cccataaaatgatcctgcca

SEQ ID NO: 3548337 - DNA, 22 bp, Homo sapiens
cccataattttttttttccttt

SEQ ID NO: 3548338 - DNA, 23 bp, Homo sapiens
cccataattttttttttcctttt

SEQ ID NO: 3548339 - DNA, 19 bp, Homo sapiens
cccatatataaattattac

SEQ ID NO: 3548340 - DNA, 14 bp, Homo sapiens
cccatccaaccact

SEQ ID NO: 3548341 - DNA, 16 bp, Homo sapiens
cccatccagccagacc

SEQ ID NO: 3548342 - DNA, 14 bp, Homo sapiens
cccatccctgcctg

SEQ ID NO: 3548343 - DNA, 17 bp, Homo sapiens
cccatccctgcctggag

SEQ ID NO: 3548344 - DNA, 14 bp, Homo sapiens
cccatcctagaggc

SEQ ID NO: 3548345 - DNA, 18 bp, Homo sapiens
cccatcctccagcaggga

SEQ ID NO: 3548346 - DNA, 16 bp, Homo sapiens
cccatcctggggcagc

SEQ ID NO: 3548347 - DNA, 12 bp, Homo sapiens
ccatcgccggga

SEQ ID NO: 3548348 - DNA, 22 bp, Homo sapiens
ccatcgccgggactccagaacc

SEQ ID NO: 3548349 - DNA, 15 bp, Homo sapiens
ccatcggccaagaat

SEQ ID NO: 3548350 - DNA, 18 bp, Homo sapiens
ccatctcaaaacaaaaca

SEQ ID NO: 3548351 - DNA, 14 bp, Homo sapiens
ccatctcaggagat

SEQ ID NO: 3548352 - DNA, 23 bp, Homo sapiens
ccatctcaggagatggagggctt

SEQ ID NO: 3548353 - DNA, 15 bp, Homo sapiens
ccatctgctgcagtt

SEQ ID NO: 3548354 - DNA, 18 bp, Homo sapiens
ccatcttctttcttccac

SEQ ID NO: 3548355 - DNA, 16 bp, Homo sapiens
ccatcttgagccacag

SEQ ID NO: 3548356 - DNA, 15 bp, Homo sapiens
ccatctttagcagtt

SEQ ID NO: 3548357 - DNA, 17 bp, Homo sapiens
ccatctttagcagtttc

SEQ ID NO: 3548358 - DNA, 21 bp, Homo sapiens
ccatctttagcagtttcctca

SEQ ID NO: 3548359 - DNA, 14 bp, Homo sapiens
ccatgatgcacagt

SEQ ID NO: 3548360 - DNA, 13 bp, Homo sapiens
ccatgatgtatat

SEQ ID NO: 3548361 - DNA, 14 bp, Homo sapiens
ccatgatgtatatc

SEQ ID NO: 3548362 - DNA, 15 bp, Homo sapiens
ccatgcactgtgaag

SEQ ID NO: 3548363 - DNA, 19 bp, Homo sapiens
ccatgcactgtgaaggacc

SEQ ID NO: 3548364 - DNA, 11 bp, Homo sapiens
ccatgcagaaa

SEQ ID NO: 3548365 - DNA, 20 bp, Homo sapiens
ccatgcatttcataaactaa

SEQ ID NO: 3548366 - DNA, 15 bp, Homo sapiens
ccatgcctcctcagg

SEQ ID NO: 3548367 - DNA, 16 bp, Homo sapiens
ccatgcctcctcagga

SEQ ID NO: 3548368 - DNA, 23 bp, Homo sapiens
ccatgctcaacccccctcccaga

SEQ ID NO: 3548369 - DNA, 17 bp, Homo sapiens
ccatgctgccttcaggg

SEQ ID NO: 3548370 - DNA, 18 bp, Homo sapiens
ccatgctgccttcaggga

SEQ ID NO: 3548371 - DNA, 18 bp, Homo sapiens
ccatgcttgcctgaagct

SEQ ID NO: 3548372 - DNA, 18 bp, Homo sapiens
ccatggaattccctcctg

SEQ ID NO: 3548373 - DNA, 19 bp, Homo sapiens
ccatggaattccctcctga

SEQ ID NO: 3548374 - DNA, 16 bp, Homo sapiens
ccatggagcctacctc

SEQ ID NO: 3548375 - DNA, 14 bp, Homo sapiens
ccatggcagctcct

SEQ ID NO: 3548376 - DNA, 15 bp, Homo sapiens
ccatggcagctcctg

SEQ ID NO: 3548377 - DNA, 19 bp, Homo sapiens
ccatggccatttctgtgga

SEQ ID NO: 3548378 - DNA, 17 bp, Homo sapiens
ccatgggaggctggagt

SEQ ID NO: 3548379 - DNA, 16 bp, Homo sapiens
ccatgggcacagtggt

SEQ ID NO: 3548380 - DNA, 15 bp, Homo sapiens
ccatgggctgtgtcc

SEQ ID NO: 3548381 - DNA, 19 bp, Homo sapiens
ccatggtactgtagcaggg

SEQ ID NO: 3548382 - DNA, 16 bp, Homo sapiens
ccatgtcgcctctgca

SEQ ID NO: 3548383 - DNA, 17 bp, Homo sapiens
ccatgtcgcctctgcat

SEQ ID NO: 3548384 - DNA, 13 bp, Homo sapiens
ccatgtgcctttc

SEQ ID NO: 3548385 - DNA, 23 bp, Homo sapiens
ccatgtgcctttctttgcctctg

SEQ ID NO: 3548386 - DNA, 16 bp, Homo sapiens
ccatgtgtacattctg

SEQ ID NO: 3548387 - DNA, 23 bp, Homo sapiens
ccatgttggccaggctggtctca

SEQ ID NO: 3548388 - DNA, 20 bp, Homo sapiens
ccatgttgtaatgctgcact

SEQ ID NO: 3548389 - DNA, 13 bp, Homo sapiens
ccattatatttat

SEQ ID NO: 3548390 - DNA, 18 bp, Homo sapiens
ccattcacaagcctcctg

SEQ ID NO: 3548391 - DNA, 23 bp, Homo sapiens
ccattcacaagcctcctgtacct

SEQ ID NO: 3548392 - DNA, 16 bp, Homo sapiens
ccattccaaagcttta

SEQ ID NO: 3548393 - DNA, 13 bp, Homo sapiens
ccattcctgaaga

SEQ ID NO: 3548394 - DNA, 13 bp, Homo sapiens
ccattcctgcctt

SEQ ID NO: 3548395 - DNA, 15 bp, Homo sapiens
ccattctattctcca

SEQ ID NO: 3548396 - DNA, 17 bp, Homo sapiens
ccattctattttagaat

SEQ ID NO: 3548397 - DNA, 17 bp, Homo sapiens
ccattctgttttccccc

SEQ ID NO: 3548398 - DNA, 19 bp, Homo sapiens
ccattctgttttcccccag

SEQ ID NO: 3548399 - DNA, 22 bp, Homo sapiens
ccattgacttagaggcaacagg

SEQ ID NO: 3548400 - DNA, 22 bp, Homo sapiens
ccattggttcacctgtgactcc

SEQ ID NO: 3548401 - DNA, 17 bp, Homo sapiens
ccattgtccctctgccc

SEQ ID NO: 3548402 - DNA, 22 bp, Homo sapiens
ccattgtccctctgccccatcc

SEQ ID NO: 3548403 - DNA, 22 bp, Homo sapiens
ccatttcaggactctctccagg

SEQ ID NO: 3548404 - DNA, 23 bp, Homo sapiens
ccatttcaggactctctccagga

SEQ ID NO: 3548405 - DNA, 17 bp, Homo sapiens
ccatttctctacactaa

SEQ ID NO: 3548406 - DNA, 13 bp, Homo sapiens
ccatttctttctt

SEQ ID NO: 3548407 - DNA, 16 bp, Homo sapiens
ccatttctttcttcca

SEQ ID NO: 3548408 - DNA, 17 bp, Homo sapiens
ccattttaacgctgcct

SEQ ID NO: 3548409 - DNA, 20 bp, Homo sapiens
ccattttgtaaatgaaactt

SEQ ID NO: 3548410 - DNA, 22 bp, Homo sapiens
ccattttgtaaatgaaacttaa

SEQ ID NO: 3548411 - DNA, 12 bp, Homo sapiens
ccattttgtcag

SEQ ID NO: 3548412 - DNA, 13 bp, Homo sapiens
cccaaaccccctg

SEQ ID NO: 3548413 - DNA, 20 bp, Homo sapiens
cccaaacccttaactgacat

SEQ ID NO: 3548414 - DNA, 18 bp, Homo sapiens
cccaaagactctggaggt

SEQ ID NO: 3548415 - DNA, 19 bp, Homo sapiens
cccaacccctctccaggcc

SEQ ID NO: 3548416 - DNA, 12 bp, Homo sapiens
cccaacctacat

SEQ ID NO: 3548417 - DNA, 23 bp, Homo sapiens
cccaacctgctctcctcttgcca

SEQ ID NO: 3548418 - DNA, 23 bp, Homo sapiens
cccaacgtgcaaagccaaggcag

SEQ ID NO: 3548419 - DNA, 13 bp, Homo sapiens
cccaactggggtt

SEQ ID NO: 3548420 - DNA, 20 bp, Homo sapiens
cccaagaatagatgctgact

SEQ ID NO: 3548421 - DNA, 13 bp, Homo sapiens
cccaagcttccca

SEQ ID NO: 3548422 - DNA, 15 bp, Homo sapiens
cccaagcttcccaac

SEQ ID NO: 3548423 - DNA, 18 bp, Homo sapiens
cccaagcttcccaacaga

SEQ ID NO: 3548424 - DNA, 24 bp, Homo sapiens
cccaaggccactgcgctcttggga

SEQ ID NO: 3548425 - DNA, 17 bp, Homo sapiens
cccaaggctctgagcaa

SEQ ID NO: 3548426 - DNA, 15 bp, Homo sapiens
cccaagggggctgct

SEQ ID NO: 3548427 - DNA, 18 bp, Homo sapiens
cccaagggggctgctgct

SEQ ID NO: 3548428 - DNA, 22 bp, Homo sapiens
cccaagggggctgctgctcctc

SEQ ID NO: 3548429 - DNA, 23 bp, Homo sapiens
cccaaggtgaggtgaactccagg

SEQ ID NO: 3548430 - DNA, 16 bp, Homo sapiens
cccaagttagttcaat

SEQ ID NO: 3548431 - DNA, 17 bp, Homo sapiens
cccaatgctgcttttgg

SEQ ID NO: 3548432 - DNA, 14 bp, Homo sapiens
cccaatgtttaaaa

SEQ ID NO: 3548433 - DNA, 16 bp, Homo sapiens
cccacaaactccaggc

SEQ ID NO: 3548434 - DNA, 17 bp, Homo sapiens
cccacaaactccaggct

SEQ ID NO: 3548435 - DNA, 23 bp, Homo sapiens
cccacaaactccaggctggaagt

SEQ ID NO: 3548436 - DNA, 16 bp, Homo sapiens
cccacaagctgtccct

SEQ ID NO: 3548437 - DNA, 17 bp, Homo sapiens
cccacaagctgtccctg

SEQ ID NO: 3548438 - DNA, 18 bp, Homo sapiens
cccacaaggaaccctcag

SEQ ID NO: 3548439 - DNA, 20 bp, Homo sapiens
cccacaagtggtggtaaccc

SEQ ID NO: 3548440 - DNA, 23 bp, Homo sapiens
cccacaagtggtggtaaccctgg

SEQ ID NO: 3548441 - DNA, 22 bp, Homo sapiens
cccacacagctgccctagctga

SEQ ID NO: 3548442 - DNA, 13 bp, Homo sapiens
cccacacctggtg

SEQ ID NO: 3548443 - DNA, 21 bp, Homo sapiens
catgctgggccactggggact

SEQ ID NO: 3548444 - DNA, 14 bp, Homo sapiens
catgctgttattta

SEQ ID NO: 3548445 - DNA, 17 bp, Homo sapiens
catgcttgcctgaagct

SEQ ID NO: 3548446 - DNA, 21 bp, Homo sapiens
catgcttgggctgacccagca

SEQ ID NO: 3548447 - DNA, 22 bp, Homo sapiens
catgcttgggctgacccagcat

SEQ ID NO: 3548448 - DNA, 23 bp, Homo sapiens
catgcttgggctgacccagcatc

SEQ ID NO: 3548449 - DNA, 13 bp, Homo sapiens
catggaaaaatgg

SEQ ID NO: 3548450 - DNA, 14 bp, Homo sapiens
catggaaaaatggt

SEQ ID NO: 3548451 - DNA, 23 bp, Homo sapiens
catggaaaaatggttgatggaaa

SEQ ID NO: 3548452 - DNA, 14 bp, Homo sapiens
catggaacagtgta

SEQ ID NO: 3548453 - DNA, 23 bp, Homo sapiens
catggaacagtgtaaatcccaga

SEQ ID NO: 3548454 - DNA, 20 bp, Homo sapiens
catggagaatgggacgagga

SEQ ID NO: 3548455 - DNA, 15 bp, Homo sapiens
catggagacagcagt

SEQ ID NO: 3548456 - DNA, 11 bp, Homo sapiens
catggagccta

SEQ ID NO: 3548457 - DNA, 21 bp, Homo sapiens
catggagcctacctctgtctg

SEQ ID NO: 3548458 - DNA, 14 bp, Homo sapiens
catggattttccag

SEQ ID NO: 3548459 - DNA, 18 bp, Homo sapiens
catggcagctcctgacct

SEQ ID NO: 3548460 - DNA, 13 bp, Homo sapiens
catggcagctggt

SEQ ID NO: 3548461 - DNA, 12 bp, Homo sapiens
catggcaggagt

SEQ ID NO: 3548462 - DNA, 21 bp, Homo sapiens
catggcaggagtctctgccag

SEQ ID NO: 3548463 - DNA, 17 bp, Homo sapiens
catggcatagccccggc

SEQ ID NO: 3548464 - DNA, 13 bp, Homo sapiens
catggccaggtgg

SEQ ID NO: 3548465 - DNA, 19 bp, Homo sapiens
catggccggctttcaggag

SEQ ID NO: 3548466 - DNA, 20 bp, Homo sapiens
catgggaaatgtcaacaagt

SEQ ID NO: 3548467 - DNA, 23 bp, Homo sapiens
catgggcccttggaaaaacagga

SEQ ID NO: 3548468 - DNA, 11 bp, Homo sapiens
catggggccag

SEQ ID NO: 3548469 - DNA, 13 bp, Homo sapiens
catggggccagga

SEQ ID NO: 3548470 - DNA, 14 bp, Homo sapiens
catggggccaggaa

SEQ ID NO: 3548471 - DNA, 19 bp, Homo sapiens
catggtgccccaggaccag

SEQ ID NO: 3548472 - DNA, 20 bp, Homo sapiens
catggtggaaaacgaagctc

SEQ ID NO: 3548473 - DNA, 19 bp, Homo sapiens
catggtggctcatgcctgt

SEQ ID NO: 3548474 - DNA, 15 bp, Homo sapiens
catggtggggtctcc

SEQ ID NO: 3548475 - DNA, 23 bp, Homo sapiens
catggtggggtctcctcaggacc

SEQ ID NO: 3548476 - DNA, 16 bp, Homo sapiens
catggtgtggggggct

SEQ ID NO: 3548477 - DNA, 13 bp, Homo sapiens
catggttcaagta

SEQ ID NO: 3548478 - DNA, 23 bp, Homo sapiens
catggttcaagtattaagcagtt

SEQ ID NO: 3548479 - DNA, 18 bp, Homo sapiens
catgtaaaaagtgcagta

SEQ ID NO: 3548480 - DNA, 16 bp, Homo sapiens
catgtaaagaaatgtc

SEQ ID NO: 3548481 - DNA, 21 bp, Homo sapiens
catgtaaagaaatgtcttaat

SEQ ID NO: 3548482 - DNA, 15 bp, Homo sapiens
catgtaaataagatg

SEQ ID NO: 3548483 - DNA, 17 bp, Homo sapiens
catgtagactgtgccag

SEQ ID NO: 3548484 - DNA, 16 bp, Homo sapiens
catgtagcatataaat

SEQ ID NO: 3548485 - DNA, 20 bp, Homo sapiens
catgtagcatataaatgttt

SEQ ID NO: 3548486 - DNA, 15 bp, Homo sapiens
catgtataaatgtga

SEQ ID NO: 3548487 - DNA, 16 bp, Homo sapiens
catgtataaatgtgat

SEQ ID NO: 3548488 - DNA, 17 bp, Homo sapiens
catgtataaatgtgata

SEQ ID NO: 3548489 - DNA, 21 bp, Homo sapiens
catgtattgcacattgtaaaa

SEQ ID NO: 3548490 - DNA, 19 bp, Homo sapiens
catgtcaagagtcgctgtg

SEQ ID NO: 3548491 - DNA, 21 bp, Homo sapiens
catgtcaagagtcgctgtgcc

SEQ ID NO: 3548492 - DNA, 21 bp, Homo sapiens
catgtccagtgagcagtgttg

SEQ ID NO: 3548493 - DNA, 22 bp, Homo sapiens
catgtccctaccgagtctcttc

SEQ ID NO: 3548494 - DNA, 14 bp, Homo sapiens
catgtctgcatttc

SEQ ID NO: 3548495 - DNA, 13 bp, Homo sapiens
catgtcttgtcat

SEQ ID NO: 3548496 - DNA, 12 bp, Homo sapiens
catgtgacattt

SEQ ID NO: 3548497 - DNA, 14 bp, Homo sapiens
catgtgacatttat

SEQ ID NO: 3548498 - DNA, 16 bp, Homo sapiens
catgtgaccactctgt

SEQ ID NO: 3548499 - DNA, 16 bp, Homo sapiens
catgtgagtctgggat

SEQ ID NO: 3548500 - DNA, 17 bp, Homo sapiens
catgtgagtctgggata

SEQ ID NO: 3548501 - DNA, 18 bp, Homo sapiens
catgtgagtctgggatat

SEQ ID NO: 3548502 - DNA, 12 bp, Homo sapiens
catgtgcctttc

SEQ ID NO: 3548503 - DNA, 14 bp, Homo sapiens
catgtgcctttctt

SEQ ID NO: 3548504 - DNA, 22 bp, Homo sapiens
catgtgtgcatgtgctgtgtga

SEQ ID NO: 3548505 - DNA, 15 bp, Homo sapiens
catgtgttttcatca

SEQ ID NO: 3548506 - DNA, 19 bp, Homo sapiens
catgttctaccgtggattt

SEQ ID NO: 3548507 - DNA, 16 bp, Homo sapiens
catgttggccaggctg

SEQ ID NO: 3548508 - DNA, 15 bp, Homo sapiens
catgttgtaatgctg

SEQ ID NO: 3548509 - DNA, 19 bp, Homo sapiens
catgttgttgtgtgtatat

SEQ ID NO: 3548510 - DNA, 18 bp, Homo sapiens
catgttttagcatttgta

SEQ ID NO: 3548511 - DNA, 16 bp, Homo sapiens
ccagagaaaggggagc

SEQ ID NO: 3548512 - DNA, 20 bp, Homo sapiens
ccagagaaaggggagcccac

SEQ ID NO: 3548513 - DNA, 14 bp, Homo sapiens
ccagagacctcatc

SEQ ID NO: 3548514 - DNA, 17 bp, Homo sapiens
ccagagagaccctgcaa

SEQ ID NO: 3548515 - DNA, 14 bp, Homo sapiens
ccagagagggaaaa

SEQ ID NO: 3548516 - DNA, 16 bp, Homo sapiens
ccagagagggaaaagg

SEQ ID NO: 3548517 - DNA, 19 bp, Homo sapiens
ccagagagtggagagagca

SEQ ID NO: 3548518 - DNA, 15 bp, Homo sapiens
ccagagagtggctcc

SEQ ID NO: 3548519 - DNA, 14 bp, Homo sapiens
ccagagataaaaat

SEQ ID NO: 3548520 - DNA, 20 bp, Homo sapiens
ccagagatgcctgatttcat

SEQ ID NO: 3548521 - DNA, 13 bp, Homo sapiens
ccagagccacctg

SEQ ID NO: 3548522 - DNA, 18 bp, Homo sapiens
ccagagccacctggatct

SEQ ID NO: 3548523 - DNA, 11 bp, Homo sapiens
ccagagcccag

SEQ ID NO: 3548524 - DNA, 13 bp, Homo sapiens
ccagagcccagct

SEQ ID NO: 3548525 - DNA, 18 bp, Homo sapiens
ccagagcccagctccaag

SEQ ID NO: 3548526 - DNA, 16 bp, Homo sapiens
ccagagccgggaggaa

SEQ ID NO: 3548527 - DNA, 17 bp, Homo sapiens
ccagaggagccaccagt

SEQ ID NO: 3548528 - DNA, 14 bp, Homo sapiens
ccagaggccctgga

SEQ ID NO: 3548529 - DNA, 23 bp, Homo sapiens
ccagaggccctggaggtctccag

SEQ ID NO: 3548530 - DNA, 22 bp, Homo sapiens
ccagaggctcctctcaggctgg

SEQ ID NO: 3548531 - DNA, 16 bp, Homo sapiens
ccagagggttgctggt

SEQ ID NO: 3548532 - DNA, 19 bp, Homo sapiens
ccagagggttgctggtcct

SEQ ID NO: 3548533 - DNA, 15 bp, Homo sapiens
ccagaggtcctccgt

SEQ ID NO: 3548534 - DNA, 19 bp, Homo sapiens
ccagagtccccccactccc

SEQ ID NO: 3548535 - DNA, 21 bp, Homo sapiens
ccagagtccccccactcccag

SEQ ID NO: 3548536 - DNA, 23 bp, Homo sapiens
ccagagtccccccactcccagca

SEQ ID NO: 3548537 - DNA, 13 bp, Homo sapiens
ccagatccagcct

SEQ ID NO: 3548538 - DNA, 14 bp, Homo sapiens
ccagatccagcctg

SEQ ID NO: 3548539 - DNA, 18 bp, Homo sapiens
ccagatgcacatccctgg

SEQ ID NO: 3548540 - DNA, 14 bp, Homo sapiens
ccagcaagacctca

SEQ ID NO: 3548541 - DNA, 20 bp, Homo sapiens
ccagcaaggggaccccgaga

SEQ ID NO: 3548542 - DNA, 21 bp, Homo sapiens
ccagcacatccatcagcaccc

SEQ ID NO: 3548543 - DNA, 20 bp, Homo sapiens
ccagcaccccttcctcgtgg

SEQ ID NO: 3548544 - DNA, 20 bp, Homo sapiens
ccagcactttgggaggccga

SEQ ID NO: 3548545 - DNA, 22 bp, Homo sapiens
ccagcagaggcgtactacccag

SEQ ID NO: 3548546 - DNA, 12 bp, Homo sapiens
ccagcagcatgg

SEQ ID NO: 3548547 - DNA, 16 bp, Homo sapiens
ccagcagctgatgctg

SEQ ID NO: 3548548 - DNA, 23 bp, Homo sapiens
ccagcaggagagactgagcagcc

SEQ ID NO: 3548549 - DNA, 19 bp, Homo sapiens
ccagcaggggggctgtgcc

SEQ ID NO: 3548550 - DNA, 23 bp, Homo sapiens
ccagcaggggggctgtgccaacc

SEQ ID NO: 3548551 - DNA, 12 bp, Homo sapiens
ccagcatccctg

SEQ ID NO: 3548552 - DNA, 23 bp, Homo sapiens
ccagcatccctggagcaggagcc

SEQ ID NO: 3548553 - DNA, 11 bp, Homo sapiens
ccagcatctcc

SEQ ID NO: 3548554 - DNA, 16 bp, Homo sapiens
ccagcatctcccagca

SEQ ID NO: 3548555 - DNA, 18 bp, Homo sapiens
ccagcatgactttcctta

SEQ ID NO: 3548556 - DNA, 13 bp, Homo sapiens
ccagcattccttt

SEQ ID NO: 3548557 - DNA, 18 bp, Homo sapiens
ccagccaaccatcatgtg

SEQ ID NO: 3548558 - DNA, 9 bp, Homo sapiens
ccagccaca

SEQ ID NO: 3548559 - DNA, 12 bp, Homo sapiens
ccagccacagac

SEQ ID NO: 3548560 - DNA, 18 bp, Homo sapiens
ccagccacagacccctgg

SEQ ID NO: 3548561 - DNA, 22 bp, Homo sapiens
ccagccactccccagccagcct

SEQ ID NO: 3548562 - DNA, 19 bp, Homo sapiens
ccagccagcctcagaaggc

SEQ ID NO: 3548563 - DNA, 20 bp, Homo sapiens
ccagccagcgtcccttggtg

SEQ ID NO: 3548564 - DNA, 20 bp, Homo sapiens
ccagccaggccaacagcacc

SEQ ID NO: 3548565 - DNA, 16 bp, Homo sapiens
ccagcccaaacctggg

SEQ ID NO: 3548566 - DNA, 15 bp, Homo sapiens
ccagcccaccccatg

SEQ ID NO: 3548567 - DNA, 18 bp, Homo sapiens
ccagcccaccccatggcc

SEQ ID NO: 3548568 - DNA, 12 bp, Homo sapiens
ccagcccagaga

SEQ ID NO: 3548569 - DNA, 13 bp, Homo sapiens
ccagcccagagac

SEQ ID NO: 3548570 - DNA, 16 bp, Homo sapiens
ccagcccagagccacc

SEQ ID NO: 3548571 - DNA, 12 bp, Homo sapiens
ccagcccagcac

SEQ ID NO: 3548572 - DNA, 14 bp, Homo sapiens
ccagcccagcaccc

SEQ ID NO: 3548573 - DNA, 12 bp, Homo sapiens
ccagcccagcca

SEQ ID NO: 3548574 - DNA, 13 bp, Homo sapiens
ccagcccagccag

SEQ ID NO: 3548575 - DNA, 16 bp, Homo sapiens
ccagcccagccaggcc

SEQ ID NO: 3548576 - DNA, 18 bp, Homo sapiens
ccagcccatttgggcaga

SEQ ID NO: 3548577 - DNA, 13 bp, Homo sapiens
ccagccccaactc

SEQ ID NO: 3548578 - DNA, 12 bp, Homo sapiens
ccagccccttcc

SEQ ID NO: 3548579 - DNA, 21 bp, Homo sapiens
ccagcccggggccagcttggc

SEQ ID NO: 3548580 - DNA, 12 bp, Homo sapiens
ccagccctggga

SEQ ID NO: 3548581 - DNA, 19 bp, Homo sapiens
ccagcccttccctggcccc

SEQ ID NO: 3548582 - DNA, 23 bp, Homo sapiens
ccagcccttccctggccccgccg

SEQ ID NO: 3548583 - DNA, 14 bp, Homo sapiens
ccagccgtatttta

SEQ ID NO: 3548584 - DNA, 15 bp, Homo sapiens
ccagcctcagaaggc

SEQ ID NO: 3548585 - DNA, 19 bp, Homo sapiens
ccagcctcatctctttgtt

SEQ ID NO: 3548586 - DNA, 21 bp, Homo sapiens
ccagcctccaagctccatctc

SEQ ID NO: 3548587 - DNA, 16 bp, Homo sapiens
ccagcctccatgctgc

SEQ ID NO: 3548588 - DNA, 18 bp, Homo sapiens
ccagcctcccctcccctg

SEQ ID NO: 3548589 - DNA, 21 bp, Homo sapiens
ccagcctcccctcccctgggg

SEQ ID NO: 3548590 - DNA, 13 bp, Homo sapiens
ccagcctccctga

SEQ ID NO: 3548591 - DNA, 13 bp, Homo sapiens
ccagcctccctgt

SEQ ID NO: 3548592 - DNA, 14 bp, Homo sapiens
ccagcctccctgtc

SEQ ID NO: 3548593 - DNA, 18 bp, Homo sapiens
ccagcctccctgtctcca

SEQ ID NO: 3548594 - DNA, 23 bp, Homo sapiens
ccagcctccctgtctccagctgc

SEQ ID NO: 3548595 - DNA, 11 bp, Homo sapiens
ccagcctggcc

SEQ ID NO: 3548596 - DNA, 15 bp, Homo sapiens
ccagcctggctctgc

SEQ ID NO: 3548597 - DNA, 13 bp, Homo sapiens
ccagcctgggagc

SEQ ID NO: 3548598 - DNA, 17 bp, Homo sapiens
ccagcctgggagcccag

SEQ ID NO: 3548599 - DNA, 18 bp, Homo sapiens
ccagcctgggagcccaga

SEQ ID NO: 3548600 - DNA, 13 bp, Homo sapiens
ccagcctggggtc

SEQ ID NO: 3548601 - DNA, 15 bp, Homo sapiens
ccagcgctgctggtc

SEQ ID NO: 3548602 - DNA, 17 bp, Homo sapiens
ccagcgggaatggcagc

SEQ ID NO: 3548603 - DNA, 14 bp, Homo sapiens
ccagcgtcccttgg

SEQ ID NO: 3548604 - DNA, 16 bp, Homo sapiens
ccagcgtcccttggtg

SEQ ID NO: 3548605 - DNA, 18 bp, Homo sapiens
ccagctaaacaccaaccc

SEQ ID NO: 3548606 - DNA, 13 bp, Homo sapiens
ccagctaagaacc

SEQ ID NO: 3548607 - DNA, 14 bp, Homo sapiens
ccagctaagaacct

SEQ ID NO: 3548608 - DNA, 19 bp, Homo sapiens
ccagctcacccctggagga

SEQ ID NO: 3548609 - DNA, 23 bp, Homo sapiens
ccagctcagccctggcctggctg

SEQ ID NO: 3548610 - DNA, 13 bp, Homo sapiens
ccagctcaggaca

SEQ ID NO: 3548611 - DNA, 20 bp, Homo sapiens
ccagctccaacctgcaaaga

SEQ ID NO: 3548612 - DNA, 14 bp, Homo sapiens
ccagctccttcgct

SEQ ID NO: 3548613 - DNA, 20 bp, Homo sapiens
ccagctctagcctctggact

SEQ ID NO: 3548614 - DNA, 16 bp, Homo sapiens
ccagctctgacatccc

SEQ ID NO: 3548615 - DNA, 17 bp, Homo sapiens
ccagctctgacatccct

SEQ ID NO: 3548616 - DNA, 17 bp, Homo sapiens
ccagctgaaggcagtgg

SEQ ID NO: 3548617 - DNA, 17 bp, Homo sapiens
ccagctgacagccacac

SEQ ID NO: 3548618 - DNA, 20 bp, Homo sapiens
ccagctgcaccccttcctgg

SEQ ID NO: 3548619 - DNA, 23 bp, Homo sapiens
ccagctgcaccccttcctgggca

SEQ ID NO: 3548620 - DNA, 14 bp, Homo sapiens
ccagctgcactgat

SEQ ID NO: 3548621 - DNA, 18 bp, Homo sapiens
ccagctgcactgatgctg

SEQ ID NO: 3548622 - DNA, 17 bp, Homo sapiens
ccagctgggaagccctt

SEQ ID NO: 3548623 - DNA, 20 bp, Homo sapiens
ccagctgggaagcccttttt

SEQ ID NO: 3548624 - DNA, 17 bp, Homo sapiens
ccagctttccctgccag

SEQ ID NO: 3548625 - DNA, 23 bp, Homo sapiens
ccaggaagggaaagcgggcagcc

SEQ ID NO: 3548626 - DNA, 16 bp, Homo sapiens
ccaggaatttcccagg

SEQ ID NO: 3548627 - DNA, 17 bp, Homo sapiens
ccaggaatttcccagga

SEQ ID NO: 3548628 - DNA, 22 bp, Homo sapiens
ccaggaatttcccaggaccctg

SEQ ID NO: 3548629 - DNA, 23 bp, Homo sapiens
ccaggaatttcccaggaccctga

SEQ ID NO: 3548630 - DNA, 13 bp, Homo sapiens
ccaggaccagctc

SEQ ID NO: 3548631 - DNA, 14 bp, Homo sapiens
ccaggaccagctca

SEQ ID NO: 3548632 - DNA, 15 bp, Homo sapiens
ccaggaccagctcag

SEQ ID NO: 3548633 - DNA, 20 bp, Homo sapiens
ccaggaccagctcaggacag

SEQ ID NO: 3548634 - DNA, 16 bp, Homo sapiens
ccaggaccctgaaggg

SEQ ID NO: 3548635 - DNA, 18 bp, Homo sapiens
ccaggaccctgaaggggc

SEQ ID NO: 3548636 - DNA, 23 bp, Homo sapiens
ccaggaccctgaaggggccatga

SEQ ID NO: 3548637 - DNA, 21 bp, Homo sapiens
ccaggaccctgacctccgccc

SEQ ID NO: 3548638 - DNA, 18 bp, Homo sapiens
ccaggacctcttctggag

SEQ ID NO: 3548639 - DNA, 20 bp, Homo sapiens
ccaggactatatttgggcct

SEQ ID NO: 3548640 - DNA, 21 bp, Homo sapiens
ccaggactatatttgggcctg

SEQ ID NO: 3548641 - DNA, 17 bp, Homo sapiens
ccaggactcccagaacc

SEQ ID NO: 3548642 - DNA, 18 bp, Homo sapiens
ccaggactcccagaacct

SEQ ID NO: 3548643 - DNA, 16 bp, Homo sapiens
ccaggactgtttcaaa

SEQ ID NO: 3548644 - DNA, 16 bp, Homo sapiens
ccaggagacctccagc

SEQ ID NO: 3548645 - DNA, 17 bp, Homo sapiens
ccaggagagagccagga

SEQ ID NO: 3548646 - DNA, 14 bp, Homo sapiens
ccaggagagcctgg

SEQ ID NO: 3548647 - DNA, 17 bp, Homo sapiens
ccaggaggcctgggccg

SEQ ID NO: 3548648 - DNA, 20 bp, Homo sapiens
ccaggattattgtcaaagaa

SEQ ID NO: 3548649 - DNA, 16 bp, Homo sapiens
ccaggcaccacagcct

SEQ ID NO: 3548650 - DNA, 17 bp, Homo sapiens
ccaggcaccacagcctc

SEQ ID NO: 3548651 - DNA, 17 bp, Homo sapiens
ccaggcagaggggcgtt

SEQ ID NO: 3548652 - DNA, 19 bp, Homo sapiens
ccaggcagatccaggacta

SEQ ID NO: 3548653 - DNA, 16 bp, Homo sapiens
ccaggcagggagagag

SEQ ID NO: 3548654 - DNA, 20 bp, Homo sapiens
ccaggcatgtgtctggccct

SEQ ID NO: 3548655 - DNA, 16 bp, Homo sapiens
ccaggccaacagcacc

SEQ ID NO: 3548656 - DNA, 19 bp, Homo sapiens
ccaggccccaccggccagg

SEQ ID NO: 3548657 - DNA, 16 bp, Homo sapiens
ccaggccgcgcccagc

SEQ ID NO: 3548658 - DNA, 19 bp, Homo sapiens
ccaggccgcgcccagcaga

SEQ ID NO: 3548659 - DNA, 22 bp, Homo sapiens
ccaggccgcgcccagcagaggc

SEQ ID NO: 3548660 - DNA, 12 bp, Homo sapiens
ccaggctcagga

SEQ ID NO: 3548661 - DNA, 20 bp, Homo sapiens
ccaggctcaggagaagccag

SEQ ID NO: 3548662 - DNA, 20 bp, Homo sapiens
ccaggctcctacctgtctgc

SEQ ID NO: 3548663 - DNA, 16 bp, Homo sapiens
ccaggctgcctcctgc

SEQ ID NO: 3548664 - DNA, 13 bp, Homo sapiens
ccaggctggaagt

SEQ ID NO: 3548665 - DNA, 14 bp, Homo sapiens
ccaggctggtctca

SEQ ID NO: 3548666 - DNA, 13 bp, Homo sapiens
ccagggacagagg

SEQ ID NO: 3548667 - DNA, 22 bp, Homo sapiens
ccagggacagaggccccagcct

SEQ ID NO: 3548668 - DNA, 17 bp, Homo sapiens
ccagggactatctttgc

SEQ ID NO: 3548669 - DNA, 18 bp, Homo sapiens
ccagggagctctggggac

SEQ ID NO: 3548670 - DNA, 18 bp, Homo sapiens
ccagggatgctgggctgg

SEQ ID NO: 3548671 - DNA, 21 bp, Homo sapiens
ccagggatgctgggctgggcc

SEQ ID NO: 3548672 - DNA, 13 bp, Homo sapiens
ccagggcagcagg

SEQ ID NO: 3548673 - DNA, 14 bp, Homo sapiens
ccagggcagcaggc

SEQ ID NO: 3548674 - DNA, 20 bp, Homo sapiens
ccagggcagcaggccagaga

SEQ ID NO: 3548675 - DNA, 13 bp, Homo sapiens
ccagggcagcggc

SEQ ID NO: 3548676 - DNA, 15 bp, Homo sapiens
ccagggcccagagcc

SEQ ID NO: 3548677 - DNA, 17 bp, Homo sapiens
ccagggcccagagccca

SEQ ID NO: 3548678 - DNA, 18 bp, Homo sapiens
ccagggcccagagcccag

SEQ ID NO: 3548679 - DNA, 12 bp, Homo sapiens
ccagggccccca

SEQ ID NO: 3548680 - DNA, 14 bp, Homo sapiens
ccagggcccccacc

SEQ ID NO: 3548681 - DNA, 12 bp, Homo sapiens
ccagggcctcca

SEQ ID NO: 3548682 - DNA, 15 bp, Homo sapiens
ccagggcctccaggg

SEQ ID NO: 3548683 - DNA, 14 bp, Homo sapiens
ccagggcctgacac

SEQ ID NO: 3548684 - DNA, 14 bp, Homo sapiens
ccagggcctgcgga

SEQ ID NO: 3548685 - DNA, 12 bp, Homo sapiens
ccagggctgggg

SEQ ID NO: 3548686 - DNA, 14 bp, Homo sapiens
ccagggctggggac

SEQ ID NO: 3548687 - DNA, 13 bp, Homo sapiens
ccaggggagccct

SEQ ID NO: 3548688 - DNA, 17 bp, Homo sapiens
ccaggggaggagcctgt

SEQ ID NO: 3548689 - DNA, 18 bp, Homo sapiens
ccaggggccaacctcagg

SEQ ID NO: 3548690 - DNA, 20 bp, Homo sapiens
ccaggggccaacctcaggct

SEQ ID NO: 3548691 - DNA, 22 bp, Homo sapiens
ccaggggccaacctcaggctcc

SEQ ID NO: 3548692 - DNA, 16 bp, Homo sapiens
ccaggggcctgcagaa

SEQ ID NO: 3548693 - DNA, 14 bp, Homo sapiens
ccagggtctttgca

SEQ ID NO: 3548694 - DNA, 15 bp, Homo sapiens
ccagggtgacaaggc

SEQ ID NO: 3548695 - DNA, 19 bp, Homo sapiens
ccagggtgacaaggcctgc

SEQ ID NO: 3548696 - DNA, 15 bp, Homo sapiens
ccaggtacaggagag

SEQ ID NO: 3548697 - DNA, 23 bp, Homo sapiens
ccaggtacaggagaggcagcatg

SEQ ID NO: 3548698 - DNA, 18 bp, Homo sapiens
ccaggtcggagtgcctgg

SEQ ID NO: 3548699 - DNA, 23 bp, Homo sapiens
ccaggtcggagtgcctggagtca

SEQ ID NO: 3548700 - DNA, 15 bp, Homo sapiens
ccaggtctgactcca

SEQ ID NO: 3548701 - DNA, 18 bp, Homo sapiens
ccaggtgcagaccttggg

SEQ ID NO: 3548702 - DNA, 17 bp, Homo sapiens
ccaggtgccagttatgg

SEQ ID NO: 3548703 - DNA, 20 bp, Homo sapiens
ccaggtgcccgcgccaggcc

SEQ ID NO: 3548704 - DNA, 22 bp, Homo sapiens
ccaggtgcccgcgccaggccct

SEQ ID NO: 3548705 - DNA, 16 bp, Homo sapiens
ccaggtggccactcca

SEQ ID NO: 3548706 - DNA, 19 bp, Homo sapiens
ccaggttcccccagcaagc

SEQ ID NO: 3548707 - DNA, 14 bp, Homo sapiens
ccaggttcgagacc

SEQ ID NO: 3548708 - DNA, 12 bp, Homo sapiens
ccaggtttttca

SEQ ID NO: 3548709 - DNA, 15 bp, Homo sapiens
ccaggtttttcaatt

SEQ ID NO: 3548710 - DNA, 17 bp, Homo sapiens
ccaggtttttcaattaa

SEQ ID NO: 3548711 - DNA, 19 bp, Homo sapiens
ccaggtttttcaattaaac

SEQ ID NO: 3548712 - DNA, 20 bp, Homo sapiens
ccagtaggggcttataataa

SEQ ID NO: 3548713 - DNA, 15 bp, Homo sapiens
ccagtattgccccct

SEQ ID NO: 3548714 - DNA, 18 bp, Homo sapiens
ccagtatttagaagccaa

SEQ ID NO: 3548715 - DNA, 19 bp, Homo sapiens
ccagtcagacgccaggcac

SEQ ID NO: 3548716 - DNA, 21 bp, Homo sapiens
ccagtcattatgttaatattt

SEQ ID NO: 3548717 - DNA, 14 bp, Homo sapiens
ccagtcccacactg

SEQ ID NO: 3548718 - DNA, 14 bp, Homo sapiens
ccagtcccattcct

SEQ ID NO: 3548719 - DNA, 18 bp, Homo sapiens
ccagtccccctgccccag

SEQ ID NO: 3548720 - DNA, 21 bp, Homo sapiens
ccagtcctccactcgacccag

SEQ ID NO: 3548721 - DNA, 18 bp, Homo sapiens
ccagtcggccccatctct

SEQ ID NO: 3548722 - DNA, 22 bp, Homo sapiens
ccagtctcctcactctgtccct

SEQ ID NO: 3548723 - DNA, 12 bp, Homo sapiens
ccagtctttctt

SEQ ID NO: 3548724 - DNA, 12 bp, Homo sapiens
ccagtgaagcct

SEQ ID NO: 3548725 - DNA, 17 bp, Homo sapiens
ccagtgaagtccttcag

SEQ ID NO: 3548726 - DNA, 20 bp, Homo sapiens
ccagtgaagtccttcagtga

SEQ ID NO: 3548727 - DNA, 13 bp, Homo sapiens
ccagtgacgctgc

SEQ ID NO: 3548728 - DNA, 13 bp, Homo sapiens
ccagtgactccag

SEQ ID NO: 3548729 - DNA, 12 bp, Homo sapiens
ccagtgcagcca

SEQ ID NO: 3548730 - DNA, 14 bp, Homo sapiens
ccagtgcagccact

SEQ ID NO: 3548731 - DNA, 23 bp, Homo sapiens
ccagtgcagtttggtgtgtcctc

SEQ ID NO: 3548732 - DNA, 21 bp, Homo sapiens
ccagtgcggttcctcatctga

SEQ ID NO: 3548733 - DNA, 12 bp, Homo sapiens
ccagtgctgaat

SEQ ID NO: 3548734 - DNA, 13 bp, Homo sapiens
cctgaactttctc

SEQ ID NO: 3548735 - DNA, 16 bp, Homo sapiens
cctgaactttctccct

SEQ ID NO: 3548736 - DNA, 17 bp, Homo sapiens
cctgaactttctccctc

SEQ ID NO: 3548737 - DNA, 17 bp, Homo sapiens
cctgaagaaccagtccc

SEQ ID NO: 3548738 - DNA, 16 bp, Homo sapiens
cctgaagaactatttt

SEQ ID NO: 3548739 - DNA, 18 bp, Homo sapiens
cctgaagctgctgtgtcc

SEQ ID NO: 3548740 - DNA, 23 bp, Homo sapiens
cctgaagcttcggccgcgccacc

SEQ ID NO: 3548741 - DNA, 16 bp, Homo sapiens
cctgaaggggcgtctg

SEQ ID NO: 3548742 - DNA, 22 bp, Homo sapiens
cctgaaggggcgtctgttcccc

SEQ ID NO: 3548743 - DNA, 14 bp, Homo sapiens
cctgacacaccagg

SEQ ID NO: 3548744 - DNA, 17 bp, Homo sapiens
cctgacacaccaggcgc

SEQ ID NO: 3548745 - DNA, 18 bp, Homo sapiens
cctgacagccttccccag

SEQ ID NO: 3548746 - DNA, 19 bp, Homo sapiens
cctgacagccttccccagc

SEQ ID NO: 3548747 - DNA, 15 bp, Homo sapiens
cctgaccccgccatg

SEQ ID NO: 3548748 - DNA, 13 bp, Homo sapiens
cctgacccctgcc

SEQ ID NO: 3548749 - DNA, 16 bp, Homo sapiens
cctgacccctgcctgt

SEQ ID NO: 3548750 - DNA, 18 bp, Homo sapiens
cctgacctaccccagcca

SEQ ID NO: 3548751 - DNA, 19 bp, Homo sapiens
cctgacctaccccagccag

SEQ ID NO: 3548752 - DNA, 21 bp, Homo sapiens
cctgacctaccccagccaggc

SEQ ID NO: 3548753 - DNA, 14 bp, Homo sapiens
cctgacctcaagtg

SEQ ID NO: 3548754 - DNA, 19 bp, Homo sapiens
cctgactgggggcagacat

SEQ ID NO: 3548755 - DNA, 23 bp, Homo sapiens
cctgacttcagtgaatatttttg

SEQ ID NO: 3548756 - DNA, 15 bp, Homo sapiens
cctgagaaggggcag

SEQ ID NO: 3548757 - DNA, 19 bp, Homo sapiens
cctgagagcatctcaggag

SEQ ID NO: 3548758 - DNA, 15 bp, Homo sapiens
cctgagcagggtcca

SEQ ID NO: 3548759 - DNA, 17 bp, Homo sapiens
cctgagccaaatttctt

SEQ ID NO: 3548760 - DNA, 23 bp, Homo sapiens
cctgagctggcctgtctgcgtgg

SEQ ID NO: 3548761 - DNA, 13 bp, Homo sapiens
cctgagctgggga

SEQ ID NO: 3548762 - DNA, 17 bp, Homo sapiens
cctgagctggggaagcc

SEQ ID NO: 3548763 - DNA, 16 bp, Homo sapiens
cctgaggcaaggagtt

SEQ ID NO: 3548764 - DNA, 16 bp, Homo sapiens
cctgaggcctcatttt

SEQ ID NO: 3548765 - DNA, 20 bp, Homo sapiens
cctgagggctaattctggga

SEQ ID NO: 3548766 - DNA, 18 bp, Homo sapiens
cctgagggtccacctgga

SEQ ID NO: 3548767 - DNA, 15 bp, Homo sapiens
cctgaggtcactgct

SEQ ID NO: 3548768 - DNA, 15 bp, Homo sapiens
cctgagtagctggat

SEQ ID NO: 3548769 - DNA, 18 bp, Homo sapiens
cctgatcctggaggccca

SEQ ID NO: 3548770 - DNA, 16 bp, Homo sapiens
cctgatggggaaggga

SEQ ID NO: 3548771 - DNA, 18 bp, Homo sapiens
cctgatggggaagggact

SEQ ID NO: 3548772 - DNA, 18 bp, Homo sapiens
cctgatgtagcttgagat

SEQ ID NO: 3548773 - DNA, 18 bp, Homo sapiens
cctgatgttttgccgtgg

SEQ ID NO: 3548774 - DNA, 15 bp, Homo sapiens
cctgatttcattcct

SEQ ID NO: 3548775 - DNA, 17 bp, Homo sapiens
cctgcaacttccgctga

SEQ ID NO: 3548776 - DNA, 18 bp, Homo sapiens
cctgcaacttccgctgag

SEQ ID NO: 3548777 - DNA, 17 bp, Homo sapiens
cctgcacacagggcagt

SEQ ID NO: 3548778 - DNA, 20 bp, Homo sapiens
cctgcacacagggcagtcct

SEQ ID NO: 3548779 - DNA, 21 bp, Homo sapiens
cctgcacaggtggctgtttct

SEQ ID NO: 3548780 - DNA, 19 bp, Homo sapiens
cctgcaccatgctgctggg

SEQ ID NO: 3548781 - DNA, 15 bp, Homo sapiens
cctgcagcaggcagc

SEQ ID NO: 3548782 - DNA, 22 bp, Homo sapiens
cctgcagcagtcgcccaagcag

SEQ ID NO: 3548783 - DNA, 14 bp, Homo sapiens
cctgcagcccaggc

SEQ ID NO: 3548784 - DNA, 15 bp, Homo sapiens
cctgcagcccgtgtc

SEQ ID NO: 3548785 - DNA, 19 bp, Homo sapiens
cctgcagcctgcaggacct

SEQ ID NO: 3548786 - DNA, 13 bp, Homo sapiens
cctgcaggaccct

SEQ ID NO: 3548787 - DNA, 21 bp, Homo sapiens
cctgcaggaccctgtcctgca

SEQ ID NO: 3548788 - DNA, 22 bp, Homo sapiens
cctgcaggaccctgtcctgcag

SEQ ID NO: 3548789 - DNA, 12 bp, Homo sapiens
cctgcaggccag

SEQ ID NO: 3548790 - DNA, 17 bp, Homo sapiens
cctgcagtcccacactg

SEQ ID NO: 3548791 - DNA, 22 bp, Homo sapiens
cctgcagtctggctgagccctg

SEQ ID NO: 3548792 - DNA, 18 bp, Homo sapiens
cctgcatctctgtgaagc

SEQ ID NO: 3548793 - DNA, 21 bp, Homo sapiens
cctgcatctctgtgaagcctc

SEQ ID NO: 3548794 - DNA, 18 bp, Homo sapiens
cctgcatctgaccagcag

SEQ ID NO: 3548795 - DNA, 19 bp, Homo sapiens
cctgcatctgaccagcagc

SEQ ID NO: 3548796 - DNA, 15 bp, Homo sapiens
cctgccaaggagcat

SEQ ID NO: 3548797 - DNA, 22 bp, Homo sapiens
cctgccaaggagcatccttggc

SEQ ID NO: 3548798 - DNA, 13 bp, Homo sapiens
cctgccaccagca

SEQ ID NO: 3548799 - DNA, 14 bp, Homo sapiens
cctgccagctgcac

SEQ ID NO: 3548800 - DNA, 18 bp, Homo sapiens
cctgccatcatgtttaca

SEQ ID NO: 3548801 - DNA, 13 bp, Homo sapiens
cctgccccacccc

SEQ ID NO: 3548802 - DNA, 22 bp, Homo sapiens
cctgccccaccccacctcacag

SEQ ID NO: 3548803 - DNA, 16 bp, Homo sapiens
cctgccccaccccatc

SEQ ID NO: 3548804 - DNA, 21 bp, Homo sapiens
cctgccccaccccatccagcc

SEQ ID NO: 3548805 - DNA, 13 bp, Homo sapiens
cctgccccctgcc

SEQ ID NO: 3548806 - DNA, 15 bp, Homo sapiens
cctgccccctgccag

SEQ ID NO: 3548807 - DNA, 13 bp, Homo sapiens
cctgccccctggg

SEQ ID NO: 3548808 - DNA, 23 bp, Homo sapiens
cctgccccctgggctggggcctc

SEQ ID NO: 3548809 - DNA, 15 bp, Homo sapiens
cctgcccctcccttc

SEQ ID NO: 3548810 - DNA, 21 bp, Homo sapiens
cctgccctgtgatatgtctgc

SEQ ID NO: 3548811 - DNA, 18 bp, Homo sapiens
cctgcctaaggttgtcta

SEQ ID NO: 3548812 - DNA, 13 bp, Homo sapiens
cctgcctcagcct

SEQ ID NO: 3548813 - DNA, 20 bp, Homo sapiens
cctgcctccaggaaccacac

SEQ ID NO: 3548814 - DNA, 17 bp, Homo sapiens
cctgcctgacagccttc

SEQ ID NO: 3548815 - DNA, 23 bp, Homo sapiens
cctgcctggaggctcctctaggc

SEQ ID NO: 3548816 - DNA, 17 bp, Homo sapiens
cctgcctggccccctgt

SEQ ID NO: 3548817 - DNA, 19 bp, Homo sapiens
cctgcctgttggcaggccc

SEQ ID NO: 3548818 - DNA, 12 bp, Homo sapiens
cctgccttggag

SEQ ID NO: 3548819 - DNA, 15 bp, Homo sapiens
cctgcctttaagcca

SEQ ID NO: 3548820 - DNA, 20 bp, Homo sapiens
cctgcgagacgcacacagct

SEQ ID NO: 3548821 - DNA, 14 bp, Homo sapiens
cctgcgcctccaga

SEQ ID NO: 3548822 - DNA, 15 bp, Homo sapiens
cctgcgcctccagag

SEQ ID NO: 3548823 - DNA, 18 bp, Homo sapiens
cctgcggaggcggtggca

SEQ ID NO: 3548824 - DNA, 19 bp, Homo sapiens
cctgcggaggcggtggcag

SEQ ID NO: 3548825 - DNA, 11 bp, Homo sapiens
cctgctccaga

SEQ ID NO: 3548826 - DNA, 13 bp, Homo sapiens
cctgctccagaag

SEQ ID NO: 3548827 - DNA, 18 bp, Homo sapiens
cctgctccagaagatgcc

SEQ ID NO: 3548828 - DNA, 13 bp, Homo sapiens
cctgctccagacc

SEQ ID NO: 3548829 - DNA, 15 bp, Homo sapiens
cctgctccagacctg

SEQ ID NO: 3548830 - DNA, 16 bp, Homo sapiens
cctgctctcctcttgc

SEQ ID NO: 3548831 - DNA, 21 bp, Homo sapiens
cctgctctcctcttgccactg

SEQ ID NO: 3548832 - DNA, 12 bp, Homo sapiens
cctgctgaatgc

SEQ ID NO: 3548833 - DNA, 15 bp, Homo sapiens
cctgctgccagtgca

SEQ ID NO: 3548834 - DNA, 20 bp, Homo sapiens
cctgctgccagtgcagccac

SEQ ID NO: 3548835 - DNA, 20 bp, Homo sapiens
cctgctggggccgccacggc

SEQ ID NO: 3548836 - DNA, 16 bp, Homo sapiens
cctgctggtacctgcc

SEQ ID NO: 3548837 - DNA, 17 bp, Homo sapiens
cctgctggtacctgccc

SEQ ID NO: 3548838 - DNA, 18 bp, Homo sapiens
cctgctgtatgtgagctg

SEQ ID NO: 3548839 - DNA, 16 bp, Homo sapiens
cctgctgtgctgctca

SEQ ID NO: 3548840 - DNA, 14 bp, Homo sapiens
cctgcttcccacaa

SEQ ID NO: 3548841 - DNA, 15 bp, Homo sapiens
cctgtgcctctggga

SEQ ID NO: 3548842 - DNA, 19 bp, Homo sapiens
cctgtgcctctgggactgg

SEQ ID NO: 3548843 - DNA, 20 bp, Homo sapiens
cctgtgcctctgggactgga

SEQ ID NO: 3548844 - DNA, 16 bp, Homo sapiens
cctgtgcctttcctat

SEQ ID NO: 3548845 - DNA, 19 bp, Homo sapiens
cctgtggcactcagggagc

SEQ ID NO: 3548846 - DNA, 16 bp, Homo sapiens
cctgtggccaactgca

SEQ ID NO: 3548847 - DNA, 15 bp, Homo sapiens
cctgtggccctggcc

SEQ ID NO: 3548848 - DNA, 14 bp, Homo sapiens
cctgtgggcgcata

SEQ ID NO: 3548849 - DNA, 23 bp, Homo sapiens
cctgtggtcatgtgagtctggga

SEQ ID NO: 3548850 - DNA, 14 bp, Homo sapiens
cctgtgtgactcca

SEQ ID NO: 3548851 - DNA, 18 bp, Homo sapiens
cctgtgtgattgacagct

SEQ ID NO: 3548852 - DNA, 22 bp, Homo sapiens
cctgtgtgattgacagctttgc

SEQ ID NO: 3548853 - DNA, 20 bp, Homo sapiens
cctgtgtgtccaaaactgcc

SEQ ID NO: 3548854 - DNA, 19 bp, Homo sapiens
cctgtgtttttttctaaaa

SEQ ID NO: 3548855 - DNA, 21 bp, Homo sapiens
cctgttaaaagatgaaaatat

SEQ ID NO: 3548856 - DNA, 23 bp, Homo sapiens
cctgttaatttataatgtatttg

SEQ ID NO: 3548857 - DNA, 18 bp, Homo sapiens
cctgttacttatgtagaa

SEQ ID NO: 3548858 - DNA, 15 bp, Homo sapiens
cctgttccccagaga

SEQ ID NO: 3548859 - DNA, 23 bp, Homo sapiens
cctgttccccagagaaaggggag

SEQ ID NO: 3548860 - DNA, 12 bp, Homo sapiens
cctgttctgcgc

SEQ ID NO: 3548861 - DNA, 14 bp, Homo sapiens
cctgttctgcgctg

SEQ ID NO: 3548862 - DNA, 16 bp, Homo sapiens
cctgttctgcgctgtg

SEQ ID NO: 3548863 - DNA, 20 bp, Homo sapiens
cctgttcttagagtgtagct

SEQ ID NO: 3548864 - DNA, 23 bp, Homo sapiens
cctgttcttgggcctcaggctct

SEQ ID NO: 3548865 - DNA, 17 bp, Homo sapiens
cctgttgacacaggtct

SEQ ID NO: 3548866 - DNA, 22 bp, Homo sapiens
cctgttgacacaggtctttcct

SEQ ID NO: 3548867 - DNA, 18 bp, Homo sapiens
cctgtttcagaccccccc

SEQ ID NO: 3548868 - DNA, 19 bp, Homo sapiens
cctgtttcagaccccccca

SEQ ID NO: 3548869 - DNA, 23 bp, Homo sapiens
cctgtttggtggggtggcacctg

SEQ ID NO: 3548870 - DNA, 18 bp, Homo sapiens
ccttaaaagtaataaaga

SEQ ID NO: 3548871 - DNA, 15 bp, Homo sapiens
ccttaacccacctct

SEQ ID NO: 3548872 - DNA, 20 bp, Homo sapiens
ccttaacccacctctcctgc

SEQ ID NO: 3548873 - DNA, 13 bp, Homo sapiens
ccttaactgacat

SEQ ID NO: 3548874 - DNA, 12 bp, Homo sapiens
ccttaagcaaat

SEQ ID NO: 3548875 - DNA, 22 bp, Homo sapiens
ccttaagccaaactcaggccca

SEQ ID NO: 3548876 - DNA, 19 bp, Homo sapiens
ccttaatctaatctaaaag

SEQ ID NO: 3548877 - DNA, 20 bp, Homo sapiens
ccttacaacgccgagtgcac

SEQ ID NO: 3548878 - DNA, 12 bp, Homo sapiens
ccttacatctgg

SEQ ID NO: 3548879 - DNA, 15 bp, Homo sapiens
ccttaccctcctctg

SEQ ID NO: 3548880 - DNA, 16 bp, Homo sapiens
ccttaccctcctctgc

SEQ ID NO: 3548881 - DNA, 19 bp, Homo sapiens
ccttaccctcctctgctgg

SEQ ID NO: 3548882 - DNA, 18 bp, Homo sapiens
ccttagaaacactgcaaa

SEQ ID NO: 3548883 - DNA, 14 bp, Homo sapiens
ccttagaacctttc

SEQ ID NO: 3548884 - DNA, 16 bp, Homo sapiens
ccttagagctcttgtg

SEQ ID NO: 3548885 - DNA, 14 bp, Homo sapiens
ccttatagttactg

SEQ ID NO: 3548886 - DNA, 22 bp, Homo sapiens
ccttatctccaagaccagagat

SEQ ID NO: 3548887 - DNA, 16 bp, Homo sapiens
ccttatttgccttcta

SEQ ID NO: 3548888 - DNA, 18 bp, Homo sapiens
ccttattttcaagaaact

SEQ ID NO: 3548889 - DNA, 18 bp, Homo sapiens
ccttcaagacgaggggca

SEQ ID NO: 3548890 - DNA, 19 bp, Homo sapiens
ccttcaagacgaggggcag

SEQ ID NO: 3548891 - DNA, 21 bp, Homo sapiens
ccttcaagacgaggggcaggg

SEQ ID NO: 3548892 - DNA, 22 bp, Homo sapiens
ccttcaagacgaggggcaggga

SEQ ID NO: 3548893 - DNA, 16 bp, Homo sapiens
ccttcagattccccat

SEQ ID NO: 3548894 - DNA, 14 bp, Homo sapiens
ccttcaggagcctg

SEQ ID NO: 3548895 - DNA, 23 bp, Homo sapiens
ccttcaggagcctggccaggcag

SEQ ID NO: 3548896 - DNA, 12 bp, Homo sapiens
ccttcaggcagc

SEQ ID NO: 3548897 - DNA, 18 bp, Homo sapiens
ccttcaggcagctgaaat

SEQ ID NO: 3548898 - DNA, 19 bp, Homo sapiens
ccttcaggcagctgaaatt

SEQ ID NO: 3548899 - DNA, 18 bp, Homo sapiens
ccttcagggagacaggca

SEQ ID NO: 3548900 - DNA, 16 bp, Homo sapiens
ccttcagtgagcccct

SEQ ID NO: 3548901 - DNA, 23 bp, Homo sapiens
ccttcagtgagcccctccccagc

SEQ ID NO: 3548902 - DNA, 16 bp, Homo sapiens
ccttcatccatcctga

SEQ ID NO: 3548903 - DNA, 17 bp, Homo sapiens
ccttcatccgcctgtgg

SEQ ID NO: 3548904 - DNA, 18 bp, Homo sapiens
ccttcatccgcctgtggg

SEQ ID NO: 3548905 - DNA, 13 bp, Homo sapiens
ccttccacccagt

SEQ ID NO: 3548906 - DNA, 11 bp, Homo sapiens
ccttcccaggg

SEQ ID NO: 3548907 - DNA, 16 bp, Homo sapiens
ccttcccagggagaaa

SEQ ID NO: 3548908 - DNA, 15 bp, Homo sapiens
ccttccccagctcca

SEQ ID NO: 3548909 - DNA, 21 bp, Homo sapiens
ccttcccctaaaccccaagct

SEQ ID NO: 3548910 - DNA, 13 bp, Homo sapiens
ccttccctggccc

SEQ ID NO: 3548911 - DNA, 14 bp, Homo sapiens
ccttccctggcccc

SEQ ID NO: 3548912 - DNA, 18 bp, Homo sapiens
ccttccctgtctgccagg

SEQ ID NO: 3548913 - DNA, 23 bp, Homo sapiens
ccttccctttctaagcaaccaca

SEQ ID NO: 3548914 - DNA, 17 bp, Homo sapiens
ccttccgggttcaagtg

SEQ ID NO: 3548915 - DNA, 18 bp, Homo sapiens
ccttccgggttcaagtga

SEQ ID NO: 3548916 - DNA, 17 bp, Homo sapiens
ccttcctctccactgcc

SEQ ID NO: 3548917 - DNA, 15 bp, Homo sapiens
ccttcctggaaacag

SEQ ID NO: 3548918 - DNA, 20 bp, Homo sapiens
ccttcctggaaacagcatga

SEQ ID NO: 3548919 - DNA, 13 bp, Homo sapiens
ccttcctgtttca

SEQ ID NO: 3548920 - DNA, 17 bp, Homo sapiens
ccttcctgtttcagacc

SEQ ID NO: 3548921 - DNA, 20 bp, Homo sapiens
ccttcgatacaccgggcctg

SEQ ID NO: 3548922 - DNA, 19 bp, Homo sapiens
ccttctatacccacccaga

SEQ ID NO: 3548923 - DNA, 14 bp, Homo sapiens
ccttctatgtatta

SEQ ID NO: 3548924 - DNA, 17 bp, Homo sapiens
ccttctgaagtctgagc

SEQ ID NO: 3548925 - DNA, 20 bp, Homo sapiens
ccttctgaagtctgagccca

SEQ ID NO: 3548926 - DNA, 21 bp, Homo sapiens
ccttctgaagtctgagcccat

SEQ ID NO: 3548927 - DNA, 12 bp, Homo sapiens
ccttctgctgaa

SEQ ID NO: 3548928 - DNA, 18 bp, Homo sapiens
ccttctgggtccagggag

SEQ ID NO: 3548929 - DNA, 14 bp, Homo sapiens
ccttctgtggctca

SEQ ID NO: 3548930 - DNA, 12 bp, Homo sapiens
ccttcttcccaa

SEQ ID NO: 3548931 - DNA, 22 bp, Homo sapiens
ccttgaatctttttatcccatt

SEQ ID NO: 3548932 - DNA, 16 bp, Homo sapiens
ccttgagagttccggg

SEQ ID NO: 3548933 - DNA, 18 bp, Homo sapiens
ccttgagagttccgggga

SEQ ID NO: 3548934 - DNA, 17 bp, Homo sapiens
ccttgagttaacaggac

SEQ ID NO: 3548935 - DNA, 16 bp, Homo sapiens
ccttgattacttccac

SEQ ID NO: 3548936 - DNA, 20 bp, Homo sapiens
ccttgcaacccaaggtgagg

SEQ ID NO: 3548937 - DNA, 15 bp, Homo sapiens
ccttgcagcggctcc

SEQ ID NO: 3548938 - DNA, 19 bp, Homo sapiens
ccttgcagcggctcctgca

SEQ ID NO: 3548939 - DNA, 13 bp, Homo sapiens
ccttgccagagat

SEQ ID NO: 3548940 - DNA, 12 bp, Homo sapiens
ccttgccagttt

SEQ ID NO: 3548941 - DNA, 15 bp, Homo sapiens
ccttgccccacctcc

SEQ ID NO: 3548942 - DNA, 19 bp, Homo sapiens
ccttgctttgagactcctc

SEQ ID NO: 3548943 - DNA, 15 bp, Homo sapiens
ccttggaggagagag

SEQ ID NO: 3548944 - DNA, 18 bp, Homo sapiens
ccttggcacccccatgct

SEQ ID NO: 3548945 - DNA, 14 bp, Homo sapiens
ccttggccacagac

SEQ ID NO: 3548946 - DNA, 20 bp, Homo sapiens
ccttggcctcccaaagtgct

SEQ ID NO: 3548947 - DNA, 22 bp, Homo sapiens
ccttggctcccgggggccccac

SEQ ID NO: 3548948 - DNA, 21 bp, Homo sapiens
ccttggctttatgcaaataca

SEQ ID NO: 3548949 - DNA, 22 bp, Homo sapiens
ccttggctttatgcaaatacaa

SEQ ID NO: 3548950 - DNA, 17 bp, Homo sapiens
ccttggctttcagagcc

SEQ ID NO: 3548951 - DNA, 22 bp, Homo sapiens
ccttggctttcagagccagcct

SEQ ID NO: 3548952 - DNA, 16 bp, Homo sapiens
ccttggggtccctcca

SEQ ID NO: 3548953 - DNA, 13 bp, Homo sapiens
ccttggtgagaaa

SEQ ID NO: 3548954 - DNA, 16 bp, Homo sapiens
ccttgtcactggtaga

SEQ ID NO: 3548955 - DNA, 20 bp, Homo sapiens
ccttgtcagtgtgtcagttt

SEQ ID NO: 3548956 - DNA, 15 bp, Homo sapiens
ccttgtgccttcttt

SEQ ID NO: 3548957 - DNA, 19 bp, Homo sapiens
cctttaaatttcagctttg

SEQ ID NO: 3548958 - DNA, 19 bp, Homo sapiens
cctttaacttttttttctc

SEQ ID NO: 3548959 - DNA, 20 bp, Homo sapiens
cctttaacttttttttctct

SEQ ID NO: 3548960 - DNA, 23 bp, Homo sapiens
cctttaacttttttttctctctt

SEQ ID NO: 3548961 - DNA, 16 bp, Homo sapiens
cctttaagaaccttaa

SEQ ID NO: 3548962 - DNA, 14 bp, Homo sapiens
cctttactcctggc

SEQ ID NO: 3548963 - DNA, 16 bp, Homo sapiens
cctttatgttctttca

SEQ ID NO: 3548964 - DNA, 20 bp, Homo sapiens
cctttatttattaaacttca

SEQ ID NO: 3548965 - DNA, 22 bp, Homo sapiens
cctttatttattaaacttcagc

SEQ ID NO: 3548966 - DNA, 15 bp, Homo sapiens
cctttcaaagcactt

SEQ ID NO: 3548967 - DNA, 20 bp, Homo sapiens
cctttcagaatcttttcaat

SEQ ID NO: 3548968 - DNA, 21 bp, Homo sapiens
cctttcagaatcttttcaatg

SEQ ID NO: 3548969 - DNA, 20 bp, Homo sapiens
cctttcattaccctacagac

SEQ ID NO: 3548970 - DNA, 20 bp, Homo sapiens
cctttcctatcacctcgaga

SEQ ID NO: 3548971 - DNA, 13 bp, Homo sapiens
cctttcctctgca

SEQ ID NO: 3548972 - DNA, 14 bp, Homo sapiens
cctttcctctgcac

SEQ ID NO: 3548973 - DNA, 22 bp, Homo sapiens
cctttctcggggcttggggctc

SEQ ID NO: 3548974 - DNA, 15 bp, Homo sapiens
cctttctctctcctc

SEQ ID NO: 3548975 - DNA, 23 bp, Homo sapiens
cctttctgtcccactacatctgg

SEQ ID NO: 3548976 - DNA, 21 bp, Homo sapiens
cctttcttcctatttatcata

SEQ ID NO: 3548977 - DNA, 17 bp, Homo sapiens
cctttgaagaaggcaag

SEQ ID NO: 3548978 - DNA, 21 bp, Homo sapiens
cctttgaagaaggcaaggctg

SEQ ID NO: 3548979 - DNA, 19 bp, Homo sapiens
cctttgattagagaccaga

SEQ ID NO: 3548980 - DNA, 20 bp, Homo sapiens
cctttgcaagatgcttggtt

SEQ ID NO: 3548981 - DNA, 12 bp, Homo sapiens
cctttggaggga

SEQ ID NO: 3548982 - DNA, 21 bp, Homo sapiens
cctttggcctggggtgcatct

SEQ ID NO: 3548983 - DNA, 22 bp, Homo sapiens
cctttggcctggggtgcatctc

SEQ ID NO: 3548984 - DNA, 22 bp, Homo sapiens
cctttggctggtagcagcaggc

SEQ ID NO: 3548985 - DNA, 16 bp, Homo sapiens
cctttgggtgctgttt

SEQ ID NO: 3548986 - DNA, 14 bp, Homo sapiens
cctttgtcccagaa

SEQ ID NO: 3548987 - DNA, 19 bp, Homo sapiens
cctttgtgctttttgtcat

SEQ ID NO: 3548988 - DNA, 21 bp, Homo sapiens
cctttgtgctttttgtcatgt

SEQ ID NO: 3548989 - DNA, 18 bp, Homo sapiens
cctttgttacttctctaa

SEQ ID NO: 3548990 - DNA, 15 bp, Homo sapiens
ccttttatgtaaatt

SEQ ID NO: 3548991 - DNA, 12 bp, Homo sapiens
ccttttcaaatt

SEQ ID NO: 3548992 - DNA, 12 bp, Homo sapiens
ccttttccatgc

SEQ ID NO: 3548993 - DNA, 22 bp, Homo sapiens
ccttttggataagtttctattc

SEQ ID NO: 3548994 - DNA, 12 bp, Homo sapiens
ccttttgggggt

SEQ ID NO: 3548995 - DNA, 22 bp, Homo sapiens
ccttttgtagttttatttgtat

SEQ ID NO: 3548996 - DNA, 19 bp, Homo sapiens
cctttttacctggcctaga

SEQ ID NO: 3548997 - DNA, 22 bp, Homo sapiens
cctttttacctggcctagaaag

SEQ ID NO: 3548998 - DNA, 19 bp, Homo sapiens
cctttttcttcgctggact

SEQ ID NO: 3548999 - DNA, 14 bp, Homo sapiens
cgaaaaatgtgtgg

SEQ ID NO: 3549000 - DNA, 15 bp, Homo sapiens
cgaaatatcaaagtc

SEQ ID NO: 3549001 - DNA, 20 bp, Homo sapiens
cgaaatatctatgttttacc

SEQ ID NO: 3549002 - DNA, 15 bp, Homo sapiens
cgaacagccttagag

SEQ ID NO: 3549003 - DNA, 19 bp, Homo sapiens
cgaacagccttagagctct

SEQ ID NO: 3549004 - DNA, 16 bp, Homo sapiens
cgaactctcagaaata

SEQ ID NO: 3549005 - DNA, 21 bp, Homo sapiens
cgaactgggcatatttctaat

SEQ ID NO: 3549006 - DNA, 21 bp, Homo sapiens
cgaaggggaggcacactttct

SEQ ID NO: 3549007 - DNA, 24 bp, Homo sapiens
cgaagtctctgattagttgacagt

SEQ ID NO: 3549008 - DNA, 17 bp, Homo sapiens
cgaatctagaggagggg

SEQ ID NO: 3549009 - DNA, 12 bp, Homo sapiens
cgacagcctggc

SEQ ID NO: 3549010 - DNA, 13 bp, Homo sapiens
cctagacttgaaa

SEQ ID NO: 3549011 - DNA, 15 bp, Homo sapiens
cctagagggaggggc

SEQ ID NO: 3549012 - DNA, 13 bp, Homo sapiens
cctagcagcctca

SEQ ID NO: 3549013 - DNA, 20 bp, Homo sapiens
cctagccctgctccaactcc

SEQ ID NO: 3549014 - DNA, 17 bp, Homo sapiens
cctagcggagcccagcc

SEQ ID NO: 3549015 - DNA, 18 bp, Homo sapiens
cctagcggagcccagcct

SEQ ID NO: 3549016 - DNA, 15 bp, Homo sapiens
cctagctaattattt

SEQ ID NO: 3549017 - DNA, 13 bp, Homo sapiens
cctagctgacccc

SEQ ID NO: 3549018 - DNA, 20 bp, Homo sapiens
cctaggtgcagctcctcagc

SEQ ID NO: 3549019 - DNA, 15 bp, Homo sapiens
cctaggtgcccaggg

SEQ ID NO: 3549020 - DNA, 18 bp, Homo sapiens
cctaggtgcccagggcca

SEQ ID NO: 3549021 - DNA, 18 bp, Homo sapiens
cctagtacattactaaat

SEQ ID NO: 3549022 - DNA, 18 bp, Homo sapiens
cctagttttctcctccca

SEQ ID NO: 3549023 - DNA, 20 bp, Homo sapiens
cctagttttctcctcccagg

SEQ ID NO: 3549024 - DNA, 16 bp, Homo sapiens
cctataaagggcccac

SEQ ID NO: 3549025 - DNA, 17 bp, Homo sapiens
cctatcagaagtttctc

SEQ ID NO: 3549026 - DNA, 15 bp, Homo sapiens
cctatctccctggct

SEQ ID NO: 3549027 - DNA, 12 bp, Homo sapiens
cctatctgactt

SEQ ID NO: 3549028 - DNA, 13 bp, Homo sapiens
cctatctgacttc

SEQ ID NO: 3549029 - DNA, 17 bp, Homo sapiens
cctatctgcctggaggc

SEQ ID NO: 3549030 - DNA, 20 bp, Homo sapiens
cctatgaaactggtttataa

SEQ ID NO: 3549031 - DNA, 21 bp, Homo sapiens
cctatgaaactggtttataat

SEQ ID NO: 3549032 - DNA, 19 bp, Homo sapiens
cctatgagatggccatgct

SEQ ID NO: 3549033 - DNA, 20 bp, Homo sapiens
cctatgagatggccatgctc

SEQ ID NO: 3549034 - DNA, 19 bp, Homo sapiens
cctatgctggtagatgctg

SEQ ID NO: 3549035 - DNA, 22 bp, Homo sapiens
cctatgctggtagatgctgagg

SEQ ID NO: 3549036 - DNA, 23 bp, Homo sapiens
cctatgctggtagatgctgaggc

SEQ ID NO: 3549037 - DNA, 18 bp, Homo sapiens
cctatgtagtccgtgctg

SEQ ID NO: 3549038 - DNA, 12 bp, Homo sapiens
cctattctgaaa

SEQ ID NO: 3549039 - DNA, 19 bp, Homo sapiens
cctattctgaaaaagacat

SEQ ID NO: 3549040 - DNA, 13 bp, Homo sapiens
cctattgctgcta

SEQ ID NO: 3549041 - DNA, 13 bp, Homo sapiens
cctatttatttga

SEQ ID NO: 3549042 - DNA, 12 bp, Homo sapiens
cctatttttcct

SEQ ID NO: 3549043 - DNA, 14 bp, Homo sapiens
cctcaaaacaaagg

SEQ ID NO: 3549044 - DNA, 18 bp, Homo sapiens
cctcaagccccatttcct

SEQ ID NO: 3549045 - DNA, 16 bp, Homo sapiens
cctcaagtaaaagaaa

SEQ ID NO: 3549046 - DNA, 15 bp, Homo sapiens
cctcacacccctgtc

SEQ ID NO: 3549047 - DNA, 15 bp, Homo sapiens
cctcacaggccccag

SEQ ID NO: 3549048 - DNA, 14 bp, Homo sapiens
cctcacctctttgt

SEQ ID NO: 3549049 - DNA, 15 bp, Homo sapiens
cctcaccttggcacc

SEQ ID NO: 3549050 - DNA, 16 bp, Homo sapiens
cctcaccttggcacca

SEQ ID NO: 3549051 - DNA, 15 bp, Homo sapiens
cctcactctgtccct

SEQ ID NO: 3549052 - DNA, 21 bp, Homo sapiens
cctcactggcctgccatgcca

SEQ ID NO: 3549053 - DNA, 20 bp, Homo sapiens
cctcactgtatccaggttcc

SEQ ID NO: 3549054 - DNA, 14 bp, Homo sapiens
cctcagaaggcccc

SEQ ID NO: 3549055 - DNA, 16 bp, Homo sapiens
cctcagagccacccct

SEQ ID NO: 3549056 - DNA, 21 bp, Homo sapiens
cctcagagtgcaagcccctgc

SEQ ID NO: 3549057 - DNA, 16 bp, Homo sapiens
cctcagattcttcatt

SEQ ID NO: 3549058 - DNA, 13 bp, Homo sapiens
cctcagcctcctg

SEQ ID NO: 3549059 - DNA, 23 bp, Homo sapiens
cctcagcctgctttcctgcagca

SEQ ID NO: 3549060 - DNA, 14 bp, Homo sapiens
cctcagcctggcca

SEQ ID NO: 3549061 - DNA, 20 bp, Homo sapiens
cctcagcctggccagacaca

SEQ ID NO: 3549062 - DNA, 22 bp, Homo sapiens
cctcagcctggccagacacagg

SEQ ID NO: 3549063 - DNA, 18 bp, Homo sapiens
cctcagccttgccagaga

SEQ ID NO: 3549064 - DNA, 10 bp, Homo sapiens
cctcaggaat

SEQ ID NO: 3549065 - DNA, 11 bp, Homo sapiens
cctcaggacca

SEQ ID NO: 3549066 - DNA, 23 bp, Homo sapiens
cctcaggacccatccctgcctgg

SEQ ID NO: 3549067 - DNA, 15 bp, Homo sapiens
cctcaggcacacctt

SEQ ID NO: 3549068 - DNA, 19 bp, Homo sapiens
cctcaggcacaccttgcag

SEQ ID NO: 3549069 - DNA, 15 bp, Homo sapiens
cctcaggccaaggga

SEQ ID NO: 3549070 - DNA, 18 bp, Homo sapiens
cctcaggccaagggacca

SEQ ID NO: 3549071 - DNA, 20 bp, Homo sapiens
cctcaggccaagggaccagg

SEQ ID NO: 3549072 - DNA, 13 bp, Homo sapiens
cctcaggccaccc

SEQ ID NO: 3549073 - DNA, 14 bp, Homo sapiens
cctcaggccaccct

SEQ ID NO: 3549074 - DNA, 17 bp, Homo sapiens
cctcaggccaccctcca

SEQ ID NO: 3549075 - DNA, 12 bp, Homo sapiens
cctcaggctccg

SEQ ID NO: 3549076 - DNA, 21 bp, Homo sapiens
cctcaggctccgggcaccagg

SEQ ID NO: 3549077 - DNA, 15 bp, Homo sapiens
cctcaggctctgcac

SEQ ID NO: 3549078 - DNA, 22 bp, Homo sapiens
cctcagtgatggaatatcatga

SEQ ID NO: 3549079 - DNA, 13 bp, Homo sapiens
cctcatccctgac

SEQ ID NO: 3549080 - DNA, 18 bp, Homo sapiens
cctcatctgagaggctct

SEQ ID NO: 3549081 - DNA, 21 bp, Homo sapiens
cctcatctgagaggctctccg

SEQ ID NO: 3549082 - DNA, 15 bp, Homo sapiens
cctcatgccaaccct

SEQ ID NO: 3549083 - DNA, 20 bp, Homo sapiens
cctcatgccaaccctgggct

SEQ ID NO: 3549084 - DNA, 13 bp, Homo sapiens
cctcattctcatt

SEQ ID NO: 3549085 - DNA, 20 bp, Homo sapiens
cctcattttgggggtcatct

SEQ ID NO: 3549086 - DNA, 14 bp, Homo sapiens
cctccaaacctcca

SEQ ID NO: 3549087 - DNA, 19 bp, Homo sapiens
cctccaaaggaactctaga

SEQ ID NO: 3549088 - DNA, 17 bp, Homo sapiens
cctccaacgcccctgtg

SEQ ID NO: 3549089 - DNA, 23 bp, Homo sapiens
cctccaacgcccctgtggccaac

SEQ ID NO: 3549090 - DNA, 21 bp, Homo sapiens
cctccaagctccatctccact

SEQ ID NO: 3549091 - DNA, 22 bp, Homo sapiens
cctccaagctccatctccactc

SEQ ID NO: 3549092 - DNA, 21 bp, Homo sapiens
cctccaagggtttcgactggt

SEQ ID NO: 3549093 - DNA, 23 bp, Homo sapiens
cctccaatcccaccaaccctcag

SEQ ID NO: 3549094 - DNA, 13 bp, Homo sapiens
cctccacacccac

SEQ ID NO: 3549095 - DNA, 13 bp, Homo sapiens
cctccacagagag

SEQ ID NO: 3549096 - DNA, 16 bp, Homo sapiens
cctccaccagcaaggg

SEQ ID NO: 3549097 - DNA, 12 bp, Homo sapiens
cctccaccatgc

SEQ ID NO: 3549098 - DNA, 15 bp, Homo sapiens
cctccaccccccact

SEQ ID NO: 3549099 - DNA, 16 bp, Homo sapiens
cctccactccactgcc

SEQ ID NO: 3549100 - DNA, 12 bp, Homo sapiens
cctccagactca

SEQ ID NO: 3549101 - DNA, 22 bp, Homo sapiens
cctccagactcagcagagtgag

SEQ ID NO: 3549102 - DNA, 22 bp, Homo sapiens
cctccagaggtcctccgtaggg

SEQ ID NO: 3549103 - DNA, 12 bp, Homo sapiens
cctccagcctcc

SEQ ID NO: 3549104 - DNA, 15 bp, Homo sapiens
cctccagcctcccct

SEQ ID NO: 3549105 - DNA, 16 bp, Homo sapiens
cctccagcctccctgt

SEQ ID NO: 3549106 - DNA, 23 bp, Homo sapiens
cctccagcctccctgtctccagc

SEQ ID NO: 3549107 - DNA, 13 bp, Homo sapiens
cctccagctggga

SEQ ID NO: 3549108 - DNA, 16 bp, Homo sapiens
cctccaggagagagcc

SEQ ID NO: 3549109 - DNA, 11 bp, Homo sapiens
cctccaggttt

SEQ ID NO: 3549110 - DNA, 16 bp, Homo sapiens
cctccaggtttttcaa

SEQ ID NO: 3549111 - DNA, 17 bp, Homo sapiens
cctccaggtttttcaat

SEQ ID NO: 3549112 - DNA, 19 bp, Homo sapiens
cctccaggtttttcaatta

SEQ ID NO: 3549113 - DNA, 22 bp, Homo sapiens
cctccaggtttttcaattaaac

SEQ ID NO: 3549114 - DNA, 17 bp, Homo sapiens
cctccagtgtcagggtc

SEQ ID NO: 3549115 - DNA, 16 bp, Homo sapiens
cctccatgcctgacca

SEQ ID NO: 3549116 - DNA, 14 bp, Homo sapiens
cctccatgctgcct

SEQ ID NO: 3549117 - DNA, 15 bp, Homo sapiens
cctccatgctgcctc

SEQ ID NO: 3549118 - DNA, 16 bp, Homo sapiens
cctccatgctgcctcc

SEQ ID NO: 3549119 - DNA, 19 bp, Homo sapiens
cctccatgctgcctccaga

SEQ ID NO: 3549120 - DNA, 20 bp, Homo sapiens
cctccattctattttagaat

SEQ ID NO: 3549121 - DNA, 14 bp, Homo sapiens
cctccatttttctc

SEQ ID NO: 3549122 - DNA, 20 bp, Homo sapiens
cctcccaaggcattctccca

SEQ ID NO: 3549123 - DNA, 12 bp, Homo sapiens
cctcccaccaga

SEQ ID NO: 3549124 - DNA, 14 bp, Homo sapiens
cctcccaccagagc

SEQ ID NO: 3549125 - DNA, 16 bp, Homo sapiens
cctcccacccaccgcc

SEQ ID NO: 3549126 - DNA, 19 bp, Homo sapiens
cctcccactgcccactggc

SEQ ID NO: 3549127 - DNA, 13 bp, Homo sapiens
cctcccagacagg

SEQ ID NO: 3549128 - DNA, 20 bp, Homo sapiens
cctcccagaggagccaccag

SEQ ID NO: 3549129 - DNA, 16 bp, Homo sapiens
cctcccagagtgctgg

SEQ ID NO: 3549130 - DNA, 14 bp, Homo sapiens
cctcccaggcgccc

SEQ ID NO: 3549131 - DNA, 13 bp, Homo sapiens
cctccccagccag

SEQ ID NO: 3549132 - DNA, 14 bp, Homo sapiens
cctccccagccagc

SEQ ID NO: 3549133 - DNA, 17 bp, Homo sapiens
cctccccagccagccct

SEQ ID NO: 3549134 - DNA, 14 bp, Homo sapiens
cctccccagtagct

SEQ ID NO: 3549135 - DNA, 12 bp, Homo sapiens
cctcccccagtg

SEQ ID NO: 3549136 - DNA, 16 bp, Homo sapiens
cctcccccatgggctg

SEQ ID NO: 3549137 - DNA, 15 bp, Homo sapiens
cctcccccccatgca

SEQ ID NO: 3549138 - DNA, 16 bp, Homo sapiens
cctcccccccatgcac

SEQ ID NO: 3549139 - DNA, 17 bp, Homo sapiens
cctcccccccatgcact

SEQ ID NO: 3549140 - DNA, 16 bp, Homo sapiens
cctccccctggcactg

SEQ ID NO: 3549141 - DNA, 19 bp, Homo sapiens
cctccccctttcacactgg

SEQ ID NO: 3549142 - DNA, 14 bp, Homo sapiens
cctccccgcccctg

SEQ ID NO: 3549143 - DNA, 16 bp, Homo sapiens
cctcccctcccctggg

SEQ ID NO: 3549144 - DNA, 14 bp, Homo sapiens
cctcccctggggac

SEQ ID NO: 3549145 - DNA, 21 bp, Homo sapiens
cctcccgaaaaatgtgtggtt

SEQ ID NO: 3549146 - DNA, 16 bp, Homo sapiens
cctcccgccccgcccc

SEQ ID NO: 3549147 - DNA, 22 bp, Homo sapiens
cctccctctcagaggcctgctg

SEQ ID NO: 3549148 - DNA, 20 bp, Homo sapiens
ccccaagggggctgctgctc

SEQ ID NO: 3549149 - DNA, 13 bp, Homo sapiens
ccccaatcccagc

SEQ ID NO: 3549150 - DNA, 23 bp, Homo sapiens
ccccaatgacacccatgccagag

SEQ ID NO: 3549151 - DNA, 13 bp, Homo sapiens
ccccaattctccc

SEQ ID NO: 3549152 - DNA, 20 bp, Homo sapiens
ccccacaagctgtccctgca

SEQ ID NO: 3549153 - DNA, 23 bp, Homo sapiens
ccccacaagctgtccctgcaggg

SEQ ID NO: 3549154 - DNA, 20 bp, Homo sapiens
ccccacaaggaaccctcagg

SEQ ID NO: 3549155 - DNA, 22 bp, Homo sapiens
ccccacagaaccttcaacccag

SEQ ID NO: 3549156 - DNA, 17 bp, Homo sapiens
ccccaccactcaggcca

SEQ ID NO: 3549157 - DNA, 13 bp, Homo sapiens
ccccaccatctgc

SEQ ID NO: 3549158 - DNA, 19 bp, Homo sapiens
ccccacccctgggggctct

SEQ ID NO: 3549159 - DNA, 20 bp, Homo sapiens
ccccaccctggtgggccaac

SEQ ID NO: 3549160 - DNA, 20 bp, Homo sapiens
ccccacctcacagctactca

SEQ ID NO: 3549161 - DNA, 16 bp, Homo sapiens
ccccactcaggggacc

SEQ ID NO: 3549162 - DNA, 13 bp, Homo sapiens
ccccactccagct

SEQ ID NO: 3549163 - DNA, 15 bp, Homo sapiens
ccccactcccctcac

SEQ ID NO: 3549164 - DNA, 16 bp, Homo sapiens
ccccactcccctcaca

SEQ ID NO: 3549165 - DNA, 15 bp, Homo sapiens
ccccactgaccagaa

SEQ ID NO: 3549166 - DNA, 15 bp, Homo sapiens
ccccactgggagagc

SEQ ID NO: 3549167 - DNA, 14 bp, Homo sapiens
ccccagaaagcctc

SEQ ID NO: 3549168 - DNA, 16 bp, Homo sapiens
ccccagaaagcctcct

SEQ ID NO: 3549169 - DNA, 19 bp, Homo sapiens
ccccagaaagcctcctgcc

SEQ ID NO: 3549170 - DNA, 13 bp, Homo sapiens
ccccagacttctc

SEQ ID NO: 3549171 - DNA, 16 bp, Homo sapiens
ccccagagagaccctg

SEQ ID NO: 3549172 - DNA, 14 bp, Homo sapiens
ccccagaggccctg

SEQ ID NO: 3549173 - DNA, 18 bp, Homo sapiens
ccccagaggccctggagg

SEQ ID NO: 3549174 - DNA, 16 bp, Homo sapiens
ccccagccagcccttc

SEQ ID NO: 3549175 - DNA, 18 bp, Homo sapiens
ccccagccagcccttccc

SEQ ID NO: 3549176 - DNA, 23 bp, Homo sapiens
ccccagccagcccttccctggcc

SEQ ID NO: 3549177 - DNA, 16 bp, Homo sapiens
ccccagccagggctca

SEQ ID NO: 3549178 - DNA, 13 bp, Homo sapiens
ccccagcccagag

SEQ ID NO: 3549179 - DNA, 13 bp, Homo sapiens
ccccagccctggg

SEQ ID NO: 3549180 - DNA, 15 bp, Homo sapiens
ccccagcctccctga

SEQ ID NO: 3549181 - DNA, 17 bp, Homo sapiens
ccccagctaagaacctg

SEQ ID NO: 3549182 - DNA, 19 bp, Homo sapiens
ccccagctaagaacctgga

SEQ ID NO: 3549183 - DNA, 21 bp, Homo sapiens
ccccagctaagaacctggaac

SEQ ID NO: 3549184 - DNA, 22 bp, Homo sapiens
ccccagcttggctcacaaggcc

SEQ ID NO: 3549185 - DNA, 11 bp, Homo sapiens
ccccaggacca

SEQ ID NO: 3549186 - DNA, 16 bp, Homo sapiens
ccccaggaccagctca

SEQ ID NO: 3549187 - DNA, 18 bp, Homo sapiens
ccccaggaccagctcagg

SEQ ID NO: 3549188 - DNA, 21 bp, Homo sapiens
ccccaggaccagctcaggaca

SEQ ID NO: 3549189 - DNA, 12 bp, Homo sapiens
ccccaggaggcc

SEQ ID NO: 3549190 - DNA, 19 bp, Homo sapiens
ccccaggagggaggcaggg

SEQ ID NO: 3549191 - DNA, 16 bp, Homo sapiens
ccccagggcctgcgga

SEQ ID NO: 3549192 - DNA, 19 bp, Homo sapiens
ccccaggggaactggcagc

SEQ ID NO: 3549193 - DNA, 23 bp, Homo sapiens
ccccaggtgcagccccagggcct

SEQ ID NO: 3549194 - DNA, 19 bp, Homo sapiens
ccccagtgactccagggtg

SEQ ID NO: 3549195 - DNA, 20 bp, Homo sapiens
ccccagtgactccagggtga

SEQ ID NO: 3549196 - DNA, 22 bp, Homo sapiens
ccccagtgcggttcctcatctg

SEQ ID NO: 3549197 - DNA, 22 bp, Homo sapiens
ccccataattttttttttcctt

SEQ ID NO: 3549198 - DNA, 18 bp, Homo sapiens
ccccatatataaattatt

SEQ ID NO: 3549199 - DNA, 19 bp, Homo sapiens
ccccatccagacctggctc

SEQ ID NO: 3549200 - DNA, 14 bp, Homo sapiens
ccccatccctgctt

SEQ ID NO: 3549201 - DNA, 14 bp, Homo sapiens
ccccatcctcatcc

SEQ ID NO: 3549202 - DNA, 16 bp, Homo sapiens
ccccatcctcatccct

SEQ ID NO: 3549203 - DNA, 18 bp, Homo sapiens
ccccatcctcatccctga

SEQ ID NO: 3549204 - DNA, 12 bp, Homo sapiens
ccccatcctcca

SEQ ID NO: 3549205 - DNA, 19 bp, Homo sapiens
ccccatgctgccttcaggg

SEQ ID NO: 3549206 - DNA, 17 bp, Homo sapiens
ccccatggcagctcctg

SEQ ID NO: 3549207 - DNA, 20 bp, Homo sapiens
ccccatggcagctcctgacc

SEQ ID NO: 3549208 - DNA, 14 bp, Homo sapiens
ccccatgggcacag

SEQ ID NO: 3549209 - DNA, 14 bp, Homo sapiens
ccccatttcccgca

SEQ ID NO: 3549210 - DNA, 20 bp, Homo sapiens
cccccacaagctgtccctgc

SEQ ID NO: 3549211 - DNA, 21 bp, Homo sapiens
cccccacaagctgtccctgca

SEQ ID NO: 3549212 - DNA, 22 bp, Homo sapiens
cccccacaagctgtccctgcag

SEQ ID NO: 3549213 - DNA, 16 bp, Homo sapiens
cccccagaaagcctcc

SEQ ID NO: 3549214 - DNA, 21 bp, Homo sapiens
cccccagaaagcctcctgccc

SEQ ID NO: 3549215 - DNA, 20 bp, Homo sapiens
cccccagcaacgcccctcca

SEQ ID NO: 3549216 - DNA, 15 bp, Homo sapiens
cccccagggcctcca

SEQ ID NO: 3549217 - DNA, 16 bp, Homo sapiens
cccccagggcctccag

SEQ ID NO: 3549218 - DNA, 17 bp, Homo sapiens
cccccagggcctccagg

SEQ ID NO: 3549219 - DNA, 19 bp, Homo sapiens
cccccagggcctccagggc

SEQ ID NO: 3549220 - DNA, 15 bp, Homo sapiens
cccccatgctgcctt

SEQ ID NO: 3549221 - DNA, 18 bp, Homo sapiens
cccccatgggctgtgtcc

SEQ ID NO: 3549222 - DNA, 23 bp, Homo sapiens
cccccatgttgtaatgctgcact

SEQ ID NO: 3549223 - DNA, 13 bp, Homo sapiens
cccccattcccag

SEQ ID NO: 3549224 - DNA, 19 bp, Homo sapiens
cccccgtttctccttttcc

SEQ ID NO: 3549225 - DNA, 12 bp, Homo sapiens
ccccctcagcct

SEQ ID NO: 3549226 - DNA, 22 bp, Homo sapiens
ccccctctgccggtcgggcagc

SEQ ID NO: 3549227 - DNA, 12 bp, Homo sapiens
ccccctctgctg

SEQ ID NO: 3549228 - DNA, 22 bp, Homo sapiens
ccccctctggagaaggcctgga

SEQ ID NO: 3549229 - DNA, 19 bp, Homo sapiens
ccccctcttcttctgaaga

SEQ ID NO: 3549230 - DNA, 16 bp, Homo sapiens
ccccctgcagcccagg

SEQ ID NO: 3549231 - DNA, 20 bp, Homo sapiens
ccccctgctccaccagcagc

SEQ ID NO: 3549232 - DNA, 12 bp, Homo sapiens
cccccttcagga

SEQ ID NO: 3549233 - DNA, 16 bp, Homo sapiens
cccccttcaggagcct

SEQ ID NO: 3549234 - DNA, 12 bp, Homo sapiens
cccccttcccat

SEQ ID NO: 3549235 - DNA, 18 bp, Homo sapiens
ccccctttcacactggat

SEQ ID NO: 3549236 - DNA, 17 bp, Homo sapiens
ccccgagaaccctgagc

SEQ ID NO: 3549237 - DNA, 18 bp, Homo sapiens
ccccgagaagtgctcttg

SEQ ID NO: 3549238 - DNA, 14 bp, Homo sapiens
ccccgagtctccgg

SEQ ID NO: 3549239 - DNA, 23 bp, Homo sapiens
ccccgcagacggtctgtgtgctg

SEQ ID NO: 3549240 - DNA, 12 bp, Homo sapiens
ccccgccacagc

SEQ ID NO: 3549241 - DNA, 14 bp, Homo sapiens
ccccgccagggctg

SEQ ID NO: 3549242 - DNA, 15 bp, Homo sapiens
ccccgccccagagct

SEQ ID NO: 3549243 - DNA, 14 bp, Homo sapiens
ccccgcgcgcccac

SEQ ID NO: 3549244 - DNA, 21 bp, Homo sapiens
ccccgcgctcgcccagcagga

SEQ ID NO: 3549245 - DNA, 16 bp, Homo sapiens
ccccgtcacagcctca

SEQ ID NO: 3549246 - DNA, 17 bp, Homo sapiens
ccccgtctctgccctgg

SEQ ID NO: 3549247 - DNA, 14 bp, Homo sapiens
ccccgtctgtggct

SEQ ID NO: 3549248 - DNA, 20 bp, Homo sapiens
ccccgtttctccttttccta

SEQ ID NO: 3549249 - DNA, 15 bp, Homo sapiens
cccctaaaccccaag

SEQ ID NO: 3549250 - DNA, 18 bp, Homo sapiens
cccctaaagccaggctca

SEQ ID NO: 3549251 - DNA, 14 bp, Homo sapiens
cccctagccctggt

SEQ ID NO: 3549252 - DNA, 16 bp, Homo sapiens
cccctaggtgcccagg

SEQ ID NO: 3549253 - DNA, 20 bp, Homo sapiens
cccctcatctctctgcccaa

SEQ ID NO: 3549254 - DNA, 19 bp, Homo sapiens
cccctccaaacctccagcc

SEQ ID NO: 3549255 - DNA, 14 bp, Homo sapiens
cccctccaggagag

SEQ ID NO: 3549256 - DNA, 15 bp, Homo sapiens
cccctccatccaccc

SEQ ID NO: 3549257 - DNA, 14 bp, Homo sapiens
cccctccctctcca

SEQ ID NO: 3549258 - DNA, 14 bp, Homo sapiens
cccctccctgcctg

SEQ ID NO: 3549259 - DNA, 21 bp, Homo sapiens
cccctccttggctttatgcaa

SEQ ID NO: 3549260 - DNA, 15 bp, Homo sapiens
ctaagcaaccacact

SEQ ID NO: 3549261 - DNA, 12 bp, Homo sapiens
ctaagcagagga

SEQ ID NO: 3549262 - DNA, 13 bp, Homo sapiens
ctaagcagaggag

SEQ ID NO: 3549263 - DNA, 15 bp, Homo sapiens
ctaagcagaggaggg

SEQ ID NO: 3549264 - DNA, 22 bp, Homo sapiens
ctaagccagggcccctggatct

SEQ ID NO: 3549265 - DNA, 15 bp, Homo sapiens
ctaagcccccagggc

SEQ ID NO: 3549266 - DNA, 16 bp, Homo sapiens
ctaagcccccagggcc

SEQ ID NO: 3549267 - DNA, 17 bp, Homo sapiens
ctaagcccccagggcct

SEQ ID NO: 3549268 - DNA, 19 bp, Homo sapiens
ctaagcccccagggcctcc

SEQ ID NO: 3549269 - DNA, 17 bp, Homo sapiens
ctaagcctgaaggggcg

SEQ ID NO: 3549270 - DNA, 21 bp, Homo sapiens
ctaaggttgtctacgggggca

SEQ ID NO: 3549271 - DNA, 18 bp, Homo sapiens
ctaagtaaaaccacagca

SEQ ID NO: 3549272 - DNA, 22 bp, Homo sapiens
ctaagtaaaaccacagcagttg

SEQ ID NO: 3549273 - DNA, 17 bp, Homo sapiens
ctaagtaatttagaaga

SEQ ID NO: 3549274 - DNA, 19 bp, Homo sapiens
ctaagtacacaataagcaa

SEQ ID NO: 3549275 - DNA, 16 bp, Homo sapiens
ctaagtagaataaaga

SEQ ID NO: 3549276 - DNA, 17 bp, Homo sapiens
ctaagtcattggcaaag

SEQ ID NO: 3549277 - DNA, 18 bp, Homo sapiens
ctaagtcattggcaaagt

SEQ ID NO: 3549278 - DNA, 13 bp, Homo sapiens
ctaagtgatataa

SEQ ID NO: 3549279 - DNA, 14 bp, Homo sapiens
ctaagtgatataaa

SEQ ID NO: 3549280 - DNA, 14 bp, Homo sapiens
ctaagtggctgcct

SEQ ID NO: 3549281 - DNA, 17 bp, Homo sapiens
ctaagtggctgccttct

SEQ ID NO: 3549282 - DNA, 19 bp, Homo sapiens
ctaagtggctgccttcttt

SEQ ID NO: 3549283 - DNA, 14 bp, Homo sapiens
ctaagttattttat

SEQ ID NO: 3549284 - DNA, 17 bp, Homo sapiens
ctaagttattttatgac

SEQ ID NO: 3549285 - DNA, 23 bp, Homo sapiens
ctaagttattttatgacatgaaa

SEQ ID NO: 3549286 - DNA, 13 bp, Homo sapiens
ctaataaacactg

SEQ ID NO: 3549287 - DNA, 17 bp, Homo sapiens
ctaataacatgtgaaaa

SEQ ID NO: 3549288 - DNA, 20 bp, Homo sapiens
ctaatagaataaaggcagtt

SEQ ID NO: 3549289 - DNA, 21 bp, Homo sapiens
ctaatagaataaaggcagttt

SEQ ID NO: 3549290 - DNA, 23 bp, Homo sapiens
ctaatagaataaaggcagttttc

SEQ ID NO: 3549291 - DNA, 20 bp, Homo sapiens
ctaatatacttgtaaaacca

SEQ ID NO: 3549292 - DNA, 18 bp, Homo sapiens
ctaatattagttggcttt

SEQ ID NO: 3549293 - DNA, 22 bp, Homo sapiens
ctaatattagttggctttcata

SEQ ID NO: 3549294 - DNA, 20 bp, Homo sapiens
ctaatcagcattctcactcc

SEQ ID NO: 3549295 - DNA, 13 bp, Homo sapiens
ctaatccttttcc

SEQ ID NO: 3549296 - DNA, 15 bp, Homo sapiens
ctaatccttttcctt

SEQ ID NO: 3549297 - DNA, 22 bp, Homo sapiens
ctaatctgtgctgtttcaaagt

SEQ ID NO: 3549298 - DNA, 15 bp, Homo sapiens
ctaatgcttgattta

SEQ ID NO: 3549299 - DNA, 19 bp, Homo sapiens
ctaatgttattttccttct

SEQ ID NO: 3549300 - DNA, 13 bp, Homo sapiens
ctaattaaaaact

SEQ ID NO: 3549301 - DNA, 20 bp, Homo sapiens
ctaattaaaacactttcaaa

SEQ ID NO: 3549302 - DNA, 15 bp, Homo sapiens
ctaattcacagtgct

SEQ ID NO: 3549303 - DNA, 16 bp, Homo sapiens
ctaattcacagtgctc

SEQ ID NO: 3549304 - DNA, 22 bp, Homo sapiens
ctaattcacagtgctcttttct

SEQ ID NO: 3549305 - DNA, 22 bp, Homo sapiens
ctaattctttgacctgttggga

SEQ ID NO: 3549306 - DNA, 18 bp, Homo sapiens
ctaattggaaggagaggg

SEQ ID NO: 3549307 - DNA, 15 bp, Homo sapiens
ctaattttttatcct

SEQ ID NO: 3549308 - DNA, 18 bp, Homo sapiens
ctacaaaaacacagcaag

SEQ ID NO: 3549309 - DNA, 13 bp, Homo sapiens
ctacaaaacatta

SEQ ID NO: 3549310 - DNA, 13 bp, Homo sapiens
ctacaaatatagg

SEQ ID NO: 3549311 - DNA, 22 bp, Homo sapiens
ctacaacatcactaatttggct

SEQ ID NO: 3549312 - DNA, 17 bp, Homo sapiens
ctacaaccctaccctgg

SEQ ID NO: 3549313 - DNA, 18 bp, Homo sapiens
ctacaaccctaccctggc

SEQ ID NO: 3549314 - DNA, 15 bp, Homo sapiens
ctacaataaactggt

SEQ ID NO: 3549315 - DNA, 17 bp, Homo sapiens
ctacacatttttaaatt

SEQ ID NO: 3549316 - DNA, 15 bp, Homo sapiens
ctacacctttctcct

SEQ ID NO: 3549317 - DNA, 18 bp, Homo sapiens
ctacacctttctcctttg

SEQ ID NO: 3549318 - DNA, 13 bp, Homo sapiens
ctacactgatgca

SEQ ID NO: 3549319 - DNA, 21 bp, Homo sapiens
ctacagaaaccacagtcttcc

SEQ ID NO: 3549320 - DNA, 11 bp, Homo sapiens
ctacagacagc

SEQ ID NO: 3549321 - DNA, 22 bp, Homo sapiens
ctacagacatggaacagtgtaa

SEQ ID NO: 3549322 - DNA, 17 bp, Homo sapiens
ctacagactccatctct

SEQ ID NO: 3549323 - DNA, 18 bp, Homo sapiens
ctacagactccatctctt

SEQ ID NO: 3549324 - DNA, 22 bp, Homo sapiens
ctacagctaatcagcattctca

SEQ ID NO: 3549325 - DNA, 12 bp, Homo sapiens
ctacagtatata

SEQ ID NO: 3549326 - DNA, 19 bp, Homo sapiens
ctacagtgactccctggga

SEQ ID NO: 3549327 - DNA, 20 bp, Homo sapiens
ctacagtgactccctgggag

SEQ ID NO: 3549328 - DNA, 15 bp, Homo sapiens
ctacatgaaacagaa

SEQ ID NO: 3549329 - DNA, 16 bp, Homo sapiens
ctacatgaaacagaaa

SEQ ID NO: 3549330 - DNA, 17 bp, Homo sapiens
ctacatgatgctaaagg

SEQ ID NO: 3549331 - DNA, 13 bp, Homo sapiens
ctacatgtattgc

SEQ ID NO: 3549332 - DNA, 13 bp, Homo sapiens
ctaccaaaagaca

SEQ ID NO: 3549333 - DNA, 18 bp, Homo sapiens
ctaccaaaagacattaga

SEQ ID NO: 3549334 - DNA, 13 bp, Homo sapiens
ctaccaagctgtc

SEQ ID NO: 3549335 - DNA, 15 bp, Homo sapiens
ctaccaagctgtcac

SEQ ID NO: 3549336 - DNA, 18 bp, Homo sapiens
ctaccaagctgtcacagg

SEQ ID NO: 3549337 - DNA, 12 bp, Homo sapiens
ctaccagccagc

SEQ ID NO: 3549338 - DNA, 16 bp, Homo sapiens
ctaccagccagcctca

SEQ ID NO: 3549339 - DNA, 17 bp, Homo sapiens
ctaccagggtctctcag

SEQ ID NO: 3549340 - DNA, 21 bp, Homo sapiens
ctaccagggtctctcagggat

SEQ ID NO: 3549341 - DNA, 13 bp, Homo sapiens
ctacccatccccg

SEQ ID NO: 3549342 - DNA, 15 bp, Homo sapiens
ctacccatccccgca

SEQ ID NO: 3549343 - DNA, 12 bp, Homo sapiens
ctaccccagcca

SEQ ID NO: 3549344 - DNA, 14 bp, Homo sapiens
ctaccccagccagg

SEQ ID NO: 3549345 - DNA, 22 bp, Homo sapiens
ctacccctcaaactgcacatct

SEQ ID NO: 3549346 - DNA, 15 bp, Homo sapiens
ctaccctaaccaagt

SEQ ID NO: 3549347 - DNA, 15 bp, Homo sapiens
ctaccctcccaccag

SEQ ID NO: 3549348 - DNA, 12 bp, Homo sapiens
ctaccctggcag

SEQ ID NO: 3549349 - DNA, 13 bp, Homo sapiens
ctaccctggcagg

SEQ ID NO: 3549350 - DNA, 21 bp, Homo sapiens
ctaccctggcagggacctgag

SEQ ID NO: 3549351 - DNA, 17 bp, Homo sapiens
ctacccttggaaagaaa

SEQ ID NO: 3549352 - DNA, 19 bp, Homo sapiens
ctaccgagtctcttctcca

SEQ ID NO: 3549353 - DNA, 23 bp, Homo sapiens
ctaccgagtctcttctccactgg

SEQ ID NO: 3549354 - DNA, 16 bp, Homo sapiens
ctacctagtctccact

SEQ ID NO: 3549355 - DNA, 22 bp, Homo sapiens
ctacctatccttacatttcacc

SEQ ID NO: 3549356 - DNA, 15 bp, Homo sapiens
ctacctcacctgggc

SEQ ID NO: 3549357 - DNA, 20 bp, Homo sapiens
ctacctctgtctgagacagg

SEQ ID NO: 3549358 - DNA, 13 bp, Homo sapiens
ctacctctgtgcc

SEQ ID NO: 3549359 - DNA, 14 bp, Homo sapiens
ctacctgccttgga

SEQ ID NO: 3549360 - DNA, 18 bp, Homo sapiens
ctacctgtctgctgccag

SEQ ID NO: 3549361 - DNA, 23 bp, Homo sapiens
ctacctgtctgctgccagcacag

SEQ ID NO: 3549362 - DNA, 12 bp, Homo sapiens
ctacctgtgcct

SEQ ID NO: 3549363 - DNA, 15 bp, Homo sapiens
ctactaagttatttt

SEQ ID NO: 3549364 - DNA, 17 bp, Homo sapiens
ctactaagttattttat

SEQ ID NO: 3549365 - DNA, 18 bp, Homo sapiens
ctactaatagaataaagg

SEQ ID NO: 3549366 - DNA, 13 bp, Homo sapiens
ctactactgcagt

SEQ ID NO: 3549367 - DNA, 15 bp, Homo sapiens
ctactagtgtgactc

SEQ ID NO: 3549368 - DNA, 18 bp, Homo sapiens
ctactcagtggggctggc

SEQ ID NO: 3549369 - DNA, 21 bp, Homo sapiens
ctactcagtggggctggcatc

SEQ ID NO: 3549370 - DNA, 17 bp, Homo sapiens
ctactctcttatgcatt

SEQ ID NO: 3549371 - DNA, 14 bp, Homo sapiens
ctactctcttcctc

SEQ ID NO: 3549372 - DNA, 16 bp, Homo sapiens
ctactgacagggagca

SEQ ID NO: 3549373 - DNA, 13 bp, Homo sapiens
ctactgcagtctt

SEQ ID NO: 3549374 - DNA, 16 bp, Homo sapiens
ctactgcagtctttat

SEQ ID NO: 3549375 - DNA, 16 bp, Homo sapiens
ctactggttacctgga

SEQ ID NO: 3549376 - DNA, 17 bp, Homo sapiens
ctactggttacctggag

SEQ ID NO: 3549377 - DNA, 20 bp, Homo sapiens
ctactggttacctggagaag

SEQ ID NO: 3549378 - DNA, 19 bp, Homo sapiens
ctactgtaatgctgcctca

SEQ ID NO: 3549379 - DNA, 22 bp, Homo sapiens
ctactgtaatgctgcctcagga

SEQ ID NO: 3549380 - DNA, 14 bp, Homo sapiens
ctacttttctaaaa

SEQ ID NO: 3549381 - DNA, 19 bp, Homo sapiens
ctagaacacaggcaaaatc

SEQ ID NO: 3549382 - DNA, 22 bp, Homo sapiens
ctagaactcctgtcttctttct

SEQ ID NO: 3549383 - DNA, 15 bp, Homo sapiens
ctagaagattagaaa

SEQ ID NO: 3549384 - DNA, 22 bp, Homo sapiens
ctagaagattttgaaattttta

SEQ ID NO: 3549385 - DNA, 16 bp, Homo sapiens
ctagactgctcctggg

SEQ ID NO: 3549386 - DNA, 13 bp, Homo sapiens
ctagactggtgct

SEQ ID NO: 3549387 - DNA, 18 bp, Homo sapiens
ctagagaaatcagctgct

SEQ ID NO: 3549388 - DNA, 13 bp, Homo sapiens
ctagaggaggggg

SEQ ID NO: 3549389 - DNA, 15 bp, Homo sapiens
ctagagggacctctc

SEQ ID NO: 3549390 - DNA, 18 bp, Homo sapiens
ctagagggacctctccca

SEQ ID NO: 3549391 - DNA, 19 bp, Homo sapiens
ctagagggacctctcccag

SEQ ID NO: 3549392 - DNA, 20 bp, Homo sapiens
ctagagggacctctcccagg

SEQ ID NO: 3549393 - DNA, 23 bp, Homo sapiens
ctcaactccgtgcttaaccaaag

SEQ ID NO: 3549394 - DNA, 17 bp, Homo sapiens
ctcaagagggcactggt

SEQ ID NO: 3549395 - DNA, 21 bp, Homo sapiens
ctcaagtaaaacaaatgaaat

SEQ ID NO: 3549396 - DNA, 22 bp, Homo sapiens
ctcaagtaaaacaaatgaaatt

SEQ ID NO: 3549397 - DNA, 13 bp, Homo sapiens
ctcaagtaaaaga

SEQ ID NO: 3549398 - DNA, 20 bp, Homo sapiens
ctcaagttatttcatgcgca

SEQ ID NO: 3549399 - DNA, 12 bp, Homo sapiens
ctcaatattaaa

SEQ ID NO: 3549400 - DNA, 21 bp, Homo sapiens
ctcaatgcccagtaaaatttc

SEQ ID NO: 3549401 - DNA, 22 bp, Homo sapiens
ctcaatgcccagtaaaatttca

SEQ ID NO: 3549402 - DNA, 22 bp, Homo sapiens
ctcacaaaccatgcaaatgcta

SEQ ID NO: 3549403 - DNA, 19 bp, Homo sapiens
ctcacacacacccccccac

SEQ ID NO: 3549404 - DNA, 15 bp, Homo sapiens
ctcacacccctgtcc

SEQ ID NO: 3549405 - DNA, 17 bp, Homo sapiens
ctcaccagccccccgcg

SEQ ID NO: 3549406 - DNA, 20 bp, Homo sapiens
ctcaccagccccccgcgcgc

SEQ ID NO: 3549407 - DNA, 15 bp, Homo sapiens
ctcacccacctctgg

SEQ ID NO: 3549408 - DNA, 14 bp, Homo sapiens
ctcacccatcctag

SEQ ID NO: 3549409 - DNA, 14 bp, Homo sapiens
ctcacccccagctt

SEQ ID NO: 3549410 - DNA, 18 bp, Homo sapiens
ctcacccccagctttgct

SEQ ID NO: 3549411 - DNA, 20 bp, Homo sapiens
ctcacctctttgttcttcct

SEQ ID NO: 3549412 - DNA, 13 bp, Homo sapiens
ctcacctggactt

SEQ ID NO: 3549413 - DNA, 17 bp, Homo sapiens
ctcaccttggcaccaga

SEQ ID NO: 3549414 - DNA, 18 bp, Homo sapiens
ctcacgagatttgccagg

SEQ ID NO: 3549415 - DNA, 14 bp, Homo sapiens
ctcacgccttggcc

SEQ ID NO: 3549416 - DNA, 17 bp, Homo sapiens
ctcacgtaatgcattgc

SEQ ID NO: 3549417 - DNA, 21 bp, Homo sapiens
ctcacgtaatgcattgcctgt

SEQ ID NO: 3549418 - DNA, 22 bp, Homo sapiens
ctcactccccagggagctctgg

SEQ ID NO: 3549419 - DNA, 23 bp, Homo sapiens
ctcactccccagggagctctggg

SEQ ID NO: 3549420 - DNA, 15 bp, Homo sapiens
ctcactgaactccac

SEQ ID NO: 3549421 - DNA, 16 bp, Homo sapiens
ctcactgaactccacc

SEQ ID NO: 3549422 - DNA, 17 bp, Homo sapiens
ctcactgaactccaccg

SEQ ID NO: 3549423 - DNA, 16 bp, Homo sapiens
ctcactgcagcctcaa

SEQ ID NO: 3549424 - DNA, 22 bp, Homo sapiens
ctcactgccatggaattccctc

SEQ ID NO: 3549425 - DNA, 17 bp, Homo sapiens
ctcactggcaggtgtgg

SEQ ID NO: 3549426 - DNA, 13 bp, Homo sapiens
ctcactggcctgc

SEQ ID NO: 3549427 - DNA, 20 bp, Homo sapiens
ctcactggcctgccatgcca

SEQ ID NO: 3549428 - DNA, 18 bp, Homo sapiens
ctcagaaaattccctggg

SEQ ID NO: 3549429 - DNA, 15 bp, Homo sapiens
ctcagaaataaatca

SEQ ID NO: 3549430 - DNA, 17 bp, Homo sapiens
ctcagaaataaatcaca

SEQ ID NO: 3549431 - DNA, 15 bp, Homo sapiens
ctcagaaggccccag

SEQ ID NO: 3549432 - DNA, 16 bp, Homo sapiens
ctcagaaggccccaga

SEQ ID NO: 3549433 - DNA, 18 bp, Homo sapiens
ctcagaaggccccagaga

SEQ ID NO: 3549434 - DNA, 17 bp, Homo sapiens
ctcagacattggcacct

SEQ ID NO: 3549435 - DNA, 16 bp, Homo sapiens
ctcagaccccctcagc

SEQ ID NO: 3549436 - DNA, 16 bp, Homo sapiens
ctcagactgatttctt

SEQ ID NO: 3549437 - DNA, 17 bp, Homo sapiens
ctcagactgatttcttg

SEQ ID NO: 3549438 - DNA, 13 bp, Homo sapiens
ctcagactgggca

SEQ ID NO: 3549439 - DNA, 13 bp, Homo sapiens
ctcagagaggtag

SEQ ID NO: 3549440 - DNA, 23 bp, Homo sapiens
ctcagagaggtagcactctcaga

SEQ ID NO: 3549441 - DNA, 22 bp, Homo sapiens
ctcagaggcctgctgccagtgc

SEQ ID NO: 3549442 - DNA, 10 bp, Homo sapiens
ctcagatcca

SEQ ID NO: 3549443 - DNA, 14 bp, Homo sapiens
ctcagatccttggt

SEQ ID NO: 3549444 - DNA, 22 bp, Homo sapiens
ctcagattgtaatatgtaaatg

SEQ ID NO: 3549445 - DNA, 14 bp, Homo sapiens
ctcagcacccctcc

SEQ ID NO: 3549446 - DNA, 19 bp, Homo sapiens
ctcagcatttccttgtccc

SEQ ID NO: 3549447 - DNA, 15 bp, Homo sapiens
ctcagccagtgggga

SEQ ID NO: 3549448 - DNA, 19 bp, Homo sapiens
ctcagccctccctgcccct

SEQ ID NO: 3549449 - DNA, 20 bp, Homo sapiens
ctcagccctccctgcccctc

SEQ ID NO: 3549450 - DNA, 20 bp, Homo sapiens
ctcagccctgcaccatgctg

SEQ ID NO: 3549451 - DNA, 19 bp, Homo sapiens
ctcagccctggcctggctg

SEQ ID NO: 3549452 - DNA, 17 bp, Homo sapiens
ctcagcctcctcatctg

SEQ ID NO: 3549453 - DNA, 14 bp, Homo sapiens
ctcagcctcctggg

SEQ ID NO: 3549454 - DNA, 15 bp, Homo sapiens
ctcagcctcctgggt

SEQ ID NO: 3549455 - DNA, 14 bp, Homo sapiens
ctcagcctctgcca

SEQ ID NO: 3549456 - DNA, 15 bp, Homo sapiens
ctcagcctctgccag

SEQ ID NO: 3549457 - DNA, 20 bp, Homo sapiens
ctcagcctctgccagcgcca

SEQ ID NO: 3549458 - DNA, 14 bp, Homo sapiens
cgctcaatgcccag

SEQ ID NO: 3549459 - DNA, 21 bp, Homo sapiens
cgctcagccctccctgcccct

SEQ ID NO: 3549460 - DNA, 15 bp, Homo sapiens
cgctcaggggcctgg

SEQ ID NO: 3549461 - DNA, 21 bp, Homo sapiens
cgctcccaggttcccccagca

SEQ ID NO: 3549462 - DNA, 22 bp, Homo sapiens
cgctcccaggttcccccagcaa

SEQ ID NO: 3549463 - DNA, 23 bp, Homo sapiens
cgctcccaggttcccccagcaag

SEQ ID NO: 3549464 - DNA, 12 bp, Homo sapiens
cgctctctctga

SEQ ID NO: 3549465 - DNA, 19 bp, Homo sapiens
cgctctgttgcccaggctg

SEQ ID NO: 3549466 - DNA, 20 bp, Homo sapiens
cgctgccacccacctccctg

SEQ ID NO: 3549467 - DNA, 12 bp, Homo sapiens
cgctgctctgcc

SEQ ID NO: 3549468 - DNA, 18 bp, Homo sapiens
cgctggaatccagaagga

SEQ ID NO: 3549469 - DNA, 23 bp, Homo sapiens
cgctggactattgtgccaactgc

SEQ ID NO: 3549470 - DNA, 15 bp, Homo sapiens
cgctggccctgccgt

SEQ ID NO: 3549471 - DNA, 23 bp, Homo sapiens
cgctgtccctagtaaaaatacaa

SEQ ID NO: 3549472 - DNA, 17 bp, Homo sapiens
cgctgttgtcacatctc

SEQ ID NO: 3549473 - DNA, 21 bp, Homo sapiens
cgcttctgaagctgctgcagc

SEQ ID NO: 3549474 - DNA, 17 bp, Homo sapiens
cgctttgaaagaagcaa

SEQ ID NO: 3549475 - DNA, 20 bp, Homo sapiens
cggaaggaatgtcagggcca

SEQ ID NO: 3549476 - DNA, 22 bp, Homo sapiens
cggaaggaggccaaccagcccg

SEQ ID NO: 3549477 - DNA, 23 bp, Homo sapiens
cggaagggctttggttccttctc

SEQ ID NO: 3549478 - DNA, 19 bp, Homo sapiens
cggaattcaccagtgttcc

SEQ ID NO: 3549479 - DNA, 12 bp, Homo sapiens
cggaccatcttt

SEQ ID NO: 3549480 - DNA, 15 bp, Homo sapiens
cggactgcccccaga

SEQ ID NO: 3549481 - DNA, 18 bp, Homo sapiens
cggactgcccccagaaag

SEQ ID NO: 3549482 - DNA, 23 bp, Homo sapiens
cggagaagagctgttcacagcca

SEQ ID NO: 3549483 - DNA, 24 bp, Homo sapiens
cggagaagagctgttcacagccag

SEQ ID NO: 3549484 - DNA, 14 bp, Homo sapiens
cggagagcagcagc

SEQ ID NO: 3549485 - DNA, 19 bp, Homo sapiens
cggagcccagcctgggagc

SEQ ID NO: 3549486 - DNA, 16 bp, Homo sapiens
cggagcgccctgcagg
